United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 197

SEQ ID NO: 8191672 - DNA, 22 bp, Homo sapiens
ttcttttctgcagctggtattt

SEQ ID NO: 8191673 - DNA, 22 bp, Homo sapiens
ttcttttctgcagctggtattt

SEQ ID NO: 8191674 - DNA, 22 bp, Homo sapiens
ttcttttaattgtgggggagtg

SEQ ID NO: 8191675 - DNA, 22 bp, Homo sapiens
ttcttttaatgttctgaagttt

SEQ ID NO: 8191676 - DNA, 17 bp, Homo sapiens
ttcttttctgagccttg

SEQ ID NO: 8191677 - DNA, 22 bp, Homo sapiens
ttcttttcggcctgtgagaagg

SEQ ID NO: 8191678 - DNA, 22 bp, Homo sapiens
ttcttttaatgttctgaagttt

SEQ ID NO: 8191679 - DNA, 22 bp, Homo sapiens
ttcttttaatgttctgaagttt

SEQ ID NO: 8191680 - DNA, 22 bp, Homo sapiens
ttcttttaatgttctgaagttt

SEQ ID NO: 8191681 - DNA, 22 bp, Homo sapiens
ttgaagaaagtcatatataatg

SEQ ID NO: 8191682 - DNA, 22 bp, Homo sapiens
ttgaattgaaacataccctggt

SEQ ID NO: 8191683 - DNA, 21 bp, Homo sapiens
ttgaattgtatgattaaactg

SEQ ID NO: 8191684 - DNA, 19 bp, Homo sapiens
ttgaattgttttgagtagg

SEQ ID NO: 8191685 - DNA, 22 bp, Homo sapiens
ttgaattggcaaaactgcagct

SEQ ID NO: 8191686 - DNA, 22 bp, Homo sapiens
ttgaatttagattgtatgttga

SEQ ID NO: 8191687 - DNA, 22 bp, Homo sapiens
ttgaacattggcaatttcatat

SEQ ID NO: 8191688 - DNA, 22 bp, Homo sapiens
ttgaacattagaataagtaatt

SEQ ID NO: 8191689 - DNA, 22 bp, Homo sapiens
ttgaacattggcaatttcatat

SEQ ID NO: 8191690 - DNA, 22 bp, Homo sapiens
ttgaacattggcaatttcatat

SEQ ID NO: 8191691 - DNA, 22 bp, Homo sapiens
ttgaacattttctatgttatag

SEQ ID NO: 8191692 - DNA, 17 bp, Homo sapiens
ttgaactgctgagtcag

SEQ ID NO: 8191693 - DNA, 22 bp, Homo sapiens
ttgaactgtaagcatgtctgcc

SEQ ID NO: 8191694 - DNA, 22 bp, Homo sapiens
ttgaagaaagtcatatataatg

SEQ ID NO: 8191695 - DNA, 22 bp, Homo sapiens
ttgaactaataggtatcttgta

SEQ ID NO: 8191696 - DNA, 22 bp, Homo sapiens
ttgaacagtcctaagagaccct

SEQ ID NO: 8191697 - DNA, 22 bp, Homo sapiens
ttgaacataaatcactggtcag

SEQ ID NO: 8191698 - DNA, 22 bp, Homo sapiens
ttgaacattaacttcagtctat

SEQ ID NO: 8191699 - DNA, 19 bp, Homo sapiens
ttgaaattgtttgatatgg

SEQ ID NO: 8191700 - DNA, 22 bp, Homo sapiens
ttgaaatgtagtcctgccttca

SEQ ID NO: 8191701 - DNA, 22 bp, Homo sapiens
ttgaaatggcagcagctgacct

SEQ ID NO: 8191702 - DNA, 22 bp, Homo sapiens
ttgaaatccaattatcatatgt

SEQ ID NO: 8191703 - DNA, 22 bp, Homo sapiens
ttgaaatcaccactagcatttg

SEQ ID NO: 8191704 - DNA, 22 bp, Homo sapiens
ttgaaatatttgggagtgtttg

SEQ ID NO: 8191705 - DNA, 22 bp, Homo sapiens
ttgaaatatggattgaccttga

SEQ ID NO: 8191706 - DNA, 22 bp, Homo sapiens
ttgaaagggttaaagtggtaaa

SEQ ID NO: 8191707 - DNA, 22 bp, Homo sapiens
ttgaaagggatatatctttctg

SEQ ID NO: 8191708 - DNA, 22 bp, Homo sapiens
ttgaaatgagcaaactgtcagc

SEQ ID NO: 8191709 - DNA, 22 bp, Homo sapiens
ttgaaatgatctatttcagtag

SEQ ID NO: 8191710 - DNA, 22 bp, Homo sapiens
ttgaaatgagcaaactgtcagc

SEQ ID NO: 8191711 - DNA, 22 bp, Homo sapiens
ttgaaatggaagtgaaaattct

SEQ ID NO: 8191712 - DNA, 22 bp, Homo sapiens
ttgaaatggcagcagctgacct

SEQ ID NO: 8191713 - DNA, 22 bp, Homo sapiens
ttgaaatgcatcatcatttaga

SEQ ID NO: 8191714 - DNA, 22 bp, Homo sapiens
ttctttttaaagtgtgtatgca

SEQ ID NO: 8191715 - DNA, 22 bp, Homo sapiens
ttctttttaaagtgtgtatgca

SEQ ID NO: 8191716 - DNA, 22 bp, Homo sapiens
ttctttttaaagtgtgtatgca

SEQ ID NO: 8191717 - DNA, 22 bp, Homo sapiens
ttctttttaaagtgtgtatgca

SEQ ID NO: 8191718 - DNA, 22 bp, Homo sapiens
ttctttttaaagtgtgtatgca

SEQ ID NO: 8191719 - DNA, 22 bp, Homo sapiens
ttgaaaggcacaggcacctggg

SEQ ID NO: 8191720 - DNA, 22 bp, Homo sapiens
ttgaaaggaatacagaggccta

SEQ ID NO: 8191721 - DNA, 22 bp, Homo sapiens
ttgaaaggcctgtttatccagc

SEQ ID NO: 8191722 - DNA, 22 bp, Homo sapiens
ttcttttgcaagactattgatt

SEQ ID NO: 8191723 - DNA, 22 bp, Homo sapiens
ttcttttggactcaaagagaac

SEQ ID NO: 8191724 - DNA, 22 bp, Homo sapiens
ttcttttggactcaaagagaac

SEQ ID NO: 8191725 - DNA, 22 bp, Homo sapiens
ttcttttctttaggcattgtgt

SEQ ID NO: 8191726 - DNA, 22 bp, Homo sapiens
ttcttttcttggcaggagtaga

SEQ ID NO: 8191727 - DNA, 22 bp, Homo sapiens
ttcttttcttggcaggagtaga

SEQ ID NO: 8191728 - DNA, 22 bp, Homo sapiens
ttcttttctttaggcattgtgt

SEQ ID NO: 8191729 - DNA, 22 bp, Homo sapiens
ttctggaatcctcaaaacatga

SEQ ID NO: 8191730 - DNA, 22 bp, Homo sapiens
ttctggaattctggctatggta

SEQ ID NO: 8191731 - DNA, 22 bp, Homo sapiens
ttctggaatgcctgttctaatt

SEQ ID NO: 8191732 - DNA, 22 bp, Homo sapiens
ttctggaatgcctgttctaatt

SEQ ID NO: 8191733 - DNA, 22 bp, Homo sapiens
ttctggacacgtgactctcatt

SEQ ID NO: 8191734 - DNA, 22 bp, Homo sapiens
ttctggacttgccttgctgatg

SEQ ID NO: 8191735 - DNA, 22 bp, Homo sapiens
ttctggaattcttgcagccact

SEQ ID NO: 8191736 - DNA, 23 bp, Homo sapiens
ttctggacattgggcaatagcag

SEQ ID NO: 8191737 - DNA, 23 bp, Homo sapiens
ttctggacattgggcaatagcag

SEQ ID NO: 8191738 - DNA, 22 bp, Homo sapiens
ttctggagaataatcagcattg

SEQ ID NO: 8191739 - DNA, 22 bp, Homo sapiens
ttctggagaataatcagcattg

SEQ ID NO: 8191740 - DNA, 23 bp, Homo sapiens
ttctggagaaaggaccatagctt

SEQ ID NO: 8191741 - DNA, 23 bp, Homo sapiens
ttctggagaaaggaccatagctt

SEQ ID NO: 8191742 - DNA, 22 bp, Homo sapiens
ttctggagagaagaccagtgtg

SEQ ID NO: 8191743 - DNA, 22 bp, Homo sapiens
ttctggagaatcaccaccaggc

SEQ ID NO: 8191744 - DNA, 22 bp, Homo sapiens
ttctggagccccaagatctgta

SEQ ID NO: 8191745 - DNA, 22 bp, Homo sapiens
ttctggagccgggcctgggcag

SEQ ID NO: 8191746 - DNA, 22 bp, Homo sapiens
ttctggagccgggcctgggcag

SEQ ID NO: 8191747 - DNA, 22 bp, Homo sapiens
ttctggagctctcgaccccact

SEQ ID NO: 8191748 - DNA, 22 bp, Homo sapiens
ttctggttttactgaggaaatc

SEQ ID NO: 8191749 - DNA, 22 bp, Homo sapiens
ttctggagctaaagtccactct

SEQ ID NO: 8191750 - DNA, 22 bp, Homo sapiens
ttctgtaagctaccaagtttgt

SEQ ID NO: 8191751 - DNA, 22 bp, Homo sapiens
ttctggagatctgcctatggga

SEQ ID NO: 8191752 - DNA, 22 bp, Homo sapiens
ttctggagatagtcaggcatta

SEQ ID NO: 8191753 - DNA, 22 bp, Homo sapiens
ttctggagatgacttttagaaa

SEQ ID NO: 8191754 - DNA, 22 bp, Homo sapiens
ttctggagatctgcctatggga

SEQ ID NO: 8191755 - DNA, 22 bp, Homo sapiens
ttctggagattgagaaggcatt

SEQ ID NO: 8191756 - DNA, 22 bp, Homo sapiens
ttctggaagtggaatttttgta

SEQ ID NO: 8191757 - DNA, 22 bp, Homo sapiens
ttctggaagtgttagaatctgg

SEQ ID NO: 8191758 - DNA, 22 bp, Homo sapiens
ttctggaagttggaaatagcag

SEQ ID NO: 8191759 - DNA, 22 bp, Homo sapiens
ttctggaatactaagttccttt

SEQ ID NO: 8191760 - DNA, 22 bp, Homo sapiens
ttctggaatatttgacacaatt

SEQ ID NO: 8191761 - DNA, 22 bp, Homo sapiens
ttctggaagttggaaatagcag

SEQ ID NO: 8191762 - DNA, 22 bp, Homo sapiens
ttctggaagttttctcctgtgg

SEQ ID NO: 8191763 - DNA, 22 bp, Homo sapiens
ttctggaaatgaatgctaggaa

SEQ ID NO: 8191764 - DNA, 22 bp, Homo sapiens
ttctggaaatgcacaactaatt

SEQ ID NO: 8191765 - DNA, 18 bp, Homo sapiens
ttctctggtggatgttat

SEQ ID NO: 8191766 - DNA, 21 bp, Homo sapiens
ttctctggtcaagcacacata

SEQ ID NO: 8191767 - DNA, 22 bp, Homo sapiens
ttctggaaatgggtatagagca

SEQ ID NO: 8191768 - DNA, 22 bp, Homo sapiens
ttctggaaatgggtatagagca

SEQ ID NO: 8191769 - DNA, 22 bp, Homo sapiens
ttctggaaatgttgctgaggcc

SEQ ID NO: 8191770 - DNA, 22 bp, Homo sapiens
ttctggaacatagcaagaagtt

SEQ ID NO: 8191771 - DNA, 22 bp, Homo sapiens
ttctctggggactgtctctatt

SEQ ID NO: 8191772 - DNA, 22 bp, Homo sapiens
ttctctggggacttggttggag

SEQ ID NO: 8191773 - DNA, 22 bp, Homo sapiens
ttctctggggttcagtatctct

SEQ ID NO: 8191774 - DNA, 16 bp, Homo sapiens
ttctctggggttgtgc

SEQ ID NO: 8191775 - DNA, 22 bp, Homo sapiens
ttctctgggttaggggaactat

SEQ ID NO: 8191776 - DNA, 22 bp, Homo sapiens
ttctctgggacaggaacagttt

SEQ ID NO: 8191777 - DNA, 22 bp, Homo sapiens
ttctctgggatctggcaaaagg

SEQ ID NO: 8191778 - DNA, 22 bp, Homo sapiens
ttctctggacagtgaagagagg

SEQ ID NO: 8191779 - DNA, 22 bp, Homo sapiens
ttctctggacagtgaagagagg

SEQ ID NO: 8191780 - DNA, 19 bp, Homo sapiens
ttctctggactagatgctg

SEQ ID NO: 8191781 - DNA, 22 bp, Homo sapiens
ttctgtgtgtctcagcaagctg

SEQ ID NO: 8191782 - DNA, 22 bp, Homo sapiens
ttctgtgttgtgacattctaga

SEQ ID NO: 8191783 - DNA, 22 bp, Homo sapiens
ttctgtgttgtgacattctaga

SEQ ID NO: 8191784 - DNA, 22 bp, Homo sapiens
ttcttacattactttacatgtg

SEQ ID NO: 8191785 - DNA, 22 bp, Homo sapiens
ttcttacattactttacatgtg

SEQ ID NO: 8191786 - DNA, 22 bp, Homo sapiens
ttctgttacaagtgaaaaaatg

SEQ ID NO: 8191787 - DNA, 22 bp, Homo sapiens
ttcttacattactttacatgtg

SEQ ID NO: 8191788 - DNA, 22 bp, Homo sapiens
ttcttactacatttgcaggcta

SEQ ID NO: 8191789 - DNA, 22 bp, Homo sapiens
ttctgtgtgggtagctcctgtt

SEQ ID NO: 8191790 - DNA, 22 bp, Homo sapiens
ttctgtgtgggtagctcctgtt

SEQ ID NO: 8191791 - DNA, 19 bp, Homo sapiens
ttctgtgttaattccttta

SEQ ID NO: 8191792 - DNA, 22 bp, Homo sapiens
ttctgtgtgctgtcttggcttt

SEQ ID NO: 8191793 - DNA, 22 bp, Homo sapiens
ttctgtgtgggtagctcctgtt

SEQ ID NO: 8191794 - DNA, 22 bp, Homo sapiens
ttctgtgtgctgtcttggcttt

SEQ ID NO: 8191795 - DNA, 22 bp, Homo sapiens
ttcttagttcaactaaaattta

SEQ ID NO: 8191796 - DNA, 22 bp, Homo sapiens
ttcttataagataggcctcagg

SEQ ID NO: 8191797 - DNA, 22 bp, Homo sapiens
ttcttataagttaatatttcca

SEQ ID NO: 8191798 - DNA, 22 bp, Homo sapiens
ttcttataagttaatatttcca

SEQ ID NO: 8191799 - DNA, 22 bp, Homo sapiens
ttcttataagttaatatttcca

SEQ ID NO: 8191800 - DNA, 22 bp, Homo sapiens
ttcttatgttcacataattcca

SEQ ID NO: 8191801 - DNA, 22 bp, Homo sapiens
ttcttatattgggtcatggata

SEQ ID NO: 8191802 - DNA, 22 bp, Homo sapiens
ttcttactatgatttgagcctc

SEQ ID NO: 8191803 - DNA, 22 bp, Homo sapiens
ttcttagagatggttaaaaata

SEQ ID NO: 8191804 - DNA, 22 bp, Homo sapiens
ttcttagtagcatagctatatt

SEQ ID NO: 8191805 - DNA, 19 bp, Homo sapiens
ttcttagtctcatgcatga

SEQ ID NO: 8191806 - DNA, 22 bp, Homo sapiens
ttcttagtggtagtcatctttg

SEQ ID NO: 8191807 - DNA, 22 bp, Homo sapiens
ttctgtgtcttcttgttctgtg

SEQ ID NO: 8191808 - DNA, 22 bp, Homo sapiens
ttctgtgtcttcttgttctgtg

SEQ ID NO: 8191809 - DNA, 22 bp, Homo sapiens
ttctgtgtgccagagttgtgct

SEQ ID NO: 8191810 - DNA, 22 bp, Homo sapiens
ttctgtggaggtttggaacatt

SEQ ID NO: 8191811 - DNA, 22 bp, Homo sapiens
ttctgtggctgggagcctggct

SEQ ID NO: 8191812 - DNA, 22 bp, Homo sapiens
ttctgtggtctcccatgtctgt

SEQ ID NO: 8191813 - DNA, 22 bp, Homo sapiens
ttctgtggtctcccatgtctgt

SEQ ID NO: 8191814 - DNA, 22 bp, Homo sapiens
ttctgtgggtaatacctcatac

SEQ ID NO: 8191815 - DNA, 22 bp, Homo sapiens
ttctgtgaatggccatgacaag

SEQ ID NO: 8191816 - DNA, 22 bp, Homo sapiens
ttctgtgcccattttaaaatgg

SEQ ID NO: 8191817 - DNA, 22 bp, Homo sapiens
ttctgtgcgtaggcgatgcagt

SEQ ID NO: 8191818 - DNA, 22 bp, Homo sapiens
ttctgtggaatatgaactagca

SEQ ID NO: 8191819 - DNA, 19 bp, Homo sapiens
ttctgtaaggacattaatc

SEQ ID NO: 8191820 - DNA, 22 bp, Homo sapiens
ttctgtacccaacatttttact

SEQ ID NO: 8191821 - DNA, 22 bp, Homo sapiens
ttctgtctctgtgtttacatta

SEQ ID NO: 8191822 - DNA, 22 bp, Homo sapiens
ttctgtcttctcggttgtttac

SEQ ID NO: 8191823 - DNA, 23 bp, Homo sapiens
ttctgtcttgctgtcagctttct

SEQ ID NO: 8191824 - DNA, 23 bp, Homo sapiens
ttctgtcttgctgtcagctttct

SEQ ID NO: 8191825 - DNA, 22 bp, Homo sapiens
ttctgtctgtaaacttctcaat

SEQ ID NO: 8191826 - DNA, 22 bp, Homo sapiens
ttctgtctgtaaacttctcaat

SEQ ID NO: 8191827 - DNA, 22 bp, Homo sapiens
ttctgtctgtaaacttctcaat

SEQ ID NO: 8191828 - DNA, 22 bp, Homo sapiens
ttcctggcacccttgttagcct

SEQ ID NO: 8191829 - DNA, 22 bp, Homo sapiens
ttcctggcactgcagtggttga

SEQ ID NO: 8191830 - DNA, 22 bp, Homo sapiens
ttcctggcagaggccccgacag

SEQ ID NO: 8191831 - DNA, 23 bp, Homo sapiens
ttcctggcaggtacaacttttac

SEQ ID NO: 8191832 - DNA, 22 bp, Homo sapiens
ttcctggcatagagagggcaca

SEQ ID NO: 8191833 - DNA, 22 bp, Homo sapiens
ttcctggcatagagagggcaca

SEQ ID NO: 8191834 - DNA, 22 bp, Homo sapiens
ttcctggcatgaaaaatatcac

SEQ ID NO: 8191835 - DNA, 22 bp, Homo sapiens
ttcctggcattatgggaggctg

SEQ ID NO: 8191836 - DNA, 22 bp, Homo sapiens
ttcctggcattatgggaggctg

SEQ ID NO: 8191837 - DNA, 22 bp, Homo sapiens
ttcctggccccacccctggaga

SEQ ID NO: 8191838 - DNA, 22 bp, Homo sapiens
ttcctggccccatccatcttca

SEQ ID NO: 8191839 - DNA, 22 bp, Homo sapiens
ttcctggccccatccatcttca

SEQ ID NO: 8191840 - DNA, 22 bp, Homo sapiens
ttcctggccaagcagagtggaa

SEQ ID NO: 8191841 - DNA, 22 bp, Homo sapiens
ttcctggcattatgggaggctg

SEQ ID NO: 8191842 - DNA, 22 bp, Homo sapiens
ttcctggccaagcagagtggaa

SEQ ID NO: 8191843 - DNA, 22 bp, Homo sapiens
ttcctggccagctgtggtgagt

SEQ ID NO: 8191844 - DNA, 22 bp, Homo sapiens
ttcctggccaagcagagtggaa

SEQ ID NO: 8191845 - DNA, 21 bp, Homo sapiens
ttcctggggacttccgtggga

SEQ ID NO: 8191846 - DNA, 22 bp, Homo sapiens
ttcctggctcacagcagtgggg

SEQ ID NO: 8191847 - DNA, 22 bp, Homo sapiens
ttcctggctcacagcagtgggg

SEQ ID NO: 8191848 - DNA, 21 bp, Homo sapiens
ttcctggcggcagaaacgtga

SEQ ID NO: 8191849 - DNA, 22 bp, Homo sapiens
ttcctggggcgactgtatctga

SEQ ID NO: 8191850 - DNA, 21 bp, Homo sapiens
ttcctggggacttccgtggga

SEQ ID NO: 8191851 - DNA, 22 bp, Homo sapiens
ttcctggcctcttccaccacca

SEQ ID NO: 8191852 - DNA, 22 bp, Homo sapiens
ttcctggcgccacggagccggt

SEQ ID NO: 8191853 - DNA, 22 bp, Homo sapiens
ttcctggcctcttccaccacca

SEQ ID NO: 8191854 - DNA, 22 bp, Homo sapiens
ttcctggcctaaggtaggtgac

SEQ ID NO: 8191855 - DNA, 22 bp, Homo sapiens
ttcctggcctctctctgagcag

SEQ ID NO: 8191856 - DNA, 22 bp, Homo sapiens
ttcctggcctctctctgagcag

SEQ ID NO: 8191857 - DNA, 22 bp, Homo sapiens
ttcctgccctgcctgtgccact

SEQ ID NO: 8191858 - DNA, 22 bp, Homo sapiens
ttcctgccctgcctgtgccact

SEQ ID NO: 8191859 - DNA, 22 bp, Homo sapiens
ttcctgcctacatgccttatgc

SEQ ID NO: 8191860 - DNA, 22 bp, Homo sapiens
ttcctgcccctgagagctccca

SEQ ID NO: 8191861 - DNA, 22 bp, Homo sapiens
ttcctgcaggccccagttcaca

SEQ ID NO: 8191862 - DNA, 22 bp, Homo sapiens
ttcctgcccctgagagctccca

SEQ ID NO: 8191863 - DNA, 22 bp, Homo sapiens
ttcctgctccatttgctgagct

SEQ ID NO: 8191864 - DNA, 22 bp, Homo sapiens
ttcctgctccatttgctgagct

SEQ ID NO: 8191865 - DNA, 22 bp, Homo sapiens
ttcctggaaattatgctcacct

SEQ ID NO: 8191866 - DNA, 22 bp, Homo sapiens
ttcctgcttcctggcctcacaa

SEQ ID NO: 8191867 - DNA, 17 bp, Homo sapiens
ttcctggaagtcattcc

SEQ ID NO: 8191868 - DNA, 22 bp, Homo sapiens
ttcctggaaattatgctcacct

SEQ ID NO: 8191869 - DNA, 17 bp, Homo sapiens
ttcctggaagtcattcc

SEQ ID NO: 8191870 - DNA, 17 bp, Homo sapiens
ttcctggaagtcattcc

SEQ ID NO: 8191871 - DNA, 22 bp, Homo sapiens
ttcctggagagttttcccaaag

SEQ ID NO: 8191872 - DNA, 21 bp, Homo sapiens
ttcctggaggcagaaacgtga

SEQ ID NO: 8191873 - DNA, 21 bp, Homo sapiens
ttcctggaggcagaaacgtga

SEQ ID NO: 8191874 - DNA, 21 bp, Homo sapiens
ttcctggaggcagaaacgtga

SEQ ID NO: 8191875 - DNA, 22 bp, Homo sapiens
ttcctggcaaagtgagcatcac

SEQ ID NO: 8191876 - DNA, 21 bp, Homo sapiens
ttcctggaggcagaaacgtga

SEQ ID NO: 8191877 - DNA, 22 bp, Homo sapiens
ttcctggcaaagtgagcatcac

SEQ ID NO: 8191878 - DNA, 22 bp, Homo sapiens
ttcctggcacactcctgaatgt

SEQ ID NO: 8191879 - DNA, 22 bp, Homo sapiens
ttcctggcacatagttagtgct

SEQ ID NO: 8191880 - DNA, 22 bp, Homo sapiens
ttcctggcaccaccacttctag

SEQ ID NO: 8191881 - DNA, 22 bp, Homo sapiens
ttcctggcaccaccacttctag

SEQ ID NO: 8191882 - DNA, 22 bp, Homo sapiens
ttcctggcaccctggacccggc

SEQ ID NO: 8191883 - DNA, 22 bp, Homo sapiens
ttcctggcaccctggacccggc

SEQ ID NO: 8191884 - DNA, 22 bp, Homo sapiens
ttccagttggtagaatgtaagg

SEQ ID NO: 8191885 - DNA, 22 bp, Homo sapiens
ttccagttggcactgcaattta

SEQ ID NO: 8191886 - DNA, 22 bp, Homo sapiens
ttccagttcttctgtaagcact

SEQ ID NO: 8191887 - DNA, 22 bp, Homo sapiens
ttccagttctatgaattcaaga

SEQ ID NO: 8191888 - DNA, 19 bp, Homo sapiens
ttccagttctaatctcttc

SEQ ID NO: 8191889 - DNA, 17 bp, Homo sapiens
ttccagtttagtattgt

SEQ ID NO: 8191890 - DNA, 17 bp, Homo sapiens
ttccagtttagtattgt

SEQ ID NO: 8191891 - DNA, 17 bp, Homo sapiens
ttccagtttagtattgt

SEQ ID NO: 8191892 - DNA, 22 bp, Homo sapiens
ttcctgaattgagctttagaaa

SEQ ID NO: 8191893 - DNA, 22 bp, Homo sapiens
ttcctgaatgctgttgtgctgt

SEQ ID NO: 8191894 - DNA, 22 bp, Homo sapiens
ttcctgaatcccaaggagagct

SEQ ID NO: 8191895 - DNA, 22 bp, Homo sapiens
ttcctgaatgctgttgtgctgt

SEQ ID NO: 8191896 - DNA, 22 bp, Homo sapiens
ttcctgagaaatttgtacctgg

SEQ ID NO: 8191897 - DNA, 22 bp, Homo sapiens
ttcctgagaccctcacagtgat

SEQ ID NO: 8191898 - DNA, 22 bp, Homo sapiens
ttcctgagtcccgggtaaagat

SEQ ID NO: 8191899 - DNA, 22 bp, Homo sapiens
ttcctgagggccccagaggagg

SEQ ID NO: 8191900 - DNA, 22 bp, Homo sapiens
ttcctgaggaggaccaggacca

SEQ ID NO: 8191901 - DNA, 22 bp, Homo sapiens
ttcctgaggaggaccaggacca

SEQ ID NO: 8191902 - DNA, 22 bp, Homo sapiens
ttcctgagggacttttgagatt

SEQ ID NO: 8191903 - DNA, 22 bp, Homo sapiens
ttcctgcaaaactactagtagc

SEQ ID NO: 8191904 - DNA, 20 bp, Homo sapiens
ttcctgattgtcatttctgc

SEQ ID NO: 8191905 - DNA, 22 bp, Homo sapiens
ttcctgcagcaaggagaagctg

SEQ ID NO: 8191906 - DNA, 22 bp, Homo sapiens
ttcctgcacagcccttcctgag

SEQ ID NO: 8191907 - DNA, 22 bp, Homo sapiens
ttcctgatgcacacagtcattt

SEQ ID NO: 8191908 - DNA, 22 bp, Homo sapiens
ttcctgagtcgccgagtctatg

SEQ ID NO: 8191909 - DNA, 22 bp, Homo sapiens
ttccttcttcctttagtaacca

SEQ ID NO: 8191910 - DNA, 22 bp, Homo sapiens
ttccttcttccagaggctgccc

SEQ ID NO: 8191911 - DNA, 22 bp, Homo sapiens
ttccttcttccagaggctgccc

SEQ ID NO: 8191912 - DNA, 22 bp, Homo sapiens
ttccttcttccagaggctgccc

SEQ ID NO: 8191913 - DNA, 22 bp, Homo sapiens
ttccttcttgtaatgatctgcc

SEQ ID NO: 8191914 - DNA, 22 bp, Homo sapiens
ttccttcttcctttagtaacca

SEQ ID NO: 8191915 - DNA, 22 bp, Homo sapiens
ttccttcttcctttagtaacca

SEQ ID NO: 8191916 - DNA, 22 bp, Homo sapiens
ttccttcttgtaatgatctgcc

SEQ ID NO: 8191917 - DNA, 22 bp, Homo sapiens
ttccttcttgtaatgatctgcc

SEQ ID NO: 8191918 - DNA, 22 bp, Homo sapiens
ttccttcttccaaacccatcat

SEQ ID NO: 8191919 - DNA, 22 bp, Homo sapiens
ttccttcttccaaacccatcat

SEQ ID NO: 8191920 - DNA, 22 bp, Homo sapiens
ttccttcttccagaggctgccc

SEQ ID NO: 8191921 - DNA, 22 bp, Homo sapiens
ttccttcttccaaacccatcat

SEQ ID NO: 8191922 - DNA, 22 bp, Homo sapiens
ttccttcttccaaacccatcat

SEQ ID NO: 8191923 - DNA, 22 bp, Homo sapiens
ttccttcttccaaacccatcat

SEQ ID NO: 8191924 - DNA, 22 bp, Homo sapiens
ttccttcttcattgtgttacag

SEQ ID NO: 8191925 - DNA, 22 bp, Homo sapiens
ttccttcttcattgtgttacag

SEQ ID NO: 8191926 - DNA, 22 bp, Homo sapiens
ttccttcttcattgtgttacag

SEQ ID NO: 8191927 - DNA, 22 bp, Homo sapiens
ttccttctggaggctccagggg

SEQ ID NO: 8191928 - DNA, 22 bp, Homo sapiens
ttccttctggagcccggggagc

SEQ ID NO: 8191929 - DNA, 22 bp, Homo sapiens
ttccttctggaggctccagggg

SEQ ID NO: 8191930 - DNA, 22 bp, Homo sapiens
ttccttctggaggctccagggg

SEQ ID NO: 8191931 - DNA, 22 bp, Homo sapiens
ttccttctggaggctccagggg

SEQ ID NO: 8191932 - DNA, 22 bp, Homo sapiens
ttccttctggaggctccagggg

SEQ ID NO: 8191933 - DNA, 18 bp, Homo sapiens
ttccttctgatgtatatg

SEQ ID NO: 8191934 - DNA, 18 bp, Homo sapiens
ttccttctgatgtatatg

SEQ ID NO: 8191935 - DNA, 22 bp, Homo sapiens
ttccttctggaagcttcagggg

SEQ ID NO: 8191936 - DNA, 22 bp, Homo sapiens
ttccttctggaagcttcagggg

SEQ ID NO: 8191937 - DNA, 22 bp, Homo sapiens
ttccttctggaagcttcagggg

SEQ ID NO: 8191938 - DNA, 22 bp, Homo sapiens
ttccttctggagcccggggagc

SEQ ID NO: 8191939 - DNA, 22 bp, Homo sapiens
ttccttctggaagcttcagggg

SEQ ID NO: 8191940 - DNA, 22 bp, Homo sapiens
ttccttctggagcccggggagc

SEQ ID NO: 8191941 - DNA, 22 bp, Homo sapiens
ttccttggccacactggtgctt

SEQ ID NO: 8191942 - DNA, 22 bp, Homo sapiens
ttccttgcctcggggtaccttg

SEQ ID NO: 8191943 - DNA, 22 bp, Homo sapiens
ttccttcttttacaccataaat

SEQ ID NO: 8191944 - DNA, 22 bp, Homo sapiens
ttccttgaccactgcataatga

SEQ ID NO: 8191945 - DNA, 22 bp, Homo sapiens
ttccttgaatgagtcatggaaa

SEQ ID NO: 8191946 - DNA, 22 bp, Homo sapiens
ttccttgaaagtttgaactgac

SEQ ID NO: 8191947 - DNA, 22 bp, Homo sapiens
ttccttctttgtggtagaaagt

SEQ ID NO: 8191948 - DNA, 22 bp, Homo sapiens
ttccttctttgtggtagaaagt

SEQ ID NO: 8191949 - DNA, 22 bp, Homo sapiens
ttccttcttttacaccataaat

SEQ ID NO: 8191950 - DNA, 22 bp, Homo sapiens
ttccttctttgtggtagaaagt

SEQ ID NO: 8191951 - DNA, 22 bp, Homo sapiens
ttccttcttttacaccataaat

SEQ ID NO: 8191952 - DNA, 22 bp, Homo sapiens
ttcctggtgacctcactggtag

SEQ ID NO: 8191953 - DNA, 22 bp, Homo sapiens
ttcctggtgagatttcgttctg

SEQ ID NO: 8191954 - DNA, 22 bp, Homo sapiens
ttcctggtcccgttcttcactg

SEQ ID NO: 8191955 - DNA, 22 bp, Homo sapiens
ttcctggtctgtgccattcaga

SEQ ID NO: 8191956 - DNA, 22 bp, Homo sapiens
ttcctggtcactgctgttccct

SEQ ID NO: 8191957 - DNA, 22 bp, Homo sapiens
ttcctggtagtaagacatctgg

SEQ ID NO: 8191958 - DNA, 22 bp, Homo sapiens
ttcctggggggatagatttcac

SEQ ID NO: 8191959 - DNA, 22 bp, Homo sapiens
ttcctggggtactggagaaaat

SEQ ID NO: 8191960 - DNA, 22 bp, Homo sapiens
ttcctggggggatagatttcac

SEQ ID NO: 8191961 - DNA, 22 bp, Homo sapiens
ttcctggggtactggagaaaat

SEQ ID NO: 8191962 - DNA, 22 bp, Homo sapiens
ttcctggggtgaagatattttt

SEQ ID NO: 8191963 - DNA, 22 bp, Homo sapiens
ttcctggggtgaagatattttt

SEQ ID NO: 8191964 - DNA, 22 bp, Homo sapiens
ttcctgggggcagcagtcttga

SEQ ID NO: 8191965 - DNA, 22 bp, Homo sapiens
ttcctgggggcagcagtcttga

SEQ ID NO: 8191966 - DNA, 22 bp, Homo sapiens
ttcctggggctccagctaccag

SEQ ID NO: 8191967 - DNA, 22 bp, Homo sapiens
ttcctggggcttagcaatggag

SEQ ID NO: 8191968 - DNA, 22 bp, Homo sapiens
ttcctggggcttagcaatggag

SEQ ID NO: 8191969 - DNA, 22 bp, Homo sapiens
ttcctgggttccctctcattct

SEQ ID NO: 8191970 - DNA, 22 bp, Homo sapiens
ttcctgggttccctctcattct

SEQ ID NO: 8191971 - DNA, 22 bp, Homo sapiens
ttcctgggttccctctcattct

SEQ ID NO: 8191972 - DNA, 22 bp, Homo sapiens
ttcctgggttgtgcattgtaca

SEQ ID NO: 8191973 - DNA, 22 bp, Homo sapiens
ttcctgggtttacgtattgggt

SEQ ID NO: 8191974 - DNA, 22 bp, Homo sapiens
ttcctgggtttacgtattgggt

SEQ ID NO: 8191975 - DNA, 22 bp, Homo sapiens
ttcctgggttgtgcattgtaca

SEQ ID NO: 8191976 - DNA, 22 bp, Homo sapiens
ttcctgggttgtgcattgtaca

SEQ ID NO: 8191977 - DNA, 22 bp, Homo sapiens
ttcctgggttgtgcattgtaca

SEQ ID NO: 8191978 - DNA, 19 bp, Homo sapiens
ttcctggggttccattgtg

SEQ ID NO: 8191979 - DNA, 19 bp, Homo sapiens
ttcctggggttccattgtg

SEQ ID NO: 8191980 - DNA, 19 bp, Homo sapiens
ttcctggggttccattgtg

SEQ ID NO: 8191981 - DNA, 22 bp, Homo sapiens
ttcctgggtggtcctggtagag

SEQ ID NO: 8191982 - DNA, 22 bp, Homo sapiens
ttcctgggtggtcctggtagag

SEQ ID NO: 8191983 - DNA, 22 bp, Homo sapiens
ttctctgcagcttaggcccagt

SEQ ID NO: 8191984 - DNA, 22 bp, Homo sapiens
ttctctgatcttgctagactga

SEQ ID NO: 8191985 - DNA, 22 bp, Homo sapiens
ttctctgatcttgctagactga

SEQ ID NO: 8191986 - DNA, 22 bp, Homo sapiens
ttctctgagatagactaagtgg

SEQ ID NO: 8191987 - DNA, 17 bp, Homo sapiens
ttctctgagctgtattg

SEQ ID NO: 8191988 - DNA, 22 bp, Homo sapiens
ttctctgagtacgtttcagtgt

SEQ ID NO: 8191989 - DNA, 22 bp, Homo sapiens
ttctctgagtacgtttcagtgt

SEQ ID NO: 8191990 - DNA, 22 bp, Homo sapiens
ttctctgagatagactaagtgg

SEQ ID NO: 8191991 - DNA, 22 bp, Homo sapiens
ttctctgacccccttaaatatt

SEQ ID NO: 8191992 - DNA, 22 bp, Homo sapiens
ttctctgagatagactaagtgg

SEQ ID NO: 8191993 - DNA, 19 bp, Homo sapiens
ttctctgctacattctcag

SEQ ID NO: 8191994 - DNA, 22 bp, Homo sapiens
ttctctggaaggctctacggga

SEQ ID NO: 8191995 - DNA, 22 bp, Homo sapiens
ttctctggaactgaaacaagat

SEQ ID NO: 8191996 - DNA, 22 bp, Homo sapiens
ttctctggaactgaaacaagat

SEQ ID NO: 8191997 - DNA, 22 bp, Homo sapiens
ttctctggaactgaaacaagat

SEQ ID NO: 8191998 - DNA, 22 bp, Homo sapiens
ttctctcttccagttcccactt

SEQ ID NO: 8191999 - DNA, 22 bp, Homo sapiens
ttctctcttttgggtaggaggt

SEQ ID NO: 8192000 - DNA, 22 bp, Homo sapiens
ttctctcttccagttcccactt

SEQ ID NO: 8192001 - DNA, 22 bp, Homo sapiens
ttctctgaaggccatgctcact

SEQ ID NO: 8192002 - DNA, 22 bp, Homo sapiens
ttctctgaaggccatgctcact

SEQ ID NO: 8192003 - DNA, 22 bp, Homo sapiens
ttctctgaaggttgtggaacta

SEQ ID NO: 8192004 - DNA, 22 bp, Homo sapiens
ttctctgaaggttgtggaacta

SEQ ID NO: 8192005 - DNA, 22 bp, Homo sapiens
ttctctgaaggccatgctcact

SEQ ID NO: 8192006 - DNA, 22 bp, Homo sapiens
ttctctgaaggccatgctcact

SEQ ID NO: 8192007 - DNA, 22 bp, Homo sapiens
ttctctctgtgtcattatggac

SEQ ID NO: 8192008 - DNA, 22 bp, Homo sapiens
ttctctctgtggtcccattttg

SEQ ID NO: 8192009 - DNA, 22 bp, Homo sapiens
ttctctctgtggtcccattttg

SEQ ID NO: 8192010 - DNA, 22 bp, Homo sapiens
ttctctctggacctgggatgcg

SEQ ID NO: 8192011 - DNA, 22 bp, Homo sapiens
ttctctctggacctgggatgcg

SEQ ID NO: 8192012 - DNA, 22 bp, Homo sapiens
ttctctcttactgccatgctgt

SEQ ID NO: 8192013 - DNA, 22 bp, Homo sapiens
ttctctctgttatggattttac

SEQ ID NO: 8192014 - DNA, 22 bp, Homo sapiens
ttctctctgttatggattttac

SEQ ID NO: 8192015 - DNA, 22 bp, Homo sapiens
ttctctcttactgccatgctgt

SEQ ID NO: 8192016 - DNA, 22 bp, Homo sapiens
ttctctaatggtgatgattaga

SEQ ID NO: 8192017 - DNA, 22 bp, Homo sapiens
ttctctaagagttatatgaatt

SEQ ID NO: 8192018 - DNA, 22 bp, Homo sapiens
ttctctaaggtcccgttctgga

SEQ ID NO: 8192019 - DNA, 23 bp, Homo sapiens
ttctctagatgaggtgaagatgg

SEQ ID NO: 8192020 - DNA, 20 bp, Homo sapiens
ttctctagccttcccctggg

SEQ ID NO: 8192021 - DNA, 20 bp, Homo sapiens
ttctctagccttcccctggg

SEQ ID NO: 8192022 - DNA, 22 bp, Homo sapiens
ttctctaggagttctgggatca

SEQ ID NO: 8192023 - DNA, 22 bp, Homo sapiens
ttctctaggactttggagtcct

SEQ ID NO: 8192024 - DNA, 22 bp, Homo sapiens
ttctctatcttgaatgcgtcaa

SEQ ID NO: 8192025 - DNA, 22 bp, Homo sapiens
ttctctatcttgaatgcgtcaa

SEQ ID NO: 8192026 - DNA, 22 bp, Homo sapiens
ttctctattacagaaatggaat

SEQ ID NO: 8192027 - DNA, 22 bp, Homo sapiens
ttctctccagtcctggattctg

SEQ ID NO: 8192028 - DNA, 22 bp, Homo sapiens
ttctctcattcaaattaaagtg

SEQ ID NO: 8192029 - DNA, 22 bp, Homo sapiens
ttctctcattcaaattaaagtg

SEQ ID NO: 8192030 - DNA, 22 bp, Homo sapiens
ttctctcagttaaactttgtga

SEQ ID NO: 8192031 - DNA, 22 bp, Homo sapiens
ttctctcagttaaactttgtga

SEQ ID NO: 8192032 - DNA, 22 bp, Homo sapiens
ttctctctgagagcatctggaa

SEQ ID NO: 8192033 - DNA, 22 bp, Homo sapiens
ttctctctgagagcatctggaa

SEQ ID NO: 8192034 - DNA, 22 bp, Homo sapiens
ttctctctgagagcatctggaa

SEQ ID NO: 8192035 - DNA, 22 bp, Homo sapiens
ttctctcccatgaagcttctat

SEQ ID NO: 8192036 - DNA, 22 bp, Homo sapiens
ttctctcctacccagtatccat

SEQ ID NO: 8192037 - DNA, 22 bp, Homo sapiens
ttctctcctacccagtatccat

SEQ ID NO: 8192038 - DNA, 22 bp, Homo sapiens
ttctctaagagttatatgaatt

SEQ ID NO: 8192039 - DNA, 22 bp, Homo sapiens
ttctcctgagttcccaggtcta

SEQ ID NO: 8192040 - DNA, 23 bp, Homo sapiens
ttctcctgaggaagcagggactg

SEQ ID NO: 8192041 - DNA, 22 bp, Homo sapiens
ttctcctctgttggccttccct

SEQ ID NO: 8192042 - DNA, 22 bp, Homo sapiens
ttctccagaggtggctagagtt

SEQ ID NO: 8192043 - DNA, 22 bp, Homo sapiens
ttctcctctgttggccttccct

SEQ ID NO: 8192044 - DNA, 22 bp, Homo sapiens
ttctcctctgttggccttccct

SEQ ID NO: 8192045 - DNA, 22 bp, Homo sapiens
ttctccagagggctctgcagga

SEQ ID NO: 8192046 - DNA, 22 bp, Homo sapiens
ttctccagaccctcctgcagac

SEQ ID NO: 8192047 - DNA, 22 bp, Homo sapiens
ttctccagaccctcctgcagac

SEQ ID NO: 8192048 - DNA, 22 bp, Homo sapiens
ttctccagagggctctgcagga

SEQ ID NO: 8192049 - DNA, 22 bp, Homo sapiens
ttctccagaccttgtgactatg

SEQ ID NO: 8192050 - DNA, 22 bp, Homo sapiens
ttctccagaccttgtgactatg

SEQ ID NO: 8192051 - DNA, 22 bp, Homo sapiens
ttctccagacaggcagagggaa

SEQ ID NO: 8192052 - DNA, 22 bp, Homo sapiens
ttctccagaccctcctgcagac

SEQ ID NO: 8192053 - DNA, 22 bp, Homo sapiens
ttctccaagatgaagctgtgta

SEQ ID NO: 8192054 - DNA, 22 bp, Homo sapiens
ttctcaggtagtgctgatgctg

SEQ ID NO: 8192055 - DNA, 22 bp, Homo sapiens
ttctcagggtttgtgcaggctt

SEQ ID NO: 8192056 - DNA, 22 bp, Homo sapiens
ttctcagggtttgtgcaggctt

SEQ ID NO: 8192057 - DNA, 22 bp, Homo sapiens
ttctcagggtttgtgcaggctt

SEQ ID NO: 8192058 - DNA, 22 bp, Homo sapiens
ttctccagacacaaaatctaag

SEQ ID NO: 8192059 - DNA, 22 bp, Homo sapiens
ttctccacccactcttttgttg

SEQ ID NO: 8192060 - DNA, 18 bp, Homo sapiens
ttctccagaaaacatagc

SEQ ID NO: 8192061 - DNA, 22 bp, Homo sapiens
ttctcaggaactcagtgtcagc

SEQ ID NO: 8192062 - DNA, 22 bp, Homo sapiens
ttctcaggactcctgcctgctt

SEQ ID NO: 8192063 - DNA, 22 bp, Homo sapiens
ttctcaggactcctgcctgctt

SEQ ID NO: 8192064 - DNA, 22 bp, Homo sapiens
ttctcaggcacttcttccccgc

SEQ ID NO: 8192065 - DNA, 22 bp, Homo sapiens
ttctcagatgattcagataaac

SEQ ID NO: 8192066 - DNA, 22 bp, Homo sapiens
ttctcagatgattcagataaac

SEQ ID NO: 8192067 - DNA, 22 bp, Homo sapiens
ttctcagatgattcagataaac

SEQ ID NO: 8192068 - DNA, 21 bp, Homo sapiens
ttctcagatcgagtagtgaga

SEQ ID NO: 8192069 - DNA, 22 bp, Homo sapiens
ttctcagattccccttttaata

SEQ ID NO: 8192070 - DNA, 22 bp, Homo sapiens
ttctcagggtctggatggcctg

SEQ ID NO: 8192071 - DNA, 22 bp, Homo sapiens
ttctcagggtctggatggcctg

SEQ ID NO: 8192072 - DNA, 22 bp, Homo sapiens
ttctcaggcctttgggatggga

SEQ ID NO: 8192073 - DNA, 22 bp, Homo sapiens
ttctcaggcctttgggatggga

SEQ ID NO: 8192074 - DNA, 22 bp, Homo sapiens
ttctcaggctctgagaccctat

SEQ ID NO: 8192075 - DNA, 22 bp, Homo sapiens
ttccttgggttctgatgtgttt

SEQ ID NO: 8192076 - DNA, 22 bp, Homo sapiens
ttccttggtacagagtagcttt

SEQ ID NO: 8192077 - DNA, 22 bp, Homo sapiens
ttccttgtaagacctatttttg

SEQ ID NO: 8192078 - DNA, 22 bp, Homo sapiens
ttctcagatccatcagaagtcc

SEQ ID NO: 8192079 - DNA, 22 bp, Homo sapiens
ttctcagatccatcagaagtcc

SEQ ID NO: 8192080 - DNA, 21 bp, Homo sapiens
ttctcagatcgagtagtgaga

SEQ ID NO: 8192081 - DNA, 22 bp, Homo sapiens
ttctcagatccatcagaagtcc

SEQ ID NO: 8192082 - DNA, 22 bp, Homo sapiens
ttctcagatccatcagaagtcc

SEQ ID NO: 8192083 - DNA, 21 bp, Homo sapiens
ttctcagatcgagtagtgaga

SEQ ID NO: 8192084 - DNA, 21 bp, Homo sapiens
ttctcagatcgagtagtgaga

SEQ ID NO: 8192085 - DNA, 22 bp, Homo sapiens
tttgtaaagtctgttctgagtt

SEQ ID NO: 8192086 - DNA, 22 bp, Homo sapiens
tttgtaaaggcctgaatttcag

SEQ ID NO: 8192087 - DNA, 22 bp, Homo sapiens
tttgtaaatagcagtactcatg

SEQ ID NO: 8192088 - DNA, 22 bp, Homo sapiens
tttgtaaaaggaggaagcatgg

SEQ ID NO: 8192089 - DNA, 22 bp, Homo sapiens
tttgtaaaaggaggaagcatgg

SEQ ID NO: 8192090 - DNA, 22 bp, Homo sapiens
tttgtaaaaggaggaagcatgg

SEQ ID NO: 8192091 - DNA, 22 bp, Homo sapiens
tttgtaaaaggaggaagcatgg

SEQ ID NO: 8192092 - DNA, 22 bp, Homo sapiens
tttgtaaaattagggaattcaa

SEQ ID NO: 8192093 - DNA, 22 bp, Homo sapiens
tttgtaaaggcctgaatttcag

SEQ ID NO: 8192094 - DNA, 22 bp, Homo sapiens
tttgtaaaattagggaattcaa

SEQ ID NO: 8192095 - DNA, 22 bp, Homo sapiens
tttgtgtgtatatccttccaga

SEQ ID NO: 8192096 - DNA, 22 bp, Homo sapiens
tttgtaagagcatatgtaaagg

SEQ ID NO: 8192097 - DNA, 22 bp, Homo sapiens
tttgtgtcgtcactgtcttctc

SEQ ID NO: 8192098 - DNA, 22 bp, Homo sapiens
tttgtaaggaatattcttggtg

SEQ ID NO: 8192099 - DNA, 22 bp, Homo sapiens
tttgttaaggagtattgcttct

SEQ ID NO: 8192100 - DNA, 22 bp, Homo sapiens
tttgttaaggagtattgcttct

SEQ ID NO: 8192101 - DNA, 22 bp, Homo sapiens
tttgttaaggagtattgcttct

SEQ ID NO: 8192102 - DNA, 22 bp, Homo sapiens
tttgttactatagcatagagtg

SEQ ID NO: 8192103 - DNA, 22 bp, Homo sapiens
tttgttacattaaaaagtaggt

SEQ ID NO: 8192104 - DNA, 22 bp, Homo sapiens
tttgttacattaaaaagtaggt

SEQ ID NO: 8192105 - DNA, 22 bp, Homo sapiens
tttgttacaaagaaagaagagc

SEQ ID NO: 8192106 - DNA, 22 bp, Homo sapiens
tttgttacaaagaaagaagagc

SEQ ID NO: 8192107 - DNA, 22 bp, Homo sapiens
tttgttcaaaaattataagata

SEQ ID NO: 8192108 - DNA, 22 bp, Homo sapiens
tttgttataacaataaaaagtc

SEQ ID NO: 8192109 - DNA, 22 bp, Homo sapiens
tttgttcaaacagaccctttgt

SEQ ID NO: 8192110 - DNA, 22 bp, Homo sapiens
tttgttcaaaaattataagata

SEQ ID NO: 8192111 - DNA, 22 bp, Homo sapiens
tttgttcaaattttcctatctg

SEQ ID NO: 8192112 - DNA, 22 bp, Homo sapiens
tttgttcaacaggtgaaataga

SEQ ID NO: 8192113 - DNA, 22 bp, Homo sapiens
tttgttcaacaggtgaaataga

SEQ ID NO: 8192114 - DNA, 22 bp, Homo sapiens
tttgttcaacaggtgaaataga

SEQ ID NO: 8192115 - DNA, 22 bp, Homo sapiens
tttgttcaaggaatagtaaatg

SEQ ID NO: 8192116 - DNA, 22 bp, Homo sapiens
tttgttcaaggaatagtaaatg

SEQ ID NO: 8192117 - DNA, 22 bp, Homo sapiens
tttgttcaacatcacttccacc

SEQ ID NO: 8192118 - DNA, 22 bp, Homo sapiens
tttgttaaaatgcagattctgt

SEQ ID NO: 8192119 - DNA, 22 bp, Homo sapiens
tttgttaaaatgcagattctgt

SEQ ID NO: 8192120 - DNA, 22 bp, Homo sapiens
tttgttaaatatttattgagtg

SEQ ID NO: 8192121 - DNA, 22 bp, Homo sapiens
tttgttaaaatgcagattctgt

SEQ ID NO: 8192122 - DNA, 22 bp, Homo sapiens
tttgttaaaatgcagattctgt

SEQ ID NO: 8192123 - DNA, 22 bp, Homo sapiens
tttgtgttttcccatactattg

SEQ ID NO: 8192124 - DNA, 22 bp, Homo sapiens
tttgtgttggaagaaatgctac

SEQ ID NO: 8192125 - DNA, 22 bp, Homo sapiens
tttgtgttgtacttctgtgcat

SEQ ID NO: 8192126 - DNA, 22 bp, Homo sapiens
tttgtgtttatgaagttattct

SEQ ID NO: 8192127 - DNA, 22 bp, Homo sapiens
ttttaagaaatgtatgactgtc

SEQ ID NO: 8192128 - DNA, 22 bp, Homo sapiens
ttttaacttaaaatacatagat

SEQ ID NO: 8192129 - DNA, 22 bp, Homo sapiens
ttttaacttaaaatacatagat

SEQ ID NO: 8192130 - DNA, 22 bp, Homo sapiens
ttttaacttaaaatacatagat

SEQ ID NO: 8192131 - DNA, 21 bp, Homo sapiens
ttttaacaaggatttccctag

SEQ ID NO: 8192132 - DNA, 22 bp, Homo sapiens
ttttaaaggctgtatgaccaag

SEQ ID NO: 8192133 - DNA, 22 bp, Homo sapiens
ttttaaaggctgtatgaccaag

SEQ ID NO: 8192134 - DNA, 21 bp, Homo sapiens
ttttaacaaggatttccctag

SEQ ID NO: 8192135 - DNA, 22 bp, Homo sapiens
ttttaaatctccagttgacccc

SEQ ID NO: 8192136 - DNA, 22 bp, Homo sapiens
ttttaaatctccagttgacccc

SEQ ID NO: 8192137 - DNA, 22 bp, Homo sapiens
ttttaaatctccagttgacccc

SEQ ID NO: 8192138 - DNA, 22 bp, Homo sapiens
ttttaaatctccagttgacccc

SEQ ID NO: 8192139 - DNA, 22 bp, Homo sapiens
ttttaaaggatagctctggttg

SEQ ID NO: 8192140 - DNA, 22 bp, Homo sapiens
ttttaaagagatgctgtgcata

SEQ ID NO: 8192141 - DNA, 22 bp, Homo sapiens
ttttaaaggatactcttgtcta

SEQ ID NO: 8192142 - DNA, 22 bp, Homo sapiens
tttgttcaatccagacaatagc

SEQ ID NO: 8192143 - DNA, 22 bp, Homo sapiens
tttgttcaatccagacaatagc

SEQ ID NO: 8192144 - DNA, 22 bp, Homo sapiens
tttgttcaatatgtgtttgtcc

SEQ ID NO: 8192145 - DNA, 22 bp, Homo sapiens
tttgttcacagggttgttgtag

SEQ ID NO: 8192146 - DNA, 21 bp, Homo sapiens
tttgttcacacacagggcagc

SEQ ID NO: 8192147 - DNA, 22 bp, Homo sapiens
ttttaatgggcgactattatgg

SEQ ID NO: 8192148 - DNA, 22 bp, Homo sapiens
ttttaatgggcgactattatgg

SEQ ID NO: 8192149 - DNA, 22 bp, Homo sapiens
ttttaagaaatgtatgactgtc

SEQ ID NO: 8192150 - DNA, 22 bp, Homo sapiens
ttttaatgtgctctgcaatgat

SEQ ID NO: 8192151 - DNA, 22 bp, Homo sapiens
ttttaattgcaattatggtccc

SEQ ID NO: 8192152 - DNA, 22 bp, Homo sapiens
ttttaattcaaagtgaatagtg

SEQ ID NO: 8192153 - DNA, 22 bp, Homo sapiens
ttttaattcaaagtgaatagtg

SEQ ID NO: 8192154 - DNA, 22 bp, Homo sapiens
ttttatgtgctggactggcagt

SEQ ID NO: 8192155 - DNA, 22 bp, Homo sapiens
ttttatgtgtcaaagcagtggt

SEQ ID NO: 8192156 - DNA, 22 bp, Homo sapiens
ttttatgtgctggactggcagt

SEQ ID NO: 8192157 - DNA, 18 bp, Homo sapiens
ttttaatttcaggggtgg

SEQ ID NO: 8192158 - DNA, 22 bp, Homo sapiens
ttttatgagaatgcgccacttg

SEQ ID NO: 8192159 - DNA, 22 bp, Homo sapiens
ttttaattgcaattatggtccc

SEQ ID NO: 8192160 - DNA, 21 bp, Homo sapiens
ttttatgcataggaaatatat

SEQ ID NO: 8192161 - DNA, 22 bp, Homo sapiens
ttttatgcaagttatgattaaa

SEQ ID NO: 8192162 - DNA, 22 bp, Homo sapiens
ttttatgattgagctggctaca

SEQ ID NO: 8192163 - DNA, 22 bp, Homo sapiens
ttttatgagtgtccctctgtgg

SEQ ID NO: 8192164 - DNA, 22 bp, Homo sapiens
ttttcagttttccaggtagccg

SEQ ID NO: 8192165 - DNA, 22 bp, Homo sapiens
ttttcatagtaatggtgcatgt

SEQ ID NO: 8192166 - DNA, 22 bp, Homo sapiens
ttttcatctctgctttgtacct

SEQ ID NO: 8192167 - DNA, 22 bp, Homo sapiens
ttttcatgaggaaatactgccc

SEQ ID NO: 8192168 - DNA, 22 bp, Homo sapiens
ttttcatgtcatgtccttgagg

SEQ ID NO: 8192169 - DNA, 22 bp, Homo sapiens
ttttcatgtgatgtgacatttc

SEQ ID NO: 8192170 - DNA, 22 bp, Homo sapiens
ttttattggagtgataccaagc

SEQ ID NO: 8192171 - DNA, 22 bp, Homo sapiens
ttttattggagtgataccaagc

SEQ ID NO: 8192172 - DNA, 22 bp, Homo sapiens
ttttcacacaaggtgataagtt

SEQ ID NO: 8192173 - DNA, 22 bp, Homo sapiens
ttttcacacaaggtgataagtt

SEQ ID NO: 8192174 - DNA, 19 bp, Homo sapiens
ttttcacatactggatcct

SEQ ID NO: 8192175 - DNA, 19 bp, Homo sapiens
ttttcacatactggatcct

SEQ ID NO: 8192176 - DNA, 22 bp, Homo sapiens
ttttcagtttgcactgcagtgc

SEQ ID NO: 8192177 - DNA, 22 bp, Homo sapiens
ttttcagtttgcactgcagtgc

SEQ ID NO: 8192178 - DNA, 22 bp, Homo sapiens
ttttcacattgtcccagcacta

SEQ ID NO: 8192179 - DNA, 22 bp, Homo sapiens
ttttcacattgtcccagcacta

SEQ ID NO: 8192180 - DNA, 22 bp, Homo sapiens
ttttcattgttcctcgagcatt

SEQ ID NO: 8192181 - DNA, 22 bp, Homo sapiens
ttttcattagaatgactgagaa

SEQ ID NO: 8192182 - DNA, 22 bp, Homo sapiens
ttttcatgttccttgttaagtg

SEQ ID NO: 8192183 - DNA, 22 bp, Homo sapiens
ttttcatgttccttgttaagtg

SEQ ID NO: 8192184 - DNA, 22 bp, Homo sapiens
ttttcattgtaaatcaggaaac

SEQ ID NO: 8192185 - DNA, 22 bp, Homo sapiens
ttttatgttcctctttatgcga

SEQ ID NO: 8192186 - DNA, 22 bp, Homo sapiens
ttttatgttcctgaagctatct

SEQ ID NO: 8192187 - DNA, 22 bp, Homo sapiens
ttttatgttgctataataggta

SEQ ID NO: 8192188 - DNA, 22 bp, Homo sapiens
ttttattagtggctagatgggg

SEQ ID NO: 8192189 - DNA, 22 bp, Homo sapiens
ttttattagtggctagatgggg

SEQ ID NO: 8192190 - DNA, 22 bp, Homo sapiens
ttttattagtggctagatgggg

SEQ ID NO: 8192191 - DNA, 22 bp, Homo sapiens
ttttattagtggctagatgggg

SEQ ID NO: 8192192 - DNA, 22 bp, Homo sapiens
ttttattagtggctagatgggg

SEQ ID NO: 8192193 - DNA, 22 bp, Homo sapiens
ttttattggagtgataccaagc

SEQ ID NO: 8192194 - DNA, 22 bp, Homo sapiens
ttttattggagtgataccaagc

SEQ ID NO: 8192195 - DNA, 22 bp, Homo sapiens
ttttattggagtgataccaagc

SEQ ID NO: 8192196 - DNA, 22 bp, Homo sapiens
ttttattggagtgataccaagc

SEQ ID NO: 8192197 - DNA, 22 bp, Homo sapiens
ttttattggagtgataccaagc

SEQ ID NO: 8192198 - DNA, 22 bp, Homo sapiens
ttttattggagtgataccaagc

SEQ ID NO: 8192199 - DNA, 22 bp, Homo sapiens
ttttattgcaataaagtgtgta

SEQ ID NO: 8192200 - DNA, 22 bp, Homo sapiens
ttttattgcaataaagtgtgta

SEQ ID NO: 8192201 - DNA, 22 bp, Homo sapiens
ttttattgcaataaagtgtgta

SEQ ID NO: 8192202 - DNA, 22 bp, Homo sapiens
ttttattgcaataaagtgtgta

SEQ ID NO: 8192203 - DNA, 22 bp, Homo sapiens
ttttattgcaataaagtgtgta

SEQ ID NO: 8192204 - DNA, 22 bp, Homo sapiens
ttttattgcaataaagtgtgta

SEQ ID NO: 8192205 - DNA, 22 bp, Homo sapiens
ttttattatctttgaatgggac

SEQ ID NO: 8192206 - DNA, 22 bp, Homo sapiens
ttttattatctttgaatgggac

SEQ ID NO: 8192207 - DNA, 21 bp, Homo sapiens
ttttattgatgaatggccact

SEQ ID NO: 8192208 - DNA, 21 bp, Homo sapiens
ttttattgatgaatggccact

SEQ ID NO: 8192209 - DNA, 20 bp, Homo sapiens
ttttctgtgccaagaaaact

SEQ ID NO: 8192210 - DNA, 22 bp, Homo sapiens
ttttctgtgattctgaggttgg

SEQ ID NO: 8192211 - DNA, 22 bp, Homo sapiens
ttttctgtgattctgaggttgg

SEQ ID NO: 8192212 - DNA, 22 bp, Homo sapiens
ttttctgtgccctgctagctgg

SEQ ID NO: 8192213 - DNA, 22 bp, Homo sapiens
ttttctgtgtatccaggcttcc

SEQ ID NO: 8192214 - DNA, 22 bp, Homo sapiens
ttttctgactctattgaggtat

SEQ ID NO: 8192215 - DNA, 22 bp, Homo sapiens
ttttctgactctattgaggtat

SEQ ID NO: 8192216 - DNA, 22 bp, Homo sapiens
ttttctgacctatctacattta

SEQ ID NO: 8192217 - DNA, 22 bp, Homo sapiens
ttttctgcctgcgtgtttagga

SEQ ID NO: 8192218 - DNA, 22 bp, Homo sapiens
ttttctgcctgcgtgtttagga

SEQ ID NO: 8192219 - DNA, 22 bp, Homo sapiens
ttttctgtattattgtgcttca

SEQ ID NO: 8192220 - DNA, 22 bp, Homo sapiens
ttttctggtcacatgttattaa

SEQ ID NO: 8192221 - DNA, 22 bp, Homo sapiens
ttttcttactgtctgtgatcct

SEQ ID NO: 8192222 - DNA, 22 bp, Homo sapiens
ttttcttactgtctgtgatcct

SEQ ID NO: 8192223 - DNA, 22 bp, Homo sapiens
ttttcttaggtgctccaagtag

SEQ ID NO: 8192224 - DNA, 22 bp, Homo sapiens
ttttcttatagagcttaaagtt

SEQ ID NO: 8192225 - DNA, 22 bp, Homo sapiens
ttttcttatgtgcagctatatg

SEQ ID NO: 8192226 - DNA, 22 bp, Homo sapiens
ttttcttatgtgcagctatatg

SEQ ID NO: 8192227 - DNA, 22 bp, Homo sapiens
ttttcttatagagcttaaagtt

SEQ ID NO: 8192228 - DNA, 22 bp, Homo sapiens
ttttcttatggtgaagcacaaa

SEQ ID NO: 8192229 - DNA, 22 bp, Homo sapiens
ttttcttatggtgaagcacaaa

SEQ ID NO: 8192230 - DNA, 22 bp, Homo sapiens
ttttctcagctgcactgtatta

SEQ ID NO: 8192231 - DNA, 22 bp, Homo sapiens
ttttctcagctgcactgtatta

SEQ ID NO: 8192232 - DNA, 22 bp, Homo sapiens
ttttctcttccctctggacctg

SEQ ID NO: 8192233 - DNA, 22 bp, Homo sapiens
ttttctgaagtttaagacattt

SEQ ID NO: 8192234 - DNA, 22 bp, Homo sapiens
ttttctgaagtttaagacattt

SEQ ID NO: 8192235 - DNA, 22 bp, Homo sapiens
ttttctgaagtttaagacattt

SEQ ID NO: 8192236 - DNA, 22 bp, Homo sapiens
ttttctgaagtttaagacattt

SEQ ID NO: 8192237 - DNA, 22 bp, Homo sapiens
ttttctgaagtttaagacattt

SEQ ID NO: 8192238 - DNA, 22 bp, Homo sapiens
ttttctcttgttaatgtactga

SEQ ID NO: 8192239 - DNA, 22 bp, Homo sapiens
ttttctcttgttaatgtactga

SEQ ID NO: 8192240 - DNA, 22 bp, Homo sapiens
ttttctcttgttaatgtactga

SEQ ID NO: 8192241 - DNA, 22 bp, Homo sapiens
ttttcatttttgtagatgcaag

SEQ ID NO: 8192242 - DNA, 22 bp, Homo sapiens
ttttccaccttctagagattgt

SEQ ID NO: 8192243 - DNA, 22 bp, Homo sapiens
ttttccaccttctagagattgt

SEQ ID NO: 8192244 - DNA, 22 bp, Homo sapiens
ttttccacctggttccagggct

SEQ ID NO: 8192245 - DNA, 22 bp, Homo sapiens
ttttccacagcaccataagatt

SEQ ID NO: 8192246 - DNA, 22 bp, Homo sapiens
ttttccacagcaccataagatt

SEQ ID NO: 8192247 - DNA, 19 bp, Homo sapiens
ttttccacagaaatatgtt

SEQ ID NO: 8192248 - DNA, 19 bp, Homo sapiens
ttttccacagaaatatgtt

SEQ ID NO: 8192249 - DNA, 22 bp, Homo sapiens
tttcttttccaatatccctact

SEQ ID NO: 8192250 - DNA, 19 bp, Homo sapiens
tttcttttcccctcagcac

SEQ ID NO: 8192251 - DNA, 22 bp, Homo sapiens
tttcttttgaatagtgtgtggt

SEQ ID NO: 8192252 - DNA, 19 bp, Homo sapiens
tttcttttcccctcagcac

SEQ ID NO: 8192253 - DNA, 22 bp, Homo sapiens
tttcttttgaatagtgtgtggt

SEQ ID NO: 8192254 - DNA, 19 bp, Homo sapiens
tttcttttcccctcagcac

SEQ ID NO: 8192255 - DNA, 22 bp, Homo sapiens
tttcttttgccctgtgggttag

SEQ ID NO: 8192256 - DNA, 22 bp, Homo sapiens
tttcttttgccctgtgggttag

SEQ ID NO: 8192257 - DNA, 22 bp, Homo sapiens
tttcttttgccctgtgggttag

SEQ ID NO: 8192258 - DNA, 22 bp, Homo sapiens
tttcttttgaatagtgtgtggt

SEQ ID NO: 8192259 - DNA, 22 bp, Homo sapiens
tttcttttgaatagtgtgtggt

SEQ ID NO: 8192260 - DNA, 22 bp, Homo sapiens
tttcttttgaatagtgtgtggt

SEQ ID NO: 8192261 - DNA, 22 bp, Homo sapiens
tttcttttgccctgtgggttag

SEQ ID NO: 8192262 - DNA, 22 bp, Homo sapiens
tttcttttgctgagaggggcac

SEQ ID NO: 8192263 - DNA, 22 bp, Homo sapiens
tttgaaagcaccatttgagtag

SEQ ID NO: 8192264 - DNA, 22 bp, Homo sapiens
tttcttttgctgagaggggcac

SEQ ID NO: 8192265 - DNA, 22 bp, Homo sapiens
tttcttttgctgagaggggcac

SEQ ID NO: 8192266 - DNA, 22 bp, Homo sapiens
tttcttttgccctgtgggttag

SEQ ID NO: 8192267 - DNA, 22 bp, Homo sapiens
tttcttttacagtgtggctatt

SEQ ID NO: 8192268 - DNA, 22 bp, Homo sapiens
tttcttttacagtgtggctatt

SEQ ID NO: 8192269 - DNA, 22 bp, Homo sapiens
tttcttttacagtgtggctatt

SEQ ID NO: 8192270 - DNA, 22 bp, Homo sapiens
tttctttgttgttatcacatca

SEQ ID NO: 8192271 - DNA, 22 bp, Homo sapiens
tttctttgtagtagcataatca

SEQ ID NO: 8192272 - DNA, 21 bp, Homo sapiens
tttctttctggctctcacagt

SEQ ID NO: 8192273 - DNA, 21 bp, Homo sapiens
tttctttctggctctcacagt

SEQ ID NO: 8192274 - DNA, 21 bp, Homo sapiens
tttctttctggctctcacagt

SEQ ID NO: 8192275 - DNA, 18 bp, Homo sapiens
tttctttctgcctggggc

SEQ ID NO: 8192276 - DNA, 18 bp, Homo sapiens
tttctttctgcctggggc

SEQ ID NO: 8192277 - DNA, 22 bp, Homo sapiens
tttcctctgatgctgacttgga

SEQ ID NO: 8192278 - DNA, 22 bp, Homo sapiens
tttcctctgactgctcccctgc

SEQ ID NO: 8192279 - DNA, 22 bp, Homo sapiens
tttcctctccaccaggaggtct

SEQ ID NO: 8192280 - DNA, 22 bp, Homo sapiens
tttcctctccggggcctccagg

SEQ ID NO: 8192281 - DNA, 22 bp, Homo sapiens
tttcctcatttatctgctggga

SEQ ID NO: 8192282 - DNA, 22 bp, Homo sapiens
tttcctaacacaatgcatgaga

SEQ ID NO: 8192283 - DNA, 22 bp, Homo sapiens
tttcctcacttcatgagagttt

SEQ ID NO: 8192284 - DNA, 22 bp, Homo sapiens
tttcctaacacaatgcatgaga

SEQ ID NO: 8192285 - DNA, 19 bp, Homo sapiens
tttcctaaaaagctgtgct

SEQ ID NO: 8192286 - DNA, 22 bp, Homo sapiens
tttccctttgcactctacaatt

SEQ ID NO: 8192287 - DNA, 22 bp, Homo sapiens
tttccctttgcactctacaatt

SEQ ID NO: 8192288 - DNA, 22 bp, Homo sapiens
tttcccttctttcctgagtaat

SEQ ID NO: 8192289 - DNA, 22 bp, Homo sapiens
tttcccttctttcctgagtaat

SEQ ID NO: 8192290 - DNA, 22 bp, Homo sapiens
tttcccttgaataaagatatct

SEQ ID NO: 8192291 - DNA, 22 bp, Homo sapiens
tttccctttagcctgagaatcc

SEQ ID NO: 8192292 - DNA, 22 bp, Homo sapiens
tttcccttgttccttcctctga

SEQ ID NO: 8192293 - DNA, 22 bp, Homo sapiens
tttccctgaggcctggacatta

SEQ ID NO: 8192294 - DNA, 22 bp, Homo sapiens
tttccctgaggcctggacatta

SEQ ID NO: 8192295 - DNA, 22 bp, Homo sapiens
tttccctgaggcctggacatta

SEQ ID NO: 8192296 - DNA, 22 bp, Homo sapiens
tttccctctgtgccagcttctc

SEQ ID NO: 8192297 - DNA, 22 bp, Homo sapiens
tttgaagagccacagtgaaatt

SEQ ID NO: 8192298 - DNA, 22 bp, Homo sapiens
tttgaagagccacagtgaaatt

SEQ ID NO: 8192299 - DNA, 22 bp, Homo sapiens
tttgaaaggtgtcgagatgtgt

SEQ ID NO: 8192300 - DNA, 23 bp, Homo sapiens
tttgaagcattttgtatcttagt

SEQ ID NO: 8192301 - DNA, 22 bp, Homo sapiens
tttgaatagcataggattacat

SEQ ID NO: 8192302 - DNA, 22 bp, Homo sapiens
tttgaagcaccaaaggagaaaa

SEQ ID NO: 8192303 - DNA, 19 bp, Homo sapiens
tttgaatataatgcagcta

SEQ ID NO: 8192304 - DNA, 22 bp, Homo sapiens
tttgaatatacttcaaacaaag

SEQ ID NO: 8192305 - DNA, 22 bp, Homo sapiens
tttgaatatacttcaaacaaag

SEQ ID NO: 8192306 - DNA, 22 bp, Homo sapiens
tttgaatgacatgattcaggca

SEQ ID NO: 8192307 - DNA, 22 bp, Homo sapiens
tttgaatgagaattattgtcat

SEQ ID NO: 8192308 - DNA, 22 bp, Homo sapiens
tttgaatatgtgcttgttaaat

SEQ ID NO: 8192309 - DNA, 22 bp, Homo sapiens
tttgaatctgatatggcagcat

SEQ ID NO: 8192310 - DNA, 22 bp, Homo sapiens
tttgaatatcacaaactttcaa

SEQ ID NO: 8192311 - DNA, 21 bp, Homo sapiens
tttgaaagccctatgttttca

SEQ ID NO: 8192312 - DNA, 22 bp, Homo sapiens
tttgaaagcaggtgtgggaggg

SEQ ID NO: 8192313 - DNA, 21 bp, Homo sapiens
tttgaaagccctatgttttca

SEQ ID NO: 8192314 - DNA, 21 bp, Homo sapiens
tttgaaagccctatgttttca

SEQ ID NO: 8192315 - DNA, 22 bp, Homo sapiens
tttgaaagcctggcttttctct

SEQ ID NO: 8192316 - DNA, 19 bp, Homo sapiens
tttgaaaggattgttattt

SEQ ID NO: 8192317 - DNA, 17 bp, Homo sapiens
tttgaaaggatgtcagt

SEQ ID NO: 8192318 - DNA, 22 bp, Homo sapiens
tttgaaaggagctttatccaga

SEQ ID NO: 8192319 - DNA, 22 bp, Homo sapiens
tttgaaaggaattaggatgaca

SEQ ID NO: 8192320 - DNA, 22 bp, Homo sapiens
tttgacagacatttactacatt

SEQ ID NO: 8192321 - DNA, 22 bp, Homo sapiens
tttgacagacatttactacatt

SEQ ID NO: 8192322 - DNA, 22 bp, Homo sapiens
tttgacaattcatgacatttat

SEQ ID NO: 8192323 - DNA, 22 bp, Homo sapiens
tttgacaataattgcatttata

SEQ ID NO: 8192324 - DNA, 22 bp, Homo sapiens
tttgacaaccaggcaggtaaga

SEQ ID NO: 8192325 - DNA, 22 bp, Homo sapiens
tttgacaacagcaaatgtcaca

SEQ ID NO: 8192326 - DNA, 22 bp, Homo sapiens
tttgacaacgttgttgtgagga

SEQ ID NO: 8192327 - DNA, 22 bp, Homo sapiens
tttgacaactgtgcagtttgta

SEQ ID NO: 8192328 - DNA, 22 bp, Homo sapiens
tttgacaactgtgcagtttgta

SEQ ID NO: 8192329 - DNA, 22 bp, Homo sapiens
tttgaattattccttgagttga

SEQ ID NO: 8192330 - DNA, 22 bp, Homo sapiens
tttgaatgttttaggtacttaa

SEQ ID NO: 8192331 - DNA, 22 bp, Homo sapiens
tttgaatgttttaggtacttaa

SEQ ID NO: 8192332 - DNA, 22 bp, Homo sapiens
tttgaatgtaaatgctgcagct

SEQ ID NO: 8192333 - DNA, 22 bp, Homo sapiens
tttgaatgagggaaccacagtt

SEQ ID NO: 8192334 - DNA, 22 bp, Homo sapiens
tttgaatgagaattattgtcat

SEQ ID NO: 8192335 - DNA, 23 bp, Homo sapiens
tttgaatgggtctatttttctta

SEQ ID NO: 8192336 - DNA, 22 bp, Homo sapiens
tttgacaaatatttattggcac

SEQ ID NO: 8192337 - DNA, 22 bp, Homo sapiens
tttgacaacacgttatttgcct

SEQ ID NO: 8192338 - DNA, 22 bp, Homo sapiens
tttgatgatgatgataaagttt

SEQ ID NO: 8192339 - DNA, 22 bp, Homo sapiens
tttgatgagtttaataacagcc

SEQ ID NO: 8192340 - DNA, 22 bp, Homo sapiens
tttgatgacctgtatctttttc

SEQ ID NO: 8192341 - DNA, 22 bp, Homo sapiens
tttgatgacttcagatctttgt

SEQ ID NO: 8192342 - DNA, 19 bp, Homo sapiens
tttgatgagaatttaagca

SEQ ID NO: 8192343 - DNA, 22 bp, Homo sapiens
tttgatgacctgtatctttttc

SEQ ID NO: 8192344 - DNA, 22 bp, Homo sapiens
tttgatgaacctatataatttg

SEQ ID NO: 8192345 - DNA, 22 bp, Homo sapiens
tttgatgaaagctactatttac

SEQ ID NO: 8192346 - DNA, 22 bp, Homo sapiens
tttgattgtcacctaccttgca

SEQ ID NO: 8192347 - DNA, 22 bp, Homo sapiens
tttgatttactggatattctca

SEQ ID NO: 8192348 - DNA, 22 bp, Homo sapiens
tttgatttactggatattctca

SEQ ID NO: 8192349 - DNA, 18 bp, Homo sapiens
tttgattgctgtcatcca

SEQ ID NO: 8192350 - DNA, 22 bp, Homo sapiens
tttgattgcaatagttttatga

SEQ ID NO: 8192351 - DNA, 22 bp, Homo sapiens
tttgattctgtaaaataacagg

SEQ ID NO: 8192352 - DNA, 22 bp, Homo sapiens
tttgattctaagttctgtcaac

SEQ ID NO: 8192353 - DNA, 22 bp, Homo sapiens
tttgatgtcaaaatatcctgtt

SEQ ID NO: 8192354 - DNA, 22 bp, Homo sapiens
tttgcttgttcaagatttctgt

SEQ ID NO: 8192355 - DNA, 22 bp, Homo sapiens
tttgatttactggatattctca

SEQ ID NO: 8192356 - DNA, 18 bp, Homo sapiens
tttgctttccttcttcag

SEQ ID NO: 8192357 - DNA, 18 bp, Homo sapiens
tttgctttccttcttcag

SEQ ID NO: 8192358 - DNA, 22 bp, Homo sapiens
tttgctttgactgtcagcaagt

SEQ ID NO: 8192359 - DNA, 22 bp, Homo sapiens
tttgctttgggaggttgtctgg

SEQ ID NO: 8192360 - DNA, 22 bp, Homo sapiens
tttgctttcttgattcagatta

SEQ ID NO: 8192361 - DNA, 22 bp, Homo sapiens
tttgctttctgttgaacagagt

SEQ ID NO: 8192362 - DNA, 22 bp, Homo sapiens
tttgctttctgttgaacagagt

SEQ ID NO: 8192363 - DNA, 22 bp, Homo sapiens
tttgacagatccttaactcagc

SEQ ID NO: 8192364 - DNA, 22 bp, Homo sapiens
tttgaggaagatcggagggaaa

SEQ ID NO: 8192365 - DNA, 22 bp, Homo sapiens
tttgaggttagctagcagatca

SEQ ID NO: 8192366 - DNA, 22 bp, Homo sapiens
tttgaggttagctagcagatca

SEQ ID NO: 8192367 - DNA, 22 bp, Homo sapiens
tttgaggttagctagcagatca

SEQ ID NO: 8192368 - DNA, 22 bp, Homo sapiens
tttgaggttagctagcagatca

SEQ ID NO: 8192369 - DNA, 22 bp, Homo sapiens
tttgaggttagctagcagatca

SEQ ID NO: 8192370 - DNA, 22 bp, Homo sapiens
tttgaggttagctagcagatca

SEQ ID NO: 8192371 - DNA, 22 bp, Homo sapiens
tttgaggttagctagcagatca

SEQ ID NO: 8192372 - DNA, 19 bp, Homo sapiens
tttgatatctgaattatgc

SEQ ID NO: 8192373 - DNA, 19 bp, Homo sapiens
tttgatatctgaattatgc

SEQ ID NO: 8192374 - DNA, 22 bp, Homo sapiens
tttgatatcttggtatacagat

SEQ ID NO: 8192375 - DNA, 22 bp, Homo sapiens
tttgatatgcaaaattatggac

SEQ ID NO: 8192376 - DNA, 22 bp, Homo sapiens
tttgatccgttgctggtgagga

SEQ ID NO: 8192377 - DNA, 22 bp, Homo sapiens
tttgatccgttgctggtgagga

SEQ ID NO: 8192378 - DNA, 22 bp, Homo sapiens
tttgatgaaagctactatttac

SEQ ID NO: 8192379 - DNA, 22 bp, Homo sapiens
tttgatatcctatacaagtaaa

SEQ ID NO: 8192380 - DNA, 22 bp, Homo sapiens
tttgatatcctatacaagtaaa

SEQ ID NO: 8192381 - DNA, 22 bp, Homo sapiens
tttgataattaaaaattgtagt

SEQ ID NO: 8192382 - DNA, 22 bp, Homo sapiens
tttggaaatttcatcaatagcc

SEQ ID NO: 8192383 - DNA, 22 bp, Homo sapiens
tttggaaatttcatcaatagcc

SEQ ID NO: 8192384 - DNA, 22 bp, Homo sapiens
tttggaaagtgtacaaatttga

SEQ ID NO: 8192385 - DNA, 22 bp, Homo sapiens
tttggaaagtgtacaaatttga

SEQ ID NO: 8192386 - DNA, 22 bp, Homo sapiens
tttggaaaaagcctgaacatag

SEQ ID NO: 8192387 - DNA, 22 bp, Homo sapiens
tttgcttttgtgctctagtggt

SEQ ID NO: 8192388 - DNA, 22 bp, Homo sapiens
tttgcttttgtgctctagtggt

SEQ ID NO: 8192389 - DNA, 22 bp, Homo sapiens
tttgcttttgtgctctagtggt

SEQ ID NO: 8192390 - DNA, 22 bp, Homo sapiens
tttggaaacatctcagaaaata

SEQ ID NO: 8192391 - DNA, 22 bp, Homo sapiens
tttggaaattttcatccagaca

SEQ ID NO: 8192392 - DNA, 22 bp, Homo sapiens
tttggtcaaatattatcctgag

SEQ ID NO: 8192393 - DNA, 22 bp, Homo sapiens
tttggtcatgtcgtcatttggg

SEQ ID NO: 8192394 - DNA, 22 bp, Homo sapiens
tttggtccaagttttactcttt

SEQ ID NO: 8192395 - DNA, 22 bp, Homo sapiens
tttggtcattgaggaagtaaag

SEQ ID NO: 8192396 - DNA, 22 bp, Homo sapiens
tttggtcatagattgcgaacat

SEQ ID NO: 8192397 - DNA, 22 bp, Homo sapiens
tttggtcctaagctgctctcta

SEQ ID NO: 8192398 - DNA, 22 bp, Homo sapiens
tttggtgttccggtcattgctg

SEQ ID NO: 8192399 - DNA, 22 bp, Homo sapiens
tttggttggaaggatggatagc

SEQ ID NO: 8192400 - DNA, 22 bp, Homo sapiens
tttggttgtatcattctatgaa

SEQ ID NO: 8192401 - DNA, 22 bp, Homo sapiens
tttggttgtatcattctatgaa

SEQ ID NO: 8192402 - DNA, 22 bp, Homo sapiens
tttggtttagggtcatttaaca

SEQ ID NO: 8192403 - DNA, 22 bp, Homo sapiens
tttgtaaaagcccaagctgtag

SEQ ID NO: 8192404 - DNA, 22 bp, Homo sapiens
tttgtaaaagcccaagctgtag

SEQ ID NO: 8192405 - DNA, 22 bp, Homo sapiens
tttgtaaaagcccaagctgtag

SEQ ID NO: 8192406 - DNA, 22 bp, Homo sapiens
tttgtaaaagcccaagctgtag

SEQ ID NO: 8192407 - DNA, 22 bp, Homo sapiens
tttggtttttacctgctgagag

SEQ ID NO: 8192408 - DNA, 22 bp, Homo sapiens
tttggtttttaatacaaagtac

SEQ ID NO: 8192409 - DNA, 22 bp, Homo sapiens
tttggtttagggtcatttaaca

SEQ ID NO: 8192410 - DNA, 22 bp, Homo sapiens
tttggtttattaaattgtaggc

SEQ ID NO: 8192411 - DNA, 22 bp, Homo sapiens
tttggtttgaatgagcataaga

SEQ ID NO: 8192412 - DNA, 22 bp, Homo sapiens
tttggtttgcctgagtaccctc

SEQ ID NO: 8192413 - DNA, 22 bp, Homo sapiens
tttggtttgaatgagcataaga

SEQ ID NO: 8192414 - DNA, 22 bp, Homo sapiens
tttttcagccatgaattacact

SEQ ID NO: 8192415 - DNA, 22 bp, Homo sapiens
tttttcagccatgaattacact

SEQ ID NO: 8192416 - DNA, 22 bp, Homo sapiens
tttttatgcctacgctgaaaag

SEQ ID NO: 8192417 - DNA, 22 bp, Homo sapiens
tttttatatgaaggatagtgcg

SEQ ID NO: 8192418 - DNA, 22 bp, Homo sapiens
tttttataccacctctcactta

SEQ ID NO: 8192419 - DNA, 22 bp, Homo sapiens
tttttatactttgctcaagatt

SEQ ID NO: 8192420 - DNA, 22 bp, Homo sapiens
tttttatactttgctcaagatt

SEQ ID NO: 8192421 - DNA, 22 bp, Homo sapiens
tttttatactttgctcaagatt

SEQ ID NO: 8192422 - DNA, 22 bp, Homo sapiens
tttttatactttgctcaagatt

SEQ ID NO: 8192423 - DNA, 22 bp, Homo sapiens
tttttagagtgttaccagtata

SEQ ID NO: 8192424 - DNA, 22 bp, Homo sapiens
tttttagaattggctgagaatt

SEQ ID NO: 8192425 - DNA, 22 bp, Homo sapiens
tttttagagtgttaccagtata

SEQ ID NO: 8192426 - DNA, 22 bp, Homo sapiens
tttttataactcttttgtgaca

SEQ ID NO: 8192427 - DNA, 22 bp, Homo sapiens
tttttataccacctctcactta

SEQ ID NO: 8192428 - DNA, 22 bp, Homo sapiens
tttttataccacctctcactta

SEQ ID NO: 8192429 - DNA, 22 bp, Homo sapiens
tttttataactcttttgtgaca

SEQ ID NO: 8192430 - DNA, 22 bp, Homo sapiens
ttttcttatgtgcagctatatg

SEQ ID NO: 8192431 - DNA, 22 bp, Homo sapiens
ttttgtttgtgtccactgcagt

SEQ ID NO: 8192432 - DNA, 22 bp, Homo sapiens
ttttgttgtaatatacctatcc

SEQ ID NO: 8192433 - DNA, 19 bp, Homo sapiens
tttttacaagtaggtgtga

SEQ ID NO: 8192434 - DNA, 19 bp, Homo sapiens
tttttacaagtaggtgtga

SEQ ID NO: 8192435 - DNA, 22 bp, Homo sapiens
tttttacacttagcattgagcg

SEQ ID NO: 8192436 - DNA, 22 bp, Homo sapiens
tttttacacttagcattgagcg

SEQ ID NO: 8192437 - DNA, 22 bp, Homo sapiens
tttttacacttagcattgagcg

SEQ ID NO: 8192438 - DNA, 22 bp, Homo sapiens
tttttacacttagcattgagcg

SEQ ID NO: 8192439 - DNA, 22 bp, Homo sapiens
cacagcattgccttccaaaagg

SEQ ID NO: 8192440 - DNA, 22 bp, Homo sapiens
cacagccatgtcctcattcttc

SEQ ID NO: 8192441 - DNA, 19 bp, Homo sapiens
cacagccacagccaacctc

SEQ ID NO: 8192442 - DNA, 22 bp, Homo sapiens
cacagccctgcgccccagtttg

SEQ ID NO: 8192443 - DNA, 22 bp, Homo sapiens
ggagcagccgcgtctcagggca

SEQ ID NO: 8192444 - DNA, 22 bp, Homo sapiens
ggagcagccgcgtctcagggca

SEQ ID NO: 8192445 - DNA, 22 bp, Homo sapiens
ggagcagccgcgtctcagggca

SEQ ID NO: 8192446 - DNA, 22 bp, Homo sapiens
ggagcagccgcgtctcagggca

SEQ ID NO: 8192447 - DNA, 22 bp, Homo sapiens
ggagcagccacgtctcagggca

SEQ ID NO: 8192448 - DNA, 22 bp, Homo sapiens
ggagcagccacgtctcagggca

SEQ ID NO: 8192449 - DNA, 22 bp, Homo sapiens
ggagcagccacgtctcagggca

SEQ ID NO: 8192450 - DNA, 22 bp, Homo sapiens
ggagcagccacgtctcagggca

SEQ ID NO: 8192451 - DNA, 22 bp, Homo sapiens
cacagcataatgaaatatactt

SEQ ID NO: 8192452 - DNA, 22 bp, Homo sapiens
cacagcataatgaaatatactt

SEQ ID NO: 8192453 - DNA, 22 bp, Homo sapiens
cacagcataatgaaatatactt

SEQ ID NO: 8192454 - DNA, 22 bp, Homo sapiens
cacagcataatgaaatatactt

SEQ ID NO: 8192455 - DNA, 22 bp, Homo sapiens
cacagcagggatgaatggagtg

SEQ ID NO: 8192456 - DNA, 22 bp, Homo sapiens
cacagcagggcatggctgttgt

SEQ ID NO: 8192457 - DNA, 21 bp, Homo sapiens
cacagcagggttcctgggctc

SEQ ID NO: 8192458 - DNA, 22 bp, Homo sapiens
cacagcagggatgaatggagtg

SEQ ID NO: 8192459 - DNA, 22 bp, Homo sapiens
cacagcaggcagaacgtgggca

SEQ ID NO: 8192460 - DNA, 22 bp, Homo sapiens
cacagcaggcagaacgtgggca

SEQ ID NO: 8192461 - DNA, 22 bp, Homo sapiens
ggaggactcaggtctggccatg

SEQ ID NO: 8192462 - DNA, 22 bp, Homo sapiens
ggagctggccgcctatgtgcag

SEQ ID NO: 8192463 - DNA, 22 bp, Homo sapiens
ggaggagacagtaaaaagcacg

SEQ ID NO: 8192464 - DNA, 22 bp, Homo sapiens
ggagcaggagtctcttgaattt

SEQ ID NO: 8192465 - DNA, 22 bp, Homo sapiens
ggagctggccctctgagtttgt

SEQ ID NO: 8192466 - DNA, 22 bp, Homo sapiens
ggagctggccgcctatgtgcag

SEQ ID NO: 8192467 - DNA, 22 bp, Homo sapiens
ggagcagcttgcatgctcaggg

SEQ ID NO: 8192468 - DNA, 22 bp, Homo sapiens
ggagcagcttgcatgctcaggg

SEQ ID NO: 8192469 - DNA, 22 bp, Homo sapiens
ggagcagcttgcatgctcaggg

SEQ ID NO: 8192470 - DNA, 22 bp, Homo sapiens
ggagcagcctgtgtagacgggg

SEQ ID NO: 8192471 - DNA, 22 bp, Homo sapiens
ggagcagcctgtgtagacgggg

SEQ ID NO: 8192472 - DNA, 22 bp, Homo sapiens
ggagcaggagtctcttgaattt

SEQ ID NO: 8192473 - DNA, 22 bp, Homo sapiens
ggagcagcttgcatgctcaggg

SEQ ID NO: 8192474 - DNA, 22 bp, Homo sapiens
ggagcagcttgcatgctcaggg

SEQ ID NO: 8192475 - DNA, 22 bp, Homo sapiens
ggaggagacggagtgattagtg

SEQ ID NO: 8192476 - DNA, 22 bp, Homo sapiens
ggaggagacggagtgattagtg

SEQ ID NO: 8192477 - DNA, 22 bp, Homo sapiens
ggaggagcacttctgagctcag

SEQ ID NO: 8192478 - DNA, 22 bp, Homo sapiens
ggaggagattcccctctcactt

SEQ ID NO: 8192479 - DNA, 22 bp, Homo sapiens
ggaggagcacttctgagctcag

SEQ ID NO: 8192480 - DNA, 22 bp, Homo sapiens
ggaggagcacttctgagctcag

SEQ ID NO: 8192481 - DNA, 22 bp, Homo sapiens
ggaggagcacttctgagctcag

SEQ ID NO: 8192482 - DNA, 22 bp, Homo sapiens
ggaggagcacttctgagctcag

SEQ ID NO: 8192483 - DNA, 22 bp, Homo sapiens
ggaggagcatgagagggtagtg

SEQ ID NO: 8192484 - DNA, 22 bp, Homo sapiens
ggaggagcacttgacggggtct

SEQ ID NO: 8192485 - DNA, 22 bp, Homo sapiens
ggaggagcacttgacggggtct

SEQ ID NO: 8192486 - DNA, 22 bp, Homo sapiens
ggaggagcacttctgagctcag

SEQ ID NO: 8192487 - DNA, 22 bp, Homo sapiens
cacagctaactttcactgagca

SEQ ID NO: 8192488 - DNA, 19 bp, Homo sapiens
cacagcgaagacaaggtgg

SEQ ID NO: 8192489 - DNA, 22 bp, Homo sapiens
cacagcctgctgcactcaagaa

SEQ ID NO: 8192490 - DNA, 22 bp, Homo sapiens
cacagccttactgagatccact

SEQ ID NO: 8192491 - DNA, 22 bp, Homo sapiens
cacagccttactgagatccact

SEQ ID NO: 8192492 - DNA, 22 bp, Homo sapiens
cacagccttgagcgaggacaag

SEQ ID NO: 8192493 - DNA, 22 bp, Homo sapiens
cacagccttactgagatccact

SEQ ID NO: 8192494 - DNA, 22 bp, Homo sapiens
cacagcctccttcagagagcat

SEQ ID NO: 8192495 - DNA, 22 bp, Homo sapiens
cacagcctcctctggctcacgg

SEQ ID NO: 8192496 - DNA, 22 bp, Homo sapiens
cacagcctccttcagagagcat

SEQ ID NO: 8192497 - DNA, 22 bp, Homo sapiens
cacagcctccttcagagagcat

SEQ ID NO: 8192498 - DNA, 22 bp, Homo sapiens
cacagctgaagtagccatgtgg

SEQ ID NO: 8192499 - DNA, 19 bp, Homo sapiens
cacagctctgctcagggaa

SEQ ID NO: 8192500 - DNA, 22 bp, Homo sapiens
cacagctaggaggaaagcagag

SEQ ID NO: 8192501 - DNA, 22 bp, Homo sapiens
ggaggggatttagtagatgcta

SEQ ID NO: 8192502 - DNA, 22 bp, Homo sapiens
ggaggggatttagtagatgcta

SEQ ID NO: 8192503 - DNA, 22 bp, Homo sapiens
ggaggggatggtttgaccctgg

SEQ ID NO: 8192504 - DNA, 22 bp, Homo sapiens
ggaggggatggtttgaccctgg

SEQ ID NO: 8192505 - DNA, 22 bp, Homo sapiens
ggaggggatggtttgaccctgg

SEQ ID NO: 8192506 - DNA, 22 bp, Homo sapiens
cacaggagaggttaatgggggc

SEQ ID NO: 8192507 - DNA, 22 bp, Homo sapiens
cacaggagaggttaatgggggc

SEQ ID NO: 8192508 - DNA, 22 bp, Homo sapiens
cacaggagaggttaatgggggc

SEQ ID NO: 8192509 - DNA, 22 bp, Homo sapiens
cacaggagaggttaatgggggc

SEQ ID NO: 8192510 - DNA, 22 bp, Homo sapiens
cacaggagattgatctattggt

SEQ ID NO: 8192511 - DNA, 22 bp, Homo sapiens
cacaggagattgatctattggt

SEQ ID NO: 8192512 - DNA, 18 bp, Homo sapiens
cacaggagatgacctgac

SEQ ID NO: 8192513 - DNA, 18 bp, Homo sapiens
cacaggagatgacctgac

SEQ ID NO: 8192514 - DNA, 18 bp, Homo sapiens
cacaggagatgacctgac

SEQ ID NO: 8192515 - DNA, 22 bp, Homo sapiens
cacaggagaacccacagattct

SEQ ID NO: 8192516 - DNA, 22 bp, Homo sapiens
cacaggagaacccacagattct

SEQ ID NO: 8192517 - DNA, 22 bp, Homo sapiens
cacaggagaaaggggaagctcg

SEQ ID NO: 8192518 - DNA, 22 bp, Homo sapiens
cacaggagaaaggggaagctcg

SEQ ID NO: 8192519 - DNA, 22 bp, Homo sapiens
cacaggagaaaggggaagctcg

SEQ ID NO: 8192520 - DNA, 22 bp, Homo sapiens
cacaggagagctgggaggtgcc

SEQ ID NO: 8192521 - DNA, 22 bp, Homo sapiens
cacaggagagctgggaggtgcc

SEQ ID NO: 8192522 - DNA, 22 bp, Homo sapiens
cacaggagagctgggaggtgcc

SEQ ID NO: 8192523 - DNA, 22 bp, Homo sapiens
ggaggggccggctgcctgccac

SEQ ID NO: 8192524 - DNA, 22 bp, Homo sapiens
ggaggggccggctgcctgccac

SEQ ID NO: 8192525 - DNA, 22 bp, Homo sapiens
ggaggggccggctgcctgccac

SEQ ID NO: 8192526 - DNA, 22 bp, Homo sapiens
ggaggggccggctgcctgccac

SEQ ID NO: 8192527 - DNA, 22 bp, Homo sapiens
ggaggggcatagttcaccatca

SEQ ID NO: 8192528 - DNA, 22 bp, Homo sapiens
ggaggggcagccatggaactcc

SEQ ID NO: 8192529 - DNA, 22 bp, Homo sapiens
ggaggggcagccatggaactcc

SEQ ID NO: 8192530 - DNA, 22 bp, Homo sapiens
ggaggggcagccatggaactcc

SEQ ID NO: 8192531 - DNA, 22 bp, Homo sapiens
ggaggggcagccatggaactcc

SEQ ID NO: 8192532 - DNA, 22 bp, Homo sapiens
ggaggggatttagtagatgcta

SEQ ID NO: 8192533 - DNA, 22 bp, Homo sapiens
ggaaggggtcacctcctgatga

SEQ ID NO: 8192534 - DNA, 22 bp, Homo sapiens
ggacaaagctctgctgcctccc

SEQ ID NO: 8192535 - DNA, 22 bp, Homo sapiens
ggacaaagggtggagcctctga

SEQ ID NO: 8192536 - DNA, 22 bp, Homo sapiens
ggacaaagggctagccacaact

SEQ ID NO: 8192537 - DNA, 22 bp, Homo sapiens
ggacaaatctcattatttctga

SEQ ID NO: 8192538 - DNA, 22 bp, Homo sapiens
ggacaaaggtctggggaacctg

SEQ ID NO: 8192539 - DNA, 22 bp, Homo sapiens
ggacaaaggtctggggaacctg

SEQ ID NO: 8192540 - DNA, 22 bp, Homo sapiens
ggacaaattccctatttgcatg

SEQ ID NO: 8192541 - DNA, 22 bp, Homo sapiens
ggacaagcctgtgagtgggttt

SEQ ID NO: 8192542 - DNA, 22 bp, Homo sapiens
ggacaagcctgtgagtgggttt

SEQ ID NO: 8192543 - DNA, 22 bp, Homo sapiens
ggacaagcctgtgagtgggttt

SEQ ID NO: 8192544 - DNA, 22 bp, Homo sapiens
ggacagattgagctaggcgttt

SEQ ID NO: 8192545 - DNA, 22 bp, Homo sapiens
ggacagagggttgacagagtat

SEQ ID NO: 8192546 - DNA, 22 bp, Homo sapiens
ggacagagggttgacagagtat

SEQ ID NO: 8192547 - DNA, 22 bp, Homo sapiens
ggacagagggttgacagagtat

SEQ ID NO: 8192548 - DNA, 22 bp, Homo sapiens
ggacacagataatcacacagat

SEQ ID NO: 8192549 - DNA, 19 bp, Homo sapiens
ggacacagaaagctgcatt

SEQ ID NO: 8192550 - DNA, 19 bp, Homo sapiens
ggacacagaaagctgcatt

SEQ ID NO: 8192551 - DNA, 22 bp, Homo sapiens
ggacacaaaagtgaataaaata

SEQ ID NO: 8192552 - DNA, 19 bp, Homo sapiens
ggacacagaaagctgcatt

SEQ ID NO: 8192553 - DNA, 22 bp, Homo sapiens
ggacacagacctttctgttcta

SEQ ID NO: 8192554 - DNA, 22 bp, Homo sapiens
ggaagagaaatgagtcaagact

SEQ ID NO: 8192555 - DNA, 22 bp, Homo sapiens
ggaagagaaatgagtcaagact

SEQ ID NO: 8192556 - DNA, 22 bp, Homo sapiens
ggaagagaaatgagtcaagact

SEQ ID NO: 8192557 - DNA, 22 bp, Homo sapiens
ggaagactgcatggcatagtga

SEQ ID NO: 8192558 - DNA, 22 bp, Homo sapiens
ggaagactagtgttttaagtta

SEQ ID NO: 8192559 - DNA, 22 bp, Homo sapiens
ggaagacatctgcttgcaccag

SEQ ID NO: 8192560 - DNA, 22 bp, Homo sapiens
ggaacagggatttggcctggtt

SEQ ID NO: 8192561 - DNA, 22 bp, Homo sapiens
ggaacagggatttggcctggtt

SEQ ID NO: 8192562 - DNA, 22 bp, Homo sapiens
ggaacaggaaaggagggatgct

SEQ ID NO: 8192563 - DNA, 22 bp, Homo sapiens
ggaacaggaaaggagggatgct

SEQ ID NO: 8192564 - DNA, 22 bp, Homo sapiens
ggaacagggatttggcctggtt

SEQ ID NO: 8192565 - DNA, 22 bp, Homo sapiens
ggaacaggaaaggagggatgct

SEQ ID NO: 8192566 - DNA, 22 bp, Homo sapiens
ggaagagaatgatggctatggg

SEQ ID NO: 8192567 - DNA, 22 bp, Homo sapiens
ggaagagaatttctctcttttt

SEQ ID NO: 8192568 - DNA, 22 bp, Homo sapiens
ggaagagagatcccatagatgt

SEQ ID NO: 8192569 - DNA, 22 bp, Homo sapiens
ggaagagagatcccatagatgt

SEQ ID NO: 8192570 - DNA, 19 bp, Homo sapiens
ggaagagaggaaaggtgga

SEQ ID NO: 8192571 - DNA, 19 bp, Homo sapiens
ggaagagaggaaaggtgga

SEQ ID NO: 8192572 - DNA, 19 bp, Homo sapiens
ggaagagaggaaaggtgga

SEQ ID NO: 8192573 - DNA, 22 bp, Homo sapiens
ggaagagagggctgggcctcaa

SEQ ID NO: 8192574 - DNA, 22 bp, Homo sapiens
ggaagagagggctgggcctcaa

SEQ ID NO: 8192575 - DNA, 22 bp, Homo sapiens
ggaagagaggttcagccctaag

SEQ ID NO: 8192576 - DNA, 22 bp, Homo sapiens
ggaagagattctttacattcat

SEQ ID NO: 8192577 - DNA, 22 bp, Homo sapiens
cacagagacagatctattttgc

SEQ ID NO: 8192578 - DNA, 22 bp, Homo sapiens
cacagagaccccttctggggcc

SEQ ID NO: 8192579 - DNA, 22 bp, Homo sapiens
cacagcaaagacactctcaact

SEQ ID NO: 8192580 - DNA, 22 bp, Homo sapiens
cacagcaggcactatacagggc

SEQ ID NO: 8192581 - DNA, 22 bp, Homo sapiens
cacagagaattcccatatgtga

SEQ ID NO: 8192582 - DNA, 22 bp, Homo sapiens
cacagagacagaagcacttatg

SEQ ID NO: 8192583 - DNA, 22 bp, Homo sapiens
cacagagacagatctattttgc

SEQ ID NO: 8192584 - DNA, 22 bp, Homo sapiens
cacagagaactgtgggagtgtg

SEQ ID NO: 8192585 - DNA, 22 bp, Homo sapiens
ggagatctgagagctggaagtg

SEQ ID NO: 8192586 - DNA, 22 bp, Homo sapiens
cacagagaatgatgagtcactg

SEQ ID NO: 8192587 - DNA, 23 bp, Homo sapiens
ggagatcagagactagggcagtt

SEQ ID NO: 8192588 - DNA, 23 bp, Homo sapiens
ggagatcagagactagggcagtt

SEQ ID NO: 8192589 - DNA, 22 bp, Homo sapiens
ggagatccaggctgagtctttc

SEQ ID NO: 8192590 - DNA, 22 bp, Homo sapiens
ggagatccaggcaaggccgcag

SEQ ID NO: 8192591 - DNA, 23 bp, Homo sapiens
ggagatctaggttggcatttcct

SEQ ID NO: 8192592 - DNA, 19 bp, Homo sapiens
ggagatcccgctgcagatg

SEQ ID NO: 8192593 - DNA, 22 bp, Homo sapiens
ggagatctcagttttataatca

SEQ ID NO: 8192594 - DNA, 22 bp, Homo sapiens
ggagatctgagagctggaagtg

SEQ ID NO: 8192595 - DNA, 22 bp, Homo sapiens
ggagatctcagttttataatca

SEQ ID NO: 8192596 - DNA, 22 bp, Homo sapiens
ggagatagtccaggtgaaggga

SEQ ID NO: 8192597 - DNA, 22 bp, Homo sapiens
ggagatatggtctagtatagag

SEQ ID NO: 8192598 - DNA, 22 bp, Homo sapiens
ggagatatttgtattctgtctc

SEQ ID NO: 8192599 - DNA, 22 bp, Homo sapiens
ggagatagacttggtgagccac

SEQ ID NO: 8192600 - DNA, 22 bp, Homo sapiens
ggagagttgtttttgcctagat

SEQ ID NO: 8192601 - DNA, 16 bp, Homo sapiens
ggagagtgtctgcaaa

SEQ ID NO: 8192602 - DNA, 22 bp, Homo sapiens
ggagagtggattccagctgtat

SEQ ID NO: 8192603 - DNA, 18 bp, Homo sapiens
ggagagtgagatcaaaca

SEQ ID NO: 8192604 - DNA, 22 bp, Homo sapiens
ggagagtggattccagctgtat

SEQ ID NO: 8192605 - DNA, 22 bp, Homo sapiens
ggagagtctgctggccacagtg

SEQ ID NO: 8192606 - DNA, 18 bp, Homo sapiens
ggagagtgacagagtcgt

SEQ ID NO: 8192607 - DNA, 18 bp, Homo sapiens
ggagagtgacagagtcgt

SEQ ID NO: 8192608 - DNA, 22 bp, Homo sapiens
ggagagctgacatcatgatgtt

SEQ ID NO: 8192609 - DNA, 22 bp, Homo sapiens
ggacagcatatcagcagggcag

SEQ ID NO: 8192610 - DNA, 22 bp, Homo sapiens
ggacagcagcctcttacatgaa

SEQ ID NO: 8192611 - DNA, 22 bp, Homo sapiens
ggacagcattctactgtaggca

SEQ ID NO: 8192612 - DNA, 22 bp, Homo sapiens
ggacagcgtggctggtggaggg

SEQ ID NO: 8192613 - DNA, 22 bp, Homo sapiens
ggacagcgtggctggtggaggg

SEQ ID NO: 8192614 - DNA, 22 bp, Homo sapiens
caaattcctcagaatcagaaaa

SEQ ID NO: 8192615 - DNA, 18 bp, Homo sapiens
caaattctcattgatttc

SEQ ID NO: 8192616 - DNA, 22 bp, Homo sapiens
caaattctcaccctgtttgatt

SEQ ID NO: 8192617 - DNA, 22 bp, Homo sapiens
caaattctcttactgtttgaca

SEQ ID NO: 8192618 - DNA, 18 bp, Homo sapiens
caaattctcattgatttc

SEQ ID NO: 8192619 - DNA, 20 bp, Homo sapiens
caaattctgttgaatacacc

SEQ ID NO: 8192620 - DNA, 22 bp, Homo sapiens
caaattgatctgtctttatgaa

SEQ ID NO: 8192621 - DNA, 22 bp, Homo sapiens
caaattgcttgtctgtagtgga

SEQ ID NO: 8192622 - DNA, 22 bp, Homo sapiens
caaattgtgtttgcttttctct

SEQ ID NO: 8192623 - DNA, 22 bp, Homo sapiens
caaatttaagtgaggtctttgt

SEQ ID NO: 8192624 - DNA, 22 bp, Homo sapiens
caaatttaagttagaaagcaat

SEQ ID NO: 8192625 - DNA, 22 bp, Homo sapiens
caaatttaagttagaaagcaat

SEQ ID NO: 8192626 - DNA, 22 bp, Homo sapiens
caaatttaggtaacagtctgta

SEQ ID NO: 8192627 - DNA, 23 bp, Homo sapiens
gctgaggtacatttacaggaaga

SEQ ID NO: 8192628 - DNA, 22 bp, Homo sapiens
gctgaggtaggaggttgcagtg

SEQ ID NO: 8192629 - DNA, 22 bp, Homo sapiens
gctgaggtaggaggttgcagtg

SEQ ID NO: 8192630 - DNA, 22 bp, Homo sapiens
gctgaggtaggaggttgcagtg

SEQ ID NO: 8192631 - DNA, 22 bp, Homo sapiens
gctgaggtcaggagctgtgggg

SEQ ID NO: 8192632 - DNA, 22 bp, Homo sapiens
gctgaggtcaggagctgtgggg

SEQ ID NO: 8192633 - DNA, 20 bp, Homo sapiens
gctgaggtcattatgcctca

SEQ ID NO: 8192634 - DNA, 22 bp, Homo sapiens
gctgaggtcaggagctgtgggg

SEQ ID NO: 8192635 - DNA, 22 bp, Homo sapiens
gctgaggtaggaggttgcagtg

SEQ ID NO: 8192636 - DNA, 23 bp, Homo sapiens
gctgaggtcctgctgagtggtgg

SEQ ID NO: 8192637 - DNA, 23 bp, Homo sapiens
gctgaggtcctgctgagtggtgg

SEQ ID NO: 8192638 - DNA, 23 bp, Homo sapiens
gctgaggtcctgctgagtggtgg

SEQ ID NO: 8192639 - DNA, 23 bp, Homo sapiens
gctgaggtcctgctgagtggtgg

SEQ ID NO: 8192640 - DNA, 22 bp, Homo sapiens
gctgaggtgaggctggaaagga

SEQ ID NO: 8192641 - DNA, 22 bp, Homo sapiens
gctgaggtggagattgcagtga

SEQ ID NO: 8192642 - DNA, 22 bp, Homo sapiens
gctgaggtgaggctggaaagga

SEQ ID NO: 8192643 - DNA, 22 bp, Homo sapiens
gctgaggtgaggctggaaagga

SEQ ID NO: 8192644 - DNA, 22 bp, Homo sapiens
gctgaggtgaggctggaaagga

SEQ ID NO: 8192645 - DNA, 20 bp, Homo sapiens
gctgaggtccctgtggtttt

SEQ ID NO: 8192646 - DNA, 20 bp, Homo sapiens
gctgaggtccctgtggtttt

SEQ ID NO: 8192647 - DNA, 20 bp, Homo sapiens
gctgaggtccctgtggtttt

SEQ ID NO: 8192648 - DNA, 20 bp, Homo sapiens
gctgaggtccctgtggtttt

SEQ ID NO: 8192649 - DNA, 22 bp, Homo sapiens
gctgaggtccagcattcgccta

SEQ ID NO: 8192650 - DNA, 20 bp, Homo sapiens
gctgaggtcattatgcctca

SEQ ID NO: 8192651 - DNA, 22 bp, Homo sapiens
gctggcagagagctggtgagga

SEQ ID NO: 8192652 - DNA, 22 bp, Homo sapiens
gctggcagagagctggtgagga

SEQ ID NO: 8192653 - DNA, 22 bp, Homo sapiens
gctggcagagagctggtgagga

SEQ ID NO: 8192654 - DNA, 16 bp, Homo sapiens
gctggagggaggggtt

SEQ ID NO: 8192655 - DNA, 16 bp, Homo sapiens
gctggagggaggggtt

SEQ ID NO: 8192656 - DNA, 22 bp, Homo sapiens
gctgaggtggagattgcagtga

SEQ ID NO: 8192657 - DNA, 22 bp, Homo sapiens
gctgaggtggagattgcagtga

SEQ ID NO: 8192658 - DNA, 22 bp, Homo sapiens
gctgaggtggagattgcagtga

SEQ ID NO: 8192659 - DNA, 19 bp, Homo sapiens
gctgaggtggaggaaggag

SEQ ID NO: 8192660 - DNA, 19 bp, Homo sapiens
gctgaggtggaggaaggag

SEQ ID NO: 8192661 - DNA, 19 bp, Homo sapiens
gctgaggtggaggaaggag

SEQ ID NO: 8192662 - DNA, 19 bp, Homo sapiens
gctgaggtggaggaaggag

SEQ ID NO: 8192663 - DNA, 22 bp, Homo sapiens
gctggcagagctctgggctggg

SEQ ID NO: 8192664 - DNA, 22 bp, Homo sapiens
gctggcagagagctggtgagga

SEQ ID NO: 8192665 - DNA, 22 bp, Homo sapiens
gctggcagagagctggtgagga

SEQ ID NO: 8192666 - DNA, 22 bp, Homo sapiens
gctggcagagagctggtgagga

SEQ ID NO: 8192667 - DNA, 22 bp, Homo sapiens
gctggcagagctctgggctggg

SEQ ID NO: 8192668 - DNA, 22 bp, Homo sapiens
gctggcagagctctgggctggg

SEQ ID NO: 8192669 - DNA, 22 bp, Homo sapiens
gctggcagagctctgggctggg

SEQ ID NO: 8192670 - DNA, 22 bp, Homo sapiens
gctggcagagctctgggctggg

SEQ ID NO: 8192671 - DNA, 20 bp, Homo sapiens
gctggcagatgtcttgagat

SEQ ID NO: 8192672 - DNA, 22 bp, Homo sapiens
gctggcagagctctgggctggg

SEQ ID NO: 8192673 - DNA, 22 bp, Homo sapiens
gctggcagccaagtgaagaggg

SEQ ID NO: 8192674 - DNA, 22 bp, Homo sapiens
gctggcagccaagtgaagaggg

SEQ ID NO: 8192675 - DNA, 22 bp, Homo sapiens
gctggcagccaagtgaagaggg

SEQ ID NO: 8192676 - DNA, 22 bp, Homo sapiens
gctggcagcattagaccctggg

SEQ ID NO: 8192677 - DNA, 22 bp, Homo sapiens
gctggcagcattagaccctggg

SEQ ID NO: 8192678 - DNA, 22 bp, Homo sapiens
gctggccagtgtggtgaccacc

SEQ ID NO: 8192679 - DNA, 22 bp, Homo sapiens
gctggccagtgtggtgaccacc

SEQ ID NO: 8192680 - DNA, 22 bp, Homo sapiens
gctggccagtgtggtgaccacc

SEQ ID NO: 8192681 - DNA, 22 bp, Homo sapiens
gctggccagtgtggtgaccacc

SEQ ID NO: 8192682 - DNA, 22 bp, Homo sapiens
gctggcagccaagtgaagaggg

SEQ ID NO: 8192683 - DNA, 19 bp, Homo sapiens
gctggcagatgtggccgtg

SEQ ID NO: 8192684 - DNA, 19 bp, Homo sapiens
gctggcagatgtggccgtg

SEQ ID NO: 8192685 - DNA, 19 bp, Homo sapiens
gctggcagatgtggccgtg

SEQ ID NO: 8192686 - DNA, 19 bp, Homo sapiens
gctggcagatgtggccgtg

SEQ ID NO: 8192687 - DNA, 19 bp, Homo sapiens
gctggcagatgtggccgtg

SEQ ID NO: 8192688 - DNA, 20 bp, Homo sapiens
gctggcagatgtcttgagat

SEQ ID NO: 8192689 - DNA, 19 bp, Homo sapiens
gctggcagatgtggccgtg

SEQ ID NO: 8192690 - DNA, 22 bp, Homo sapiens
gctggcagcattagaccctggg

SEQ ID NO: 8192691 - DNA, 22 bp, Homo sapiens
gctggcagcattagaccctggg

SEQ ID NO: 8192692 - DNA, 22 bp, Homo sapiens
gctggcagcattagaccctggg

SEQ ID NO: 8192693 - DNA, 22 bp, Homo sapiens
gctgggagccgtacctgtcacg

SEQ ID NO: 8192694 - DNA, 22 bp, Homo sapiens
gctgggagccctggtctgctcc

SEQ ID NO: 8192695 - DNA, 22 bp, Homo sapiens
gctgggagccgtacctgtcacg

SEQ ID NO: 8192696 - DNA, 22 bp, Homo sapiens
gctgggagccgtacctgtcacg

SEQ ID NO: 8192697 - DNA, 22 bp, Homo sapiens
gctgggaggaatttggggaata

SEQ ID NO: 8192698 - DNA, 22 bp, Homo sapiens
gctgggaggaatttggggaata

SEQ ID NO: 8192699 - DNA, 22 bp, Homo sapiens
gctgggagccgtacctgtcacg

SEQ ID NO: 8192700 - DNA, 22 bp, Homo sapiens
gctgggaggaatttggggaata

SEQ ID NO: 8192701 - DNA, 22 bp, Homo sapiens
gctgggcccagatcccaggatc

SEQ ID NO: 8192702 - DNA, 22 bp, Homo sapiens
gctgggccgacctgggctgcag

SEQ ID NO: 8192703 - DNA, 21 bp, Homo sapiens
gctgggcctgtacttgccctg

SEQ ID NO: 8192704 - DNA, 20 bp, Homo sapiens
gctgggctaccactggccct

SEQ ID NO: 8192705 - DNA, 20 bp, Homo sapiens
gctgggctaccactggccct

SEQ ID NO: 8192706 - DNA, 20 bp, Homo sapiens
gctgggctaccactggccct

SEQ ID NO: 8192707 - DNA, 22 bp, Homo sapiens
gctgggccctgggtgccctagc

SEQ ID NO: 8192708 - DNA, 22 bp, Homo sapiens
gctgggccccatccctcgagca

SEQ ID NO: 8192709 - DNA, 22 bp, Homo sapiens
gctgggccccatccctcgagca

SEQ ID NO: 8192710 - DNA, 22 bp, Homo sapiens
gctggcccagcgcccagggcag

SEQ ID NO: 8192711 - DNA, 21 bp, Homo sapiens
gctggctgtcccagggaagca

SEQ ID NO: 8192712 - DNA, 22 bp, Homo sapiens
gctggcccagcgcccagggcag

SEQ ID NO: 8192713 - DNA, 22 bp, Homo sapiens
gctggcccagcgcccagggcag

SEQ ID NO: 8192714 - DNA, 22 bp, Homo sapiens
gctggccattctctttgagatg

SEQ ID NO: 8192715 - DNA, 22 bp, Homo sapiens
gctggccatggggagtgaggag

SEQ ID NO: 8192716 - DNA, 22 bp, Homo sapiens
gctggccatggggagtgaggag

SEQ ID NO: 8192717 - DNA, 22 bp, Homo sapiens
gctggccatggggagtgaggag

SEQ ID NO: 8192718 - DNA, 22 bp, Homo sapiens
gctggccatggggagtgaggag

SEQ ID NO: 8192719 - DNA, 22 bp, Homo sapiens
gctggccatggggagtgaggag

SEQ ID NO: 8192720 - DNA, 22 bp, Homo sapiens
gctggccatggcctgcgccatc

SEQ ID NO: 8192721 - DNA, 22 bp, Homo sapiens
gctggccatggcctgcgccatc

SEQ ID NO: 8192722 - DNA, 22 bp, Homo sapiens
gctggccatggcctgcgccatc

SEQ ID NO: 8192723 - DNA, 22 bp, Homo sapiens
gctggccatagaagccaaagag

SEQ ID NO: 8192724 - DNA, 22 bp, Homo sapiens
gctggccatagaagccaaagag

SEQ ID NO: 8192725 - DNA, 22 bp, Homo sapiens
gctggccatatattttgctgtt

SEQ ID NO: 8192726 - DNA, 22 bp, Homo sapiens
gctggccatatattttgctgtt

SEQ ID NO: 8192727 - DNA, 22 bp, Homo sapiens
gctgggagcaaagccatgcata

SEQ ID NO: 8192728 - DNA, 22 bp, Homo sapiens
gctgggagcaagtactcatctt

SEQ ID NO: 8192729 - DNA, 22 bp, Homo sapiens
gctgggagcaagtactcatctt

SEQ ID NO: 8192730 - DNA, 19 bp, Homo sapiens
gctgggagcagaccctccc

SEQ ID NO: 8192731 - DNA, 19 bp, Homo sapiens
gctgggagcagaccctccc

SEQ ID NO: 8192732 - DNA, 22 bp, Homo sapiens
gctgggagcaaagccatgcata

SEQ ID NO: 8192733 - DNA, 22 bp, Homo sapiens
gctggctgtgattttgccaaca

SEQ ID NO: 8192734 - DNA, 21 bp, Homo sapiens
gctggctgtctcttacacggt

SEQ ID NO: 8192735 - DNA, 22 bp, Homo sapiens
gctggctgtgattttgccaaca

SEQ ID NO: 8192736 - DNA, 21 bp, Homo sapiens
gctggctgtctcttacacggt

SEQ ID NO: 8192737 - DNA, 19 bp, Homo sapiens
gctgggagcagaccctccc

SEQ ID NO: 8192738 - DNA, 22 bp, Homo sapiens
gctgggagccccgagccagcgc

SEQ ID NO: 8192739 - DNA, 22 bp, Homo sapiens
gctgggagccccgagccagcgc

SEQ ID NO: 8192740 - DNA, 22 bp, Homo sapiens
gctgggagccctggtctgctcc

SEQ ID NO: 8192741 - DNA, 22 bp, Homo sapiens
gctgggagccctggtctgctcc

SEQ ID NO: 8192742 - DNA, 22 bp, Homo sapiens
gctgggagccctggtctgctcc

SEQ ID NO: 8192743 - DNA, 22 bp, Homo sapiens
gctgggagccctggtctgctcc

SEQ ID NO: 8192744 - DNA, 22 bp, Homo sapiens
caagtttaaagtgaggtttgaa

SEQ ID NO: 8192745 - DNA, 22 bp, Homo sapiens
gctggtctagggatgggcgtat

SEQ ID NO: 8192746 - DNA, 22 bp, Homo sapiens
gctggtgagattttatgtttcc

SEQ ID NO: 8192747 - DNA, 22 bp, Homo sapiens
gctggtgagcaaaggagaagga

SEQ ID NO: 8192748 - DNA, 22 bp, Homo sapiens
gctggtgcattagctgcagttc

SEQ ID NO: 8192749 - DNA, 22 bp, Homo sapiens
gctggtgcattagctgcagttc

SEQ ID NO: 8192750 - DNA, 22 bp, Homo sapiens
gctggtggcagagacatcaggt

SEQ ID NO: 8192751 - DNA, 22 bp, Homo sapiens
gctggtgcattagctgcagttc

SEQ ID NO: 8192752 - DNA, 22 bp, Homo sapiens
gctggtgcattagctgcagttc

SEQ ID NO: 8192753 - DNA, 22 bp, Homo sapiens
gctggtgccttgttgttgttac

SEQ ID NO: 8192754 - DNA, 20 bp, Homo sapiens
gctggtgggggcttgacatg

SEQ ID NO: 8192755 - DNA, 22 bp, Homo sapiens
gctggtggcagagctccgcggc

SEQ ID NO: 8192756 - DNA, 22 bp, Homo sapiens
gctggtggtaaggaggaaaaag

SEQ ID NO: 8192757 - DNA, 22 bp, Homo sapiens
caatgcatacttcgaaatttca

SEQ ID NO: 8192758 - DNA, 22 bp, Homo sapiens
caatgcaatgcaatgcaatgca

SEQ ID NO: 8192759 - DNA, 22 bp, Homo sapiens
caatgattgctatttacataaa

SEQ ID NO: 8192760 - DNA, 22 bp, Homo sapiens
gctggtggtgggccagttctgt

SEQ ID NO: 8192761 - DNA, 22 bp, Homo sapiens
gctggtgtgtgaacctagggac

SEQ ID NO: 8192762 - DNA, 22 bp, Homo sapiens
gctggtggttaccgtgctaatg

SEQ ID NO: 8192763 - DNA, 22 bp, Homo sapiens
gctggtgtctaacctggctctt

SEQ ID NO: 8192764 - DNA, 22 bp, Homo sapiens
gctggtgtctaacctggctctt

SEQ ID NO: 8192765 - DNA, 22 bp, Homo sapiens
gctgtaaagaacattaggaatc

SEQ ID NO: 8192766 - DNA, 22 bp, Homo sapiens
gctggtttccttatctataaag

SEQ ID NO: 8192767 - DNA, 22 bp, Homo sapiens
gctggtttccttatctataaag

SEQ ID NO: 8192768 - DNA, 22 bp, Homo sapiens
gctggttagaaaacagagctca

SEQ ID NO: 8192769 - DNA, 22 bp, Homo sapiens
caagtcacatggccaactgatg

SEQ ID NO: 8192770 - DNA, 22 bp, Homo sapiens
caagtcaatgattataagagtc

SEQ ID NO: 8192771 - DNA, 22 bp, Homo sapiens
gctgggctcaccaggccactag

SEQ ID NO: 8192772 - DNA, 22 bp, Homo sapiens
caagtgatcctcccatcttggc

SEQ ID NO: 8192773 - DNA, 23 bp, Homo sapiens
caagtgcaccagatatacaggtc

SEQ ID NO: 8192774 - DNA, 22 bp, Homo sapiens
caagtgatcagacactgaagtc

SEQ ID NO: 8192775 - DNA, 22 bp, Homo sapiens
caagtgcatggtggcaaagaat

SEQ ID NO: 8192776 - DNA, 22 bp, Homo sapiens
caagtgtccatgatagtcttag

SEQ ID NO: 8192777 - DNA, 22 bp, Homo sapiens
caagtgtgtaattactgggagc

SEQ ID NO: 8192778 - DNA, 22 bp, Homo sapiens
caagtgtcttcaaaggctaaaa

SEQ ID NO: 8192779 - DNA, 22 bp, Homo sapiens
caagtgtctatatcagtgcttg

SEQ ID NO: 8192780 - DNA, 22 bp, Homo sapiens
caagtgtctatatcagtgcttg

SEQ ID NO: 8192781 - DNA, 19 bp, Homo sapiens
caagttctggagattaggg

SEQ ID NO: 8192782 - DNA, 21 bp, Homo sapiens
caagttctgtgtcttactcct

SEQ ID NO: 8192783 - DNA, 22 bp, Homo sapiens
caagttcttaactctgagcagc

SEQ ID NO: 8192784 - DNA, 22 bp, Homo sapiens
caagttcttaactctgagcagc

SEQ ID NO: 8192785 - DNA, 22 bp, Homo sapiens
caagttctactgggacatcagt

SEQ ID NO: 8192786 - DNA, 22 bp, Homo sapiens
caagttctactgggacatcagt

SEQ ID NO: 8192787 - DNA, 21 bp, Homo sapiens
caagttctgctgaatcttctt

SEQ ID NO: 8192788 - DNA, 22 bp, Homo sapiens
caagttatcagggcagttagag

SEQ ID NO: 8192789 - DNA, 22 bp, Homo sapiens
caagttatcagggcagttagag

SEQ ID NO: 8192790 - DNA, 22 bp, Homo sapiens
caagttattcctttacactata

SEQ ID NO: 8192791 - DNA, 22 bp, Homo sapiens
caagttcacgttgctttttgag

SEQ ID NO: 8192792 - DNA, 22 bp, Homo sapiens
caagttatttcattggaacaat

SEQ ID NO: 8192793 - DNA, 19 bp, Homo sapiens
gcttccagcactgcaggag

SEQ ID NO: 8192794 - DNA, 19 bp, Homo sapiens
gcttccagcactgcaggag

SEQ ID NO: 8192795 - DNA, 20 bp, Homo sapiens
gcttccaggagggctgatat

SEQ ID NO: 8192796 - DNA, 22 bp, Homo sapiens
gcttccagccttttctcctctg

SEQ ID NO: 8192797 - DNA, 22 bp, Homo sapiens
ggaaatgacttggtgcttcgtt

SEQ ID NO: 8192798 - DNA, 22 bp, Homo sapiens
ggaaaatttccttcaaaatgtg

SEQ ID NO: 8192799 - DNA, 22 bp, Homo sapiens
ggaaaatttccttcaaaatgtg

SEQ ID NO: 8192800 - DNA, 22 bp, Homo sapiens
gcttccaggcttcctacctttg

SEQ ID NO: 8192801 - DNA, 22 bp, Homo sapiens
ggaaatgtatgattctcatcag

SEQ ID NO: 8192802 - DNA, 18 bp, Homo sapiens
ggaaatgtttggtactag

SEQ ID NO: 8192803 - DNA, 22 bp, Homo sapiens
gcttccagaccccagtccctca

SEQ ID NO: 8192804 - DNA, 22 bp, Homo sapiens
gcttccagagactgagctcttc

SEQ ID NO: 8192805 - DNA, 22 bp, Homo sapiens
gcttccagagagccccgcctgg

SEQ ID NO: 8192806 - DNA, 22 bp, Homo sapiens
gcttccagatcccatgctctta

SEQ ID NO: 8192807 - DNA, 22 bp, Homo sapiens
gcttccagcaaacactggctgc

SEQ ID NO: 8192808 - DNA, 22 bp, Homo sapiens
caatgtactacaaagattgtca

SEQ ID NO: 8192809 - DNA, 22 bp, Homo sapiens
caatgtaaatattttctaatca

SEQ ID NO: 8192810 - DNA, 22 bp, Homo sapiens
gcttccacttgggaacctctct

SEQ ID NO: 8192811 - DNA, 22 bp, Homo sapiens
gcttccagaccccagtccctca

SEQ ID NO: 8192812 - DNA, 22 bp, Homo sapiens
caatgctgtgctcctcatgagg

SEQ ID NO: 8192813 - DNA, 22 bp, Homo sapiens
caatgctgtgctcctcatgagg

SEQ ID NO: 8192814 - DNA, 22 bp, Homo sapiens
caatggctggagacaatctgct

SEQ ID NO: 8192815 - DNA, 21 bp, Homo sapiens
caatggcgagatcttggctca

SEQ ID NO: 8192816 - DNA, 22 bp, Homo sapiens
caatggaggtttactctgcagc

SEQ ID NO: 8192817 - DNA, 22 bp, Homo sapiens
caatggcactgcccaaagagaa

SEQ ID NO: 8192818 - DNA, 19 bp, Homo sapiens
cagaaatagcgaagtgtaa

SEQ ID NO: 8192819 - DNA, 22 bp, Homo sapiens
cagaaatgcctgcttctctctc

SEQ ID NO: 8192820 - DNA, 21 bp, Homo sapiens
ggctgctgtcaccgctgtcac

SEQ ID NO: 8192821 - DNA, 21 bp, Homo sapiens
ggctgctgtcaccgctgtcac

SEQ ID NO: 8192822 - DNA, 22 bp, Homo sapiens
cagaaatagacaatggcagtgg

SEQ ID NO: 8192823 - DNA, 22 bp, Homo sapiens
cagaaatggaattttccatcac

SEQ ID NO: 8192824 - DNA, 22 bp, Homo sapiens
cagaaatggaattttccatcac

SEQ ID NO: 8192825 - DNA, 22 bp, Homo sapiens
cagaaatggagcccaggaatct

SEQ ID NO: 8192826 - DNA, 22 bp, Homo sapiens
cagaaatggagcccaggaatct

SEQ ID NO: 8192827 - DNA, 22 bp, Homo sapiens
cagaaatggagcccaggaatct

SEQ ID NO: 8192828 - DNA, 22 bp, Homo sapiens
cagaaatggtctgttcagctta

SEQ ID NO: 8192829 - DNA, 22 bp, Homo sapiens
cagaaatgtactgacatgcagt

SEQ ID NO: 8192830 - DNA, 22 bp, Homo sapiens
ggctgctggtggaatggtaggc

SEQ ID NO: 8192831 - DNA, 22 bp, Homo sapiens
ggctgctggtggaatggtaggc

SEQ ID NO: 8192832 - DNA, 19 bp, Homo sapiens
ggctgctggttacagaggc

SEQ ID NO: 8192833 - DNA, 22 bp, Homo sapiens
ggctgctggtaggggtaggaag

SEQ ID NO: 8192834 - DNA, 22 bp, Homo sapiens
ggctgctggtaggggtaggaag

SEQ ID NO: 8192835 - DNA, 22 bp, Homo sapiens
ggctgctggtaggggtaggaag

SEQ ID NO: 8192836 - DNA, 22 bp, Homo sapiens
ggctgctgggtcatgatgcaga

SEQ ID NO: 8192837 - DNA, 22 bp, Homo sapiens
ggctgctgggtcatgatgcaga

SEQ ID NO: 8192838 - DNA, 22 bp, Homo sapiens
ggctgctggtaggggtaggaag

SEQ ID NO: 8192839 - DNA, 22 bp, Homo sapiens
ggctgctgtactgatgtcagtt

SEQ ID NO: 8192840 - DNA, 20 bp, Homo sapiens
ggctgctggtttggctctgt

SEQ ID NO: 8192841 - DNA, 20 bp, Homo sapiens
ggctgctggtttggctctgt

SEQ ID NO: 8192842 - DNA, 20 bp, Homo sapiens
ggctgctggtttggctctgt

SEQ ID NO: 8192843 - DNA, 22 bp, Homo sapiens
ggctgctgtactgatgtcagtt

SEQ ID NO: 8192844 - DNA, 22 bp, Homo sapiens
ggctgctgtactgatgtcagtt

SEQ ID NO: 8192845 - DNA, 22 bp, Homo sapiens
ggctgctgtactgatgtcagtt

SEQ ID NO: 8192846 - DNA, 22 bp, Homo sapiens
ggctgctgtactgatgtcagtt

SEQ ID NO: 8192847 - DNA, 22 bp, Homo sapiens
cagaaatgtgatgtacacacac

SEQ ID NO: 8192848 - DNA, 22 bp, Homo sapiens
cagaaatgttctaatgattcag

SEQ ID NO: 8192849 - DNA, 22 bp, Homo sapiens
cagaaatgtttatatgtggtgt

SEQ ID NO: 8192850 - DNA, 22 bp, Homo sapiens
cagaaatgtttgttaatattgt

SEQ ID NO: 8192851 - DNA, 22 bp, Homo sapiens
cagaaatgtttgttaatattgt

SEQ ID NO: 8192852 - DNA, 22 bp, Homo sapiens
cagaaatgtttatgcttttgaa

SEQ ID NO: 8192853 - DNA, 22 bp, Homo sapiens
cagaacacattttcagagtcaa

SEQ ID NO: 8192854 - DNA, 23 bp, Homo sapiens
ggctgggagctccgggtgcacgt

SEQ ID NO: 8192855 - DNA, 23 bp, Homo sapiens
ggctgggagctccgggtgcacgt

SEQ ID NO: 8192856 - DNA, 23 bp, Homo sapiens
ggctgggagctccgggtgcacgt

SEQ ID NO: 8192857 - DNA, 23 bp, Homo sapiens
ggctgggagctccgggtgcacgt

SEQ ID NO: 8192858 - DNA, 23 bp, Homo sapiens
ggctgggagctccgggtgcacgt

SEQ ID NO: 8192859 - DNA, 23 bp, Homo sapiens
ggctgggagctccgggtgcacgt

SEQ ID NO: 8192860 - DNA, 23 bp, Homo sapiens
ggctgggagctccgggtgcacgt

SEQ ID NO: 8192861 - DNA, 22 bp, Homo sapiens
ggctgggagccccacagagtca

SEQ ID NO: 8192862 - DNA, 22 bp, Homo sapiens
cagaacagacttaacagggctg

SEQ ID NO: 8192863 - DNA, 22 bp, Homo sapiens
ggctggctttctctccgcacct

SEQ ID NO: 8192864 - DNA, 22 bp, Homo sapiens
ggctgggacgatgaggattagt

SEQ ID NO: 8192865 - DNA, 22 bp, Homo sapiens
ggctggctttctctccgcacct

SEQ ID NO: 8192866 - DNA, 22 bp, Homo sapiens
ggctggctttctctccgcacct

SEQ ID NO: 8192867 - DNA, 22 bp, Homo sapiens
ggctgggagccccacagagtca

SEQ ID NO: 8192868 - DNA, 22 bp, Homo sapiens
ggctgggagccccacagagtca

SEQ ID NO: 8192869 - DNA, 22 bp, Homo sapiens
ggctgggagctggacaggccgg

SEQ ID NO: 8192870 - DNA, 17 bp, Homo sapiens
ggcttcagggagctggg

SEQ ID NO: 8192871 - DNA, 22 bp, Homo sapiens
ggctgggagctggacaggccgg

SEQ ID NO: 8192872 - DNA, 22 bp, Homo sapiens
ggctgggagctggacaggccgg

SEQ ID NO: 8192873 - DNA, 22 bp, Homo sapiens
ggcttcaggggcccagtcagca

SEQ ID NO: 8192874 - DNA, 22 bp, Homo sapiens
ggcttcaggggcccagtcagca

SEQ ID NO: 8192875 - DNA, 22 bp, Homo sapiens
ggcttcttcctggctcctatta

SEQ ID NO: 8192876 - DNA, 22 bp, Homo sapiens
ggcttcttcctggctcctatta

SEQ ID NO: 8192877 - DNA, 22 bp, Homo sapiens
ggcttcttctctgtgtccagca

SEQ ID NO: 8192878 - DNA, 20 bp, Homo sapiens
ggcttctttacatctgtgtt

SEQ ID NO: 8192879 - DNA, 20 bp, Homo sapiens
ggcttctttacatctgtgtt

SEQ ID NO: 8192880 - DNA, 22 bp, Homo sapiens
ggcttcttgtgtgtcaggctct

SEQ ID NO: 8192881 - DNA, 22 bp, Homo sapiens
ggcttcttgtgtgtcaggctct

SEQ ID NO: 8192882 - DNA, 22 bp, Homo sapiens
ggcttctttgtaacgtgccagc

SEQ ID NO: 8192883 - DNA, 22 bp, Homo sapiens
ggcttgaagactatgacatttc

SEQ ID NO: 8192884 - DNA, 22 bp, Homo sapiens
ggcttctttttagtaaatgtca

SEQ ID NO: 8192885 - DNA, 22 bp, Homo sapiens
cagaacagacttaacagggctg

SEQ ID NO: 8192886 - DNA, 22 bp, Homo sapiens
ggcttggaattggtaggatgta

SEQ ID NO: 8192887 - DNA, 22 bp, Homo sapiens
ggcttggcccaggcctcactcc

SEQ ID NO: 8192888 - DNA, 22 bp, Homo sapiens
ggcttggaaactagagtgtgca

SEQ ID NO: 8192889 - DNA, 22 bp, Homo sapiens
ggcttgcttcttgtccaggaat

SEQ ID NO: 8192890 - DNA, 22 bp, Homo sapiens
ggcttgcttcttgtccaggaat

SEQ ID NO: 8192891 - DNA, 20 bp, Homo sapiens
ggcttgagtcagatcttgga

SEQ ID NO: 8192892 - DNA, 22 bp, Homo sapiens
ggcttgagacccgggagccaga

SEQ ID NO: 8192893 - DNA, 23 bp, Homo sapiens
ggcttgagctggaacagcttggt

SEQ ID NO: 8192894 - DNA, 19 bp, Homo sapiens
cagaacaggaccaggggcc

SEQ ID NO: 8192895 - DNA, 19 bp, Homo sapiens
cagaacagctgggaagaga

SEQ ID NO: 8192896 - DNA, 20 bp, Homo sapiens
cagaacagtctgagaggcca

SEQ ID NO: 8192897 - DNA, 22 bp, Homo sapiens
cagaacagtcgcctgcatggat

SEQ ID NO: 8192898 - DNA, 20 bp, Homo sapiens
cagaacatgagcatcgagcc

SEQ ID NO: 8192899 - DNA, 22 bp, Homo sapiens
cagaacatccccactgctacct

SEQ ID NO: 8192900 - DNA, 20 bp, Homo sapiens
cagaacatgagcatcgagcc

SEQ ID NO: 8192901 - DNA, 22 bp, Homo sapiens
cagaacatgatataaacagaag

SEQ ID NO: 8192902 - DNA, 22 bp, Homo sapiens
cagaacatgatataaacagaag

SEQ ID NO: 8192903 - DNA, 22 bp, Homo sapiens
cagaacattcactcatatgtgg

SEQ ID NO: 8192904 - DNA, 22 bp, Homo sapiens
cagaagagtagctgaacaagtt

SEQ ID NO: 8192905 - DNA, 22 bp, Homo sapiens
cagaagagtagctgaacaagtt

SEQ ID NO: 8192906 - DNA, 22 bp, Homo sapiens
cagaagaggactgggtagctca

SEQ ID NO: 8192907 - DNA, 22 bp, Homo sapiens
cagaagaggactgggtagctca

SEQ ID NO: 8192908 - DNA, 22 bp, Homo sapiens
cagaacattcttgccagtacat

SEQ ID NO: 8192909 - DNA, 22 bp, Homo sapiens
cagaacattcactcatatgtgg

SEQ ID NO: 8192910 - DNA, 22 bp, Homo sapiens
cagaacattccatgtgccctgc

SEQ ID NO: 8192911 - DNA, 22 bp, Homo sapiens
ggctgctcggagcctcctgtga

SEQ ID NO: 8192912 - DNA, 22 bp, Homo sapiens
ggctgctgggtcatgatgcaga

SEQ ID NO: 8192913 - DNA, 22 bp, Homo sapiens
ggctgctcctttaccctggcag

SEQ ID NO: 8192914 - DNA, 22 bp, Homo sapiens
ggctgctcctttaccctggcag

SEQ ID NO: 8192915 - DNA, 22 bp, Homo sapiens
ggctgctcctttaccctggcag

SEQ ID NO: 8192916 - DNA, 22 bp, Homo sapiens
ggctgctcacgcagccctccct

SEQ ID NO: 8192917 - DNA, 22 bp, Homo sapiens
ggctgctcacgcagccctccct

SEQ ID NO: 8192918 - DNA, 18 bp, Homo sapiens
ggctgctcctctccctac

SEQ ID NO: 8192919 - DNA, 21 bp, Homo sapiens
ggctgctcacctaggtcccaa

SEQ ID NO: 8192920 - DNA, 21 bp, Homo sapiens
ggctgctcacctaggtcccaa

SEQ ID NO: 8192921 - DNA, 21 bp, Homo sapiens
ggctgctcacctaggtcccaa

SEQ ID NO: 8192922 - DNA, 22 bp, Homo sapiens
ggctgcggatctaaggctggga

SEQ ID NO: 8192923 - DNA, 22 bp, Homo sapiens
ggctgcggatctaaggctggga

SEQ ID NO: 8192924 - DNA, 23 bp, Homo sapiens
ggctgcgagtgcctgggcctgtg

SEQ ID NO: 8192925 - DNA, 22 bp, Homo sapiens
ggctgctcaaggactctgatcg

SEQ ID NO: 8192926 - DNA, 19 bp, Homo sapiens
ggctgcctttccttaccag

SEQ ID NO: 8192927 - DNA, 19 bp, Homo sapiens
ggctgcctttccttaccag

SEQ ID NO: 8192928 - DNA, 22 bp, Homo sapiens
ggctgcctcaattaatcttaca

SEQ ID NO: 8192929 - DNA, 22 bp, Homo sapiens
ggctgccttgaccctggctccg

SEQ ID NO: 8192930 - DNA, 22 bp, Homo sapiens
cactgtcttttgtgaagacaat

SEQ ID NO: 8192931 - DNA, 22 bp, Homo sapiens
cactgtgaaaaatggagtggtc

SEQ ID NO: 8192932 - DNA, 22 bp, Homo sapiens
cactgtcttcagtttcactgca

SEQ ID NO: 8192933 - DNA, 22 bp, Homo sapiens
cactgtcttttgtgaagacaat

SEQ ID NO: 8192934 - DNA, 22 bp, Homo sapiens
cactgtctgagctggtgattag

SEQ ID NO: 8192935 - DNA, 22 bp, Homo sapiens
cactgtctgcttcgactcttca

SEQ ID NO: 8192936 - DNA, 22 bp, Homo sapiens
cactgtctgggacatgtggtct

SEQ ID NO: 8192937 - DNA, 22 bp, Homo sapiens
cactgtctgggacatgtggtct

SEQ ID NO: 8192938 - DNA, 22 bp, Homo sapiens
ggctgcagatagccagccacca

SEQ ID NO: 8192939 - DNA, 22 bp, Homo sapiens
ggctgcagattgtagtctgtta

SEQ ID NO: 8192940 - DNA, 22 bp, Homo sapiens
ggctgcagattgtagtctgtta

SEQ ID NO: 8192941 - DNA, 22 bp, Homo sapiens
ggctgcagattgtagtctgtta

SEQ ID NO: 8192942 - DNA, 22 bp, Homo sapiens
ggctgcagatagccagccacca

SEQ ID NO: 8192943 - DNA, 22 bp, Homo sapiens
ggctgcagatagccagccacca

SEQ ID NO: 8192944 - DNA, 22 bp, Homo sapiens
ggctgcagatagccagccacca

SEQ ID NO: 8192945 - DNA, 22 bp, Homo sapiens
ggctgcagatagccagccacca

SEQ ID NO: 8192946 - DNA, 22 bp, Homo sapiens
ggctgaggctcatgccatcttg

SEQ ID NO: 8192947 - DNA, 22 bp, Homo sapiens
ggctgaggctcatgccatcttg

SEQ ID NO: 8192948 - DNA, 22 bp, Homo sapiens
ggctgcagaggcgatctgaggt

SEQ ID NO: 8192949 - DNA, 22 bp, Homo sapiens
ggctgcagaggcgatctgaggt

SEQ ID NO: 8192950 - DNA, 22 bp, Homo sapiens
cactgcctccccaggctccaca

SEQ ID NO: 8192951 - DNA, 22 bp, Homo sapiens
cactgcctccccaggctccaca

SEQ ID NO: 8192952 - DNA, 22 bp, Homo sapiens
cactgcctgctggctgtcactt

SEQ ID NO: 8192953 - DNA, 22 bp, Homo sapiens
cactgcctctgcctcctgggtt

SEQ ID NO: 8192954 - DNA, 22 bp, Homo sapiens
ggctgcagattgtagtctgtta

SEQ ID NO: 8192955 - DNA, 22 bp, Homo sapiens
ggctgcagcagagggactcacg

SEQ ID NO: 8192956 - DNA, 22 bp, Homo sapiens
ggctgcagcagagggactcacg

SEQ ID NO: 8192957 - DNA, 22 bp, Homo sapiens
ggctgcagccctcgcctagcca

SEQ ID NO: 8192958 - DNA, 22 bp, Homo sapiens
ggctgcagcagagggactcacg

SEQ ID NO: 8192959 - DNA, 22 bp, Homo sapiens
ggctgcagcagagggactcacg

SEQ ID NO: 8192960 - DNA, 22 bp, Homo sapiens
ggctgcagccctcgcctagcca

SEQ ID NO: 8192961 - DNA, 22 bp, Homo sapiens
ggctgcagccctcgcctagcca

SEQ ID NO: 8192962 - DNA, 22 bp, Homo sapiens
ggctgcagccctcgcctagcca

SEQ ID NO: 8192963 - DNA, 22 bp, Homo sapiens
ggctgcagccctcgcctagcca

SEQ ID NO: 8192964 - DNA, 22 bp, Homo sapiens
ggctgcagcggattggggattg

SEQ ID NO: 8192965 - DNA, 22 bp, Homo sapiens
ggctgcagcggattggggattg

SEQ ID NO: 8192966 - DNA, 22 bp, Homo sapiens
ggctgcagcggattggggattg

SEQ ID NO: 8192967 - DNA, 22 bp, Homo sapiens
ggctgcagcggattggggattg

SEQ ID NO: 8192968 - DNA, 22 bp, Homo sapiens
ggctgcagcggattggggattg

SEQ ID NO: 8192969 - DNA, 22 bp, Homo sapiens
cactgtccatgcttgctaaccc

SEQ ID NO: 8192970 - DNA, 22 bp, Homo sapiens
cactgtctattaatataactta

SEQ ID NO: 8192971 - DNA, 22 bp, Homo sapiens
cactgtcctagtcttcctggag

SEQ ID NO: 8192972 - DNA, 22 bp, Homo sapiens
cactgtctattaatataactta

SEQ ID NO: 8192973 - DNA, 22 bp, Homo sapiens
cactgtccctgtttcctggaaa

SEQ ID NO: 8192974 - DNA, 22 bp, Homo sapiens
cactgtccctgtttcctggaaa

SEQ ID NO: 8192975 - DNA, 19 bp, Homo sapiens
cactgtcctagtcgaggcc

SEQ ID NO: 8192976 - DNA, 22 bp, Homo sapiens
ggctcctgtcctcctggagctc

SEQ ID NO: 8192977 - DNA, 22 bp, Homo sapiens
ggctcctgtcctcctggagctc

SEQ ID NO: 8192978 - DNA, 22 bp, Homo sapiens
ggctcctgtcctcctggagctc

SEQ ID NO: 8192979 - DNA, 22 bp, Homo sapiens
ggctcctgtcctcctggagctc

SEQ ID NO: 8192980 - DNA, 19 bp, Homo sapiens
ggctcctgtggctgcagcc

SEQ ID NO: 8192981 - DNA, 22 bp, Homo sapiens
ggctcctgtggcaagacagctt

SEQ ID NO: 8192982 - DNA, 22 bp, Homo sapiens
ggctcctgtggcaagacagctt

SEQ ID NO: 8192983 - DNA, 22 bp, Homo sapiens
ggctcctgtggcaagacagctt

SEQ ID NO: 8192984 - DNA, 22 bp, Homo sapiens
ggctcctgtggcaagacagctt

SEQ ID NO: 8192985 - DNA, 22 bp, Homo sapiens
ggctcctgtcccctcagctgct

SEQ ID NO: 8192986 - DNA, 22 bp, Homo sapiens
ggctcctgtcccctcagctgct

SEQ ID NO: 8192987 - DNA, 22 bp, Homo sapiens
ggctcctgtcccctcagctgct

SEQ ID NO: 8192988 - DNA, 22 bp, Homo sapiens
ggctcctgtcccctcagctgct

SEQ ID NO: 8192989 - DNA, 16 bp, Homo sapiens
ggctcctggttccttc

SEQ ID NO: 8192990 - DNA, 22 bp, Homo sapiens
cactgccctgggggttgccatc

SEQ ID NO: 8192991 - DNA, 22 bp, Homo sapiens
cactgcccttacatgccctgca

SEQ ID NO: 8192992 - DNA, 22 bp, Homo sapiens
cactgcccttacatgccctgca

SEQ ID NO: 8192993 - DNA, 22 bp, Homo sapiens
cactgcccttacatgccctgca

SEQ ID NO: 8192994 - DNA, 20 bp, Homo sapiens
cactgccctccagcctgagc

SEQ ID NO: 8192995 - DNA, 20 bp, Homo sapiens
cactgccctccagcctgagc

SEQ ID NO: 8192996 - DNA, 22 bp, Homo sapiens
cactgcccaggcacccatcttg

SEQ ID NO: 8192997 - DNA, 22 bp, Homo sapiens
cactgccctcactgtggttctc

SEQ ID NO: 8192998 - DNA, 22 bp, Homo sapiens
cactgcccaggcacccatcttg

SEQ ID NO: 8192999 - DNA, 22 bp, Homo sapiens
cactgcccaggacctgccaccc

SEQ ID NO: 8193000 - DNA, 22 bp, Homo sapiens
cactgcccaggcacccatcttg

SEQ ID NO: 8193001 - DNA, 22 bp, Homo sapiens
cactgcccaggacctgccaccc

SEQ ID NO: 8193002 - DNA, 22 bp, Homo sapiens
cactgcccaggacctgccaccc

SEQ ID NO: 8193003 - DNA, 22 bp, Homo sapiens
cactgcccagcgtcttaggcac

SEQ ID NO: 8193004 - DNA, 19 bp, Homo sapiens
ggctcctgtggctgcagcc

SEQ ID NO: 8193005 - DNA, 19 bp, Homo sapiens
ggctcctgtggctgcagcc

SEQ ID NO: 8193006 - DNA, 22 bp, Homo sapiens
ggcgctcagtgttgccccagag

SEQ ID NO: 8193007 - DNA, 20 bp, Homo sapiens
ggcgcctggcctcatggctg

SEQ ID NO: 8193008 - DNA, 22 bp, Homo sapiens
ggcgctctggacctggctctcg

SEQ ID NO: 8193009 - DNA, 22 bp, Homo sapiens
ggcgctggccacggtggctctg

SEQ ID NO: 8193010 - DNA, 22 bp, Homo sapiens
ggcgctctggacctggctctcg

SEQ ID NO: 8193011 - DNA, 22 bp, Homo sapiens
cactgagggcggagcccaggga

SEQ ID NO: 8193012 - DNA, 22 bp, Homo sapiens
cactgagggagggtttcttctg

SEQ ID NO: 8193013 - DNA, 22 bp, Homo sapiens
cactgagggcggagcccaggga

SEQ ID NO: 8193014 - DNA, 22 bp, Homo sapiens
cactgagggcggagcccaggga

SEQ ID NO: 8193015 - DNA, 22 bp, Homo sapiens
cactgagggcggagcccaggga

SEQ ID NO: 8193016 - DNA, 22 bp, Homo sapiens
cactgaggcttccttaggcaat

SEQ ID NO: 8193017 - DNA, 22 bp, Homo sapiens
cactgaggcttccttaggcaat

SEQ ID NO: 8193018 - DNA, 22 bp, Homo sapiens
cactgagggagggtttcttctg

SEQ ID NO: 8193019 - DNA, 22 bp, Homo sapiens
cactgaggtatctgtctctcct

SEQ ID NO: 8193020 - DNA, 22 bp, Homo sapiens
cactgaggtatctgtctctcct

SEQ ID NO: 8193021 - DNA, 22 bp, Homo sapiens
cactgaggtatctgtctctcct

SEQ ID NO: 8193022 - DNA, 22 bp, Homo sapiens
cactgaggtatctgtctctcct

SEQ ID NO: 8193023 - DNA, 22 bp, Homo sapiens
cactgaggtatctgtctctcct

SEQ ID NO: 8193024 - DNA, 22 bp, Homo sapiens
cactgagggggtggtttcagga

SEQ ID NO: 8193025 - DNA, 22 bp, Homo sapiens
cactgaggtatctgtctctcct

SEQ ID NO: 8193026 - DNA, 22 bp, Homo sapiens
cactgagggggtggtttcagga

SEQ ID NO: 8193027 - DNA, 22 bp, Homo sapiens
cactgagggcggagcccaggga

SEQ ID NO: 8193028 - DNA, 22 bp, Homo sapiens
ggctcctgggggtgctcctgcc

SEQ ID NO: 8193029 - DNA, 19 bp, Homo sapiens
ggctcctggggctcagccc

SEQ ID NO: 8193030 - DNA, 19 bp, Homo sapiens
ggctcctggggctcagccc

SEQ ID NO: 8193031 - DNA, 22 bp, Homo sapiens
ggctccagtttgtgccttcagc

SEQ ID NO: 8193032 - DNA, 22 bp, Homo sapiens
ggctccagtttccccttggggc

SEQ ID NO: 8193033 - DNA, 22 bp, Homo sapiens
ggctccagtttccccttggggc

SEQ ID NO: 8193034 - DNA, 22 bp, Homo sapiens
cactgcaacctccacctcctgg

SEQ ID NO: 8193035 - DNA, 22 bp, Homo sapiens
cactgcaacctccacctcctgg

SEQ ID NO: 8193036 - DNA, 22 bp, Homo sapiens
cactgattaagtctgctagagg

SEQ ID NO: 8193037 - DNA, 22 bp, Homo sapiens
cactgatactatagagacctca

SEQ ID NO: 8193038 - DNA, 22 bp, Homo sapiens
cactgagttccctgacatttca

SEQ ID NO: 8193039 - DNA, 22 bp, Homo sapiens
cactgcaacctccacctcctgg

SEQ ID NO: 8193040 - DNA, 20 bp, Homo sapiens
cactgaggtgcagctcatgc

SEQ ID NO: 8193041 - DNA, 20 bp, Homo sapiens
cactgaggtgcagctcatgc

SEQ ID NO: 8193042 - DNA, 21 bp, Homo sapiens
cactgaggtcaggggtagggt

SEQ ID NO: 8193043 - DNA, 22 bp, Homo sapiens
cactgaggtatctgtctctcct

SEQ ID NO: 8193044 - DNA, 22 bp, Homo sapiens
cactgaggtttgttaactgagt

SEQ ID NO: 8193045 - DNA, 22 bp, Homo sapiens
cactgaggtttgttaactgagt

SEQ ID NO: 8193046 - DNA, 20 bp, Homo sapiens
cactgaggtgcagctcatgc

SEQ ID NO: 8193047 - DNA, 22 bp, Homo sapiens
cacatttttactgccaacttaa

SEQ ID NO: 8193048 - DNA, 19 bp, Homo sapiens
cacattttgagtctgagat

SEQ ID NO: 8193049 - DNA, 19 bp, Homo sapiens
cacattttgagtctgagat

SEQ ID NO: 8193050 - DNA, 19 bp, Homo sapiens
caccaagatggctctagtc

SEQ ID NO: 8193051 - DNA, 22 bp, Homo sapiens
caccaataattttatatcacat

SEQ ID NO: 8193052 - DNA, 19 bp, Homo sapiens
caccaagatggctctagtc

SEQ ID NO: 8193053 - DNA, 22 bp, Homo sapiens
caccaagactgtataccaggca

SEQ ID NO: 8193054 - DNA, 17 bp, Homo sapiens
caccaattaagaccctc

SEQ ID NO: 8193055 - DNA, 22 bp, Homo sapiens
caccacagcatccactagaagg

SEQ ID NO: 8193056 - DNA, 22 bp, Homo sapiens
caccacagcatccactagaagg

SEQ ID NO: 8193057 - DNA, 22 bp, Homo sapiens
ggccagctacccatctgcgtca

SEQ ID NO: 8193058 - DNA, 22 bp, Homo sapiens
ggccagcggcacagcctggccc

SEQ ID NO: 8193059 - DNA, 22 bp, Homo sapiens
ggccagcggcacagcctggccc

SEQ ID NO: 8193060 - DNA, 22 bp, Homo sapiens
ggccagcggcacagcctggccc

SEQ ID NO: 8193061 - DNA, 22 bp, Homo sapiens
ggccagcctggggctcccagac

SEQ ID NO: 8193062 - DNA, 22 bp, Homo sapiens
ggccagcctggggctcccagac

SEQ ID NO: 8193063 - DNA, 22 bp, Homo sapiens
ggccagccctcctccctgggtt

SEQ ID NO: 8193064 - DNA, 22 bp, Homo sapiens
ggccagcctggggctcccagac

SEQ ID NO: 8193065 - DNA, 22 bp, Homo sapiens
ggccagccctcctccctgggtt

SEQ ID NO: 8193066 - DNA, 22 bp, Homo sapiens
ggccagcctggggctcccagac

SEQ ID NO: 8193067 - DNA, 22 bp, Homo sapiens
ggccagcccagtggtcctctct

SEQ ID NO: 8193068 - DNA, 22 bp, Homo sapiens
ggccagcccagtggtcctctct

SEQ ID NO: 8193069 - DNA, 22 bp, Homo sapiens
ggccacttggcagatggcagct

SEQ ID NO: 8193070 - DNA, 22 bp, Homo sapiens
ggccactgtttcctgggcagtt

SEQ ID NO: 8193071 - DNA, 22 bp, Homo sapiens
ggccactgtttcctgggcagtt

SEQ ID NO: 8193072 - DNA, 22 bp, Homo sapiens
ggccagccctcctccctgggtt

SEQ ID NO: 8193073 - DNA, 18 bp, Homo sapiens
ggccagccccaggccagc

SEQ ID NO: 8193074 - DNA, 18 bp, Homo sapiens
ggccagccccaggccagc

SEQ ID NO: 8193075 - DNA, 18 bp, Homo sapiens
ggccagccccaggccagc

SEQ ID NO: 8193076 - DNA, 18 bp, Homo sapiens
ggccagccccaggccagc

SEQ ID NO: 8193077 - DNA, 18 bp, Homo sapiens
ggccagccccaggccagc

SEQ ID NO: 8193078 - DNA, 18 bp, Homo sapiens
ggccagccccaggccagc

SEQ ID NO: 8193079 - DNA, 21 bp, Homo sapiens
ggccagctcggaaggtcccat

SEQ ID NO: 8193080 - DNA, 21 bp, Homo sapiens
ggccagctcggaaggtcccat

SEQ ID NO: 8193081 - DNA, 22 bp, Homo sapiens
cacccagcagcacttaagacta

SEQ ID NO: 8193082 - DNA, 22 bp, Homo sapiens
cacccagccttcacacaggagt

SEQ ID NO: 8193083 - DNA, 22 bp, Homo sapiens
cacccagcttttgcatcctccg

SEQ ID NO: 8193084 - DNA, 22 bp, Homo sapiens
cacccagcttttgcatcctccg

SEQ ID NO: 8193085 - DNA, 22 bp, Homo sapiens
ggccagctccttggcagtgcct

SEQ ID NO: 8193086 - DNA, 22 bp, Homo sapiens
ggccagctccttggcagtgcct

SEQ ID NO: 8193087 - DNA, 18 bp, Homo sapiens
ggccagctcctgaggcag

SEQ ID NO: 8193088 - DNA, 18 bp, Homo sapiens
ggccagctcctgaggcag

SEQ ID NO: 8193089 - DNA, 18 bp, Homo sapiens
ggccagctcctgaggcag

SEQ ID NO: 8193090 - DNA, 22 bp, Homo sapiens
ggccagctcagactccacttgc

SEQ ID NO: 8193091 - DNA, 22 bp, Homo sapiens
ggccagctcagtctccatcagg

SEQ ID NO: 8193092 - DNA, 22 bp, Homo sapiens
ggccagctcagggtccttgggc

SEQ ID NO: 8193093 - DNA, 22 bp, Homo sapiens
cacccaggcaggtggctgagaa

SEQ ID NO: 8193094 - DNA, 22 bp, Homo sapiens
cacccaggcaggtggctgagaa

SEQ ID NO: 8193095 - DNA, 22 bp, Homo sapiens
cacccaggcaggtggctgagaa

SEQ ID NO: 8193096 - DNA, 22 bp, Homo sapiens
cacccaggacaggccagatgtg

SEQ ID NO: 8193097 - DNA, 22 bp, Homo sapiens
cacccaggacaggccagatgtg

SEQ ID NO: 8193098 - DNA, 22 bp, Homo sapiens
cacccaggctagagtgcagtgg

SEQ ID NO: 8193099 - DNA, 22 bp, Homo sapiens
ggccagggccaaggctttccca

SEQ ID NO: 8193100 - DNA, 22 bp, Homo sapiens
ggccagggcctggggactgtcc

SEQ ID NO: 8193101 - DNA, 22 bp, Homo sapiens
ggccagggcctggggactgtcc

SEQ ID NO: 8193102 - DNA, 22 bp, Homo sapiens
cacccaggctagagtgcagtgg

SEQ ID NO: 8193103 - DNA, 22 bp, Homo sapiens
cacccaggctagagtgcagtgg

SEQ ID NO: 8193104 - DNA, 22 bp, Homo sapiens
ggcccagcatcttgtgaagttt

SEQ ID NO: 8193105 - DNA, 22 bp, Homo sapiens
ggcccagcccgagtcagccttc

SEQ ID NO: 8193106 - DNA, 22 bp, Homo sapiens
ggccccagcagaccctcctctg

SEQ ID NO: 8193107 - DNA, 22 bp, Homo sapiens
ggcccagagacgtgcaatgtac

SEQ ID NO: 8193108 - DNA, 22 bp, Homo sapiens
ggcccagagctccctggcacct

SEQ ID NO: 8193109 - DNA, 22 bp, Homo sapiens
ggcccagaagccagaagcctcc

SEQ ID NO: 8193110 - DNA, 22 bp, Homo sapiens
ggcccagaagccagaagcctcc

SEQ ID NO: 8193111 - DNA, 22 bp, Homo sapiens
ggcccagacccaagagtggtgg

SEQ ID NO: 8193112 - DNA, 22 bp, Homo sapiens
ggcccagcacagtgcttggggg

SEQ ID NO: 8193113 - DNA, 22 bp, Homo sapiens
ggcccagcacagtgcttggggg

SEQ ID NO: 8193114 - DNA, 22 bp, Homo sapiens
ggcccagcacagtgcttggggg

SEQ ID NO: 8193115 - DNA, 22 bp, Homo sapiens
ggcccagcacagtgcttggggg

SEQ ID NO: 8193116 - DNA, 22 bp, Homo sapiens
ggcccagagtctgcaatggagt

SEQ ID NO: 8193117 - DNA, 22 bp, Homo sapiens
ggcccagagggtcaggagctga

SEQ ID NO: 8193118 - DNA, 22 bp, Homo sapiens
ggcccagagggtcaggagctga

SEQ ID NO: 8193119 - DNA, 22 bp, Homo sapiens
ggcgcagtgtgcagaggagtga

SEQ ID NO: 8193120 - DNA, 22 bp, Homo sapiens
ggcgccagcactgcagcgcctc

SEQ ID NO: 8193121 - DNA, 22 bp, Homo sapiens
ggcgcccccttcaaacagagca

SEQ ID NO: 8193122 - DNA, 22 bp, Homo sapiens
ggcgcccatcggtgcagagggc

SEQ ID NO: 8193123 - DNA, 22 bp, Homo sapiens
ggcgcaggccttggatcctggt

SEQ ID NO: 8193124 - DNA, 22 bp, Homo sapiens
ggcgcaggccttggatcctggt

SEQ ID NO: 8193125 - DNA, 22 bp, Homo sapiens
ggcgaggtgtctgccatcaagc

SEQ ID NO: 8193126 - DNA, 22 bp, Homo sapiens
ggcgagggagcagtgcggtggg

SEQ ID NO: 8193127 - DNA, 22 bp, Homo sapiens
ggcgagggagcagtgcggtggg

SEQ ID NO: 8193128 - DNA, 22 bp, Homo sapiens
ggccccagcctcagtcccctga

SEQ ID NO: 8193129 - DNA, 22 bp, Homo sapiens
ggccccaggcctttggtctggc

SEQ ID NO: 8193130 - DNA, 22 bp, Homo sapiens
ggccccagggaagaaggtggtc

SEQ ID NO: 8193131 - DNA, 22 bp, Homo sapiens
ggccccagggaagaaggtggtc

SEQ ID NO: 8193132 - DNA, 22 bp, Homo sapiens
ggccccagggattaggccaacc

SEQ ID NO: 8193133 - DNA, 17 bp, Homo sapiens
ggcctgtgtggctgcag

SEQ ID NO: 8193134 - DNA, 17 bp, Homo sapiens
ggcctgtgtggctgcag

SEQ ID NO: 8193135 - DNA, 22 bp, Homo sapiens
ggatatatgcatgttatcattt

SEQ ID NO: 8193136 - DNA, 19 bp, Homo sapiens
ggataaggttggagtgatc

SEQ ID NO: 8193137 - DNA, 22 bp, Homo sapiens
ggatcaggcgccatgggaagtg

SEQ ID NO: 8193138 - DNA, 22 bp, Homo sapiens
ggatcaggctgaagctaggact

SEQ ID NO: 8193139 - DNA, 22 bp, Homo sapiens
ggatcaggctgaagctaggact

SEQ ID NO: 8193140 - DNA, 19 bp, Homo sapiens
ggatccagaggatctgcca

SEQ ID NO: 8193141 - DNA, 20 bp, Homo sapiens
ggatcagatggagcctctgc

SEQ ID NO: 8193142 - DNA, 22 bp, Homo sapiens
ggatcagaggatcagggacagt

SEQ ID NO: 8193143 - DNA, 22 bp, Homo sapiens
ggatcagaatctttgggtgtaa

SEQ ID NO: 8193144 - DNA, 22 bp, Homo sapiens
ggatcagaacgtgatggctgtg

SEQ ID NO: 8193145 - DNA, 22 bp, Homo sapiens
ggatcagaatctctgagagttt

SEQ ID NO: 8193146 - DNA, 22 bp, Homo sapiens
ggatcagaatctctgagagttt

SEQ ID NO: 8193147 - DNA, 22 bp, Homo sapiens
ggcaggaagtagcagtctgagc

SEQ ID NO: 8193148 - DNA, 22 bp, Homo sapiens
ggcaggaagctcatgtggactg

SEQ ID NO: 8193149 - DNA, 22 bp, Homo sapiens
ggcaggaagaggagggtgaact

SEQ ID NO: 8193150 - DNA, 22 bp, Homo sapiens
ggcaggaagaggagggtgaact

SEQ ID NO: 8193151 - DNA, 22 bp, Homo sapiens
ggcagctgcaaatctgctctgt

SEQ ID NO: 8193152 - DNA, 22 bp, Homo sapiens
ggcagctgcaaatctgctctgt

SEQ ID NO: 8193153 - DNA, 22 bp, Homo sapiens
ggcagctgcaaatctgctctgt

SEQ ID NO: 8193154 - DNA, 22 bp, Homo sapiens
ggcaggaaaacaatgagccagg

SEQ ID NO: 8193155 - DNA, 22 bp, Homo sapiens
ggcagcttttccaggctctcca

SEQ ID NO: 8193156 - DNA, 22 bp, Homo sapiens
ggcaggaaaacaatgagccagg

SEQ ID NO: 8193157 - DNA, 22 bp, Homo sapiens
ggagtgactctcggggccacta

SEQ ID NO: 8193158 - DNA, 22 bp, Homo sapiens
ggagtgactctcggggccacta

SEQ ID NO: 8193159 - DNA, 22 bp, Homo sapiens
ggagtgactctcggggccacta

SEQ ID NO: 8193160 - DNA, 22 bp, Homo sapiens
ggagtgaagtggcgcgatctcg

SEQ ID NO: 8193161 - DNA, 22 bp, Homo sapiens
ggagtgaagtggcgcgatctcg

SEQ ID NO: 8193162 - DNA, 22 bp, Homo sapiens
ggagtgaatcactagatgcaga

SEQ ID NO: 8193163 - DNA, 22 bp, Homo sapiens
ggagtgaatcactagatgcaga

SEQ ID NO: 8193164 - DNA, 22 bp, Homo sapiens
ggagtgactcacagctgggaca

SEQ ID NO: 8193165 - DNA, 22 bp, Homo sapiens
ggagtgactcacagctgggaca

SEQ ID NO: 8193166 - DNA, 22 bp, Homo sapiens
ggagtgactcacagctgggaca

SEQ ID NO: 8193167 - DNA, 22 bp, Homo sapiens
ggagtgactcacagctgggaca

SEQ ID NO: 8193168 - DNA, 22 bp, Homo sapiens
ggagtgactcacagctgggaca

SEQ ID NO: 8193169 - DNA, 22 bp, Homo sapiens
ggagtctgggaattggagagaa

SEQ ID NO: 8193170 - DNA, 22 bp, Homo sapiens
ggagtgaaaggtaagttgagct

SEQ ID NO: 8193171 - DNA, 22 bp, Homo sapiens
ggagtctgttttacatgcagga

SEQ ID NO: 8193172 - DNA, 22 bp, Homo sapiens
ggaggtggaggttgcagtgagc

SEQ ID NO: 8193173 - DNA, 22 bp, Homo sapiens
ggaggtggaggttgcagtgagc

SEQ ID NO: 8193174 - DNA, 22 bp, Homo sapiens
ggagtctgcggcagacactgta

SEQ ID NO: 8193175 - DNA, 22 bp, Homo sapiens
ggagtctgctcccagacatgat

SEQ ID NO: 8193176 - DNA, 22 bp, Homo sapiens
cacatgcatacctatgtgtata

SEQ ID NO: 8193177 - DNA, 22 bp, Homo sapiens
cacatgcatcacgacttccttt

SEQ ID NO: 8193178 - DNA, 22 bp, Homo sapiens
cacatgcatcacgacttccttt

SEQ ID NO: 8193179 - DNA, 22 bp, Homo sapiens
cacatgcagttttccagcagtc

SEQ ID NO: 8193180 - DNA, 22 bp, Homo sapiens
cacatgcagttttccagcagtc

SEQ ID NO: 8193181 - DNA, 22 bp, Homo sapiens
cacatgcagttttccagcagtc

SEQ ID NO: 8193182 - DNA, 22 bp, Homo sapiens
cacatgcatgccaggctcacag

SEQ ID NO: 8193183 - DNA, 22 bp, Homo sapiens
cacatgcattggcaaaagtgta

SEQ ID NO: 8193184 - DNA, 21 bp, Homo sapiens
cacatgcatgcacaggttgta

SEQ ID NO: 8193185 - DNA, 22 bp, Homo sapiens
cacatgcatctgtcatgtttgg

SEQ ID NO: 8193186 - DNA, 22 bp, Homo sapiens
ggcaggactcttctgtgggccg

SEQ ID NO: 8193187 - DNA, 20 bp, Homo sapiens
ggcaggacccggtagggagc

SEQ ID NO: 8193188 - DNA, 20 bp, Homo sapiens
ggcaggacccggtagggagc

SEQ ID NO: 8193189 - DNA, 20 bp, Homo sapiens
ggcaggaccccagtggcatc

SEQ ID NO: 8193190 - DNA, 22 bp, Homo sapiens
ggcaggacattgactacagtga

SEQ ID NO: 8193191 - DNA, 22 bp, Homo sapiens
ggcaggacagtcccagttcaaa

SEQ ID NO: 8193192 - DNA, 22 bp, Homo sapiens
ggcaggagaaaggtctcttctt

SEQ ID NO: 8193193 - DNA, 22 bp, Homo sapiens
ggcaggagaaaggtctcttctt

SEQ ID NO: 8193194 - DNA, 22 bp, Homo sapiens
ggcaggactcttctgtgggccg

SEQ ID NO: 8193195 - DNA, 22 bp, Homo sapiens
cacatgcagtttacgtcactga

SEQ ID NO: 8193196 - DNA, 22 bp, Homo sapiens
cacatgcagtttacgtcactga

SEQ ID NO: 8193197 - DNA, 23 bp, Homo sapiens
cacatgcaggcagtggccttcaa

SEQ ID NO: 8193198 - DNA, 23 bp, Homo sapiens
cacatgcaggcagtggccttcaa

SEQ ID NO: 8193199 - DNA, 22 bp, Homo sapiens
ggcaggagaaaggtctcttctt

SEQ ID NO: 8193200 - DNA, 22 bp, Homo sapiens
cacatgctcattggcactgttc

SEQ ID NO: 8193201 - DNA, 22 bp, Homo sapiens
cacatgctagaataaatctcca

SEQ ID NO: 8193202 - DNA, 22 bp, Homo sapiens
ggcaggtgccttctgtgctagc

SEQ ID NO: 8193203 - DNA, 22 bp, Homo sapiens
ggcaggtgccttctgtgctagc

SEQ ID NO: 8193204 - DNA, 22 bp, Homo sapiens
ggcaggtgccttctgtgctagc

SEQ ID NO: 8193205 - DNA, 22 bp, Homo sapiens
cacatgctccatacagaatggg

SEQ ID NO: 8193206 - DNA, 22 bp, Homo sapiens
ggcaggtgcgcatgttgcatta

SEQ ID NO: 8193207 - DNA, 22 bp, Homo sapiens
ggcaggtgtgagatcgaggcca

SEQ ID NO: 8193208 - DNA, 22 bp, Homo sapiens
ggcaggtgtgagatcgaggcca

SEQ ID NO: 8193209 - DNA, 22 bp, Homo sapiens
ggcaggtgtgagatcgaggcca

SEQ ID NO: 8193210 - DNA, 22 bp, Homo sapiens
ggcaggtgtgagatcgaggcca

SEQ ID NO: 8193211 - DNA, 22 bp, Homo sapiens
ggcaggtgtgagctgtaaagga

SEQ ID NO: 8193212 - DNA, 22 bp, Homo sapiens
ggcaggtgtgagatcgaggcca

SEQ ID NO: 8193213 - DNA, 19 bp, Homo sapiens
ggcaggtgtgcttatgctt

SEQ ID NO: 8193214 - DNA, 22 bp, Homo sapiens
ggcaggtgtgagctgtaaagga

SEQ ID NO: 8193215 - DNA, 22 bp, Homo sapiens
ggcaggtgtgagctgtaaagga

SEQ ID NO: 8193216 - DNA, 19 bp, Homo sapiens
ggcaggtgtgcttatgctt

SEQ ID NO: 8193217 - DNA, 19 bp, Homo sapiens
ggcaggtgtgcttatgctt

SEQ ID NO: 8193218 - DNA, 22 bp, Homo sapiens
ggcaggtgtggagtgttatttt

SEQ ID NO: 8193219 - DNA, 22 bp, Homo sapiens
ggcaggtgtggagtgttatttt

SEQ ID NO: 8193220 - DNA, 22 bp, Homo sapiens
ggcaggtgtggtgaccagagat

SEQ ID NO: 8193221 - DNA, 22 bp, Homo sapiens
ggcaggtgtggtgaccagagat

SEQ ID NO: 8193222 - DNA, 22 bp, Homo sapiens
cacatttctctacctcacacaa

SEQ ID NO: 8193223 - DNA, 22 bp, Homo sapiens
ggcagtcacaggggagactggg

SEQ ID NO: 8193224 - DNA, 22 bp, Homo sapiens
cacatttctggaattgacttgg

SEQ ID NO: 8193225 - DNA, 22 bp, Homo sapiens
cacatttctgtacttaggtaga

SEQ ID NO: 8193226 - DNA, 22 bp, Homo sapiens
cacatttctggaattgacttgg

SEQ ID NO: 8193227 - DNA, 22 bp, Homo sapiens
cacatttcttatggatgttggc

SEQ ID NO: 8193228 - DNA, 22 bp, Homo sapiens
cacatttctgtgagtcaatatt

SEQ ID NO: 8193229 - DNA, 21 bp, Homo sapiens
ggcagtaagccaaatccattt

SEQ ID NO: 8193230 - DNA, 22 bp, Homo sapiens
ggcaggttggatgctgtagtga

SEQ ID NO: 8193231 - DNA, 22 bp, Homo sapiens
ggcagtcaagagggagtctgaa

SEQ ID NO: 8193232 - DNA, 22 bp, Homo sapiens
ggcagtatgagttcaaataatt

SEQ ID NO: 8193233 - DNA, 22 bp, Homo sapiens
ggcaggtgtggtgaccagagat

SEQ ID NO: 8193234 - DNA, 22 bp, Homo sapiens
ggcaggtgtggtgaccagagat

SEQ ID NO: 8193235 - DNA, 22 bp, Homo sapiens
ggcaggtgtggtgaccagagat

SEQ ID NO: 8193236 - DNA, 22 bp, Homo sapiens
ggcaggtgtttttatattaaag

SEQ ID NO: 8193237 - DNA, 22 bp, Homo sapiens
ggcaggtgtttttatattaaag

SEQ ID NO: 8193238 - DNA, 22 bp, Homo sapiens
gtctcttctttgccggtcctgc

SEQ ID NO: 8193239 - DNA, 22 bp, Homo sapiens
gtcttaaaatcagaggatatag

SEQ ID NO: 8193240 - DNA, 16 bp, Homo sapiens
gtctcttccctgctga

SEQ ID NO: 8193241 - DNA, 22 bp, Homo sapiens
gtctcttctttgccggtcctgc

SEQ ID NO: 8193242 - DNA, 16 bp, Homo sapiens
gtctcttccctgctga

SEQ ID NO: 8193243 - DNA, 22 bp, Homo sapiens
gtctttctgccatgtgaagaga

SEQ ID NO: 8193244 - DNA, 22 bp, Homo sapiens
gtctttctgctgcacggactgc

SEQ ID NO: 8193245 - DNA, 22 bp, Homo sapiens
gtctttcttaattcaagtgctt

SEQ ID NO: 8193246 - DNA, 22 bp, Homo sapiens
gtctttcttaattcaagtgctt

SEQ ID NO: 8193247 - DNA, 22 bp, Homo sapiens
gtctttcttcagagcttggact

SEQ ID NO: 8193248 - DNA, 22 bp, Homo sapiens
gtctttgctgtctttgctctca

SEQ ID NO: 8193249 - DNA, 22 bp, Homo sapiens
gtctttcttcagagcttggact

SEQ ID NO: 8193250 - DNA, 22 bp, Homo sapiens
gtctttggagaggtgccatttc

SEQ ID NO: 8193251 - DNA, 22 bp, Homo sapiens
gtctttggaggcactgttgagt

SEQ ID NO: 8193252 - DNA, 22 bp, Homo sapiens
gtctttggagaggtgccatttc

SEQ ID NO: 8193253 - DNA, 22 bp, Homo sapiens
gtgaagttcaagcttgccatct

SEQ ID NO: 8193254 - DNA, 22 bp, Homo sapiens
gtctttggatgtaagataaagt

SEQ ID NO: 8193255 - DNA, 18 bp, Homo sapiens
gtctttggagtggaggta

SEQ ID NO: 8193256 - DNA, 22 bp, Homo sapiens
gtgaaggtggggagcctcagtt

SEQ ID NO: 8193257 - DNA, 22 bp, Homo sapiens
gtctcagggactgcttctgggg

SEQ ID NO: 8193258 - DNA, 18 bp, Homo sapiens
gtctcaggagtggcacgt

SEQ ID NO: 8193259 - DNA, 20 bp, Homo sapiens
gtctccactgggggttaacc

SEQ ID NO: 8193260 - DNA, 22 bp, Homo sapiens
gtctccagaagcctagacagcc

SEQ ID NO: 8193261 - DNA, 20 bp, Homo sapiens
gtctccactgggggttaacc

SEQ ID NO: 8193262 - DNA, 20 bp, Homo sapiens
gtctccactgggggttaacc

SEQ ID NO: 8193263 - DNA, 22 bp, Homo sapiens
gtctcagtgtcacctccagctg

SEQ ID NO: 8193264 - DNA, 22 bp, Homo sapiens
gtctctgttatttccagggtca

SEQ ID NO: 8193265 - DNA, 22 bp, Homo sapiens
gtctctgtggtacgtttcatcc

SEQ ID NO: 8193266 - DNA, 18 bp, Homo sapiens
gtctctgtgggaattggc

SEQ ID NO: 8193267 - DNA, 18 bp, Homo sapiens
gtctctgtgggaattggc

SEQ ID NO: 8193268 - DNA, 22 bp, Homo sapiens
gtctctgtggtacgtttcatcc

SEQ ID NO: 8193269 - DNA, 17 bp, Homo sapiens
gtctctgtcttgctttt

SEQ ID NO: 8193270 - DNA, 22 bp, Homo sapiens
gtctctgtcttaggccaggcct

SEQ ID NO: 8193271 - DNA, 22 bp, Homo sapiens
gtctctgggtgtgtgatgccaa

SEQ ID NO: 8193272 - DNA, 22 bp, Homo sapiens
gtctctggctttatgctggttt

SEQ ID NO: 8193273 - DNA, 22 bp, Homo sapiens
gtctctggctttatgctggttt

SEQ ID NO: 8193274 - DNA, 22 bp, Homo sapiens
gtctctgggttaagcagtgcat

SEQ ID NO: 8193275 - DNA, 22 bp, Homo sapiens
gtctctgtcatttcaccttccc

SEQ ID NO: 8193276 - DNA, 22 bp, Homo sapiens
gtctctgtcttaggccaggcct

SEQ ID NO: 8193277 - DNA, 22 bp, Homo sapiens
gtgaatggggcaggaaggatgg

SEQ ID NO: 8193278 - DNA, 21 bp, Homo sapiens
gtgaattaattatatgcctta

SEQ ID NO: 8193279 - DNA, 22 bp, Homo sapiens
gtgaataattttttagtataag

SEQ ID NO: 8193280 - DNA, 22 bp, Homo sapiens
gtgaataatcacccttctggat

SEQ ID NO: 8193281 - DNA, 22 bp, Homo sapiens
gtgaataatattgtttataaaa

SEQ ID NO: 8193282 - DNA, 22 bp, Homo sapiens
gtgaagttttagtatatgtaga

SEQ ID NO: 8193283 - DNA, 22 bp, Homo sapiens
gtgaataactttctatgttaat

SEQ ID NO: 8193284 - DNA, 22 bp, Homo sapiens
gtgcaaaagtaattgcagtttt

SEQ ID NO: 8193285 - DNA, 22 bp, Homo sapiens
gtgcaaaagtaattgcagtttt

SEQ ID NO: 8193286 - DNA, 22 bp, Homo sapiens
gtgcaaaagtaattgcggtttt

SEQ ID NO: 8193287 - DNA, 22 bp, Homo sapiens
gtgcaaaagtaattgctgtttt

SEQ ID NO: 8193288 - DNA, 22 bp, Homo sapiens
gtgcaaaagtcattgtggtttt

SEQ ID NO: 8193289 - DNA, 22 bp, Homo sapiens
gtgcaaaagtaattgtggtttt

SEQ ID NO: 8193290 - DNA, 22 bp, Homo sapiens
gtgcaaaagtacttgcggattt

SEQ ID NO: 8193291 - DNA, 22 bp, Homo sapiens
gtgcaaaagtaattacagtttt

SEQ ID NO: 8193292 - DNA, 22 bp, Homo sapiens
gtgcaaaagtaattacagtttt

SEQ ID NO: 8193293 - DNA, 22 bp, Homo sapiens
gtgcaaaagtaattgcagtact

SEQ ID NO: 8193294 - DNA, 22 bp, Homo sapiens
gtgcaaaagtaattgaggtttt

SEQ ID NO: 8193295 - DNA, 22 bp, Homo sapiens
gtgaggtcaaagccttgggtat

SEQ ID NO: 8193296 - DNA, 22 bp, Homo sapiens
gtgcaaaagtaatggcagtttt

SEQ ID NO: 8193297 - DNA, 22 bp, Homo sapiens
gtgaggtcaaagccttgggtat

SEQ ID NO: 8193298 - DNA, 22 bp, Homo sapiens
gtgaggtcaccggccgttgcca

SEQ ID NO: 8193299 - DNA, 22 bp, Homo sapiens
gtgcaaaagtaatggcagtttt

SEQ ID NO: 8193300 - DNA, 22 bp, Homo sapiens
gtgcagctgaaggctggccagc

SEQ ID NO: 8193301 - DNA, 22 bp, Homo sapiens
gtgcagctgccgatcagatagg

SEQ ID NO: 8193302 - DNA, 22 bp, Homo sapiens
gtgcagctgtggtggagccagg

SEQ ID NO: 8193303 - DNA, 22 bp, Homo sapiens
gtgcaggagccaggggtaggaa

SEQ ID NO: 8193304 - DNA, 22 bp, Homo sapiens
gtgcaggagcaggagccatgtc

SEQ ID NO: 8193305 - DNA, 22 bp, Homo sapiens
gtgcaggacagcacatctcctg

SEQ ID NO: 8193306 - DNA, 22 bp, Homo sapiens
gtgcagcaggggccctctcacc

SEQ ID NO: 8193307 - DNA, 22 bp, Homo sapiens
gtgcaaatgtaattgcagtttt

SEQ ID NO: 8193308 - DNA, 22 bp, Homo sapiens
gtgcaaatgattctaatgggta

SEQ ID NO: 8193309 - DNA, 20 bp, Homo sapiens
gtgcagccaagctgagccgc

SEQ ID NO: 8193310 - DNA, 22 bp, Homo sapiens
gtgcagcctgtcgccagtggat

SEQ ID NO: 8193311 - DNA, 22 bp, Homo sapiens
gtgcagcctgtcgccagtggat

SEQ ID NO: 8193312 - DNA, 22 bp, Homo sapiens
gtgcagctactccttggtccta

SEQ ID NO: 8193313 - DNA, 22 bp, Homo sapiens
gtgcaaaatgatatcctgaagc

SEQ ID NO: 8193314 - DNA, 16 bp, Homo sapiens
gtgcaaaagtgaggag

SEQ ID NO: 8193315 - DNA, 22 bp, Homo sapiens
gtgcaaagcttaacattctgca

SEQ ID NO: 8193316 - DNA, 22 bp, Homo sapiens
gtgcaaatgagatggattcaag

SEQ ID NO: 8193317 - DNA, 22 bp, Homo sapiens
gtgcaaatacatatgctgtgga

SEQ ID NO: 8193318 - DNA, 22 bp, Homo sapiens
gtcctctgtgtaggctgcagac

SEQ ID NO: 8193319 - DNA, 22 bp, Homo sapiens
gtcctctgtgtaggctgcagac

SEQ ID NO: 8193320 - DNA, 22 bp, Homo sapiens
gtcctctgtttccatctgactt

SEQ ID NO: 8193321 - DNA, 22 bp, Homo sapiens
gtcctctgttagaaatgtgctt

SEQ ID NO: 8193322 - DNA, 22 bp, Homo sapiens
cagcagtgtacaaggtgtcaga

SEQ ID NO: 8193323 - DNA, 22 bp, Homo sapiens
cagcagtggctgcaggcagctg

SEQ ID NO: 8193324 - DNA, 22 bp, Homo sapiens
cagcagtgtacaaggtgtcaga

SEQ ID NO: 8193325 - DNA, 22 bp, Homo sapiens
gtcctgacggctgattggcctg

SEQ ID NO: 8193326 - DNA, 22 bp, Homo sapiens
gtcctgacggctgattggcctg

SEQ ID NO: 8193327 - DNA, 22 bp, Homo sapiens
gtcctgaatgcctttaggcaga

SEQ ID NO: 8193328 - DNA, 22 bp, Homo sapiens
gtcctgagagaggctccttgcc

SEQ ID NO: 8193329 - DNA, 22 bp, Homo sapiens
gtcctgagaatactaggcacaa

SEQ ID NO: 8193330 - DNA, 22 bp, Homo sapiens
gtcctgagggcccaggcattct

SEQ ID NO: 8193331 - DNA, 22 bp, Homo sapiens
gtcctgaggcaggatgggtttc

SEQ ID NO: 8193332 - DNA, 22 bp, Homo sapiens
gtcctgagtcaagtgtgggcag

SEQ ID NO: 8193333 - DNA, 22 bp, Homo sapiens
gtcctgagtcaagtgtgggcag

SEQ ID NO: 8193334 - DNA, 19 bp, Homo sapiens
gtcctgcaactggctctcc

SEQ ID NO: 8193335 - DNA, 22 bp, Homo sapiens
gtcctgagccctcagcacagca

SEQ ID NO: 8193336 - DNA, 18 bp, Homo sapiens
gtcctgagctctgctgta

SEQ ID NO: 8193337 - DNA, 18 bp, Homo sapiens
gtcctgagctctgctgta

SEQ ID NO: 8193338 - DNA, 22 bp, Homo sapiens
gtcctgaggcaggatgggtttc

SEQ ID NO: 8193339 - DNA, 22 bp, Homo sapiens
gtcctgaggatgcagagataaa

SEQ ID NO: 8193340 - DNA, 22 bp, Homo sapiens
gtcctgaggatgcagagataaa

SEQ ID NO: 8193341 - DNA, 22 bp, Homo sapiens
gtctcagaccaccctctttggc

SEQ ID NO: 8193342 - DNA, 22 bp, Homo sapiens
gtctcagagagctactctctta

SEQ ID NO: 8193343 - DNA, 22 bp, Homo sapiens
gtctcagagtcctacttattcc

SEQ ID NO: 8193344 - DNA, 22 bp, Homo sapiens
gtctcaaactcctaggctaaag

SEQ ID NO: 8193345 - DNA, 22 bp, Homo sapiens
gtcctgtgtaagccaggacaat

SEQ ID NO: 8193346 - DNA, 22 bp, Homo sapiens
cagcatgcaggggcctgagcac

SEQ ID NO: 8193347 - DNA, 22 bp, Homo sapiens
cagcatgcattttctctctttg

SEQ ID NO: 8193348 - DNA, 22 bp, Homo sapiens
cagcatgcagcccctggcagct

SEQ ID NO: 8193349 - DNA, 22 bp, Homo sapiens
cagcatgcagcccctggcagct

SEQ ID NO: 8193350 - DNA, 22 bp, Homo sapiens
cagcatgcaggggcctgagcac

SEQ ID NO: 8193351 - DNA, 22 bp, Homo sapiens
gtcctgtggaaagctagccgct

SEQ ID NO: 8193352 - DNA, 22 bp, Homo sapiens
gtcctgtggaaagctagccgct

SEQ ID NO: 8193353 - DNA, 22 bp, Homo sapiens
cagcatgcattttctctctttg

SEQ ID NO: 8193354 - DNA, 22 bp, Homo sapiens
gtcctgtgctcagacatggggg

SEQ ID NO: 8193355 - DNA, 22 bp, Homo sapiens
cagcatgcaagtccagatgtgg

SEQ ID NO: 8193356 - DNA, 22 bp, Homo sapiens
cagcatgattggtgtctggtga

SEQ ID NO: 8193357 - DNA, 22 bp, Homo sapiens
cagcatgattggtgtctggtga

SEQ ID NO: 8193358 - DNA, 22 bp, Homo sapiens
cagcatgcagcccctggcagct

SEQ ID NO: 8193359 - DNA, 22 bp, Homo sapiens
cagcatgcaagtccagatgtgg

SEQ ID NO: 8193360 - DNA, 22 bp, Homo sapiens
cagcatgcagcccctggcagct

SEQ ID NO: 8193361 - DNA, 22 bp, Homo sapiens
cagcatctttctcttctggagt

SEQ ID NO: 8193362 - DNA, 22 bp, Homo sapiens
cagcatctttctcttctggagt

SEQ ID NO: 8193363 - DNA, 22 bp, Homo sapiens
cagcatgatgagtgcagtttgg

SEQ ID NO: 8193364 - DNA, 22 bp, Homo sapiens
cagcatgagaaaatgaatcaga

SEQ ID NO: 8193365 - DNA, 22 bp, Homo sapiens
cagcatgactcactgtggtcac

SEQ ID NO: 8193366 - DNA, 22 bp, Homo sapiens
cagcatgaccctggagcctgca

SEQ ID NO: 8193367 - DNA, 22 bp, Homo sapiens
cagcatctttctcttctggagt

SEQ ID NO: 8193368 - DNA, 22 bp, Homo sapiens
cagcatcttgaagggtaaacca

SEQ ID NO: 8193369 - DNA, 22 bp, Homo sapiens
cagcatcttattttctatggaa

SEQ ID NO: 8193370 - DNA, 18 bp, Homo sapiens
cagcatcttcattaggcc

SEQ ID NO: 8193371 - DNA, 22 bp, Homo sapiens
cagcatcttcatgtgcatctcc

SEQ ID NO: 8193372 - DNA, 22 bp, Homo sapiens
cagcagagacggtaagcagaac

SEQ ID NO: 8193373 - DNA, 22 bp, Homo sapiens
cagcagagacggtaagcagaac

SEQ ID NO: 8193374 - DNA, 22 bp, Homo sapiens
cagcagagcatttggtaggagg

SEQ ID NO: 8193375 - DNA, 22 bp, Homo sapiens
cagcagagctgggctttgaatt

SEQ ID NO: 8193376 - DNA, 22 bp, Homo sapiens
cagcaggtctcagcagctcctt

SEQ ID NO: 8193377 - DNA, 22 bp, Homo sapiens
cagcaggtcctgggcgtggcct

SEQ ID NO: 8193378 - DNA, 22 bp, Homo sapiens
cagcaggtcccactgagggccc

SEQ ID NO: 8193379 - DNA, 18 bp, Homo sapiens
cagcaggtagagtttggt

SEQ ID NO: 8193380 - DNA, 22 bp, Homo sapiens
cagcaggtatgtttgttcagca

SEQ ID NO: 8193381 - DNA, 22 bp, Homo sapiens
cagcagggaagctgtgctgttt

SEQ ID NO: 8193382 - DNA, 22 bp, Homo sapiens
cagcagggaagctgtgctgttt

SEQ ID NO: 8193383 - DNA, 22 bp, Homo sapiens
cagcagggttaagtgactcacc

SEQ ID NO: 8193384 - DNA, 22 bp, Homo sapiens
cagcagggaagctgtgctgttt

SEQ ID NO: 8193385 - DNA, 22 bp, Homo sapiens
cagcagagctgtgtgggaaggg

SEQ ID NO: 8193386 - DNA, 22 bp, Homo sapiens
cagcagagctgtgtgggaaggg

SEQ ID NO: 8193387 - DNA, 22 bp, Homo sapiens
cagcagagctgtgtgggaaggg

SEQ ID NO: 8193388 - DNA, 22 bp, Homo sapiens
cagcaggtgctgcctgtcaccc

SEQ ID NO: 8193389 - DNA, 22 bp, Homo sapiens
cagcaggtctgcatttgaggtc

SEQ ID NO: 8193390 - DNA, 22 bp, Homo sapiens
cagcaggtgtctagcaagggtc

SEQ ID NO: 8193391 - DNA, 22 bp, Homo sapiens
cagcaggtgggctttgcggatg

SEQ ID NO: 8193392 - DNA, 22 bp, Homo sapiens
cagcaggtgtccttttggtgga

SEQ ID NO: 8193393 - DNA, 22 bp, Homo sapiens
cagcagtagtctctgtggcttt

SEQ ID NO: 8193394 - DNA, 22 bp, Homo sapiens
cagcagtacttctcagaggtat

SEQ ID NO: 8193395 - DNA, 22 bp, Homo sapiens
cagcaggttaacagaggctggt

SEQ ID NO: 8193396 - DNA, 22 bp, Homo sapiens
cagcaggttaacagaggctggt

SEQ ID NO: 8193397 - DNA, 22 bp, Homo sapiens
cagcaggttaacagaggctggt

SEQ ID NO: 8193398 - DNA, 22 bp, Homo sapiens
cagcagtggctgcaggcagctg

SEQ ID NO: 8193399 - DNA, 22 bp, Homo sapiens
cagcagtggccatctgtgtggt

SEQ ID NO: 8193400 - DNA, 22 bp, Homo sapiens
cagcagtggctgcaggcagctg

SEQ ID NO: 8193401 - DNA, 22 bp, Homo sapiens
cagcagtggccatctgtgtggt

SEQ ID NO: 8193402 - DNA, 20 bp, Homo sapiens
cagcagtggatgagagtttt

SEQ ID NO: 8193403 - DNA, 22 bp, Homo sapiens
cagcagtggaactacccaggga

SEQ ID NO: 8193404 - DNA, 22 bp, Homo sapiens
cagcagtggaactacccaggga

SEQ ID NO: 8193405 - DNA, 22 bp, Homo sapiens
cagcagtgcttcagtgtgagat

SEQ ID NO: 8193406 - DNA, 22 bp, Homo sapiens
cagcagtgatgtgtgagggttc

SEQ ID NO: 8193407 - DNA, 22 bp, Homo sapiens
cagcagtgcttcagtgtgagat

SEQ ID NO: 8193408 - DNA, 21 bp, Homo sapiens
cagctctgagatttctactag

SEQ ID NO: 8193409 - DNA, 22 bp, Homo sapiens
cagctctgaggaacactccttt

SEQ ID NO: 8193410 - DNA, 22 bp, Homo sapiens
cagctctgaggaacactccttt

SEQ ID NO: 8193411 - DNA, 17 bp, Homo sapiens
cagctctgcagacttcc

SEQ ID NO: 8193412 - DNA, 22 bp, Homo sapiens
cagctctgatgaaatgtaccag

SEQ ID NO: 8193413 - DNA, 22 bp, Homo sapiens
cagctctgaggaacactccttt

SEQ ID NO: 8193414 - DNA, 22 bp, Homo sapiens
cagctctgaggaacactccttt

SEQ ID NO: 8193415 - DNA, 22 bp, Homo sapiens
cagctcctgaggactgctggga

SEQ ID NO: 8193416 - DNA, 22 bp, Homo sapiens
cagctcctgcagctgctgccgt

SEQ ID NO: 8193417 - DNA, 22 bp, Homo sapiens
cagctcctgaggactgctggga

SEQ ID NO: 8193418 - DNA, 22 bp, Homo sapiens
cagctcctctgttagccctggg

SEQ ID NO: 8193419 - DNA, 22 bp, Homo sapiens
cagctcctgcagctggctccca

SEQ ID NO: 8193420 - DNA, 22 bp, Homo sapiens
cagctcctgcagctgctgccgt

SEQ ID NO: 8193421 - DNA, 22 bp, Homo sapiens
cagctcctgcagctggctccca

SEQ ID NO: 8193422 - DNA, 22 bp, Homo sapiens
cagctctgagactgaggctatg

SEQ ID NO: 8193423 - DNA, 22 bp, Homo sapiens
cagctcctgcagctggctccca

SEQ ID NO: 8193424 - DNA, 22 bp, Homo sapiens
cagctcctctggccagccctgc

SEQ ID NO: 8193425 - DNA, 22 bp, Homo sapiens
cagctcctctggccagccctgc

SEQ ID NO: 8193426 - DNA, 22 bp, Homo sapiens
cagctcctctgttagccctggg

SEQ ID NO: 8193427 - DNA, 22 bp, Homo sapiens
cagctcctctgttagccctggg

SEQ ID NO: 8193428 - DNA, 22 bp, Homo sapiens
cagctcctcagccctgccttgg

SEQ ID NO: 8193429 - DNA, 22 bp, Homo sapiens
cagctcctcacgagtcttgaaa

SEQ ID NO: 8193430 - DNA, 22 bp, Homo sapiens
cagctcctctggccagccctgc

SEQ ID NO: 8193431 - DNA, 22 bp, Homo sapiens
cagctcctcagccctgccttgg

SEQ ID NO: 8193432 - DNA, 22 bp, Homo sapiens
cagctcctagatcggcgaagtg

SEQ ID NO: 8193433 - DNA, 22 bp, Homo sapiens
cagctccctatggtgaggcgac

SEQ ID NO: 8193434 - DNA, 22 bp, Homo sapiens
cagctcccgccatcgggaggca

SEQ ID NO: 8193435 - DNA, 22 bp, Homo sapiens
gtgcatgctgcagtatgatttc

SEQ ID NO: 8193436 - DNA, 18 bp, Homo sapiens
gtgcatgcatgctctgcc

SEQ ID NO: 8193437 - DNA, 22 bp, Homo sapiens
gtgcatgccctaagatatttat

SEQ ID NO: 8193438 - DNA, 21 bp, Homo sapiens
gtgcatggagaaaggcttgct

SEQ ID NO: 8193439 - DNA, 22 bp, Homo sapiens
gtgcatggccagggtggtctgg

SEQ ID NO: 8193440 - DNA, 22 bp, Homo sapiens
gtgcatggggagggaagcgctc

SEQ ID NO: 8193441 - DNA, 22 bp, Homo sapiens
gtgcatgaagactcagaaagtc

SEQ ID NO: 8193442 - DNA, 22 bp, Homo sapiens
gtgcatgaagcaggcagctcct

SEQ ID NO: 8193443 - DNA, 22 bp, Homo sapiens
gtgcatgcaaattactgtaaag

SEQ ID NO: 8193444 - DNA, 22 bp, Homo sapiens
gtgcatgcaaattactgtaaag

SEQ ID NO: 8193445 - DNA, 22 bp, Homo sapiens
gtgcatgcacacatgtgtgagg

SEQ ID NO: 8193446 - DNA, 22 bp, Homo sapiens
gtgcatgcagtaagtgttttaa

SEQ ID NO: 8193447 - DNA, 22 bp, Homo sapiens
gtgcatcaatttcccatgtgtc

SEQ ID NO: 8193448 - DNA, 22 bp, Homo sapiens
gtgcaggagcttctggcctgac

SEQ ID NO: 8193449 - DNA, 22 bp, Homo sapiens
gtgcaggagcttctggcctgac

SEQ ID NO: 8193450 - DNA, 22 bp, Homo sapiens
gtgcaggaggatgacaactgca

SEQ ID NO: 8193451 - DNA, 22 bp, Homo sapiens
cagccctgtgctaagcaccctc

SEQ ID NO: 8193452 - DNA, 22 bp, Homo sapiens
cagccctgtgctaagcaccctc

SEQ ID NO: 8193453 - DNA, 22 bp, Homo sapiens
cagccctgtgcggagggccctg

SEQ ID NO: 8193454 - DNA, 22 bp, Homo sapiens
gtgcatgttaatggtgtacaaa

SEQ ID NO: 8193455 - DNA, 22 bp, Homo sapiens
gtgcatgtgtctttatagtagc

SEQ ID NO: 8193456 - DNA, 23 bp, Homo sapiens
gtgcatgtgtctttacagtagca

SEQ ID NO: 8193457 - DNA, 22 bp, Homo sapiens
gtgcatgtgtctttatagtaga

SEQ ID NO: 8193458 - DNA, 22 bp, Homo sapiens
gtgcatgtcggggtgcatgtca

SEQ ID NO: 8193459 - DNA, 22 bp, Homo sapiens
gtgcatgtgcatccatgtgtac

SEQ ID NO: 8193460 - DNA, 22 bp, Homo sapiens
gtgcatgtgcatccatgtgtac

SEQ ID NO: 8193461 - DNA, 22 bp, Homo sapiens
gtgcatgtcggggtgcatgtca

SEQ ID NO: 8193462 - DNA, 22 bp, Homo sapiens
gtgcatggggagggaagcgctc

SEQ ID NO: 8193463 - DNA, 22 bp, Homo sapiens
cagccgcgctcgtgccagacag

SEQ ID NO: 8193464 - DNA, 22 bp, Homo sapiens
cagccctttccttctcagcttt

SEQ ID NO: 8193465 - DNA, 22 bp, Homo sapiens
cagcccttggcccagggcacag

SEQ ID NO: 8193466 - DNA, 20 bp, Homo sapiens
cagccctttatcctcctatg

SEQ ID NO: 8193467 - DNA, 23 bp, Homo sapiens
cagcccttcctgcatgtttttgt

SEQ ID NO: 8193468 - DNA, 22 bp, Homo sapiens
cagcccttccaggcagaattct

SEQ ID NO: 8193469 - DNA, 22 bp, Homo sapiens
cagcccttgcgacaccctggct

SEQ ID NO: 8193470 - DNA, 22 bp, Homo sapiens
cagccctgttgcgcttccggcg

SEQ ID NO: 8193471 - DNA, 22 bp, Homo sapiens
cagccctgttgcgcttccggcg

SEQ ID NO: 8193472 - DNA, 22 bp, Homo sapiens
cagccctgttgcgcttccggcg

SEQ ID NO: 8193473 - DNA, 22 bp, Homo sapiens
cagcccttaagagtcatccctc

SEQ ID NO: 8193474 - DNA, 22 bp, Homo sapiens
gtgcctgggggtaatgtaggat

SEQ ID NO: 8193475 - DNA, 22 bp, Homo sapiens
gtgcctgggggtaatgtaggat

SEQ ID NO: 8193476 - DNA, 22 bp, Homo sapiens
gtgcctggggttgagctatgaa

SEQ ID NO: 8193477 - DNA, 22 bp, Homo sapiens
gtgcctgggacttgctccggat

SEQ ID NO: 8193478 - DNA, 22 bp, Homo sapiens
gtgcctgggcatgagcttgttg

SEQ ID NO: 8193479 - DNA, 22 bp, Homo sapiens
gtgcctgggacttgctccggat

SEQ ID NO: 8193480 - DNA, 20 bp, Homo sapiens
cagcctccactcactcagct

SEQ ID NO: 8193481 - DNA, 19 bp, Homo sapiens
cagcctcaatccctcgggc

SEQ ID NO: 8193482 - DNA, 19 bp, Homo sapiens
cagcctcaatccctcgggc

SEQ ID NO: 8193483 - DNA, 22 bp, Homo sapiens
gtgcctgggacacagcagatac

SEQ ID NO: 8193484 - DNA, 22 bp, Homo sapiens
gtgcctgggacacagcagatac

SEQ ID NO: 8193485 - DNA, 22 bp, Homo sapiens
gtgccctgacacacctggtgtg

SEQ ID NO: 8193486 - DNA, 22 bp, Homo sapiens
gtgccctgacacacctggtgtg

SEQ ID NO: 8193487 - DNA, 22 bp, Homo sapiens
cagctccagctctgggcgcctc

SEQ ID NO: 8193488 - DNA, 22 bp, Homo sapiens
cagctccagctctgggcgcctc

SEQ ID NO: 8193489 - DNA, 23 bp, Homo sapiens
cagctccagtgcactcaggtagc

SEQ ID NO: 8193490 - DNA, 22 bp, Homo sapiens
cagctccagcctgacaccaaga

SEQ ID NO: 8193491 - DNA, 22 bp, Homo sapiens
cagctccagcctgacaccaaga

SEQ ID NO: 8193492 - DNA, 22 bp, Homo sapiens
cagctcccagagtgaccagcag

SEQ ID NO: 8193493 - DNA, 22 bp, Homo sapiens
cagctcccctctgtggggcagt

SEQ ID NO: 8193494 - DNA, 22 bp, Homo sapiens
cagctccccatggttcctgaag

SEQ ID NO: 8193495 - DNA, 22 bp, Homo sapiens
cagctccagcccaggcagctcc

SEQ ID NO: 8193496 - DNA, 21 bp, Homo sapiens
cagctccactaaagcagctgt

SEQ ID NO: 8193497 - DNA, 21 bp, Homo sapiens
cagctccactaaagcagctgt

SEQ ID NO: 8193498 - DNA, 21 bp, Homo sapiens
cagctccactaaagcagctgt

SEQ ID NO: 8193499 - DNA, 22 bp, Homo sapiens
cagctcaggaaggaaggccggc

SEQ ID NO: 8193500 - DNA, 22 bp, Homo sapiens
cagctcaggaaggaaggccggc

SEQ ID NO: 8193501 - DNA, 22 bp, Homo sapiens
cagctcagcttcctgggtgtgt

SEQ ID NO: 8193502 - DNA, 22 bp, Homo sapiens
gtgctgaggtacacaaattcta

SEQ ID NO: 8193503 - DNA, 22 bp, Homo sapiens
gtgctgaggtgggtgggcagcc

SEQ ID NO: 8193504 - DNA, 20 bp, Homo sapiens
gtgctgagggctgggcaatg

SEQ ID NO: 8193505 - DNA, 22 bp, Homo sapiens
gtgctgaggtgggtgggcagcc

SEQ ID NO: 8193506 - DNA, 22 bp, Homo sapiens
gtgctgaggtgggtgggcagcc

SEQ ID NO: 8193507 - DNA, 22 bp, Homo sapiens
gtgctgaggtgggtgggcagcc

SEQ ID NO: 8193508 - DNA, 22 bp, Homo sapiens
gtgctgagctgcagatgcgctc

SEQ ID NO: 8193509 - DNA, 22 bp, Homo sapiens
gtgctgaggagagggggtggtc

SEQ ID NO: 8193510 - DNA, 22 bp, Homo sapiens
gtgctgagcatcatgaggcact

SEQ ID NO: 8193511 - DNA, 22 bp, Homo sapiens
gtgctgagcatcatgaggcact

SEQ ID NO: 8193512 - DNA, 22 bp, Homo sapiens
gtgctgaggatacagctgtgaa

SEQ ID NO: 8193513 - DNA, 22 bp, Homo sapiens
gtgctgaggagagggggtggtc

SEQ ID NO: 8193514 - DNA, 22 bp, Homo sapiens
gtgctgagcacaccttggagca

SEQ ID NO: 8193515 - DNA, 22 bp, Homo sapiens
gtgctgagcacaccttggagca

SEQ ID NO: 8193516 - DNA, 22 bp, Homo sapiens
gtgctgagcacagctgcccagg

SEQ ID NO: 8193517 - DNA, 22 bp, Homo sapiens
gtgctgagcatcatgaggcact

SEQ ID NO: 8193518 - DNA, 22 bp, Homo sapiens
gtgctgagcatcatgaggcact

SEQ ID NO: 8193519 - DNA, 22 bp, Homo sapiens
gtgctgagcacagctgcccagg

SEQ ID NO: 8193520 - DNA, 22 bp, Homo sapiens
gtgctgagatcttccctcactg

SEQ ID NO: 8193521 - DNA, 22 bp, Homo sapiens
gtgctgagattacaggtgtgag

SEQ ID NO: 8193522 - DNA, 22 bp, Homo sapiens
gtgctgagattggagtgagcag

SEQ ID NO: 8193523 - DNA, 22 bp, Homo sapiens
gtgctgagattacaggtgtgag

SEQ ID NO: 8193524 - DNA, 22 bp, Homo sapiens
gtgcctggtatgtaggtagcgg

SEQ ID NO: 8193525 - DNA, 22 bp, Homo sapiens
gtgcctggtatgtaggtagcgg

SEQ ID NO: 8193526 - DNA, 22 bp, Homo sapiens
gtgcctggtatgtaggtagcgg

SEQ ID NO: 8193527 - DNA, 22 bp, Homo sapiens
gtgcctggtatgtaggtagcgg

SEQ ID NO: 8193528 - DNA, 22 bp, Homo sapiens
gtgcctggggttgagctatgaa

SEQ ID NO: 8193529 - DNA, 22 bp, Homo sapiens
gtgcctggggttgagctatgaa

SEQ ID NO: 8193530 - DNA, 22 bp, Homo sapiens
gtgcctggtttggggaatgttc

SEQ ID NO: 8193531 - DNA, 22 bp, Homo sapiens
gtgcctggtttggggagtgttc

SEQ ID NO: 8193532 - DNA, 22 bp, Homo sapiens
gtgcctggtttggggagtgttc

SEQ ID NO: 8193533 - DNA, 22 bp, Homo sapiens
gtgcctggtatgtaggtagcgg

SEQ ID NO: 8193534 - DNA, 22 bp, Homo sapiens
gtgcctggtttggggaatgttc

SEQ ID NO: 8193535 - DNA, 17 bp, Homo sapiens
gtgcctgttgtcctgga

SEQ ID NO: 8193536 - DNA, 22 bp, Homo sapiens
gtgcctgtgcggactcagggaa

SEQ ID NO: 8193537 - DNA, 22 bp, Homo sapiens
gtgctgagatcttccctcactg

SEQ ID NO: 8193538 - DNA, 22 bp, Homo sapiens
gtgcctgtgccaggggtgtgct

SEQ ID NO: 8193539 - DNA, 22 bp, Homo sapiens
gtgcctgtgccaggggtgtgct

SEQ ID NO: 8193540 - DNA, 22 bp, Homo sapiens
cagatacattaaaatgatgatt

SEQ ID NO: 8193541 - DNA, 22 bp, Homo sapiens
cagatacattaaaatgatgatt

SEQ ID NO: 8193542 - DNA, 22 bp, Homo sapiens
cagataggaaaagctaggcata

SEQ ID NO: 8193543 - DNA, 20 bp, Homo sapiens
cagataggttagtgtttcag

SEQ ID NO: 8193544 - DNA, 22 bp, Homo sapiens
cagatagtaacctttctagagc

SEQ ID NO: 8193545 - DNA, 22 bp, Homo sapiens
cagatagctgactactcttctt

SEQ ID NO: 8193546 - DNA, 22 bp, Homo sapiens
cagatagcgtttgagagcataa

SEQ ID NO: 8193547 - DNA, 22 bp, Homo sapiens
cagatatattttccttattagg

SEQ ID NO: 8193548 - DNA, 22 bp, Homo sapiens
cagatatattttccttattagg

SEQ ID NO: 8193549 - DNA, 22 bp, Homo sapiens
cagatatattttccttattagg

SEQ ID NO: 8193550 - DNA, 22 bp, Homo sapiens
cagatatattttatttggtcaa

SEQ ID NO: 8193551 - DNA, 22 bp, Homo sapiens
cagatatattcatttgcagtgc

SEQ ID NO: 8193552 - DNA, 22 bp, Homo sapiens
cagatatattttatttggtcaa

SEQ ID NO: 8193553 - DNA, 22 bp, Homo sapiens
cagatataaatggatgtggtag

SEQ ID NO: 8193554 - DNA, 22 bp, Homo sapiens
cagatataagaaagctattgtc

SEQ ID NO: 8193555 - DNA, 22 bp, Homo sapiens
cagatataaatggatgtggtag

SEQ ID NO: 8193556 - DNA, 22 bp, Homo sapiens
cagatatatattcatcaggctg

SEQ ID NO: 8193557 - DNA, 22 bp, Homo sapiens
cagatatattcatttgcagtgc

SEQ ID NO: 8193558 - DNA, 22 bp, Homo sapiens
cagatacagctagctccgtggc

SEQ ID NO: 8193559 - DNA, 22 bp, Homo sapiens
cagatacagctagctccgtggc

SEQ ID NO: 8193560 - DNA, 22 bp, Homo sapiens
cagataaatagatagataaact

SEQ ID NO: 8193561 - DNA, 22 bp, Homo sapiens
cagataaatagatagataaact

SEQ ID NO: 8193562 - DNA, 22 bp, Homo sapiens
cagataaatagatagataaact

SEQ ID NO: 8193563 - DNA, 20 bp, Homo sapiens
cagataaacgggaaagaagc

SEQ ID NO: 8193564 - DNA, 20 bp, Homo sapiens
cagataaacgggaaagaagc

SEQ ID NO: 8193565 - DNA, 22 bp, Homo sapiens
cagataaaggcttactagtagt

SEQ ID NO: 8193566 - DNA, 22 bp, Homo sapiens
ggtgcagaggagccagctgggg

SEQ ID NO: 8193567 - DNA, 22 bp, Homo sapiens
ggtgcagagcagtgtcagagca

SEQ ID NO: 8193568 - DNA, 22 bp, Homo sapiens
ggtgcagaaggaagggagctgg

SEQ ID NO: 8193569 - DNA, 22 bp, Homo sapiens
ggtgcagaagaaagcagtcatt

SEQ ID NO: 8193570 - DNA, 22 bp, Homo sapiens
ggtgcagaaggaagggagctgg

SEQ ID NO: 8193571 - DNA, 22 bp, Homo sapiens
ggtgcagaaggaagggagctgg

SEQ ID NO: 8193572 - DNA, 22 bp, Homo sapiens
ggtgcaaggccaccatctagtg

SEQ ID NO: 8193573 - DNA, 22 bp, Homo sapiens
ggtgcaaggccaccatctagtg

SEQ ID NO: 8193574 - DNA, 22 bp, Homo sapiens
ggtgcaagttttttgaggaagt

SEQ ID NO: 8193575 - DNA, 22 bp, Homo sapiens
ggtgcaagtggctagggaccag

SEQ ID NO: 8193576 - DNA, 22 bp, Homo sapiens
ggtgcaagggttgagttgagtg

SEQ ID NO: 8193577 - DNA, 22 bp, Homo sapiens
ggtgcaagagctccaggccctg

SEQ ID NO: 8193578 - DNA, 22 bp, Homo sapiens
ggtgcaagagctccaggccctg

SEQ ID NO: 8193579 - DNA, 22 bp, Homo sapiens
ggtgcaaacgtaattgtggttt

SEQ ID NO: 8193580 - DNA, 22 bp, Homo sapiens
ggtgcaaaagtagttctgcttt

SEQ ID NO: 8193581 - DNA, 22 bp, Homo sapiens
ggtgcaaaagtagttctgcttt

SEQ ID NO: 8193582 - DNA, 22 bp, Homo sapiens
ggtgcaggaaaattacctggag

SEQ ID NO: 8193583 - DNA, 18 bp, Homo sapiens
cagatgctaggcctccag

SEQ ID NO: 8193584 - DNA, 22 bp, Homo sapiens
ggtgcagctgcagcctgggagc

SEQ ID NO: 8193585 - DNA, 22 bp, Homo sapiens
ggtgcagctgcagcctgggagc

SEQ ID NO: 8193586 - DNA, 22 bp, Homo sapiens
ggtgcagaggagccagctgggg

SEQ ID NO: 8193587 - DNA, 22 bp, Homo sapiens
ggtgcagagtccacagaaagct

SEQ ID NO: 8193588 - DNA, 22 bp, Homo sapiens
ggtgcagagtccacagaaagct

SEQ ID NO: 8193589 - DNA, 22 bp, Homo sapiens
ggtgcagagtccacagaaagct

SEQ ID NO: 8193590 - DNA, 22 bp, Homo sapiens
ggtgcagcctccccagtgacag

SEQ ID NO: 8193591 - DNA, 22 bp, Homo sapiens
cagatgcttcgtgggtgagcac

SEQ ID NO: 8193592 - DNA, 22 bp, Homo sapiens
cagatgctggtatgggggaggt

SEQ ID NO: 8193593 - DNA, 20 bp, Homo sapiens
cagatgctggatcttggtcc

SEQ ID NO: 8193594 - DNA, 22 bp, Homo sapiens
cagatgctgcctgggaatgtct

SEQ ID NO: 8193595 - DNA, 22 bp, Homo sapiens
cagatgctgctatttcaccctg

SEQ ID NO: 8193596 - DNA, 22 bp, Homo sapiens
cagatgctgctcacctgattat

SEQ ID NO: 8193597 - DNA, 22 bp, Homo sapiens
cagatgctatgtattatgtatg

SEQ ID NO: 8193598 - DNA, 22 bp, Homo sapiens
cagatgctatagtgctgccata

SEQ ID NO: 8193599 - DNA, 22 bp, Homo sapiens
ggggtatgcttagtaagtacca

SEQ ID NO: 8193600 - DNA, 22 bp, Homo sapiens
ggggtagggtgattgtgaagta

SEQ ID NO: 8193601 - DNA, 22 bp, Homo sapiens
ggggtaggtcatagcccctcta

SEQ ID NO: 8193602 - DNA, 22 bp, Homo sapiens
ggggtagggtgattgtgaagta

SEQ ID NO: 8193603 - DNA, 22 bp, Homo sapiens
ggggtagggtgattgtgaagta

SEQ ID NO: 8193604 - DNA, 22 bp, Homo sapiens
ggggtagggtgattgtgaagta

SEQ ID NO: 8193605 - DNA, 22 bp, Homo sapiens
cagaggctgctctgggtggcat

SEQ ID NO: 8193606 - DNA, 22 bp, Homo sapiens
ggggtagggtgattgtgaagta

SEQ ID NO: 8193607 - DNA, 22 bp, Homo sapiens
cagaggctgctctgggtggcat

SEQ ID NO: 8193608 - DNA, 22 bp, Homo sapiens
cagaggctgctctgggtggcat

SEQ ID NO: 8193609 - DNA, 22 bp, Homo sapiens
cagaggctgctctgggtggcat

SEQ ID NO: 8193610 - DNA, 22 bp, Homo sapiens
cagaggctgccagccatgtgca

SEQ ID NO: 8193611 - DNA, 22 bp, Homo sapiens
cagaggctgccagccatgtgca

SEQ ID NO: 8193612 - DNA, 22 bp, Homo sapiens
cagaggctgatgtgggatgggc

SEQ ID NO: 8193613 - DNA, 22 bp, Homo sapiens
cagaggctgagcagtcagtttg

SEQ ID NO: 8193614 - DNA, 22 bp, Homo sapiens
cagaggctgatggctgtagcca

SEQ ID NO: 8193615 - DNA, 22 bp, Homo sapiens
cagaggctgagcagtcagtttg

SEQ ID NO: 8193616 - DNA, 21 bp, Homo sapiens
cagaggctgagagggcaatct

SEQ ID NO: 8193617 - DNA, 22 bp, Homo sapiens
cagaggctgatgtgggatgggc

SEQ ID NO: 8193618 - DNA, 22 bp, Homo sapiens
cagaggctgatggctgtagcca

SEQ ID NO: 8193619 - DNA, 21 bp, Homo sapiens
cagaggctgagagggcaatct

SEQ ID NO: 8193620 - DNA, 22 bp, Homo sapiens
cagaggctgaccctgctgttgt

SEQ ID NO: 8193621 - DNA, 22 bp, Homo sapiens
cagaggcctttctacagtgata

SEQ ID NO: 8193622 - DNA, 22 bp, Homo sapiens
cagaggcctttctacagtgata

SEQ ID NO: 8193623 - DNA, 22 bp, Homo sapiens
cagaggctgaccctgctgttgt

SEQ ID NO: 8193624 - DNA, 22 bp, Homo sapiens
cagaggcaggataagaactgcg

SEQ ID NO: 8193625 - DNA, 22 bp, Homo sapiens
cagaggcctttctacagtgata

SEQ ID NO: 8193626 - DNA, 22 bp, Homo sapiens
cagaggcaggataagaactgcg

SEQ ID NO: 8193627 - DNA, 22 bp, Homo sapiens
ggggtctgggcttagctggaat

SEQ ID NO: 8193628 - DNA, 22 bp, Homo sapiens
ggggtctgctgcggagcagaga

SEQ ID NO: 8193629 - DNA, 22 bp, Homo sapiens
cagagtgaaaactgagctcaaa

SEQ ID NO: 8193630 - DNA, 22 bp, Homo sapiens
cagagtgaaaactgagctcaaa

SEQ ID NO: 8193631 - DNA, 22 bp, Homo sapiens
cagagtgaaaactgagctcaaa

SEQ ID NO: 8193632 - DNA, 22 bp, Homo sapiens
ggggtgagatcaaggaagccct

SEQ ID NO: 8193633 - DNA, 22 bp, Homo sapiens
ggggtgagatcaaggaagccct

SEQ ID NO: 8193634 - DNA, 22 bp, Homo sapiens
ggggtcggggcatagccactta

SEQ ID NO: 8193635 - DNA, 22 bp, Homo sapiens
ggggtcggggcatagccactta

SEQ ID NO: 8193636 - DNA, 22 bp, Homo sapiens
ggggtctgctgcggagcagaga

SEQ ID NO: 8193637 - DNA, 22 bp, Homo sapiens
ggggtctgctgcggagcagaga

SEQ ID NO: 8193638 - DNA, 22 bp, Homo sapiens
ggggtcaagctcagaatcctag

SEQ ID NO: 8193639 - DNA, 21 bp, Homo sapiens
ggggtcaagtgaatggtgttg

SEQ ID NO: 8193640 - DNA, 21 bp, Homo sapiens
ggggtcaagtgaatggtgttg

SEQ ID NO: 8193641 - DNA, 22 bp, Homo sapiens
cagagtggtgcaagggcagtgt

SEQ ID NO: 8193642 - DNA, 22 bp, Homo sapiens
cagagtggtgcaagggcagtgt

SEQ ID NO: 8193643 - DNA, 22 bp, Homo sapiens
cagagtgggctgtcagccacca

SEQ ID NO: 8193644 - DNA, 22 bp, Homo sapiens
cagagtgtggcatcttccaact

SEQ ID NO: 8193645 - DNA, 22 bp, Homo sapiens
cagagtggtgcaagggcagtgt

SEQ ID NO: 8193646 - DNA, 22 bp, Homo sapiens
cagagtgtttctttgggtgggt

SEQ ID NO: 8193647 - DNA, 22 bp, Homo sapiens
cagagtgtttctttgggtgggt

SEQ ID NO: 8193648 - DNA, 22 bp, Homo sapiens
cagagttcaaagcctgctggga

SEQ ID NO: 8193649 - DNA, 22 bp, Homo sapiens
cagagtttcggtaagcatagaa

SEQ ID NO: 8193650 - DNA, 19 bp, Homo sapiens
cagagtttgcaggcagagg

SEQ ID NO: 8193651 - DNA, 22 bp, Homo sapiens
ggtgtccttgtcctttggtacc

SEQ ID NO: 8193652 - DNA, 22 bp, Homo sapiens
ggtgtcctttgggggctccgag

SEQ ID NO: 8193653 - DNA, 22 bp, Homo sapiens
ggtgtccttgttgaacgaaaat

SEQ ID NO: 8193654 - DNA, 22 bp, Homo sapiens
ggtgtcctttgggggctccgag

SEQ ID NO: 8193655 - DNA, 22 bp, Homo sapiens
ggtgtccttgttgaacgaaaat

SEQ ID NO: 8193656 - DNA, 22 bp, Homo sapiens
ggtgtcctttgggggctccgag

SEQ ID NO: 8193657 - DNA, 22 bp, Homo sapiens
ggtgtccttgtcctttggtacc

SEQ ID NO: 8193658 - DNA, 20 bp, Homo sapiens
cagcagagacccatggggag

SEQ ID NO: 8193659 - DNA, 22 bp, Homo sapiens
ggtgtctcagctgctggcaggg

SEQ ID NO: 8193660 - DNA, 22 bp, Homo sapiens
ggtgtctatgattcagtttatg

SEQ ID NO: 8193661 - DNA, 22 bp, Homo sapiens
ggtgtctatgattcagtttatg

SEQ ID NO: 8193662 - DNA, 19 bp, Homo sapiens
ggtgtgaagtgaggagtta

SEQ ID NO: 8193663 - DNA, 22 bp, Homo sapiens
ggtgtctgttgcctcctggtta

SEQ ID NO: 8193664 - DNA, 22 bp, Homo sapiens
ggtgtctgttgcctcctggtta

SEQ ID NO: 8193665 - DNA, 22 bp, Homo sapiens
ggtgtctgtgatggcatataac

SEQ ID NO: 8193666 - DNA, 22 bp, Homo sapiens
ggtgtctgatggtggcttctca

SEQ ID NO: 8193667 - DNA, 22 bp, Homo sapiens
cagcagactggagtaggcagtg

SEQ ID NO: 8193668 - DNA, 22 bp, Homo sapiens
cagcagacttactagaatgtaa

SEQ ID NO: 8193669 - DNA, 22 bp, Homo sapiens
cagcagactggagtaggcagtg

SEQ ID NO: 8193670 - DNA, 21 bp, Homo sapiens
cagcagaagcatctatggaag

SEQ ID NO: 8193671 - DNA, 20 bp, Homo sapiens
cagcagagacccatggggag

SEQ ID NO: 8193672 - DNA, 18 bp, Homo sapiens
cagcagagacattcaaaa

SEQ ID NO: 8193673 - DNA, 22 bp, Homo sapiens
cagcagagaaattacatatttg

SEQ ID NO: 8193674 - DNA, 22 bp, Homo sapiens
cagcagagaaattacatatttg

SEQ ID NO: 8193675 - DNA, 22 bp, Homo sapiens
cagcagagaaattaaacttctg

SEQ ID NO: 8193676 - DNA, 22 bp, Homo sapiens
gtaacatttacagttcctagag

SEQ ID NO: 8193677 - DNA, 22 bp, Homo sapiens
gtaaacatcagccactctattt

SEQ ID NO: 8193678 - DNA, 22 bp, Homo sapiens
gtaacattattcatgagataca

SEQ ID NO: 8193679 - DNA, 22 bp, Homo sapiens
gtaaacatcgacccaacagggg

SEQ ID NO: 8193680 - DNA, 19 bp, Homo sapiens
ggtgtgaagtgaggagtta

SEQ ID NO: 8193681 - DNA, 22 bp, Homo sapiens
ggtgtgattatgacatgtgact

SEQ ID NO: 8193682 - DNA, 22 bp, Homo sapiens
ggtgtgactcgccctcagggac

SEQ ID NO: 8193683 - DNA, 22 bp, Homo sapiens
gtaagcacatgtgtgtgcatgg

SEQ ID NO: 8193684 - DNA, 22 bp, Homo sapiens
gtaagcaaacagcaaatgattt

SEQ ID NO: 8193685 - DNA, 22 bp, Homo sapiens
gtaagaggagtgggaagcctca

SEQ ID NO: 8193686 - DNA, 22 bp, Homo sapiens
gtaagaggatcaaggcggtgca

SEQ ID NO: 8193687 - DNA, 22 bp, Homo sapiens
gtaagaggagtgggaagcctca

SEQ ID NO: 8193688 - DNA, 22 bp, Homo sapiens
gtaagaagatgaatccaggctg

SEQ ID NO: 8193689 - DNA, 17 bp, Homo sapiens
gtaaggcttgcagatgc

SEQ ID NO: 8193690 - DNA, 22 bp, Homo sapiens
gtaaggcaatagtaaggagtcc

SEQ ID NO: 8193691 - DNA, 22 bp, Homo sapiens
gtaagcattcattgtctgtata

SEQ ID NO: 8193692 - DNA, 22 bp, Homo sapiens
gtaagcagaggttaatgttaac

SEQ ID NO: 8193693 - DNA, 22 bp, Homo sapiens
cagcagagacggtaagcagaac

SEQ ID NO: 8193694 - DNA, 20 bp, Homo sapiens
cagcagagacccatggggag

SEQ ID NO: 8193695 - DNA, 20 bp, Homo sapiens
cagcagagacccatggggag

SEQ ID NO: 8193696 - DNA, 18 bp, Homo sapiens
ggtggcaggtcagatgcc

SEQ ID NO: 8193697 - DNA, 18 bp, Homo sapiens
ggtggcaggtcagatgcc

SEQ ID NO: 8193698 - DNA, 18 bp, Homo sapiens
ggtggcaggtcagatgcc

SEQ ID NO: 8193699 - DNA, 18 bp, Homo sapiens
ggtggcaggtcagatgcc

SEQ ID NO: 8193700 - DNA, 18 bp, Homo sapiens
ggtggcaggtcagatgcc

SEQ ID NO: 8193701 - DNA, 22 bp, Homo sapiens
ggtggcagtagcactgggcctg

SEQ ID NO: 8193702 - DNA, 22 bp, Homo sapiens
ggtggcagtagcactgggcctg

SEQ ID NO: 8193703 - DNA, 18 bp, Homo sapiens
ggtggcaggtcagatgcc

SEQ ID NO: 8193704 - DNA, 22 bp, Homo sapiens
ggtggcagtagcactgggcctg

SEQ ID NO: 8193705 - DNA, 22 bp, Homo sapiens
ggtggcagtcttaagagatctt

SEQ ID NO: 8193706 - DNA, 22 bp, Homo sapiens
ggtggcagtagcactgggcctg

SEQ ID NO: 8193707 - DNA, 22 bp, Homo sapiens
ggtggcagtagcactgggcctg

SEQ ID NO: 8193708 - DNA, 22 bp, Homo sapiens
ggtggcagtagcactgggcctg

SEQ ID NO: 8193709 - DNA, 22 bp, Homo sapiens
ggtggcagtagcactgggcctg

SEQ ID NO: 8193710 - DNA, 22 bp, Homo sapiens
ggtggcagtgcttgcgggtcta

SEQ ID NO: 8193711 - DNA, 22 bp, Homo sapiens
ggtggcagtgcttgcgggtcta

SEQ ID NO: 8193712 - DNA, 22 bp, Homo sapiens
ggtggcagtcttaagagatctt

SEQ ID NO: 8193713 - DNA, 22 bp, Homo sapiens
ggtggcagtcttaagagatctt

SEQ ID NO: 8193714 - DNA, 22 bp, Homo sapiens
cagatggattttgtaggctgat

SEQ ID NO: 8193715 - DNA, 22 bp, Homo sapiens
cagatggcaacagctctgtgac

SEQ ID NO: 8193716 - DNA, 22 bp, Homo sapiens
ggtggcagggagtgtccctggg

SEQ ID NO: 8193717 - DNA, 22 bp, Homo sapiens
ggtggcagggagtgtccctggg

SEQ ID NO: 8193718 - DNA, 22 bp, Homo sapiens
ggtggcagggagtgtccctggg

SEQ ID NO: 8193719 - DNA, 22 bp, Homo sapiens
ggtggcaggctggcattggcaa

SEQ ID NO: 8193720 - DNA, 22 bp, Homo sapiens
ggtgctggttcagggtggctgt

SEQ ID NO: 8193721 - DNA, 22 bp, Homo sapiens
ggtgctggttcagggtggctgt

SEQ ID NO: 8193722 - DNA, 22 bp, Homo sapiens
ggtgctggttcagggtggctgt

SEQ ID NO: 8193723 - DNA, 22 bp, Homo sapiens
cagatggaacacagaaaggaga

SEQ ID NO: 8193724 - DNA, 22 bp, Homo sapiens
cagatgcttttgattctggggt

SEQ ID NO: 8193725 - DNA, 22 bp, Homo sapiens
cagatgcttggaggacacttgg

SEQ ID NO: 8193726 - DNA, 22 bp, Homo sapiens
cagatgcttgttggctggtctc

SEQ ID NO: 8193727 - DNA, 22 bp, Homo sapiens
cagatgcttgttggctggtctc

SEQ ID NO: 8193728 - DNA, 22 bp, Homo sapiens
cagatggaaggcatagaggttt

SEQ ID NO: 8193729 - DNA, 22 bp, Homo sapiens
cagatggagtcccgtggagttc

SEQ ID NO: 8193730 - DNA, 22 bp, Homo sapiens
cagatggagtcccgtggagttc

SEQ ID NO: 8193731 - DNA, 22 bp, Homo sapiens
ggtggcagtggtctctgacaga

SEQ ID NO: 8193732 - DNA, 22 bp, Homo sapiens
ggtggcagtgcttgcgggtcta

SEQ ID NO: 8193733 - DNA, 22 bp, Homo sapiens
ggtggcagtggtctctgacaga

SEQ ID NO: 8193734 - DNA, 22 bp, Homo sapiens
ggtggcagtggtctctgacaga

SEQ ID NO: 8193735 - DNA, 22 bp, Homo sapiens
ggtggcagtggtctctgacaga

SEQ ID NO: 8193736 - DNA, 22 bp, Homo sapiens
ggtggctggaggagctgatgga

SEQ ID NO: 8193737 - DNA, 22 bp, Homo sapiens
ggtggctgcttcctcaagagga

SEQ ID NO: 8193738 - DNA, 22 bp, Homo sapiens
ggtggctgcttcctcaagagga

SEQ ID NO: 8193739 - DNA, 22 bp, Homo sapiens
ggtggctggaggagctgatgga

SEQ ID NO: 8193740 - DNA, 22 bp, Homo sapiens
ggtggctggaggagctgatgga

SEQ ID NO: 8193741 - DNA, 22 bp, Homo sapiens
ggtggctggaggagctgatgga

SEQ ID NO: 8193742 - DNA, 22 bp, Homo sapiens
ggtggctggaggagctgatgga

SEQ ID NO: 8193743 - DNA, 22 bp, Homo sapiens
ggtggctggaggagctgatgga

SEQ ID NO: 8193744 - DNA, 18 bp, Homo sapiens
ggtggctggggacggaca

SEQ ID NO: 8193745 - DNA, 22 bp, Homo sapiens
cagcactgctgctgtacacaca

SEQ ID NO: 8193746 - DNA, 22 bp, Homo sapiens
ggtgggaaggggccagtgtgcg

SEQ ID NO: 8193747 - DNA, 22 bp, Homo sapiens
ggtgggaaggggccagtgtgcg

SEQ ID NO: 8193748 - DNA, 22 bp, Homo sapiens
ggtgggaaggccactgaaggtt

SEQ ID NO: 8193749 - DNA, 22 bp, Homo sapiens
ggtgggaaggccactgaaggtt

SEQ ID NO: 8193750 - DNA, 22 bp, Homo sapiens
ggtgggaaggccactgaaggtt

SEQ ID NO: 8193751 - DNA, 22 bp, Homo sapiens
gggctcaggcctggcctctcac

SEQ ID NO: 8193752 - DNA, 22 bp, Homo sapiens
gggctcaggcctggcctctcac

SEQ ID NO: 8193753 - DNA, 22 bp, Homo sapiens
gggctcaggcctggcctctcac

SEQ ID NO: 8193754 - DNA, 22 bp, Homo sapiens
gggctcaggcctggcctctcac

SEQ ID NO: 8193755 - DNA, 22 bp, Homo sapiens
gggctcaggagtttgaggctgc

SEQ ID NO: 8193756 - DNA, 22 bp, Homo sapiens
gggctcaggagtttgaggctgc

SEQ ID NO: 8193757 - DNA, 22 bp, Homo sapiens
gggctcaggcctggcctctcac

SEQ ID NO: 8193758 - DNA, 22 bp, Homo sapiens
gggctcaggagtttgaggctgc

SEQ ID NO: 8193759 - DNA, 22 bp, Homo sapiens
gggctcaggtcagggcatcagc

SEQ ID NO: 8193760 - DNA, 22 bp, Homo sapiens
gggctcagggacacatgtgtgt

SEQ ID NO: 8193761 - DNA, 22 bp, Homo sapiens
gggctcagggacacatgtgtgt

SEQ ID NO: 8193762 - DNA, 22 bp, Homo sapiens
gggctcaggtcagggcatcagc

SEQ ID NO: 8193763 - DNA, 22 bp, Homo sapiens
gggctcagtcctggttctaccc

SEQ ID NO: 8193764 - DNA, 22 bp, Homo sapiens
gggctcagtctgcggcgcgcgg

SEQ ID NO: 8193765 - DNA, 22 bp, Homo sapiens
gggctcagtctgcggcgcgcgg

SEQ ID NO: 8193766 - DNA, 22 bp, Homo sapiens
gggctcagtcggcaagcccctt

SEQ ID NO: 8193767 - DNA, 22 bp, Homo sapiens
gggctcagtcggcaagcccctt

SEQ ID NO: 8193768 - DNA, 21 bp, Homo sapiens
gggctcagtggaaaagagtgt

SEQ ID NO: 8193769 - DNA, 22 bp, Homo sapiens
gggctcagtctggcgtggaatg

SEQ ID NO: 8193770 - DNA, 21 bp, Homo sapiens
gggctcagtggaaaagagtgt

SEQ ID NO: 8193771 - DNA, 18 bp, Homo sapiens
gggctctgatccttcacc

SEQ ID NO: 8193772 - DNA, 18 bp, Homo sapiens
gggctctgatccttcacc

SEQ ID NO: 8193773 - DNA, 22 bp, Homo sapiens
gggctctgatagagattattgc

SEQ ID NO: 8193774 - DNA, 22 bp, Homo sapiens
gggctctgatagagattattgc

SEQ ID NO: 8193775 - DNA, 18 bp, Homo sapiens
gggctctgatccttcacc

SEQ ID NO: 8193776 - DNA, 18 bp, Homo sapiens
gggctctgatccttcacc

SEQ ID NO: 8193777 - DNA, 22 bp, Homo sapiens
gggctctgcacgttctggcgtc

SEQ ID NO: 8193778 - DNA, 22 bp, Homo sapiens
gggctctgcagagaactggctc

SEQ ID NO: 8193779 - DNA, 22 bp, Homo sapiens
gggctctgcagagaactggctc

SEQ ID NO: 8193780 - DNA, 22 bp, Homo sapiens
gggctctgcagagaactggctc

SEQ ID NO: 8193781 - DNA, 22 bp, Homo sapiens
gggctctgcacgttctggcgtc

SEQ ID NO: 8193782 - DNA, 22 bp, Homo sapiens
gggctctgcacgttctggcgtc

SEQ ID NO: 8193783 - DNA, 22 bp, Homo sapiens
gggctctgcagtgacttgaggg

SEQ ID NO: 8193784 - DNA, 22 bp, Homo sapiens
gggctctgcagtgacttgaggg

SEQ ID NO: 8193785 - DNA, 22 bp, Homo sapiens
gggctctgcagtgacttgaggg

SEQ ID NO: 8193786 - DNA, 22 bp, Homo sapiens
gggctctgcagtgacttgaggg

SEQ ID NO: 8193787 - DNA, 22 bp, Homo sapiens
gggctctgcagagaactggctc

SEQ ID NO: 8193788 - DNA, 22 bp, Homo sapiens
gggctctgcgctcagctccagc

SEQ ID NO: 8193789 - DNA, 22 bp, Homo sapiens
gggctctgcgctcagctccagc

SEQ ID NO: 8193790 - DNA, 22 bp, Homo sapiens
gggctctgcgctcagctccagc

SEQ ID NO: 8193791 - DNA, 22 bp, Homo sapiens
gggctctgcgctcagctccagc

SEQ ID NO: 8193792 - DNA, 22 bp, Homo sapiens
gggctctgcgggcccggactcc

SEQ ID NO: 8193793 - DNA, 22 bp, Homo sapiens
cagagctgtcatttgccagtga

SEQ ID NO: 8193794 - DNA, 22 bp, Homo sapiens
cagagcttctgacagctgctgc

SEQ ID NO: 8193795 - DNA, 22 bp, Homo sapiens
cagagcttctgacagctgctgc

SEQ ID NO: 8193796 - DNA, 22 bp, Homo sapiens
cagagctgtcatttgccagtga

SEQ ID NO: 8193797 - DNA, 22 bp, Homo sapiens
cagagctgtcatttgccagtga

SEQ ID NO: 8193798 - DNA, 22 bp, Homo sapiens
gggctctgcctggctgggagta

SEQ ID NO: 8193799 - DNA, 22 bp, Homo sapiens
gggctctgcctggctgggagta

SEQ ID NO: 8193800 - DNA, 22 bp, Homo sapiens
gggctctgcctggctgggagta

SEQ ID NO: 8193801 - DNA, 22 bp, Homo sapiens
gggctctgcctggctgggagta

SEQ ID NO: 8193802 - DNA, 21 bp, Homo sapiens
gggctctgccctcctggagct

SEQ ID NO: 8193803 - DNA, 21 bp, Homo sapiens
gggctctgccctcctggagct

SEQ ID NO: 8193804 - DNA, 21 bp, Homo sapiens
gggctctgccctcctggagct

SEQ ID NO: 8193805 - DNA, 21 bp, Homo sapiens
gggctctgccctcctggagct

SEQ ID NO: 8193806 - DNA, 20 bp, Homo sapiens
gggctctgcatccatcagcc

SEQ ID NO: 8193807 - DNA, 20 bp, Homo sapiens
gggctctgcatccatcagcc

SEQ ID NO: 8193808 - DNA, 20 bp, Homo sapiens
gggctctgcatccatcagcc

SEQ ID NO: 8193809 - DNA, 20 bp, Homo sapiens
gggctctgcatccatcagcc

SEQ ID NO: 8193810 - DNA, 22 bp, Homo sapiens
cagaggaaagtatttctggaag

SEQ ID NO: 8193811 - DNA, 22 bp, Homo sapiens
cagaggaaagtatttctggaag

SEQ ID NO: 8193812 - DNA, 22 bp, Homo sapiens
cagagctttttacattaatgat

SEQ ID NO: 8193813 - DNA, 22 bp, Homo sapiens
cagagctttttacattaatgat

SEQ ID NO: 8193814 - DNA, 22 bp, Homo sapiens
cagagcttttagatgttgaaca

SEQ ID NO: 8193815 - DNA, 22 bp, Homo sapiens
cagagcttttagatgttgaaca

SEQ ID NO: 8193816 - DNA, 22 bp, Homo sapiens
cagagcttggctgtggttgtga

SEQ ID NO: 8193817 - DNA, 21 bp, Homo sapiens
cagagcttgctgagaggcctg

SEQ ID NO: 8193818 - DNA, 22 bp, Homo sapiens
cagagcttgaatgtccatggtt

SEQ ID NO: 8193819 - DNA, 22 bp, Homo sapiens
cagagcttgaatccaacaaaga

SEQ ID NO: 8193820 - DNA, 22 bp, Homo sapiens
cagagcttgaatgtccatggtt

SEQ ID NO: 8193821 - DNA, 22 bp, Homo sapiens
cagaggaaatgggaaggagata

SEQ ID NO: 8193822 - DNA, 22 bp, Homo sapiens
cagaggaaatgggaaggagata

SEQ ID NO: 8193823 - DNA, 22 bp, Homo sapiens
cagaggaacgtttggattgatt

SEQ ID NO: 8193824 - DNA, 22 bp, Homo sapiens
cagaggaaatgggaaggagata

SEQ ID NO: 8193825 - DNA, 22 bp, Homo sapiens
cagaggaaatgggaaggagata

SEQ ID NO: 8193826 - DNA, 22 bp, Homo sapiens
cagaggaagagatacaagccct

SEQ ID NO: 8193827 - DNA, 22 bp, Homo sapiens
cagaggaacgtttggattgatt

SEQ ID NO: 8193828 - DNA, 22 bp, Homo sapiens
gggggaggtgaatgcaataagg

SEQ ID NO: 8193829 - DNA, 22 bp, Homo sapiens
gggggaggtgaatgcaataagg

SEQ ID NO: 8193830 - DNA, 22 bp, Homo sapiens
gggggaggtgaatgcaataagg

SEQ ID NO: 8193831 - DNA, 22 bp, Homo sapiens
gggggaggtgaatgcaataagg

SEQ ID NO: 8193832 - DNA, 22 bp, Homo sapiens
cagaggaagcagacacatcttg

SEQ ID NO: 8193833 - DNA, 22 bp, Homo sapiens
cagaggaagcagacacatcttg

SEQ ID NO: 8193834 - DNA, 22 bp, Homo sapiens
cagaggaagcagacacatcttg

SEQ ID NO: 8193835 - DNA, 22 bp, Homo sapiens
cagaggaagagatacaagccct

SEQ ID NO: 8193836 - DNA, 22 bp, Homo sapiens
cagaggaagagatacaagccct

SEQ ID NO: 8193837 - DNA, 22 bp, Homo sapiens
cagaggaagctgggtgtggagt

SEQ ID NO: 8193838 - DNA, 22 bp, Homo sapiens
cagaggaaggctctgggaatgt

SEQ ID NO: 8193839 - DNA, 22 bp, Homo sapiens
cagaggaaggctctgggaatgt

SEQ ID NO: 8193840 - DNA, 22 bp, Homo sapiens
cagaggaagctgggtgtggagt

SEQ ID NO: 8193841 - DNA, 22 bp, Homo sapiens
cagaggaagggtgctgcgaaag

SEQ ID NO: 8193842 - DNA, 22 bp, Homo sapiens
cagaggaaggctctgggaatgt

SEQ ID NO: 8193843 - DNA, 22 bp, Homo sapiens
cagaggaagggtgctgcgaaag

SEQ ID NO: 8193844 - DNA, 22 bp, Homo sapiens
cagaggacaatagaatggaaag

SEQ ID NO: 8193845 - DNA, 22 bp, Homo sapiens
cagaggaagttccttgatgaga

SEQ ID NO: 8193846 - DNA, 22 bp, Homo sapiens
cagaggaagttccttgatgaga

SEQ ID NO: 8193847 - DNA, 22 bp, Homo sapiens
gggggcagtaacctcaaagtgt

SEQ ID NO: 8193848 - DNA, 22 bp, Homo sapiens
gggggcagtaacctcaaagtgt

SEQ ID NO: 8193849 - DNA, 22 bp, Homo sapiens
gggggcagtaaggatatggaaa

SEQ ID NO: 8193850 - DNA, 22 bp, Homo sapiens
gggggcagtaaggatatggaaa

SEQ ID NO: 8193851 - DNA, 19 bp, Homo sapiens
cagaggcactttctcttag

SEQ ID NO: 8193852 - DNA, 19 bp, Homo sapiens
cagaggcactttctcttag

SEQ ID NO: 8193853 - DNA, 22 bp, Homo sapiens
gggggcaggtctggaactttga

SEQ ID NO: 8193854 - DNA, 22 bp, Homo sapiens
gggggcagaatgtactcttgtc

SEQ ID NO: 8193855 - DNA, 22 bp, Homo sapiens
gggggatgctcaggaggctgct

SEQ ID NO: 8193856 - DNA, 22 bp, Homo sapiens
gggggatgctcaggaggctgct

SEQ ID NO: 8193857 - DNA, 22 bp, Homo sapiens
cagaggcagaggtcatctctgg

SEQ ID NO: 8193858 - DNA, 22 bp, Homo sapiens
cagaggcagccgggggagaacg

SEQ ID NO: 8193859 - DNA, 22 bp, Homo sapiens
cagaggcagccgggggagaacg

SEQ ID NO: 8193860 - DNA, 22 bp, Homo sapiens
cagaggcagccgggggagaacg

SEQ ID NO: 8193861 - DNA, 22 bp, Homo sapiens
cagaggcaggaagatgggcagt

SEQ ID NO: 8193862 - DNA, 22 bp, Homo sapiens
cagaggcaggaagatgggcagt

SEQ ID NO: 8193863 - DNA, 22 bp, Homo sapiens
cagaggcaggaagatgggcagt

SEQ ID NO: 8193864 - DNA, 22 bp, Homo sapiens
cagaggcaggaagatgggcagt

SEQ ID NO: 8193865 - DNA, 22 bp, Homo sapiens
cagaggcaggaagatgggcagt

SEQ ID NO: 8193866 - DNA, 22 bp, Homo sapiens
cagaggcagaatggagatttgg

SEQ ID NO: 8193867 - DNA, 22 bp, Homo sapiens
cagaggcagaatggagatttgg

SEQ ID NO: 8193868 - DNA, 22 bp, Homo sapiens
cagaggcagaatggagatttgg

SEQ ID NO: 8193869 - DNA, 22 bp, Homo sapiens
cagaggcagaatggagatttgg

SEQ ID NO: 8193870 - DNA, 22 bp, Homo sapiens
cagaggcagaccctccagggcg

SEQ ID NO: 8193871 - DNA, 22 bp, Homo sapiens
cagaggcagaggtcatctctgg

SEQ ID NO: 8193872 - DNA, 22 bp, Homo sapiens
cagaggcagaggtcatctctgg

SEQ ID NO: 8193873 - DNA, 20 bp, Homo sapiens
cagaagcaaggcaggtacct

SEQ ID NO: 8193874 - DNA, 22 bp, Homo sapiens
cagaagcaagggccaaagtctt

SEQ ID NO: 8193875 - DNA, 20 bp, Homo sapiens
cagaagcaaggcaggtacct

SEQ ID NO: 8193876 - DNA, 22 bp, Homo sapiens
cagaagcaagagccggagctag

SEQ ID NO: 8193877 - DNA, 22 bp, Homo sapiens
cagaagcaagggccaaagtctt

SEQ ID NO: 8193878 - DNA, 22 bp, Homo sapiens
cagaagcaagtagtgattcttt

SEQ ID NO: 8193879 - DNA, 22 bp, Homo sapiens
cagaagcaagtagtgattcttt

SEQ ID NO: 8193880 - DNA, 22 bp, Homo sapiens
cagaagcaaatgccttgctgag

SEQ ID NO: 8193881 - DNA, 22 bp, Homo sapiens
cagaagcaaatgccttgctgag

SEQ ID NO: 8193882 - DNA, 22 bp, Homo sapiens
cagaagcaaatgccttgctgag

SEQ ID NO: 8193883 - DNA, 22 bp, Homo sapiens
cagaagcaaatgccttgctgag

SEQ ID NO: 8193884 - DNA, 22 bp, Homo sapiens
cagaagatgctttgtaaaatga

SEQ ID NO: 8193885 - DNA, 22 bp, Homo sapiens
cagaagatgcagtgtctgagaa

SEQ ID NO: 8193886 - DNA, 22 bp, Homo sapiens
cagaagcagattctaaagcaag

SEQ ID NO: 8193887 - DNA, 18 bp, Homo sapiens
cagaagcaggcagtgcag

SEQ ID NO: 8193888 - DNA, 22 bp, Homo sapiens
cagaagcagaacactagattta

SEQ ID NO: 8193889 - DNA, 22 bp, Homo sapiens
cagaagcactaggaggaaacgt

SEQ ID NO: 8193890 - DNA, 22 bp, Homo sapiens
cagaagcactaggaggaaacgt

SEQ ID NO: 8193891 - DNA, 22 bp, Homo sapiens
cagaagcactaggaggaaacgt

SEQ ID NO: 8193892 - DNA, 23 bp, Homo sapiens
cagaagcacctgttgactgctgc

SEQ ID NO: 8193893 - DNA, 22 bp, Homo sapiens
cagaagcacatgtttacatgta

SEQ ID NO: 8193894 - DNA, 23 bp, Homo sapiens
cagaagcacctgttgactgctgc

SEQ ID NO: 8193895 - DNA, 22 bp, Homo sapiens
cagagagaggtgccgataatgg

SEQ ID NO: 8193896 - DNA, 22 bp, Homo sapiens
cagagagagtctgtccctgaag

SEQ ID NO: 8193897 - DNA, 22 bp, Homo sapiens
cagagagaggggctgcctggcc

SEQ ID NO: 8193898 - DNA, 22 bp, Homo sapiens
cagagagagcaggaaacctccg

SEQ ID NO: 8193899 - DNA, 19 bp, Homo sapiens
cagagagaccaaggcgcca

SEQ ID NO: 8193900 - DNA, 19 bp, Homo sapiens
cagagagaccaaggcgcca

SEQ ID NO: 8193901 - DNA, 22 bp, Homo sapiens
cagagagagcaggaaacctccg

SEQ ID NO: 8193902 - DNA, 22 bp, Homo sapiens
cagagagagcaggaaacctccg

SEQ ID NO: 8193903 - DNA, 22 bp, Homo sapiens
cagagagaggccactgctatta

SEQ ID NO: 8193904 - DNA, 22 bp, Homo sapiens
cagagagaatcttggcagctga

SEQ ID NO: 8193905 - DNA, 22 bp, Homo sapiens
cagagagaatatgtagtatgga

SEQ ID NO: 8193906 - DNA, 22 bp, Homo sapiens
cagagagaatatgtagtatgga

SEQ ID NO: 8193907 - DNA, 22 bp, Homo sapiens
cagagagaatcttggcagctga

SEQ ID NO: 8193908 - DNA, 22 bp, Homo sapiens
cagagagaatcttggcagctga

SEQ ID NO: 8193909 - DNA, 22 bp, Homo sapiens
cagagagaatcttggcagctga

SEQ ID NO: 8193910 - DNA, 22 bp, Homo sapiens
cagagagaatcttggcagctga

SEQ ID NO: 8193911 - DNA, 22 bp, Homo sapiens
cagagagaatcttggcagctga

SEQ ID NO: 8193912 - DNA, 18 bp, Homo sapiens
cagaagcaggcagtgcag

SEQ ID NO: 8193913 - DNA, 18 bp, Homo sapiens
cagaagcaggcagtgcag

SEQ ID NO: 8193914 - DNA, 22 bp, Homo sapiens
cagagacagtttcacagggtct

SEQ ID NO: 8193915 - DNA, 18 bp, Homo sapiens
cagaagcaggcagtgcag

SEQ ID NO: 8193916 - DNA, 18 bp, Homo sapiens
cagaagcaggcagtgcag

SEQ ID NO: 8193917 - DNA, 22 bp, Homo sapiens
cagagacatccatgttagttgg

SEQ ID NO: 8193918 - DNA, 20 bp, Homo sapiens
cagagacctgtcttcacaga

SEQ ID NO: 8193919 - DNA, 22 bp, Homo sapiens
cagagcaggcccactgccctcc

SEQ ID NO: 8193920 - DNA, 22 bp, Homo sapiens
gggcgccgtgggaaacagccgg

SEQ ID NO: 8193921 - DNA, 22 bp, Homo sapiens
cagagcaggaatagggtgttga

SEQ ID NO: 8193922 - DNA, 21 bp, Homo sapiens
cagagcagcgttctgctgtgg

SEQ ID NO: 8193923 - DNA, 22 bp, Homo sapiens
cagagcaggcccactgccctcc

SEQ ID NO: 8193924 - DNA, 22 bp, Homo sapiens
cagagcaggaatagggtgttga

SEQ ID NO: 8193925 - DNA, 22 bp, Homo sapiens
cagagcaggcccactgccctcc

SEQ ID NO: 8193926 - DNA, 21 bp, Homo sapiens
cagagcagcgttctgctgtgg

SEQ ID NO: 8193927 - DNA, 21 bp, Homo sapiens
cagagcagcgttctgctgtgg

SEQ ID NO: 8193928 - DNA, 21 bp, Homo sapiens
cagagcagcgttctgctgtgg

SEQ ID NO: 8193929 - DNA, 21 bp, Homo sapiens
cagagcagcgttctgctgtgg

SEQ ID NO: 8193930 - DNA, 21 bp, Homo sapiens
cagagcagcgttctgctgtgg

SEQ ID NO: 8193931 - DNA, 21 bp, Homo sapiens
cagagcagcgttctgctgtgg

SEQ ID NO: 8193932 - DNA, 22 bp, Homo sapiens
cagagcagagtgattgttctgg

SEQ ID NO: 8193933 - DNA, 18 bp, Homo sapiens
cagagcagaggtggagcg

SEQ ID NO: 8193934 - DNA, 18 bp, Homo sapiens
cagagcagaggtggagcg

SEQ ID NO: 8193935 - DNA, 18 bp, Homo sapiens
cagagcagaggtggagcg

SEQ ID NO: 8193936 - DNA, 22 bp, Homo sapiens
cagagcagcagagcttccatgg

SEQ ID NO: 8193937 - DNA, 22 bp, Homo sapiens
cagagcagcagagcttccatgg

SEQ ID NO: 8193938 - DNA, 22 bp, Homo sapiens
cagagcagcagagcttccatgg

SEQ ID NO: 8193939 - DNA, 22 bp, Homo sapiens
cagagcagcagagcttccatgg

SEQ ID NO: 8193940 - DNA, 22 bp, Homo sapiens
gggccctgggattcagagcaag

SEQ ID NO: 8193941 - DNA, 22 bp, Homo sapiens
gggccctgggattcagagcaag

SEQ ID NO: 8193942 - DNA, 18 bp, Homo sapiens
gggccctggcgtccgccc

SEQ ID NO: 8193943 - DNA, 18 bp, Homo sapiens
gggccctggcgtccgccc

SEQ ID NO: 8193944 - DNA, 22 bp, Homo sapiens
gggccctggctttcctgttctt

SEQ ID NO: 8193945 - DNA, 22 bp, Homo sapiens
gggccctggctttcctgttctt

SEQ ID NO: 8193946 - DNA, 22 bp, Homo sapiens
gggccctggatttaagcatgga

SEQ ID NO: 8193947 - DNA, 22 bp, Homo sapiens
gggccctggacgtggcggcaga

SEQ ID NO: 8193948 - DNA, 22 bp, Homo sapiens
gggccctggacgtggcggcaga

SEQ ID NO: 8193949 - DNA, 22 bp, Homo sapiens
gggccctggatttaagcatgga

SEQ ID NO: 8193950 - DNA, 22 bp, Homo sapiens
gggccctggccgaatccctctg

SEQ ID NO: 8193951 - DNA, 22 bp, Homo sapiens
gggccctggccgaatccctctg

SEQ ID NO: 8193952 - DNA, 22 bp, Homo sapiens
gggccctggccgaatccctctg

SEQ ID NO: 8193953 - DNA, 22 bp, Homo sapiens
gggccctgcgtccggaagtctg

SEQ ID NO: 8193954 - DNA, 22 bp, Homo sapiens
gggccctgcgtccggaagtctg

SEQ ID NO: 8193955 - DNA, 22 bp, Homo sapiens
gggccctggacgtggcggcaga

SEQ ID NO: 8193956 - DNA, 22 bp, Homo sapiens
gggccctggacgtggcggcaga

SEQ ID NO: 8193957 - DNA, 22 bp, Homo sapiens
gggccaggagtggagatatggg

SEQ ID NO: 8193958 - DNA, 22 bp, Homo sapiens
gggccagctctgtgatgtaggg

SEQ ID NO: 8193959 - DNA, 22 bp, Homo sapiens
gggccagctctgtgatgtaggg

SEQ ID NO: 8193960 - DNA, 22 bp, Homo sapiens
cagagaggaggctatatgcaaa

SEQ ID NO: 8193961 - DNA, 22 bp, Homo sapiens
cagagagagtctgtccctgaag

SEQ ID NO: 8193962 - DNA, 22 bp, Homo sapiens
cagagagagtggggtgtggatt

SEQ ID NO: 8193963 - DNA, 22 bp, Homo sapiens
cagagagagtggggtgtggatt

SEQ ID NO: 8193964 - DNA, 22 bp, Homo sapiens
cagagagagtggggtgtggatt

SEQ ID NO: 8193965 - DNA, 22 bp, Homo sapiens
cagagagagtggggtgtggatt

SEQ ID NO: 8193966 - DNA, 22 bp, Homo sapiens
cagagagcttagtgtgctgcat

SEQ ID NO: 8193967 - DNA, 16 bp, Homo sapiens
cagagaggacagaggc

SEQ ID NO: 8193968 - DNA, 16 bp, Homo sapiens
cagagaggacagaggc

SEQ ID NO: 8193969 - DNA, 22 bp, Homo sapiens
cagagagcatgggaggcccgag

SEQ ID NO: 8193970 - DNA, 22 bp, Homo sapiens
atgcttttcctaaaatgatgcc

SEQ ID NO: 8193971 - DNA, 21 bp, Homo sapiens
atggaaaaacaggtagagcat

SEQ ID NO: 8193972 - DNA, 21 bp, Homo sapiens
atggaaaaacaggtagagcat

SEQ ID NO: 8193973 - DNA, 22 bp, Homo sapiens
gagaggaagccttctgtacttg

SEQ ID NO: 8193974 - DNA, 22 bp, Homo sapiens
gagaggaagccttctgtacttg

SEQ ID NO: 8193975 - DNA, 22 bp, Homo sapiens
gagaggaatgaggttaaggact

SEQ ID NO: 8193976 - DNA, 22 bp, Homo sapiens
gagaggctccgccactgctcag

SEQ ID NO: 8193977 - DNA, 22 bp, Homo sapiens
gagaggctccgccactgctcag

SEQ ID NO: 8193978 - DNA, 22 bp, Homo sapiens
gagaggctctgaggactggggt

SEQ ID NO: 8193979 - DNA, 22 bp, Homo sapiens
gagaggctctgaggactggggt

SEQ ID NO: 8193980 - DNA, 22 bp, Homo sapiens
gagaggctccgccactgctcag

SEQ ID NO: 8193981 - DNA, 22 bp, Homo sapiens
gagaggctctgaggactggggt

SEQ ID NO: 8193982 - DNA, 22 bp, Homo sapiens
gagaggctgactggctgtcctg

SEQ ID NO: 8193983 - DNA, 22 bp, Homo sapiens
gagaggctgactggctgtcctg

SEQ ID NO: 8193984 - DNA, 22 bp, Homo sapiens
gagaggctgatcctgcagagaa

SEQ ID NO: 8193985 - DNA, 22 bp, Homo sapiens
gagaggctgaaatcacaggagc

SEQ ID NO: 8193986 - DNA, 22 bp, Homo sapiens
gagaggctgactggctgtcctg

SEQ ID NO: 8193987 - DNA, 22 bp, Homo sapiens
gagaggctgactggctgtcctg

SEQ ID NO: 8193988 - DNA, 22 bp, Homo sapiens
gagaggtagcagtaagaacagg

SEQ ID NO: 8193989 - DNA, 22 bp, Homo sapiens
gagaggtagcagtaagaacagg

SEQ ID NO: 8193990 - DNA, 22 bp, Homo sapiens
gagaggctggcagtgccaggtt

SEQ ID NO: 8193991 - DNA, 22 bp, Homo sapiens
gagaggctggcagtgccaggtt

SEQ ID NO: 8193992 - DNA, 22 bp, Homo sapiens
gagaggctgcatatgcacactg

SEQ ID NO: 8193993 - DNA, 16 bp, Homo sapiens
gagcagcctgggcctt

SEQ ID NO: 8193994 - DNA, 22 bp, Homo sapiens
gagcacagtaaagcagtgtcac

SEQ ID NO: 8193995 - DNA, 22 bp, Homo sapiens
gagcagctaaaattctcatgca

SEQ ID NO: 8193996 - DNA, 22 bp, Homo sapiens
gagcagctcagaggactagtgt

SEQ ID NO: 8193997 - DNA, 22 bp, Homo sapiens
gagcagctcgagaaggaagcag

SEQ ID NO: 8193998 - DNA, 22 bp, Homo sapiens
gagcagctcgagaaggaagcag

SEQ ID NO: 8193999 - DNA, 22 bp, Homo sapiens
gagcagctcgagaaggaagcag

SEQ ID NO: 8194000 - DNA, 22 bp, Homo sapiens
gagaggtgaaggctgccctggg

SEQ ID NO: 8194001 - DNA, 22 bp, Homo sapiens
gagaggtgaaggctgccctggg

SEQ ID NO: 8194002 - DNA, 22 bp, Homo sapiens
gagaggtgaatgtggatgccac

SEQ ID NO: 8194003 - DNA, 22 bp, Homo sapiens
gagaggtgaatgtggatgccac

SEQ ID NO: 8194004 - DNA, 22 bp, Homo sapiens
gagaggtgaaggctgccctggg

SEQ ID NO: 8194005 - DNA, 22 bp, Homo sapiens
gagaggtgaaggctgccctggg

SEQ ID NO: 8194006 - DNA, 22 bp, Homo sapiens
gagaggtgaaatagttgtccgg

SEQ ID NO: 8194007 - DNA, 22 bp, Homo sapiens
gagaggtgaaatagttgtccgg

SEQ ID NO: 8194008 - DNA, 22 bp, Homo sapiens
gagaggtgaaatagttgtccgg

SEQ ID NO: 8194009 - DNA, 22 bp, Homo sapiens
gagaggtggaggttgcagtgag

SEQ ID NO: 8194010 - DNA, 22 bp, Homo sapiens
gagaggtggtgaggacttgtct

SEQ ID NO: 8194011 - DNA, 22 bp, Homo sapiens
gagaggtgtgtttcagataaga

SEQ ID NO: 8194012 - DNA, 22 bp, Homo sapiens
gagaggtggtgaggacttgtct

SEQ ID NO: 8194013 - DNA, 22 bp, Homo sapiens
gagaggtggaggttgcagtgag

SEQ ID NO: 8194014 - DNA, 22 bp, Homo sapiens
gagaggtggaggttgcagtgag

SEQ ID NO: 8194015 - DNA, 22 bp, Homo sapiens
gagaggtggaggttgcagtgag

SEQ ID NO: 8194016 - DNA, 22 bp, Homo sapiens
gagaggtggaggttgcagtgag

SEQ ID NO: 8194017 - DNA, 23 bp, Homo sapiens
gagctctgcactaggccctggga

SEQ ID NO: 8194018 - DNA, 22 bp, Homo sapiens
gagctctgcagattgttttagg

SEQ ID NO: 8194019 - DNA, 22 bp, Homo sapiens
gagctctgcagattgttttagg

SEQ ID NO: 8194020 - DNA, 22 bp, Homo sapiens
gagctctgcagattgttttagg

SEQ ID NO: 8194021 - DNA, 23 bp, Homo sapiens
gagctctgcactaggccctggga

SEQ ID NO: 8194022 - DNA, 22 bp, Homo sapiens
gagctctgccatggctcccacc

SEQ ID NO: 8194023 - DNA, 22 bp, Homo sapiens
gagctctgccatggctcccacc

SEQ ID NO: 8194024 - DNA, 18 bp, Homo sapiens
gagctctgcctcccagtc

SEQ ID NO: 8194025 - DNA, 22 bp, Homo sapiens
gagctctgccatggctcccacc

SEQ ID NO: 8194026 - DNA, 18 bp, Homo sapiens
gagctctgcctcccagtc

SEQ ID NO: 8194027 - DNA, 18 bp, Homo sapiens
gagctctgcctcccagtc

SEQ ID NO: 8194028 - DNA, 18 bp, Homo sapiens
gagctctgcctcccagtc

SEQ ID NO: 8194029 - DNA, 22 bp, Homo sapiens
gagcctgtgtttcctgtagcca

SEQ ID NO: 8194030 - DNA, 22 bp, Homo sapiens
gagcctttctagataatccagg

SEQ ID NO: 8194031 - DNA, 22 bp, Homo sapiens
gagcctttgcacttgctgtgtt

SEQ ID NO: 8194032 - DNA, 19 bp, Homo sapiens
gagcgcagagggcagggga

SEQ ID NO: 8194033 - DNA, 22 bp, Homo sapiens
gagcggaggcttggaggccagc

SEQ ID NO: 8194034 - DNA, 22 bp, Homo sapiens
gagcctgggtccttccctggga

SEQ ID NO: 8194035 - DNA, 22 bp, Homo sapiens
gagcctgggtccttccctggga

SEQ ID NO: 8194036 - DNA, 22 bp, Homo sapiens
gagcctgggtccttccctggga

SEQ ID NO: 8194037 - DNA, 22 bp, Homo sapiens
gagcctgggactgggggtcatg

SEQ ID NO: 8194038 - DNA, 22 bp, Homo sapiens
gagcctgggactgggggtcatg

SEQ ID NO: 8194039 - DNA, 22 bp, Homo sapiens
gagcctggggaccctcctgagt

SEQ ID NO: 8194040 - DNA, 22 bp, Homo sapiens
gagcctggggaccctcctgagt

SEQ ID NO: 8194041 - DNA, 22 bp, Homo sapiens
gagcctggggaccctcctgagt

SEQ ID NO: 8194042 - DNA, 22 bp, Homo sapiens
gagcctgggactgggggtcatg

SEQ ID NO: 8194043 - DNA, 22 bp, Homo sapiens
gagcctgggactgggggtcatg

SEQ ID NO: 8194044 - DNA, 20 bp, Homo sapiens
gagcctgggaagtctaaggt

SEQ ID NO: 8194045 - DNA, 20 bp, Homo sapiens
gagcctgggaagtctaaggt

SEQ ID NO: 8194046 - DNA, 22 bp, Homo sapiens
gagcctggcctcctgcctcagc

SEQ ID NO: 8194047 - DNA, 22 bp, Homo sapiens
gagcctggcctcctgcctcagc

SEQ ID NO: 8194048 - DNA, 22 bp, Homo sapiens
gagcctggcctcctgcctcagc

SEQ ID NO: 8194049 - DNA, 22 bp, Homo sapiens
gagcaggtctttcatggtgcat

SEQ ID NO: 8194050 - DNA, 22 bp, Homo sapiens
gagcagggcttgtcctcctcat

SEQ ID NO: 8194051 - DNA, 17 bp, Homo sapiens
gagcagggatgcggttc

SEQ ID NO: 8194052 - DNA, 22 bp, Homo sapiens
gagcagggccacttctgtacct

SEQ ID NO: 8194053 - DNA, 22 bp, Homo sapiens
gagcagggccacttctgtacct

SEQ ID NO: 8194054 - DNA, 22 bp, Homo sapiens
gagcagggccacttctgtacct

SEQ ID NO: 8194055 - DNA, 22 bp, Homo sapiens
gagcagtgactggagcatgaga

SEQ ID NO: 8194056 - DNA, 22 bp, Homo sapiens
gagccctgaacaacagcaggaa

SEQ ID NO: 8194057 - DNA, 22 bp, Homo sapiens
gagcagtaggagaaccctgagc

SEQ ID NO: 8194058 - DNA, 22 bp, Homo sapiens
gagcagtgaagacagaagtaca

SEQ ID NO: 8194059 - DNA, 22 bp, Homo sapiens
gagcagtagagtacatggctcc

SEQ ID NO: 8194060 - DNA, 22 bp, Homo sapiens
gagcagggagacaactctggtg

SEQ ID NO: 8194061 - DNA, 17 bp, Homo sapiens
gagcagggatgcggttc

SEQ ID NO: 8194062 - DNA, 17 bp, Homo sapiens
gagcagggatgcggttc

SEQ ID NO: 8194063 - DNA, 22 bp, Homo sapiens
gagcagggagacaactctggtg

SEQ ID NO: 8194064 - DNA, 22 bp, Homo sapiens
gagcagggagacaactctggtg

SEQ ID NO: 8194065 - DNA, 22 bp, Homo sapiens
gagcagggagacaactctggtg

SEQ ID NO: 8194066 - DNA, 19 bp, Homo sapiens
gagcagctgcacccattga

SEQ ID NO: 8194067 - DNA, 22 bp, Homo sapiens
gagcagctgagctggaatgaga

SEQ ID NO: 8194068 - DNA, 22 bp, Homo sapiens
gagcagctctgggtgacccagt

SEQ ID NO: 8194069 - DNA, 22 bp, Homo sapiens
gagcagctgagctggaatgaga

SEQ ID NO: 8194070 - DNA, 22 bp, Homo sapiens
gagcagctgagctggaatgaga

SEQ ID NO: 8194071 - DNA, 22 bp, Homo sapiens
gagcagctgagctggaatgaga

SEQ ID NO: 8194072 - DNA, 22 bp, Homo sapiens
gagcagctgagctggaatgaga

SEQ ID NO: 8194073 - DNA, 22 bp, Homo sapiens
gagcagctgagctggaatgaga

SEQ ID NO: 8194074 - DNA, 22 bp, Homo sapiens
gagctttaagggataaaatgat

SEQ ID NO: 8194075 - DNA, 22 bp, Homo sapiens
gagctttagctgagacctgctt

SEQ ID NO: 8194076 - DNA, 22 bp, Homo sapiens
gagctttaggagaaggaggtca

SEQ ID NO: 8194077 - DNA, 22 bp, Homo sapiens
gagcttggctggacctcacgga

SEQ ID NO: 8194078 - DNA, 22 bp, Homo sapiens
gagctggggcggatactcagct

SEQ ID NO: 8194079 - DNA, 22 bp, Homo sapiens
gagctggggcggatactcagct

SEQ ID NO: 8194080 - DNA, 22 bp, Homo sapiens
gagcttggggcatatggtgcta

SEQ ID NO: 8194081 - DNA, 22 bp, Homo sapiens
gagctctgggaaacaaagtgta

SEQ ID NO: 8194082 - DNA, 22 bp, Homo sapiens
gagctctggcagggcaggtctg

SEQ ID NO: 8194083 - DNA, 22 bp, Homo sapiens
gagctctggcagggcaggtctg

SEQ ID NO: 8194084 - DNA, 22 bp, Homo sapiens
gagctctggacgaggggagtgg

SEQ ID NO: 8194085 - DNA, 22 bp, Homo sapiens
gagctctggcagggcaggtctg

SEQ ID NO: 8194086 - DNA, 22 bp, Homo sapiens
gagctctgctactcaaagtatg

SEQ ID NO: 8194087 - DNA, 22 bp, Homo sapiens
gagctctgcggaaaacgtgccg

SEQ ID NO: 8194088 - DNA, 22 bp, Homo sapiens
gagctctgctactcaaagtatg

SEQ ID NO: 8194089 - DNA, 22 bp, Homo sapiens
gagctctgcttgggttcttagg

SEQ ID NO: 8194090 - DNA, 22 bp, Homo sapiens
gagctctgcttgggttcttagg

SEQ ID NO: 8194091 - DNA, 22 bp, Homo sapiens
gagctggggcggatactcagct

SEQ ID NO: 8194092 - DNA, 22 bp, Homo sapiens
gagctctgtccacacttggaga

SEQ ID NO: 8194093 - DNA, 22 bp, Homo sapiens
gagctctgtacacagagggtgt

SEQ ID NO: 8194094 - DNA, 22 bp, Homo sapiens
gagctctgtacacagagggtgt

SEQ ID NO: 8194095 - DNA, 22 bp, Homo sapiens
gagctctggttcatgatctatt

SEQ ID NO: 8194096 - DNA, 22 bp, Homo sapiens
gagctctggttcatgatctatt

SEQ ID NO: 8194097 - DNA, 22 bp, Homo sapiens
gagctctgggtgtgttgtcagt

SEQ ID NO: 8194098 - DNA, 22 bp, Homo sapiens
gagctctgggtgtgttgtcagt

SEQ ID NO: 8194099 - DNA, 22 bp, Homo sapiens
gagctctgggtggcaggtgtct

SEQ ID NO: 8194100 - DNA, 22 bp, Homo sapiens
gagctctgggaaacaaagtgta

SEQ ID NO: 8194101 - DNA, 22 bp, Homo sapiens
gagctctgggaaacaaagtgta

SEQ ID NO: 8194102 - DNA, 22 bp, Homo sapiens
gagctttgtgctggtaggtggt

SEQ ID NO: 8194103 - DNA, 22 bp, Homo sapiens
gagctttgtctcctggagaccc

SEQ ID NO: 8194104 - DNA, 22 bp, Homo sapiens
gagctttgctggaagcctgggg

SEQ ID NO: 8194105 - DNA, 22 bp, Homo sapiens
gagctttgctggaagcctgggg

SEQ ID NO: 8194106 - DNA, 22 bp, Homo sapiens
gagctttgcctaaaactagaat

SEQ ID NO: 8194107 - DNA, 22 bp, Homo sapiens
gaggaagctgcgtggcatttca

SEQ ID NO: 8194108 - DNA, 22 bp, Homo sapiens
gaggaagatggttgagtggtcc

SEQ ID NO: 8194109 - DNA, 22 bp, Homo sapiens
gaggaagatggttgagtggtcc

SEQ ID NO: 8194110 - DNA, 22 bp, Homo sapiens
gaggaaggaatgcagtgtatgc

SEQ ID NO: 8194111 - DNA, 22 bp, Homo sapiens
gaggaaggaatgcagtgtatgc

SEQ ID NO: 8194112 - DNA, 22 bp, Homo sapiens
gaggaaggaatgcagtgtatgc

SEQ ID NO: 8194113 - DNA, 22 bp, Homo sapiens
gaggaaggagggaaagcgcgcg

SEQ ID NO: 8194114 - DNA, 22 bp, Homo sapiens
gaggaaggagggaaagcgcgcg

SEQ ID NO: 8194115 - DNA, 22 bp, Homo sapiens
gaggaaggagggaaagcgcgcg

SEQ ID NO: 8194116 - DNA, 22 bp, Homo sapiens
gaggaaggagggaaagcgcgcg

SEQ ID NO: 8194117 - DNA, 22 bp, Homo sapiens
atggttattggccagatgccat

SEQ ID NO: 8194118 - DNA, 22 bp, Homo sapiens
gaggaaggctaaggggcttaga

SEQ ID NO: 8194119 - DNA, 22 bp, Homo sapiens
gaggaaggctaaggggcttaga

SEQ ID NO: 8194120 - DNA, 22 bp, Homo sapiens
gaggaaggatttagtttgaggg

SEQ ID NO: 8194121 - DNA, 22 bp, Homo sapiens
gaggaaggatttagtttgaggg

SEQ ID NO: 8194122 - DNA, 22 bp, Homo sapiens
gaggaaggatttagtttgaggg

SEQ ID NO: 8194123 - DNA, 22 bp, Homo sapiens
gaggaaggatttagtttgaggg

SEQ ID NO: 8194124 - DNA, 22 bp, Homo sapiens
atgtcacagttgcaacatgaat

SEQ ID NO: 8194125 - DNA, 22 bp, Homo sapiens
atgtcacagtgttgctggaagt

SEQ ID NO: 8194126 - DNA, 22 bp, Homo sapiens
atgtcacagtctgactcagtga

SEQ ID NO: 8194127 - DNA, 22 bp, Homo sapiens
atgtcacagcaggagtattctt

SEQ ID NO: 8194128 - DNA, 22 bp, Homo sapiens
atgtcacaggcaacaagattgc

SEQ ID NO: 8194129 - DNA, 22 bp, Homo sapiens
atgtcacagctcccattcctcc

SEQ ID NO: 8194130 - DNA, 22 bp, Homo sapiens
atgtcacagcaggagtattctt

SEQ ID NO: 8194131 - DNA, 18 bp, Homo sapiens
atgtcacagagggctgaa

SEQ ID NO: 8194132 - DNA, 22 bp, Homo sapiens
atgtcacagcaggagtattctt

SEQ ID NO: 8194133 - DNA, 22 bp, Homo sapiens
atgtcacaaaagtcccattatg

SEQ ID NO: 8194134 - DNA, 22 bp, Homo sapiens
atgtcaatttgttctctcgaag

SEQ ID NO: 8194135 - DNA, 22 bp, Homo sapiens
atgtatttgaaatttgagacat

SEQ ID NO: 8194136 - DNA, 21 bp, Homo sapiens
atgtcaaatgctttattttat

SEQ ID NO: 8194137 - DNA, 22 bp, Homo sapiens
atgtatttctatgtagtgaaga

SEQ ID NO: 8194138 - DNA, 22 bp, Homo sapiens
atgtacaatctatcacaagaag

SEQ ID NO: 8194139 - DNA, 22 bp, Homo sapiens
atgtacaaaatgttttgaaatg

SEQ ID NO: 8194140 - DNA, 22 bp, Homo sapiens
atgtacaaaatgttttgaaatg

SEQ ID NO: 8194141 - DNA, 22 bp, Homo sapiens
atgtacaaaatgccactgaatt

SEQ ID NO: 8194142 - DNA, 22 bp, Homo sapiens
atgtacaaaatgccactgaatt

SEQ ID NO: 8194143 - DNA, 22 bp, Homo sapiens
atgtacaaaatgccactgaatt

SEQ ID NO: 8194144 - DNA, 22 bp, Homo sapiens
atgtacaaaatgccactgaatt

SEQ ID NO: 8194145 - DNA, 22 bp, Homo sapiens
atgtacaacctgcatgacagtc

SEQ ID NO: 8194146 - DNA, 22 bp, Homo sapiens
atgtacaacctgcatgacagtc

SEQ ID NO: 8194147 - DNA, 22 bp, Homo sapiens
atgtacaaaatgttttgaaatg

SEQ ID NO: 8194148 - DNA, 22 bp, Homo sapiens
atgtacaaaatgttttgaaatg

SEQ ID NO: 8194149 - DNA, 22 bp, Homo sapiens
atgtacaatctatcacaagaag

SEQ ID NO: 8194150 - DNA, 22 bp, Homo sapiens
atgtacaatctagggtttgcat

SEQ ID NO: 8194151 - DNA, 22 bp, Homo sapiens
atgtacaagctgttttactgca

SEQ ID NO: 8194152 - DNA, 22 bp, Homo sapiens
atgtacaagctgttttactgca

SEQ ID NO: 8194153 - DNA, 22 bp, Homo sapiens
atgtacaatctatcacaagaag

SEQ ID NO: 8194154 - DNA, 22 bp, Homo sapiens
atgtacaacctgcatgacagtc

SEQ ID NO: 8194155 - DNA, 22 bp, Homo sapiens
atgtacaacctgcatgacagtc

SEQ ID NO: 8194156 - DNA, 22 bp, Homo sapiens
atgtacaacctgcatgacagtc

SEQ ID NO: 8194157 - DNA, 22 bp, Homo sapiens
atgtacaacctgcatgacagtc

SEQ ID NO: 8194158 - DNA, 22 bp, Homo sapiens
atgtacaacctgcatgacagtc

SEQ ID NO: 8194159 - DNA, 22 bp, Homo sapiens
atgtaacaaatggtatacatgt

SEQ ID NO: 8194160 - DNA, 22 bp, Homo sapiens
atgtaacaaatggtatacatgt

SEQ ID NO: 8194161 - DNA, 22 bp, Homo sapiens
atgtaacaaatggtatacatgt

SEQ ID NO: 8194162 - DNA, 22 bp, Homo sapiens
atgtaaagttacttgagttttg

SEQ ID NO: 8194163 - DNA, 22 bp, Homo sapiens
atgtaaatcaagcagtgctggt

SEQ ID NO: 8194164 - DNA, 22 bp, Homo sapiens
atgtaaagtataaagtaagggg

SEQ ID NO: 8194165 - DNA, 22 bp, Homo sapiens
atggtttaagggagaatattga

SEQ ID NO: 8194166 - DNA, 22 bp, Homo sapiens
atggtttacaatgttttcagtt

SEQ ID NO: 8194167 - DNA, 22 bp, Homo sapiens
atgtaagtttaagcacaacaag

SEQ ID NO: 8194168 - DNA, 22 bp, Homo sapiens
atgtaagtattcaaaatatttc

SEQ ID NO: 8194169 - DNA, 22 bp, Homo sapiens
atgtaaggttcagagtatgtga

SEQ ID NO: 8194170 - DNA, 22 bp, Homo sapiens
atgtaatttgccctcaagttaa

SEQ ID NO: 8194171 - DNA, 22 bp, Homo sapiens
atgtaatttatgttatccataa

SEQ ID NO: 8194172 - DNA, 22 bp, Homo sapiens
atgtaatgattgcaatgctgct

SEQ ID NO: 8194173 - DNA, 22 bp, Homo sapiens
atgtaatagggtaacataacat

SEQ ID NO: 8194174 - DNA, 22 bp, Homo sapiens
atgtttccattttcttgtatca

SEQ ID NO: 8194175 - DNA, 22 bp, Homo sapiens
atgtttcccagagcaaatctgg

SEQ ID NO: 8194176 - DNA, 22 bp, Homo sapiens
atgtttccgtgagcatccttga

SEQ ID NO: 8194177 - DNA, 22 bp, Homo sapiens
gatctggaatctgaaggctgag

SEQ ID NO: 8194178 - DNA, 22 bp, Homo sapiens
atgtttcatttagatatcaggc

SEQ ID NO: 8194179 - DNA, 22 bp, Homo sapiens
atgtttccaggttcttcctatg

SEQ ID NO: 8194180 - DNA, 22 bp, Homo sapiens
atgtttccatcaaatttgatga

SEQ ID NO: 8194181 - DNA, 22 bp, Homo sapiens
gatctggaagaaagggagggca

SEQ ID NO: 8194182 - DNA, 22 bp, Homo sapiens
gatctctgaatctgaagccttc

SEQ ID NO: 8194183 - DNA, 21 bp, Homo sapiens
gatctctggaatgactctggc

SEQ ID NO: 8194184 - DNA, 21 bp, Homo sapiens
gatctctggaaggagaaagct

SEQ ID NO: 8194185 - DNA, 22 bp, Homo sapiens
gatctctgggtcctgttggcct

SEQ ID NO: 8194186 - DNA, 22 bp, Homo sapiens
gatctctgtggactcttagcac

SEQ ID NO: 8194187 - DNA, 18 bp, Homo sapiens
gatcgggggcgccccaag

SEQ ID NO: 8194188 - DNA, 22 bp, Homo sapiens
gatcctgggactgaatgggtgc

SEQ ID NO: 8194189 - DNA, 22 bp, Homo sapiens
gatcctgggcccttctgggtca

SEQ ID NO: 8194190 - DNA, 22 bp, Homo sapiens
gatatttacaaatttgccaata

SEQ ID NO: 8194191 - DNA, 22 bp, Homo sapiens
gatatttacaaatttgccaata

SEQ ID NO: 8194192 - DNA, 22 bp, Homo sapiens
gatcctgacatcctgacatgga

SEQ ID NO: 8194193 - DNA, 22 bp, Homo sapiens
gatcctggcacaggttggtccc

SEQ ID NO: 8194194 - DNA, 22 bp, Homo sapiens
gatcctgggactgaatgggtgc

SEQ ID NO: 8194195 - DNA, 22 bp, Homo sapiens
gatcctgggactgaatgggtgc

SEQ ID NO: 8194196 - DNA, 22 bp, Homo sapiens
gagttacattcattgttacgct

SEQ ID NO: 8194197 - DNA, 22 bp, Homo sapiens
gagttactgggtggaaggcact

SEQ ID NO: 8194198 - DNA, 22 bp, Homo sapiens
gagttatagatggactattatt

SEQ ID NO: 8194199 - DNA, 22 bp, Homo sapiens
gagttatagatggactattatt

SEQ ID NO: 8194200 - DNA, 22 bp, Homo sapiens
gagttatatcctgagtcatatt

SEQ ID NO: 8194201 - DNA, 22 bp, Homo sapiens
gagttagcaaagggtggcaggg

SEQ ID NO: 8194202 - DNA, 22 bp, Homo sapiens
gagttagcaaagggtggcaggg

SEQ ID NO: 8194203 - DNA, 22 bp, Homo sapiens
gagttatatcctgagtcatatt

SEQ ID NO: 8194204 - DNA, 22 bp, Homo sapiens
gagttatatttgcgatattgga

SEQ ID NO: 8194205 - DNA, 20 bp, Homo sapiens
atgtttaatgttgtccaccc

SEQ ID NO: 8194206 - DNA, 22 bp, Homo sapiens
atgtttaattatctgggttttg

SEQ ID NO: 8194207 - DNA, 22 bp, Homo sapiens
atgtttaattatctgggttttg

SEQ ID NO: 8194208 - DNA, 21 bp, Homo sapiens
gagtgcaggtctgatgccatc

SEQ ID NO: 8194209 - DNA, 22 bp, Homo sapiens
atgtttattttgcagagtaggg

SEQ ID NO: 8194210 - DNA, 22 bp, Homo sapiens
atgtttattttgcagagtaggg

SEQ ID NO: 8194211 - DNA, 22 bp, Homo sapiens
atgtttattttgcagagtaggg

SEQ ID NO: 8194212 - DNA, 22 bp, Homo sapiens
atgtttattgttttaagctgct

SEQ ID NO: 8194213 - DNA, 22 bp, Homo sapiens
atgtttcaccagcaaattacct

SEQ ID NO: 8194214 - DNA, 22 bp, Homo sapiens
atgtttcaatgcactttagcct

SEQ ID NO: 8194215 - DNA, 22 bp, Homo sapiens
atgtttcaggcgaactaacatg

SEQ ID NO: 8194216 - DNA, 22 bp, Homo sapiens
atgtttcaggcgaactaacatg

SEQ ID NO: 8194217 - DNA, 22 bp, Homo sapiens
atgtttcagatacagatcaaat

SEQ ID NO: 8194218 - DNA, 22 bp, Homo sapiens
atgtttcaccagttttataaga

SEQ ID NO: 8194219 - DNA, 22 bp, Homo sapiens
atgtttcaccagttttataaga

SEQ ID NO: 8194220 - DNA, 22 bp, Homo sapiens
atgtttcaccagttttataaga

SEQ ID NO: 8194221 - DNA, 22 bp, Homo sapiens
atgtttcaggaaatcagctaga

SEQ ID NO: 8194222 - DNA, 22 bp, Homo sapiens
atgtttcaggaaatcagctaga

SEQ ID NO: 8194223 - DNA, 22 bp, Homo sapiens
atgtttcagttctaaagttaga

SEQ ID NO: 8194224 - DNA, 22 bp, Homo sapiens
atgtttcatgactgagcaaaat

SEQ ID NO: 8194225 - DNA, 22 bp, Homo sapiens
atgtttcatttagatatcaggc

SEQ ID NO: 8194226 - DNA, 22 bp, Homo sapiens
gagtccagttagtgaggctggg

SEQ ID NO: 8194227 - DNA, 22 bp, Homo sapiens
gagtccagttagtgaggctggg

SEQ ID NO: 8194228 - DNA, 22 bp, Homo sapiens
gagtccagttagtgaggctggg

SEQ ID NO: 8194229 - DNA, 22 bp, Homo sapiens
gagtccagttctttccagcagt

SEQ ID NO: 8194230 - DNA, 22 bp, Homo sapiens
gagtccagtagttaggacagag

SEQ ID NO: 8194231 - DNA, 22 bp, Homo sapiens
gagtccagtgatgttcctggtc

SEQ ID NO: 8194232 - DNA, 20 bp, Homo sapiens
gagtccaggggcctgtagca

SEQ ID NO: 8194233 - DNA, 22 bp, Homo sapiens
gagtgcaggcctgagcaccatc

SEQ ID NO: 8194234 - DNA, 22 bp, Homo sapiens
gagtgcaggcctgagcaccatc

SEQ ID NO: 8194235 - DNA, 22 bp, Homo sapiens
gagtgcagatgccagccccagt

SEQ ID NO: 8194236 - DNA, 21 bp, Homo sapiens
gagtgcagcaaggtagagtct

SEQ ID NO: 8194237 - DNA, 21 bp, Homo sapiens
gagtgcagcaaggtagagtct

SEQ ID NO: 8194238 - DNA, 17 bp, Homo sapiens
gagtgcagacacaagca

SEQ ID NO: 8194239 - DNA, 22 bp, Homo sapiens
gagtgcagatgaacagaagatt

SEQ ID NO: 8194240 - DNA, 22 bp, Homo sapiens
gagtgcagatgaacagaagatt

SEQ ID NO: 8194241 - DNA, 23 bp, Homo sapiens
gagtgcagaatagacatgcagtg

SEQ ID NO: 8194242 - DNA, 23 bp, Homo sapiens
gagtgcagaatagacatgcagtg

SEQ ID NO: 8194243 - DNA, 23 bp, Homo sapiens
gagtgcagaatagacatgcagtg

SEQ ID NO: 8194244 - DNA, 22 bp, Homo sapiens
gaggtagggcagaggctgaatg

SEQ ID NO: 8194245 - DNA, 22 bp, Homo sapiens
gagtccagctcattgtctggga

SEQ ID NO: 8194246 - DNA, 22 bp, Homo sapiens
gagtccaggatttgagctctgt

SEQ ID NO: 8194247 - DNA, 18 bp, Homo sapiens
gaggtagataagattttc

SEQ ID NO: 8194248 - DNA, 22 bp, Homo sapiens
gaggtacatgaggatacacagg

SEQ ID NO: 8194249 - DNA, 22 bp, Homo sapiens
gagggggtctatgaggtagagc

SEQ ID NO: 8194250 - DNA, 22 bp, Homo sapiens
gaggtaagggcaggagagtgaa

SEQ ID NO: 8194251 - DNA, 22 bp, Homo sapiens
gaggtacagagtgttccaatgt

SEQ ID NO: 8194252 - DNA, 23 bp, Homo sapiens
gaggtacagcaccagtgaatagg

SEQ ID NO: 8194253 - DNA, 17 bp, Homo sapiens
gaggtaggaagtgagtc

SEQ ID NO: 8194254 - DNA, 17 bp, Homo sapiens
gaggtaggaagtgagtc

SEQ ID NO: 8194255 - DNA, 17 bp, Homo sapiens
gaggtaggaagtgagtc

SEQ ID NO: 8194256 - DNA, 17 bp, Homo sapiens
gaggtaggaagtgagtc

SEQ ID NO: 8194257 - DNA, 17 bp, Homo sapiens
gaggtaggaagtgagtc

SEQ ID NO: 8194258 - DNA, 22 bp, Homo sapiens
gaggtaggctgtgaaagggggt

SEQ ID NO: 8194259 - DNA, 19 bp, Homo sapiens
gaggggaggaattgacaag

SEQ ID NO: 8194260 - DNA, 22 bp, Homo sapiens
gagggggcgaacagaagcaagg

SEQ ID NO: 8194261 - DNA, 22 bp, Homo sapiens
gagggggcgtgcaaggctccgc

SEQ ID NO: 8194262 - DNA, 22 bp, Homo sapiens
gagggcaccagaagagccagat

SEQ ID NO: 8194263 - DNA, 22 bp, Homo sapiens
gagggcagaaaattatgcggtg

SEQ ID NO: 8194264 - DNA, 22 bp, Homo sapiens
gagggcagaaaattatgcggtg

SEQ ID NO: 8194265 - DNA, 22 bp, Homo sapiens
gagggcagaaaattatgcggtg

SEQ ID NO: 8194266 - DNA, 22 bp, Homo sapiens
gagggggctccctgaagccagt

SEQ ID NO: 8194267 - DNA, 22 bp, Homo sapiens
gagggggctagcgcagtgccca

SEQ ID NO: 8194268 - DNA, 22 bp, Homo sapiens
gagggggtctatgaggtagagc

SEQ ID NO: 8194269 - DNA, 22 bp, Homo sapiens
gaggggggcgccctgcagtgca

SEQ ID NO: 8194270 - DNA, 22 bp, Homo sapiens
gaggggggcgccctgcagtgca

SEQ ID NO: 8194271 - DNA, 22 bp, Homo sapiens
gaggggggcgccctgcagtgca

SEQ ID NO: 8194272 - DNA, 22 bp, Homo sapiens
gaggggggcgccctgcagtgca

SEQ ID NO: 8194273 - DNA, 22 bp, Homo sapiens
gaggggggcgccctgcagtgca

SEQ ID NO: 8194274 - DNA, 22 bp, Homo sapiens
atgtcacatggcctgtactttg

SEQ ID NO: 8194275 - DNA, 22 bp, Homo sapiens
atgtcacatgagagcgcagcac

SEQ ID NO: 8194276 - DNA, 22 bp, Homo sapiens
atgtcacatctgggatggccct

SEQ ID NO: 8194277 - DNA, 22 bp, Homo sapiens
atgtcacatggtcacctctagc

SEQ ID NO: 8194278 - DNA, 22 bp, Homo sapiens
atgtcacatggttctggggcct

SEQ ID NO: 8194279 - DNA, 22 bp, Homo sapiens
atgtcacattggagctgctgga

SEQ ID NO: 8194280 - DNA, 22 bp, Homo sapiens
gaggccaagggagaagatctct

SEQ ID NO: 8194281 - DNA, 23 bp, Homo sapiens
gaggccacattcccctgcttgag

SEQ ID NO: 8194282 - DNA, 22 bp, Homo sapiens
gaggccacagtgtctgggggcc

SEQ ID NO: 8194283 - DNA, 22 bp, Homo sapiens
gaggccacagtcctgaggcatc

SEQ ID NO: 8194284 - DNA, 22 bp, Homo sapiens
gaggccacagtcctgaggcatc

SEQ ID NO: 8194285 - DNA, 22 bp, Homo sapiens
gaggccacagtcctgaggcatc

SEQ ID NO: 8194286 - DNA, 22 bp, Homo sapiens
gaggccacagctatcagggaca

SEQ ID NO: 8194287 - DNA, 22 bp, Homo sapiens
gaggctgtgtgtccctctggac

SEQ ID NO: 8194288 - DNA, 22 bp, Homo sapiens
gaggctgttaggagggactctg

SEQ ID NO: 8194289 - DNA, 23 bp, Homo sapiens
gaggccacattcccctgcttgag

SEQ ID NO: 8194290 - DNA, 23 bp, Homo sapiens
gaggccacattcccctgcttgag

SEQ ID NO: 8194291 - DNA, 22 bp, Homo sapiens
gaggctgctttgatgacaggag

SEQ ID NO: 8194292 - DNA, 22 bp, Homo sapiens
gaggctggaatattagaaatgt

SEQ ID NO: 8194293 - DNA, 22 bp, Homo sapiens
gagggatggtgtgagaggctca

SEQ ID NO: 8194294 - DNA, 22 bp, Homo sapiens
gagggatgtcaggggaccttgg

SEQ ID NO: 8194295 - DNA, 22 bp, Homo sapiens
gagggatgtcaggggaccttgg

SEQ ID NO: 8194296 - DNA, 22 bp, Homo sapiens
gagggatgtgcctgaaggcagg

SEQ ID NO: 8194297 - DNA, 22 bp, Homo sapiens
gagggatgtcaggggaccttgg

SEQ ID NO: 8194298 - DNA, 22 bp, Homo sapiens
gagggatgtgcctgaaggcagg

SEQ ID NO: 8194299 - DNA, 22 bp, Homo sapiens
gagggcaaaacagagaagatgt

SEQ ID NO: 8194300 - DNA, 22 bp, Homo sapiens
gagggatgtgcctgaaggcagg

SEQ ID NO: 8194301 - DNA, 22 bp, Homo sapiens
gagggatgtgcctgaaggcagg

SEQ ID NO: 8194302 - DNA, 22 bp, Homo sapiens
gagggatggtgtgagaggctca

SEQ ID NO: 8194303 - DNA, 22 bp, Homo sapiens
gagggatggtgtgagaggctca

SEQ ID NO: 8194304 - DNA, 22 bp, Homo sapiens
gagggatggtgtgagaggctca

SEQ ID NO: 8194305 - DNA, 22 bp, Homo sapiens
gagggaaacagatgggttgtgg

SEQ ID NO: 8194306 - DNA, 22 bp, Homo sapiens
gagggaaacagatgggttgtgg

SEQ ID NO: 8194307 - DNA, 22 bp, Homo sapiens
gaggctgtttgtggcagtgatg

SEQ ID NO: 8194308 - DNA, 22 bp, Homo sapiens
gaggcttgcaccatgagcacca

SEQ ID NO: 8194309 - DNA, 22 bp, Homo sapiens
gaggcttcccgcccatgctgga

SEQ ID NO: 8194310 - DNA, 22 bp, Homo sapiens
gaggcttctgttcactcacgct

SEQ ID NO: 8194311 - DNA, 22 bp, Homo sapiens
gagggaaaataaaattgcagta

SEQ ID NO: 8194312 - DNA, 22 bp, Homo sapiens
atgcttttccaggagaaatata

SEQ ID NO: 8194313 - DNA, 22 bp, Homo sapiens
atgctttattgttaggtcatgt

SEQ ID NO: 8194314 - DNA, 22 bp, Homo sapiens
atgctttcttctttcctgtaag

SEQ ID NO: 8194315 - DNA, 22 bp, Homo sapiens
atgctttctcttagttcattga

SEQ ID NO: 8194316 - DNA, 20 bp, Homo sapiens
atgctttcttgtgtgctgct

SEQ ID NO: 8194317 - DNA, 22 bp, Homo sapiens
gactttcttgcagaaatattcc

SEQ ID NO: 8194318 - DNA, 22 bp, Homo sapiens
gactttgagggatacaaacatt

SEQ ID NO: 8194319 - DNA, 22 bp, Homo sapiens
gactttgccctaatgaggtctc

SEQ ID NO: 8194320 - DNA, 22 bp, Homo sapiens
gaccccagaggaaggggcgccg

SEQ ID NO: 8194321 - DNA, 21 bp, Homo sapiens
gaccccagaccagcagacaca

SEQ ID NO: 8194322 - DNA, 22 bp, Homo sapiens
gaccccaaccctagagtctgac

SEQ ID NO: 8194323 - DNA, 21 bp, Homo sapiens
gaccccagaccagcagacaca

SEQ ID NO: 8194324 - DNA, 22 bp, Homo sapiens
gaccccaagggatgcgtgtgct

SEQ ID NO: 8194325 - DNA, 22 bp, Homo sapiens
atgctttatgttctggcatttt

SEQ ID NO: 8194326 - DNA, 22 bp, Homo sapiens
atgctttattggagacagtcat

SEQ ID NO: 8194327 - DNA, 22 bp, Homo sapiens
gaccccaggcagatcagggggt

SEQ ID NO: 8194328 - DNA, 22 bp, Homo sapiens
gacccggctccaggcccagcag

SEQ ID NO: 8194329 - DNA, 22 bp, Homo sapiens
gaccctcctactaccctggaaa

SEQ ID NO: 8194330 - DNA, 22 bp, Homo sapiens
gaccctcctactaccctggaaa

SEQ ID NO: 8194331 - DNA, 22 bp, Homo sapiens
gaccctcattgtcaccgtgagc

SEQ ID NO: 8194332 - DNA, 22 bp, Homo sapiens
gaccctctagatggaagcactg

SEQ ID NO: 8194333 - DNA, 22 bp, Homo sapiens
gaccctggaactttcagcagag

SEQ ID NO: 8194334 - DNA, 22 bp, Homo sapiens
gaccctggagccgtctgaggca

SEQ ID NO: 8194335 - DNA, 22 bp, Homo sapiens
gaccctgccatgagtgacaggg

SEQ ID NO: 8194336 - DNA, 22 bp, Homo sapiens
gactttctgatgtaaacattta

SEQ ID NO: 8194337 - DNA, 22 bp, Homo sapiens
gactttctgagtcaaagaaagg

SEQ ID NO: 8194338 - DNA, 22 bp, Homo sapiens
gactttctctcctcccaggtgt

SEQ ID NO: 8194339 - DNA, 22 bp, Homo sapiens
gactggggtaaggtgaggaggt

SEQ ID NO: 8194340 - DNA, 22 bp, Homo sapiens
gactggggtaaggtgaggaggt

SEQ ID NO: 8194341 - DNA, 22 bp, Homo sapiens
gactgggggcagccgcaccagt

SEQ ID NO: 8194342 - DNA, 22 bp, Homo sapiens
gactggggtaaggtgaggaggt

SEQ ID NO: 8194343 - DNA, 22 bp, Homo sapiens
gacagtttttaatcctttcatg

SEQ ID NO: 8194344 - DNA, 22 bp, Homo sapiens
gacataaaatggaattctgttg

SEQ ID NO: 8194345 - DNA, 22 bp, Homo sapiens
gacataaaattcaataatttgt

SEQ ID NO: 8194346 - DNA, 22 bp, Homo sapiens
gacataaaccttgagatattaa

SEQ ID NO: 8194347 - DNA, 22 bp, Homo sapiens
gacataaagttcttgcttgaat

SEQ ID NO: 8194348 - DNA, 22 bp, Homo sapiens
atgcttgtagtgtaatcactgt

SEQ ID NO: 8194349 - DNA, 22 bp, Homo sapiens
atgcttgtactaaaaaaatatt

SEQ ID NO: 8194350 - DNA, 22 bp, Homo sapiens
atgctttagtgtcaagtttggg

SEQ ID NO: 8194351 - DNA, 22 bp, Homo sapiens
atgctttagtgtcaagtttggg

SEQ ID NO: 8194352 - DNA, 22 bp, Homo sapiens
atgctttatacaaaacacttaa

SEQ ID NO: 8194353 - DNA, 22 bp, Homo sapiens
atgctttatacaaaacacttaa

SEQ ID NO: 8194354 - DNA, 19 bp, Homo sapiens
atgctttatgttatttctt

SEQ ID NO: 8194355 - DNA, 22 bp, Homo sapiens
atgctttacagttttccaaaca

SEQ ID NO: 8194356 - DNA, 22 bp, Homo sapiens
atgctttacagttttccaaaca

SEQ ID NO: 8194357 - DNA, 22 bp, Homo sapiens
atgctttaaatgtcttttgctt

SEQ ID NO: 8194358 - DNA, 22 bp, Homo sapiens
atgctttaaaacgtatgtgtaa

SEQ ID NO: 8194359 - DNA, 22 bp, Homo sapiens
atgcttgtagtgtaatcactgt

SEQ ID NO: 8194360 - DNA, 22 bp, Homo sapiens
atgcttgtagtgtaatcactgt

SEQ ID NO: 8194361 - DNA, 22 bp, Homo sapiens
atgcttgtactaaaaaaatatt

SEQ ID NO: 8194362 - DNA, 22 bp, Homo sapiens
gacagtttaggttcaaatctca

SEQ ID NO: 8194363 - DNA, 22 bp, Homo sapiens
gacagtttctgaatgcgtactt

SEQ ID NO: 8194364 - DNA, 22 bp, Homo sapiens
gacagtttaggttcaaatctca

SEQ ID NO: 8194365 - DNA, 22 bp, Homo sapiens
gacagtgctatggtaggacatt

SEQ ID NO: 8194366 - DNA, 22 bp, Homo sapiens
gacagtggattcatctagtcaa

SEQ ID NO: 8194367 - DNA, 23 bp, Homo sapiens
gacagggctgacttggcagctgc

SEQ ID NO: 8194368 - DNA, 23 bp, Homo sapiens
gacagggctgacttggcagctgc

SEQ ID NO: 8194369 - DNA, 22 bp, Homo sapiens
gacagtggttccaaggcagctt

SEQ ID NO: 8194370 - DNA, 22 bp, Homo sapiens
gacagtggttccaaggcagctt

SEQ ID NO: 8194371 - DNA, 22 bp, Homo sapiens
gacagtgtccctctggggtgga

SEQ ID NO: 8194372 - DNA, 22 bp, Homo sapiens
gacagggccaaaccggctgatc

SEQ ID NO: 8194373 - DNA, 22 bp, Homo sapiens
gacagggcatggtgcagagttc

SEQ ID NO: 8194374 - DNA, 22 bp, Homo sapiens
gacagggcatggtgcagagttc

SEQ ID NO: 8194375 - DNA, 22 bp, Homo sapiens
gacagggcatggtgcagagttc

SEQ ID NO: 8194376 - DNA, 22 bp, Homo sapiens
gacagggccgcagatggagact

SEQ ID NO: 8194377 - DNA, 22 bp, Homo sapiens
gacagggccgcagatggagact

SEQ ID NO: 8194378 - DNA, 22 bp, Homo sapiens
gacagggccgcagatggagact

SEQ ID NO: 8194379 - DNA, 22 bp, Homo sapiens
gacagggccaaaccggctgatc

SEQ ID NO: 8194380 - DNA, 22 bp, Homo sapiens
gacagggccgcagatggagact

SEQ ID NO: 8194381 - DNA, 22 bp, Homo sapiens
gacagggcgagactcagtctca

SEQ ID NO: 8194382 - DNA, 22 bp, Homo sapiens
gacagggcgagactcagtctca

SEQ ID NO: 8194383 - DNA, 23 bp, Homo sapiens
gacagggctgacttggcagctgc

SEQ ID NO: 8194384 - DNA, 22 bp, Homo sapiens
gacagggaggaaagagactgct

SEQ ID NO: 8194385 - DNA, 22 bp, Homo sapiens
gacagggaggaaagagactgct

SEQ ID NO: 8194386 - DNA, 22 bp, Homo sapiens
gacagggaggaaagagactgct

SEQ ID NO: 8194387 - DNA, 22 bp, Homo sapiens
gacagggcaagactctgtctaa

SEQ ID NO: 8194388 - DNA, 22 bp, Homo sapiens
gacagggcaagactctgtctaa

SEQ ID NO: 8194389 - DNA, 22 bp, Homo sapiens
gacagggaggagcagagcttct

SEQ ID NO: 8194390 - DNA, 22 bp, Homo sapiens
gacagggaggagcagagcttct

SEQ ID NO: 8194391 - DNA, 22 bp, Homo sapiens
gacaggaaatatgggggttgtt

SEQ ID NO: 8194392 - DNA, 22 bp, Homo sapiens
gacaggaaatatgggggttgtt

SEQ ID NO: 8194393 - DNA, 22 bp, Homo sapiens
atgcctggactgacatgcactg

SEQ ID NO: 8194394 - DNA, 22 bp, Homo sapiens
gacagggacgaggcttcaggca

SEQ ID NO: 8194395 - DNA, 22 bp, Homo sapiens
gacagggacgaggcttcaggca

SEQ ID NO: 8194396 - DNA, 22 bp, Homo sapiens
gacagggactccctggttagaa

SEQ ID NO: 8194397 - DNA, 22 bp, Homo sapiens
atgcctcctcaaatctgccaca

SEQ ID NO: 8194398 - DNA, 22 bp, Homo sapiens
atgcctcctgtgccactgtgat

SEQ ID NO: 8194399 - DNA, 20 bp, Homo sapiens
atgcctctaattttgcaaac

SEQ ID NO: 8194400 - DNA, 20 bp, Homo sapiens
atgccctgtcctcttctgtt

SEQ ID NO: 8194401 - DNA, 22 bp, Homo sapiens
atgccctgtgactctcctggac

SEQ ID NO: 8194402 - DNA, 22 bp, Homo sapiens
atgccctggggctacctctgag

SEQ ID NO: 8194403 - DNA, 23 bp, Homo sapiens
atgccctgtagaggctgctgacc

SEQ ID NO: 8194404 - DNA, 22 bp, Homo sapiens
atgccctgggagtgctgtacca

SEQ ID NO: 8194405 - DNA, 22 bp, Homo sapiens
atgccctgtggttcatgtgaga

SEQ ID NO: 8194406 - DNA, 22 bp, Homo sapiens
atgcctccgcatgtgcctttga

SEQ ID NO: 8194407 - DNA, 22 bp, Homo sapiens
atgcccagaaccccctggatgg

SEQ ID NO: 8194408 - DNA, 22 bp, Homo sapiens
atgccctgctgctggggcagtg

SEQ ID NO: 8194409 - DNA, 22 bp, Homo sapiens
atgccctgctctcgggaaggga

SEQ ID NO: 8194410 - DNA, 22 bp, Homo sapiens
atgccctgcatcaagtgacact

SEQ ID NO: 8194411 - DNA, 22 bp, Homo sapiens
atgccctgctctcgggaaggga

SEQ ID NO: 8194412 - DNA, 22 bp, Homo sapiens
atgcatatgcaatgcacaattt

SEQ ID NO: 8194413 - DNA, 22 bp, Homo sapiens
atgcatatgcaatgcacaattt

SEQ ID NO: 8194414 - DNA, 22 bp, Homo sapiens
atgccacttcattccagcctcg

SEQ ID NO: 8194415 - DNA, 22 bp, Homo sapiens
atgccacttcattccagcctcg

SEQ ID NO: 8194416 - DNA, 22 bp, Homo sapiens
atgccacttcattccagcctcg

SEQ ID NO: 8194417 - DNA, 22 bp, Homo sapiens
atgcccaatgtcacaatttttg

SEQ ID NO: 8194418 - DNA, 22 bp, Homo sapiens
atgcccacaacactgcactttt

SEQ ID NO: 8194419 - DNA, 22 bp, Homo sapiens
atgcccaccctcagcccaggct

SEQ ID NO: 8194420 - DNA, 22 bp, Homo sapiens
atgcccacaacactgcactttt

SEQ ID NO: 8194421 - DNA, 22 bp, Homo sapiens
gaatcatggctgtgtcttcagc

SEQ ID NO: 8194422 - DNA, 22 bp, Homo sapiens
gaatcatgctcaataatgcttg

SEQ ID NO: 8194423 - DNA, 22 bp, Homo sapiens
gaatgtaatagtcagtagaaca

SEQ ID NO: 8194424 - DNA, 22 bp, Homo sapiens
gaatcatgtctagaagcagtgg

SEQ ID NO: 8194425 - DNA, 22 bp, Homo sapiens
gaagcagagcctaaggcagaca

SEQ ID NO: 8194426 - DNA, 22 bp, Homo sapiens
gaagcagagcctaaggcagaca

SEQ ID NO: 8194427 - DNA, 22 bp, Homo sapiens
gaagcagagcctaaggcagaca

SEQ ID NO: 8194428 - DNA, 22 bp, Homo sapiens
gaagcacattagatgtgtcttc

SEQ ID NO: 8194429 - DNA, 22 bp, Homo sapiens
gaagcactgcatttcaagatca

SEQ ID NO: 8194430 - DNA, 22 bp, Homo sapiens
gaagcactgccataattcagac

SEQ ID NO: 8194431 - DNA, 22 bp, Homo sapiens
gaagcactgtgctgctaagttg

SEQ ID NO: 8194432 - DNA, 22 bp, Homo sapiens
gaagcagaacccactccccaac

SEQ ID NO: 8194433 - DNA, 22 bp, Homo sapiens
gaagcacatggctatagctatt

SEQ ID NO: 8194434 - DNA, 22 bp, Homo sapiens
gaagcacatggctgtgagcaac

SEQ ID NO: 8194435 - DNA, 22 bp, Homo sapiens
gaagcacagaatggttaacatg

SEQ ID NO: 8194436 - DNA, 22 bp, Homo sapiens
gaagcacaaagtgtagttccga

SEQ ID NO: 8194437 - DNA, 22 bp, Homo sapiens
gaagcaattaagtttgtgatct

SEQ ID NO: 8194438 - DNA, 22 bp, Homo sapiens
gaagcaatttagaatcagaagc

SEQ ID NO: 8194439 - DNA, 22 bp, Homo sapiens
gaagcaatgtgttttcaacatt

SEQ ID NO: 8194440 - DNA, 22 bp, Homo sapiens
atgcacaagcaagagataatgg

SEQ ID NO: 8194441 - DNA, 22 bp, Homo sapiens
atgcacaagcaagagataatgg

SEQ ID NO: 8194442 - DNA, 22 bp, Homo sapiens
atgcacaagaggctagaaaaga

SEQ ID NO: 8194443 - DNA, 20 bp, Homo sapiens
gaatgtttcacttgctccat

SEQ ID NO: 8194444 - DNA, 22 bp, Homo sapiens
gaatgtttcatgtgtatgttag

SEQ ID NO: 8194445 - DNA, 22 bp, Homo sapiens
gaatgtttcatgtgtatgttag

SEQ ID NO: 8194446 - DNA, 22 bp, Homo sapiens
gaatgtttaaaaggtgcagttt

SEQ ID NO: 8194447 - DNA, 22 bp, Homo sapiens
gaatgtttaaggaaggcgtggc

SEQ ID NO: 8194448 - DNA, 22 bp, Homo sapiens
gaatgtttaaggaaggcgtggc

SEQ ID NO: 8194449 - DNA, 22 bp, Homo sapiens
gaatgtttgactaaaggtagct

SEQ ID NO: 8194450 - DNA, 19 bp, Homo sapiens
gaatgtttctgtctcttct

SEQ ID NO: 8194451 - DNA, 19 bp, Homo sapiens
gaatgtttctgtctcttct

SEQ ID NO: 8194452 - DNA, 22 bp, Homo sapiens
atgcataatgtatgtattgact

SEQ ID NO: 8194453 - DNA, 22 bp, Homo sapiens
atgcatataaggcacatgtatt

SEQ ID NO: 8194454 - DNA, 22 bp, Homo sapiens
atgcatataatggccagaacaa

SEQ ID NO: 8194455 - DNA, 22 bp, Homo sapiens
gaatgtcagttgcgggcatttc

SEQ ID NO: 8194456 - DNA, 22 bp, Homo sapiens
gaatgtcttctgttcccagctg

SEQ ID NO: 8194457 - DNA, 22 bp, Homo sapiens
gaatgttattgaactacgagct

SEQ ID NO: 8194458 - DNA, 22 bp, Homo sapiens
gaatgtttaaaaggtgcagttt

SEQ ID NO: 8194459 - DNA, 22 bp, Homo sapiens
gaatgtgaggttgtatgtgaaa

SEQ ID NO: 8194460 - DNA, 22 bp, Homo sapiens
atgcaagagatggacttgtgtt

SEQ ID NO: 8194461 - DNA, 22 bp, Homo sapiens
atgcaagacccagaaatcatta

SEQ ID NO: 8194462 - DNA, 22 bp, Homo sapiens
gaagaaagatcaaatagtttcc

SEQ ID NO: 8194463 - DNA, 22 bp, Homo sapiens
gaagaaagatcaaatagtttcc

SEQ ID NO: 8194464 - DNA, 22 bp, Homo sapiens
gaagaaagattggcatgcttca

SEQ ID NO: 8194465 - DNA, 22 bp, Homo sapiens
gaagaaagattggcatgcttca

SEQ ID NO: 8194466 - DNA, 22 bp, Homo sapiens
atgcaatatgtgtttctgttta

SEQ ID NO: 8194467 - DNA, 22 bp, Homo sapiens
atgcaatttactgtacataaat

SEQ ID NO: 8194468 - DNA, 22 bp, Homo sapiens
atgcacaagaggctagaaaaga

SEQ ID NO: 8194469 - DNA, 22 bp, Homo sapiens
atgcaagggttgcctttccagc

SEQ ID NO: 8194470 - DNA, 22 bp, Homo sapiens
atgcaagggtaaccccagacat

SEQ ID NO: 8194471 - DNA, 22 bp, Homo sapiens
atgcaaggacatgtaatgatgt

SEQ ID NO: 8194472 - DNA, 22 bp, Homo sapiens
gaactttaattagcttttgtct

SEQ ID NO: 8194473 - DNA, 22 bp, Homo sapiens
gaactttataactgtaaatgtc

SEQ ID NO: 8194474 - DNA, 22 bp, Homo sapiens
gaactttaaaacaaagtacagt

SEQ ID NO: 8194475 - DNA, 22 bp, Homo sapiens
gaactttaaaacaaagtacagt

SEQ ID NO: 8194476 - DNA, 22 bp, Homo sapiens
gaacatttgatgatgacattgg

SEQ ID NO: 8194477 - DNA, 22 bp, Homo sapiens
gaacatttgatgatgacattgg

SEQ ID NO: 8194478 - DNA, 22 bp, Homo sapiens
gaacatttgatgatgacattgg

SEQ ID NO: 8194479 - DNA, 17 bp, Homo sapiens
gaacttttattaaattc

SEQ ID NO: 8194480 - DNA, 22 bp, Homo sapiens
gaactttggatcatgttcttgg

SEQ ID NO: 8194481 - DNA, 22 bp, Homo sapiens
gaactttggatcatgttcttgg

SEQ ID NO: 8194482 - DNA, 22 bp, Homo sapiens
gaactttgcgcagttcccgggg

SEQ ID NO: 8194483 - DNA, 22 bp, Homo sapiens
gaactttattccagaagaaagc

SEQ ID NO: 8194484 - DNA, 22 bp, Homo sapiens
gaacattattgtacaaatgtct

SEQ ID NO: 8194485 - DNA, 22 bp, Homo sapiens
gaacattattgtacaaatgtct

SEQ ID NO: 8194486 - DNA, 22 bp, Homo sapiens
gaacatgcaatgacaggggact

SEQ ID NO: 8194487 - DNA, 22 bp, Homo sapiens
gaacatgaaaagtcttacacgc

SEQ ID NO: 8194488 - DNA, 22 bp, Homo sapiens
gaacatcttatccatttcctct

SEQ ID NO: 8194489 - DNA, 22 bp, Homo sapiens
gaacatttccagaaaggaacta

SEQ ID NO: 8194490 - DNA, 22 bp, Homo sapiens
gaacatttatgatgcaatacct

SEQ ID NO: 8194491 - DNA, 22 bp, Homo sapiens
gaacatttatgatgcaatacct

SEQ ID NO: 8194492 - DNA, 22 bp, Homo sapiens
gaacattcttggaggaaataac

SEQ ID NO: 8194493 - DNA, 22 bp, Homo sapiens
gaacatttatattagatagcta

SEQ ID NO: 8194494 - DNA, 22 bp, Homo sapiens
gaacattgctttatttcttcta

SEQ ID NO: 8194495 - DNA, 22 bp, Homo sapiens
gaacaatgagtcattcaggtga

SEQ ID NO: 8194496 - DNA, 19 bp, Homo sapiens
gaacaatttgttagctctc

SEQ ID NO: 8194497 - DNA, 22 bp, Homo sapiens
gaacataactattgtgaatagt

SEQ ID NO: 8194498 - DNA, 22 bp, Homo sapiens
gaacataactattgtgaatagt

SEQ ID NO: 8194499 - DNA, 22 bp, Homo sapiens
atgaggcatgtgaggagaaggg

SEQ ID NO: 8194500 - DNA, 23 bp, Homo sapiens
atgaggcattaaacaggcttttt

SEQ ID NO: 8194501 - DNA, 23 bp, Homo sapiens
atgaggcattaaacaggcttttt

SEQ ID NO: 8194502 - DNA, 22 bp, Homo sapiens
atgaggcattcacagaaggcac

SEQ ID NO: 8194503 - DNA, 22 bp, Homo sapiens
atgaggcattcacagaaggcac

SEQ ID NO: 8194504 - DNA, 22 bp, Homo sapiens
atgaggcattccactcaaactc

SEQ ID NO: 8194505 - DNA, 22 bp, Homo sapiens
atgaggcattccactcaaactc

SEQ ID NO: 8194506 - DNA, 15 bp, Homo sapiens
atgaggcatttgggg

SEQ ID NO: 8194507 - DNA, 22 bp, Homo sapiens
gaaatgatgtctgtgctgccac

SEQ ID NO: 8194508 - DNA, 22 bp, Homo sapiens
gaaatgattttagtttatcatg

SEQ ID NO: 8194509 - DNA, 22 bp, Homo sapiens
gaaatgattttagtttatcatg

SEQ ID NO: 8194510 - DNA, 22 bp, Homo sapiens
atgaggcagtctggcctgaggg

SEQ ID NO: 8194511 - DNA, 22 bp, Homo sapiens
atgaggcatagcagggatcgga

SEQ ID NO: 8194512 - DNA, 22 bp, Homo sapiens
atgaggcatagcagggatcgga

SEQ ID NO: 8194513 - DNA, 16 bp, Homo sapiens
atgaggcataggctgc

SEQ ID NO: 8194514 - DNA, 16 bp, Homo sapiens
atgaggcataggctgc

SEQ ID NO: 8194515 - DNA, 21 bp, Homo sapiens
atgaggcatgagagggtttct

SEQ ID NO: 8194516 - DNA, 22 bp, Homo sapiens
atgaggcatctgcagtcactag

SEQ ID NO: 8194517 - DNA, 22 bp, Homo sapiens
atgaggcatgtgaggagaaggg

SEQ ID NO: 8194518 - DNA, 22 bp, Homo sapiens
atgaggcatgggatcaaaatga

SEQ ID NO: 8194519 - DNA, 22 bp, Homo sapiens
atgaggcatctaacattgcaaa

SEQ ID NO: 8194520 - DNA, 22 bp, Homo sapiens
atgaggcatatcctcctatggt

SEQ ID NO: 8194521 - DNA, 22 bp, Homo sapiens
atgaggcatctaacattgcaaa

SEQ ID NO: 8194522 - DNA, 22 bp, Homo sapiens
gaaaatgagcctcagctacatt

SEQ ID NO: 8194523 - DNA, 22 bp, Homo sapiens
gaaaatgagcctcagctacatt

SEQ ID NO: 8194524 - DNA, 22 bp, Homo sapiens
gaaaatgagcctcagctacatt

SEQ ID NO: 8194525 - DNA, 22 bp, Homo sapiens
gaaaatgcctctggcattaaac

SEQ ID NO: 8194526 - DNA, 22 bp, Homo sapiens
gaaatatacatgaagtcggctg

SEQ ID NO: 8194527 - DNA, 22 bp, Homo sapiens
gaaatatacatgaagtcggctg

SEQ ID NO: 8194528 - DNA, 22 bp, Homo sapiens
gaaatatacatgaagtcggctg

SEQ ID NO: 8194529 - DNA, 22 bp, Homo sapiens
gaaatctacttagtgtctggat

SEQ ID NO: 8194530 - DNA, 22 bp, Homo sapiens
gaaatctactttgggttagaca

SEQ ID NO: 8194531 - DNA, 22 bp, Homo sapiens
gaaatctactttgggttagaca

SEQ ID NO: 8194532 - DNA, 23 bp, Homo sapiens
gaaatctagtcatttttagtctg

SEQ ID NO: 8194533 - DNA, 22 bp, Homo sapiens
gaaatcttttaaccattcattt

SEQ ID NO: 8194534 - DNA, 22 bp, Homo sapiens
gaaatcttttcatctcatttga

SEQ ID NO: 8194535 - DNA, 22 bp, Homo sapiens
gaaatcttccaatggtcacatc

SEQ ID NO: 8194536 - DNA, 22 bp, Homo sapiens
gaaatcttccaatggtcacatc

SEQ ID NO: 8194537 - DNA, 22 bp, Homo sapiens
gaaatctgcggtgaggcctgag

SEQ ID NO: 8194538 - DNA, 22 bp, Homo sapiens
gaaatctgcttcttgcatagta

SEQ ID NO: 8194539 - DNA, 22 bp, Homo sapiens
gaaatgaaacaggcttttaagg

SEQ ID NO: 8194540 - DNA, 22 bp, Homo sapiens
atgaatgatgccagttgaaatg

SEQ ID NO: 8194541 - DNA, 22 bp, Homo sapiens
atgaatgattaaagagtacagt

SEQ ID NO: 8194542 - DNA, 22 bp, Homo sapiens
atgaatgatgccagttgaaatg

SEQ ID NO: 8194543 - DNA, 22 bp, Homo sapiens
atgaatgagattaccaatgtga

SEQ ID NO: 8194544 - DNA, 22 bp, Homo sapiens
atgaatgagagaatagtggagc

SEQ ID NO: 8194545 - DNA, 22 bp, Homo sapiens
atgaatgagaaagctgaaatct

SEQ ID NO: 8194546 - DNA, 22 bp, Homo sapiens
atgaatgagaaacaggtgagat

SEQ ID NO: 8194547 - DNA, 22 bp, Homo sapiens
atgaatgactgtctactttggg

SEQ ID NO: 8194548 - DNA, 22 bp, Homo sapiens
atgaatgattttatgtaaatga

SEQ ID NO: 8194549 - DNA, 22 bp, Homo sapiens
atgaatgcaaactagtttgtgt

SEQ ID NO: 8194550 - DNA, 22 bp, Homo sapiens
atgaatgattttatgtaaatga

SEQ ID NO: 8194551 - DNA, 22 bp, Homo sapiens
atgaatgcagcactgtttttct

SEQ ID NO: 8194552 - DNA, 22 bp, Homo sapiens
atgaatgcaatattttatgaca

SEQ ID NO: 8194553 - DNA, 22 bp, Homo sapiens
atgaatgcatacatttgtcaag

SEQ ID NO: 8194554 - DNA, 22 bp, Homo sapiens
atgaatgcatacatttgtcaag

SEQ ID NO: 8194555 - DNA, 22 bp, Homo sapiens
atgaatgcatgcttattttgca

SEQ ID NO: 8194556 - DNA, 22 bp, Homo sapiens
atgaatgcatggtagactctgt

SEQ ID NO: 8194557 - DNA, 22 bp, Homo sapiens
atgaatgcatggtagactctgt

SEQ ID NO: 8194558 - DNA, 19 bp, Homo sapiens
atgaatgcattgcatggat

SEQ ID NO: 8194559 - DNA, 22 bp, Homo sapiens
atgaatgctgaattatgaactg

SEQ ID NO: 8194560 - DNA, 22 bp, Homo sapiens
atgaatgtttggtgatcagata

SEQ ID NO: 8194561 - DNA, 22 bp, Homo sapiens
atgaattgaaagaagaatatct

SEQ ID NO: 8194562 - DNA, 22 bp, Homo sapiens
atgaattgaggaaaacagtcgt

SEQ ID NO: 8194563 - DNA, 22 bp, Homo sapiens
atgaattgaggaaaacagtcgt

SEQ ID NO: 8194564 - DNA, 22 bp, Homo sapiens
gaaaacatccagagatagacct

SEQ ID NO: 8194565 - DNA, 22 bp, Homo sapiens
gaaaacatccagagatagacct

SEQ ID NO: 8194566 - DNA, 22 bp, Homo sapiens
ctttttccagcttcagggtggg

SEQ ID NO: 8194567 - DNA, 22 bp, Homo sapiens
ctttttccagcttcagggtggg

SEQ ID NO: 8194568 - DNA, 22 bp, Homo sapiens
ctttttccagcttcagggtggg

SEQ ID NO: 8194569 - DNA, 21 bp, Homo sapiens
gaaaaccatttgcatcatgag

SEQ ID NO: 8194570 - DNA, 22 bp, Homo sapiens
gaaaatagttcatcacaatgat

SEQ ID NO: 8194571 - DNA, 22 bp, Homo sapiens
gaaaataggctgcatctccttc

SEQ ID NO: 8194572 - DNA, 22 bp, Homo sapiens
gaaaatctgcttatattatttt

SEQ ID NO: 8194573 - DNA, 22 bp, Homo sapiens
gaaaatgagcctcagctacatt

SEQ ID NO: 8194574 - DNA, 22 bp, Homo sapiens
gaaaatgagcctcagctacatt

SEQ ID NO: 8194575 - DNA, 22 bp, Homo sapiens
gaaaatagcagatagaccaatg

SEQ ID NO: 8194576 - DNA, 22 bp, Homo sapiens
gaaaataggcagatgcattgta

SEQ ID NO: 8194577 - DNA, 22 bp, Homo sapiens
gaaaatagcagatagaccaatg

SEQ ID NO: 8194578 - DNA, 22 bp, Homo sapiens
gaaaatagcagatagaccaatg

SEQ ID NO: 8194579 - DNA, 20 bp, Homo sapiens
gaaaataggccagccaggta

SEQ ID NO: 8194580 - DNA, 22 bp, Homo sapiens
gaaaagagaacatctgaggatc

SEQ ID NO: 8194581 - DNA, 22 bp, Homo sapiens
gaaaagaactgcatgggattaa

SEQ ID NO: 8194582 - DNA, 22 bp, Homo sapiens
gaaaagaactgcatgggattaa

SEQ ID NO: 8194583 - DNA, 22 bp, Homo sapiens
gaaaactaacggaaaagttagg

SEQ ID NO: 8194584 - DNA, 22 bp, Homo sapiens
gaaaactaacggaaaagttagg

SEQ ID NO: 8194585 - DNA, 22 bp, Homo sapiens
gaaaactattggcctagaacaa

SEQ ID NO: 8194586 - DNA, 22 bp, Homo sapiens
gaaaactattggcctagaacaa

SEQ ID NO: 8194587 - DNA, 22 bp, Homo sapiens
atgaatcagaatctgcatttta

SEQ ID NO: 8194588 - DNA, 22 bp, Homo sapiens
atgaatgaagaacatctgtgcc

SEQ ID NO: 8194589 - DNA, 22 bp, Homo sapiens
atgaatctgttttttgtcaata

SEQ ID NO: 8194590 - DNA, 22 bp, Homo sapiens
atgaatgaaatacagagtactt

SEQ ID NO: 8194591 - DNA, 23 bp, Homo sapiens
atgaatgaataaggcaggaaagc

SEQ ID NO: 8194592 - DNA, 22 bp, Homo sapiens
atgaatgaataccatgcaacta

SEQ ID NO: 8194593 - DNA, 22 bp, Homo sapiens
atgaatgacatctgattccata

SEQ ID NO: 8194594 - DNA, 22 bp, Homo sapiens
atgaatacgcggtcatacacat

SEQ ID NO: 8194595 - DNA, 22 bp, Homo sapiens
atgaataagtaaactcctttgg

SEQ ID NO: 8194596 - DNA, 22 bp, Homo sapiens
atgaatatgagactgagagcct

SEQ ID NO: 8194597 - DNA, 22 bp, Homo sapiens
atgaatatgtacacatctgtca

SEQ ID NO: 8194598 - DNA, 22 bp, Homo sapiens
atgaatatgtacacatctgtca

SEQ ID NO: 8194599 - DNA, 22 bp, Homo sapiens
atgaatcaaactgtacactgag

SEQ ID NO: 8194600 - DNA, 22 bp, Homo sapiens
atgaatattgaatgtcttatga

SEQ ID NO: 8194601 - DNA, 22 bp, Homo sapiens
atgaatatgtacacatctgtca

SEQ ID NO: 8194602 - DNA, 22 bp, Homo sapiens
cttgagatgtcatctgctttgg

SEQ ID NO: 8194603 - DNA, 22 bp, Homo sapiens
cttgagcacagcggcttcagga

SEQ ID NO: 8194604 - DNA, 22 bp, Homo sapiens
cttgaggttttgactcagcttt

SEQ ID NO: 8194605 - DNA, 22 bp, Homo sapiens
atgaagcaggcacagcttcagg

SEQ ID NO: 8194606 - DNA, 22 bp, Homo sapiens
atgaagcaggcacagcttcagg

SEQ ID NO: 8194607 - DNA, 22 bp, Homo sapiens
cttgaggttttgactcagcttt

SEQ ID NO: 8194608 - DNA, 22 bp, Homo sapiens
atgaagttctcaataatcatgt

SEQ ID NO: 8194609 - DNA, 22 bp, Homo sapiens
atgaataaaacattttaatcag

SEQ ID NO: 8194610 - DNA, 22 bp, Homo sapiens
atgaataaaacattttaatcag

SEQ ID NO: 8194611 - DNA, 22 bp, Homo sapiens
atgaataaacaggtgcctcttc

SEQ ID NO: 8194612 - DNA, 22 bp, Homo sapiens
atcttcccaggctggggagagg

SEQ ID NO: 8194613 - DNA, 22 bp, Homo sapiens
atcttcccaggctggggagagg

SEQ ID NO: 8194614 - DNA, 22 bp, Homo sapiens
atcttcccaggctggggagagg

SEQ ID NO: 8194615 - DNA, 22 bp, Homo sapiens
cttgagaatgtgagccacagat

SEQ ID NO: 8194616 - DNA, 22 bp, Homo sapiens
cttgagagggagtagtttagga

SEQ ID NO: 8194617 - DNA, 21 bp, Homo sapiens
cttgagaattaactgttcatt

SEQ ID NO: 8194618 - DNA, 22 bp, Homo sapiens
cttgagaagcattaagaggtag

SEQ ID NO: 8194619 - DNA, 22 bp, Homo sapiens
atcttcaatatttttgtgtaga

SEQ ID NO: 8194620 - DNA, 22 bp, Homo sapiens
atcttcaattgaaaactagcct

SEQ ID NO: 8194621 - DNA, 22 bp, Homo sapiens
atcttcatcaagttcacagtgg

SEQ ID NO: 8194622 - DNA, 22 bp, Homo sapiens
atcttcatcaagttcacagtgg

SEQ ID NO: 8194623 - DNA, 22 bp, Homo sapiens
atcttcatcaagttcacagtgg

SEQ ID NO: 8194624 - DNA, 22 bp, Homo sapiens
atcttcagcgaggtttcctttc

SEQ ID NO: 8194625 - DNA, 22 bp, Homo sapiens
atcttcagttttcagtgagcca

SEQ ID NO: 8194626 - DNA, 22 bp, Homo sapiens
atcttccaagctccctggtgta

SEQ ID NO: 8194627 - DNA, 19 bp, Homo sapiens
atcttcattttacaggcag

SEQ ID NO: 8194628 - DNA, 21 bp, Homo sapiens
atcttcaactgattggaggag

SEQ ID NO: 8194629 - DNA, 22 bp, Homo sapiens
atcttcaacttgatcatttgaa

SEQ ID NO: 8194630 - DNA, 22 bp, Homo sapiens
atcttcaaggaaaaaatacagt

SEQ ID NO: 8194631 - DNA, 22 bp, Homo sapiens
atcttcaaggaaaaaatacagt

SEQ ID NO: 8194632 - DNA, 22 bp, Homo sapiens
gccaccttccaaaataatcaca

SEQ ID NO: 8194633 - DNA, 22 bp, Homo sapiens
gccactcatgggaggtgtgcaa

SEQ ID NO: 8194634 - DNA, 22 bp, Homo sapiens
gccactcatgggaggtgtgcaa

SEQ ID NO: 8194635 - DNA, 21 bp, Homo sapiens
gccactgcactccagcctggg

SEQ ID NO: 8194636 - DNA, 22 bp, Homo sapiens
gccactggacccagggttatca

SEQ ID NO: 8194637 - DNA, 22 bp, Homo sapiens
gccactggagacagtggggaag

SEQ ID NO: 8194638 - DNA, 21 bp, Homo sapiens
gccactgcactccagcctggg

SEQ ID NO: 8194639 - DNA, 21 bp, Homo sapiens
gccactgcactccagcctggg

SEQ ID NO: 8194640 - DNA, 21 bp, Homo sapiens
gccactgcactccagcctggg

SEQ ID NO: 8194641 - DNA, 22 bp, Homo sapiens
gccactgcactccagcccaggc

SEQ ID NO: 8194642 - DNA, 22 bp, Homo sapiens
gccactgattccaagtcaattt

SEQ ID NO: 8194643 - DNA, 22 bp, Homo sapiens
gcattcactgggtgttcatggg

SEQ ID NO: 8194644 - DNA, 22 bp, Homo sapiens
gcattcatatggaaggaaacta

SEQ ID NO: 8194645 - DNA, 22 bp, Homo sapiens
gcattcatcaaaaatgttcctc

SEQ ID NO: 8194646 - DNA, 22 bp, Homo sapiens
gcattcatcaaaaatgttcctc

SEQ ID NO: 8194647 - DNA, 22 bp, Homo sapiens
gcattcatcttcctccatgcag

SEQ ID NO: 8194648 - DNA, 22 bp, Homo sapiens
gcattcatcttcatgaaagcac

SEQ ID NO: 8194649 - DNA, 22 bp, Homo sapiens
gcattcatgtccttcctgaacg

SEQ ID NO: 8194650 - DNA, 22 bp, Homo sapiens
gcattcattcattcattaggta

SEQ ID NO: 8194651 - DNA, 22 bp, Homo sapiens
gcattcatgcctgtgtgagctc

SEQ ID NO: 8194652 - DNA, 22 bp, Homo sapiens
gcattcattcattcattaggta

SEQ ID NO: 8194653 - DNA, 22 bp, Homo sapiens
gcattccttgagttccctgtgc

SEQ ID NO: 8194654 - DNA, 16 bp, Homo sapiens
attgttttcaattaga

SEQ ID NO: 8194655 - DNA, 22 bp, Homo sapiens
atttaaagtggtagattggcag

SEQ ID NO: 8194656 - DNA, 22 bp, Homo sapiens
atttaaagtggtagattggcag

SEQ ID NO: 8194657 - DNA, 22 bp, Homo sapiens
atttaaagtggtagattggcag

SEQ ID NO: 8194658 - DNA, 22 bp, Homo sapiens
atttaaatgcttaagagggttt

SEQ ID NO: 8194659 - DNA, 22 bp, Homo sapiens
atttaaatgcttaagagggttt

SEQ ID NO: 8194660 - DNA, 22 bp, Homo sapiens
atttaaatgcttaagagggttt

SEQ ID NO: 8194661 - DNA, 22 bp, Homo sapiens
atttaaatgcttaagagggttt

SEQ ID NO: 8194662 - DNA, 22 bp, Homo sapiens
atttaaatgcttaagagggttt

SEQ ID NO: 8194663 - DNA, 22 bp, Homo sapiens
atttaaattttctgatggagag

SEQ ID NO: 8194664 - DNA, 22 bp, Homo sapiens
atttaaatgcttaagagggttt

SEQ ID NO: 8194665 - DNA, 22 bp, Homo sapiens
atttaaatgcttaagagggttt

SEQ ID NO: 8194666 - DNA, 20 bp, Homo sapiens
gccactgggcaccagcaggg

SEQ ID NO: 8194667 - DNA, 22 bp, Homo sapiens
gccactggcgctgtgcagagtg

SEQ ID NO: 8194668 - DNA, 22 bp, Homo sapiens
gccactggcatctagttggtag

SEQ ID NO: 8194669 - DNA, 22 bp, Homo sapiens
gccactgtcatcttgtgaagca

SEQ ID NO: 8194670 - DNA, 22 bp, Homo sapiens
gccactgtcataccctggcaat

SEQ ID NO: 8194671 - DNA, 22 bp, Homo sapiens
attgttttattaaatgagccct

SEQ ID NO: 8194672 - DNA, 22 bp, Homo sapiens
attgtacaatgcctggaacatt

SEQ ID NO: 8194673 - DNA, 22 bp, Homo sapiens
attgtacaatgctgaggtttgg

SEQ ID NO: 8194674 - DNA, 22 bp, Homo sapiens
attgtacactagtggcagcagt

SEQ ID NO: 8194675 - DNA, 22 bp, Homo sapiens
attgtacaatgcctggaacatt

SEQ ID NO: 8194676 - DNA, 22 bp, Homo sapiens
attgtacaatgctgaggtttgg

SEQ ID NO: 8194677 - DNA, 22 bp, Homo sapiens
attgtacaatgctgaggtttgg

SEQ ID NO: 8194678 - DNA, 21 bp, Homo sapiens
gcagtgcagcttggagggtag

SEQ ID NO: 8194679 - DNA, 21 bp, Homo sapiens
gcagtgcagcttggagggtag

SEQ ID NO: 8194680 - DNA, 22 bp, Homo sapiens
attgtaattttagagaaagtgg

SEQ ID NO: 8194681 - DNA, 22 bp, Homo sapiens
attgtaagaggtttggctgtgt

SEQ ID NO: 8194682 - DNA, 22 bp, Homo sapiens
attgtacaagtttggttattta

SEQ ID NO: 8194683 - DNA, 22 bp, Homo sapiens
attgtacaagtttggttattta

SEQ ID NO: 8194684 - DNA, 22 bp, Homo sapiens
attgtacaatgcctggaacatt

SEQ ID NO: 8194685 - DNA, 22 bp, Homo sapiens
attgtacaagtttggttattta

SEQ ID NO: 8194686 - DNA, 22 bp, Homo sapiens
gcagtgccacaagatgggagga

SEQ ID NO: 8194687 - DNA, 22 bp, Homo sapiens
gcagtgcatgtcggaactcatt

SEQ ID NO: 8194688 - DNA, 22 bp, Homo sapiens
gcagtgcaggacaaatcagtgc

SEQ ID NO: 8194689 - DNA, 22 bp, Homo sapiens
gcagtgccgaccatccttccca

SEQ ID NO: 8194690 - DNA, 22 bp, Homo sapiens
gcagtgccttgcttctctgtct

SEQ ID NO: 8194691 - DNA, 22 bp, Homo sapiens
gcagtgccttgcttctctgtct

SEQ ID NO: 8194692 - DNA, 18 bp, Homo sapiens
gcagtgccagcctctcct

SEQ ID NO: 8194693 - DNA, 18 bp, Homo sapiens
gcagtgccagcctctcct

SEQ ID NO: 8194694 - DNA, 22 bp, Homo sapiens
gcagtgctaaggattctgcctt

SEQ ID NO: 8194695 - DNA, 22 bp, Homo sapiens
gcagtgctaagtagctggccca

SEQ ID NO: 8194696 - DNA, 22 bp, Homo sapiens
gcagtgctgatcccatggcaga

SEQ ID NO: 8194697 - DNA, 22 bp, Homo sapiens
gcagtgctagcctcacagggtc

SEQ ID NO: 8194698 - DNA, 22 bp, Homo sapiens
gcagtgctgagaggtgatcgga

SEQ ID NO: 8194699 - DNA, 22 bp, Homo sapiens
attgttgataatcgtgttgtca

SEQ ID NO: 8194700 - DNA, 20 bp, Homo sapiens
attgttgctgctgctgttga

SEQ ID NO: 8194701 - DNA, 22 bp, Homo sapiens
attgttgggtctcactcctaga

SEQ ID NO: 8194702 - DNA, 22 bp, Homo sapiens
attgttgtctttacctgtattt

SEQ ID NO: 8194703 - DNA, 22 bp, Homo sapiens
gcattattaatagctgcatgag

SEQ ID NO: 8194704 - DNA, 22 bp, Homo sapiens
gcattattaactggaggaaaag

SEQ ID NO: 8194705 - DNA, 22 bp, Homo sapiens
attgtttacactaacttcataa

SEQ ID NO: 8194706 - DNA, 22 bp, Homo sapiens
attgttgaggagactcttcaat

SEQ ID NO: 8194707 - DNA, 22 bp, Homo sapiens
attgttctggatatttacattg

SEQ ID NO: 8194708 - DNA, 22 bp, Homo sapiens
attgttcctggaaaagaacagg

SEQ ID NO: 8194709 - DNA, 22 bp, Homo sapiens
attgttatgaaaataagatgtt

SEQ ID NO: 8194710 - DNA, 22 bp, Homo sapiens
attgttcaaagtgctttgcatg

SEQ ID NO: 8194711 - DNA, 22 bp, Homo sapiens
attgttcaatgtaataattttg

SEQ ID NO: 8194712 - DNA, 22 bp, Homo sapiens
attgttcaatgtaataattttg

SEQ ID NO: 8194713 - DNA, 22 bp, Homo sapiens
attgttcatgtatgaataaata

SEQ ID NO: 8194714 - DNA, 22 bp, Homo sapiens
attgttcaatgtaataattttg

SEQ ID NO: 8194715 - DNA, 22 bp, Homo sapiens
attgttcactgtgaatcttgat

SEQ ID NO: 8194716 - DNA, 20 bp, Homo sapiens
attgtgcagcccttggcaga

SEQ ID NO: 8194717 - DNA, 22 bp, Homo sapiens
attgtgcagcagtggtacctgg

SEQ ID NO: 8194718 - DNA, 22 bp, Homo sapiens
attgtgcagcacagatcatgac

SEQ ID NO: 8194719 - DNA, 22 bp, Homo sapiens
attgtgcatctactgtgtgcag

SEQ ID NO: 8194720 - DNA, 22 bp, Homo sapiens
attgtgcagtaaagtccttttc

SEQ ID NO: 8194721 - DNA, 22 bp, Homo sapiens
attgtgcaggtcagttattgca

SEQ ID NO: 8194722 - DNA, 22 bp, Homo sapiens
attgtgcagctctgctcttatt

SEQ ID NO: 8194723 - DNA, 20 bp, Homo sapiens
gcagtgctggtgcctctgct

SEQ ID NO: 8194724 - DNA, 22 bp, Homo sapiens
attgtgcacctactgtgtgcag

SEQ ID NO: 8194725 - DNA, 22 bp, Homo sapiens
attgtgcagaattggaattgca

SEQ ID NO: 8194726 - DNA, 22 bp, Homo sapiens
attgtgcagatagtaattagga

SEQ ID NO: 8194727 - DNA, 21 bp, Homo sapiens
attgttatcattgtgctgtgt

SEQ ID NO: 8194728 - DNA, 22 bp, Homo sapiens
attgttaatgttgcactaaggt

SEQ ID NO: 8194729 - DNA, 22 bp, Homo sapiens
gcagggactgtgatctcacaga

SEQ ID NO: 8194730 - DNA, 22 bp, Homo sapiens
gcagggactgtgatctcacaga

SEQ ID NO: 8194731 - DNA, 22 bp, Homo sapiens
gcagggacgccagggacagcaa

SEQ ID NO: 8194732 - DNA, 22 bp, Homo sapiens
gcaggctgtggtatgttgggca

SEQ ID NO: 8194733 - DNA, 22 bp, Homo sapiens
gcagggactttggcaacaggtg

SEQ ID NO: 8194734 - DNA, 22 bp, Homo sapiens
gcagggaggaagagatgcttcc

SEQ ID NO: 8194735 - DNA, 22 bp, Homo sapiens
gcaggctggtctgaccatccct

SEQ ID NO: 8194736 - DNA, 22 bp, Homo sapiens
gcaggctggtctgaccatccct

SEQ ID NO: 8194737 - DNA, 22 bp, Homo sapiens
gcaggctgtagacaccaaacta

SEQ ID NO: 8194738 - DNA, 22 bp, Homo sapiens
gcaggctgtagacaccaaacta

SEQ ID NO: 8194739 - DNA, 22 bp, Homo sapiens
gcaggctgtctaaagttagagt

SEQ ID NO: 8194740 - DNA, 22 bp, Homo sapiens
gcaggctgtctaaagttagagt

SEQ ID NO: 8194741 - DNA, 22 bp, Homo sapiens
gcaggctgtgaggctcagatgg

SEQ ID NO: 8194742 - DNA, 22 bp, Homo sapiens
gcaggctgtgaggctcagatgg

SEQ ID NO: 8194743 - DNA, 22 bp, Homo sapiens
gcaggctgtgaggctcagatgg

SEQ ID NO: 8194744 - DNA, 22 bp, Homo sapiens
gcaggctgtgaggctcagatgg

SEQ ID NO: 8194745 - DNA, 22 bp, Homo sapiens
gcaggctgtgaggctcagatgg

SEQ ID NO: 8194746 - DNA, 22 bp, Homo sapiens
gcaggctgtggtatgttgggca

SEQ ID NO: 8194747 - DNA, 22 bp, Homo sapiens
gcaggctgtgaggctcagatgg

SEQ ID NO: 8194748 - DNA, 22 bp, Homo sapiens
gcaggctgtgaggctcagatgg

SEQ ID NO: 8194749 - DNA, 22 bp, Homo sapiens
gcaggctgtgaggctcagatgg

SEQ ID NO: 8194750 - DNA, 22 bp, Homo sapiens
gcaggctgtctaaagttagagt

SEQ ID NO: 8194751 - DNA, 22 bp, Homo sapiens
gcaggctgtctaaagttagagt

SEQ ID NO: 8194752 - DNA, 22 bp, Homo sapiens
gcaggctgtctaaagttagagt

SEQ ID NO: 8194753 - DNA, 22 bp, Homo sapiens
gcaggagcaatggcctatcaga

SEQ ID NO: 8194754 - DNA, 22 bp, Homo sapiens
gcaggagcagtcaggggcagct

SEQ ID NO: 8194755 - DNA, 18 bp, Homo sapiens
gcaggagatgggtggggt

SEQ ID NO: 8194756 - DNA, 22 bp, Homo sapiens
gcaggagcaaactgcagtgtgg

SEQ ID NO: 8194757 - DNA, 22 bp, Homo sapiens
gcaggagccacttcagggatgc

SEQ ID NO: 8194758 - DNA, 22 bp, Homo sapiens
gcaggagccacttcagggatgc

SEQ ID NO: 8194759 - DNA, 22 bp, Homo sapiens
gcaggatgaactaacacctgca

SEQ ID NO: 8194760 - DNA, 23 bp, Homo sapiens
gcaggagttcctggactccagga

SEQ ID NO: 8194761 - DNA, 22 bp, Homo sapiens
gcaggatgaactaacacctgca

SEQ ID NO: 8194762 - DNA, 22 bp, Homo sapiens
gcaggatgaaggcagaggctga

SEQ ID NO: 8194763 - DNA, 22 bp, Homo sapiens
gcaggatgaaggcagaggctga

SEQ ID NO: 8194764 - DNA, 22 bp, Homo sapiens
gcaggatgaactaacacctgca

SEQ ID NO: 8194765 - DNA, 22 bp, Homo sapiens
gcaggagcagtcaggggcagct

SEQ ID NO: 8194766 - DNA, 22 bp, Homo sapiens
gcaggagcagtcaggggcagct

SEQ ID NO: 8194767 - DNA, 22 bp, Homo sapiens
gcaggagccacttcagggatgc

SEQ ID NO: 8194768 - DNA, 22 bp, Homo sapiens
gcaggatggtggaaggcctgct

SEQ ID NO: 8194769 - DNA, 22 bp, Homo sapiens
gcaggcggatcactggaagtca

SEQ ID NO: 8194770 - DNA, 14 bp, Homo sapiens
gcaggcggatcact

SEQ ID NO: 8194771 - DNA, 22 bp, Homo sapiens
gcaggcgtgtttcacgtgccag

SEQ ID NO: 8194772 - DNA, 22 bp, Homo sapiens
gcaggatggtgccctttctgcc

SEQ ID NO: 8194773 - DNA, 22 bp, Homo sapiens
gcaggatgggtgtagcccagca

SEQ ID NO: 8194774 - DNA, 22 bp, Homo sapiens
gcaggatggtggaaggcctgct

SEQ ID NO: 8194775 - DNA, 22 bp, Homo sapiens
gcaggatggtgccctttctgcc

SEQ ID NO: 8194776 - DNA, 22 bp, Homo sapiens
gcaggatgcaacagcttgtagt

SEQ ID NO: 8194777 - DNA, 21 bp, Homo sapiens
gcaggatgcatcttggtgtct

SEQ ID NO: 8194778 - DNA, 21 bp, Homo sapiens
gcaggatgcatcttggtgtct

SEQ ID NO: 8194779 - DNA, 22 bp, Homo sapiens
gcaggatgagtgagtacattta

SEQ ID NO: 8194780 - DNA, 22 bp, Homo sapiens
gcaggatgcaacagcttgtagt

SEQ ID NO: 8194781 - DNA, 22 bp, Homo sapiens
gcaggatgaaggcagaggctga

SEQ ID NO: 8194782 - DNA, 22 bp, Homo sapiens
gcaggatgaaggcagaggctga

SEQ ID NO: 8194783 - DNA, 22 bp, Homo sapiens
gcaggatgagtgagtacattta

SEQ ID NO: 8194784 - DNA, 22 bp, Homo sapiens
gcaggatgccagggcagcagcg

SEQ ID NO: 8194785 - DNA, 22 bp, Homo sapiens
gcaggatgccagggcagcagcg

SEQ ID NO: 8194786 - DNA, 22 bp, Homo sapiens
gcaggatgccagggcagcagcg

SEQ ID NO: 8194787 - DNA, 22 bp, Homo sapiens
gcaggatgccagggcagcagcg

SEQ ID NO: 8194788 - DNA, 22 bp, Homo sapiens
gcaggatgggagcttcactctg

SEQ ID NO: 8194789 - DNA, 22 bp, Homo sapiens
gcaggatgggagcttcactctg

SEQ ID NO: 8194790 - DNA, 22 bp, Homo sapiens
gcaggatgggagcttcactctg

SEQ ID NO: 8194791 - DNA, 22 bp, Homo sapiens
gcaggatgggagcttcactttg

SEQ ID NO: 8194792 - DNA, 22 bp, Homo sapiens
gcaggatgggtgtagcccagca

SEQ ID NO: 8194793 - DNA, 22 bp, Homo sapiens
gcaggatgggagcttcactttg

SEQ ID NO: 8194794 - DNA, 22 bp, Homo sapiens
gcaggatgggagcttcactttg

SEQ ID NO: 8194795 - DNA, 22 bp, Homo sapiens
attggtggtgaggacatgccag

SEQ ID NO: 8194796 - DNA, 22 bp, Homo sapiens
attggcagttagtgacgaggct

SEQ ID NO: 8194797 - DNA, 22 bp, Homo sapiens
attggcagggccagcatctccc

SEQ ID NO: 8194798 - DNA, 22 bp, Homo sapiens
attggcaggaaccgaggagggg

SEQ ID NO: 8194799 - DNA, 15 bp, Homo sapiens
gcaggtggatcactt

SEQ ID NO: 8194800 - DNA, 22 bp, Homo sapiens
attgtaaaagtattctaagatt

SEQ ID NO: 8194801 - DNA, 22 bp, Homo sapiens
attggttttgttatctccattc

SEQ ID NO: 8194802 - DNA, 22 bp, Homo sapiens
attgtaaatagtgccacaataa

SEQ ID NO: 8194803 - DNA, 14 bp, Homo sapiens
gcaggtggatcact

SEQ ID NO: 8194804 - DNA, 15 bp, Homo sapiens
gcaggtggatcactt

SEQ ID NO: 8194805 - DNA, 14 bp, Homo sapiens
gcaggtggatcact

SEQ ID NO: 8194806 - DNA, 22 bp, Homo sapiens
gcaggtggatcacctgaggtca

SEQ ID NO: 8194807 - DNA, 22 bp, Homo sapiens
gcaggtggatcacctgaggtca

SEQ ID NO: 8194808 - DNA, 22 bp, Homo sapiens
gcaggtggatcacctgaggtca

SEQ ID NO: 8194809 - DNA, 22 bp, Homo sapiens
gcaggtggatcacctgaggtca

SEQ ID NO: 8194810 - DNA, 16 bp, Homo sapiens
gcaggtggatcacctg

SEQ ID NO: 8194811 - DNA, 16 bp, Homo sapiens
gcaggtggatcacctg

SEQ ID NO: 8194812 - DNA, 22 bp, Homo sapiens
gcaggtggatcacctgaggtca

SEQ ID NO: 8194813 - DNA, 22 bp, Homo sapiens
gcaggtggatcacctgaggtca

SEQ ID NO: 8194814 - DNA, 22 bp, Homo sapiens
gcaggtggatcacctgaggtca

SEQ ID NO: 8194815 - DNA, 22 bp, Homo sapiens
gcaggtggatcaccacgtcagg

SEQ ID NO: 8194816 - DNA, 14 bp, Homo sapiens
gcaggtggatcacc

SEQ ID NO: 8194817 - DNA, 22 bp, Homo sapiens
gcaggtggatcaccacgtcagg

SEQ ID NO: 8194818 - DNA, 22 bp, Homo sapiens
gcaggtggatcaccacgtcagg

SEQ ID NO: 8194819 - DNA, 22 bp, Homo sapiens
gcaggtggatcaccacgtcagg

SEQ ID NO: 8194820 - DNA, 22 bp, Homo sapiens
gcaggtggatcaccacgtcagg

SEQ ID NO: 8194821 - DNA, 22 bp, Homo sapiens
gcaggtggatcaccacgtcagg

SEQ ID NO: 8194822 - DNA, 14 bp, Homo sapiens
gcaggtggatcacc

SEQ ID NO: 8194823 - DNA, 22 bp, Homo sapiens
gcagggtgaaggtcacatagaa

SEQ ID NO: 8194824 - DNA, 22 bp, Homo sapiens
gcagggtgaaggtcacatagaa

SEQ ID NO: 8194825 - DNA, 22 bp, Homo sapiens
gcagggtgaaggtcacatagaa

SEQ ID NO: 8194826 - DNA, 22 bp, Homo sapiens
gcaggtggatattgctacttga

SEQ ID NO: 8194827 - DNA, 22 bp, Homo sapiens
gcaggtggatattgctacttga

SEQ ID NO: 8194828 - DNA, 22 bp, Homo sapiens
gcaggtggatattgctacttga

SEQ ID NO: 8194829 - DNA, 22 bp, Homo sapiens
gcaggtggatattgctacttga

SEQ ID NO: 8194830 - DNA, 22 bp, Homo sapiens
gcaggtggatattgctacttga

SEQ ID NO: 8194831 - DNA, 22 bp, Homo sapiens
gcagggtctgaggccacagagg

SEQ ID NO: 8194832 - DNA, 22 bp, Homo sapiens
gcagggtcttgagaggcagcca

SEQ ID NO: 8194833 - DNA, 22 bp, Homo sapiens
gcagggtcttgagaggcagcca

SEQ ID NO: 8194834 - DNA, 22 bp, Homo sapiens
gcagggtcttgagaggcagcca

SEQ ID NO: 8194835 - DNA, 22 bp, Homo sapiens
gcagggtcttgagaggcagcca

SEQ ID NO: 8194836 - DNA, 22 bp, Homo sapiens
gcagggtctgaggccacagagg

SEQ ID NO: 8194837 - DNA, 21 bp, Homo sapiens
gcagggtcctttccattccta

SEQ ID NO: 8194838 - DNA, 22 bp, Homo sapiens
gcagggtccatggaggcagccc

SEQ ID NO: 8194839 - DNA, 22 bp, Homo sapiens
gcagggtccatggaggcagccc

SEQ ID NO: 8194840 - DNA, 22 bp, Homo sapiens
gcagggtccatggaggcagccc

SEQ ID NO: 8194841 - DNA, 22 bp, Homo sapiens
gcagggtccatggaggcagccc

SEQ ID NO: 8194842 - DNA, 22 bp, Homo sapiens
gcaggggttttctgacttgagt

SEQ ID NO: 8194843 - DNA, 22 bp, Homo sapiens
gcagggtaggtgacaggtagtc

SEQ ID NO: 8194844 - DNA, 22 bp, Homo sapiens
gcagggtacattgggatgggat

SEQ ID NO: 8194845 - DNA, 22 bp, Homo sapiens
gcagggaggtttgctgacctgg

SEQ ID NO: 8194846 - DNA, 22 bp, Homo sapiens
gcagggatgctgaggctcagtg

SEQ ID NO: 8194847 - DNA, 22 bp, Homo sapiens
gcagggatgctgaggctcagtg

SEQ ID NO: 8194848 - DNA, 22 bp, Homo sapiens
gcagggattgtcaatgctgctc

SEQ ID NO: 8194849 - DNA, 22 bp, Homo sapiens
gcagggattgtcaatgctgctc

SEQ ID NO: 8194850 - DNA, 22 bp, Homo sapiens
gcagggatgctgaggctcagtg

SEQ ID NO: 8194851 - DNA, 22 bp, Homo sapiens
gcagggattgtgcagggggcta

SEQ ID NO: 8194852 - DNA, 22 bp, Homo sapiens
gcagggattgtcaatgctgctc

SEQ ID NO: 8194853 - DNA, 22 bp, Homo sapiens
gcaggggtagtgtcttcctgag

SEQ ID NO: 8194854 - DNA, 22 bp, Homo sapiens
gcaggggtagtgtcttcctgag

SEQ ID NO: 8194855 - DNA, 22 bp, Homo sapiens
gcaggggtggaggctgtcctgt

SEQ ID NO: 8194856 - DNA, 22 bp, Homo sapiens
gcaggggtggaggctgtcctgt

SEQ ID NO: 8194857 - DNA, 22 bp, Homo sapiens
gcagggctgggatttgagccca

SEQ ID NO: 8194858 - DNA, 22 bp, Homo sapiens
gcagggctgggatttgagccca

SEQ ID NO: 8194859 - DNA, 22 bp, Homo sapiens
gcagggctggggctgctcctga

SEQ ID NO: 8194860 - DNA, 22 bp, Homo sapiens
gcaggggtagagattgctggtg

SEQ ID NO: 8194861 - DNA, 22 bp, Homo sapiens
gcaggggtagagattgctggtg

SEQ ID NO: 8194862 - DNA, 20 bp, Homo sapiens
gcaaaataggctctgttggt

SEQ ID NO: 8194863 - DNA, 22 bp, Homo sapiens
gcaaaaattccagggacgactc

SEQ ID NO: 8194864 - DNA, 22 bp, Homo sapiens
gcaaaaattccagggacgactc

SEQ ID NO: 8194865 - DNA, 22 bp, Homo sapiens
gcaaaagtacagccggatttct

SEQ ID NO: 8194866 - DNA, 22 bp, Homo sapiens
gcaaaagtacagccggatttct

SEQ ID NO: 8194867 - DNA, 22 bp, Homo sapiens
atgtttctcactgtttctctat

SEQ ID NO: 8194868 - DNA, 22 bp, Homo sapiens
atgtttctagttgtatgtcact

SEQ ID NO: 8194869 - DNA, 22 bp, Homo sapiens
atgtttctagagctttgtccca

SEQ ID NO: 8194870 - DNA, 22 bp, Homo sapiens
atgtttctacagcgtccactga

SEQ ID NO: 8194871 - DNA, 22 bp, Homo sapiens
atgtttctcactgtttctctat

SEQ ID NO: 8194872 - DNA, 22 bp, Homo sapiens
gatttctgggctttatttcaga

SEQ ID NO: 8194873 - DNA, 22 bp, Homo sapiens
atgtttctagttgtatgtcact

SEQ ID NO: 8194874 - DNA, 22 bp, Homo sapiens
gcaactgaacatgtgtgtggcc

SEQ ID NO: 8194875 - DNA, 22 bp, Homo sapiens
gcaactgaacatgtgtgtggcc

SEQ ID NO: 8194876 - DNA, 22 bp, Homo sapiens
gcaactgaacatgtgtgtggcc

SEQ ID NO: 8194877 - DNA, 22 bp, Homo sapiens
gcaactgaacatgtgtgtggcc

SEQ ID NO: 8194878 - DNA, 22 bp, Homo sapiens
gcaactgaacatgtgtgtggcc

SEQ ID NO: 8194879 - DNA, 22 bp, Homo sapiens
gcaacattcatgttctgtaacc

SEQ ID NO: 8194880 - DNA, 22 bp, Homo sapiens
gcaacatcggtattggaggagt

SEQ ID NO: 8194881 - DNA, 18 bp, Homo sapiens
gcaacagatcaacagaaa

SEQ ID NO: 8194882 - DNA, 22 bp, Homo sapiens
gcaacagcccaggttctgtgtg

SEQ ID NO: 8194883 - DNA, 22 bp, Homo sapiens
gcaaatgttcacggggagcata

SEQ ID NO: 8194884 - DNA, 22 bp, Homo sapiens
gcaaacaagctgcctgaagatt

SEQ ID NO: 8194885 - DNA, 22 bp, Homo sapiens
gcaaacaaggacatacatcctg

SEQ ID NO: 8194886 - DNA, 22 bp, Homo sapiens
gcaaattgggctgactcaaggt

SEQ ID NO: 8194887 - DNA, 22 bp, Homo sapiens
gcaaattgctagctttctctgc

SEQ ID NO: 8194888 - DNA, 22 bp, Homo sapiens
gcaaattgggaaatttctctag

SEQ ID NO: 8194889 - DNA, 22 bp, Homo sapiens
gcacagggagcaggtctctggt

SEQ ID NO: 8194890 - DNA, 22 bp, Homo sapiens
gcacagggaggctggcctggcc

SEQ ID NO: 8194891 - DNA, 22 bp, Homo sapiens
gcacagggaggctggcctggcc

SEQ ID NO: 8194892 - DNA, 22 bp, Homo sapiens
gcacagggcaacaggtctgtta

SEQ ID NO: 8194893 - DNA, 22 bp, Homo sapiens
gcactgggggcagcagtgaggg

SEQ ID NO: 8194894 - DNA, 22 bp, Homo sapiens
gcactgggggcagcagtgaggg

SEQ ID NO: 8194895 - DNA, 22 bp, Homo sapiens
gcacagggccctgtgcgtaggt

SEQ ID NO: 8194896 - DNA, 22 bp, Homo sapiens
gcacagggccctgtgcgtaggt

SEQ ID NO: 8194897 - DNA, 22 bp, Homo sapiens
gcactcaggactctcatcagta

SEQ ID NO: 8194898 - DNA, 22 bp, Homo sapiens
gcactcaggactctcatcagta

SEQ ID NO: 8194899 - DNA, 22 bp, Homo sapiens
gcactcaggactctcatcagta

SEQ ID NO: 8194900 - DNA, 22 bp, Homo sapiens
gcactggggtcatagcctccag

SEQ ID NO: 8194901 - DNA, 22 bp, Homo sapiens
gcactgtgaatatactagcaaa

SEQ ID NO: 8194902 - DNA, 22 bp, Homo sapiens
gcactggtgtgttagtaaggga

SEQ ID NO: 8194903 - DNA, 22 bp, Homo sapiens
gcactggttaccctgagtggct

SEQ ID NO: 8194904 - DNA, 18 bp, Homo sapiens
gcacagagcaagtttcat

SEQ ID NO: 8194905 - DNA, 20 bp, Homo sapiens
gcacagagatgagcaaagta

SEQ ID NO: 8194906 - DNA, 23 bp, Homo sapiens
gcacagagcagttaggggaagat

SEQ ID NO: 8194907 - DNA, 23 bp, Homo sapiens
gcacagagcagttaggggaagat

SEQ ID NO: 8194908 - DNA, 18 bp, Homo sapiens
gcacagagcccaggctct

SEQ ID NO: 8194909 - DNA, 18 bp, Homo sapiens
gcacagagcccaggctct

SEQ ID NO: 8194910 - DNA, 18 bp, Homo sapiens
gcacagagcccaggctct

SEQ ID NO: 8194911 - DNA, 22 bp, Homo sapiens
gcacagaggaagcacagactct

SEQ ID NO: 8194912 - DNA, 22 bp, Homo sapiens
gcacagaggaagcacagactct

SEQ ID NO: 8194913 - DNA, 22 bp, Homo sapiens
gcacagaggaagcacagactct

SEQ ID NO: 8194914 - DNA, 22 bp, Homo sapiens
gcacagaggaagcacagactct

SEQ ID NO: 8194915 - DNA, 22 bp, Homo sapiens
gcacagagcctggtaccgagaa

SEQ ID NO: 8194916 - DNA, 22 bp, Homo sapiens
gcacagagcctggtaccgagaa

SEQ ID NO: 8194917 - DNA, 22 bp, Homo sapiens
gcacagagctggccctccaggc

SEQ ID NO: 8194918 - DNA, 22 bp, Homo sapiens
gcacagagctggccctccaggc

SEQ ID NO: 8194919 - DNA, 22 bp, Homo sapiens
gcacagggagacagccgtggcc

SEQ ID NO: 8194920 - DNA, 21 bp, Homo sapiens
gcacagggacagatcatcaca

SEQ ID NO: 8194921 - DNA, 22 bp, Homo sapiens
gcacaggctctcttggggacac

SEQ ID NO: 8194922 - DNA, 22 bp, Homo sapiens
gcacaggctgttggccttcaga

SEQ ID NO: 8194923 - DNA, 22 bp, Homo sapiens
gcacaggctctcttggggacac

SEQ ID NO: 8194924 - DNA, 22 bp, Homo sapiens
gcacagaggatgaggcagctct

SEQ ID NO: 8194925 - DNA, 22 bp, Homo sapiens
gcacagaggatgaggcagctct

SEQ ID NO: 8194926 - DNA, 19 bp, Homo sapiens
gcagatgatgaggctggtc

SEQ ID NO: 8194927 - DNA, 22 bp, Homo sapiens
gcagatagggtattaggagtaa

SEQ ID NO: 8194928 - DNA, 22 bp, Homo sapiens
gcagagtttgaagtcaagatgt

SEQ ID NO: 8194929 - DNA, 22 bp, Homo sapiens
gcagataacttgtccaacacca

SEQ ID NO: 8194930 - DNA, 19 bp, Homo sapiens
gcagatccaaaagtcacat

SEQ ID NO: 8194931 - DNA, 22 bp, Homo sapiens
gcagaggggaagctgaggaatt

SEQ ID NO: 8194932 - DNA, 22 bp, Homo sapiens
gcagaggggaagctgaggaatt

SEQ ID NO: 8194933 - DNA, 22 bp, Homo sapiens
gcagaggcctgaaggtggcggg

SEQ ID NO: 8194934 - DNA, 22 bp, Homo sapiens
gcagaggcctgaaggtggcggg

SEQ ID NO: 8194935 - DNA, 22 bp, Homo sapiens
gcagaggctgtagggaaggttg

SEQ ID NO: 8194936 - DNA, 22 bp, Homo sapiens
gcagaggctgtagggaaggttg

SEQ ID NO: 8194937 - DNA, 22 bp, Homo sapiens
gcagaggctctttaatgcttag

SEQ ID NO: 8194938 - DNA, 16 bp, Homo sapiens
gcagaggaaaggggag

SEQ ID NO: 8194939 - DNA, 16 bp, Homo sapiens
gcagaggaaaggggag

SEQ ID NO: 8194940 - DNA, 22 bp, Homo sapiens
gcagaattgaaatgtgtcactt

SEQ ID NO: 8194941 - DNA, 22 bp, Homo sapiens
gcagaggcctaggtggaaggcc

SEQ ID NO: 8194942 - DNA, 22 bp, Homo sapiens
gcagaatactgagagctgattg

SEQ ID NO: 8194943 - DNA, 22 bp, Homo sapiens
gcagaatgtccaagctgggccc

SEQ ID NO: 8194944 - DNA, 22 bp, Homo sapiens
gcagaagggaataaggagcttt

SEQ ID NO: 8194945 - DNA, 22 bp, Homo sapiens
gcagaagggaataaggagcttt

SEQ ID NO: 8194946 - DNA, 22 bp, Homo sapiens
gcagaagggaataaggagcttt

SEQ ID NO: 8194947 - DNA, 22 bp, Homo sapiens
gcagaagggaataaggagcttt

SEQ ID NO: 8194948 - DNA, 22 bp, Homo sapiens
gcactgtgacccagagcaggtg

SEQ ID NO: 8194949 - DNA, 22 bp, Homo sapiens
gcagaaggtctggcacttcagg

SEQ ID NO: 8194950 - DNA, 22 bp, Homo sapiens
gcagaaggtcaaagcaagatgt

SEQ ID NO: 8194951 - DNA, 22 bp, Homo sapiens
gcagaaggttgtttgggaaagg

SEQ ID NO: 8194952 - DNA, 22 bp, Homo sapiens
gcagaaggttgtttgggaaagg

SEQ ID NO: 8194953 - DNA, 17 bp, Homo sapiens
gcagcctcttggtagtg

SEQ ID NO: 8194954 - DNA, 22 bp, Homo sapiens
gcagccaggtttgaggaccact

SEQ ID NO: 8194955 - DNA, 22 bp, Homo sapiens
gcagccaggtttgaggaccact

SEQ ID NO: 8194956 - DNA, 22 bp, Homo sapiens
gcagcctgggcaacagagtgag

SEQ ID NO: 8194957 - DNA, 22 bp, Homo sapiens
gcagcctgatgatctgggttgt

SEQ ID NO: 8194958 - DNA, 22 bp, Homo sapiens
gcagcctgggcaacagagtgag

SEQ ID NO: 8194959 - DNA, 22 bp, Homo sapiens
gcagcctgggcaacagagtgag

SEQ ID NO: 8194960 - DNA, 22 bp, Homo sapiens
gcagcctgttgtaccagcctgt

SEQ ID NO: 8194961 - DNA, 22 bp, Homo sapiens
gcagcctgttgtaccagcctgt

SEQ ID NO: 8194962 - DNA, 22 bp, Homo sapiens
gcagccttatcattagagtgtt

SEQ ID NO: 8194963 - DNA, 22 bp, Homo sapiens
gcagccttccgtggacctggac

SEQ ID NO: 8194964 - DNA, 22 bp, Homo sapiens
gcagccttggttgtgagatgaa

SEQ ID NO: 8194965 - DNA, 22 bp, Homo sapiens
gcagctttctaagctttattgc

SEQ ID NO: 8194966 - DNA, 22 bp, Homo sapiens
gcagctttaaaggaggctctga

SEQ ID NO: 8194967 - DNA, 22 bp, Homo sapiens
gcagctttaaacattggaaata

SEQ ID NO: 8194968 - DNA, 22 bp, Homo sapiens
gcaggagagtctgtgccaggtt

SEQ ID NO: 8194969 - DNA, 22 bp, Homo sapiens
gcaggagagtctgtgccaggtt

SEQ ID NO: 8194970 - DNA, 22 bp, Homo sapiens
gcaggagagtctgtgccaggtt

SEQ ID NO: 8194971 - DNA, 18 bp, Homo sapiens
gcaggagatgggtggggt

SEQ ID NO: 8194972 - DNA, 18 bp, Homo sapiens
gcaggagatgggtggggt

SEQ ID NO: 8194973 - DNA, 22 bp, Homo sapiens
gcaggagagtctgtgccaggtt

SEQ ID NO: 8194974 - DNA, 22 bp, Homo sapiens
gcaggagagtctgtgccaggtt

SEQ ID NO: 8194975 - DNA, 22 bp, Homo sapiens
gcaggagagtctgtgccaggtt

SEQ ID NO: 8194976 - DNA, 22 bp, Homo sapiens
gcaggagagtctgtgccaggtt

SEQ ID NO: 8194977 - DNA, 22 bp, Homo sapiens
gcagccagggagagaaccaggg

SEQ ID NO: 8194978 - DNA, 22 bp, Homo sapiens
gcagccagggagagaaccaggg

SEQ ID NO: 8194979 - DNA, 22 bp, Homo sapiens
gcagccagggagagaaccaggg

SEQ ID NO: 8194980 - DNA, 22 bp, Homo sapiens
gcagccaggctacagcgggctt

SEQ ID NO: 8194981 - DNA, 22 bp, Homo sapiens
gcagccaggctacagcgggctt

SEQ ID NO: 8194982 - DNA, 22 bp, Homo sapiens
gcagccagggctaagctgggga

SEQ ID NO: 8194983 - DNA, 22 bp, Homo sapiens
gcagccagggctaagctgggga

SEQ ID NO: 8194984 - DNA, 22 bp, Homo sapiens
gcagccagggctaagctgggga

SEQ ID NO: 8194985 - DNA, 22 bp, Homo sapiens
gcagccaggtttgaggaccact

SEQ ID NO: 8194986 - DNA, 22 bp, Homo sapiens
gcagccaggtttgaggaccact

SEQ ID NO: 8194987 - DNA, 19 bp, Homo sapiens
gcagccaggtgctctacct

SEQ ID NO: 8194988 - DNA, 22 bp, Homo sapiens
gcagccaggggctgtgacctgt

SEQ ID NO: 8194989 - DNA, 19 bp, Homo sapiens
gcagccaggtgctctacct

SEQ ID NO: 8194990 - DNA, 22 bp, Homo sapiens
gcagccagggttaattatattt

SEQ ID NO: 8194991 - DNA, 22 bp, Homo sapiens
gcagatgccactaggtgaagtg

SEQ ID NO: 8194992 - DNA, 22 bp, Homo sapiens
gcagatgcagaactcagtgggt

SEQ ID NO: 8194993 - DNA, 19 bp, Homo sapiens
gcagatgatgaggctggtc

SEQ ID NO: 8194994 - DNA, 22 bp, Homo sapiens
gcagatgcaactgcaggtgagt

SEQ ID NO: 8194995 - DNA, 22 bp, Homo sapiens
gcagatgctgagatttatttct

SEQ ID NO: 8194996 - DNA, 22 bp, Homo sapiens
gcagcaggtccgcatcatcatc

SEQ ID NO: 8194997 - DNA, 22 bp, Homo sapiens
gcagccaggaagcctttccctc

SEQ ID NO: 8194998 - DNA, 22 bp, Homo sapiens
gcagcaggtctgtcaatgtcat

SEQ ID NO: 8194999 - DNA, 22 bp, Homo sapiens
gcagcaggtccgcatcatcatc

SEQ ID NO: 8195000 - DNA, 21 bp, Homo sapiens
gcagccaggactttgggctgg

SEQ ID NO: 8195001 - DNA, 22 bp, Homo sapiens
gcagccaggaagcctttccctc

SEQ ID NO: 8195002 - DNA, 22 bp, Homo sapiens
gccagaggggctcgaaggcgcg

SEQ ID NO: 8195003 - DNA, 22 bp, Homo sapiens
gccagaggggctcgaaggcgcg

SEQ ID NO: 8195004 - DNA, 18 bp, Homo sapiens
gccagagggcccaaggtc

SEQ ID NO: 8195005 - DNA, 18 bp, Homo sapiens
gccagagggcccaaggtc

SEQ ID NO: 8195006 - DNA, 22 bp, Homo sapiens
gccagaggttcaacaactgtct

SEQ ID NO: 8195007 - DNA, 22 bp, Homo sapiens
gccagaggtatcaaagatagta

SEQ ID NO: 8195008 - DNA, 22 bp, Homo sapiens
gccagaggtatcaaagatagta

SEQ ID NO: 8195009 - DNA, 22 bp, Homo sapiens
gccagaggtatcaaagatagta

SEQ ID NO: 8195010 - DNA, 22 bp, Homo sapiens
gcccagcaggggatggcagctc

SEQ ID NO: 8195011 - DNA, 22 bp, Homo sapiens
gcccagcaggggatggcagctc

SEQ ID NO: 8195012 - DNA, 22 bp, Homo sapiens
gcccagcaggggatggcagctc

SEQ ID NO: 8195013 - DNA, 22 bp, Homo sapiens
gcccagcaggacagagtggttt

SEQ ID NO: 8195014 - DNA, 22 bp, Homo sapiens
gcccagccacagtcactttcat

SEQ ID NO: 8195015 - DNA, 22 bp, Homo sapiens
gcccagcaggggatggcagctc

SEQ ID NO: 8195016 - DNA, 22 bp, Homo sapiens
gcccagcaggggatggcagctc

SEQ ID NO: 8195017 - DNA, 22 bp, Homo sapiens
gcccagccagagctgtgtgatg

SEQ ID NO: 8195018 - DNA, 22 bp, Homo sapiens
gcccagccacagtcactttcat

SEQ ID NO: 8195019 - DNA, 22 bp, Homo sapiens
gcccagccagagctgtgtgatg

SEQ ID NO: 8195020 - DNA, 22 bp, Homo sapiens
gcccagcccctgggtggacgtg

SEQ ID NO: 8195021 - DNA, 22 bp, Homo sapiens
gcccagcccagaaaggttcgga

SEQ ID NO: 8195022 - DNA, 22 bp, Homo sapiens
gcccagccagagctgtgtgatg

SEQ ID NO: 8195023 - DNA, 22 bp, Homo sapiens
atttacagaccctcccactaag

SEQ ID NO: 8195024 - DNA, 22 bp, Homo sapiens
atttacagaccctcccactaag

SEQ ID NO: 8195025 - DNA, 22 bp, Homo sapiens
atttacagaccctcccactaag

SEQ ID NO: 8195026 - DNA, 22 bp, Homo sapiens
atttacagacgtggattagtgc

SEQ ID NO: 8195027 - DNA, 22 bp, Homo sapiens
atttacagacgtggattagtgc

SEQ ID NO: 8195028 - DNA, 22 bp, Homo sapiens
atttacagacgtggattagtgc

SEQ ID NO: 8195029 - DNA, 22 bp, Homo sapiens
atttacagtgtgcctactatat

SEQ ID NO: 8195030 - DNA, 22 bp, Homo sapiens
atttacagtgtgcctactatat

SEQ ID NO: 8195031 - DNA, 22 bp, Homo sapiens
atttacagtgtgcctactatat

SEQ ID NO: 8195032 - DNA, 22 bp, Homo sapiens
atttacagtgtgcctactatat

SEQ ID NO: 8195033 - DNA, 22 bp, Homo sapiens
atttacagtgtgcctactatat

SEQ ID NO: 8195034 - DNA, 22 bp, Homo sapiens
atttacagtttagcatttcaag

SEQ ID NO: 8195035 - DNA, 22 bp, Homo sapiens
atttacagtttagcatttcaag

SEQ ID NO: 8195036 - DNA, 22 bp, Homo sapiens
atttacagtttagcatttcaag

SEQ ID NO: 8195037 - DNA, 22 bp, Homo sapiens
atttacataatagactttaggt

SEQ ID NO: 8195038 - DNA, 22 bp, Homo sapiens
atttacagtttagcatttcaag

SEQ ID NO: 8195039 - DNA, 22 bp, Homo sapiens
atttacagtttagcatttcaag

SEQ ID NO: 8195040 - DNA, 22 bp, Homo sapiens
atttacagtttagcatttcaag

SEQ ID NO: 8195041 - DNA, 22 bp, Homo sapiens
atttacattccatggtggttac

SEQ ID NO: 8195042 - DNA, 22 bp, Homo sapiens
atttacataatagactttaggt

SEQ ID NO: 8195043 - DNA, 22 bp, Homo sapiens
atttacattccatggtggttac

SEQ ID NO: 8195044 - DNA, 22 bp, Homo sapiens
atttacataatagactttaggt

SEQ ID NO: 8195045 - DNA, 22 bp, Homo sapiens
atttacataatagactttaggt

SEQ ID NO: 8195046 - DNA, 17 bp, Homo sapiens
atttacattgtcaccga

SEQ ID NO: 8195047 - DNA, 17 bp, Homo sapiens
atttacattgtcaccga

SEQ ID NO: 8195048 - DNA, 22 bp, Homo sapiens
atttacatttatttgagaaggt

SEQ ID NO: 8195049 - DNA, 22 bp, Homo sapiens
atttaccatatgtactgagtat

SEQ ID NO: 8195050 - DNA, 22 bp, Homo sapiens
atttaccagtgctgacatttga

SEQ ID NO: 8195051 - DNA, 22 bp, Homo sapiens
atttacatttatttgagaaggt

SEQ ID NO: 8195052 - DNA, 22 bp, Homo sapiens
atttacatttatttgagaaggt

SEQ ID NO: 8195053 - DNA, 18 bp, Homo sapiens
gccagagggaagcaggtg

SEQ ID NO: 8195054 - DNA, 18 bp, Homo sapiens
gccagagggaagcaggtg

SEQ ID NO: 8195055 - DNA, 18 bp, Homo sapiens
gccagagggaagcaggtg

SEQ ID NO: 8195056 - DNA, 18 bp, Homo sapiens
gccagagggaagcaggtg

SEQ ID NO: 8195057 - DNA, 22 bp, Homo sapiens
atttactaatgtcatatcgcgt

SEQ ID NO: 8195058 - DNA, 18 bp, Homo sapiens
gccagagggaagcaggtg

SEQ ID NO: 8195059 - DNA, 18 bp, Homo sapiens
gccagagggaagcaggtg

SEQ ID NO: 8195060 - DNA, 23 bp, Homo sapiens
gccctgcccttagcacactcaca

SEQ ID NO: 8195061 - DNA, 22 bp, Homo sapiens
gccctgccgggtattttgtgct

SEQ ID NO: 8195062 - DNA, 23 bp, Homo sapiens
gccctgcccttagcacactcaca

SEQ ID NO: 8195063 - DNA, 22 bp, Homo sapiens
gccctgcctgccggtgtgggtc

SEQ ID NO: 8195064 - DNA, 22 bp, Homo sapiens
gccctgcctgccggtgtgggtc

SEQ ID NO: 8195065 - DNA, 22 bp, Homo sapiens
atttcttccttctcctagaaga

SEQ ID NO: 8195066 - DNA, 22 bp, Homo sapiens
gccctgccctgttgaaactaga

SEQ ID NO: 8195067 - DNA, 23 bp, Homo sapiens
gccctgcccttagcacactcaca

SEQ ID NO: 8195068 - DNA, 22 bp, Homo sapiens
gccctgccctgagccgtagacc

SEQ ID NO: 8195069 - DNA, 22 bp, Homo sapiens
gccctgccctgttgaaactaga

SEQ ID NO: 8195070 - DNA, 22 bp, Homo sapiens
gccctgccctgagccgtagacc

SEQ ID NO: 8195071 - DNA, 22 bp, Homo sapiens
gccctgccctgagccgtagacc

SEQ ID NO: 8195072 - DNA, 22 bp, Homo sapiens
gccctgccctctcggcactcgc

SEQ ID NO: 8195073 - DNA, 22 bp, Homo sapiens
gccctgccctctcggcactcgc

SEQ ID NO: 8195074 - DNA, 22 bp, Homo sapiens
gccctgccctctcggcactcgc

SEQ ID NO: 8195075 - DNA, 19 bp, Homo sapiens
gccctgcaggaggtggggc

SEQ ID NO: 8195076 - DNA, 19 bp, Homo sapiens
gccctgcaggaggtggggc

SEQ ID NO: 8195077 - DNA, 22 bp, Homo sapiens
gccctcccctctgggtggtgag

SEQ ID NO: 8195078 - DNA, 22 bp, Homo sapiens
gccctccatggtgatccaggcc

SEQ ID NO: 8195079 - DNA, 22 bp, Homo sapiens
gccctccctacagcctatttct

SEQ ID NO: 8195080 - DNA, 22 bp, Homo sapiens
gccctccctacagcctatttct

SEQ ID NO: 8195081 - DNA, 19 bp, Homo sapiens
gccctcctcactgagctct

SEQ ID NO: 8195082 - DNA, 19 bp, Homo sapiens
gccctcctcactgagctct

SEQ ID NO: 8195083 - DNA, 23 bp, Homo sapiens
gccctccctcccaggtgggtgtt

SEQ ID NO: 8195084 - DNA, 19 bp, Homo sapiens
gccctcctcactgagctct

SEQ ID NO: 8195085 - DNA, 22 bp, Homo sapiens
gccctcctgcaggggcttctgg

SEQ ID NO: 8195086 - DNA, 22 bp, Homo sapiens
gccctcctgagctagcacgtgt

SEQ ID NO: 8195087 - DNA, 22 bp, Homo sapiens
gccctcctgcaggggcttctgg

SEQ ID NO: 8195088 - DNA, 22 bp, Homo sapiens
gccctgagttgagccttccaaa

SEQ ID NO: 8195089 - DNA, 22 bp, Homo sapiens
gccctcctggcaggcagtgatg

SEQ ID NO: 8195090 - DNA, 22 bp, Homo sapiens
gccctcctggcaggcagtgatg

SEQ ID NO: 8195091 - DNA, 22 bp, Homo sapiens
gcccctccatccatcaccgggg

SEQ ID NO: 8195092 - DNA, 22 bp, Homo sapiens
gccctccaccagagcccttctc

SEQ ID NO: 8195093 - DNA, 22 bp, Homo sapiens
gccctccacctggtctctctgg

SEQ ID NO: 8195094 - DNA, 22 bp, Homo sapiens
gccctccacctggtctctctgg

SEQ ID NO: 8195095 - DNA, 22 bp, Homo sapiens
gccctccatgagacacagtgta

SEQ ID NO: 8195096 - DNA, 22 bp, Homo sapiens
gccctccagctgttgcgcgtcg

SEQ ID NO: 8195097 - DNA, 22 bp, Homo sapiens
gccctccagcctgtggaaccgg

SEQ ID NO: 8195098 - DNA, 22 bp, Homo sapiens
gccctccatgagacacagtgta

SEQ ID NO: 8195099 - DNA, 22 bp, Homo sapiens
gccctccatgagacacagtgta

SEQ ID NO: 8195100 - DNA, 22 bp, Homo sapiens
gccctccatgagacacagtgta

SEQ ID NO: 8195101 - DNA, 22 bp, Homo sapiens
gccctccatgagacacagtgta

SEQ ID NO: 8195102 - DNA, 22 bp, Homo sapiens
gcccaggagttgaagggctgac

SEQ ID NO: 8195103 - DNA, 22 bp, Homo sapiens
gcccaggagttgaagggctgac

SEQ ID NO: 8195104 - DNA, 22 bp, Homo sapiens
gcccaggagttcaagtctagtg

SEQ ID NO: 8195105 - DNA, 22 bp, Homo sapiens
gcccaggagttgaagggctgac

SEQ ID NO: 8195106 - DNA, 22 bp, Homo sapiens
gcccaggagttcaaggctgcag

SEQ ID NO: 8195107 - DNA, 22 bp, Homo sapiens
gcccaggagttcaaggctgcag

SEQ ID NO: 8195108 - DNA, 22 bp, Homo sapiens
gcccaggagttcaaggctgcag

SEQ ID NO: 8195109 - DNA, 22 bp, Homo sapiens
gcccaggaggttgggctgtgca

SEQ ID NO: 8195110 - DNA, 22 bp, Homo sapiens
gcccaggaggttgggctgtgca

SEQ ID NO: 8195111 - DNA, 22 bp, Homo sapiens
gcccaggaggtggaggtgcagt

SEQ ID NO: 8195112 - DNA, 22 bp, Homo sapiens
gcccaggaggtggaggtgcagt

SEQ ID NO: 8195113 - DNA, 22 bp, Homo sapiens
gcccaggaggtggaggtgcagt

SEQ ID NO: 8195114 - DNA, 22 bp, Homo sapiens
gcccaggaggtcaagtagctat

SEQ ID NO: 8195115 - DNA, 22 bp, Homo sapiens
gcccaggaggtcaagtagctat

SEQ ID NO: 8195116 - DNA, 22 bp, Homo sapiens
gcccaggaggtcaagtagctat

SEQ ID NO: 8195117 - DNA, 22 bp, Homo sapiens
attttaataagattcccaagta

SEQ ID NO: 8195118 - DNA, 22 bp, Homo sapiens
attttaaggcttatttaaaggc

SEQ ID NO: 8195119 - DNA, 22 bp, Homo sapiens
attttaaggcttatttaaaggc

SEQ ID NO: 8195120 - DNA, 22 bp, Homo sapiens
attttaaggcttatttaaaggc

SEQ ID NO: 8195121 - DNA, 22 bp, Homo sapiens
attttaaggcttatttaaaggc

SEQ ID NO: 8195122 - DNA, 23 bp, Homo sapiens
attttaaccttgactaacatgca

SEQ ID NO: 8195123 - DNA, 23 bp, Homo sapiens
attttaaccttgactaacatgca

SEQ ID NO: 8195124 - DNA, 22 bp, Homo sapiens
atttgtctttggacctgtgaga

SEQ ID NO: 8195125 - DNA, 23 bp, Homo sapiens
attttaaccttgactaacatgca

SEQ ID NO: 8195126 - DNA, 22 bp, Homo sapiens
attttaaggcttatttaaaggc

SEQ ID NO: 8195127 - DNA, 22 bp, Homo sapiens
atttgtctgcttgctgccttcc

SEQ ID NO: 8195128 - DNA, 22 bp, Homo sapiens
atttgccttttaaactcacaat

SEQ ID NO: 8195129 - DNA, 22 bp, Homo sapiens
atttgtctttggacctgtgaga

SEQ ID NO: 8195130 - DNA, 22 bp, Homo sapiens
atttgtcttcagtaggttcttc

SEQ ID NO: 8195131 - DNA, 22 bp, Homo sapiens
atttgcatatctgatagactaa

SEQ ID NO: 8195132 - DNA, 23 bp, Homo sapiens
atttgcatggccggattatggat

SEQ ID NO: 8195133 - DNA, 22 bp, Homo sapiens
atttgcatttacatagcataga

SEQ ID NO: 8195134 - DNA, 22 bp, Homo sapiens
atttgccttactgaagaaggag

SEQ ID NO: 8195135 - DNA, 22 bp, Homo sapiens
atttgcctgtaagacaaggcct

SEQ ID NO: 8195136 - DNA, 22 bp, Homo sapiens
atttgcctttcgaatcaacagg

SEQ ID NO: 8195137 - DNA, 22 bp, Homo sapiens
atttgagaaaggagggaacttt

SEQ ID NO: 8195138 - DNA, 22 bp, Homo sapiens
atttgacattgacacacctatg

SEQ ID NO: 8195139 - DNA, 22 bp, Homo sapiens
atttgacattgacacacctatg

SEQ ID NO: 8195140 - DNA, 22 bp, Homo sapiens
atttgacattattctctcagtc

SEQ ID NO: 8195141 - DNA, 23 bp, Homo sapiens
atttgacagagcatagcatttct

SEQ ID NO: 8195142 - DNA, 23 bp, Homo sapiens
atttgacagagcatagcatttct

SEQ ID NO: 8195143 - DNA, 22 bp, Homo sapiens
atttcttgattccaccagtgaa

SEQ ID NO: 8195144 - DNA, 23 bp, Homo sapiens
atttgagaaagtatttttaagac

SEQ ID NO: 8195145 - DNA, 22 bp, Homo sapiens
atttgaggatagttgggtactc

SEQ ID NO: 8195146 - DNA, 22 bp, Homo sapiens
atttgatttgtagatagtgtag

SEQ ID NO: 8195147 - DNA, 22 bp, Homo sapiens
atttgattagctgtgtaatttt

SEQ ID NO: 8195148 - DNA, 22 bp, Homo sapiens
atttgattagctgtgtaatttt

SEQ ID NO: 8195149 - DNA, 22 bp, Homo sapiens
atttgatttgtagatagtgtag

SEQ ID NO: 8195150 - DNA, 22 bp, Homo sapiens
atttgcaaagtcgtatctgtga

SEQ ID NO: 8195151 - DNA, 22 bp, Homo sapiens
atttgcaagagtaagaatttct

SEQ ID NO: 8195152 - DNA, 22 bp, Homo sapiens
atttgcaattactcatgtcatt

SEQ ID NO: 8195153 - DNA, 18 bp, Homo sapiens
atttgcaggcatgcaggc

SEQ ID NO: 8195154 - DNA, 22 bp, Homo sapiens
atttgcagattctgtcaggttt

SEQ ID NO: 8195155 - DNA, 22 bp, Homo sapiens
atttgcacatagtattatcttt

SEQ ID NO: 8195156 - DNA, 22 bp, Homo sapiens
atttgcaattttactttgcagt

SEQ ID NO: 8195157 - DNA, 22 bp, Homo sapiens
atttgcataatagtgatttgta

SEQ ID NO: 8195158 - DNA, 22 bp, Homo sapiens
atttgcagttattgttcatgaa

SEQ ID NO: 8195159 - DNA, 22 bp, Homo sapiens
atttgcaggtgtcgattagtct

SEQ ID NO: 8195160 - DNA, 22 bp, Homo sapiens
atttgcaggtgtcgattagtct

SEQ ID NO: 8195161 - DNA, 22 bp, Homo sapiens
gcctgcccacggggctggcata

SEQ ID NO: 8195162 - DNA, 22 bp, Homo sapiens
gcctgcccacggggctggcata

SEQ ID NO: 8195163 - DNA, 18 bp, Homo sapiens
gcctgccatccccacagc

SEQ ID NO: 8195164 - DNA, 22 bp, Homo sapiens
attttactaagtggatatctgt

SEQ ID NO: 8195165 - DNA, 22 bp, Homo sapiens
attttactaagtggatatctgt

SEQ ID NO: 8195166 - DNA, 22 bp, Homo sapiens
attttactaagtggatatctgt

SEQ ID NO: 8195167 - DNA, 22 bp, Homo sapiens
attttacataaggaaggtttaa

SEQ ID NO: 8195168 - DNA, 22 bp, Homo sapiens
attttacataaggaaggtttaa

SEQ ID NO: 8195169 - DNA, 23 bp, Homo sapiens
attttacaggtcagttccttgaa

SEQ ID NO: 8195170 - DNA, 23 bp, Homo sapiens
attttacaggtcagttccttgaa

SEQ ID NO: 8195171 - DNA, 23 bp, Homo sapiens
attttacaggtcagttccttgaa

SEQ ID NO: 8195172 - DNA, 23 bp, Homo sapiens
attttacaggtcagttccttgaa

SEQ ID NO: 8195173 - DNA, 23 bp, Homo sapiens
attttacaggtcagttccttgaa

SEQ ID NO: 8195174 - DNA, 22 bp, Homo sapiens
gcctgccccttcctgggcaggg

SEQ ID NO: 8195175 - DNA, 22 bp, Homo sapiens
gcctgccccttcctgggcaggg

SEQ ID NO: 8195176 - DNA, 22 bp, Homo sapiens
gcctgccccttcctgggcaggg

SEQ ID NO: 8195177 - DNA, 22 bp, Homo sapiens
gcctgccccttcctgggcaggg

SEQ ID NO: 8195178 - DNA, 22 bp, Homo sapiens
gcctgccccttcctgggcaggg

SEQ ID NO: 8195179 - DNA, 21 bp, Homo sapiens
gcctgccccatgtttctgttg

SEQ ID NO: 8195180 - DNA, 22 bp, Homo sapiens
gcctgccctgaaagaggtgaag

SEQ ID NO: 8195181 - DNA, 21 bp, Homo sapiens
gcctgccctctgtgatggcca

SEQ ID NO: 8195182 - DNA, 21 bp, Homo sapiens
gcctgccctctgtgatggcca

SEQ ID NO: 8195183 - DNA, 22 bp, Homo sapiens
gcctgcctagaattgcagcttt

SEQ ID NO: 8195184 - DNA, 22 bp, Homo sapiens
gcctgcctagaattgcagcttt

SEQ ID NO: 8195185 - DNA, 18 bp, Homo sapiens
gcctgcctagagcttgcc

SEQ ID NO: 8195186 - DNA, 22 bp, Homo sapiens
gcctgcctagaattgcagcttt

SEQ ID NO: 8195187 - DNA, 23 bp, Homo sapiens
gcctgccgcctggctgagaactg

SEQ ID NO: 8195188 - DNA, 23 bp, Homo sapiens
gcctgccgcctggctgagaactg

SEQ ID NO: 8195189 - DNA, 22 bp, Homo sapiens
gcctgcctagaattgcagcttt

SEQ ID NO: 8195190 - DNA, 22 bp, Homo sapiens
attttcttctctccctggctgc

SEQ ID NO: 8195191 - DNA, 22 bp, Homo sapiens
attttctagatagatgatgcat

SEQ ID NO: 8195192 - DNA, 22 bp, Homo sapiens
attttctgtgtgcagataaata

SEQ ID NO: 8195193 - DNA, 22 bp, Homo sapiens
attttctgtgtgcagataaata

SEQ ID NO: 8195194 - DNA, 22 bp, Homo sapiens
attttgaaaccaagttatttcc

SEQ ID NO: 8195195 - DNA, 22 bp, Homo sapiens
attttgaaatacttgaaggaaa

SEQ ID NO: 8195196 - DNA, 22 bp, Homo sapiens
gcctggctccctctgcagctcc

SEQ ID NO: 8195197 - DNA, 22 bp, Homo sapiens
gcctggctcctaagagcacaac

SEQ ID NO: 8195198 - DNA, 22 bp, Homo sapiens
gcctggctcctaagagcacaac

SEQ ID NO: 8195199 - DNA, 22 bp, Homo sapiens
gcctggctcacagagcagcctt

SEQ ID NO: 8195200 - DNA, 22 bp, Homo sapiens
gcctggctcacagagcagcctt

SEQ ID NO: 8195201 - DNA, 22 bp, Homo sapiens
gcctggctccctctgcagctcc

SEQ ID NO: 8195202 - DNA, 18 bp, Homo sapiens
attttgaactgggaatat

SEQ ID NO: 8195203 - DNA, 18 bp, Homo sapiens
attttgaactgggaatat

SEQ ID NO: 8195204 - DNA, 22 bp, Homo sapiens
attttgaagggaattgaagttc

SEQ ID NO: 8195205 - DNA, 22 bp, Homo sapiens
caaatgaatagggagtgtgatg

SEQ ID NO: 8195206 - DNA, 22 bp, Homo sapiens
caaatgaagtccaaagggctta

SEQ ID NO: 8195207 - DNA, 22 bp, Homo sapiens
caaatgaagtccaaagggctta

SEQ ID NO: 8195208 - DNA, 22 bp, Homo sapiens
caaatgaagggagctgaagtct

SEQ ID NO: 8195209 - DNA, 22 bp, Homo sapiens
caaatgaaggtggtgggtcatt

SEQ ID NO: 8195210 - DNA, 22 bp, Homo sapiens
caaatgaagggagctgaagtct

SEQ ID NO: 8195211 - DNA, 22 bp, Homo sapiens
caaatgaatatttccatgggtt

SEQ ID NO: 8195212 - DNA, 22 bp, Homo sapiens
caaatgaatttccctgcaaatg

SEQ ID NO: 8195213 - DNA, 22 bp, Homo sapiens
caaatgtgtagagcttttgggg

SEQ ID NO: 8195214 - DNA, 22 bp, Homo sapiens
caaatgtgttttttcttctaca

SEQ ID NO: 8195215 - DNA, 22 bp, Homo sapiens
caaatgtgttttttcttctaca

SEQ ID NO: 8195216 - DNA, 22 bp, Homo sapiens
caaattagaggtttgttttgat

SEQ ID NO: 8195217 - DNA, 22 bp, Homo sapiens
caaattcaaatttcatcagtgt

SEQ ID NO: 8195218 - DNA, 22 bp, Homo sapiens
caaattcaatgaacatgtttaa

SEQ ID NO: 8195219 - DNA, 22 bp, Homo sapiens
caaattcacatgattgcttctg

SEQ ID NO: 8195220 - DNA, 22 bp, Homo sapiens
gctgaggacatacacattgtgc

SEQ ID NO: 8195221 - DNA, 22 bp, Homo sapiens
gctgaggaagtcaggtggccca

SEQ ID NO: 8195222 - DNA, 22 bp, Homo sapiens
gctgaggacatacacattgtgc

SEQ ID NO: 8195223 - DNA, 22 bp, Homo sapiens
gctgaggaagtcaggtggccca

SEQ ID NO: 8195224 - DNA, 22 bp, Homo sapiens
gctgaggacatcatggaaggaa

SEQ ID NO: 8195225 - DNA, 20 bp, Homo sapiens
gctgaggagcagtgtggttg

SEQ ID NO: 8195226 - DNA, 20 bp, Homo sapiens
gctgaggagcagtgtggttg

SEQ ID NO: 8195227 - DNA, 22 bp, Homo sapiens
gctgaggacatcatggaaggaa

SEQ ID NO: 8195228 - DNA, 22 bp, Homo sapiens
gctgaggaaaccaatgctcaga

SEQ ID NO: 8195229 - DNA, 22 bp, Homo sapiens
gctgaggaaaccaatgctcaga

SEQ ID NO: 8195230 - DNA, 22 bp, Homo sapiens
gctgaggaaaccaatgctcaga

SEQ ID NO: 8195231 - DNA, 22 bp, Homo sapiens
gctgaggaaaccaatgctcaga

SEQ ID NO: 8195232 - DNA, 22 bp, Homo sapiens
gctgaggaaaggctggaaggga

SEQ ID NO: 8195233 - DNA, 22 bp, Homo sapiens
gctgaggaaaggctggaaggga

SEQ ID NO: 8195234 - DNA, 22 bp, Homo sapiens
gctgaggaagtcaggtggccca

SEQ ID NO: 8195235 - DNA, 22 bp, Homo sapiens
gctgagctgggacagtcctggg

SEQ ID NO: 8195236 - DNA, 22 bp, Homo sapiens
gctgagctgggacagtcctggg

SEQ ID NO: 8195237 - DNA, 22 bp, Homo sapiens
gctgagctgaggcagggctggg

SEQ ID NO: 8195238 - DNA, 22 bp, Homo sapiens
gctgagctgctgttcatcctgc

SEQ ID NO: 8195239 - DNA, 22 bp, Homo sapiens
gctgagctgggacagtcctggg

SEQ ID NO: 8195240 - DNA, 22 bp, Homo sapiens
gctgagctgggacagtcctggg

SEQ ID NO: 8195241 - DNA, 22 bp, Homo sapiens
gctgagctgaggcagggctggg

SEQ ID NO: 8195242 - DNA, 22 bp, Homo sapiens
gctgagctgctgttcatcctgc

SEQ ID NO: 8195243 - DNA, 22 bp, Homo sapiens
gctgagctgaggcagggctggg

SEQ ID NO: 8195244 - DNA, 22 bp, Homo sapiens
gctgagctgaggcagggctggg

SEQ ID NO: 8195245 - DNA, 22 bp, Homo sapiens
gctgagaaatgcagacatgctg

SEQ ID NO: 8195246 - DNA, 22 bp, Homo sapiens
gctgagaaatgcagacatgctg

SEQ ID NO: 8195247 - DNA, 22 bp, Homo sapiens
gctctggttaaaaagaattaaa

SEQ ID NO: 8195248 - DNA, 22 bp, Homo sapiens
gctctggtggtgatcagacgct

SEQ ID NO: 8195249 - DNA, 22 bp, Homo sapiens
gctctggtgagtgtagttcagg

SEQ ID NO: 8195250 - DNA, 22 bp, Homo sapiens
gctctggtgagtgtagttcagg

SEQ ID NO: 8195251 - DNA, 22 bp, Homo sapiens
gctctggtggtgatcagacgct

SEQ ID NO: 8195252 - DNA, 22 bp, Homo sapiens
gctctggtagatcctcaggctc

SEQ ID NO: 8195253 - DNA, 22 bp, Homo sapiens
gctctggtagatcctcaggctc

SEQ ID NO: 8195254 - DNA, 22 bp, Homo sapiens
gctctggtctgcttatatctat

SEQ ID NO: 8195255 - DNA, 22 bp, Homo sapiens
gctctgggttctgatttatgag

SEQ ID NO: 8195256 - DNA, 22 bp, Homo sapiens
gctctggtaccagctactccta

SEQ ID NO: 8195257 - DNA, 22 bp, Homo sapiens
gctctgggtgaacttggagcaa

SEQ ID NO: 8195258 - DNA, 22 bp, Homo sapiens
gctctgggtgaacttggagcaa

SEQ ID NO: 8195259 - DNA, 22 bp, Homo sapiens
gctctgggtgaacttggagcaa

SEQ ID NO: 8195260 - DNA, 15 bp, Homo sapiens
gctctgggtatttga

SEQ ID NO: 8195261 - DNA, 22 bp, Homo sapiens
gctctgggtgaacttggagcaa

SEQ ID NO: 8195262 - DNA, 20 bp, Homo sapiens
gctctgggtggtaaatgact

SEQ ID NO: 8195263 - DNA, 22 bp, Homo sapiens
gctctgggtgaatggcagattg

SEQ ID NO: 8195264 - DNA, 22 bp, Homo sapiens
gctctgggtgaatggcagattg

SEQ ID NO: 8195265 - DNA, 22 bp, Homo sapiens
gctctgggtgaatggcagattg

SEQ ID NO: 8195266 - DNA, 22 bp, Homo sapiens
gctctgggtgaagggtaccatt

SEQ ID NO: 8195267 - DNA, 22 bp, Homo sapiens
gctctgggtgaagggtaccatt

SEQ ID NO: 8195268 - DNA, 20 bp, Homo sapiens
caaatccctgctctgtgctg

SEQ ID NO: 8195269 - DNA, 22 bp, Homo sapiens
caaatcatggctctagcttaca

SEQ ID NO: 8195270 - DNA, 20 bp, Homo sapiens
caaatccctgctctgtgctg

SEQ ID NO: 8195271 - DNA, 22 bp, Homo sapiens
caaatcatggctctagcttaca

SEQ ID NO: 8195272 - DNA, 22 bp, Homo sapiens
caaatcatggaataactagaga

SEQ ID NO: 8195273 - DNA, 22 bp, Homo sapiens
caaatcatggaataactagaga

SEQ ID NO: 8195274 - DNA, 22 bp, Homo sapiens
caaatcatggctctagcttaca

SEQ ID NO: 8195275 - DNA, 22 bp, Homo sapiens
caaatcatggaataactagaga

SEQ ID NO: 8195276 - DNA, 22 bp, Homo sapiens
caaatcatggaataactagaga

SEQ ID NO: 8195277 - DNA, 22 bp, Homo sapiens
caaatctacatgaacccaaaga

SEQ ID NO: 8195278 - DNA, 22 bp, Homo sapiens
caaatcctggagccatggtaac

SEQ ID NO: 8195279 - DNA, 20 bp, Homo sapiens
caaatccctgctctgtgctg

SEQ ID NO: 8195280 - DNA, 22 bp, Homo sapiens
caaatctatatgttgatattct

SEQ ID NO: 8195281 - DNA, 22 bp, Homo sapiens
caaatctatatgttgatattct

SEQ ID NO: 8195282 - DNA, 22 bp, Homo sapiens
caaatctaggatgcatgtagtg

SEQ ID NO: 8195283 - DNA, 22 bp, Homo sapiens
caaatattccaggtacatccct

SEQ ID NO: 8195284 - DNA, 22 bp, Homo sapiens
caaatattccaggtacatccct

SEQ ID NO: 8195285 - DNA, 22 bp, Homo sapiens
caaatagacttaagcatctgta

SEQ ID NO: 8195286 - DNA, 22 bp, Homo sapiens
caaatattccaggtacatccct

SEQ ID NO: 8195287 - DNA, 22 bp, Homo sapiens
caaatattccaggtacatccct

SEQ ID NO: 8195288 - DNA, 22 bp, Homo sapiens
caaatattccaggtacatccct

SEQ ID NO: 8195289 - DNA, 22 bp, Homo sapiens
gctctgagagtgcatgatagca

SEQ ID NO: 8195290 - DNA, 22 bp, Homo sapiens
gctctgagaggtgcagcagtaa

SEQ ID NO: 8195291 - DNA, 22 bp, Homo sapiens
gctctgagaggtgcagcagtaa

SEQ ID NO: 8195292 - DNA, 22 bp, Homo sapiens
gctctgagaggtgcagcagtaa

SEQ ID NO: 8195293 - DNA, 19 bp, Homo sapiens
gctctgagaggggcatggg

SEQ ID NO: 8195294 - DNA, 19 bp, Homo sapiens
gctctgagaggggcatggg

SEQ ID NO: 8195295 - DNA, 19 bp, Homo sapiens
gctctgagaggggcatggg

SEQ ID NO: 8195296 - DNA, 19 bp, Homo sapiens
gctctgagaggggcatggg

SEQ ID NO: 8195297 - DNA, 22 bp, Homo sapiens
gctctgagacagtagagatggc

SEQ ID NO: 8195298 - DNA, 22 bp, Homo sapiens
gctctgagacagtagagatggc

SEQ ID NO: 8195299 - DNA, 22 bp, Homo sapiens
gctctgagacagtagagatggc

SEQ ID NO: 8195300 - DNA, 22 bp, Homo sapiens
gctctgagaggatgctgagcag

SEQ ID NO: 8195301 - DNA, 22 bp, Homo sapiens
gctctgagagctacacagggta

SEQ ID NO: 8195302 - DNA, 22 bp, Homo sapiens
gctctgagagctacacagggta

SEQ ID NO: 8195303 - DNA, 22 bp, Homo sapiens
gctctgagaggatgctgagcag

SEQ ID NO: 8195304 - DNA, 22 bp, Homo sapiens
gctctgaagggtgagctgttcg

SEQ ID NO: 8195305 - DNA, 22 bp, Homo sapiens
gctctgaagggtgagctgttcg

SEQ ID NO: 8195306 - DNA, 20 bp, Homo sapiens
gctctgaaccaagagctgtc

SEQ ID NO: 8195307 - DNA, 20 bp, Homo sapiens
gctctgaaccaagagctgtc

SEQ ID NO: 8195308 - DNA, 22 bp, Homo sapiens
gctctgaatcaatcagataagg

SEQ ID NO: 8195309 - DNA, 20 bp, Homo sapiens
gctctgaccatatcaagaca

SEQ ID NO: 8195310 - DNA, 22 bp, Homo sapiens
gctcagggtgcagtgtccatga

SEQ ID NO: 8195311 - DNA, 22 bp, Homo sapiens
gctcaggtagatggggttgtcc

SEQ ID NO: 8195312 - DNA, 22 bp, Homo sapiens
gctcaggtcttacccatgcctg

SEQ ID NO: 8195313 - DNA, 18 bp, Homo sapiens
gctcaggtatagacaggg

SEQ ID NO: 8195314 - DNA, 22 bp, Homo sapiens
gctcaggtcttacccatgcctg

SEQ ID NO: 8195315 - DNA, 18 bp, Homo sapiens
gctcaggtatagacaggg

SEQ ID NO: 8195316 - DNA, 18 bp, Homo sapiens
gctcaggtatagacaggg

SEQ ID NO: 8195317 - DNA, 18 bp, Homo sapiens
gctcaggtatagacaggg

SEQ ID NO: 8195318 - DNA, 20 bp, Homo sapiens
gctcaggtttgggctttgtg

SEQ ID NO: 8195319 - DNA, 22 bp, Homo sapiens
gctcaggtgttacctcctctag

SEQ ID NO: 8195320 - DNA, 22 bp, Homo sapiens
gctcaggtgttacctcctctag

SEQ ID NO: 8195321 - DNA, 22 bp, Homo sapiens
gctcaggtgttacctcctctag

SEQ ID NO: 8195322 - DNA, 23 bp, Homo sapiens
gctcaggtggctcagggactgat

SEQ ID NO: 8195323 - DNA, 23 bp, Homo sapiens
gctcaggtggctcagggactgat

SEQ ID NO: 8195324 - DNA, 23 bp, Homo sapiens
gctcaggtggctcagggactgat

SEQ ID NO: 8195325 - DNA, 20 bp, Homo sapiens
gctcaggtgacagtcaggag

SEQ ID NO: 8195326 - DNA, 20 bp, Homo sapiens
gctcaggtgacagtcaggag

SEQ ID NO: 8195327 - DNA, 20 bp, Homo sapiens
gctcaggtgacagtcaggag

SEQ ID NO: 8195328 - DNA, 22 bp, Homo sapiens
gctcagggtcccttggtgctgg

SEQ ID NO: 8195329 - DNA, 22 bp, Homo sapiens
gctcagggtcccttggtgctgg

SEQ ID NO: 8195330 - DNA, 22 bp, Homo sapiens
gctcagggtcccttggtgctgg

SEQ ID NO: 8195331 - DNA, 22 bp, Homo sapiens
gctcagggtcccttggtgctgg

SEQ ID NO: 8195332 - DNA, 22 bp, Homo sapiens
gctcagggctaaggctgagggg

SEQ ID NO: 8195333 - DNA, 22 bp, Homo sapiens
gctcaggggaatgggctgccgt

SEQ ID NO: 8195334 - DNA, 22 bp, Homo sapiens
gctcaggggaatgggctgccgt

SEQ ID NO: 8195335 - DNA, 22 bp, Homo sapiens
gctccaggcgagctggaccaga

SEQ ID NO: 8195336 - DNA, 17 bp, Homo sapiens
gctccaggcgtgagtga

SEQ ID NO: 8195337 - DNA, 17 bp, Homo sapiens
gctccaggcgtgagtga

SEQ ID NO: 8195338 - DNA, 22 bp, Homo sapiens
gctccaggccccagcgttccgc

SEQ ID NO: 8195339 - DNA, 22 bp, Homo sapiens
gctccaggcgagctggaccaga

SEQ ID NO: 8195340 - DNA, 22 bp, Homo sapiens
gctccaggcgagctggaccaga

SEQ ID NO: 8195341 - DNA, 22 bp, Homo sapiens
gctccaggcgagctggaccaga

SEQ ID NO: 8195342 - DNA, 22 bp, Homo sapiens
gctccaggcagcatagtggatg

SEQ ID NO: 8195343 - DNA, 20 bp, Homo sapiens
gctcaggtttgggctttgtg

SEQ ID NO: 8195344 - DNA, 22 bp, Homo sapiens
gctccaggcagcatagtggatg

SEQ ID NO: 8195345 - DNA, 22 bp, Homo sapiens
gctccaggcagcatagtggatg

SEQ ID NO: 8195346 - DNA, 22 bp, Homo sapiens
gctccaggccacggcttcttgg

SEQ ID NO: 8195347 - DNA, 22 bp, Homo sapiens
gctccaggccccagcgttccgc

SEQ ID NO: 8195348 - DNA, 17 bp, Homo sapiens
gctccaggcgtgagtga

SEQ ID NO: 8195349 - DNA, 17 bp, Homo sapiens
gctccaggcgtgagtga

SEQ ID NO: 8195350 - DNA, 22 bp, Homo sapiens
gctccaggctgctctgtcccat

SEQ ID NO: 8195351 - DNA, 22 bp, Homo sapiens
gctccaggctgctctgtcccat

SEQ ID NO: 8195352 - DNA, 22 bp, Homo sapiens
gctcctggatgttcaagtcggc

SEQ ID NO: 8195353 - DNA, 22 bp, Homo sapiens
gctcctggatgttcaagtcggc

SEQ ID NO: 8195354 - DNA, 22 bp, Homo sapiens
gctccaggctgctctgtcccat

SEQ ID NO: 8195355 - DNA, 22 bp, Homo sapiens
gctccaggctgctctgtcccat

SEQ ID NO: 8195356 - DNA, 22 bp, Homo sapiens
gctccagggaacagaatgtact

SEQ ID NO: 8195357 - DNA, 22 bp, Homo sapiens
gctcggagaactgggggctccg

SEQ ID NO: 8195358 - DNA, 22 bp, Homo sapiens
gctcggagtcccacctgggaaa

SEQ ID NO: 8195359 - DNA, 22 bp, Homo sapiens
gctcgtacaccagcgtggaggt

SEQ ID NO: 8195360 - DNA, 22 bp, Homo sapiens
gctcggtggccagcctgaggcc

SEQ ID NO: 8195361 - DNA, 22 bp, Homo sapiens
gctccttctggctcccttttgg

SEQ ID NO: 8195362 - DNA, 17 bp, Homo sapiens
gctccttctaacttcca

SEQ ID NO: 8195363 - DNA, 22 bp, Homo sapiens
gctctagatcataggtcattat

SEQ ID NO: 8195364 - DNA, 22 bp, Homo sapiens
gctctagcaaggctggcctggg

SEQ ID NO: 8195365 - DNA, 22 bp, Homo sapiens
gctctagcaaggctggcctggg

SEQ ID NO: 8195366 - DNA, 22 bp, Homo sapiens
gctctagcccatttcctgcttg

SEQ ID NO: 8195367 - DNA, 22 bp, Homo sapiens
gctctagctggcgctgacctgg

SEQ ID NO: 8195368 - DNA, 22 bp, Homo sapiens
gctctagctggcgctgacctgg

SEQ ID NO: 8195369 - DNA, 22 bp, Homo sapiens
gctctaggagaggggcagtcca

SEQ ID NO: 8195370 - DNA, 22 bp, Homo sapiens
gctctaggagaggggcagtcca

SEQ ID NO: 8195371 - DNA, 22 bp, Homo sapiens
gctctaggttcctagccaagtc

SEQ ID NO: 8195372 - DNA, 22 bp, Homo sapiens
gctctaggttcctagccaagtc

SEQ ID NO: 8195373 - DNA, 22 bp, Homo sapiens
gctctatgaatcacacgagggt

SEQ ID NO: 8195374 - DNA, 22 bp, Homo sapiens
gctctgaaaaatggaggttggc

SEQ ID NO: 8195375 - DNA, 20 bp, Homo sapiens
gctctgaaccaagagctgtc

SEQ ID NO: 8195376 - DNA, 22 bp, Homo sapiens
gctctaaagagaatctatgcgg

SEQ ID NO: 8195377 - DNA, 20 bp, Homo sapiens
gctctaaagccacagattga

SEQ ID NO: 8195378 - DNA, 20 bp, Homo sapiens
gctctaaagccacagattga

SEQ ID NO: 8195379 - DNA, 22 bp, Homo sapiens
gctctaaagaacccagaggagt

SEQ ID NO: 8195380 - DNA, 20 bp, Homo sapiens
gctctaaaccacaaagccca

SEQ ID NO: 8195381 - DNA, 19 bp, Homo sapiens
gctctaaaagattttgaag

SEQ ID NO: 8195382 - DNA, 22 bp, Homo sapiens
gctctaaagtccagtcaactag

SEQ ID NO: 8195383 - DNA, 22 bp, Homo sapiens
gctctaaagggttggacaggtg

SEQ ID NO: 8195384 - DNA, 22 bp, Homo sapiens
gctctagacagaaagaccagtg

SEQ ID NO: 8195385 - DNA, 18 bp, Homo sapiens
gctctaattttagaaagg

SEQ ID NO: 8195386 - DNA, 22 bp, Homo sapiens
gctctagaaagaaggatgtggg

SEQ ID NO: 8195387 - DNA, 22 bp, Homo sapiens
gctctaattgaaaaatactgca

SEQ ID NO: 8195388 - DNA, 22 bp, Homo sapiens
gcgtggtgctgccctgcacaca

SEQ ID NO: 8195389 - DNA, 22 bp, Homo sapiens
gcgccccatctacagtactttt

SEQ ID NO: 8195390 - DNA, 22 bp, Homo sapiens
gcgtggggtaggtagacatgga

SEQ ID NO: 8195391 - DNA, 22 bp, Homo sapiens
gcgtggggtaggtagacatgga

SEQ ID NO: 8195392 - DNA, 22 bp, Homo sapiens
gctaagaattctgagcagctga

SEQ ID NO: 8195393 - DNA, 22 bp, Homo sapiens
gctaagaggctatatctttctc

SEQ ID NO: 8195394 - DNA, 22 bp, Homo sapiens
gctaagaggagcctccttctga

SEQ ID NO: 8195395 - DNA, 22 bp, Homo sapiens
gctaaggcacaaatagctttgc

SEQ ID NO: 8195396 - DNA, 22 bp, Homo sapiens
gctaaggccttaactcatggag

SEQ ID NO: 8195397 - DNA, 22 bp, Homo sapiens
gctaaataatcttcttctgaca

SEQ ID NO: 8195398 - DNA, 22 bp, Homo sapiens
gctaaaataactgagtttttgc

SEQ ID NO: 8195399 - DNA, 22 bp, Homo sapiens
gcctggctcctaaggactggct

SEQ ID NO: 8195400 - DNA, 22 bp, Homo sapiens
gcctggctcctaaggactggct

SEQ ID NO: 8195401 - DNA, 22 bp, Homo sapiens
gcctggctcctaaggactggct

SEQ ID NO: 8195402 - DNA, 21 bp, Homo sapiens
gcctggctctcactggcctgg

SEQ ID NO: 8195403 - DNA, 22 bp, Homo sapiens
gcctggctcctaagagcacaac

SEQ ID NO: 8195404 - DNA, 22 bp, Homo sapiens
gcctggctcctaaggactggct

SEQ ID NO: 8195405 - DNA, 22 bp, Homo sapiens
gcctggctcctaagagcacaac

SEQ ID NO: 8195406 - DNA, 21 bp, Homo sapiens
gcctggctctcactggcctgg

SEQ ID NO: 8195407 - DNA, 22 bp, Homo sapiens
gcctggctctgagggagctcct

SEQ ID NO: 8195408 - DNA, 22 bp, Homo sapiens
gcctggctctgagggagctcct

SEQ ID NO: 8195409 - DNA, 22 bp, Homo sapiens
gcgcaggcccgggtcagggccg

SEQ ID NO: 8195410 - DNA, 22 bp, Homo sapiens
gcgcaggagccgcggagggccg

SEQ ID NO: 8195411 - DNA, 22 bp, Homo sapiens
gcgcaggtgctgctggagcagc

SEQ ID NO: 8195412 - DNA, 22 bp, Homo sapiens
gcgcaggtgatgcgtctgcctt

SEQ ID NO: 8195413 - DNA, 22 bp, Homo sapiens
gctaataattcctttgtgaact

SEQ ID NO: 8195414 - DNA, 22 bp, Homo sapiens
gctaataattcctttgtgaact

SEQ ID NO: 8195415 - DNA, 22 bp, Homo sapiens
gctaatgaaaaatagattatag

SEQ ID NO: 8195416 - DNA, 22 bp, Homo sapiens
gctaatgactgagtttttagca

SEQ ID NO: 8195417 - DNA, 22 bp, Homo sapiens
gctattgcaggttaccttatcc

SEQ ID NO: 8195418 - DNA, 22 bp, Homo sapiens
gctattgtacatttcttgtttg

SEQ ID NO: 8195419 - DNA, 22 bp, Homo sapiens
gctattgtgacagcttttcgcc

SEQ ID NO: 8195420 - DNA, 22 bp, Homo sapiens
gctacagactgagcatggctct

SEQ ID NO: 8195421 - DNA, 22 bp, Homo sapiens
gctatgcaggagcctaatgaca

SEQ ID NO: 8195422 - DNA, 22 bp, Homo sapiens
gctatgggatgtgctgtggatg

SEQ ID NO: 8195423 - DNA, 22 bp, Homo sapiens
gctatgttcccttttgctataa

SEQ ID NO: 8195424 - DNA, 22 bp, Homo sapiens
gctatgttagacattctcattt

SEQ ID NO: 8195425 - DNA, 23 bp, Homo sapiens
gctcaggcatcattcttcctggc

SEQ ID NO: 8195426 - DNA, 23 bp, Homo sapiens
gctcaggcatcattcttcctggc

SEQ ID NO: 8195427 - DNA, 23 bp, Homo sapiens
gctcaggcatcattcttcctggc

SEQ ID NO: 8195428 - DNA, 22 bp, Homo sapiens
gctcagggctaaggctgagggg

SEQ ID NO: 8195429 - DNA, 22 bp, Homo sapiens
gctcagggctaaggctgagggg

SEQ ID NO: 8195430 - DNA, 22 bp, Homo sapiens
gctatttattaaaatggtgaag

SEQ ID NO: 8195431 - DNA, 22 bp, Homo sapiens
gctatttttgagccatttataa

SEQ ID NO: 8195432 - DNA, 22 bp, Homo sapiens
gctatttttgagccatttataa

SEQ ID NO: 8195433 - DNA, 22 bp, Homo sapiens
gctatttttgagccatttataa

SEQ ID NO: 8195434 - DNA, 22 bp, Homo sapiens
gctatttttgagccatttataa

SEQ ID NO: 8195435 - DNA, 22 bp, Homo sapiens
cctgaagaattcaaatccagat

SEQ ID NO: 8195436 - DNA, 22 bp, Homo sapiens
cctgaagacaacttttatcacc

SEQ ID NO: 8195437 - DNA, 22 bp, Homo sapiens
cctgaagagcactctagagttg

SEQ ID NO: 8195438 - DNA, 22 bp, Homo sapiens
cctgaagagtgaatgtggcagt

SEQ ID NO: 8195439 - DNA, 22 bp, Homo sapiens
cctgaagatccattatagacac

SEQ ID NO: 8195440 - DNA, 22 bp, Homo sapiens
cctgaagatccattatagacac

SEQ ID NO: 8195441 - DNA, 20 bp, Homo sapiens
cctgaagagtttctctttct

SEQ ID NO: 8195442 - DNA, 22 bp, Homo sapiens
cctgaaatgactccagctgagt

SEQ ID NO: 8195443 - DNA, 22 bp, Homo sapiens
cctgaaatccatagtttacact

SEQ ID NO: 8195444 - DNA, 21 bp, Homo sapiens
cctgaaattctcactagctta

SEQ ID NO: 8195445 - DNA, 22 bp, Homo sapiens
cctgaaatgagttctgctcact

SEQ ID NO: 8195446 - DNA, 22 bp, Homo sapiens
cctgaactctaaatagagcagt

SEQ ID NO: 8195447 - DNA, 22 bp, Homo sapiens
cctgaagaagttgttatggtct

SEQ ID NO: 8195448 - DNA, 22 bp, Homo sapiens
cctgaacaaatggcatagccaa

SEQ ID NO: 8195449 - DNA, 22 bp, Homo sapiens
cctgaaatttgaagacctgaat

SEQ ID NO: 8195450 - DNA, 22 bp, Homo sapiens
cctgaagatgctgtggcctggt

SEQ ID NO: 8195451 - DNA, 22 bp, Homo sapiens
cctgagagagtgagccctgaca

SEQ ID NO: 8195452 - DNA, 22 bp, Homo sapiens
cctgagagccctagccaggcgc

SEQ ID NO: 8195453 - DNA, 22 bp, Homo sapiens
cctgagagccagtgcctgccca

SEQ ID NO: 8195454 - DNA, 22 bp, Homo sapiens
cctgagagccagtgcctgccca

SEQ ID NO: 8195455 - DNA, 22 bp, Homo sapiens
cctgagaggccctctcactgtc

SEQ ID NO: 8195456 - DNA, 22 bp, Homo sapiens
cctgagaggccctctcactgtc

SEQ ID NO: 8195457 - DNA, 22 bp, Homo sapiens
cctgagagggggccctagaaat

SEQ ID NO: 8195458 - DNA, 22 bp, Homo sapiens
cctgagagggggccctagaaat

SEQ ID NO: 8195459 - DNA, 22 bp, Homo sapiens
cctgagagtaggtgtctcttta

SEQ ID NO: 8195460 - DNA, 22 bp, Homo sapiens
agggtagggccgtagggccatg

SEQ ID NO: 8195461 - DNA, 22 bp, Homo sapiens
agggtagggccgtagggccatg

SEQ ID NO: 8195462 - DNA, 22 bp, Homo sapiens
agggtagggcccggagacagac

SEQ ID NO: 8195463 - DNA, 22 bp, Homo sapiens
agggtagggcccggagacagac

SEQ ID NO: 8195464 - DNA, 22 bp, Homo sapiens
agggtaggaactgagtggaagg

SEQ ID NO: 8195465 - DNA, 22 bp, Homo sapiens
agggtaggaactgagtggaagg

SEQ ID NO: 8195466 - DNA, 22 bp, Homo sapiens
agggtagggcccggagacagac

SEQ ID NO: 8195467 - DNA, 22 bp, Homo sapiens
aggggtgaaggcccgataggag

SEQ ID NO: 8195468 - DNA, 22 bp, Homo sapiens
agggtaggaactgagtggaagg

SEQ ID NO: 8195469 - DNA, 22 bp, Homo sapiens
aggggtgaaggcccgataggag

SEQ ID NO: 8195470 - DNA, 22 bp, Homo sapiens
agggtagggccgtagggccatg

SEQ ID NO: 8195471 - DNA, 22 bp, Homo sapiens
agggtagggccgtagggccatg

SEQ ID NO: 8195472 - DNA, 22 bp, Homo sapiens
agggtatgttttaggctgagtt

SEQ ID NO: 8195473 - DNA, 22 bp, Homo sapiens
agggtaggtgtaagatagccct

SEQ ID NO: 8195474 - DNA, 22 bp, Homo sapiens
agggtagggtaaatgatgcatc

SEQ ID NO: 8195475 - DNA, 22 bp, Homo sapiens
agggtagggtaaatgatgcatc

SEQ ID NO: 8195476 - DNA, 22 bp, Homo sapiens
agggtcaagtcactggttcacg

SEQ ID NO: 8195477 - DNA, 22 bp, Homo sapiens
agggtcaagaggcagagttctt

SEQ ID NO: 8195478 - DNA, 22 bp, Homo sapiens
agggtcaccagttcataggcac

SEQ ID NO: 8195479 - DNA, 22 bp, Homo sapiens
agggtcacctgcttgccagggc

SEQ ID NO: 8195480 - DNA, 22 bp, Homo sapiens
cctgaggtggctgcagcactgc

SEQ ID NO: 8195481 - DNA, 22 bp, Homo sapiens
cctgaggtctagagtcagggtg

SEQ ID NO: 8195482 - DNA, 22 bp, Homo sapiens
cctgaggtctagagtcagggtg

SEQ ID NO: 8195483 - DNA, 22 bp, Homo sapiens
agggtcaacaggagtcaagatg

SEQ ID NO: 8195484 - DNA, 22 bp, Homo sapiens
agggtcaacactttaaacatat

SEQ ID NO: 8195485 - DNA, 22 bp, Homo sapiens
agggtcaacactttaaacatat

SEQ ID NO: 8195486 - DNA, 22 bp, Homo sapiens
agggtcaacattctaaaatctg

SEQ ID NO: 8195487 - DNA, 22 bp, Homo sapiens
agggtcaacattctaaaatctg

SEQ ID NO: 8195488 - DNA, 22 bp, Homo sapiens
agggtcaagaataaagattaca

SEQ ID NO: 8195489 - DNA, 22 bp, Homo sapiens
agggtcaacatttcattgattc

SEQ ID NO: 8195490 - DNA, 22 bp, Homo sapiens
agggtcaacatttcattgattc

SEQ ID NO: 8195491 - DNA, 22 bp, Homo sapiens
agggtatgttttaggctgagtt

SEQ ID NO: 8195492 - DNA, 22 bp, Homo sapiens
agggtcaaatgggcaggaagag

SEQ ID NO: 8195493 - DNA, 22 bp, Homo sapiens
agggtcaaaggaaaggcccaca

SEQ ID NO: 8195494 - DNA, 22 bp, Homo sapiens
agggtcaaatgggcaggaagag

SEQ ID NO: 8195495 - DNA, 22 bp, Homo sapiens
aggggaggcagcgataaacctg

SEQ ID NO: 8195496 - DNA, 22 bp, Homo sapiens
aggggaggagcttttcttgcct

SEQ ID NO: 8195497 - DNA, 22 bp, Homo sapiens
aggggaggtgtccccaaatctc

SEQ ID NO: 8195498 - DNA, 22 bp, Homo sapiens
aggggatgcctagtggagtctc

SEQ ID NO: 8195499 - DNA, 22 bp, Homo sapiens
aggggatgcctagtggagtctc

SEQ ID NO: 8195500 - DNA, 22 bp, Homo sapiens
aggggatgatcctcccgcagcg

SEQ ID NO: 8195501 - DNA, 22 bp, Homo sapiens
aggggatgatcctcccgcagcg

SEQ ID NO: 8195502 - DNA, 22 bp, Homo sapiens
agggctggcatctctaatgctg

SEQ ID NO: 8195503 - DNA, 22 bp, Homo sapiens
agggctggcatctctaatgctg

SEQ ID NO: 8195504 - DNA, 22 bp, Homo sapiens
agggctggccacatgatttggt

SEQ ID NO: 8195505 - DNA, 22 bp, Homo sapiens
agggctggctaggtgcgttccc

SEQ ID NO: 8195506 - DNA, 22 bp, Homo sapiens
agggctggctaggtgcgttccc

SEQ ID NO: 8195507 - DNA, 22 bp, Homo sapiens
agggctggccacatgatttggt

SEQ ID NO: 8195508 - DNA, 22 bp, Homo sapiens
agggctggccacatgatttggt

SEQ ID NO: 8195509 - DNA, 22 bp, Homo sapiens
agggctggccacatgatttggt

SEQ ID NO: 8195510 - DNA, 22 bp, Homo sapiens
agggctggctaggtgcgttccc

SEQ ID NO: 8195511 - DNA, 22 bp, Homo sapiens
agggctggctaggtgcgttccc

SEQ ID NO: 8195512 - DNA, 22 bp, Homo sapiens
agggctggctccgttaccttga

SEQ ID NO: 8195513 - DNA, 22 bp, Homo sapiens
aggggagagttaatgtgaatgt

SEQ ID NO: 8195514 - DNA, 22 bp, Homo sapiens
aggggcagcctcacaatcctct

SEQ ID NO: 8195515 - DNA, 23 bp, Homo sapiens
aggggcagcaagttttggtgtta

SEQ ID NO: 8195516 - DNA, 23 bp, Homo sapiens
aggggcagcaagttttggtgtta

SEQ ID NO: 8195517 - DNA, 23 bp, Homo sapiens
aggggcagcaagttttggtgtta

SEQ ID NO: 8195518 - DNA, 22 bp, Homo sapiens
aggggcacttctcaggctgtgg

SEQ ID NO: 8195519 - DNA, 22 bp, Homo sapiens
aggggcagcctcacaatcctct

SEQ ID NO: 8195520 - DNA, 22 bp, Homo sapiens
cctcttcatcctggaagctgct

SEQ ID NO: 8195521 - DNA, 18 bp, Homo sapiens
aggggcagcttgtgtgga

SEQ ID NO: 8195522 - DNA, 22 bp, Homo sapiens
cctcttccactgggccccatcc

SEQ ID NO: 8195523 - DNA, 22 bp, Homo sapiens
cctcttccactgggccccatcc

SEQ ID NO: 8195524 - DNA, 22 bp, Homo sapiens
cctcttcatcctggaagctgct

SEQ ID NO: 8195525 - DNA, 22 bp, Homo sapiens
aggggcacgagtagagctctag

SEQ ID NO: 8195526 - DNA, 20 bp, Homo sapiens
aggggcacctgcgacggggc

SEQ ID NO: 8195527 - DNA, 22 bp, Homo sapiens
aggggatggagctggaaggcag

SEQ ID NO: 8195528 - DNA, 22 bp, Homo sapiens
aggggatgcctgaggatctgta

SEQ ID NO: 8195529 - DNA, 22 bp, Homo sapiens
aggggatggagctggaaggcag

SEQ ID NO: 8195530 - DNA, 22 bp, Homo sapiens
aggggatggagctggaaggcag

SEQ ID NO: 8195531 - DNA, 22 bp, Homo sapiens
aggggatgcctgaggatctgta

SEQ ID NO: 8195532 - DNA, 22 bp, Homo sapiens
aggggatggagctggaaggcag

SEQ ID NO: 8195533 - DNA, 22 bp, Homo sapiens
aggggatggagctggaaggcag

SEQ ID NO: 8195534 - DNA, 22 bp, Homo sapiens
ccctgctttcaaccttctagct

SEQ ID NO: 8195535 - DNA, 22 bp, Homo sapiens
ccctgctttcaaccttctagct

SEQ ID NO: 8195536 - DNA, 22 bp, Homo sapiens
ccctgctttcaaccttctagct

SEQ ID NO: 8195537 - DNA, 22 bp, Homo sapiens
ccctgcttagcacccttgcacc

SEQ ID NO: 8195538 - DNA, 22 bp, Homo sapiens
ccctgcttgtcacccctgggtc

SEQ ID NO: 8195539 - DNA, 22 bp, Homo sapiens
ccctggaaatgaggcatgtgcg

SEQ ID NO: 8195540 - DNA, 22 bp, Homo sapiens
ccctggaacccatggccagtgt

SEQ ID NO: 8195541 - DNA, 22 bp, Homo sapiens
ccctggaaatgaggcatgtgcg

SEQ ID NO: 8195542 - DNA, 22 bp, Homo sapiens
ccctgctttgcacccaggctgg

SEQ ID NO: 8195543 - DNA, 22 bp, Homo sapiens
ccctgctttgcacccaggctgg

SEQ ID NO: 8195544 - DNA, 22 bp, Homo sapiens
ccctgctttgcacccaggctgg

SEQ ID NO: 8195545 - DNA, 22 bp, Homo sapiens
agggcctccagggcagcagtgg

SEQ ID NO: 8195546 - DNA, 22 bp, Homo sapiens
agggcctccagggcagcagtgg

SEQ ID NO: 8195547 - DNA, 22 bp, Homo sapiens
agggcctccagggcagcagtgg

SEQ ID NO: 8195548 - DNA, 22 bp, Homo sapiens
agggcctgagctggctgacctc

SEQ ID NO: 8195549 - DNA, 22 bp, Homo sapiens
agggcctgagctctcctccagt

SEQ ID NO: 8195550 - DNA, 22 bp, Homo sapiens
agggcctcagtgttctcatctg

SEQ ID NO: 8195551 - DNA, 22 bp, Homo sapiens
agggcctcagtgttctcatctg

SEQ ID NO: 8195552 - DNA, 22 bp, Homo sapiens
ccctggaaggagatgggacatg

SEQ ID NO: 8195553 - DNA, 22 bp, Homo sapiens
ccctggaactgccaagcctcag

SEQ ID NO: 8195554 - DNA, 19 bp, Homo sapiens
agggcctgcagctcaagct

SEQ ID NO: 8195555 - DNA, 22 bp, Homo sapiens
agggcctgaggctgacggggag

SEQ ID NO: 8195556 - DNA, 22 bp, Homo sapiens
agggcctgagctggctgacctc

SEQ ID NO: 8195557 - DNA, 22 bp, Homo sapiens
agggcctgagctggctgacctc

SEQ ID NO: 8195558 - DNA, 22 bp, Homo sapiens
agggcctgagctggctgacctc

SEQ ID NO: 8195559 - DNA, 22 bp, Homo sapiens
agggcctgaggctgacggggag

SEQ ID NO: 8195560 - DNA, 22 bp, Homo sapiens
agggcctgaggctgacggggag

SEQ ID NO: 8195561 - DNA, 19 bp, Homo sapiens
agggcctgcagctcaagct

SEQ ID NO: 8195562 - DNA, 19 bp, Homo sapiens
agggcctgcagctcaagct

SEQ ID NO: 8195563 - DNA, 19 bp, Homo sapiens
agggcctgcagctcaagct

SEQ ID NO: 8195564 - DNA, 19 bp, Homo sapiens
agggcctgcagctcaagct

SEQ ID NO: 8195565 - DNA, 19 bp, Homo sapiens
agggcctgcagctcaagct

SEQ ID NO: 8195566 - DNA, 22 bp, Homo sapiens
agggcctgcatcaggagcttgg

SEQ ID NO: 8195567 - DNA, 22 bp, Homo sapiens
agggcctgcatcaggagcttgg

SEQ ID NO: 8195568 - DNA, 22 bp, Homo sapiens
agggcctgcatcaggagcttgg

SEQ ID NO: 8195569 - DNA, 22 bp, Homo sapiens
agggcctgcatcaggagcttgg

SEQ ID NO: 8195570 - DNA, 22 bp, Homo sapiens
agggcctggcgcgtggccgccg

SEQ ID NO: 8195571 - DNA, 22 bp, Homo sapiens
agggcctggcgcgtggccgccg

SEQ ID NO: 8195572 - DNA, 22 bp, Homo sapiens
agggcctggcgcgtggccgccg

SEQ ID NO: 8195573 - DNA, 22 bp, Homo sapiens
agggcctggcgcgtggccgccg

SEQ ID NO: 8195574 - DNA, 23 bp, Homo sapiens
agggcctggcgtggagtgtgtgc

SEQ ID NO: 8195575 - DNA, 22 bp, Homo sapiens
agggcctggcgcgtggccgccg

SEQ ID NO: 8195576 - DNA, 22 bp, Homo sapiens
agggcctggactaattggatcc

SEQ ID NO: 8195577 - DNA, 20 bp, Homo sapiens
agggcctggagtacagcagg

SEQ ID NO: 8195578 - DNA, 20 bp, Homo sapiens
agggcctggagtacagcagg

SEQ ID NO: 8195579 - DNA, 22 bp, Homo sapiens
cctcagagcgcgtggcattatt

SEQ ID NO: 8195580 - DNA, 20 bp, Homo sapiens
cctcagagcgcaggccccct

SEQ ID NO: 8195581 - DNA, 19 bp, Homo sapiens
cctcagagctagtgaacat

SEQ ID NO: 8195582 - DNA, 18 bp, Homo sapiens
cctcagaggcaaattgtt

SEQ ID NO: 8195583 - DNA, 22 bp, Homo sapiens
cctcagcttgatttctgcagag

SEQ ID NO: 8195584 - DNA, 22 bp, Homo sapiens
cctcagcttgatttctgcagag

SEQ ID NO: 8195585 - DNA, 22 bp, Homo sapiens
agggcctggaactggagaccac

SEQ ID NO: 8195586 - DNA, 22 bp, Homo sapiens
agggcctggaactggagaccac

SEQ ID NO: 8195587 - DNA, 22 bp, Homo sapiens
agggcctgctctatcactctca

SEQ ID NO: 8195588 - DNA, 20 bp, Homo sapiens
agggcctgctctgtggtgtc

SEQ ID NO: 8195589 - DNA, 20 bp, Homo sapiens
agggcctgctctgtggtgtc

SEQ ID NO: 8195590 - DNA, 22 bp, Homo sapiens
agggcctggaactgtgggcagg

SEQ ID NO: 8195591 - DNA, 22 bp, Homo sapiens
agggcctggaactgtgggcagg

SEQ ID NO: 8195592 - DNA, 22 bp, Homo sapiens
agggcctggaactggagaccac

SEQ ID NO: 8195593 - DNA, 22 bp, Homo sapiens
agggcctggaactggagaccac

SEQ ID NO: 8195594 - DNA, 22 bp, Homo sapiens
agggcctggaactggagaccac

SEQ ID NO: 8195595 - DNA, 22 bp, Homo sapiens
agggcctggaactggagaccac

SEQ ID NO: 8195596 - DNA, 22 bp, Homo sapiens
agggcctggaactgtgggcagg

SEQ ID NO: 8195597 - DNA, 22 bp, Homo sapiens
agggcctggaactgtgggcagg

SEQ ID NO: 8195598 - DNA, 22 bp, Homo sapiens
agggctggagccacagctggga

SEQ ID NO: 8195599 - DNA, 22 bp, Homo sapiens
agggctggagggtactagttta

SEQ ID NO: 8195600 - DNA, 22 bp, Homo sapiens
agggctggagggtactagttta

SEQ ID NO: 8195601 - DNA, 22 bp, Homo sapiens
agggctggagccacagctggga

SEQ ID NO: 8195602 - DNA, 22 bp, Homo sapiens
agggctggagccacagctggga

SEQ ID NO: 8195603 - DNA, 22 bp, Homo sapiens
agggctggagccacagctggga

SEQ ID NO: 8195604 - DNA, 22 bp, Homo sapiens
agggctggagccacagctggga

SEQ ID NO: 8195605 - DNA, 22 bp, Homo sapiens
agggctggagccacagctggga

SEQ ID NO: 8195606 - DNA, 22 bp, Homo sapiens
agggctggagccacagctggga

SEQ ID NO: 8195607 - DNA, 22 bp, Homo sapiens
agggctggcaagggattgaaat

SEQ ID NO: 8195608 - DNA, 22 bp, Homo sapiens
agggctggcaagggattgaaat

SEQ ID NO: 8195609 - DNA, 22 bp, Homo sapiens
agggctggcaagggattgaaat

SEQ ID NO: 8195610 - DNA, 22 bp, Homo sapiens
agggctggcaagggattgaaat

SEQ ID NO: 8195611 - DNA, 22 bp, Homo sapiens
agggctggcaagggattgaaat

SEQ ID NO: 8195612 - DNA, 22 bp, Homo sapiens
agggctggcaagggattgaaat

SEQ ID NO: 8195613 - DNA, 22 bp, Homo sapiens
agggctggcatctctaatgctg

SEQ ID NO: 8195614 - DNA, 22 bp, Homo sapiens
agggctggcatctctaatgctg

SEQ ID NO: 8195615 - DNA, 22 bp, Homo sapiens
agggctgccatttctggcccaa

SEQ ID NO: 8195616 - DNA, 22 bp, Homo sapiens
agggctgctgctccgggcccag

SEQ ID NO: 8195617 - DNA, 22 bp, Homo sapiens
agggctgcatctgcctggtgaa

SEQ ID NO: 8195618 - DNA, 22 bp, Homo sapiens
agggctgcatctgcctggtgaa

SEQ ID NO: 8195619 - DNA, 22 bp, Homo sapiens
agggctaggaatggaactggag

SEQ ID NO: 8195620 - DNA, 22 bp, Homo sapiens
agggctagagttgagatgggga

SEQ ID NO: 8195621 - DNA, 22 bp, Homo sapiens
agggctggagccacagctggga

SEQ ID NO: 8195622 - DNA, 22 bp, Homo sapiens
agggctggagccacagctggga

SEQ ID NO: 8195623 - DNA, 22 bp, Homo sapiens
agggctggagccacagctggga

SEQ ID NO: 8195624 - DNA, 22 bp, Homo sapiens
agggctgctttgctaaatatgg

SEQ ID NO: 8195625 - DNA, 22 bp, Homo sapiens
agggctgcttacctggaatggc

SEQ ID NO: 8195626 - DNA, 22 bp, Homo sapiens
agggctggagccacagctggga

SEQ ID NO: 8195627 - DNA, 22 bp, Homo sapiens
agggctggagccacagctggga

SEQ ID NO: 8195628 - DNA, 22 bp, Homo sapiens
agggctggagccacagctggga

SEQ ID NO: 8195629 - DNA, 22 bp, Homo sapiens
agggcgtggtggtgctggagca

SEQ ID NO: 8195630 - DNA, 22 bp, Homo sapiens
agggcgtggtggtgctggagca

SEQ ID NO: 8195631 - DNA, 22 bp, Homo sapiens
agggcgtggtggtgctggagca

SEQ ID NO: 8195632 - DNA, 22 bp, Homo sapiens
agggcgtggtggtgctggagca

SEQ ID NO: 8195633 - DNA, 22 bp, Homo sapiens
agggcgctgtctggccagcggt

SEQ ID NO: 8195634 - DNA, 22 bp, Homo sapiens
agggcgctgaaatactaacatg

SEQ ID NO: 8195635 - DNA, 19 bp, Homo sapiens
agggcggggcccaggcaca

SEQ ID NO: 8195636 - DNA, 22 bp, Homo sapiens
agggcgcctgctgtggccaccg

SEQ ID NO: 8195637 - DNA, 22 bp, Homo sapiens
agggcgaggagacggaggcaca

SEQ ID NO: 8195638 - DNA, 22 bp, Homo sapiens
agggcgaggagacggaggcaca

SEQ ID NO: 8195639 - DNA, 22 bp, Homo sapiens
agggcgacaatggagagcgttt

SEQ ID NO: 8195640 - DNA, 22 bp, Homo sapiens
agggcgaggagacggaggcaca

SEQ ID NO: 8195641 - DNA, 22 bp, Homo sapiens
agggcgacaatggagagcgttt

SEQ ID NO: 8195642 - DNA, 22 bp, Homo sapiens
agggccttgctgtctgaagctg

SEQ ID NO: 8195643 - DNA, 22 bp, Homo sapiens
agggccttgctgtctgaagctg

SEQ ID NO: 8195644 - DNA, 22 bp, Homo sapiens
agggcgacaatggagagcgttt

SEQ ID NO: 8195645 - DNA, 22 bp, Homo sapiens
cctcaggcagtggtatggatgg

SEQ ID NO: 8195646 - DNA, 20 bp, Homo sapiens
cctcaggccagttttaaagt

SEQ ID NO: 8195647 - DNA, 22 bp, Homo sapiens
cctcaggccagggggcggccag

SEQ ID NO: 8195648 - DNA, 22 bp, Homo sapiens
cctcaggccagggggcggccag

SEQ ID NO: 8195649 - DNA, 22 bp, Homo sapiens
cctcaggccctgtccctgcgcc

SEQ ID NO: 8195650 - DNA, 22 bp, Homo sapiens
cctcaggcctctgcctcattgg

SEQ ID NO: 8195651 - DNA, 22 bp, Homo sapiens
cctcaggccctgtccctgcgcc

SEQ ID NO: 8195652 - DNA, 22 bp, Homo sapiens
cctcaggccctgtccctgcgcc

SEQ ID NO: 8195653 - DNA, 22 bp, Homo sapiens
cctcaggcaggaaactgtcccg

SEQ ID NO: 8195654 - DNA, 22 bp, Homo sapiens
cctcaggcaggaaactgtcccg

SEQ ID NO: 8195655 - DNA, 22 bp, Homo sapiens
cctcaggcaagtcacttaacat

SEQ ID NO: 8195656 - DNA, 22 bp, Homo sapiens
aggctggtagtatttagtcaca

SEQ ID NO: 8195657 - DNA, 22 bp, Homo sapiens
aggctggtctatacggagacga

SEQ ID NO: 8195658 - DNA, 22 bp, Homo sapiens
aggctggtgattagaagcagcc

SEQ ID NO: 8195659 - DNA, 22 bp, Homo sapiens
aggctggtgattagaagcagcc

SEQ ID NO: 8195660 - DNA, 22 bp, Homo sapiens
aggctggtgcctgcagtgaatc

SEQ ID NO: 8195661 - DNA, 22 bp, Homo sapiens
aggctggtgcttcctagggcag

SEQ ID NO: 8195662 - DNA, 22 bp, Homo sapiens
aggctggtgcctgcagtgaatc

SEQ ID NO: 8195663 - DNA, 22 bp, Homo sapiens
aggctggtgtctctgtcctgtc

SEQ ID NO: 8195664 - DNA, 22 bp, Homo sapiens
aggctggtgtctctgtcctgtc

SEQ ID NO: 8195665 - DNA, 22 bp, Homo sapiens
aggctggtgtgtcctgaagcct

SEQ ID NO: 8195666 - DNA, 22 bp, Homo sapiens
aggctggtgtgtcctgaagcct

SEQ ID NO: 8195667 - DNA, 22 bp, Homo sapiens
aggctgtagtgcatgtgctatg

SEQ ID NO: 8195668 - DNA, 22 bp, Homo sapiens
aggctgtcatctttgcaggcag

SEQ ID NO: 8195669 - DNA, 22 bp, Homo sapiens
aggctgtcctctcttgctcagt

SEQ ID NO: 8195670 - DNA, 22 bp, Homo sapiens
aggctgtccaaggtggcgaagt

SEQ ID NO: 8195671 - DNA, 20 bp, Homo sapiens
aggctgtcatttctggcagg

SEQ ID NO: 8195672 - DNA, 20 bp, Homo sapiens
aggctgtcatttctggcagg

SEQ ID NO: 8195673 - DNA, 21 bp, Homo sapiens
aggctgtcctttgccagccct

SEQ ID NO: 8195674 - DNA, 21 bp, Homo sapiens
aggctgtcctttgccagccct

SEQ ID NO: 8195675 - DNA, 22 bp, Homo sapiens
aggctgtctcagcctgcttgca

SEQ ID NO: 8195676 - DNA, 22 bp, Homo sapiens
aggctgtctcagcctgcttgca

SEQ ID NO: 8195677 - DNA, 22 bp, Homo sapiens
aggctgtctgaccccagagccc

SEQ ID NO: 8195678 - DNA, 22 bp, Homo sapiens
aggctgtgacagggtcatggag

SEQ ID NO: 8195679 - DNA, 22 bp, Homo sapiens
aggctgtgacagggtcatggag

SEQ ID NO: 8195680 - DNA, 22 bp, Homo sapiens
cccaggaatgaggggcggaggc

SEQ ID NO: 8195681 - DNA, 22 bp, Homo sapiens
aggctgtgaaatgtggcaagga

SEQ ID NO: 8195682 - DNA, 22 bp, Homo sapiens
aggctgtgaaatgtggcaagga

SEQ ID NO: 8195683 - DNA, 22 bp, Homo sapiens
aggctgtgaactctatgctgaa

SEQ ID NO: 8195684 - DNA, 22 bp, Homo sapiens
cccaggagatgcactccattgg

SEQ ID NO: 8195685 - DNA, 22 bp, Homo sapiens
cccaggagatggaggttgcagt

SEQ ID NO: 8195686 - DNA, 22 bp, Homo sapiens
cccaggagatctggatctcgtc

SEQ ID NO: 8195687 - DNA, 22 bp, Homo sapiens
cccaggagccatctgtcttggc

SEQ ID NO: 8195688 - DNA, 23 bp, Homo sapiens
cccaggagcctgagtcctctctg

SEQ ID NO: 8195689 - DNA, 23 bp, Homo sapiens
cccaggagcctgagtcctctctg

SEQ ID NO: 8195690 - DNA, 22 bp, Homo sapiens
cccaggagatggtgcgtggtct

SEQ ID NO: 8195691 - DNA, 22 bp, Homo sapiens
cccaggaggtcaaggctgcagt

SEQ ID NO: 8195692 - DNA, 22 bp, Homo sapiens
cccaggaggtcaaggctgcagt

SEQ ID NO: 8195693 - DNA, 22 bp, Homo sapiens
cccaggaggtagaggttgcagt

SEQ ID NO: 8195694 - DNA, 20 bp, Homo sapiens
cccaggagctgtgccccatc

SEQ ID NO: 8195695 - DNA, 20 bp, Homo sapiens
cccaggagctgtgccccatc

SEQ ID NO: 8195696 - DNA, 20 bp, Homo sapiens
cccaggagctgtgccccatc

SEQ ID NO: 8195697 - DNA, 20 bp, Homo sapiens
cccaggagctgtgccccatc

SEQ ID NO: 8195698 - DNA, 22 bp, Homo sapiens
cccaggagcttctctctgcctc

SEQ ID NO: 8195699 - DNA, 22 bp, Homo sapiens
cccaggagcttctctctgcctc

SEQ ID NO: 8195700 - DNA, 22 bp, Homo sapiens
cccatccctgattttcactcgt

SEQ ID NO: 8195701 - DNA, 22 bp, Homo sapiens
cccatctcagtcgtgctaaggg

SEQ ID NO: 8195702 - DNA, 22 bp, Homo sapiens
cccagttttctgattgaagagc

SEQ ID NO: 8195703 - DNA, 22 bp, Homo sapiens
cccatcaggaacccaggagccc

SEQ ID NO: 8195704 - DNA, 22 bp, Homo sapiens
cccatagaaggggaagtgctac

SEQ ID NO: 8195705 - DNA, 22 bp, Homo sapiens
cccatcacagacactgggttat

SEQ ID NO: 8195706 - DNA, 22 bp, Homo sapiens
cccagtacctctgttccctgct

SEQ ID NO: 8195707 - DNA, 22 bp, Homo sapiens
cccaggcttttctcttgcccca

SEQ ID NO: 8195708 - DNA, 22 bp, Homo sapiens
cccaggcttttctcttgcccca

SEQ ID NO: 8195709 - DNA, 22 bp, Homo sapiens
cccaggcttttctcttgcccca

SEQ ID NO: 8195710 - DNA, 22 bp, Homo sapiens
cccaggcttttctcttgcccca

SEQ ID NO: 8195711 - DNA, 22 bp, Homo sapiens
cccaggcttttaagttagacag

SEQ ID NO: 8195712 - DNA, 22 bp, Homo sapiens
cccaggcttttaagttagacag

SEQ ID NO: 8195713 - DNA, 18 bp, Homo sapiens
cccaggctttgtgggtct

SEQ ID NO: 8195714 - DNA, 18 bp, Homo sapiens
cccaggctttgtgggtct

SEQ ID NO: 8195715 - DNA, 22 bp, Homo sapiens
cccaggcttcccaatcagaagg

SEQ ID NO: 8195716 - DNA, 22 bp, Homo sapiens
cccaggcttcccaatcagaagg

SEQ ID NO: 8195717 - DNA, 22 bp, Homo sapiens
cccaggctgtgcaaacttcaaa

SEQ ID NO: 8195718 - DNA, 22 bp, Homo sapiens
cccaggctggaattccaggcct

SEQ ID NO: 8195719 - DNA, 22 bp, Homo sapiens
cccaggctggaattccaggcct

SEQ ID NO: 8195720 - DNA, 22 bp, Homo sapiens
cccaggctgcgtatccacaata

SEQ ID NO: 8195721 - DNA, 22 bp, Homo sapiens
cccaggctggaattccaggcct

SEQ ID NO: 8195722 - DNA, 22 bp, Homo sapiens
cccaggctgtctgtcctttgct

SEQ ID NO: 8195723 - DNA, 22 bp, Homo sapiens
cccaggctgtctgtcctttgct

SEQ ID NO: 8195724 - DNA, 22 bp, Homo sapiens
cccaggctgtgcaaacttcaaa

SEQ ID NO: 8195725 - DNA, 22 bp, Homo sapiens
cccaggctggaattccaggcct

SEQ ID NO: 8195726 - DNA, 22 bp, Homo sapiens
cccaggctgtctgtcctttgct

SEQ ID NO: 8195727 - DNA, 22 bp, Homo sapiens
cccaggctgatgggatgggcca

SEQ ID NO: 8195728 - DNA, 22 bp, Homo sapiens
cccaggctgatgggatgggcca

SEQ ID NO: 8195729 - DNA, 22 bp, Homo sapiens
cccaggctgatgggatgggcca

SEQ ID NO: 8195730 - DNA, 22 bp, Homo sapiens
cccaggctgatgggatgggcca

SEQ ID NO: 8195731 - DNA, 22 bp, Homo sapiens
cccaggctgatgttcagcgggt

SEQ ID NO: 8195732 - DNA, 22 bp, Homo sapiens
cccaggctgatgttcagcgggt

SEQ ID NO: 8195733 - DNA, 22 bp, Homo sapiens
cccaggctgatgttcagcgggt

SEQ ID NO: 8195734 - DNA, 22 bp, Homo sapiens
cccaggctgatgttcagcgggt

SEQ ID NO: 8195735 - DNA, 22 bp, Homo sapiens
cccaggctgatgttcagcgggt

SEQ ID NO: 8195736 - DNA, 22 bp, Homo sapiens
cccaggctgcgtatccacaata

SEQ ID NO: 8195737 - DNA, 22 bp, Homo sapiens
cccaggctgcgtatccacaata

SEQ ID NO: 8195738 - DNA, 22 bp, Homo sapiens
cccaggctgccacgattactgc

SEQ ID NO: 8195739 - DNA, 22 bp, Homo sapiens
cccaggctgccacgattactgc

SEQ ID NO: 8195740 - DNA, 22 bp, Homo sapiens
cccaggctgcatgagtccatgg

SEQ ID NO: 8195741 - DNA, 22 bp, Homo sapiens
cccaggctgcatgagtccatgg

SEQ ID NO: 8195742 - DNA, 22 bp, Homo sapiens
cccaggctgcatgagtccatgg

SEQ ID NO: 8195743 - DNA, 22 bp, Homo sapiens
cccaggctgcatgagtccatgg

SEQ ID NO: 8195744 - DNA, 22 bp, Homo sapiens
cccaggaggtggagcttgcagt

SEQ ID NO: 8195745 - DNA, 22 bp, Homo sapiens
cccaggaggtcgaagctgcagt

SEQ ID NO: 8195746 - DNA, 23 bp, Homo sapiens
cccaggctacaaattatgctctg

SEQ ID NO: 8195747 - DNA, 23 bp, Homo sapiens
cccaggctacaaattatgctctg

SEQ ID NO: 8195748 - DNA, 23 bp, Homo sapiens
cccaggctacaaattatgctctg

SEQ ID NO: 8195749 - DNA, 22 bp, Homo sapiens
cccaggaggtggagcttgcagt

SEQ ID NO: 8195750 - DNA, 22 bp, Homo sapiens
cccaggaggtcaaggctgcagt

SEQ ID NO: 8195751 - DNA, 22 bp, Homo sapiens
cccaggaggtcaaggctgcagt

SEQ ID NO: 8195752 - DNA, 22 bp, Homo sapiens
cccaggaggtcgaagctgcagt

SEQ ID NO: 8195753 - DNA, 22 bp, Homo sapiens
cccaggaggtcgaagctgcagt

SEQ ID NO: 8195754 - DNA, 22 bp, Homo sapiens
cccaggaggtcgaagctgcagt

SEQ ID NO: 8195755 - DNA, 22 bp, Homo sapiens
ccctccattaaaacagacctat

SEQ ID NO: 8195756 - DNA, 22 bp, Homo sapiens
ccctcagctccaccctcagcag

SEQ ID NO: 8195757 - DNA, 22 bp, Homo sapiens
ccctcagctccaccctcagcag

SEQ ID NO: 8195758 - DNA, 22 bp, Homo sapiens
ccctccatgagtgtgctgctgg

SEQ ID NO: 8195759 - DNA, 22 bp, Homo sapiens
ccctccatgagtgtgctgctgg

SEQ ID NO: 8195760 - DNA, 22 bp, Homo sapiens
ccctccatgagtgtgctgctgg

SEQ ID NO: 8195761 - DNA, 22 bp, Homo sapiens
ccctcagctcaagcccctgtgc

SEQ ID NO: 8195762 - DNA, 22 bp, Homo sapiens
ccctcagctcaagcccctgtgc

SEQ ID NO: 8195763 - DNA, 22 bp, Homo sapiens
ccctcagagcctgaagcaagca

SEQ ID NO: 8195764 - DNA, 22 bp, Homo sapiens
ccctcagctccaccctcagcag

SEQ ID NO: 8195765 - DNA, 22 bp, Homo sapiens
ccctcagctccaccctcagcag

SEQ ID NO: 8195766 - DNA, 22 bp, Homo sapiens
ccctcagctccaccctcagcag

SEQ ID NO: 8195767 - DNA, 22 bp, Homo sapiens
ccctccattaaaacagacctat

SEQ ID NO: 8195768 - DNA, 22 bp, Homo sapiens
ccctcccaagcactctgacata

SEQ ID NO: 8195769 - DNA, 22 bp, Homo sapiens
ccctcccaagcactctgacata

SEQ ID NO: 8195770 - DNA, 22 bp, Homo sapiens
ccctcccaagcactctgacata

SEQ ID NO: 8195771 - DNA, 20 bp, Homo sapiens
ccctcccagatgcttcccaa

SEQ ID NO: 8195772 - DNA, 20 bp, Homo sapiens
ccctcccagatgcttcccaa

SEQ ID NO: 8195773 - DNA, 20 bp, Homo sapiens
ccctcccagatgcttcccaa

SEQ ID NO: 8195774 - DNA, 22 bp, Homo sapiens
ccctgccagatgtgcttcagtt

SEQ ID NO: 8195775 - DNA, 17 bp, Homo sapiens
ccctgccaccaggaagc

SEQ ID NO: 8195776 - DNA, 18 bp, Homo sapiens
ccctgccagctcccagca

SEQ ID NO: 8195777 - DNA, 18 bp, Homo sapiens
ccctgccagctcccagca

SEQ ID NO: 8195778 - DNA, 18 bp, Homo sapiens
ccctgccagctcccagca

SEQ ID NO: 8195779 - DNA, 22 bp, Homo sapiens
ccctgccaatcccgtctctctg

SEQ ID NO: 8195780 - DNA, 23 bp, Homo sapiens
ccctgcatctgtccctcaccagt

SEQ ID NO: 8195781 - DNA, 22 bp, Homo sapiens
ccctgatgttttctctgccttt

SEQ ID NO: 8195782 - DNA, 22 bp, Homo sapiens
ccctcccaggagtggccagaga

SEQ ID NO: 8195783 - DNA, 22 bp, Homo sapiens
ccctcccaggagtggccagaga

SEQ ID NO: 8195784 - DNA, 22 bp, Homo sapiens
ccctgatggcacagtggcaggc

SEQ ID NO: 8195785 - DNA, 22 bp, Homo sapiens
ccctgccccaggcggcttcact

SEQ ID NO: 8195786 - DNA, 22 bp, Homo sapiens
ccctgccccaggcggcttcact

SEQ ID NO: 8195787 - DNA, 22 bp, Homo sapiens
ccctgccccaggcggcttcact

SEQ ID NO: 8195788 - DNA, 23 bp, Homo sapiens
ccctgcccattgagcaggacgtc

SEQ ID NO: 8195789 - DNA, 23 bp, Homo sapiens
ccctgcccattgagcaggacgtc

SEQ ID NO: 8195790 - DNA, 21 bp, Homo sapiens
ccctgccctcaaggacagtgc

SEQ ID NO: 8195791 - DNA, 21 bp, Homo sapiens
ccctgccctcaaggacagtgc

SEQ ID NO: 8195792 - DNA, 22 bp, Homo sapiens
ccctgccccaggcggcttcact

SEQ ID NO: 8195793 - DNA, 22 bp, Homo sapiens
ccctgccctggagacacttaaa

SEQ ID NO: 8195794 - DNA, 22 bp, Homo sapiens
ccctgccctggagacacttaaa

SEQ ID NO: 8195795 - DNA, 21 bp, Homo sapiens
ccctgccctcaaggacagtgc

SEQ ID NO: 8195796 - DNA, 22 bp, Homo sapiens
ccctgcccaccacatgctggga

SEQ ID NO: 8195797 - DNA, 22 bp, Homo sapiens
ccctgcccaccacatgctggga

SEQ ID NO: 8195798 - DNA, 22 bp, Homo sapiens
ccctgcccatcggggcggcctg

SEQ ID NO: 8195799 - DNA, 22 bp, Homo sapiens
ccctgcccatcggggcggcctg

SEQ ID NO: 8195800 - DNA, 22 bp, Homo sapiens
ccctgcccatcggggcggcctg

SEQ ID NO: 8195801 - DNA, 22 bp, Homo sapiens
ccctgccctgggcagaagtggg

SEQ ID NO: 8195802 - DNA, 22 bp, Homo sapiens
ccctgccctgggcagaagtggg

SEQ ID NO: 8195803 - DNA, 19 bp, Homo sapiens
ccctgccctggtgactggg

SEQ ID NO: 8195804 - DNA, 19 bp, Homo sapiens
ccctgccctggtgactggg

SEQ ID NO: 8195805 - DNA, 22 bp, Homo sapiens
ccctgctgccttcacccaggac

SEQ ID NO: 8195806 - DNA, 22 bp, Homo sapiens
ccctgctgtccctcagtcctgc

SEQ ID NO: 8195807 - DNA, 22 bp, Homo sapiens
ccctgctgtccctcagtcctgc

SEQ ID NO: 8195808 - DNA, 22 bp, Homo sapiens
cccatgagattctgaatttggc

SEQ ID NO: 8195809 - DNA, 22 bp, Homo sapiens
cccatggggacaccatgaagga

SEQ ID NO: 8195810 - DNA, 22 bp, Homo sapiens
ccccagaagtttgcacaagaga

SEQ ID NO: 8195811 - DNA, 22 bp, Homo sapiens
ccccagagaaagtcagcagcat

SEQ ID NO: 8195812 - DNA, 22 bp, Homo sapiens
cccatgtggtaccttctgtgga

SEQ ID NO: 8195813 - DNA, 22 bp, Homo sapiens
ccccacttgctcagcatgtcca

SEQ ID NO: 8195814 - DNA, 22 bp, Homo sapiens
ccccactttgagtagcacttga

SEQ ID NO: 8195815 - DNA, 22 bp, Homo sapiens
ccccagaaggggacagagggta

SEQ ID NO: 8195816 - DNA, 22 bp, Homo sapiens
ccctaggctgggctcttggctt

SEQ ID NO: 8195817 - DNA, 22 bp, Homo sapiens
ccctaggctgaggccagggtgc

SEQ ID NO: 8195818 - DNA, 22 bp, Homo sapiens
ccctaggctgggctcttggctt

SEQ ID NO: 8195819 - DNA, 22 bp, Homo sapiens
ccctaggctgggctcttggctt

SEQ ID NO: 8195820 - DNA, 22 bp, Homo sapiens
ccctaggctgggctcttggctt

SEQ ID NO: 8195821 - DNA, 22 bp, Homo sapiens
ccctaggctgaggccagggtgc

SEQ ID NO: 8195822 - DNA, 22 bp, Homo sapiens
ccctaggcccaaagggtgacat

SEQ ID NO: 8195823 - DNA, 22 bp, Homo sapiens
ccccttccacagtgcttcctaa

SEQ ID NO: 8195824 - DNA, 22 bp, Homo sapiens
ccccagcacttggagtggggag

SEQ ID NO: 8195825 - DNA, 22 bp, Homo sapiens
ccccagcactctgactcttacc

SEQ ID NO: 8195826 - DNA, 22 bp, Homo sapiens
ccccagcactaccagaagccag

SEQ ID NO: 8195827 - DNA, 21 bp, Homo sapiens
ccccagcaccttgccagcctg

SEQ ID NO: 8195828 - DNA, 22 bp, Homo sapiens
ccccagcacaggctcctcagat

SEQ ID NO: 8195829 - DNA, 22 bp, Homo sapiens
ccccagataggttcatgcccta

SEQ ID NO: 8195830 - DNA, 22 bp, Homo sapiens
ccctagggtttggccagagccc

SEQ ID NO: 8195831 - DNA, 22 bp, Homo sapiens
ccctagggtttggccagagccc

SEQ ID NO: 8195832 - DNA, 22 bp, Homo sapiens
ccctagggctaagcaggactgc

SEQ ID NO: 8195833 - DNA, 19 bp, Homo sapiens
ccctaggggctcctgaggg

SEQ ID NO: 8195834 - DNA, 22 bp, Homo sapiens
ccctaggggcaatgatggtgct

SEQ ID NO: 8195835 - DNA, 22 bp, Homo sapiens
ccctaggggcaatgatggtgct

SEQ ID NO: 8195836 - DNA, 17 bp, Homo sapiens
ccctcactcctgccggg

SEQ ID NO: 8195837 - DNA, 22 bp, Homo sapiens
ccctcactctgcctcctggggt

SEQ ID NO: 8195838 - DNA, 22 bp, Homo sapiens
ccctcacttcacgctctgcaga

SEQ ID NO: 8195839 - DNA, 22 bp, Homo sapiens
ccctcacttcacgctctgcaga

SEQ ID NO: 8195840 - DNA, 22 bp, Homo sapiens
ccctcacagtctaggagcagct

SEQ ID NO: 8195841 - DNA, 22 bp, Homo sapiens
ccctcaccaggctccaggcatg

SEQ ID NO: 8195842 - DNA, 22 bp, Homo sapiens
ccagctggaaacaaatagagtg

SEQ ID NO: 8195843 - DNA, 22 bp, Homo sapiens
ccagctggaacggcagcccagc

SEQ ID NO: 8195844 - DNA, 22 bp, Homo sapiens
ccagctggagccaaggtggact

SEQ ID NO: 8195845 - DNA, 22 bp, Homo sapiens
ccagctggagctcgcagatagg

SEQ ID NO: 8195846 - DNA, 22 bp, Homo sapiens
ccagctggagctcgcagatagg

SEQ ID NO: 8195847 - DNA, 22 bp, Homo sapiens
ccagctggaagagtgcagaact

SEQ ID NO: 8195848 - DNA, 22 bp, Homo sapiens
ccagctggaagagtgcagaact

SEQ ID NO: 8195849 - DNA, 22 bp, Homo sapiens
ccagctggaagagtgcagaact

SEQ ID NO: 8195850 - DNA, 22 bp, Homo sapiens
ccagctggagctcgcagatagg

SEQ ID NO: 8195851 - DNA, 22 bp, Homo sapiens
ccagctggcactgtggctgccc

SEQ ID NO: 8195852 - DNA, 22 bp, Homo sapiens
ccagctggcactgtggctgccc

SEQ ID NO: 8195853 - DNA, 22 bp, Homo sapiens
ccagctggcactgtggctgccc

SEQ ID NO: 8195854 - DNA, 22 bp, Homo sapiens
ccagctggcaggagagtcaggg

SEQ ID NO: 8195855 - DNA, 22 bp, Homo sapiens
ccagctggcaggagagtcaggg

SEQ ID NO: 8195856 - DNA, 22 bp, Homo sapiens
ccagctggcaggagagtcaggg

SEQ ID NO: 8195857 - DNA, 22 bp, Homo sapiens
aggcctctgggcctgcgggttt

SEQ ID NO: 8195858 - DNA, 22 bp, Homo sapiens
aggcctctggaggtggcagtgt

SEQ ID NO: 8195859 - DNA, 22 bp, Homo sapiens
aggcctgctgtcttgaggccaa

SEQ ID NO: 8195860 - DNA, 22 bp, Homo sapiens
ccagctggcccagctgtgctcc

SEQ ID NO: 8195861 - DNA, 22 bp, Homo sapiens
ccagctggcccagctgtgctcc

SEQ ID NO: 8195862 - DNA, 22 bp, Homo sapiens
ccagctggcccagctgtgctcc

SEQ ID NO: 8195863 - DNA, 22 bp, Homo sapiens
ccagctggcccagctgtgctcc

SEQ ID NO: 8195864 - DNA, 22 bp, Homo sapiens
aggcctctgctggaaagagttg

SEQ ID NO: 8195865 - DNA, 17 bp, Homo sapiens
aggcctctgccggtgcc

SEQ ID NO: 8195866 - DNA, 22 bp, Homo sapiens
ccagcaggagactagcaacata

SEQ ID NO: 8195867 - DNA, 22 bp, Homo sapiens
ccagcaggagactagcaacata

SEQ ID NO: 8195868 - DNA, 22 bp, Homo sapiens
ccagcaggagatgcctgtgtct

SEQ ID NO: 8195869 - DNA, 22 bp, Homo sapiens
ccagcaggagagaacatttccc

SEQ ID NO: 8195870 - DNA, 22 bp, Homo sapiens
ccagcaggagagaacatttccc

SEQ ID NO: 8195871 - DNA, 22 bp, Homo sapiens
ccagcaggagatgcctgtgtct

SEQ ID NO: 8195872 - DNA, 22 bp, Homo sapiens
ccagcaggagatgcctgtgtct

SEQ ID NO: 8195873 - DNA, 22 bp, Homo sapiens
ccagcaggcagtcatatccttt

SEQ ID NO: 8195874 - DNA, 22 bp, Homo sapiens
ccagcaggcagtcatatccttt

SEQ ID NO: 8195875 - DNA, 23 bp, Homo sapiens
ccagctccgtgagcctcgggctc

SEQ ID NO: 8195876 - DNA, 23 bp, Homo sapiens
ccagctccgtgagcctcgggctc

SEQ ID NO: 8195877 - DNA, 23 bp, Homo sapiens
ccagctccgtgagcctcgggctc

SEQ ID NO: 8195878 - DNA, 21 bp, Homo sapiens
ccagctctgcctccagttggt

SEQ ID NO: 8195879 - DNA, 22 bp, Homo sapiens
ccagctctggcttcttgctggg

SEQ ID NO: 8195880 - DNA, 22 bp, Homo sapiens
ccagctctgcttgcccagtcag

SEQ ID NO: 8195881 - DNA, 22 bp, Homo sapiens
ccagctctgcttgcccagtcag

SEQ ID NO: 8195882 - DNA, 22 bp, Homo sapiens
ccagctctgtaagctgtgaaat

SEQ ID NO: 8195883 - DNA, 22 bp, Homo sapiens
ccagctcttttggctgagtgag

SEQ ID NO: 8195884 - DNA, 22 bp, Homo sapiens
ccagctcttttggctgagtgag

SEQ ID NO: 8195885 - DNA, 22 bp, Homo sapiens
ccagctcttggtgcacttacat

SEQ ID NO: 8195886 - DNA, 22 bp, Homo sapiens
aggcctgggacgggagccgtga

SEQ ID NO: 8195887 - DNA, 22 bp, Homo sapiens
aggcctgggacgggagccgtga

SEQ ID NO: 8195888 - DNA, 22 bp, Homo sapiens
aggcctgggacgggagccgtga

SEQ ID NO: 8195889 - DNA, 22 bp, Homo sapiens
ccaggaaggcaggcctccccgc

SEQ ID NO: 8195890 - DNA, 22 bp, Homo sapiens
ccaggaaggcaggcctccccgc

SEQ ID NO: 8195891 - DNA, 22 bp, Homo sapiens
aggcctgggacgggagccgtga

SEQ ID NO: 8195892 - DNA, 18 bp, Homo sapiens
aggcctgggaagctgagg

SEQ ID NO: 8195893 - DNA, 18 bp, Homo sapiens
aggcctgggaagctgagg

SEQ ID NO: 8195894 - DNA, 22 bp, Homo sapiens
ccaggaaggcctggatgccccc

SEQ ID NO: 8195895 - DNA, 22 bp, Homo sapiens
ccaggaaggcaggcctccccgc

SEQ ID NO: 8195896 - DNA, 22 bp, Homo sapiens
ccaggaaggcctggatgccccc

SEQ ID NO: 8195897 - DNA, 22 bp, Homo sapiens
ccaggaaggcctggatgccccc

SEQ ID NO: 8195898 - DNA, 22 bp, Homo sapiens
ccaggaaggcctggatgccccc

SEQ ID NO: 8195899 - DNA, 22 bp, Homo sapiens
ccaggaaggcctggatgccccc

SEQ ID NO: 8195900 - DNA, 22 bp, Homo sapiens
ccaggaaggcgttgttcctctc

SEQ ID NO: 8195901 - DNA, 22 bp, Homo sapiens
ccaggaaggcgttgttcctctc

SEQ ID NO: 8195902 - DNA, 22 bp, Homo sapiens
ccaggaaggcgttgttcctctc

SEQ ID NO: 8195903 - DNA, 22 bp, Homo sapiens
ccaggaaggtatgggaagaaaa

SEQ ID NO: 8195904 - DNA, 22 bp, Homo sapiens
ccaggaaggtatgggaagaaaa

SEQ ID NO: 8195905 - DNA, 22 bp, Homo sapiens
ccaggaagggctctttaaagac

SEQ ID NO: 8195906 - DNA, 22 bp, Homo sapiens
ccaggaagggctctttaaagac

SEQ ID NO: 8195907 - DNA, 22 bp, Homo sapiens
ccaggaaggcgttgttcctctc

SEQ ID NO: 8195908 - DNA, 22 bp, Homo sapiens
aggcctggcatgagacctgaga

SEQ ID NO: 8195909 - DNA, 22 bp, Homo sapiens
aggcctggcatgagacctgaga

SEQ ID NO: 8195910 - DNA, 22 bp, Homo sapiens
aggcctggcatgagacctgaga

SEQ ID NO: 8195911 - DNA, 22 bp, Homo sapiens
aggcctgctgtcttgaggccaa

SEQ ID NO: 8195912 - DNA, 22 bp, Homo sapiens
aggcctgctgtgtagcctgttg

SEQ ID NO: 8195913 - DNA, 22 bp, Homo sapiens
aggcctggcatgagacctgaga

SEQ ID NO: 8195914 - DNA, 22 bp, Homo sapiens
aggcctggccccagttgctagg

SEQ ID NO: 8195915 - DNA, 22 bp, Homo sapiens
aggcctggccccagttgctagg

SEQ ID NO: 8195916 - DNA, 22 bp, Homo sapiens
aggcctggccccagttgctagg

SEQ ID NO: 8195917 - DNA, 22 bp, Homo sapiens
aggcctggcctttatgttcaag

SEQ ID NO: 8195918 - DNA, 22 bp, Homo sapiens
aggcctggctttggtttgctga

SEQ ID NO: 8195919 - DNA, 22 bp, Homo sapiens
aggcctggctttggtttgctga

SEQ ID NO: 8195920 - DNA, 22 bp, Homo sapiens
aggcctggcctgggcggcattg

SEQ ID NO: 8195921 - DNA, 22 bp, Homo sapiens
aggcctggcctgggcggcattg

SEQ ID NO: 8195922 - DNA, 22 bp, Homo sapiens
aggcctggcctgggcggcattg

SEQ ID NO: 8195923 - DNA, 22 bp, Homo sapiens
aggcctggcctgggcggcattg

SEQ ID NO: 8195924 - DNA, 22 bp, Homo sapiens
aggcctggcctttatgttcaag

SEQ ID NO: 8195925 - DNA, 22 bp, Homo sapiens
aggcgctgtgcttggggctgga

SEQ ID NO: 8195926 - DNA, 22 bp, Homo sapiens
aggcgctgtgcttggggctgga

SEQ ID NO: 8195927 - DNA, 22 bp, Homo sapiens
aggcgctgtgcttggggctgga

SEQ ID NO: 8195928 - DNA, 22 bp, Homo sapiens
aggcgctgcgctggggccagaa

SEQ ID NO: 8195929 - DNA, 22 bp, Homo sapiens
aggcgctgcgctggggccagaa

SEQ ID NO: 8195930 - DNA, 22 bp, Homo sapiens
aggcgtgggaggatctgaggcc

SEQ ID NO: 8195931 - DNA, 22 bp, Homo sapiens
aggcgtgggaggatctgaggcc

SEQ ID NO: 8195932 - DNA, 22 bp, Homo sapiens
ccaggaagtatgacccaacaga

SEQ ID NO: 8195933 - DNA, 22 bp, Homo sapiens
ccaggaagtatgacccaacaga

SEQ ID NO: 8195934 - DNA, 22 bp, Homo sapiens
ccaggaagtatgacccaacaga

SEQ ID NO: 8195935 - DNA, 22 bp, Homo sapiens
ccaggacaagccagagggacag

SEQ ID NO: 8195936 - DNA, 22 bp, Homo sapiens
ccaggaaggtatgggaagaaaa

SEQ ID NO: 8195937 - DNA, 22 bp, Homo sapiens
ccaggaaggtatgggaagaaaa

SEQ ID NO: 8195938 - DNA, 22 bp, Homo sapiens
ccaggaaggtgtttaactagag

SEQ ID NO: 8195939 - DNA, 22 bp, Homo sapiens
ccaggaaggtgtttaactagag

SEQ ID NO: 8195940 - DNA, 22 bp, Homo sapiens
aggcgctgcatgtgaaggagtt

SEQ ID NO: 8195941 - DNA, 22 bp, Homo sapiens
aggcgctgcatgtgaaggagtt

SEQ ID NO: 8195942 - DNA, 22 bp, Homo sapiens
ccaggacaagccagagggacag

SEQ ID NO: 8195943 - DNA, 22 bp, Homo sapiens
ccaggacaagccagagggacag

SEQ ID NO: 8195944 - DNA, 22 bp, Homo sapiens
ccagagaaaaatgtgtccctgt

SEQ ID NO: 8195945 - DNA, 22 bp, Homo sapiens
ccagagaaaaatgtgtccctgt

SEQ ID NO: 8195946 - DNA, 22 bp, Homo sapiens
ccagacttttagtagtgagtta

SEQ ID NO: 8195947 - DNA, 22 bp, Homo sapiens
ccagactgtggagttcctggtg

SEQ ID NO: 8195948 - DNA, 22 bp, Homo sapiens
ccagagaaaagaggccaaggat

SEQ ID NO: 8195949 - DNA, 22 bp, Homo sapiens
aggccacaagaaaatgcttcat

SEQ ID NO: 8195950 - DNA, 22 bp, Homo sapiens
aggccacaagaaaatgcttcat

SEQ ID NO: 8195951 - DNA, 22 bp, Homo sapiens
aggccacagtactttgcagacc

SEQ ID NO: 8195952 - DNA, 22 bp, Homo sapiens
aggccacagtcagtgggtgctg

SEQ ID NO: 8195953 - DNA, 22 bp, Homo sapiens
aggccacaagaactaccccatc

SEQ ID NO: 8195954 - DNA, 22 bp, Homo sapiens
aggccacagtactttgcagacc

SEQ ID NO: 8195955 - DNA, 22 bp, Homo sapiens
aggccacagttgaggccagcaa

SEQ ID NO: 8195956 - DNA, 22 bp, Homo sapiens
aggccacagttgaggccagcaa

SEQ ID NO: 8195957 - DNA, 22 bp, Homo sapiens
aggccacagtcagtgggtgctg

SEQ ID NO: 8195958 - DNA, 22 bp, Homo sapiens
aggccacagtcagtgggtgctg

SEQ ID NO: 8195959 - DNA, 22 bp, Homo sapiens
ccagaccctttcttggcatgtg

SEQ ID NO: 8195960 - DNA, 22 bp, Homo sapiens
ccagaccctgctctggggctct

SEQ ID NO: 8195961 - DNA, 22 bp, Homo sapiens
ccagacctaagcatcagtgcat

SEQ ID NO: 8195962 - DNA, 22 bp, Homo sapiens
ccagacctaagcatcagtgcat

SEQ ID NO: 8195963 - DNA, 22 bp, Homo sapiens
ccagacctgcaaggctgagagg

SEQ ID NO: 8195964 - DNA, 22 bp, Homo sapiens
ccagactgcttgcttcccagcc

SEQ ID NO: 8195965 - DNA, 21 bp, Homo sapiens
ccagactggcctatgtggtag

SEQ ID NO: 8195966 - DNA, 22 bp, Homo sapiens
ccagaccaccctggccatgcac

SEQ ID NO: 8195967 - DNA, 22 bp, Homo sapiens
ccagaccagactgacttgagcc

SEQ ID NO: 8195968 - DNA, 22 bp, Homo sapiens
ccagaccctccattcaagctcc

SEQ ID NO: 8195969 - DNA, 22 bp, Homo sapiens
ccagaccctgctctggggctct

SEQ ID NO: 8195970 - DNA, 22 bp, Homo sapiens
ccagaccctccattcaagctcc

SEQ ID NO: 8195971 - DNA, 22 bp, Homo sapiens
ccagacatgtgcccttgaggaa

SEQ ID NO: 8195972 - DNA, 22 bp, Homo sapiens
ccagacagttccttgaggttca

SEQ ID NO: 8195973 - DNA, 22 bp, Homo sapiens
ccagaagaccggggagtcaggg

SEQ ID NO: 8195974 - DNA, 22 bp, Homo sapiens
ccagaaatggccctagtcagag

SEQ ID NO: 8195975 - DNA, 22 bp, Homo sapiens
ccagaacagacctgcctgacct

SEQ ID NO: 8195976 - DNA, 22 bp, Homo sapiens
ccagaaatcctctctttcttgc

SEQ ID NO: 8195977 - DNA, 22 bp, Homo sapiens
ccagaaagttcagctgtgaatg

SEQ ID NO: 8195978 - DNA, 22 bp, Homo sapiens
ccagaagaaaaagctggtatta

SEQ ID NO: 8195979 - DNA, 22 bp, Homo sapiens
ccagaactgagaaaataaattt

SEQ ID NO: 8195980 - DNA, 22 bp, Homo sapiens
ccagaagaacttaattcaaaac

SEQ ID NO: 8195981 - DNA, 18 bp, Homo sapiens
aggcaggctggagtgact

SEQ ID NO: 8195982 - DNA, 18 bp, Homo sapiens
aggcaggctggagtgact

SEQ ID NO: 8195983 - DNA, 22 bp, Homo sapiens
aggcaggctgctatggagtaga

SEQ ID NO: 8195984 - DNA, 22 bp, Homo sapiens
ccagaaagactttttaggtacg

SEQ ID NO: 8195985 - DNA, 22 bp, Homo sapiens
ccagaaagactttttaggtacg

SEQ ID NO: 8195986 - DNA, 22 bp, Homo sapiens
ccagaaagataggaaatcaagt

SEQ ID NO: 8195987 - DNA, 22 bp, Homo sapiens
ccagaaagataggaaatcaagt

SEQ ID NO: 8195988 - DNA, 22 bp, Homo sapiens
ccagaaagactttttaggtacg

SEQ ID NO: 8195989 - DNA, 22 bp, Homo sapiens
ccagaaacacctggattctgtt

SEQ ID NO: 8195990 - DNA, 22 bp, Homo sapiens
ccagaaaatgcagaacatagaa

SEQ ID NO: 8195991 - DNA, 22 bp, Homo sapiens
ccagaaacagatgacaagccct

SEQ ID NO: 8195992 - DNA, 22 bp, Homo sapiens
ccagaaacagatgacaagccct

SEQ ID NO: 8195993 - DNA, 22 bp, Homo sapiens
ccagaaaatatggctaaggtga

SEQ ID NO: 8195994 - DNA, 19 bp, Homo sapiens
ccagcagctttgattctct

SEQ ID NO: 8195995 - DNA, 22 bp, Homo sapiens
ccagcaggaaagtgacgtttga

SEQ ID NO: 8195996 - DNA, 22 bp, Homo sapiens
ccagcaggactttggaaatatg

SEQ ID NO: 8195997 - DNA, 22 bp, Homo sapiens
ccagcaggaaagtgacgtttga

SEQ ID NO: 8195998 - DNA, 22 bp, Homo sapiens
ccagcaggactttggaaatatg

SEQ ID NO: 8195999 - DNA, 22 bp, Homo sapiens
ccagcaggactttggaaatatg

SEQ ID NO: 8196000 - DNA, 22 bp, Homo sapiens
aggccatgtggccccagagtct

SEQ ID NO: 8196001 - DNA, 23 bp, Homo sapiens
aggcccaactctgtgagggctgc

SEQ ID NO: 8196002 - DNA, 22 bp, Homo sapiens
aggcccaaaagaaaccactggg

SEQ ID NO: 8196003 - DNA, 22 bp, Homo sapiens
aggccatgaggtcatgggagat

SEQ ID NO: 8196004 - DNA, 22 bp, Homo sapiens
aggccatgtggccccagagtct

SEQ ID NO: 8196005 - DNA, 19 bp, Homo sapiens
ccagcagctttgattctct

SEQ ID NO: 8196006 - DNA, 22 bp, Homo sapiens
aggcccagagagccagttagtg

SEQ ID NO: 8196007 - DNA, 22 bp, Homo sapiens
aggccaggttcctcaatcttga

SEQ ID NO: 8196008 - DNA, 22 bp, Homo sapiens
aggccaggttcctcaatcttga

SEQ ID NO: 8196009 - DNA, 22 bp, Homo sapiens
aggccaggtggtcatgcttgct

SEQ ID NO: 8196010 - DNA, 22 bp, Homo sapiens
aggccaggtggtcatgcttgct

SEQ ID NO: 8196011 - DNA, 22 bp, Homo sapiens
aggccaggcaacattctgaagt

SEQ ID NO: 8196012 - DNA, 22 bp, Homo sapiens
aggccaggcaacattctgaagt

SEQ ID NO: 8196013 - DNA, 22 bp, Homo sapiens
aggccaggatagcatggatcag

SEQ ID NO: 8196014 - DNA, 22 bp, Homo sapiens
aggccagttgttcagtgggccg

SEQ ID NO: 8196015 - DNA, 22 bp, Homo sapiens
aggccagttgttcagtgggccg

SEQ ID NO: 8196016 - DNA, 22 bp, Homo sapiens
aggccagtgtggctggagcaca

SEQ ID NO: 8196017 - DNA, 22 bp, Homo sapiens
aggccatattaattacacagga

SEQ ID NO: 8196018 - DNA, 22 bp, Homo sapiens
aggccagttgttcagtgggccg

SEQ ID NO: 8196019 - DNA, 23 bp, Homo sapiens
aggccagtttttcctgcttgctg

SEQ ID NO: 8196020 - DNA, 22 bp, Homo sapiens
aggccagtgcctttccagggct

SEQ ID NO: 8196021 - DNA, 22 bp, Homo sapiens
aggccagtggttctctgtgtcc

SEQ ID NO: 8196022 - DNA, 22 bp, Homo sapiens
aggccagtgtggctggagcaca

SEQ ID NO: 8196023 - DNA, 22 bp, Homo sapiens
aggccagtgcctttccagggct

SEQ ID NO: 8196024 - DNA, 22 bp, Homo sapiens
aggccagtgccatcagggtttt

SEQ ID NO: 8196025 - DNA, 22 bp, Homo sapiens
aggccagtgcagctggaacaga

SEQ ID NO: 8196026 - DNA, 22 bp, Homo sapiens
aggccagtgcagctggaacaga

SEQ ID NO: 8196027 - DNA, 22 bp, Homo sapiens
aggccagtgcagctggaacaga

SEQ ID NO: 8196028 - DNA, 22 bp, Homo sapiens
ccagagctaaacacacaggctg

SEQ ID NO: 8196029 - DNA, 17 bp, Homo sapiens
ccagagctactgagact

SEQ ID NO: 8196030 - DNA, 22 bp, Homo sapiens
ccagagctaaacacacaggctg

SEQ ID NO: 8196031 - DNA, 22 bp, Homo sapiens
ccagagctccagggctacagaa

SEQ ID NO: 8196032 - DNA, 22 bp, Homo sapiens
ccagagctccagggctacagaa

SEQ ID NO: 8196033 - DNA, 22 bp, Homo sapiens
ccagagctccagggctacagaa

SEQ ID NO: 8196034 - DNA, 22 bp, Homo sapiens
ccagagctccagggctacagaa

SEQ ID NO: 8196035 - DNA, 22 bp, Homo sapiens
ccagagctccagggctacagaa

SEQ ID NO: 8196036 - DNA, 22 bp, Homo sapiens
ccagagctgaggagatgggctt

SEQ ID NO: 8196037 - DNA, 22 bp, Homo sapiens
ccagagctgaggagatgggctt

SEQ ID NO: 8196038 - DNA, 22 bp, Homo sapiens
ccagagctgagggagcctgagc

SEQ ID NO: 8196039 - DNA, 22 bp, Homo sapiens
ccagagctgagggagcctgagc

SEQ ID NO: 8196040 - DNA, 22 bp, Homo sapiens
ccagagctccagggctacagaa

SEQ ID NO: 8196041 - DNA, 22 bp, Homo sapiens
ccagagctccagggctacagaa

SEQ ID NO: 8196042 - DNA, 23 bp, Homo sapiens
ccagagctctttcatgcttccat

SEQ ID NO: 8196043 - DNA, 22 bp, Homo sapiens
aggccacatagcttgcatgtag

SEQ ID NO: 8196044 - DNA, 22 bp, Homo sapiens
aggccacatagcttgcatgtag

SEQ ID NO: 8196045 - DNA, 22 bp, Homo sapiens
aggccacatagcttgcatgtag

SEQ ID NO: 8196046 - DNA, 22 bp, Homo sapiens
aggccacagttgaggccagcaa

SEQ ID NO: 8196047 - DNA, 22 bp, Homo sapiens
aggccagaaaaagacagctcca

SEQ ID NO: 8196048 - DNA, 22 bp, Homo sapiens
aggccacggcgggtggattact

SEQ ID NO: 8196049 - DNA, 22 bp, Homo sapiens
aggccacattgtgattcccgca

SEQ ID NO: 8196050 - DNA, 22 bp, Homo sapiens
aggccaccaccctatctcctgg

SEQ ID NO: 8196051 - DNA, 21 bp, Homo sapiens
ccagagcctgctgagccccct

SEQ ID NO: 8196052 - DNA, 22 bp, Homo sapiens
ccagagcctggcatctgcataa

SEQ ID NO: 8196053 - DNA, 22 bp, Homo sapiens
ccagagcctggcatctgcataa

SEQ ID NO: 8196054 - DNA, 22 bp, Homo sapiens
aggccagaaatgtcagggagtg

SEQ ID NO: 8196055 - DNA, 22 bp, Homo sapiens
aggccagaaatgtcagggagtg

SEQ ID NO: 8196056 - DNA, 22 bp, Homo sapiens
aggccagaaatgtcagggagtg

SEQ ID NO: 8196057 - DNA, 22 bp, Homo sapiens
aggccagaaatgtcagggagtg

SEQ ID NO: 8196058 - DNA, 22 bp, Homo sapiens
aggccagaaaaagacagctcca

SEQ ID NO: 8196059 - DNA, 22 bp, Homo sapiens
aggctggagtgcagtggcgtga

SEQ ID NO: 8196060 - DNA, 22 bp, Homo sapiens
aggctggagtgcagtggtgtga

SEQ ID NO: 8196061 - DNA, 22 bp, Homo sapiens
aggctggagtgcaatggcgtga

SEQ ID NO: 8196062 - DNA, 22 bp, Homo sapiens
aggctggagtacagtggctatt

SEQ ID NO: 8196063 - DNA, 22 bp, Homo sapiens
aggctggagtgcagttgcatga

SEQ ID NO: 8196064 - DNA, 22 bp, Homo sapiens
aggctggagtgctggagtgctg

SEQ ID NO: 8196065 - DNA, 22 bp, Homo sapiens
aggctggagtgtagcagtgcag

SEQ ID NO: 8196066 - DNA, 22 bp, Homo sapiens
aggctggagtgctggagtgctg

SEQ ID NO: 8196067 - DNA, 22 bp, Homo sapiens
aggctggagtgctggagtgctg

SEQ ID NO: 8196068 - DNA, 22 bp, Homo sapiens
aggctggagtgtgcagtggcgc

SEQ ID NO: 8196069 - DNA, 22 bp, Homo sapiens
aggctggagtgtagcagtgcag

SEQ ID NO: 8196070 - DNA, 22 bp, Homo sapiens
aggctggagtgtagcagtgcag

SEQ ID NO: 8196071 - DNA, 22 bp, Homo sapiens
aggctggagtgtagcagtgcag

SEQ ID NO: 8196072 - DNA, 22 bp, Homo sapiens
aggctggagtgtagcagtgcag

SEQ ID NO: 8196073 - DNA, 22 bp, Homo sapiens
aggctggcccacctcttgtctt

SEQ ID NO: 8196074 - DNA, 22 bp, Homo sapiens
aggctggcccacctcttgtctt

SEQ ID NO: 8196075 - DNA, 22 bp, Homo sapiens
aggctggcccacctcttgtctt

SEQ ID NO: 8196076 - DNA, 22 bp, Homo sapiens
aggctggcccacctcttgtctt

SEQ ID NO: 8196077 - DNA, 22 bp, Homo sapiens
aggctggccagtgctgcagtgg

SEQ ID NO: 8196078 - DNA, 22 bp, Homo sapiens
aggctggagtacagtggctatt

SEQ ID NO: 8196079 - DNA, 22 bp, Homo sapiens
aggctggagtacagtggctatt

SEQ ID NO: 8196080 - DNA, 22 bp, Homo sapiens
aggctggagtacagtggctatt

SEQ ID NO: 8196081 - DNA, 22 bp, Homo sapiens
aggctggagggcaatggcaaga

SEQ ID NO: 8196082 - DNA, 22 bp, Homo sapiens
aggctggagggcaatggcaaga

SEQ ID NO: 8196083 - DNA, 22 bp, Homo sapiens
aggctggaggtttgttgcggct

SEQ ID NO: 8196084 - DNA, 22 bp, Homo sapiens
aggctggagcaagggggcatat

SEQ ID NO: 8196085 - DNA, 22 bp, Homo sapiens
aggctggagagtgcagtggcgt

SEQ ID NO: 8196086 - DNA, 22 bp, Homo sapiens
aggctggagagtgcagtggcgt

SEQ ID NO: 8196087 - DNA, 22 bp, Homo sapiens
aggctggagcaagggggcatat

SEQ ID NO: 8196088 - DNA, 22 bp, Homo sapiens
aggctggagcaagggggcatat

SEQ ID NO: 8196089 - DNA, 22 bp, Homo sapiens
aggctggagcaagggggcatat

SEQ ID NO: 8196090 - DNA, 22 bp, Homo sapiens
aggctggagcaagggggcatat

SEQ ID NO: 8196091 - DNA, 22 bp, Homo sapiens
aggctggagagtgcagtggcgt

SEQ ID NO: 8196092 - DNA, 22 bp, Homo sapiens
aggctggagagtgcagtggcgt

SEQ ID NO: 8196093 - DNA, 22 bp, Homo sapiens
aggctggagagtgcagtggcgt

SEQ ID NO: 8196094 - DNA, 22 bp, Homo sapiens
aggctggagagtgcagtggcgt

SEQ ID NO: 8196095 - DNA, 22 bp, Homo sapiens
aggctggagagtgcagtggcgt

SEQ ID NO: 8196096 - DNA, 22 bp, Homo sapiens
aggctggagagtgcagtggcgt

SEQ ID NO: 8196097 - DNA, 22 bp, Homo sapiens
aggctggagacccgccaagaaa

SEQ ID NO: 8196098 - DNA, 22 bp, Homo sapiens
aggctggagacccgccaagaaa

SEQ ID NO: 8196099 - DNA, 19 bp, Homo sapiens
aggctggagacaccaggcc

SEQ ID NO: 8196100 - DNA, 22 bp, Homo sapiens
aggctggagacccgccaagaaa

SEQ ID NO: 8196101 - DNA, 22 bp, Homo sapiens
aggctggagacccgccaagaaa

SEQ ID NO: 8196102 - DNA, 22 bp, Homo sapiens
aggctggaaatcactagattcc

SEQ ID NO: 8196103 - DNA, 22 bp, Homo sapiens
aggctggaaagggaccagagtg

SEQ ID NO: 8196104 - DNA, 22 bp, Homo sapiens
aggctggaaagggaccagagtg

SEQ ID NO: 8196105 - DNA, 22 bp, Homo sapiens
aggctgctttcatggccgcccc

SEQ ID NO: 8196106 - DNA, 22 bp, Homo sapiens
aggctggaaagggaccagagtg

SEQ ID NO: 8196107 - DNA, 22 bp, Homo sapiens
aggctggaaagggaccagagtg

SEQ ID NO: 8196108 - DNA, 19 bp, Homo sapiens
aggctggagacaccaggcc

SEQ ID NO: 8196109 - DNA, 19 bp, Homo sapiens
aggctggagacaccaggcc

SEQ ID NO: 8196110 - DNA, 19 bp, Homo sapiens
aggctggagacaccaggcc

SEQ ID NO: 8196111 - DNA, 19 bp, Homo sapiens
aggctggagacaccaggcc

SEQ ID NO: 8196112 - DNA, 19 bp, Homo sapiens
aggctggagacaccaggcc

SEQ ID NO: 8196113 - DNA, 22 bp, Homo sapiens
aggctggacccgacacctgccc

SEQ ID NO: 8196114 - DNA, 19 bp, Homo sapiens
aggctggagacaccaggcc

SEQ ID NO: 8196115 - DNA, 22 bp, Homo sapiens
aggctggacccgacacctgccc

SEQ ID NO: 8196116 - DNA, 22 bp, Homo sapiens
aggctgcttcttgtccttggca

SEQ ID NO: 8196117 - DNA, 22 bp, Homo sapiens
aggctgcttcttgtccttggca

SEQ ID NO: 8196118 - DNA, 22 bp, Homo sapiens
aggctgcttcttgtccttggca

SEQ ID NO: 8196119 - DNA, 22 bp, Homo sapiens
aggctgctttttatttacaggt

SEQ ID NO: 8196120 - DNA, 22 bp, Homo sapiens
aggctgctttcatggccgcccc

SEQ ID NO: 8196121 - DNA, 22 bp, Homo sapiens
aggctgctttattcacaatagc

SEQ ID NO: 8196122 - DNA, 22 bp, Homo sapiens
aggctgcttccttacgtggctg

SEQ ID NO: 8196123 - DNA, 22 bp, Homo sapiens
aggctgcttccttacgtggctg

SEQ ID NO: 8196124 - DNA, 22 bp, Homo sapiens
aggctgcttccttacgtggctg

SEQ ID NO: 8196125 - DNA, 22 bp, Homo sapiens
aggctgctcagtagatggagct

SEQ ID NO: 8196126 - DNA, 22 bp, Homo sapiens
aggctgctctgcgaagtcagct

SEQ ID NO: 8196127 - DNA, 22 bp, Homo sapiens
aggctgcttcagctgcagggag

SEQ ID NO: 8196128 - DNA, 22 bp, Homo sapiens
ccaggtctgtcttcttagctca

SEQ ID NO: 8196129 - DNA, 19 bp, Homo sapiens
ccaggtctggggccagatt

SEQ ID NO: 8196130 - DNA, 22 bp, Homo sapiens
ccaggtcttcactttactgaag

SEQ ID NO: 8196131 - DNA, 22 bp, Homo sapiens
ccaggtctggcactggccagtc

SEQ ID NO: 8196132 - DNA, 22 bp, Homo sapiens
ccaggtctggcactggccagtc

SEQ ID NO: 8196133 - DNA, 19 bp, Homo sapiens
ccaggtctggggccagatt

SEQ ID NO: 8196134 - DNA, 19 bp, Homo sapiens
ccaggtctggggccagatt

SEQ ID NO: 8196135 - DNA, 22 bp, Homo sapiens
ccaggtctggcactggccagtc

SEQ ID NO: 8196136 - DNA, 22 bp, Homo sapiens
ccaggtctggaaccaccagggc

SEQ ID NO: 8196137 - DNA, 22 bp, Homo sapiens
ccaggtctggaaccaccagggc

SEQ ID NO: 8196138 - DNA, 22 bp, Homo sapiens
ccaggtgaggtaggtatggtag

SEQ ID NO: 8196139 - DNA, 22 bp, Homo sapiens
aggctgctcagtagatggagct

SEQ ID NO: 8196140 - DNA, 22 bp, Homo sapiens
aggctgctcagtagatggagct

SEQ ID NO: 8196141 - DNA, 22 bp, Homo sapiens
ccaggtcttgtttgacatcaat

SEQ ID NO: 8196142 - DNA, 21 bp, Homo sapiens
ccaggtcttggtccttggact

SEQ ID NO: 8196143 - DNA, 22 bp, Homo sapiens
ccaggtcttggcccccggacct

SEQ ID NO: 8196144 - DNA, 21 bp, Homo sapiens
ccaggtcttggtccttggact

SEQ ID NO: 8196145 - DNA, 22 bp, Homo sapiens
ccatttcactcttcctgaagga

SEQ ID NO: 8196146 - DNA, 22 bp, Homo sapiens
aggctggcggtgactgctctga

SEQ ID NO: 8196147 - DNA, 22 bp, Homo sapiens
aggctggcgtcaggggctgtac

SEQ ID NO: 8196148 - DNA, 22 bp, Homo sapiens
aggctggcgtcaggggctgtac

SEQ ID NO: 8196149 - DNA, 22 bp, Homo sapiens
aggctggcgtcaggggctgtac

SEQ ID NO: 8196150 - DNA, 22 bp, Homo sapiens
aggctggcgtcaggggctgtac

SEQ ID NO: 8196151 - DNA, 22 bp, Homo sapiens
ccatttatagatgtatttggct

SEQ ID NO: 8196152 - DNA, 22 bp, Homo sapiens
ccatttatagatgtatttggct

SEQ ID NO: 8196153 - DNA, 22 bp, Homo sapiens
ccatttatagatgtatttggct

SEQ ID NO: 8196154 - DNA, 22 bp, Homo sapiens
ccatttactagggagatctaga

SEQ ID NO: 8196155 - DNA, 22 bp, Homo sapiens
ccatttacattgtactctgtga

SEQ ID NO: 8196156 - DNA, 22 bp, Homo sapiens
aggctggccctactggctgcct

SEQ ID NO: 8196157 - DNA, 22 bp, Homo sapiens
aggctggcctatttctttatcg

SEQ ID NO: 8196158 - DNA, 22 bp, Homo sapiens
aggctggcctatttctttatcg

SEQ ID NO: 8196159 - DNA, 22 bp, Homo sapiens
aggctggcctatttctttatcg

SEQ ID NO: 8196160 - DNA, 17 bp, Homo sapiens
aggctggccttcacagt

SEQ ID NO: 8196161 - DNA, 17 bp, Homo sapiens
aggctggccttcacagt

SEQ ID NO: 8196162 - DNA, 17 bp, Homo sapiens
aggctggccttcacagt

SEQ ID NO: 8196163 - DNA, 17 bp, Homo sapiens
aggctggccttcacagt

SEQ ID NO: 8196164 - DNA, 22 bp, Homo sapiens
aggctggccctactggctgcct

SEQ ID NO: 8196165 - DNA, 22 bp, Homo sapiens
aggctggccctactggctgcct

SEQ ID NO: 8196166 - DNA, 22 bp, Homo sapiens
aggctggccctactggctgcct

SEQ ID NO: 8196167 - DNA, 22 bp, Homo sapiens
aggctggccctactggctgcct

SEQ ID NO: 8196168 - DNA, 22 bp, Homo sapiens
aggctggccctactggctgcct

SEQ ID NO: 8196169 - DNA, 17 bp, Homo sapiens
aggctggccttcacagt

SEQ ID NO: 8196170 - DNA, 22 bp, Homo sapiens
aggctggcgacatctggcgggc

SEQ ID NO: 8196171 - DNA, 17 bp, Homo sapiens
aggctggccttcacagt

SEQ ID NO: 8196172 - DNA, 22 bp, Homo sapiens
aggctggcgacatctggcgggc

SEQ ID NO: 8196173 - DNA, 22 bp, Homo sapiens
aggctggcgacatctggcgggc

SEQ ID NO: 8196174 - DNA, 22 bp, Homo sapiens
aggctggcgacatctggcgggc

SEQ ID NO: 8196175 - DNA, 22 bp, Homo sapiens
aggctggcgacatctggcgggc

SEQ ID NO: 8196176 - DNA, 22 bp, Homo sapiens
aggctggcgacatctggcgggc

SEQ ID NO: 8196177 - DNA, 22 bp, Homo sapiens
aggctggcggtgactgctctga

SEQ ID NO: 8196178 - DNA, 22 bp, Homo sapiens
aggctggcggtgactgctctga

SEQ ID NO: 8196179 - DNA, 22 bp, Homo sapiens
aggctggcggtgactgctctga

SEQ ID NO: 8196180 - DNA, 22 bp, Homo sapiens
aggctggcggtgactgctctga

SEQ ID NO: 8196181 - DNA, 22 bp, Homo sapiens
aggctgggctccgcccaactcc

SEQ ID NO: 8196182 - DNA, 22 bp, Homo sapiens
aggctgggaaggtaaagttgta

SEQ ID NO: 8196183 - DNA, 22 bp, Homo sapiens
aggctggggaattgaatttgct

SEQ ID NO: 8196184 - DNA, 20 bp, Homo sapiens
aggctggggtgttttgccca

SEQ ID NO: 8196185 - DNA, 22 bp, Homo sapiens
aggctgggtacctgtcatatgc

SEQ ID NO: 8196186 - DNA, 22 bp, Homo sapiens
aggctgggtacctgtcatatgc

SEQ ID NO: 8196187 - DNA, 22 bp, Homo sapiens
aggctggctggggatgcgtctt

SEQ ID NO: 8196188 - DNA, 22 bp, Homo sapiens
aggctgggaaggtaaagttgta

SEQ ID NO: 8196189 - DNA, 22 bp, Homo sapiens
aggctggctggggatgcgtctt

SEQ ID NO: 8196190 - DNA, 22 bp, Homo sapiens
aggctggctggggatgcgtctt

SEQ ID NO: 8196191 - DNA, 22 bp, Homo sapiens
aggctggctggggatgcgtctt

SEQ ID NO: 8196192 - DNA, 22 bp, Homo sapiens
ccattttattagtgacatttag

SEQ ID NO: 8196193 - DNA, 22 bp, Homo sapiens
ccatttgttgtgtattaatatt

SEQ ID NO: 8196194 - DNA, 22 bp, Homo sapiens
ccatttgttgtgtattaatatt

SEQ ID NO: 8196195 - DNA, 22 bp, Homo sapiens
ccatttgtggtttatttgctct

SEQ ID NO: 8196196 - DNA, 22 bp, Homo sapiens
ccatttgtgatgtggcagcatc

SEQ ID NO: 8196197 - DNA, 22 bp, Homo sapiens
ccatttgtgcttcttcaaagca

SEQ ID NO: 8196198 - DNA, 22 bp, Homo sapiens
ccagggctgggtttgtcggtgt

SEQ ID NO: 8196199 - DNA, 22 bp, Homo sapiens
ccagggctgggtttgtcggtgt

SEQ ID NO: 8196200 - DNA, 22 bp, Homo sapiens
ccagggctgggtttgtcggtgt

SEQ ID NO: 8196201 - DNA, 22 bp, Homo sapiens
ccagggctggtggctgcagagg

SEQ ID NO: 8196202 - DNA, 22 bp, Homo sapiens
ccagggctggtggctgcagagg

SEQ ID NO: 8196203 - DNA, 22 bp, Homo sapiens
ccagggctggtggctgcagagg

SEQ ID NO: 8196204 - DNA, 22 bp, Homo sapiens
ccagggctggtgggagatgctg

SEQ ID NO: 8196205 - DNA, 22 bp, Homo sapiens
ccagggctggtgggagatgctg

SEQ ID NO: 8196206 - DNA, 22 bp, Homo sapiens
ccagggctggtggctgcagagg

SEQ ID NO: 8196207 - DNA, 22 bp, Homo sapiens
ccagggctggtggctgcagagg

SEQ ID NO: 8196208 - DNA, 22 bp, Homo sapiens
aggctgaggatcgtactttcca

SEQ ID NO: 8196209 - DNA, 22 bp, Homo sapiens
aggctgaggatcgtactttcca

SEQ ID NO: 8196210 - DNA, 22 bp, Homo sapiens
aggctgaggatccctgtgttct

SEQ ID NO: 8196211 - DNA, 22 bp, Homo sapiens
aggctgaggatccctgtgttct

SEQ ID NO: 8196212 - DNA, 22 bp, Homo sapiens
aggctgaggatccctgtgttct

SEQ ID NO: 8196213 - DNA, 22 bp, Homo sapiens
aggctgagctgacctggtttgg

SEQ ID NO: 8196214 - DNA, 22 bp, Homo sapiens
ccagggctggtgggagatgctg

SEQ ID NO: 8196215 - DNA, 22 bp, Homo sapiens
ccagggctggtgggagatgctg

SEQ ID NO: 8196216 - DNA, 22 bp, Homo sapiens
aggctgagctgacctggtttgg

SEQ ID NO: 8196217 - DNA, 22 bp, Homo sapiens
ccaggtctgcgggcggcaggca

SEQ ID NO: 8196218 - DNA, 22 bp, Homo sapiens
ccaggtctggaaccaccagggc

SEQ ID NO: 8196219 - DNA, 22 bp, Homo sapiens
ccaggtctcgggtctgctcgtg

SEQ ID NO: 8196220 - DNA, 22 bp, Homo sapiens
aggctgaggcaggtggatcacc

SEQ ID NO: 8196221 - DNA, 22 bp, Homo sapiens
aggctgaggcaggtggatcacc

SEQ ID NO: 8196222 - DNA, 22 bp, Homo sapiens
aggctgaggcaggtggatcacc

SEQ ID NO: 8196223 - DNA, 22 bp, Homo sapiens
aggctgaggcaggtggatcacc

SEQ ID NO: 8196224 - DNA, 22 bp, Homo sapiens
aggctgaggcaggtggatcacc

SEQ ID NO: 8196225 - DNA, 22 bp, Homo sapiens
aggctgaggcaggtggatcacc

SEQ ID NO: 8196226 - DNA, 22 bp, Homo sapiens
aggctgaggcaagaggatcact

SEQ ID NO: 8196227 - DNA, 22 bp, Homo sapiens
aggctgaggcaagaggatcact

SEQ ID NO: 8196228 - DNA, 22 bp, Homo sapiens
aggctgaggcaagaggatcact

SEQ ID NO: 8196229 - DNA, 22 bp, Homo sapiens
aggctgaggcaagaggatcact

SEQ ID NO: 8196230 - DNA, 22 bp, Homo sapiens
aggctgaggcaagaggatcact

SEQ ID NO: 8196231 - DNA, 22 bp, Homo sapiens
aggctgaggatcgtactttcca

SEQ ID NO: 8196232 - DNA, 22 bp, Homo sapiens
aggctgaggatcgtactttcca

SEQ ID NO: 8196233 - DNA, 22 bp, Homo sapiens
aggctgaggatcgtactttcca

SEQ ID NO: 8196234 - DNA, 22 bp, Homo sapiens
aggctgaggatcgtactttcca

SEQ ID NO: 8196235 - DNA, 22 bp, Homo sapiens
aggctgaggatccctgtgttct

SEQ ID NO: 8196236 - DNA, 22 bp, Homo sapiens
aggctgaggcaagaggatcact

SEQ ID NO: 8196237 - DNA, 22 bp, Homo sapiens
aggctgaggcaagaggatcact

SEQ ID NO: 8196238 - DNA, 22 bp, Homo sapiens
ccaggctgtaaacaccttcaaa

SEQ ID NO: 8196239 - DNA, 22 bp, Homo sapiens
ccaggctgtaaacaccttcaaa

SEQ ID NO: 8196240 - DNA, 22 bp, Homo sapiens
ccagggcagcgcccctccacgc

SEQ ID NO: 8196241 - DNA, 22 bp, Homo sapiens
ccagggcagcgcccctccacgc

SEQ ID NO: 8196242 - DNA, 22 bp, Homo sapiens
ccagggcaggagaaagactcac

SEQ ID NO: 8196243 - DNA, 22 bp, Homo sapiens
ccagggcctcgtgttctgagtg

SEQ ID NO: 8196244 - DNA, 22 bp, Homo sapiens
ccagggcctgagggcgacgccc

SEQ ID NO: 8196245 - DNA, 22 bp, Homo sapiens
ccagggcctgagggcgacgccc

SEQ ID NO: 8196246 - DNA, 22 bp, Homo sapiens
ccagggcctgccacttagcaag

SEQ ID NO: 8196247 - DNA, 22 bp, Homo sapiens
ccagggcctgccacttagcaag

SEQ ID NO: 8196248 - DNA, 23 bp, Homo sapiens
ccagggctacgggcaccgtcctg

SEQ ID NO: 8196249 - DNA, 23 bp, Homo sapiens
ccagggctacgggcaccgtcctg

SEQ ID NO: 8196250 - DNA, 22 bp, Homo sapiens
ccagggcctgccacttagcaag

SEQ ID NO: 8196251 - DNA, 22 bp, Homo sapiens
ccagggcctgccacttagcaag

SEQ ID NO: 8196252 - DNA, 22 bp, Homo sapiens
ccagggctcaggctcccagtgg

SEQ ID NO: 8196253 - DNA, 23 bp, Homo sapiens
ccagggctacgggcaccgtcctg

SEQ ID NO: 8196254 - DNA, 22 bp, Homo sapiens
ccagggctcaggctcccagtgg

SEQ ID NO: 8196255 - DNA, 22 bp, Homo sapiens
ccagggctcaggctcccagtgg

SEQ ID NO: 8196256 - DNA, 22 bp, Homo sapiens
ccagggctcaggctcccagtgg

SEQ ID NO: 8196257 - DNA, 22 bp, Homo sapiens
ccagggctccattgctcatcct

SEQ ID NO: 8196258 - DNA, 19 bp, Homo sapiens
ccagggctccaagctgagt

SEQ ID NO: 8196259 - DNA, 22 bp, Homo sapiens
ccagggctccattgctcatcct

SEQ ID NO: 8196260 - DNA, 22 bp, Homo sapiens
ccagggctccattgctcatcct

SEQ ID NO: 8196261 - DNA, 19 bp, Homo sapiens
ccagggctccaagctgagt

SEQ ID NO: 8196262 - DNA, 19 bp, Homo sapiens
ccagggctccaagctgagt

SEQ ID NO: 8196263 - DNA, 19 bp, Homo sapiens
ccagggctccaagctgagt

SEQ ID NO: 8196264 - DNA, 19 bp, Homo sapiens
ccagggctccaagctgagt

SEQ ID NO: 8196265 - DNA, 20 bp, Homo sapiens
ccagggctggctcctgggat

SEQ ID NO: 8196266 - DNA, 20 bp, Homo sapiens
ccagggctggctcctgggat

SEQ ID NO: 8196267 - DNA, 20 bp, Homo sapiens
ccagggctggctcctgggat

SEQ ID NO: 8196268 - DNA, 20 bp, Homo sapiens
ccagggctggctcctgggat

SEQ ID NO: 8196269 - DNA, 22 bp, Homo sapiens
ccagggctggaccagtgcttgg

SEQ ID NO: 8196270 - DNA, 20 bp, Homo sapiens
ccagggctggctcctgggat

SEQ ID NO: 8196271 - DNA, 20 bp, Homo sapiens
ccagggctggctcctgggat

SEQ ID NO: 8196272 - DNA, 22 bp, Homo sapiens
aggctaaaagagaatcatttag

SEQ ID NO: 8196273 - DNA, 22 bp, Homo sapiens
aggcgtggttgaggcgagcata

SEQ ID NO: 8196274 - DNA, 22 bp, Homo sapiens
aggctaagatgtggtctgagca

SEQ ID NO: 8196275 - DNA, 22 bp, Homo sapiens
aggctaagagcatttgctgaag

SEQ ID NO: 8196276 - DNA, 19 bp, Homo sapiens
aggctaaagagtcttgcgt

SEQ ID NO: 8196277 - DNA, 19 bp, Homo sapiens
aggctaaagagtcttgcgt

SEQ ID NO: 8196278 - DNA, 22 bp, Homo sapiens
aggctaaaagagaatcatttag

SEQ ID NO: 8196279 - DNA, 22 bp, Homo sapiens
aggctaagtgagtaaaatgtgg

SEQ ID NO: 8196280 - DNA, 22 bp, Homo sapiens
aggctaagggatgactggagtg

SEQ ID NO: 8196281 - DNA, 22 bp, Homo sapiens
aggctaaggagtgtgatgctca

SEQ ID NO: 8196282 - DNA, 22 bp, Homo sapiens
aggctaaggagtgtgatgctca

SEQ ID NO: 8196283 - DNA, 22 bp, Homo sapiens
aggctaagatgtggtctgagca

SEQ ID NO: 8196284 - DNA, 22 bp, Homo sapiens
aggctacaataattcccatgca

SEQ ID NO: 8196285 - DNA, 22 bp, Homo sapiens
aggctacaataattcccatgca

SEQ ID NO: 8196286 - DNA, 22 bp, Homo sapiens
ccaggctgctgttggtgtccgc

SEQ ID NO: 8196287 - DNA, 22 bp, Homo sapiens
ccaggctgctgttggtgtccgc

SEQ ID NO: 8196288 - DNA, 22 bp, Homo sapiens
ccaggctctgcgctggacatgg

SEQ ID NO: 8196289 - DNA, 22 bp, Homo sapiens
aggctagaggcttctggcttca

SEQ ID NO: 8196290 - DNA, 22 bp, Homo sapiens
aggctagaggcttctggcttca

SEQ ID NO: 8196291 - DNA, 22 bp, Homo sapiens
ccaggctctgcgctggacatgg

SEQ ID NO: 8196292 - DNA, 22 bp, Homo sapiens
aggctacaggagacgccaggag

SEQ ID NO: 8196293 - DNA, 22 bp, Homo sapiens
aggctacaataattcccatgca

SEQ ID NO: 8196294 - DNA, 22 bp, Homo sapiens
aggctagaggcttctggcttca

SEQ ID NO: 8196295 - DNA, 22 bp, Homo sapiens
aggctagactttggcgaagcac

SEQ ID NO: 8196296 - DNA, 22 bp, Homo sapiens
aggctagactttggcgaagcac

SEQ ID NO: 8196297 - DNA, 22 bp, Homo sapiens
ccaggctgctttattactctgt

SEQ ID NO: 8196298 - DNA, 22 bp, Homo sapiens
ccaggctgcttagccttatctt

SEQ ID NO: 8196299 - DNA, 22 bp, Homo sapiens
ccaggctgcttagccttatctt

SEQ ID NO: 8196300 - DNA, 22 bp, Homo sapiens
ccaggctgcttagccttatctt

SEQ ID NO: 8196301 - DNA, 22 bp, Homo sapiens
ccaggctgcttagccttatctt

SEQ ID NO: 8196302 - DNA, 22 bp, Homo sapiens
ccaggctggaatcaatattctg

SEQ ID NO: 8196303 - DNA, 22 bp, Homo sapiens
ccaggctgctttattactctgt

SEQ ID NO: 8196304 - DNA, 22 bp, Homo sapiens
ccaggctgctttattactctgt

SEQ ID NO: 8196305 - DNA, 22 bp, Homo sapiens
ccaggctggagtatagtggcgc

SEQ ID NO: 8196306 - DNA, 22 bp, Homo sapiens
ccaggctggaatcaatattctg

SEQ ID NO: 8196307 - DNA, 22 bp, Homo sapiens
ccaggctggagtatagtggcgc

SEQ ID NO: 8196308 - DNA, 22 bp, Homo sapiens
ccaggctggagtatagtggcgc

SEQ ID NO: 8196309 - DNA, 22 bp, Homo sapiens
ccaggctggagtatagtggcgc

SEQ ID NO: 8196310 - DNA, 22 bp, Homo sapiens
ccaggctggagtatagtggcgc

SEQ ID NO: 8196311 - DNA, 22 bp, Homo sapiens
ccaggctggagtatagtggcgc

SEQ ID NO: 8196312 - DNA, 22 bp, Homo sapiens
ccaggctggagtatagtggcgc

SEQ ID NO: 8196313 - DNA, 22 bp, Homo sapiens
ccaggctggagtatagtggcgc

SEQ ID NO: 8196314 - DNA, 22 bp, Homo sapiens
ccaggctggagtgcaatggcat

SEQ ID NO: 8196315 - DNA, 22 bp, Homo sapiens
ccaggctggagtatagtggcgc

SEQ ID NO: 8196316 - DNA, 22 bp, Homo sapiens
ccaggctggtctgaatttctag

SEQ ID NO: 8196317 - DNA, 22 bp, Homo sapiens
ccaggctggtctgaatttctag

SEQ ID NO: 8196318 - DNA, 15 bp, Homo sapiens
ccaggctgggtgagc

SEQ ID NO: 8196319 - DNA, 15 bp, Homo sapiens
ccaggctgggtgagc

SEQ ID NO: 8196320 - DNA, 15 bp, Homo sapiens
ccaggctgggtgagc

SEQ ID NO: 8196321 - DNA, 22 bp, Homo sapiens
ccaggctgggctacaagttgag

SEQ ID NO: 8196322 - DNA, 22 bp, Homo sapiens
ccaggctgggctacaagttgag

SEQ ID NO: 8196323 - DNA, 22 bp, Homo sapiens
ccaggctgggctacaagttgag

SEQ ID NO: 8196324 - DNA, 22 bp, Homo sapiens
ccaggctgggctacaagttgag

SEQ ID NO: 8196325 - DNA, 22 bp, Homo sapiens
ccaggctgggcggggaacctgg

SEQ ID NO: 8196326 - DNA, 22 bp, Homo sapiens
ccaggctgggcggggaacctgg

SEQ ID NO: 8196327 - DNA, 22 bp, Homo sapiens
ccaggctgggcggggaacctgg

SEQ ID NO: 8196328 - DNA, 22 bp, Homo sapiens
ccaggctgggcggggaacctgg

SEQ ID NO: 8196329 - DNA, 22 bp, Homo sapiens
ccaggctgggcggggaacctgg

SEQ ID NO: 8196330 - DNA, 22 bp, Homo sapiens
ccaggctgggcggggaacctgg

SEQ ID NO: 8196331 - DNA, 22 bp, Homo sapiens
ccaggctgggcggggaacctgg

SEQ ID NO: 8196332 - DNA, 21 bp, Homo sapiens
ccaggctgggagggcagttcc

SEQ ID NO: 8196333 - DNA, 21 bp, Homo sapiens
ccaggctgggagggcagttcc

SEQ ID NO: 8196334 - DNA, 22 bp, Homo sapiens
cagggacagcgggactctgaca

SEQ ID NO: 8196335 - DNA, 22 bp, Homo sapiens
cagggacagcgggactctgaca

SEQ ID NO: 8196336 - DNA, 22 bp, Homo sapiens
cagggacaggggagaaaagatg

SEQ ID NO: 8196337 - DNA, 22 bp, Homo sapiens
cagggacagggatcatttgctt

SEQ ID NO: 8196338 - DNA, 22 bp, Homo sapiens
cagggacaggggagaaaagatg

SEQ ID NO: 8196339 - DNA, 22 bp, Homo sapiens
cagggacaggggagaaaagatg

SEQ ID NO: 8196340 - DNA, 20 bp, Homo sapiens
cagggacagtggcagattca

SEQ ID NO: 8196341 - DNA, 20 bp, Homo sapiens
cagggacagtggcagattca

SEQ ID NO: 8196342 - DNA, 22 bp, Homo sapiens
cagggacataagaggaacatgg

SEQ ID NO: 8196343 - DNA, 22 bp, Homo sapiens
cagggacatgactggtctctgt

SEQ ID NO: 8196344 - DNA, 22 bp, Homo sapiens
cagggacataagaggaacatgg

SEQ ID NO: 8196345 - DNA, 22 bp, Homo sapiens
agctttctcttctttagaaagt

SEQ ID NO: 8196346 - DNA, 22 bp, Homo sapiens
agctttctctcagccaggctgc

SEQ ID NO: 8196347 - DNA, 22 bp, Homo sapiens
agctttctggttacagtcttca

SEQ ID NO: 8196348 - DNA, 22 bp, Homo sapiens
agctttctggttacagtcttca

SEQ ID NO: 8196349 - DNA, 22 bp, Homo sapiens
agctttctccctgacgctttgg

SEQ ID NO: 8196350 - DNA, 22 bp, Homo sapiens
agctttctccctgacgctttgg

SEQ ID NO: 8196351 - DNA, 22 bp, Homo sapiens
agctttctagtttagccatctt

SEQ ID NO: 8196352 - DNA, 22 bp, Homo sapiens
cagggacccgcacaggtagcat

SEQ ID NO: 8196353 - DNA, 22 bp, Homo sapiens
cagggacccgcacaggtagcat

SEQ ID NO: 8196354 - DNA, 22 bp, Homo sapiens
cagggacatttccaagagaatt

SEQ ID NO: 8196355 - DNA, 22 bp, Homo sapiens
cagggacatttccaagagaatt

SEQ ID NO: 8196356 - DNA, 22 bp, Homo sapiens
cagggacattggtggccaggtt

SEQ ID NO: 8196357 - DNA, 22 bp, Homo sapiens
cagggacattggtggccaggtt

SEQ ID NO: 8196358 - DNA, 22 bp, Homo sapiens
cagggacattggtggccaggtt

SEQ ID NO: 8196359 - DNA, 22 bp, Homo sapiens
cagggacattggtggccaggtt

SEQ ID NO: 8196360 - DNA, 22 bp, Homo sapiens
cagggacattggtggccaggtt

SEQ ID NO: 8196361 - DNA, 22 bp, Homo sapiens
cagggaccctactagctcacac

SEQ ID NO: 8196362 - DNA, 22 bp, Homo sapiens
cagggaccctactagctcacac

SEQ ID NO: 8196363 - DNA, 22 bp, Homo sapiens
cagggactcgctggacataccg

SEQ ID NO: 8196364 - DNA, 22 bp, Homo sapiens
aggaaacaacttggcatgagcc

SEQ ID NO: 8196365 - DNA, 22 bp, Homo sapiens
aggaaacaacttggcatgagcc

SEQ ID NO: 8196366 - DNA, 22 bp, Homo sapiens
aggaaaattatcatgagagcca

SEQ ID NO: 8196367 - DNA, 22 bp, Homo sapiens
aggaaaatggaccagagttgtt

SEQ ID NO: 8196368 - DNA, 22 bp, Homo sapiens
aggaaaatggaccagagttgtt

SEQ ID NO: 8196369 - DNA, 22 bp, Homo sapiens
aggaaaagtgtgaagtatggag

SEQ ID NO: 8196370 - DNA, 22 bp, Homo sapiens
aggaaaagtgtgaagtatggag

SEQ ID NO: 8196371 - DNA, 22 bp, Homo sapiens
aggaaaagtgtgaagtatggag

SEQ ID NO: 8196372 - DNA, 22 bp, Homo sapiens
aggaaaagtgtgaagtatggag

SEQ ID NO: 8196373 - DNA, 22 bp, Homo sapiens
aggaaaatggaccagagttgtt

SEQ ID NO: 8196374 - DNA, 22 bp, Homo sapiens
aggaaaatggaccagagttgtt

SEQ ID NO: 8196375 - DNA, 20 bp, Homo sapiens
aggaaaagggtggtggtaga

SEQ ID NO: 8196376 - DNA, 20 bp, Homo sapiens
aggaaaagggtggtggtaga

SEQ ID NO: 8196377 - DNA, 20 bp, Homo sapiens
aggaaaagggtggtggtaga

SEQ ID NO: 8196378 - DNA, 22 bp, Homo sapiens
aggaaaagtgtgaagtatggag

SEQ ID NO: 8196379 - DNA, 20 bp, Homo sapiens
aggaaaagggtggtggtaga

SEQ ID NO: 8196380 - DNA, 22 bp, Homo sapiens
aggaaaaataaggcagcagggc

SEQ ID NO: 8196381 - DNA, 22 bp, Homo sapiens
caggcttccgccaggtttccag

SEQ ID NO: 8196382 - DNA, 22 bp, Homo sapiens
caggcttcagcatccacttagt

SEQ ID NO: 8196383 - DNA, 22 bp, Homo sapiens
caggcttcagggaacgcagtct

SEQ ID NO: 8196384 - DNA, 22 bp, Homo sapiens
caggcttcttttctttccagac

SEQ ID NO: 8196385 - DNA, 22 bp, Homo sapiens
caggcttcttttctttccagac

SEQ ID NO: 8196386 - DNA, 22 bp, Homo sapiens
caggcttgaagcttcagagtat

SEQ ID NO: 8196387 - DNA, 22 bp, Homo sapiens
caggcttgaagcttcagagtat

SEQ ID NO: 8196388 - DNA, 21 bp, Homo sapiens
caggcttgaccctagtgggaa

SEQ ID NO: 8196389 - DNA, 22 bp, Homo sapiens
caggcttgagggcaggcccagt

SEQ ID NO: 8196390 - DNA, 21 bp, Homo sapiens
caggcttgaggaatgtgcctg

SEQ ID NO: 8196391 - DNA, 22 bp, Homo sapiens
caggcttgctgctagagcactt

SEQ ID NO: 8196392 - DNA, 22 bp, Homo sapiens
agcttctccctttcctattggt

SEQ ID NO: 8196393 - DNA, 22 bp, Homo sapiens
caggcttgagggcaggcccagt

SEQ ID NO: 8196394 - DNA, 22 bp, Homo sapiens
caggcttgattattcagacaat

SEQ ID NO: 8196395 - DNA, 22 bp, Homo sapiens
caggcttgattattcagacaat

SEQ ID NO: 8196396 - DNA, 22 bp, Homo sapiens
caggcttgctagaggagccaaa

SEQ ID NO: 8196397 - DNA, 22 bp, Homo sapiens
caggcttgctagaggagccaaa

SEQ ID NO: 8196398 - DNA, 22 bp, Homo sapiens
agctggtgctgaagctcttgag

SEQ ID NO: 8196399 - DNA, 22 bp, Homo sapiens
agctggtgctcggggagctggc

SEQ ID NO: 8196400 - DNA, 22 bp, Homo sapiens
agctggtgctcggggagctggc

SEQ ID NO: 8196401 - DNA, 22 bp, Homo sapiens
caggctgtctgaatggaggccc

SEQ ID NO: 8196402 - DNA, 22 bp, Homo sapiens
caggctggagttcagtggtgtg

SEQ ID NO: 8196403 - DNA, 22 bp, Homo sapiens
caggctggagttacctttaggg

SEQ ID NO: 8196404 - DNA, 22 bp, Homo sapiens
agctggtgctgaagctcttgag

SEQ ID NO: 8196405 - DNA, 22 bp, Homo sapiens
caggctgtgaaactgagatgcg

SEQ ID NO: 8196406 - DNA, 22 bp, Homo sapiens
caggctgtgaaactgagatgcg

SEQ ID NO: 8196407 - DNA, 22 bp, Homo sapiens
caggctgtgaaactgagatgcg

SEQ ID NO: 8196408 - DNA, 22 bp, Homo sapiens
caggctgtggatcaggagcctt

SEQ ID NO: 8196409 - DNA, 22 bp, Homo sapiens
caggctgtggatcaggagcctt

SEQ ID NO: 8196410 - DNA, 22 bp, Homo sapiens
caggcttaggagtcagcctgct

SEQ ID NO: 8196411 - DNA, 22 bp, Homo sapiens
caggctgtgttcctggaacccc

SEQ ID NO: 8196412 - DNA, 22 bp, Homo sapiens
caggctgtgttcctggaacccc

SEQ ID NO: 8196413 - DNA, 22 bp, Homo sapiens
caggctgtgggagtcaggaccc

SEQ ID NO: 8196414 - DNA, 22 bp, Homo sapiens
caggctgtgggagtcaggaccc

SEQ ID NO: 8196415 - DNA, 22 bp, Homo sapiens
agcttctgagaatagtaaatgc

SEQ ID NO: 8196416 - DNA, 22 bp, Homo sapiens
agcttctcctggtacagaactg

SEQ ID NO: 8196417 - DNA, 22 bp, Homo sapiens
agcttctctctttgcactcaca

SEQ ID NO: 8196418 - DNA, 22 bp, Homo sapiens
agcttctctcagggtatctttc

SEQ ID NO: 8196419 - DNA, 22 bp, Homo sapiens
agcttctctcagggtatctttc

SEQ ID NO: 8196420 - DNA, 22 bp, Homo sapiens
agcttctgttcatcttccaggc

SEQ ID NO: 8196421 - DNA, 23 bp, Homo sapiens
agcttctggttcaggtcaagcag

SEQ ID NO: 8196422 - DNA, 23 bp, Homo sapiens
agcttctggttcaggtcaagcag

SEQ ID NO: 8196423 - DNA, 20 bp, Homo sapiens
agcttctgctgcctttcggc

SEQ ID NO: 8196424 - DNA, 22 bp, Homo sapiens
agcttctggaagcctggcagca

SEQ ID NO: 8196425 - DNA, 22 bp, Homo sapiens
agcttctggaaggcaaggcttg

SEQ ID NO: 8196426 - DNA, 22 bp, Homo sapiens
agcttctggaagcctggcagca

SEQ ID NO: 8196427 - DNA, 22 bp, Homo sapiens
agctttatttgtcattcacggc

SEQ ID NO: 8196428 - DNA, 22 bp, Homo sapiens
agctttatttgtcattcacggc

SEQ ID NO: 8196429 - DNA, 22 bp, Homo sapiens
agctttcagttactaatgaagg

SEQ ID NO: 8196430 - DNA, 22 bp, Homo sapiens
agctttctagatttggaattgt

SEQ ID NO: 8196431 - DNA, 22 bp, Homo sapiens
agctttattcatgatttcaggg

SEQ ID NO: 8196432 - DNA, 22 bp, Homo sapiens
agctttattcatgatttcaggg

SEQ ID NO: 8196433 - DNA, 22 bp, Homo sapiens
agctttattcatgatttcaggg

SEQ ID NO: 8196434 - DNA, 22 bp, Homo sapiens
agctttatttgtcattcacggc

SEQ ID NO: 8196435 - DNA, 22 bp, Homo sapiens
agctttatttgtcattcacggc

SEQ ID NO: 8196436 - DNA, 22 bp, Homo sapiens
agctttatatttaatgaattct

SEQ ID NO: 8196437 - DNA, 22 bp, Homo sapiens
agctttattaactctccaggtg

SEQ ID NO: 8196438 - DNA, 22 bp, Homo sapiens
agctttatatttaatgaattct

SEQ ID NO: 8196439 - DNA, 22 bp, Homo sapiens
agctttatatttaatgaattct

SEQ ID NO: 8196440 - DNA, 22 bp, Homo sapiens
agctttatatttaatgaattct

SEQ ID NO: 8196441 - DNA, 22 bp, Homo sapiens
aggaagcaccggaatgatgact

SEQ ID NO: 8196442 - DNA, 22 bp, Homo sapiens
aggaaggactgcagcatttggt

SEQ ID NO: 8196443 - DNA, 22 bp, Homo sapiens
aggaagcaccggaatgatgact

SEQ ID NO: 8196444 - DNA, 22 bp, Homo sapiens
aggaagatgtgtttagcaggtt

SEQ ID NO: 8196445 - DNA, 22 bp, Homo sapiens
aggaagatgtgcaaagttggaa

SEQ ID NO: 8196446 - DNA, 22 bp, Homo sapiens
aggaagatgtgtttagcaggtt

SEQ ID NO: 8196447 - DNA, 22 bp, Homo sapiens
aggaagcaaaaggcagggtcta

SEQ ID NO: 8196448 - DNA, 22 bp, Homo sapiens
aggaagagtgttacctatgggt

SEQ ID NO: 8196449 - DNA, 22 bp, Homo sapiens
aggaagagtgttacctatgggt

SEQ ID NO: 8196450 - DNA, 22 bp, Homo sapiens
aggaagagtgttacctatgggt

SEQ ID NO: 8196451 - DNA, 22 bp, Homo sapiens
aggaagaggtgtgcaatggtgt

SEQ ID NO: 8196452 - DNA, 22 bp, Homo sapiens
aggaagaggtgtgcaatggtgt

SEQ ID NO: 8196453 - DNA, 22 bp, Homo sapiens
aggaagaggtgtgcaatggtgt

SEQ ID NO: 8196454 - DNA, 22 bp, Homo sapiens
aggaagagggtggcagataatc

SEQ ID NO: 8196455 - DNA, 22 bp, Homo sapiens
aggaagagggtggcagataatc

SEQ ID NO: 8196456 - DNA, 22 bp, Homo sapiens
aggaagagggtggcagataatc

SEQ ID NO: 8196457 - DNA, 22 bp, Homo sapiens
aggaagaggtagctgtcaaggg

SEQ ID NO: 8196458 - DNA, 22 bp, Homo sapiens
aggaagaggtagctgtcaaggg

SEQ ID NO: 8196459 - DNA, 22 bp, Homo sapiens
aggaagaggtagctgtcaaggg

SEQ ID NO: 8196460 - DNA, 22 bp, Homo sapiens
cagggtttcaccatgttagcag

SEQ ID NO: 8196461 - DNA, 22 bp, Homo sapiens
cagggtttcaccatgttagcag

SEQ ID NO: 8196462 - DNA, 22 bp, Homo sapiens
cagggtttcaccatgttagcag

SEQ ID NO: 8196463 - DNA, 22 bp, Homo sapiens
cagggtttcaccatgttagcag

SEQ ID NO: 8196464 - DNA, 22 bp, Homo sapiens
cagggttgattccttctgaggg

SEQ ID NO: 8196465 - DNA, 22 bp, Homo sapiens
cagggttggtttctcctcaggc

SEQ ID NO: 8196466 - DNA, 22 bp, Homo sapiens
cagggtggtgaatagctatagt

SEQ ID NO: 8196467 - DNA, 22 bp, Homo sapiens
cagggttcagtgggccctcttg

SEQ ID NO: 8196468 - DNA, 22 bp, Homo sapiens
cagggtgtgaacagtgtaaaac

SEQ ID NO: 8196469 - DNA, 22 bp, Homo sapiens
cagggtggggctggctatcaaa

SEQ ID NO: 8196470 - DNA, 22 bp, Homo sapiens
cagggtggtaccagcatctagt

SEQ ID NO: 8196471 - DNA, 22 bp, Homo sapiens
cagggtggtaccagcatctagt

SEQ ID NO: 8196472 - DNA, 22 bp, Homo sapiens
cagggtggtaccagcatctagt

SEQ ID NO: 8196473 - DNA, 22 bp, Homo sapiens
cagggtggggctggctatcaaa

SEQ ID NO: 8196474 - DNA, 22 bp, Homo sapiens
cagggtgctgcaccatccctca

SEQ ID NO: 8196475 - DNA, 22 bp, Homo sapiens
cagggtgcttagaaatggacct

SEQ ID NO: 8196476 - DNA, 22 bp, Homo sapiens
aggaaacagttggtaatgcata

SEQ ID NO: 8196477 - DNA, 22 bp, Homo sapiens
aggaaacatccttatctattct

SEQ ID NO: 8196478 - DNA, 22 bp, Homo sapiens
aggaaacagagtgaagcttggg

SEQ ID NO: 8196479 - DNA, 22 bp, Homo sapiens
aggaaacatgaatctgccttga

SEQ ID NO: 8196480 - DNA, 22 bp, Homo sapiens
aggaaacatgaatctgccttga

SEQ ID NO: 8196481 - DNA, 17 bp, Homo sapiens
aggaaacattttctttc

SEQ ID NO: 8196482 - DNA, 22 bp, Homo sapiens
aggaaacattgatattgggaaa

SEQ ID NO: 8196483 - DNA, 22 bp, Homo sapiens
caggtcctcgggggaggccggc

SEQ ID NO: 8196484 - DNA, 22 bp, Homo sapiens
caggtcctcacgcctcaccctt

SEQ ID NO: 8196485 - DNA, 22 bp, Homo sapiens
caggtcccgttccccagagatt

SEQ ID NO: 8196486 - DNA, 22 bp, Homo sapiens
caggtcccgttccccagagatt

SEQ ID NO: 8196487 - DNA, 22 bp, Homo sapiens
caggtcctggcagctgactcag

SEQ ID NO: 8196488 - DNA, 14 bp, Homo sapiens
aggaatgtcctagg

SEQ ID NO: 8196489 - DNA, 14 bp, Homo sapiens
aggaatgtcctagg

SEQ ID NO: 8196490 - DNA, 22 bp, Homo sapiens
aggaatgtcgtcataaacatga

SEQ ID NO: 8196491 - DNA, 22 bp, Homo sapiens
aggaatgtcgtcataaacatga

SEQ ID NO: 8196492 - DNA, 22 bp, Homo sapiens
aggaatgacagatgtccgcacc

SEQ ID NO: 8196493 - DNA, 22 bp, Homo sapiens
aggaatgaactcgagtgatctg

SEQ ID NO: 8196494 - DNA, 22 bp, Homo sapiens
caggtcctggcatcaggcaggt

SEQ ID NO: 8196495 - DNA, 22 bp, Homo sapiens
caggtcctggcagctgactcag

SEQ ID NO: 8196496 - DNA, 22 bp, Homo sapiens
caggtcctggcatcaggcaggt

SEQ ID NO: 8196497 - DNA, 22 bp, Homo sapiens
caggtcctggcatcaggcaggt

SEQ ID NO: 8196498 - DNA, 22 bp, Homo sapiens
aggaatgttaaagattaagagc

SEQ ID NO: 8196499 - DNA, 22 bp, Homo sapiens
aggaatgttaaagattaagagc

SEQ ID NO: 8196500 - DNA, 22 bp, Homo sapiens
aggaatgtgtttctaggctgtt

SEQ ID NO: 8196501 - DNA, 22 bp, Homo sapiens
aggaatgtgtttctaggctgtt

SEQ ID NO: 8196502 - DNA, 16 bp, Homo sapiens
aggaatgtggcggaac

SEQ ID NO: 8196503 - DNA, 21 bp, Homo sapiens
aggaatgtgtatatatacaat

SEQ ID NO: 8196504 - DNA, 16 bp, Homo sapiens
aggaatgtggcggaac

SEQ ID NO: 8196505 - DNA, 21 bp, Homo sapiens
aggaatgtgtatatatacaat

SEQ ID NO: 8196506 - DNA, 22 bp, Homo sapiens
aggaatgtgtgtccaccgggga

SEQ ID NO: 8196507 - DNA, 22 bp, Homo sapiens
aggaatgtgtgtccaccgggga

SEQ ID NO: 8196508 - DNA, 22 bp, Homo sapiens
aggaatgtttagaatgtcagaa

SEQ ID NO: 8196509 - DNA, 22 bp, Homo sapiens
aggaatgtttagaatgtcagaa

SEQ ID NO: 8196510 - DNA, 22 bp, Homo sapiens
aggaatgtttagaatgtcagaa

SEQ ID NO: 8196511 - DNA, 22 bp, Homo sapiens
aggaatgtttacacgacagaaa

SEQ ID NO: 8196512 - DNA, 22 bp, Homo sapiens
aggaatgttagttctgtataca

SEQ ID NO: 8196513 - DNA, 22 bp, Homo sapiens
aggaatgtttacacgacagaaa

SEQ ID NO: 8196514 - DNA, 22 bp, Homo sapiens
aggaatgttaggagatgagtct

SEQ ID NO: 8196515 - DNA, 22 bp, Homo sapiens
aggaatgttaagaaggtctacc

SEQ ID NO: 8196516 - DNA, 22 bp, Homo sapiens
aggaatgttaagaaggtctacc

SEQ ID NO: 8196517 - DNA, 22 bp, Homo sapiens
aggaatgttaggagatgagtct

SEQ ID NO: 8196518 - DNA, 22 bp, Homo sapiens
aggaatgttagttctgtataca

SEQ ID NO: 8196519 - DNA, 22 bp, Homo sapiens
aggaatgtctgagaaagaggca

SEQ ID NO: 8196520 - DNA, 22 bp, Homo sapiens
aggaatgtctgagaaagaggca

SEQ ID NO: 8196521 - DNA, 22 bp, Homo sapiens
aggaatgtgaaacaggtggctg

SEQ ID NO: 8196522 - DNA, 22 bp, Homo sapiens
aggaatgtgaaacaggtggctg

SEQ ID NO: 8196523 - DNA, 22 bp, Homo sapiens
aggaatgtgaccactagactct

SEQ ID NO: 8196524 - DNA, 22 bp, Homo sapiens
aggaatgtgaggcaagttgtga

SEQ ID NO: 8196525 - DNA, 22 bp, Homo sapiens
aggaatgtgaggcaagttgtga

SEQ ID NO: 8196526 - DNA, 22 bp, Homo sapiens
aggaatgtgaccactagactct

SEQ ID NO: 8196527 - DNA, 22 bp, Homo sapiens
aggaatgtgactattttttcag

SEQ ID NO: 8196528 - DNA, 22 bp, Homo sapiens
aggaatgtgactattttttcag

SEQ ID NO: 8196529 - DNA, 22 bp, Homo sapiens
aggaatgtggaaggtggcggcg

SEQ ID NO: 8196530 - DNA, 22 bp, Homo sapiens
aggaatgtggcaatcttcaagt

SEQ ID NO: 8196531 - DNA, 22 bp, Homo sapiens
aggaatgtggcaatcttcaagt

SEQ ID NO: 8196532 - DNA, 22 bp, Homo sapiens
aggaatgtggcctagggaggag

SEQ ID NO: 8196533 - DNA, 22 bp, Homo sapiens
aggaatgtggcctagggaggag

SEQ ID NO: 8196534 - DNA, 22 bp, Homo sapiens
aggaatgtggaaggtggcggcg

SEQ ID NO: 8196535 - DNA, 22 bp, Homo sapiens
aggaatgtgcctagcctccctg

SEQ ID NO: 8196536 - DNA, 22 bp, Homo sapiens
aggaatgtgcctagcctccctg

SEQ ID NO: 8196537 - DNA, 23 bp, Homo sapiens
aggaatgtgcccacccatctcct

SEQ ID NO: 8196538 - DNA, 23 bp, Homo sapiens
aggaatgtgcccacccatctcct

SEQ ID NO: 8196539 - DNA, 22 bp, Homo sapiens
aggaaggggagaagttaaagct

SEQ ID NO: 8196540 - DNA, 22 bp, Homo sapiens
aggaaggggagaagttaaagct

SEQ ID NO: 8196541 - DNA, 22 bp, Homo sapiens
aggaaggggagaagttaaagct

SEQ ID NO: 8196542 - DNA, 22 bp, Homo sapiens
aggaaggggagaagttaaagct

SEQ ID NO: 8196543 - DNA, 22 bp, Homo sapiens
aggaagggtggatagtaacgtg

SEQ ID NO: 8196544 - DNA, 22 bp, Homo sapiens
aggaagggtggatagtaacgtg

SEQ ID NO: 8196545 - DNA, 22 bp, Homo sapiens
aggaagggttctttgtgaaaga

SEQ ID NO: 8196546 - DNA, 22 bp, Homo sapiens
aggaagggttctttctgtttat

SEQ ID NO: 8196547 - DNA, 22 bp, Homo sapiens
aggaagggtgtcatgagccctt

SEQ ID NO: 8196548 - DNA, 22 bp, Homo sapiens
aggaagggtgtcatgagccctt

SEQ ID NO: 8196549 - DNA, 22 bp, Homo sapiens
aggaagggtgtcatgagccctt

SEQ ID NO: 8196550 - DNA, 22 bp, Homo sapiens
aggaagggtgtcatgagccctt

SEQ ID NO: 8196551 - DNA, 22 bp, Homo sapiens
aggaagggtgtcatgagccctt

SEQ ID NO: 8196552 - DNA, 22 bp, Homo sapiens
caggtcccgccccgggctgacc

SEQ ID NO: 8196553 - DNA, 22 bp, Homo sapiens
caggtcccgccccgggctgacc

SEQ ID NO: 8196554 - DNA, 22 bp, Homo sapiens
caggtcccgttccccagagatt

SEQ ID NO: 8196555 - DNA, 22 bp, Homo sapiens
caggtcccctcccctaccaggc

SEQ ID NO: 8196556 - DNA, 22 bp, Homo sapiens
caggtcccctcccctaccaggc

SEQ ID NO: 8196557 - DNA, 17 bp, Homo sapiens
caggtcccagggtctct

SEQ ID NO: 8196558 - DNA, 22 bp, Homo sapiens
caggtccagtcactggtctgca

SEQ ID NO: 8196559 - DNA, 22 bp, Homo sapiens
caggtccagtaaaaagagtcct

SEQ ID NO: 8196560 - DNA, 20 bp, Homo sapiens
caggtccagcacgtgcacgg

SEQ ID NO: 8196561 - DNA, 22 bp, Homo sapiens
aggaagtgaaagggaaggagtt

SEQ ID NO: 8196562 - DNA, 20 bp, Homo sapiens
caggtccagcacgtgcacgg

SEQ ID NO: 8196563 - DNA, 22 bp, Homo sapiens
aggaaggtaatgaactgaggag

SEQ ID NO: 8196564 - DNA, 22 bp, Homo sapiens
aggaaggtaatgaactgaggag

SEQ ID NO: 8196565 - DNA, 22 bp, Homo sapiens
aggaagggttctttgtgaaaga

SEQ ID NO: 8196566 - DNA, 22 bp, Homo sapiens
aggaagggttctttgtgaaaga

SEQ ID NO: 8196567 - DNA, 22 bp, Homo sapiens
aggaagggttctttgtgaaaga

SEQ ID NO: 8196568 - DNA, 22 bp, Homo sapiens
aggaagtcagaatgctggggag

SEQ ID NO: 8196569 - DNA, 22 bp, Homo sapiens
aggaagtcagctgccatgctgt

SEQ ID NO: 8196570 - DNA, 21 bp, Homo sapiens
aggaagtcctgctgtgctgtc

SEQ ID NO: 8196571 - DNA, 22 bp, Homo sapiens
aggaaggtgcagtagggtgtgc

SEQ ID NO: 8196572 - DNA, 22 bp, Homo sapiens
aggaaggtaatgaactgaggag

SEQ ID NO: 8196573 - DNA, 22 bp, Homo sapiens
agctgaagaaatgggaagcatt

SEQ ID NO: 8196574 - DNA, 22 bp, Homo sapiens
caggaaaaggagactttagcac

SEQ ID NO: 8196575 - DNA, 22 bp, Homo sapiens
caggaaatataggaaaaggaac

SEQ ID NO: 8196576 - DNA, 22 bp, Homo sapiens
caggaaatatctcaacacttta

SEQ ID NO: 8196577 - DNA, 22 bp, Homo sapiens
caggaaatatctcctggcagag

SEQ ID NO: 8196578 - DNA, 22 bp, Homo sapiens
caggaaatcagaactcaagtgg

SEQ ID NO: 8196579 - DNA, 22 bp, Homo sapiens
caggaaatcagaactcaagtgg

SEQ ID NO: 8196580 - DNA, 22 bp, Homo sapiens
agctgaacgtgcttctgcagca

SEQ ID NO: 8196581 - DNA, 22 bp, Homo sapiens
agctgaagaaatgggaagcatt

SEQ ID NO: 8196582 - DNA, 22 bp, Homo sapiens
agctgaaattttactgagtata

SEQ ID NO: 8196583 - DNA, 22 bp, Homo sapiens
agctgaaagggtgttggagtgt

SEQ ID NO: 8196584 - DNA, 22 bp, Homo sapiens
agctgaaattctttgtcctcag

SEQ ID NO: 8196585 - DNA, 22 bp, Homo sapiens
agctgaaattcacaaggatcca

SEQ ID NO: 8196586 - DNA, 22 bp, Homo sapiens
agctcttttgtgagcatttggc

SEQ ID NO: 8196587 - DNA, 22 bp, Homo sapiens
agctcttttgctctccaagttt

SEQ ID NO: 8196588 - DNA, 22 bp, Homo sapiens
agctcttttgtgagcatttggc

SEQ ID NO: 8196589 - DNA, 22 bp, Homo sapiens
agctcttttatcatgaggagag

SEQ ID NO: 8196590 - DNA, 22 bp, Homo sapiens
agctcttttatcatgaggagag

SEQ ID NO: 8196591 - DNA, 22 bp, Homo sapiens
agctcttttgattctccctgtc

SEQ ID NO: 8196592 - DNA, 22 bp, Homo sapiens
agctctttggcactgagcagca

SEQ ID NO: 8196593 - DNA, 22 bp, Homo sapiens
agctctttggcactgagcagca

SEQ ID NO: 8196594 - DNA, 22 bp, Homo sapiens
agctgaaagcttgactggggct

SEQ ID NO: 8196595 - DNA, 22 bp, Homo sapiens
agctgaaaattagtgatagttt

SEQ ID NO: 8196596 - DNA, 20 bp, Homo sapiens
agctctttttagctaaggta

SEQ ID NO: 8196597 - DNA, 22 bp, Homo sapiens
caggaaccagaaccttcccccg

SEQ ID NO: 8196598 - DNA, 23 bp, Homo sapiens
caggaaatgaatccaggaggatg

SEQ ID NO: 8196599 - DNA, 22 bp, Homo sapiens
caggaaatgcgtagttgaactt

SEQ ID NO: 8196600 - DNA, 22 bp, Homo sapiens
caggaaatgctatcatagctga

SEQ ID NO: 8196601 - DNA, 22 bp, Homo sapiens
caggaaatgaacaggaatgaac

SEQ ID NO: 8196602 - DNA, 22 bp, Homo sapiens
caggaagaaagaggtgaggtgt

SEQ ID NO: 8196603 - DNA, 22 bp, Homo sapiens
caggaactcaaggtttgtaaca

SEQ ID NO: 8196604 - DNA, 22 bp, Homo sapiens
caggaagaaagaggtgaggtgt

SEQ ID NO: 8196605 - DNA, 22 bp, Homo sapiens
caggaagaaagaggtgaggtgt

SEQ ID NO: 8196606 - DNA, 22 bp, Homo sapiens
caggaagaagggtggtgagtcc

SEQ ID NO: 8196607 - DNA, 22 bp, Homo sapiens
caggaagaaagaggtgaggtgt

SEQ ID NO: 8196608 - DNA, 22 bp, Homo sapiens
caggaagaccagggctgtggct

SEQ ID NO: 8196609 - DNA, 22 bp, Homo sapiens
caggaagaccagggctgtggct

SEQ ID NO: 8196610 - DNA, 22 bp, Homo sapiens
caggaagaccagggctgtggct

SEQ ID NO: 8196611 - DNA, 22 bp, Homo sapiens
caggaagaccagggctgtggct

SEQ ID NO: 8196612 - DNA, 22 bp, Homo sapiens
caggaagaagggtggtgagtcc

SEQ ID NO: 8196613 - DNA, 22 bp, Homo sapiens
caggaagaagggtggtgagtcc

SEQ ID NO: 8196614 - DNA, 22 bp, Homo sapiens
agctgccctttatgatgctgaa

SEQ ID NO: 8196615 - DNA, 22 bp, Homo sapiens
agctgcccttctcttgcccttg

SEQ ID NO: 8196616 - DNA, 22 bp, Homo sapiens
agctgcccttctcttgcccttg

SEQ ID NO: 8196617 - DNA, 22 bp, Homo sapiens
agctgcccttctcttgcccttg

SEQ ID NO: 8196618 - DNA, 22 bp, Homo sapiens
agctgcccttaataggcattca

SEQ ID NO: 8196619 - DNA, 22 bp, Homo sapiens
agctgccctgggtcttgctgct

SEQ ID NO: 8196620 - DNA, 22 bp, Homo sapiens
agctgccctgggtcttgctgct

SEQ ID NO: 8196621 - DNA, 22 bp, Homo sapiens
agctgccctgggtcttgctgct

SEQ ID NO: 8196622 - DNA, 22 bp, Homo sapiens
agctgccctgggtcttgctgct

SEQ ID NO: 8196623 - DNA, 20 bp, Homo sapiens
agctgcccttttcacatgtt

SEQ ID NO: 8196624 - DNA, 22 bp, Homo sapiens
agctgcccttaataggcattca

SEQ ID NO: 8196625 - DNA, 22 bp, Homo sapiens
agctgccgatgcccagctgcat

SEQ ID NO: 8196626 - DNA, 20 bp, Homo sapiens
agctgcccttttcacatgtt

SEQ ID NO: 8196627 - DNA, 20 bp, Homo sapiens
agctgcccttttcacatgtt

SEQ ID NO: 8196628 - DNA, 22 bp, Homo sapiens
agctgcctcagtcactcatggc

SEQ ID NO: 8196629 - DNA, 22 bp, Homo sapiens
agctgcctcagtcactcatggc

SEQ ID NO: 8196630 - DNA, 21 bp, Homo sapiens
agctgcctccacttctgaggc

SEQ ID NO: 8196631 - DNA, 22 bp, Homo sapiens
agctgcccccagggctgtgctt

SEQ ID NO: 8196632 - DNA, 22 bp, Homo sapiens
agctgcccccagggctgtgctt

SEQ ID NO: 8196633 - DNA, 22 bp, Homo sapiens
agctgcccccagggctgtgctt

SEQ ID NO: 8196634 - DNA, 22 bp, Homo sapiens
agctgccagatgacagtgctat

SEQ ID NO: 8196635 - DNA, 22 bp, Homo sapiens
agctgccagatgacagtgctat

SEQ ID NO: 8196636 - DNA, 22 bp, Homo sapiens
agctgccagatgacagtgctat

SEQ ID NO: 8196637 - DNA, 22 bp, Homo sapiens
agctgccagatgacagtgctat

SEQ ID NO: 8196638 - DNA, 22 bp, Homo sapiens
caggaagaccagggctgtggct

SEQ ID NO: 8196639 - DNA, 20 bp, Homo sapiens
agctgcccctgggcactgcc

SEQ ID NO: 8196640 - DNA, 22 bp, Homo sapiens
agctgccctggcggagctgctc

SEQ ID NO: 8196641 - DNA, 22 bp, Homo sapiens
agctgccctggcggagctgctc

SEQ ID NO: 8196642 - DNA, 18 bp, Homo sapiens
agctgccctgggctggag

SEQ ID NO: 8196643 - DNA, 17 bp, Homo sapiens
agctgcctctcccacca

SEQ ID NO: 8196644 - DNA, 22 bp, Homo sapiens
agctgcctctcttgaggttacg

SEQ ID NO: 8196645 - DNA, 22 bp, Homo sapiens
agctgcctccctgtgcttgtcc

SEQ ID NO: 8196646 - DNA, 22 bp, Homo sapiens
agctgcctcctggtgccccatc

SEQ ID NO: 8196647 - DNA, 22 bp, Homo sapiens
agctgcctgcttatgagctcca

SEQ ID NO: 8196648 - DNA, 22 bp, Homo sapiens
agctgcctgcttatgagctcca

SEQ ID NO: 8196649 - DNA, 21 bp, Homo sapiens
agctgcctgctctggacctgg

SEQ ID NO: 8196650 - DNA, 21 bp, Homo sapiens
agctgcctgctctggacctgg

SEQ ID NO: 8196651 - DNA, 22 bp, Homo sapiens
agctgcctgccatgccgctggt

SEQ ID NO: 8196652 - DNA, 22 bp, Homo sapiens
agctgcctgccatgccgctggt

SEQ ID NO: 8196653 - DNA, 22 bp, Homo sapiens
agctgcctgcatttatatcctg

SEQ ID NO: 8196654 - DNA, 22 bp, Homo sapiens
agctgcctctcttgaggttacg

SEQ ID NO: 8196655 - DNA, 22 bp, Homo sapiens
agctgcttttattaggacaatg

SEQ ID NO: 8196656 - DNA, 22 bp, Homo sapiens
agctgctgggaccccagatcca

SEQ ID NO: 8196657 - DNA, 22 bp, Homo sapiens
agctgctgggagaagtgagcca

SEQ ID NO: 8196658 - DNA, 22 bp, Homo sapiens
agctgctgggagaagtgagcca

SEQ ID NO: 8196659 - DNA, 22 bp, Homo sapiens
agctgcctggagccagagttga

SEQ ID NO: 8196660 - DNA, 22 bp, Homo sapiens
agctggagcttcaagcaggtaa

SEQ ID NO: 8196661 - DNA, 22 bp, Homo sapiens
agctggagcttcaagcaggtaa

SEQ ID NO: 8196662 - DNA, 22 bp, Homo sapiens
agctggagcttcaagcaggtaa

SEQ ID NO: 8196663 - DNA, 22 bp, Homo sapiens
agctggagcttcaagcaggtaa

SEQ ID NO: 8196664 - DNA, 22 bp, Homo sapiens
agctggagcttcaagcaggtaa

SEQ ID NO: 8196665 - DNA, 22 bp, Homo sapiens
agctggagccagtgtgaggctt

SEQ ID NO: 8196666 - DNA, 22 bp, Homo sapiens
agctggagccagtgtgaggctt

SEQ ID NO: 8196667 - DNA, 19 bp, Homo sapiens
agctggagattggagggca

SEQ ID NO: 8196668 - DNA, 22 bp, Homo sapiens
agctggagattctggggacagt

SEQ ID NO: 8196669 - DNA, 22 bp, Homo sapiens
agctggagattctggggacagt

SEQ ID NO: 8196670 - DNA, 22 bp, Homo sapiens
agctggagattctggggacagt

SEQ ID NO: 8196671 - DNA, 22 bp, Homo sapiens
agctggagattctggggacagt

SEQ ID NO: 8196672 - DNA, 19 bp, Homo sapiens
agctggagattggagggca

SEQ ID NO: 8196673 - DNA, 19 bp, Homo sapiens
agctggagattggagggca

SEQ ID NO: 8196674 - DNA, 22 bp, Homo sapiens
agctggagccagtgtgaggctt

SEQ ID NO: 8196675 - DNA, 20 bp, Homo sapiens
agctggagaagggcccttcc

SEQ ID NO: 8196676 - DNA, 22 bp, Homo sapiens
agctggagaaacctgggagggt

SEQ ID NO: 8196677 - DNA, 22 bp, Homo sapiens
agctggagaataggaattagtg

SEQ ID NO: 8196678 - DNA, 22 bp, Homo sapiens
agctggagaataggaattagtg

SEQ ID NO: 8196679 - DNA, 22 bp, Homo sapiens
agctggagaatgtggatgatcc

SEQ ID NO: 8196680 - DNA, 22 bp, Homo sapiens
agctggagaaacctgggagggt

SEQ ID NO: 8196681 - DNA, 22 bp, Homo sapiens
agctggagaaacctgggagggt

SEQ ID NO: 8196682 - DNA, 22 bp, Homo sapiens
agctggagatgagtgacgtgcc

SEQ ID NO: 8196683 - DNA, 22 bp, Homo sapiens
agctggagatgagtgacgtgcc

SEQ ID NO: 8196684 - DNA, 22 bp, Homo sapiens
agctggagatgcccagcaccgg

SEQ ID NO: 8196685 - DNA, 22 bp, Homo sapiens
agctggagatcatgctgatact

SEQ ID NO: 8196686 - DNA, 22 bp, Homo sapiens
agctggagagtttccaggaagg

SEQ ID NO: 8196687 - DNA, 22 bp, Homo sapiens
agctggagagtttccaggaagg

SEQ ID NO: 8196688 - DNA, 22 bp, Homo sapiens
agctggagagtttccaggaagg

SEQ ID NO: 8196689 - DNA, 22 bp, Homo sapiens
agctggagaatgtggatgatcc

SEQ ID NO: 8196690 - DNA, 22 bp, Homo sapiens
agctgggcaccccgctgcgtct

SEQ ID NO: 8196691 - DNA, 22 bp, Homo sapiens
agctgggactcaactgtctggg

SEQ ID NO: 8196692 - DNA, 22 bp, Homo sapiens
agctgggcagactgcagtggtt

SEQ ID NO: 8196693 - DNA, 22 bp, Homo sapiens
agctgggcaccccgctgcgtct

SEQ ID NO: 8196694 - DNA, 22 bp, Homo sapiens
agctgggactcaactgtctggg

SEQ ID NO: 8196695 - DNA, 22 bp, Homo sapiens
agctggaggagtttctcctagc

SEQ ID NO: 8196696 - DNA, 22 bp, Homo sapiens
agctggaggagtttctcctagc

SEQ ID NO: 8196697 - DNA, 22 bp, Homo sapiens
agctgggcagtgcttggattca

SEQ ID NO: 8196698 - DNA, 22 bp, Homo sapiens
agctgggcagactgcagtggtt

SEQ ID NO: 8196699 - DNA, 23 bp, Homo sapiens
agctgggccaggtggtcagacct

SEQ ID NO: 8196700 - DNA, 22 bp, Homo sapiens
agctgggcagactgcagtggtt

SEQ ID NO: 8196701 - DNA, 22 bp, Homo sapiens
agctgggcagactgcagtggtt

SEQ ID NO: 8196702 - DNA, 21 bp, Homo sapiens
agctgggcctcagcctgcagt

SEQ ID NO: 8196703 - DNA, 21 bp, Homo sapiens
agctgggcctcagcctgcagt

SEQ ID NO: 8196704 - DNA, 23 bp, Homo sapiens
agctgggccaggtggtcagacct

SEQ ID NO: 8196705 - DNA, 22 bp, Homo sapiens
agctgggcgcagtggctggtga

SEQ ID NO: 8196706 - DNA, 22 bp, Homo sapiens
agctgggcctgagctggaagct

SEQ ID NO: 8196707 - DNA, 22 bp, Homo sapiens
agctgggcctgatttgcagggg

SEQ ID NO: 8196708 - DNA, 22 bp, Homo sapiens
agctgggcctgagctggaagct

SEQ ID NO: 8196709 - DNA, 21 bp, Homo sapiens
agctgggcctcagcctgcagt

SEQ ID NO: 8196710 - DNA, 21 bp, Homo sapiens
agctgggcctcagcctgcagt

SEQ ID NO: 8196711 - DNA, 22 bp, Homo sapiens
agctgggctgatgactcatgtt

SEQ ID NO: 8196712 - DNA, 22 bp, Homo sapiens
agctgggctgatgactcatgtt

SEQ ID NO: 8196713 - DNA, 22 bp, Homo sapiens
agctgggctggagctccaagcg

SEQ ID NO: 8196714 - DNA, 22 bp, Homo sapiens
agctgggctgatgactcatgtt

SEQ ID NO: 8196715 - DNA, 22 bp, Homo sapiens
caggcagagctgaagatagatg

SEQ ID NO: 8196716 - DNA, 22 bp, Homo sapiens
agctgggcgcagtggctggtga

SEQ ID NO: 8196717 - DNA, 22 bp, Homo sapiens
agctggtccttccctgccctgt

SEQ ID NO: 8196718 - DNA, 22 bp, Homo sapiens
agctggtccttggcagttctca

SEQ ID NO: 8196719 - DNA, 22 bp, Homo sapiens
agctggtccttccctgccctgt

SEQ ID NO: 8196720 - DNA, 22 bp, Homo sapiens
agctggtcctaattgagccatt

SEQ ID NO: 8196721 - DNA, 22 bp, Homo sapiens
agctggtcctaattgagccatt

SEQ ID NO: 8196722 - DNA, 22 bp, Homo sapiens
agctggtcttaaatgtgtccag

SEQ ID NO: 8196723 - DNA, 22 bp, Homo sapiens
agctggtctgctgcatggagtg

SEQ ID NO: 8196724 - DNA, 22 bp, Homo sapiens
agctggtccttggcagttctca

SEQ ID NO: 8196725 - DNA, 22 bp, Homo sapiens
agctggtgaacctgaggcacag

SEQ ID NO: 8196726 - DNA, 22 bp, Homo sapiens
agctggtgaacctgaggcacag

SEQ ID NO: 8196727 - DNA, 22 bp, Homo sapiens
agctggtgaacctgaggcacag

SEQ ID NO: 8196728 - DNA, 20 bp, Homo sapiens
agctggtgaattaaagactg

SEQ ID NO: 8196729 - DNA, 22 bp, Homo sapiens
agctggtgctcaggggcatgga

SEQ ID NO: 8196730 - DNA, 22 bp, Homo sapiens
agctggtgatgtggtccctcac

SEQ ID NO: 8196731 - DNA, 22 bp, Homo sapiens
agctggtgcctgcttttgtgtg

SEQ ID NO: 8196732 - DNA, 22 bp, Homo sapiens
agctggtgctcaggggcatgga

SEQ ID NO: 8196733 - DNA, 22 bp, Homo sapiens
agctggtgctcggggagctggc

SEQ ID NO: 8196734 - DNA, 22 bp, Homo sapiens
agctggtgagggttgaggggta

SEQ ID NO: 8196735 - DNA, 20 bp, Homo sapiens
agctggtgaattaaagactg

SEQ ID NO: 8196736 - DNA, 20 bp, Homo sapiens
agctggtgaattaaagactg

SEQ ID NO: 8196737 - DNA, 20 bp, Homo sapiens
agctggtccccaagcctctc

SEQ ID NO: 8196738 - DNA, 22 bp, Homo sapiens
agctggtatttgttagggagtt

SEQ ID NO: 8196739 - DNA, 22 bp, Homo sapiens
agctgggtttctggcaggctta

SEQ ID NO: 8196740 - DNA, 22 bp, Homo sapiens
agctgggtttctggcaggctta

SEQ ID NO: 8196741 - DNA, 22 bp, Homo sapiens
agctggtaaaggggaaagcaga

SEQ ID NO: 8196742 - DNA, 19 bp, Homo sapiens
agctgggtgttagtggaga

SEQ ID NO: 8196743 - DNA, 19 bp, Homo sapiens
agctgggtgttagtggaga

SEQ ID NO: 8196744 - DNA, 22 bp, Homo sapiens
agctgggtgtgtatcagataaa

SEQ ID NO: 8196745 - DNA, 19 bp, Homo sapiens
agctgggtgttagtggaga

SEQ ID NO: 8196746 - DNA, 17 bp, Homo sapiens
agctgggttctcaggaa

SEQ ID NO: 8196747 - DNA, 17 bp, Homo sapiens
agctgggttctcaggaa

SEQ ID NO: 8196748 - DNA, 22 bp, Homo sapiens
agctgggttgacaagatggaaa

SEQ ID NO: 8196749 - DNA, 20 bp, Homo sapiens
caggcagaggatgctgacca

SEQ ID NO: 8196750 - DNA, 22 bp, Homo sapiens
caggcagaggaagtctgggtct

SEQ ID NO: 8196751 - DNA, 22 bp, Homo sapiens
caggcagaggaagtctgggtct

SEQ ID NO: 8196752 - DNA, 20 bp, Homo sapiens
caggcagaggatgctgacca

SEQ ID NO: 8196753 - DNA, 22 bp, Homo sapiens
caggcagaggcttttcatggct

SEQ ID NO: 8196754 - DNA, 22 bp, Homo sapiens
caggcagagtgagaagcccttg

SEQ ID NO: 8196755 - DNA, 22 bp, Homo sapiens
caggcagagtcagattagactt

SEQ ID NO: 8196756 - DNA, 22 bp, Homo sapiens
agctgggtgcccgaagccacgt

SEQ ID NO: 8196757 - DNA, 19 bp, Homo sapiens
agctggggcggtgtgtgtt

SEQ ID NO: 8196758 - DNA, 19 bp, Homo sapiens
agctggggcggtgtgtgtt

SEQ ID NO: 8196759 - DNA, 22 bp, Homo sapiens
caggcagagtgagaagcccttg

SEQ ID NO: 8196760 - DNA, 22 bp, Homo sapiens
caggcagagtgagaagcccttg

SEQ ID NO: 8196761 - DNA, 22 bp, Homo sapiens
caggcagagtgagaagcccttg

SEQ ID NO: 8196762 - DNA, 19 bp, Homo sapiens
agctggggcggtgtgtgtt

SEQ ID NO: 8196763 - DNA, 19 bp, Homo sapiens
agctggggcggtgtgtgtt

SEQ ID NO: 8196764 - DNA, 19 bp, Homo sapiens
agctggggcggtgtgtgtt

SEQ ID NO: 8196765 - DNA, 22 bp, Homo sapiens
caggcagagtgaggtggtctaa

SEQ ID NO: 8196766 - DNA, 22 bp, Homo sapiens
agctgggtgtagggctggacaa

SEQ ID NO: 8196767 - DNA, 22 bp, Homo sapiens
agctgggtgtagggctggacaa

SEQ ID NO: 8196768 - DNA, 22 bp, Homo sapiens
agctgggtggtgctgagccttg

SEQ ID NO: 8196769 - DNA, 21 bp, Homo sapiens
agctgggtgctaatgacaact

SEQ ID NO: 8196770 - DNA, 23 bp, Homo sapiens
agctgggtggcctgcgtgaagct

SEQ ID NO: 8196771 - DNA, 23 bp, Homo sapiens
agctgggtggcctgcgtgaagct

SEQ ID NO: 8196772 - DNA, 22 bp, Homo sapiens
cagttcatagtcttcatgtctc

SEQ ID NO: 8196773 - DNA, 22 bp, Homo sapiens
cagttccatcttcatctttccc

SEQ ID NO: 8196774 - DNA, 22 bp, Homo sapiens
cagttcaggccggctgactcag

SEQ ID NO: 8196775 - DNA, 22 bp, Homo sapiens
cagttcaaagttaagcagcagt

SEQ ID NO: 8196776 - DNA, 22 bp, Homo sapiens
cagttattctagttccacatct

SEQ ID NO: 8196777 - DNA, 21 bp, Homo sapiens
cagttattcttgatgtgtgtg

SEQ ID NO: 8196778 - DNA, 22 bp, Homo sapiens
cagttatttcaacagagaggat

SEQ ID NO: 8196779 - DNA, 22 bp, Homo sapiens
cagttattttgaggattaaatg

SEQ ID NO: 8196780 - DNA, 22 bp, Homo sapiens
cagttatttcaacagagaggat

SEQ ID NO: 8196781 - DNA, 22 bp, Homo sapiens
cagttattatcttagagagaca

SEQ ID NO: 8196782 - DNA, 22 bp, Homo sapiens
cagttataggagccattgtata

SEQ ID NO: 8196783 - DNA, 17 bp, Homo sapiens
aggagctgggggtggtg

SEQ ID NO: 8196784 - DNA, 17 bp, Homo sapiens
aggagctgggggtggtg

SEQ ID NO: 8196785 - DNA, 17 bp, Homo sapiens
aggagctgggggtggtg

SEQ ID NO: 8196786 - DNA, 22 bp, Homo sapiens
catcacccggaactgtgtctgc

SEQ ID NO: 8196787 - DNA, 22 bp, Homo sapiens
catcactacaaatttaagaaat

SEQ ID NO: 8196788 - DNA, 22 bp, Homo sapiens
catcacatttaattaaaatgtc

SEQ ID NO: 8196789 - DNA, 22 bp, Homo sapiens
catcacatttaaggggaaggac

SEQ ID NO: 8196790 - DNA, 22 bp, Homo sapiens
catcacatttaattaaaatgtc

SEQ ID NO: 8196791 - DNA, 22 bp, Homo sapiens
catattttagttgctgaacagc

SEQ ID NO: 8196792 - DNA, 19 bp, Homo sapiens
catatttttgggctggcat

SEQ ID NO: 8196793 - DNA, 23 bp, Homo sapiens
cagttcccactgtctgtcacaag

SEQ ID NO: 8196794 - DNA, 22 bp, Homo sapiens
cagttccctaatgtgtagaaga

SEQ ID NO: 8196795 - DNA, 22 bp, Homo sapiens
cagttctcttgatcgtctcttg

SEQ ID NO: 8196796 - DNA, 22 bp, Homo sapiens
cagttctcttgatcgtctcttg

SEQ ID NO: 8196797 - DNA, 22 bp, Homo sapiens
cagttctctgtgcctcgctggg

SEQ ID NO: 8196798 - DNA, 22 bp, Homo sapiens
aggaggctgggcacagtggcct

SEQ ID NO: 8196799 - DNA, 22 bp, Homo sapiens
aggaggctgggcacagtggcct

SEQ ID NO: 8196800 - DNA, 22 bp, Homo sapiens
aggaggctgggcacagtggcct

SEQ ID NO: 8196801 - DNA, 22 bp, Homo sapiens
aggaggctgggcacagtggcct

SEQ ID NO: 8196802 - DNA, 22 bp, Homo sapiens
aggaggctgcaaccctgaggcc

SEQ ID NO: 8196803 - DNA, 22 bp, Homo sapiens
catcagaattacttggggagct

SEQ ID NO: 8196804 - DNA, 22 bp, Homo sapiens
catcagaggtacttaatgaatg

SEQ ID NO: 8196805 - DNA, 23 bp, Homo sapiens
catcagaggttgccactccctgg

SEQ ID NO: 8196806 - DNA, 23 bp, Homo sapiens
catcagaggttgccactccctgg

SEQ ID NO: 8196807 - DNA, 22 bp, Homo sapiens
catcagagtcagagctctttct

SEQ ID NO: 8196808 - DNA, 22 bp, Homo sapiens
aggaggctgcaaccctgaggcc

SEQ ID NO: 8196809 - DNA, 22 bp, Homo sapiens
aggaggctgcaaccctgaggcc

SEQ ID NO: 8196810 - DNA, 22 bp, Homo sapiens
catcagaacgtgagctccttgt

SEQ ID NO: 8196811 - DNA, 22 bp, Homo sapiens
catcagaaagagtcctggactt

SEQ ID NO: 8196812 - DNA, 22 bp, Homo sapiens
catcagaaccagctgggtgagg

SEQ ID NO: 8196813 - DNA, 22 bp, Homo sapiens
catcactgacgctgagattcca

SEQ ID NO: 8196814 - DNA, 22 bp, Homo sapiens
catcatttcacttagatgaagt

SEQ ID NO: 8196815 - DNA, 22 bp, Homo sapiens
catcatttcacttagatgaagt

SEQ ID NO: 8196816 - DNA, 22 bp, Homo sapiens
catcatttaattataggggctg

SEQ ID NO: 8196817 - DNA, 22 bp, Homo sapiens
catcattcctaggtgcagagct

SEQ ID NO: 8196818 - DNA, 22 bp, Homo sapiens
catcattgcctgtttcccttgg

SEQ ID NO: 8196819 - DNA, 22 bp, Homo sapiens
catcattgaacacttcttcctg

SEQ ID NO: 8196820 - DNA, 22 bp, Homo sapiens
catcattaccttgtaaccaata

SEQ ID NO: 8196821 - DNA, 22 bp, Homo sapiens
catcattaccatcattagtagt

SEQ ID NO: 8196822 - DNA, 20 bp, Homo sapiens
catcattttaaaatctctcc

SEQ ID NO: 8196823 - DNA, 20 bp, Homo sapiens
catcattttaaaatctctcc

SEQ ID NO: 8196824 - DNA, 22 bp, Homo sapiens
catcattttattaaccaagaaa

SEQ ID NO: 8196825 - DNA, 22 bp, Homo sapiens
catcatttgtttgcatgcagga

SEQ ID NO: 8196826 - DNA, 22 bp, Homo sapiens
catcatttgttcacttgattcc

SEQ ID NO: 8196827 - DNA, 22 bp, Homo sapiens
catcatttgttcacttgattcc

SEQ ID NO: 8196828 - DNA, 22 bp, Homo sapiens
catcatttgttcacttgattcc

SEQ ID NO: 8196829 - DNA, 22 bp, Homo sapiens
aggaggttgccagtctgggggt

SEQ ID NO: 8196830 - DNA, 22 bp, Homo sapiens
aggagtatctaataatctgaga

SEQ ID NO: 8196831 - DNA, 22 bp, Homo sapiens
aggaggtgttgatagaaggttt

SEQ ID NO: 8196832 - DNA, 22 bp, Homo sapiens
aggagtgggggcgagaagttaa

SEQ ID NO: 8196833 - DNA, 22 bp, Homo sapiens
catcattttgtatccaagggga

SEQ ID NO: 8196834 - DNA, 22 bp, Homo sapiens
catcattttattaaccaagaaa

SEQ ID NO: 8196835 - DNA, 22 bp, Homo sapiens
catcatttttgtaagctggtag

SEQ ID NO: 8196836 - DNA, 22 bp, Homo sapiens
catcattttgtatccaagggga

SEQ ID NO: 8196837 - DNA, 22 bp, Homo sapiens
aggagtggtgcaggacctgcca

SEQ ID NO: 8196838 - DNA, 22 bp, Homo sapiens
aggagtggtgcaggacctgcca

SEQ ID NO: 8196839 - DNA, 22 bp, Homo sapiens
aggagtgtgaagagcctagatc

SEQ ID NO: 8196840 - DNA, 22 bp, Homo sapiens
aggagtgttagagtagagctgg

SEQ ID NO: 8196841 - DNA, 22 bp, Homo sapiens
aggagtgtggccagggctctgg

SEQ ID NO: 8196842 - DNA, 22 bp, Homo sapiens
aggagtgtgaagagcctagatc

SEQ ID NO: 8196843 - DNA, 22 bp, Homo sapiens
aggaggggcatagaaatgtaat

SEQ ID NO: 8196844 - DNA, 22 bp, Homo sapiens
aggaggctggttcaggccatat

SEQ ID NO: 8196845 - DNA, 22 bp, Homo sapiens
aggaggctggttcaggccatat

SEQ ID NO: 8196846 - DNA, 22 bp, Homo sapiens
aggaggctggttcaggccatat

SEQ ID NO: 8196847 - DNA, 22 bp, Homo sapiens
aggagggtggcctcatgtgagt

SEQ ID NO: 8196848 - DNA, 22 bp, Homo sapiens
aggagggtggcctcatgtgagt

SEQ ID NO: 8196849 - DNA, 22 bp, Homo sapiens
aggagggtggcctcatgtgagt

SEQ ID NO: 8196850 - DNA, 22 bp, Homo sapiens
aggagggtggcctcatgtgagt

SEQ ID NO: 8196851 - DNA, 22 bp, Homo sapiens
aggagggttctctggacagagg

SEQ ID NO: 8196852 - DNA, 22 bp, Homo sapiens
aggagggtggggtctgcctgtc

SEQ ID NO: 8196853 - DNA, 22 bp, Homo sapiens
aggagggtggggtctgcctgtc

SEQ ID NO: 8196854 - DNA, 22 bp, Homo sapiens
aggagggtggggtctgcctgtc

SEQ ID NO: 8196855 - DNA, 22 bp, Homo sapiens
aggagggtggggtctgcctgtc

SEQ ID NO: 8196856 - DNA, 22 bp, Homo sapiens
aggaggtgacagcctgcatctg

SEQ ID NO: 8196857 - DNA, 22 bp, Homo sapiens
aggaggtcagagccccatgctg

SEQ ID NO: 8196858 - DNA, 22 bp, Homo sapiens
aggaggtgacagcctgcatctg

SEQ ID NO: 8196859 - DNA, 22 bp, Homo sapiens
aggaggtgacagcctgcatctg

SEQ ID NO: 8196860 - DNA, 22 bp, Homo sapiens
aggaggtgagcggtcatgtggt

SEQ ID NO: 8196861 - DNA, 22 bp, Homo sapiens
aggaggtgagcggtcatgtggt

SEQ ID NO: 8196862 - DNA, 22 bp, Homo sapiens
aggaggtgagcggtcatgtggt

SEQ ID NO: 8196863 - DNA, 20 bp, Homo sapiens
aggagggtttctctgacaca

SEQ ID NO: 8196864 - DNA, 20 bp, Homo sapiens
aggaggtcaaatggaatctg

SEQ ID NO: 8196865 - DNA, 22 bp, Homo sapiens
aggaggtagtcttataaatgtt

SEQ ID NO: 8196866 - DNA, 20 bp, Homo sapiens
aggaggtcaaatggaatctg

SEQ ID NO: 8196867 - DNA, 22 bp, Homo sapiens
aggagggtttcaatgggatgag

SEQ ID NO: 8196868 - DNA, 22 bp, Homo sapiens
aggagggttctctggacagagg

SEQ ID NO: 8196869 - DNA, 22 bp, Homo sapiens
aggagggttctctggacagagg

SEQ ID NO: 8196870 - DNA, 22 bp, Homo sapiens
aggagggttctctggacagagg

SEQ ID NO: 8196871 - DNA, 22 bp, Homo sapiens
aggagggtttcaatgggatgag

SEQ ID NO: 8196872 - DNA, 22 bp, Homo sapiens
aggagggtttcaatgggatgag

SEQ ID NO: 8196873 - DNA, 22 bp, Homo sapiens
aggagggttgaggaggatactt

SEQ ID NO: 8196874 - DNA, 22 bp, Homo sapiens
aggagggttgaggaggatactt

SEQ ID NO: 8196875 - DNA, 22 bp, Homo sapiens
cagtctgatgttcgcaggtgaa

SEQ ID NO: 8196876 - DNA, 22 bp, Homo sapiens
cagtctgaacactgggctactc

SEQ ID NO: 8196877 - DNA, 22 bp, Homo sapiens
cagtctcttttcagctccatcc

SEQ ID NO: 8196878 - DNA, 22 bp, Homo sapiens
aggacaaaggaccagatctgga

SEQ ID NO: 8196879 - DNA, 22 bp, Homo sapiens
aggaatttttctagccggagtt

SEQ ID NO: 8196880 - DNA, 22 bp, Homo sapiens
aggacaaaggaccagatctgga

SEQ ID NO: 8196881 - DNA, 22 bp, Homo sapiens
aggacaaaggaccagatctgga

SEQ ID NO: 8196882 - DNA, 22 bp, Homo sapiens
aggacaagacaaggaccagaga

SEQ ID NO: 8196883 - DNA, 22 bp, Homo sapiens
aggacaaaggaccagatctgga

SEQ ID NO: 8196884 - DNA, 22 bp, Homo sapiens
aggacaaaggaccagatctgga

SEQ ID NO: 8196885 - DNA, 22 bp, Homo sapiens
cagtgaggatgataattaaggt

SEQ ID NO: 8196886 - DNA, 22 bp, Homo sapiens
cagtgaggagtccagggcagag

SEQ ID NO: 8196887 - DNA, 22 bp, Homo sapiens
cagtgaggagtccagggcagag

SEQ ID NO: 8196888 - DNA, 22 bp, Homo sapiens
cagtgaggagtccagggcagag

SEQ ID NO: 8196889 - DNA, 22 bp, Homo sapiens
cagtgaggagtccagggcagag

SEQ ID NO: 8196890 - DNA, 22 bp, Homo sapiens
cagtgaggagtccagggcagag

SEQ ID NO: 8196891 - DNA, 22 bp, Homo sapiens
cagtgaggagtccagggcagag

SEQ ID NO: 8196892 - DNA, 22 bp, Homo sapiens
aggaatgtttagaatgtcagaa

SEQ ID NO: 8196893 - DNA, 22 bp, Homo sapiens
aggaattaacaatatatttagg

SEQ ID NO: 8196894 - DNA, 22 bp, Homo sapiens
aggaattactcatctgtggtat

SEQ ID NO: 8196895 - DNA, 22 bp, Homo sapiens
aggaattcaagaccagctgggc

SEQ ID NO: 8196896 - DNA, 22 bp, Homo sapiens
aggaattatagtagtatttgtc

SEQ ID NO: 8196897 - DNA, 22 bp, Homo sapiens
aggaattcaagaccagctgggc

SEQ ID NO: 8196898 - DNA, 22 bp, Homo sapiens
aggaattcaagaccagctgggc

SEQ ID NO: 8196899 - DNA, 22 bp, Homo sapiens
aggaattgcctggggcctggga

SEQ ID NO: 8196900 - DNA, 22 bp, Homo sapiens
aggaattgagatcctaggtttt

SEQ ID NO: 8196901 - DNA, 22 bp, Homo sapiens
aggaattgagatcctaggtttt

SEQ ID NO: 8196902 - DNA, 22 bp, Homo sapiens
aggaattcaagaccagctgggc

SEQ ID NO: 8196903 - DNA, 22 bp, Homo sapiens
aggaattgagatcctaggtttt

SEQ ID NO: 8196904 - DNA, 22 bp, Homo sapiens
aggaattttacatctcagagag

SEQ ID NO: 8196905 - DNA, 22 bp, Homo sapiens
aggaattttacaagctggttgc

SEQ ID NO: 8196906 - DNA, 22 bp, Homo sapiens
aggaattttcacagttgggtat

SEQ ID NO: 8196907 - DNA, 22 bp, Homo sapiens
aggaatttgagtgctgtaggaa

SEQ ID NO: 8196908 - DNA, 19 bp, Homo sapiens
aggaatttctcagggaggc

SEQ ID NO: 8196909 - DNA, 22 bp, Homo sapiens
aggaatttaagggctcagagag

SEQ ID NO: 8196910 - DNA, 22 bp, Homo sapiens
aggaattgtgttgtagtggaga

SEQ ID NO: 8196911 - DNA, 22 bp, Homo sapiens
aggaattgtgttgtagtggaga

SEQ ID NO: 8196912 - DNA, 22 bp, Homo sapiens
aggaattggttcaaggtttatc

SEQ ID NO: 8196913 - DNA, 22 bp, Homo sapiens
aggaattggcacggccttctca

SEQ ID NO: 8196914 - DNA, 22 bp, Homo sapiens
aggaattgcctggggcctggga

SEQ ID NO: 8196915 - DNA, 22 bp, Homo sapiens
cagtgcagccaaggacaggcac

SEQ ID NO: 8196916 - DNA, 22 bp, Homo sapiens
cagtgcagccaaggacaggcac

SEQ ID NO: 8196917 - DNA, 22 bp, Homo sapiens
cagtgagggcattcagtgctgg

SEQ ID NO: 8196918 - DNA, 22 bp, Homo sapiens
cagtgagggcattcagtgctgg

SEQ ID NO: 8196919 - DNA, 22 bp, Homo sapiens
cagtgagggcattcagtgctgg

SEQ ID NO: 8196920 - DNA, 22 bp, Homo sapiens
cagtgagggcattcagtgctgg

SEQ ID NO: 8196921 - DNA, 22 bp, Homo sapiens
cagtgaggctctgctgagcggt

SEQ ID NO: 8196922 - DNA, 22 bp, Homo sapiens
cagtgaggctctgctgagcggt

SEQ ID NO: 8196923 - DNA, 22 bp, Homo sapiens
cagtgagggaagatctcagcac

SEQ ID NO: 8196924 - DNA, 22 bp, Homo sapiens
cagtgagggaagatctcagcac

SEQ ID NO: 8196925 - DNA, 22 bp, Homo sapiens
cagtgagggaagatctcagcac

SEQ ID NO: 8196926 - DNA, 22 bp, Homo sapiens
cagtgaggctctgctgagcggt

SEQ ID NO: 8196927 - DNA, 22 bp, Homo sapiens
cagtgaggctctgctgagcggt

SEQ ID NO: 8196928 - DNA, 22 bp, Homo sapiens
cagtgagggaagatctcagcac

SEQ ID NO: 8196929 - DNA, 23 bp, Homo sapiens
cagtgcagggcaactcagactcc

SEQ ID NO: 8196930 - DNA, 22 bp, Homo sapiens
cagtgcaggctgggggccctgc

SEQ ID NO: 8196931 - DNA, 22 bp, Homo sapiens
cagtgcaggaagtgagatgcct

SEQ ID NO: 8196932 - DNA, 22 bp, Homo sapiens
cagtgcaggcttgtggccgcag

SEQ ID NO: 8196933 - DNA, 20 bp, Homo sapiens
aggagatgatccagagtcag

SEQ ID NO: 8196934 - DNA, 20 bp, Homo sapiens
aggagatgatccagagtcag

SEQ ID NO: 8196935 - DNA, 23 bp, Homo sapiens
cagtgcagggcaactcagactcc

SEQ ID NO: 8196936 - DNA, 22 bp, Homo sapiens
cagtgcaggctgggggccctgc

SEQ ID NO: 8196937 - DNA, 22 bp, Homo sapiens
cagtgcaggaagtgagatgcct

SEQ ID NO: 8196938 - DNA, 22 bp, Homo sapiens
cagtgcaggaagtgagatgcct

SEQ ID NO: 8196939 - DNA, 22 bp, Homo sapiens
cagtgcaggaagtgagatgcct

SEQ ID NO: 8196940 - DNA, 22 bp, Homo sapiens
cagtgcagccaaggacaggcac

SEQ ID NO: 8196941 - DNA, 22 bp, Homo sapiens
cagtgcagccaaggacaggcac

SEQ ID NO: 8196942 - DNA, 22 bp, Homo sapiens
cagtgcagccaaggacaggcac

SEQ ID NO: 8196943 - DNA, 22 bp, Homo sapiens
cagtgcagccaaggacaggcac

SEQ ID NO: 8196944 - DNA, 22 bp, Homo sapiens
cagtgcagctgccccgctggta

SEQ ID NO: 8196945 - DNA, 22 bp, Homo sapiens
cagtgcagctgccccgctggta

SEQ ID NO: 8196946 - DNA, 22 bp, Homo sapiens
aggagctgggagaaggactaaa

SEQ ID NO: 8196947 - DNA, 22 bp, Homo sapiens
aggagctgggagaaggactaaa

SEQ ID NO: 8196948 - DNA, 22 bp, Homo sapiens
aggagctggcctagaaaggaga

SEQ ID NO: 8196949 - DNA, 22 bp, Homo sapiens
aggagctgggagaaggactaaa

SEQ ID NO: 8196950 - DNA, 22 bp, Homo sapiens
aggagctgggagaaggactaaa

SEQ ID NO: 8196951 - DNA, 22 bp, Homo sapiens
aggagctgggagaaggactaaa

SEQ ID NO: 8196952 - DNA, 22 bp, Homo sapiens
aggagctgggcccaaggatgct

SEQ ID NO: 8196953 - DNA, 22 bp, Homo sapiens
aggagctgggcccaaggatgct

SEQ ID NO: 8196954 - DNA, 22 bp, Homo sapiens
aggagctgggcccaaggatgct

SEQ ID NO: 8196955 - DNA, 22 bp, Homo sapiens
aggagctgggcccaaggatgct

SEQ ID NO: 8196956 - DNA, 22 bp, Homo sapiens
aggagctgggcccaaggatgct

SEQ ID NO: 8196957 - DNA, 22 bp, Homo sapiens
aggagctgggcccaaggatgct

SEQ ID NO: 8196958 - DNA, 22 bp, Homo sapiens
aggagctgggctgctgctggga

SEQ ID NO: 8196959 - DNA, 22 bp, Homo sapiens
aggagctgggctgctgctggga

SEQ ID NO: 8196960 - DNA, 22 bp, Homo sapiens
aggagctgggctgctgctggga

SEQ ID NO: 8196961 - DNA, 22 bp, Homo sapiens
aggagctgggcccaaggatgct

SEQ ID NO: 8196962 - DNA, 22 bp, Homo sapiens
aggagctgggctgctgctggga

SEQ ID NO: 8196963 - DNA, 17 bp, Homo sapiens
aggagctgggggtggtg

SEQ ID NO: 8196964 - DNA, 22 bp, Homo sapiens
aggagctgggctgctgctggga

SEQ ID NO: 8196965 - DNA, 22 bp, Homo sapiens
aggagctgggctgctgctggga

SEQ ID NO: 8196966 - DNA, 22 bp, Homo sapiens
aggagctgggctgctgctggga

SEQ ID NO: 8196967 - DNA, 23 bp, Homo sapiens
cagtggagactcatgcttcctta

SEQ ID NO: 8196968 - DNA, 23 bp, Homo sapiens
cagtggagactcatgcttcctta

SEQ ID NO: 8196969 - DNA, 22 bp, Homo sapiens
cagtggagagacttttactctt

SEQ ID NO: 8196970 - DNA, 22 bp, Homo sapiens
aggagctgatagtctatggaga

SEQ ID NO: 8196971 - DNA, 22 bp, Homo sapiens
cagtggaatatataggggattt

SEQ ID NO: 8196972 - DNA, 22 bp, Homo sapiens
cagtggaagctggctgtgaaga

SEQ ID NO: 8196973 - DNA, 22 bp, Homo sapiens
cagtggaatacgagcagatgtc

SEQ ID NO: 8196974 - DNA, 22 bp, Homo sapiens
aggagctggccactaggatgca

SEQ ID NO: 8196975 - DNA, 22 bp, Homo sapiens
aggagctggccactaggatgca

SEQ ID NO: 8196976 - DNA, 22 bp, Homo sapiens
aggagctggccactaggatgca

SEQ ID NO: 8196977 - DNA, 22 bp, Homo sapiens
aggagctggccactaggatgca

SEQ ID NO: 8196978 - DNA, 22 bp, Homo sapiens
aggagctggccactaggatgca

SEQ ID NO: 8196979 - DNA, 22 bp, Homo sapiens
aggagctgatagtctatggaga

SEQ ID NO: 8196980 - DNA, 22 bp, Homo sapiens
aggagctgatgattctttgatc

SEQ ID NO: 8196981 - DNA, 22 bp, Homo sapiens
aggagctggcctagaaaggaga

SEQ ID NO: 8196982 - DNA, 22 bp, Homo sapiens
aggagctggccactaggatgca

SEQ ID NO: 8196983 - DNA, 22 bp, Homo sapiens
cagtggaaactatgctgctgga

SEQ ID NO: 8196984 - DNA, 22 bp, Homo sapiens
cagtgcttttttaccttccaac

SEQ ID NO: 8196985 - DNA, 22 bp, Homo sapiens
cagtggaaatcagagtgagagt

SEQ ID NO: 8196986 - DNA, 22 bp, Homo sapiens
cagtgcttttttaccttccaac

SEQ ID NO: 8196987 - DNA, 22 bp, Homo sapiens
cagtggaaactatgctgctgga

SEQ ID NO: 8196988 - DNA, 22 bp, Homo sapiens
aggagccacctaggagctgttt

SEQ ID NO: 8196989 - DNA, 22 bp, Homo sapiens
cagtgctttgggaggctgagga

SEQ ID NO: 8196990 - DNA, 22 bp, Homo sapiens
cagtgcttggggagcggagaga

SEQ ID NO: 8196991 - DNA, 22 bp, Homo sapiens
cagtgcttttaaaacaacatca

SEQ ID NO: 8196992 - DNA, 22 bp, Homo sapiens
aggagccaatctgataaagcca

SEQ ID NO: 8196993 - DNA, 22 bp, Homo sapiens
aggagccaaggaaaacagtatt

SEQ ID NO: 8196994 - DNA, 22 bp, Homo sapiens
aggagccaaggaaaacagtatt

SEQ ID NO: 8196995 - DNA, 22 bp, Homo sapiens
aggagccaagcagaactaagga

SEQ ID NO: 8196996 - DNA, 22 bp, Homo sapiens
aggagccaagcagaactaagga

SEQ ID NO: 8196997 - DNA, 22 bp, Homo sapiens
aggagccaagatggggcaagta

SEQ ID NO: 8196998 - DNA, 22 bp, Homo sapiens
aggagccaagatgctgtctggc

SEQ ID NO: 8196999 - DNA, 22 bp, Homo sapiens
aggagccaagatgctgtctggc

SEQ ID NO: 8197000 - DNA, 22 bp, Homo sapiens
aggagccaaattttagactctg

SEQ ID NO: 8197001 - DNA, 22 bp, Homo sapiens
aggagccaaattttagactctg

SEQ ID NO: 8197002 - DNA, 22 bp, Homo sapiens
aggagccaagatgctgtctggc

SEQ ID NO: 8197003 - DNA, 22 bp, Homo sapiens
aggagcagcttctgaaccatgt

SEQ ID NO: 8197004 - DNA, 22 bp, Homo sapiens
aggagccaaaagctgaacaaga

SEQ ID NO: 8197005 - DNA, 22 bp, Homo sapiens
aggagccaaattactagctctg

SEQ ID NO: 8197006 - DNA, 22 bp, Homo sapiens
aggagccaaaagctgaacaaga

SEQ ID NO: 8197007 - DNA, 22 bp, Homo sapiens
aggagcagattggtaagatcat

SEQ ID NO: 8197008 - DNA, 22 bp, Homo sapiens
aggagcagattggtaagatcat

SEQ ID NO: 8197009 - DNA, 22 bp, Homo sapiens
aggagatggagctcagtgggca

SEQ ID NO: 8197010 - DNA, 22 bp, Homo sapiens
aggagatggagctcagtgggca

SEQ ID NO: 8197011 - DNA, 22 bp, Homo sapiens
aggagatggagctcagtgggca

SEQ ID NO: 8197012 - DNA, 22 bp, Homo sapiens
aggagcagcccactcctgtcct

SEQ ID NO: 8197013 - DNA, 22 bp, Homo sapiens
aggagcagcccactcctgtcct

SEQ ID NO: 8197014 - DNA, 22 bp, Homo sapiens
aggagcagcccactcctgtcct

SEQ ID NO: 8197015 - DNA, 22 bp, Homo sapiens
aggagcagcccactcctgtcct

SEQ ID NO: 8197016 - DNA, 22 bp, Homo sapiens
ccaaaatattagtgcttaagta

SEQ ID NO: 8197017 - DNA, 22 bp, Homo sapiens
ccaaaccatccatctccaggct

SEQ ID NO: 8197018 - DNA, 22 bp, Homo sapiens
ccaaactgtgtcgtctgcatag

SEQ ID NO: 8197019 - DNA, 22 bp, Homo sapiens
ccaaagaaacccaagctcaggg

SEQ ID NO: 8197020 - DNA, 20 bp, Homo sapiens
ccaaagactgccccttccag

SEQ ID NO: 8197021 - DNA, 22 bp, Homo sapiens
ccaaagacagacttgactagag

SEQ ID NO: 8197022 - DNA, 22 bp, Homo sapiens
aggcaggccctctggaaaggta

SEQ ID NO: 8197023 - DNA, 22 bp, Homo sapiens
aggcaggcccctgagaatagac

SEQ ID NO: 8197024 - DNA, 23 bp, Homo sapiens
aggcaggcagttcagctgttgtt

SEQ ID NO: 8197025 - DNA, 23 bp, Homo sapiens
aggcaggcagttcagctgttgtt

SEQ ID NO: 8197026 - DNA, 21 bp, Homo sapiens
aggcaggattcaaacacagag

SEQ ID NO: 8197027 - DNA, 21 bp, Homo sapiens
aggcaggattcaaacacagag

SEQ ID NO: 8197028 - DNA, 21 bp, Homo sapiens
aggcaggattcaaacacagag

SEQ ID NO: 8197029 - DNA, 22 bp, Homo sapiens
aggcaggcccctgagaatagac

SEQ ID NO: 8197030 - DNA, 23 bp, Homo sapiens
aggcaggcagttcagctgttgtt

SEQ ID NO: 8197031 - DNA, 22 bp, Homo sapiens
aggcaggccctgggccatcccg

SEQ ID NO: 8197032 - DNA, 22 bp, Homo sapiens
aggcaggccctgggccatcccg

SEQ ID NO: 8197033 - DNA, 22 bp, Homo sapiens
aggcaggccctctggaaaggta

SEQ ID NO: 8197034 - DNA, 22 bp, Homo sapiens
aggcaggccctctggaaaggta

SEQ ID NO: 8197035 - DNA, 22 bp, Homo sapiens
aggcaggccctgggccatcccg

SEQ ID NO: 8197036 - DNA, 22 bp, Homo sapiens
aggcaggccctctggaaaggta

SEQ ID NO: 8197037 - DNA, 22 bp, Homo sapiens
aggcaggccctctggaaaggta

SEQ ID NO: 8197038 - DNA, 22 bp, Homo sapiens
aggcaggcctacacaatgggag

SEQ ID NO: 8197039 - DNA, 22 bp, Homo sapiens
aggcaggccgtgtccctcctca

SEQ ID NO: 8197040 - DNA, 22 bp, Homo sapiens
aggcaggcctacacaatgggag

SEQ ID NO: 8197041 - DNA, 22 bp, Homo sapiens
aggcaggcctacacaatgggag

SEQ ID NO: 8197042 - DNA, 18 bp, Homo sapiens
aggcaggcggatcacaag

SEQ ID NO: 8197043 - DNA, 18 bp, Homo sapiens
aggcaggcggatcacaag

SEQ ID NO: 8197044 - DNA, 18 bp, Homo sapiens
aggcaggcggatcacaag

SEQ ID NO: 8197045 - DNA, 18 bp, Homo sapiens
aggcaggcggatcacaag

SEQ ID NO: 8197046 - DNA, 22 bp, Homo sapiens
aggcaggcctacacaatgggag

SEQ ID NO: 8197047 - DNA, 22 bp, Homo sapiens
aggcaggctcaggcccatgctt

SEQ ID NO: 8197048 - DNA, 22 bp, Homo sapiens
aggcaggctcaggcccatgctt

SEQ ID NO: 8197049 - DNA, 22 bp, Homo sapiens
aggcaggctcaatgcccagtct

SEQ ID NO: 8197050 - DNA, 22 bp, Homo sapiens
aggcaggctcaatgcccagtct

SEQ ID NO: 8197051 - DNA, 22 bp, Homo sapiens
aggcaggctcaatgcccagtct

SEQ ID NO: 8197052 - DNA, 22 bp, Homo sapiens
aggcaggctcaatgcccagtct

SEQ ID NO: 8197053 - DNA, 22 bp, Homo sapiens
aggcaggctagtcgcttgagcc

SEQ ID NO: 8197054 - DNA, 22 bp, Homo sapiens
aggcaggctagtcgcttgagcc

SEQ ID NO: 8197055 - DNA, 22 bp, Homo sapiens
aggcaggctagtcgcttgagcc

SEQ ID NO: 8197056 - DNA, 22 bp, Homo sapiens
aggcaggctagtcgcttgagcc

SEQ ID NO: 8197057 - DNA, 22 bp, Homo sapiens
aggcaggctagtcgcttgagcc

SEQ ID NO: 8197058 - DNA, 22 bp, Homo sapiens
aggcaggctctgggtatgtgca

SEQ ID NO: 8197059 - DNA, 22 bp, Homo sapiens
aggcaggctcaggcccatgctt

SEQ ID NO: 8197060 - DNA, 22 bp, Homo sapiens
aggcaggctctgggtatgtgca

SEQ ID NO: 8197061 - DNA, 22 bp, Homo sapiens
aggcaggctctgggtatgtgca

SEQ ID NO: 8197062 - DNA, 22 bp, Homo sapiens
aggcaggctgctatggagtaga

SEQ ID NO: 8197063 - DNA, 22 bp, Homo sapiens
aggcaggctgctatggagtaga

SEQ ID NO: 8197064 - DNA, 22 bp, Homo sapiens
aggcaggctgctatggagtaga

SEQ ID NO: 8197065 - DNA, 22 bp, Homo sapiens
aggcaggctgctatggagtaga

SEQ ID NO: 8197066 - DNA, 22 bp, Homo sapiens
aggcaggctgctatggagtaga

SEQ ID NO: 8197067 - DNA, 22 bp, Homo sapiens
aggcaggctgctatggagtaga

SEQ ID NO: 8197068 - DNA, 22 bp, Homo sapiens
aggcaggctctgggtatgtgca

SEQ ID NO: 8197069 - DNA, 22 bp, Homo sapiens
aggcaggctctgggtatgtgca

SEQ ID NO: 8197070 - DNA, 22 bp, Homo sapiens
aggcagctttcagtgtctctca

SEQ ID NO: 8197071 - DNA, 22 bp, Homo sapiens
aggcagctttaactggtagtag

SEQ ID NO: 8197072 - DNA, 22 bp, Homo sapiens
aggcagcttctgattagcagcg

SEQ ID NO: 8197073 - DNA, 22 bp, Homo sapiens
aggcagcttaagccctggccca

SEQ ID NO: 8197074 - DNA, 22 bp, Homo sapiens
aggcagctttctgtaggggtgt

SEQ ID NO: 8197075 - DNA, 22 bp, Homo sapiens
aggcagctttgtagtaaagcta

SEQ ID NO: 8197076 - DNA, 22 bp, Homo sapiens
aggcagctttgtagtaaagcta

SEQ ID NO: 8197077 - DNA, 22 bp, Homo sapiens
aggcagctttcagtgtctctca

SEQ ID NO: 8197078 - DNA, 22 bp, Homo sapiens
aggcagctttctggtgcaccat

SEQ ID NO: 8197079 - DNA, 19 bp, Homo sapiens
aggcagaggcttggctagc

SEQ ID NO: 8197080 - DNA, 22 bp, Homo sapiens
aggcagcgtagcaaggctagta

SEQ ID NO: 8197081 - DNA, 22 bp, Homo sapiens
aggcagcgtagcaaggctagta

SEQ ID NO: 8197082 - DNA, 21 bp, Homo sapiens
aggcagcgtgagggccactca

SEQ ID NO: 8197083 - DNA, 21 bp, Homo sapiens
aggcagcgtgagggccactca

SEQ ID NO: 8197084 - DNA, 23 bp, Homo sapiens
aggcagctgggtagcatctttct

SEQ ID NO: 8197085 - DNA, 22 bp, Homo sapiens
aggcagctgtgaggactggatt

SEQ ID NO: 8197086 - DNA, 23 bp, Homo sapiens
aggcagagccaaggtcaaaaccc

SEQ ID NO: 8197087 - DNA, 22 bp, Homo sapiens
aggcagagctaggaagaattgt

SEQ ID NO: 8197088 - DNA, 20 bp, Homo sapiens
aggcagagcgcacttttaga

SEQ ID NO: 8197089 - DNA, 22 bp, Homo sapiens
aggcagagctgatgttctgtga

SEQ ID NO: 8197090 - DNA, 22 bp, Homo sapiens
aggcagagctgatgttctgtga

SEQ ID NO: 8197091 - DNA, 22 bp, Homo sapiens
aggcagagctaggaagaattgt

SEQ ID NO: 8197092 - DNA, 22 bp, Homo sapiens
aggcagagctgggttttgaaat

SEQ ID NO: 8197093 - DNA, 22 bp, Homo sapiens
aggcagaggaagggtggatttg

SEQ ID NO: 8197094 - DNA, 22 bp, Homo sapiens
aggcagagctgggttttgaaat

SEQ ID NO: 8197095 - DNA, 22 bp, Homo sapiens
aggcagaggaagggtggatttg

SEQ ID NO: 8197096 - DNA, 22 bp, Homo sapiens
aggcagaggaagggtggatttg

SEQ ID NO: 8197097 - DNA, 22 bp, Homo sapiens
aggcagaggagaatgatcttcc

SEQ ID NO: 8197098 - DNA, 22 bp, Homo sapiens
aggcagaggagaatgatcttcc

SEQ ID NO: 8197099 - DNA, 22 bp, Homo sapiens
aggcagaggagaatgatcttcc

SEQ ID NO: 8197100 - DNA, 19 bp, Homo sapiens
aggcagaggcttggctagc

SEQ ID NO: 8197101 - DNA, 16 bp, Homo sapiens
aggcagagatttaccc

SEQ ID NO: 8197102 - DNA, 22 bp, Homo sapiens
aggcagagagcagtggccgtct

SEQ ID NO: 8197103 - DNA, 22 bp, Homo sapiens
aggcagagagcagtggccgtct

SEQ ID NO: 8197104 - DNA, 22 bp, Homo sapiens
aggcagagagcagtggccgtct

SEQ ID NO: 8197105 - DNA, 22 bp, Homo sapiens
aggcagagagcagtggccgtct

SEQ ID NO: 8197106 - DNA, 22 bp, Homo sapiens
aggcactgattctcagagttac

SEQ ID NO: 8197107 - DNA, 22 bp, Homo sapiens
aggcactgattctgttttccat

SEQ ID NO: 8197108 - DNA, 22 bp, Homo sapiens
aggcactgcagattacaggcgc

SEQ ID NO: 8197109 - DNA, 22 bp, Homo sapiens
aggcactttccttgaggagttt

SEQ ID NO: 8197110 - DNA, 22 bp, Homo sapiens
aggcactttctgtatgctagtt

SEQ ID NO: 8197111 - DNA, 22 bp, Homo sapiens
aggcactttaggatcaggttga

SEQ ID NO: 8197112 - DNA, 22 bp, Homo sapiens
aggcagagagcagtggccgtct

SEQ ID NO: 8197113 - DNA, 22 bp, Homo sapiens
aggcactttgaaatttggagct

SEQ ID NO: 8197114 - DNA, 22 bp, Homo sapiens
aggcactttctgtatgctagtt

SEQ ID NO: 8197115 - DNA, 22 bp, Homo sapiens
aggcactttgaaatttggagct

SEQ ID NO: 8197116 - DNA, 22 bp, Homo sapiens
aggcagagaaaaaccagatatg

SEQ ID NO: 8197117 - DNA, 22 bp, Homo sapiens
aggcactgattctcagagttac

SEQ ID NO: 8197118 - DNA, 22 bp, Homo sapiens
aggcactgactcaagggagcca

SEQ ID NO: 8197119 - DNA, 22 bp, Homo sapiens
aggcactgagaggctgtgttgc

SEQ ID NO: 8197120 - DNA, 22 bp, Homo sapiens
aggcactgactcaagggagcca

SEQ ID NO: 8197121 - DNA, 22 bp, Homo sapiens
aggcactgactcaagggagcca

SEQ ID NO: 8197122 - DNA, 22 bp, Homo sapiens
aggcactgactcaagggagcca

SEQ ID NO: 8197123 - DNA, 22 bp, Homo sapiens
aggcactgacagattctgtgtc

SEQ ID NO: 8197124 - DNA, 22 bp, Homo sapiens
aggcactgacagattctgtgtc

SEQ ID NO: 8197125 - DNA, 22 bp, Homo sapiens
aggcactgacctgcttccttga

SEQ ID NO: 8197126 - DNA, 22 bp, Homo sapiens
aggcactgacaattctggactg

SEQ ID NO: 8197127 - DNA, 19 bp, Homo sapiens
aggcacaggttgtctggac

SEQ ID NO: 8197128 - DNA, 19 bp, Homo sapiens
aggcacaggttgtctggac

SEQ ID NO: 8197129 - DNA, 19 bp, Homo sapiens
aggcacaggttgtctggac

SEQ ID NO: 8197130 - DNA, 19 bp, Homo sapiens
aggcacaggttgtctggac

SEQ ID NO: 8197131 - DNA, 22 bp, Homo sapiens
aggcacagtgcctggaatcaaa

SEQ ID NO: 8197132 - DNA, 22 bp, Homo sapiens
aggcacagtgcctggaatcaaa

SEQ ID NO: 8197133 - DNA, 20 bp, Homo sapiens
aggcacagttcctagttggg

SEQ ID NO: 8197134 - DNA, 22 bp, Homo sapiens
aggcacagtggccctgtttggg

SEQ ID NO: 8197135 - DNA, 22 bp, Homo sapiens
aggcacagtggctcacacctgt

SEQ ID NO: 8197136 - DNA, 22 bp, Homo sapiens
aggcacagtggctcacacctgt

SEQ ID NO: 8197137 - DNA, 22 bp, Homo sapiens
aggcactgaagaactctttttg

SEQ ID NO: 8197138 - DNA, 22 bp, Homo sapiens
aggcactgaagaactctttttg

SEQ ID NO: 8197139 - DNA, 22 bp, Homo sapiens
aggcactgaaaggtggccagag

SEQ ID NO: 8197140 - DNA, 22 bp, Homo sapiens
aggcactgaaaggtggccagag

SEQ ID NO: 8197141 - DNA, 22 bp, Homo sapiens
aggcacagtttcatccccgggc

SEQ ID NO: 8197142 - DNA, 22 bp, Homo sapiens
aggcactgaaggaagcttgcgc

SEQ ID NO: 8197143 - DNA, 22 bp, Homo sapiens
aggcactgaaggaagcttgcgc

SEQ ID NO: 8197144 - DNA, 22 bp, Homo sapiens
aggcactgaagtggtaaatgta

SEQ ID NO: 8197145 - DNA, 23 bp, Homo sapiens
aggcactgaatgtgtcagtgagt

SEQ ID NO: 8197146 - DNA, 22 bp, Homo sapiens
aggcactgaatatccagtaaaa

SEQ ID NO: 8197147 - DNA, 22 bp, Homo sapiens
aggcactgaagtggtaaatgta

SEQ ID NO: 8197148 - DNA, 22 bp, Homo sapiens
aggatcatgtggtcattcctga

SEQ ID NO: 8197149 - DNA, 22 bp, Homo sapiens
aggatcatgtggtcattcctga

SEQ ID NO: 8197150 - DNA, 22 bp, Homo sapiens
aggatcagtgaatactcagggt

SEQ ID NO: 8197151 - DNA, 22 bp, Homo sapiens
aggatcatataagctccagcta

SEQ ID NO: 8197152 - DNA, 22 bp, Homo sapiens
aggatcctccttagaaaagacc

SEQ ID NO: 8197153 - DNA, 22 bp, Homo sapiens
aggatctgtgagtgctgcagac

SEQ ID NO: 8197154 - DNA, 22 bp, Homo sapiens
aggatctgtgagtgctgcagac

SEQ ID NO: 8197155 - DNA, 22 bp, Homo sapiens
aggatctcgcctcctgagctat

SEQ ID NO: 8197156 - DNA, 22 bp, Homo sapiens
aggatcctttggccacttctta

SEQ ID NO: 8197157 - DNA, 22 bp, Homo sapiens
aggatcagggtggtggaagtca

SEQ ID NO: 8197158 - DNA, 21 bp, Homo sapiens
aggagttgagtgcacagttgg

SEQ ID NO: 8197159 - DNA, 16 bp, Homo sapiens
aggagttgaggctatt

SEQ ID NO: 8197160 - DNA, 23 bp, Homo sapiens
aggagttgagggttgggttggca

SEQ ID NO: 8197161 - DNA, 22 bp, Homo sapiens
aggagttggtcaccgtggccca

SEQ ID NO: 8197162 - DNA, 22 bp, Homo sapiens
aggagttggtgctctccaaata

SEQ ID NO: 8197163 - DNA, 22 bp, Homo sapiens
aggagttgtatgtccaagggac

SEQ ID NO: 8197164 - DNA, 22 bp, Homo sapiens
aggagttgattacgtttatttt

SEQ ID NO: 8197165 - DNA, 23 bp, Homo sapiens
aggagttgcatgatttttagagc

SEQ ID NO: 8197166 - DNA, 21 bp, Homo sapiens
aggagttgctgtggcctggtt

SEQ ID NO: 8197167 - DNA, 22 bp, Homo sapiens
aggagtttcaaagcttccatgt

SEQ ID NO: 8197168 - DNA, 22 bp, Homo sapiens
aggagtttatccgagggcataa

SEQ ID NO: 8197169 - DNA, 22 bp, Homo sapiens
aggagtttcaaagcttccatgt

SEQ ID NO: 8197170 - DNA, 22 bp, Homo sapiens
aggagtttggcacatgtatgca

SEQ ID NO: 8197171 - DNA, 23 bp, Homo sapiens
aggataaactaaactcattttgg

SEQ ID NO: 8197172 - DNA, 22 bp, Homo sapiens
aggataaatgatctagattttc

SEQ ID NO: 8197173 - DNA, 22 bp, Homo sapiens
aggataaatgatctagattttc

SEQ ID NO: 8197174 - DNA, 22 bp, Homo sapiens
aggcacaggtggacttcacagt

SEQ ID NO: 8197175 - DNA, 22 bp, Homo sapiens
aggcacaggtggacttcacagt

SEQ ID NO: 8197176 - DNA, 22 bp, Homo sapiens
aggcacaggtggacttcacagt

SEQ ID NO: 8197177 - DNA, 22 bp, Homo sapiens
aggcacagggatgcggagccag

SEQ ID NO: 8197178 - DNA, 22 bp, Homo sapiens
aggcacagggatgcggagccag

SEQ ID NO: 8197179 - DNA, 22 bp, Homo sapiens
catgtgtgggacccttaggttg

SEQ ID NO: 8197180 - DNA, 22 bp, Homo sapiens
catgtgtggtctgtggctatct

SEQ ID NO: 8197181 - DNA, 22 bp, Homo sapiens
catgtgtggtctgtggctatct

SEQ ID NO: 8197182 - DNA, 22 bp, Homo sapiens
catgtgtgggacccttaggttg

SEQ ID NO: 8197183 - DNA, 23 bp, Homo sapiens
catgtgtgacagtatcactgttt

SEQ ID NO: 8197184 - DNA, 22 bp, Homo sapiens
catgtgtgagtatatcttatcc

SEQ ID NO: 8197185 - DNA, 23 bp, Homo sapiens
catgtgtgacagtatcactgttt

SEQ ID NO: 8197186 - DNA, 22 bp, Homo sapiens
catgtgtgagtatatcttatcc

SEQ ID NO: 8197187 - DNA, 22 bp, Homo sapiens
catgtgtgacaaactgcctgca

SEQ ID NO: 8197188 - DNA, 22 bp, Homo sapiens
catgtgtgacaaactgcctgca

SEQ ID NO: 8197189 - DNA, 22 bp, Homo sapiens
catgtgtggagggcatgcatgg

SEQ ID NO: 8197190 - DNA, 22 bp, Homo sapiens
catgtgtggagggcatgcatgg

SEQ ID NO: 8197191 - DNA, 22 bp, Homo sapiens
catgtgtggagggcatgcatgg

SEQ ID NO: 8197192 - DNA, 22 bp, Homo sapiens
catgtgtgcaccaaccctatgt

SEQ ID NO: 8197193 - DNA, 22 bp, Homo sapiens
catgtgtggagggcatgcatgg

SEQ ID NO: 8197194 - DNA, 22 bp, Homo sapiens
catgtgtgggacccttaggttg

SEQ ID NO: 8197195 - DNA, 22 bp, Homo sapiens
catgtgtgagtatatcttatcc

SEQ ID NO: 8197196 - DNA, 22 bp, Homo sapiens
catgtgtgagtatatcttatcc

SEQ ID NO: 8197197 - DNA, 22 bp, Homo sapiens
catgtgtgcaccaaccctatgt

SEQ ID NO: 8197198 - DNA, 22 bp, Homo sapiens
catgtgtgagtgagcagtcttc

SEQ ID NO: 8197199 - DNA, 22 bp, Homo sapiens
catgtgtgagtgagcagtcttc

SEQ ID NO: 8197200 - DNA, 22 bp, Homo sapiens
aggatgagaagattggaatctt

SEQ ID NO: 8197201 - DNA, 22 bp, Homo sapiens
catgtccttctcattgcctcat

SEQ ID NO: 8197202 - DNA, 22 bp, Homo sapiens
aggatgagaagattggaatctt

SEQ ID NO: 8197203 - DNA, 22 bp, Homo sapiens
catgtgtcctagctattctcct

SEQ ID NO: 8197204 - DNA, 22 bp, Homo sapiens
catgtgtccacccttgaacaca

SEQ ID NO: 8197205 - DNA, 22 bp, Homo sapiens
catgtctgagtagagtgtgatt

SEQ ID NO: 8197206 - DNA, 22 bp, Homo sapiens
aggatcttcattgtgctgcaaa

SEQ ID NO: 8197207 - DNA, 22 bp, Homo sapiens
aggatgactggaacccaagtga

SEQ ID NO: 8197208 - DNA, 22 bp, Homo sapiens
aggatgactggaacccaagtga

SEQ ID NO: 8197209 - DNA, 22 bp, Homo sapiens
aggatgaatatttagtgggata

SEQ ID NO: 8197210 - DNA, 22 bp, Homo sapiens
catgtgtgaagactgcgggcca

SEQ ID NO: 8197211 - DNA, 22 bp, Homo sapiens
catgtgtgaagactgcgggcca

SEQ ID NO: 8197212 - DNA, 22 bp, Homo sapiens
catgtgtgaatcttgtgatcat

SEQ ID NO: 8197213 - DNA, 22 bp, Homo sapiens
catgtgtgaatcttgtgatcat

SEQ ID NO: 8197214 - DNA, 22 bp, Homo sapiens
catgtgtcttgctgccctccat

SEQ ID NO: 8197215 - DNA, 22 bp, Homo sapiens
catgtgtctaatctactaatat

SEQ ID NO: 8197216 - DNA, 22 bp, Homo sapiens
catgtgtctaatctactaatat

SEQ ID NO: 8197217 - DNA, 22 bp, Homo sapiens
catgtgtcctagctattctcct

SEQ ID NO: 8197218 - DNA, 22 bp, Homo sapiens
catgtgtctttatggagccaca

SEQ ID NO: 8197219 - DNA, 21 bp, Homo sapiens
catgtgtcttgtgttactgct

SEQ ID NO: 8197220 - DNA, 22 bp, Homo sapiens
catgtgtctttatggagccaca

SEQ ID NO: 8197221 - DNA, 19 bp, Homo sapiens
cttctgatggaaagccaac

SEQ ID NO: 8197222 - DNA, 22 bp, Homo sapiens
cttctgattagcaagtttgtat

SEQ ID NO: 8197223 - DNA, 22 bp, Homo sapiens
cttctgattagcaagtttgtat

SEQ ID NO: 8197224 - DNA, 22 bp, Homo sapiens
cttctgcaggccctgtctgacc

SEQ ID NO: 8197225 - DNA, 19 bp, Homo sapiens
cttctgcagggtgacagtg

SEQ ID NO: 8197226 - DNA, 22 bp, Homo sapiens
cttctgagcagacctcctgggg

SEQ ID NO: 8197227 - DNA, 22 bp, Homo sapiens
cttctgaggactctaaagagga

SEQ ID NO: 8197228 - DNA, 22 bp, Homo sapiens
cttctgagatgttgttttacag

SEQ ID NO: 8197229 - DNA, 22 bp, Homo sapiens
cttctgagatgttgttttacag

SEQ ID NO: 8197230 - DNA, 22 bp, Homo sapiens
cttctgagatgttgttttacag

SEQ ID NO: 8197231 - DNA, 22 bp, Homo sapiens
cttctgagcagacctcctgggg

SEQ ID NO: 8197232 - DNA, 22 bp, Homo sapiens
cttctgtgttaaatgagtcttt

SEQ ID NO: 8197233 - DNA, 22 bp, Homo sapiens
cttctgtgttaaatgagtcttt

SEQ ID NO: 8197234 - DNA, 22 bp, Homo sapiens
cttctgtgtagaaaggtagccc

SEQ ID NO: 8197235 - DNA, 22 bp, Homo sapiens
cttctgttactgttagctgaag

SEQ ID NO: 8197236 - DNA, 22 bp, Homo sapiens
cttctgtgttttactatatgta

SEQ ID NO: 8197237 - DNA, 22 bp, Homo sapiens
cttctgtgttttactatatgta

SEQ ID NO: 8197238 - DNA, 22 bp, Homo sapiens
cttctgtggtaaactttgttgt

SEQ ID NO: 8197239 - DNA, 22 bp, Homo sapiens
cttctgtggtaaactttgttgt

SEQ ID NO: 8197240 - DNA, 22 bp, Homo sapiens
cttctgtggatgttggatgcat

SEQ ID NO: 8197241 - DNA, 22 bp, Homo sapiens
cttctgtggatgttggatgcat

SEQ ID NO: 8197242 - DNA, 22 bp, Homo sapiens
cttctgtggatgttggatgcat

SEQ ID NO: 8197243 - DNA, 22 bp, Homo sapiens
cttctgtgcttcacagttgcca

SEQ ID NO: 8197244 - DNA, 22 bp, Homo sapiens
cttctgtggatatgttctctct

SEQ ID NO: 8197245 - DNA, 22 bp, Homo sapiens
cttctgtgcttcacagttgcca

SEQ ID NO: 8197246 - DNA, 22 bp, Homo sapiens
cttctgtgcttcacagttgcca

SEQ ID NO: 8197247 - DNA, 22 bp, Homo sapiens
cttctgtgcaattgtggaggag

SEQ ID NO: 8197248 - DNA, 23 bp, Homo sapiens
cttctgtgcaagagggagggaaa

SEQ ID NO: 8197249 - DNA, 22 bp, Homo sapiens
cttctgtgcaattgtggaggag

SEQ ID NO: 8197250 - DNA, 22 bp, Homo sapiens
cttctgcccctgtagcctgagt

SEQ ID NO: 8197251 - DNA, 22 bp, Homo sapiens
cttctgcccctgtagcctgagt

SEQ ID NO: 8197252 - DNA, 22 bp, Homo sapiens
cttctgtgatttggttaggata

SEQ ID NO: 8197253 - DNA, 22 bp, Homo sapiens
cttctgtgatttggttaggata

SEQ ID NO: 8197254 - DNA, 22 bp, Homo sapiens
cttctgtgatttggttaggata

SEQ ID NO: 8197255 - DNA, 19 bp, Homo sapiens
cttctgtgatacatcagtc

SEQ ID NO: 8197256 - DNA, 22 bp, Homo sapiens
cttctccttatatgtcccgttc

SEQ ID NO: 8197257 - DNA, 23 bp, Homo sapiens
atctctctttattcttggggata

SEQ ID NO: 8197258 - DNA, 22 bp, Homo sapiens
atctctgaaggctccaggagag

SEQ ID NO: 8197259 - DNA, 22 bp, Homo sapiens
cttctccttatatgtcccgttc

SEQ ID NO: 8197260 - DNA, 22 bp, Homo sapiens
cttctgagatgttgttttacag

SEQ ID NO: 8197261 - DNA, 22 bp, Homo sapiens
cttctgagatgttgttttacag

SEQ ID NO: 8197262 - DNA, 22 bp, Homo sapiens
cttctgagatgttgttttacag

SEQ ID NO: 8197263 - DNA, 22 bp, Homo sapiens
cttctgagatgttgttttacag

SEQ ID NO: 8197264 - DNA, 22 bp, Homo sapiens
atctctatctttattgaaatct

SEQ ID NO: 8197265 - DNA, 22 bp, Homo sapiens
atctctccttatgaagcattat

SEQ ID NO: 8197266 - DNA, 22 bp, Homo sapiens
atctctagctaaccctctggca

SEQ ID NO: 8197267 - DNA, 22 bp, Homo sapiens
atctctccttatgaagcattat

SEQ ID NO: 8197268 - DNA, 17 bp, Homo sapiens
atctctctaaggcaggc

SEQ ID NO: 8197269 - DNA, 15 bp, Homo sapiens
atctctctagctgct

SEQ ID NO: 8197270 - DNA, 22 bp, Homo sapiens
atctctctatgcactgaggact

SEQ ID NO: 8197271 - DNA, 22 bp, Homo sapiens
atctctctgcccaggggctgtg

SEQ ID NO: 8197272 - DNA, 23 bp, Homo sapiens
atctctctggtggtcacagtcag

SEQ ID NO: 8197273 - DNA, 23 bp, Homo sapiens
atctctctggtggtcacagtcag

SEQ ID NO: 8197274 - DNA, 22 bp, Homo sapiens
cttcctttcagaggaaggcctg

SEQ ID NO: 8197275 - DNA, 22 bp, Homo sapiens
atctccccgagcttacctcctg

SEQ ID NO: 8197276 - DNA, 21 bp, Homo sapiens
atctccccttccttgtaggtg

SEQ ID NO: 8197277 - DNA, 22 bp, Homo sapiens
atctccgaaagtcttgtcaccc

SEQ ID NO: 8197278 - DNA, 22 bp, Homo sapiens
atctccccgagcttacctcctg

SEQ ID NO: 8197279 - DNA, 18 bp, Homo sapiens
atctcccattggccaagg

SEQ ID NO: 8197280 - DNA, 22 bp, Homo sapiens
cttccttgtggtccttctcatt

SEQ ID NO: 8197281 - DNA, 22 bp, Homo sapiens
cttccttggcttctggggtgtg

SEQ ID NO: 8197282 - DNA, 22 bp, Homo sapiens
cttccttgtggtccttctcatt

SEQ ID NO: 8197283 - DNA, 20 bp, Homo sapiens
atctcctgctaccacccatt

SEQ ID NO: 8197284 - DNA, 20 bp, Homo sapiens
atctcctgctaccacccatt

SEQ ID NO: 8197285 - DNA, 22 bp, Homo sapiens
atctcctcccgcgccgagctcg

SEQ ID NO: 8197286 - DNA, 22 bp, Homo sapiens
atctccccgagcttacctcctg

SEQ ID NO: 8197287 - DNA, 22 bp, Homo sapiens
atctctaatttaaaaagtaaca

SEQ ID NO: 8197288 - DNA, 22 bp, Homo sapiens
atctggtttggggatccttgtg

SEQ ID NO: 8197289 - DNA, 22 bp, Homo sapiens
atctggttcttcttaggcatca

SEQ ID NO: 8197290 - DNA, 22 bp, Homo sapiens
atctgtaacatcagtagcagaa

SEQ ID NO: 8197291 - DNA, 22 bp, Homo sapiens
atctgtaacatcagtagcagaa

SEQ ID NO: 8197292 - DNA, 22 bp, Homo sapiens
atctgtaaataaaaagggaggt

SEQ ID NO: 8197293 - DNA, 22 bp, Homo sapiens
atctgtatatttttcaatgcaa

SEQ ID NO: 8197294 - DNA, 22 bp, Homo sapiens
atctgtagaagatactctgaga

SEQ ID NO: 8197295 - DNA, 22 bp, Homo sapiens
atctgtcaagatagactctgca

SEQ ID NO: 8197296 - DNA, 22 bp, Homo sapiens
atctgtcaggagcaaggactac

SEQ ID NO: 8197297 - DNA, 22 bp, Homo sapiens
atctgtcaggagcaaggactac

SEQ ID NO: 8197298 - DNA, 22 bp, Homo sapiens
atctggtgacacgaggagctgg

SEQ ID NO: 8197299 - DNA, 22 bp, Homo sapiens
atctgggtttaaatctcagctt

SEQ ID NO: 8197300 - DNA, 22 bp, Homo sapiens
atctgggtttcaaagaagcctt

SEQ ID NO: 8197301 - DNA, 22 bp, Homo sapiens
atctggctcgctaggctctggg

SEQ ID NO: 8197302 - DNA, 22 bp, Homo sapiens
cttcttaaatatttggctgact

SEQ ID NO: 8197303 - DNA, 22 bp, Homo sapiens
cttctgttactgttagctgaag

SEQ ID NO: 8197304 - DNA, 22 bp, Homo sapiens
cttcttaaagattacacaatga

SEQ ID NO: 8197305 - DNA, 18 bp, Homo sapiens
atctgtcctttctctgcc

SEQ ID NO: 8197306 - DNA, 22 bp, Homo sapiens
atctgtcctgtgacagtgggag

SEQ ID NO: 8197307 - DNA, 22 bp, Homo sapiens
atctgtcctccagcatctccat

SEQ ID NO: 8197308 - DNA, 22 bp, Homo sapiens
atctgtccctggtccaagattt

SEQ ID NO: 8197309 - DNA, 22 bp, Homo sapiens
atctgtctatgatatagtctgt

SEQ ID NO: 8197310 - DNA, 22 bp, Homo sapiens
atctgtctgagtgcttaggacc

SEQ ID NO: 8197311 - DNA, 22 bp, Homo sapiens
atctgtcttccaccacacatcc

SEQ ID NO: 8197312 - DNA, 22 bp, Homo sapiens
atctgtcttccaccacacatcc

SEQ ID NO: 8197313 - DNA, 22 bp, Homo sapiens
atctgtcttgccttgcatattt

SEQ ID NO: 8197314 - DNA, 22 bp, Homo sapiens
atctgtgagaaaggcttgtgct

SEQ ID NO: 8197315 - DNA, 22 bp, Homo sapiens
atctgtggaaattggcaagtgc

SEQ ID NO: 8197316 - DNA, 22 bp, Homo sapiens
atctgtgatcaagacagacagt

SEQ ID NO: 8197317 - DNA, 22 bp, Homo sapiens
atctgtggctggtgagaggcag

SEQ ID NO: 8197318 - DNA, 22 bp, Homo sapiens
atctgtgtgttattgtttatca

SEQ ID NO: 8197319 - DNA, 23 bp, Homo sapiens
atctgtgtgtgggtagggatgat

SEQ ID NO: 8197320 - DNA, 22 bp, Homo sapiens
atcttatttaacacagcaaaac

SEQ ID NO: 8197321 - DNA, 22 bp, Homo sapiens
atctgttcttgtgtcagtaatt

SEQ ID NO: 8197322 - DNA, 22 bp, Homo sapiens
atctgttatttacccatctctg

SEQ ID NO: 8197323 - DNA, 22 bp, Homo sapiens
atctgttcccctatgctctcta

SEQ ID NO: 8197324 - DNA, 23 bp, Homo sapiens
atctgttcatctgacacagattc

SEQ ID NO: 8197325 - DNA, 23 bp, Homo sapiens
atcatagtctttgtgactggccc

SEQ ID NO: 8197326 - DNA, 22 bp, Homo sapiens
atcatcatcaacaagaaacatt

SEQ ID NO: 8197327 - DNA, 22 bp, Homo sapiens
atcatcagggacatttctgtgc

SEQ ID NO: 8197328 - DNA, 22 bp, Homo sapiens
ctgtttctcccatgtccaagtg

SEQ ID NO: 8197329 - DNA, 22 bp, Homo sapiens
ctgtttctcccatgtccaagtg

SEQ ID NO: 8197330 - DNA, 22 bp, Homo sapiens
ctgtttctcccaacgccctagt

SEQ ID NO: 8197331 - DNA, 22 bp, Homo sapiens
ctgtttctccacactcttccca

SEQ ID NO: 8197332 - DNA, 19 bp, Homo sapiens
atcatacatgttacactct

SEQ ID NO: 8197333 - DNA, 22 bp, Homo sapiens
atcatacatgtaactaagtaaa

SEQ ID NO: 8197334 - DNA, 22 bp, Homo sapiens
atcatacagaacctgagcactt

SEQ ID NO: 8197335 - DNA, 22 bp, Homo sapiens
atcatacagcctttgttagtgt

SEQ ID NO: 8197336 - DNA, 22 bp, Homo sapiens
atcatacagcctttgttagtgt

SEQ ID NO: 8197337 - DNA, 22 bp, Homo sapiens
cttaacatcctgcatttttctt

SEQ ID NO: 8197338 - DNA, 22 bp, Homo sapiens
cttaacatggggggtaagtctg

SEQ ID NO: 8197339 - DNA, 22 bp, Homo sapiens
cttaacagagagaagtgttgct

SEQ ID NO: 8197340 - DNA, 21 bp, Homo sapiens
cttaacattttaaatgaaagg

SEQ ID NO: 8197341 - DNA, 22 bp, Homo sapiens
cttaaggaaaagtctcttttaa

SEQ ID NO: 8197342 - DNA, 22 bp, Homo sapiens
cttaagatttgcgatacctaat

SEQ ID NO: 8197343 - DNA, 22 bp, Homo sapiens
cttaagatttgagatacctaat

SEQ ID NO: 8197344 - DNA, 22 bp, Homo sapiens
cttaagatgaggtcatgctata

SEQ ID NO: 8197345 - DNA, 22 bp, Homo sapiens
cttaagagtctttctgtgttta

SEQ ID NO: 8197346 - DNA, 22 bp, Homo sapiens
atccatttctatcttgctgagg

SEQ ID NO: 8197347 - DNA, 22 bp, Homo sapiens
atccatttctatcttgctgagg

SEQ ID NO: 8197348 - DNA, 22 bp, Homo sapiens
cttagatgaagtcacagaaccc

SEQ ID NO: 8197349 - DNA, 22 bp, Homo sapiens
atccatgattgcccagaggtgt

SEQ ID NO: 8197350 - DNA, 22 bp, Homo sapiens
cttaatctcacctgcaaagtcc

SEQ ID NO: 8197351 - DNA, 22 bp, Homo sapiens
cttaatctcacctgcaaagtcc

SEQ ID NO: 8197352 - DNA, 22 bp, Homo sapiens
cttaatctcacctgcaaagtcc

SEQ ID NO: 8197353 - DNA, 22 bp, Homo sapiens
atccatgaccctctcaacaacc

SEQ ID NO: 8197354 - DNA, 22 bp, Homo sapiens
atccatctttcctgctgaactg

SEQ ID NO: 8197355 - DNA, 22 bp, Homo sapiens
cttattaatggaatcctaatga

SEQ ID NO: 8197356 - DNA, 22 bp, Homo sapiens
cttattaatggaatcctaatga

SEQ ID NO: 8197357 - DNA, 22 bp, Homo sapiens
cttattaatggaatcctaatga

SEQ ID NO: 8197358 - DNA, 22 bp, Homo sapiens
cttattaatggaatcctaatga

SEQ ID NO: 8197359 - DNA, 22 bp, Homo sapiens
cttattcaatgctggaaatgtt

SEQ ID NO: 8197360 - DNA, 22 bp, Homo sapiens
cttatgtacacacatatattgt

SEQ ID NO: 8197361 - DNA, 22 bp, Homo sapiens
cttatggaagaaacctcagaga

SEQ ID NO: 8197362 - DNA, 22 bp, Homo sapiens
cttatcttacttccccttcatg

SEQ ID NO: 8197363 - DNA, 22 bp, Homo sapiens
cttattcataagtcagacacac

SEQ ID NO: 8197364 - DNA, 22 bp, Homo sapiens
cttattcagcacttgctctgta

SEQ ID NO: 8197365 - DNA, 22 bp, Homo sapiens
cttattcagcacttgctctgta

SEQ ID NO: 8197366 - DNA, 22 bp, Homo sapiens
cttattcagcaagtttgggtac

SEQ ID NO: 8197367 - DNA, 22 bp, Homo sapiens
cttattcagatacagactcttg

SEQ ID NO: 8197368 - DNA, 22 bp, Homo sapiens
cttattcagatacagactcttg

SEQ ID NO: 8197369 - DNA, 22 bp, Homo sapiens
cttattcagaccttggattctt

SEQ ID NO: 8197370 - DNA, 22 bp, Homo sapiens
cttattcagaaggagaaatgga

SEQ ID NO: 8197371 - DNA, 21 bp, Homo sapiens
cttattcactgttatttatca

SEQ ID NO: 8197372 - DNA, 22 bp, Homo sapiens
cttattcagaaggagaaatgga

SEQ ID NO: 8197373 - DNA, 23 bp, Homo sapiens
cttattcattcatgtagcccatt

SEQ ID NO: 8197374 - DNA, 22 bp, Homo sapiens
cttattcatatattctcggtag

SEQ ID NO: 8197375 - DNA, 22 bp, Homo sapiens
cttcaaattcgaggagtagatg

SEQ ID NO: 8197376 - DNA, 22 bp, Homo sapiens
cttcaagaagacagcagagcat

SEQ ID NO: 8197377 - DNA, 22 bp, Homo sapiens
cttcaactttgtaagtagaatt

SEQ ID NO: 8197378 - DNA, 22 bp, Homo sapiens
cttcaacttccctagatgtcat

SEQ ID NO: 8197379 - DNA, 22 bp, Homo sapiens
cttcaacagttttagaacactg

SEQ ID NO: 8197380 - DNA, 22 bp, Homo sapiens
cttccttccacaccttcagaat

SEQ ID NO: 8197381 - DNA, 22 bp, Homo sapiens
cttcctctcttgcccataagag

SEQ ID NO: 8197382 - DNA, 22 bp, Homo sapiens
cttcctctatgttcaggtagaa

SEQ ID NO: 8197383 - DNA, 22 bp, Homo sapiens
cttccttctgaagcatagaagc

SEQ ID NO: 8197384 - DNA, 22 bp, Homo sapiens
cttccttctgaagcatagaagc

SEQ ID NO: 8197385 - DNA, 22 bp, Homo sapiens
cttccttctcactagcagcgcc

SEQ ID NO: 8197386 - DNA, 22 bp, Homo sapiens
cttccttctcactagcagcgcc

SEQ ID NO: 8197387 - DNA, 22 bp, Homo sapiens
cttccttccttccccgaaatgc

SEQ ID NO: 8197388 - DNA, 22 bp, Homo sapiens
cttccttccttccccgaaatgc

SEQ ID NO: 8197389 - DNA, 22 bp, Homo sapiens
cttccttccttccccgaaatgc

SEQ ID NO: 8197390 - DNA, 22 bp, Homo sapiens
cttccttgctgtctgctccagg

SEQ ID NO: 8197391 - DNA, 22 bp, Homo sapiens
cttccttgctgtctgctccagg

SEQ ID NO: 8197392 - DNA, 19 bp, Homo sapiens
cttccttgctccccatgtg

SEQ ID NO: 8197393 - DNA, 22 bp, Homo sapiens
cttccttgcggcccctgcctag

SEQ ID NO: 8197394 - DNA, 22 bp, Homo sapiens
cttccttctgaagcatagaagc

SEQ ID NO: 8197395 - DNA, 22 bp, Homo sapiens
cttccttctgaagcatagaagc

SEQ ID NO: 8197396 - DNA, 22 bp, Homo sapiens
cttccttctgtaagaccagttg

SEQ ID NO: 8197397 - DNA, 22 bp, Homo sapiens
cttccttctgtaagaccagttg

SEQ ID NO: 8197398 - DNA, 22 bp, Homo sapiens
cttccttctgtaagaccagttg

SEQ ID NO: 8197399 - DNA, 22 bp, Homo sapiens
cttcaagatatttctagaatca

SEQ ID NO: 8197400 - DNA, 22 bp, Homo sapiens
cttcaagaagacagcagagcat

SEQ ID NO: 8197401 - DNA, 22 bp, Homo sapiens
cttcaaggtggctaaatggggc

SEQ ID NO: 8197402 - DNA, 22 bp, Homo sapiens
cttcaaggtggctaaatggggc

SEQ ID NO: 8197403 - DNA, 22 bp, Homo sapiens
cttcaagtcgccaaatgctgaa

SEQ ID NO: 8197404 - DNA, 21 bp, Homo sapiens
cttcaattcaacactgccatg

SEQ ID NO: 8197405 - DNA, 22 bp, Homo sapiens
cttcaattgccaccagctagca

SEQ ID NO: 8197406 - DNA, 22 bp, Homo sapiens
cttcaatttaaatggaagccac

SEQ ID NO: 8197407 - DNA, 22 bp, Homo sapiens
cttcaatttttggtatgatgga

SEQ ID NO: 8197408 - DNA, 22 bp, Homo sapiens
atcataaagtgctatctgattg

SEQ ID NO: 8197409 - DNA, 22 bp, Homo sapiens
atcataaagtgctatctgattg

SEQ ID NO: 8197410 - DNA, 22 bp, Homo sapiens
atcataaaccactttgtaatct

SEQ ID NO: 8197411 - DNA, 22 bp, Homo sapiens
atcataaaccactttgtaatct

SEQ ID NO: 8197412 - DNA, 22 bp, Homo sapiens
atcataaaccactttgtaatct

SEQ ID NO: 8197413 - DNA, 22 bp, Homo sapiens
atcataattgctccagtgatat

SEQ ID NO: 8197414 - DNA, 22 bp, Homo sapiens
atcataattgctccagtgatat

SEQ ID NO: 8197415 - DNA, 22 bp, Homo sapiens
atcataaagtgctatctgattg

SEQ ID NO: 8197416 - DNA, 22 bp, Homo sapiens
atcataaagtgctatctgattg

SEQ ID NO: 8197417 - DNA, 22 bp, Homo sapiens
atcagtttctgtgaagaacaca

SEQ ID NO: 8197418 - DNA, 22 bp, Homo sapiens
atcagtttggaacattcaggcc

SEQ ID NO: 8197419 - DNA, 22 bp, Homo sapiens
atcagtttggtgctttcagtga

SEQ ID NO: 8197420 - DNA, 22 bp, Homo sapiens
atcagtttctgtgaagaacaca

SEQ ID NO: 8197421 - DNA, 22 bp, Homo sapiens
atcagtttcacttgcttgcaaa

SEQ ID NO: 8197422 - DNA, 22 bp, Homo sapiens
atcagtttctaccatgtggaat

SEQ ID NO: 8197423 - DNA, 22 bp, Homo sapiens
atcagtttaactgtcaagagcc

SEQ ID NO: 8197424 - DNA, 22 bp, Homo sapiens
atcataaaattgcaccatttct

SEQ ID NO: 8197425 - DNA, 22 bp, Homo sapiens
atcagtttttattaatgtagct

SEQ ID NO: 8197426 - DNA, 22 bp, Homo sapiens
atcagtttgtatatgaaacact

SEQ ID NO: 8197427 - DNA, 22 bp, Homo sapiens
atcagtttgtatatgaaacact

SEQ ID NO: 8197428 - DNA, 22 bp, Homo sapiens
atcagttttgggggacatactg

SEQ ID NO: 8197429 - DNA, 22 bp, Homo sapiens
atcagttttgggggacatactg

SEQ ID NO: 8197430 - DNA, 21 bp, Homo sapiens
ctgtcgcaggtcgccccaccc

SEQ ID NO: 8197431 - DNA, 22 bp, Homo sapiens
ctgtcgctgccaacagggctgg

SEQ ID NO: 8197432 - DNA, 22 bp, Homo sapiens
ctgtctatcccttccttccttt

SEQ ID NO: 8197433 - DNA, 22 bp, Homo sapiens
ctgtctccagggcaggtgcagg

SEQ ID NO: 8197434 - DNA, 22 bp, Homo sapiens
atcaggaaaaattgtgaaaggg

SEQ ID NO: 8197435 - DNA, 22 bp, Homo sapiens
atcaggaaagaaaagcttggcg

SEQ ID NO: 8197436 - DNA, 20 bp, Homo sapiens
atcagctggagaacattatg

SEQ ID NO: 8197437 - DNA, 22 bp, Homo sapiens
ctgtctctgtcttaactcccag

SEQ ID NO: 8197438 - DNA, 22 bp, Homo sapiens
atcaggtgcattagattaatta

SEQ ID NO: 8197439 - DNA, 22 bp, Homo sapiens
atcaggtgatgctctggttccc

SEQ ID NO: 8197440 - DNA, 22 bp, Homo sapiens
ctgtctctgataagctcgaggg

SEQ ID NO: 8197441 - DNA, 22 bp, Homo sapiens
ctgtctctctaggacactgggg

SEQ ID NO: 8197442 - DNA, 22 bp, Homo sapiens
ctgtctctctaggacactgggg

SEQ ID NO: 8197443 - DNA, 22 bp, Homo sapiens
ctgtctctgataagctcgaggg

SEQ ID NO: 8197444 - DNA, 22 bp, Homo sapiens
ctgtctctgataagctcgaggg

SEQ ID NO: 8197445 - DNA, 22 bp, Homo sapiens
ctgtctcctccactgcatggga

SEQ ID NO: 8197446 - DNA, 22 bp, Homo sapiens
ctgtctcctccactgcatggga

SEQ ID NO: 8197447 - DNA, 22 bp, Homo sapiens
ctgtctccgccctcttggtagg

SEQ ID NO: 8197448 - DNA, 22 bp, Homo sapiens
ctgtctccgccctcttggtagg

SEQ ID NO: 8197449 - DNA, 19 bp, Homo sapiens
atcagctgaagccttcaga

SEQ ID NO: 8197450 - DNA, 22 bp, Homo sapiens
atcagcatctttaacaattacc

SEQ ID NO: 8197451 - DNA, 22 bp, Homo sapiens
atcagcccaccatcttcataac

SEQ ID NO: 8197452 - DNA, 22 bp, Homo sapiens
atcagctaattagaattaggat

SEQ ID NO: 8197453 - DNA, 22 bp, Homo sapiens
atcagcagatgctcaatgaaca

SEQ ID NO: 8197454 - DNA, 22 bp, Homo sapiens
atcagagctgcattttagagcc

SEQ ID NO: 8197455 - DNA, 22 bp, Homo sapiens
atcagcaatctcgtgtattagg

SEQ ID NO: 8197456 - DNA, 22 bp, Homo sapiens
atcagcacaacgtacagagaaa

SEQ ID NO: 8197457 - DNA, 22 bp, Homo sapiens
atcagcaggtgctggtggagac

SEQ ID NO: 8197458 - DNA, 22 bp, Homo sapiens
atcagcagtgagtggctttcat

SEQ ID NO: 8197459 - DNA, 22 bp, Homo sapiens
atcagcaggtgctggtggagac

SEQ ID NO: 8197460 - DNA, 22 bp, Homo sapiens
ctgtaaatggaactatgtagta

SEQ ID NO: 8197461 - DNA, 22 bp, Homo sapiens
ctgtaacttaatgagaggcaga

SEQ ID NO: 8197462 - DNA, 22 bp, Homo sapiens
ctgtaatcccagctacctggga

SEQ ID NO: 8197463 - DNA, 22 bp, Homo sapiens
ctgtaatcccagctacctggga

SEQ ID NO: 8197464 - DNA, 22 bp, Homo sapiens
ctgtaatcccagctacctggga

SEQ ID NO: 8197465 - DNA, 22 bp, Homo sapiens
ctgtaatcccagctactcggga

SEQ ID NO: 8197466 - DNA, 22 bp, Homo sapiens
atcagagctagtacttgcaggt

SEQ ID NO: 8197467 - DNA, 22 bp, Homo sapiens
atcagagccttatgcttctcat

SEQ ID NO: 8197468 - DNA, 22 bp, Homo sapiens
atcagagcccggcaatttattt

SEQ ID NO: 8197469 - DNA, 22 bp, Homo sapiens
atcagagccctgatgacagact

SEQ ID NO: 8197470 - DNA, 22 bp, Homo sapiens
ctgtaatcccagctactcggga

SEQ ID NO: 8197471 - DNA, 22 bp, Homo sapiens
ctgtaatcccagctactcggga

SEQ ID NO: 8197472 - DNA, 22 bp, Homo sapiens
atcacaaaggtctcagagcaca

SEQ ID NO: 8197473 - DNA, 22 bp, Homo sapiens
atcacaaaggtctcagagcaca

SEQ ID NO: 8197474 - DNA, 22 bp, Homo sapiens
atcacaaaggtctcagagcaca

SEQ ID NO: 8197475 - DNA, 22 bp, Homo sapiens
atcacaatgtacgttaaaatgt

SEQ ID NO: 8197476 - DNA, 22 bp, Homo sapiens
atcacaaaggtctcagagcaca

SEQ ID NO: 8197477 - DNA, 22 bp, Homo sapiens
atcacagcacacctgacatgta

SEQ ID NO: 8197478 - DNA, 22 bp, Homo sapiens
ctgtaaactaggtcatttttaa

SEQ ID NO: 8197479 - DNA, 20 bp, Homo sapiens
ctgtaaactgcgtctgtaat

SEQ ID NO: 8197480 - DNA, 22 bp, Homo sapiens
ctgtaaatggaactatgtagta

SEQ ID NO: 8197481 - DNA, 22 bp, Homo sapiens
ctgtaaatggaactatgtagta

SEQ ID NO: 8197482 - DNA, 22 bp, Homo sapiens
ctgtaaataatgacagttgact

SEQ ID NO: 8197483 - DNA, 22 bp, Homo sapiens
atcacactgttattttagttaa

SEQ ID NO: 8197484 - DNA, 22 bp, Homo sapiens
atcacactgttattttagttaa

SEQ ID NO: 8197485 - DNA, 19 bp, Homo sapiens
ctggggctttggtactgcc

SEQ ID NO: 8197486 - DNA, 19 bp, Homo sapiens
ctggggctttggtactgcc

SEQ ID NO: 8197487 - DNA, 19 bp, Homo sapiens
ctggggctttggtactgcc

SEQ ID NO: 8197488 - DNA, 19 bp, Homo sapiens
ctggggctttggtactgcc

SEQ ID NO: 8197489 - DNA, 19 bp, Homo sapiens
ctggggctttggtactgcc

SEQ ID NO: 8197490 - DNA, 22 bp, Homo sapiens
ctgggggcaagcagacagctgt

SEQ ID NO: 8197491 - DNA, 19 bp, Homo sapiens
ctggggctttggtactgcc

SEQ ID NO: 8197492 - DNA, 22 bp, Homo sapiens
atattattctagctcttgtgtg

SEQ ID NO: 8197493 - DNA, 22 bp, Homo sapiens
atattattctagtaacagtgat

SEQ ID NO: 8197494 - DNA, 23 bp, Homo sapiens
ctggggctttcaaatctgggcag

SEQ ID NO: 8197495 - DNA, 23 bp, Homo sapiens
ctggggctttcaaatctgggcag

SEQ ID NO: 8197496 - DNA, 23 bp, Homo sapiens
ctggggctttcaaatctgggcag

SEQ ID NO: 8197497 - DNA, 23 bp, Homo sapiens
ctggggctttcaaatctgggcag

SEQ ID NO: 8197498 - DNA, 22 bp, Homo sapiens
ctggggcttcaatgcttcggtg

SEQ ID NO: 8197499 - DNA, 22 bp, Homo sapiens
ctggggcttcaatgcttcggtg

SEQ ID NO: 8197500 - DNA, 22 bp, Homo sapiens
ctggggctgtgggagacaaggc

SEQ ID NO: 8197501 - DNA, 22 bp, Homo sapiens
ctggggctgtgggagacaaggc

SEQ ID NO: 8197502 - DNA, 22 bp, Homo sapiens
ctggggcatctgacagataaat

SEQ ID NO: 8197503 - DNA, 22 bp, Homo sapiens
ctggggcatctgacagataaat

SEQ ID NO: 8197504 - DNA, 19 bp, Homo sapiens
ctgggaggtgttcagagaa

SEQ ID NO: 8197505 - DNA, 22 bp, Homo sapiens
ctggggctgtaggaggacttat

SEQ ID NO: 8197506 - DNA, 22 bp, Homo sapiens
ctggggctgtaggaggacttat

SEQ ID NO: 8197507 - DNA, 22 bp, Homo sapiens
ctggggcatgggcccctagagg

SEQ ID NO: 8197508 - DNA, 22 bp, Homo sapiens
ctgggaggacaacttggagctc

SEQ ID NO: 8197509 - DNA, 22 bp, Homo sapiens
ctgggaggacaacttggagctc

SEQ ID NO: 8197510 - DNA, 22 bp, Homo sapiens
ctgggaggacaacttggagctc

SEQ ID NO: 8197511 - DNA, 22 bp, Homo sapiens
ctgggaggacaacttggagctc

SEQ ID NO: 8197512 - DNA, 22 bp, Homo sapiens
ctgggaggcggaggttgcagtg

SEQ ID NO: 8197513 - DNA, 22 bp, Homo sapiens
ctgggaggattcattgaggtga

SEQ ID NO: 8197514 - DNA, 22 bp, Homo sapiens
ctgggaggattcattgaggtga

SEQ ID NO: 8197515 - DNA, 22 bp, Homo sapiens
ctgggaggatacacaagatcag

SEQ ID NO: 8197516 - DNA, 22 bp, Homo sapiens
ctgggaggatacacaagatcag

SEQ ID NO: 8197517 - DNA, 22 bp, Homo sapiens
ctgggaggattcattgaggtga

SEQ ID NO: 8197518 - DNA, 22 bp, Homo sapiens
ctgggaggcggaggttgtagtg

SEQ ID NO: 8197519 - DNA, 22 bp, Homo sapiens
ctgggaggcggaggttgtagtg

SEQ ID NO: 8197520 - DNA, 22 bp, Homo sapiens
ctgggaggcggaggttgtagtg

SEQ ID NO: 8197521 - DNA, 20 bp, Homo sapiens
ctgggaggtcttccaaatca

SEQ ID NO: 8197522 - DNA, 20 bp, Homo sapiens
ctgggaggtcttccaaatca

SEQ ID NO: 8197523 - DNA, 22 bp, Homo sapiens
ctgggaggggtagccaatccta

SEQ ID NO: 8197524 - DNA, 19 bp, Homo sapiens
ctgggaggtgttcagagaa

SEQ ID NO: 8197525 - DNA, 19 bp, Homo sapiens
ctgggaggtgttcagagaa

SEQ ID NO: 8197526 - DNA, 22 bp, Homo sapiens
ctgggaggtggaggttgcattg

SEQ ID NO: 8197527 - DNA, 22 bp, Homo sapiens
ctgggaggtggaggttgcattg

SEQ ID NO: 8197528 - DNA, 22 bp, Homo sapiens
ctgggaggtgaacagaaaaact

SEQ ID NO: 8197529 - DNA, 22 bp, Homo sapiens
ctgggaggtgaacagaaaaact

SEQ ID NO: 8197530 - DNA, 22 bp, Homo sapiens
ctgggaggtgcagcaaaaatca

SEQ ID NO: 8197531 - DNA, 22 bp, Homo sapiens
ctgggaggtgcagcaaaaatca

SEQ ID NO: 8197532 - DNA, 22 bp, Homo sapiens
ctgggtggcgtctggggccagt

SEQ ID NO: 8197533 - DNA, 22 bp, Homo sapiens
ctgggtggcgtctggggccagt

SEQ ID NO: 8197534 - DNA, 22 bp, Homo sapiens
ctgggtggctgtccagccagcc

SEQ ID NO: 8197535 - DNA, 22 bp, Homo sapiens
ctgggtggcgtctggggccagt

SEQ ID NO: 8197536 - DNA, 22 bp, Homo sapiens
ctgggtggctgtccagccagcc

SEQ ID NO: 8197537 - DNA, 22 bp, Homo sapiens
ctgggtggctgtccagccagcc

SEQ ID NO: 8197538 - DNA, 22 bp, Homo sapiens
ctgggtggctgtccagccagcc

SEQ ID NO: 8197539 - DNA, 22 bp, Homo sapiens
ctgggtggctgtccagccagcc

SEQ ID NO: 8197540 - DNA, 18 bp, Homo sapiens
ctggtcagggcaatgggc

SEQ ID NO: 8197541 - DNA, 22 bp, Homo sapiens
ctggtcatcactctaacagact

SEQ ID NO: 8197542 - DNA, 22 bp, Homo sapiens
ctggtcatcactctaacagact

SEQ ID NO: 8197543 - DNA, 22 bp, Homo sapiens
ctggtcatgccaggtttgctgc

SEQ ID NO: 8197544 - DNA, 22 bp, Homo sapiens
ctggtcattcaggtgttttaaa

SEQ ID NO: 8197545 - DNA, 22 bp, Homo sapiens
ctggtcagggtagtgttgcaga

SEQ ID NO: 8197546 - DNA, 22 bp, Homo sapiens
ctggtccctggacctccctgga

SEQ ID NO: 8197547 - DNA, 22 bp, Homo sapiens
ctggtccctgcagtgtgctggg

SEQ ID NO: 8197548 - DNA, 22 bp, Homo sapiens
ctggtccctgcagtgtgctggg

SEQ ID NO: 8197549 - DNA, 22 bp, Homo sapiens
ctggtccctgcagtgtgctggg

SEQ ID NO: 8197550 - DNA, 22 bp, Homo sapiens
ctggtcctccttgccttcagat

SEQ ID NO: 8197551 - DNA, 22 bp, Homo sapiens
ctggtccctggacctccctgga

SEQ ID NO: 8197552 - DNA, 22 bp, Homo sapiens
ctggtcctccttgccttcagat

SEQ ID NO: 8197553 - DNA, 22 bp, Homo sapiens
ctggtcctccttgccttcagat

SEQ ID NO: 8197554 - DNA, 22 bp, Homo sapiens
ctggtccagtggatgctgaggg

SEQ ID NO: 8197555 - DNA, 22 bp, Homo sapiens
ctggtccagtggatgctgaggg

SEQ ID NO: 8197556 - DNA, 17 bp, Homo sapiens
ctggtcccaccaagccc

SEQ ID NO: 8197557 - DNA, 22 bp, Homo sapiens
ctggtcccagctctgccaccaa

SEQ ID NO: 8197558 - DNA, 22 bp, Homo sapiens
ctggtcccagctctgccaccaa

SEQ ID NO: 8197559 - DNA, 22 bp, Homo sapiens
ctgggtggatcgcagccccagg

SEQ ID NO: 8197560 - DNA, 20 bp, Homo sapiens
ctgggtggcaagcaaggggg

SEQ ID NO: 8197561 - DNA, 20 bp, Homo sapiens
ctgggtggcaagcaaggggg

SEQ ID NO: 8197562 - DNA, 22 bp, Homo sapiens
ctgggtggatcgcagccccagg

SEQ ID NO: 8197563 - DNA, 18 bp, Homo sapiens
ctgggtctccaggctgcc

SEQ ID NO: 8197564 - DNA, 18 bp, Homo sapiens
ctgggtctccaggctgcc

SEQ ID NO: 8197565 - DNA, 22 bp, Homo sapiens
ctgggtggatcgcagccccagg

SEQ ID NO: 8197566 - DNA, 22 bp, Homo sapiens
ctgggtggcagagcctgcagtg

SEQ ID NO: 8197567 - DNA, 22 bp, Homo sapiens
ctgggtggcagagcctgcagtg

SEQ ID NO: 8197568 - DNA, 20 bp, Homo sapiens
ctgggtggcaagcaaggggg

SEQ ID NO: 8197569 - DNA, 22 bp, Homo sapiens
ctgggtggcagagcctgcagtg

SEQ ID NO: 8197570 - DNA, 22 bp, Homo sapiens
ctgggtggcagagcctgcagtg

SEQ ID NO: 8197571 - DNA, 22 bp, Homo sapiens
ctgggtggcgtctggggccagt

SEQ ID NO: 8197572 - DNA, 22 bp, Homo sapiens
ctgggtggcagagcctgcagtg

SEQ ID NO: 8197573 - DNA, 22 bp, Homo sapiens
atattcaaattacatttactaa

SEQ ID NO: 8197574 - DNA, 22 bp, Homo sapiens
atattcaaattacatttactaa

SEQ ID NO: 8197575 - DNA, 22 bp, Homo sapiens
atattattctagtaacagtgat

SEQ ID NO: 8197576 - DNA, 22 bp, Homo sapiens
atattattttccctggagttgt

SEQ ID NO: 8197577 - DNA, 22 bp, Homo sapiens
atattcaagtgaggatggctaa

SEQ ID NO: 8197578 - DNA, 18 bp, Homo sapiens
atattcaagaagacagag

SEQ ID NO: 8197579 - DNA, 18 bp, Homo sapiens
atattcaagaagacagag

SEQ ID NO: 8197580 - DNA, 22 bp, Homo sapiens
atacatgtacataaatgtagca

SEQ ID NO: 8197581 - DNA, 22 bp, Homo sapiens
atacatgtaactgcattgtaat

SEQ ID NO: 8197582 - DNA, 22 bp, Homo sapiens
atacatgtgggtctaaacatat

SEQ ID NO: 8197583 - DNA, 22 bp, Homo sapiens
atacatgtgggtctaaacatat

SEQ ID NO: 8197584 - DNA, 22 bp, Homo sapiens
atacatgtcatcatatgtttgt

SEQ ID NO: 8197585 - DNA, 22 bp, Homo sapiens
atacatgtgggtctaaacatat

SEQ ID NO: 8197586 - DNA, 22 bp, Homo sapiens
atacatgtgggtctaaacatat

SEQ ID NO: 8197587 - DNA, 22 bp, Homo sapiens
ctggcagcttagcactctggtt

SEQ ID NO: 8197588 - DNA, 22 bp, Homo sapiens
ctggcagcttagcactctggtt

SEQ ID NO: 8197589 - DNA, 22 bp, Homo sapiens
ctggcacatagcaaatctcaac

SEQ ID NO: 8197590 - DNA, 19 bp, Homo sapiens
atacatgcatttacatgct

SEQ ID NO: 8197591 - DNA, 19 bp, Homo sapiens
atacatgcatttacatgct

SEQ ID NO: 8197592 - DNA, 22 bp, Homo sapiens
atacatgcgccatgttggtgtg

SEQ ID NO: 8197593 - DNA, 22 bp, Homo sapiens
ctggcacagttaacatatgcta

SEQ ID NO: 8197594 - DNA, 20 bp, Homo sapiens
ctggcacagggtccgtcctt

SEQ ID NO: 8197595 - DNA, 22 bp, Homo sapiens
ctggcacagttaacatatgcta

SEQ ID NO: 8197596 - DNA, 22 bp, Homo sapiens
ctggcacaggatccgagacctt

SEQ ID NO: 8197597 - DNA, 20 bp, Homo sapiens
ctggcacagggtccgtcctt

SEQ ID NO: 8197598 - DNA, 22 bp, Homo sapiens
ctggcacatagcaaatctcaac

SEQ ID NO: 8197599 - DNA, 22 bp, Homo sapiens
ctggcacataattagtgatcct

SEQ ID NO: 8197600 - DNA, 22 bp, Homo sapiens
ctggcacagcttgggccccatc

SEQ ID NO: 8197601 - DNA, 22 bp, Homo sapiens
ctggcacagccactgcaggcag

SEQ ID NO: 8197602 - DNA, 22 bp, Homo sapiens
ctggcacaggatccgagacctt

SEQ ID NO: 8197603 - DNA, 22 bp, Homo sapiens
ctggcacagcttgggccccatc

SEQ ID NO: 8197604 - DNA, 22 bp, Homo sapiens
ctggcacagcttgggccccatc

SEQ ID NO: 8197605 - DNA, 22 bp, Homo sapiens
ctggagtggccggtgctgtggc

SEQ ID NO: 8197606 - DNA, 22 bp, Homo sapiens
ctggagtgcagtggcatgatca

SEQ ID NO: 8197607 - DNA, 22 bp, Homo sapiens
ctggagtggccggtgctgtggc

SEQ ID NO: 8197608 - DNA, 22 bp, Homo sapiens
ctggcaagtactgggccagctc

SEQ ID NO: 8197609 - DNA, 22 bp, Homo sapiens
ctggagtgcagtggcatgatca

SEQ ID NO: 8197610 - DNA, 22 bp, Homo sapiens
ctggagtgcagtggcatgatca

SEQ ID NO: 8197611 - DNA, 22 bp, Homo sapiens
atacacatgtgtatgtgcatgc

SEQ ID NO: 8197612 - DNA, 20 bp, Homo sapiens
atacacatgcagacagatgc

SEQ ID NO: 8197613 - DNA, 22 bp, Homo sapiens
ctggcacaaatggaaaccaagc

SEQ ID NO: 8197614 - DNA, 22 bp, Homo sapiens
ctggcacaactccacctcagcg

SEQ ID NO: 8197615 - DNA, 22 bp, Homo sapiens
ctggcacaactccacctcagcg

SEQ ID NO: 8197616 - DNA, 22 bp, Homo sapiens
ctggcaagtggttgggatggat

SEQ ID NO: 8197617 - DNA, 22 bp, Homo sapiens
ctggcaagtggttgggatggat

SEQ ID NO: 8197618 - DNA, 22 bp, Homo sapiens
ctggcaagtggttgggatggat

SEQ ID NO: 8197619 - DNA, 22 bp, Homo sapiens
ctggcacaaaagaaaactgcca

SEQ ID NO: 8197620 - DNA, 22 bp, Homo sapiens
ctggcacaaaagaaaactgcca

SEQ ID NO: 8197621 - DNA, 22 bp, Homo sapiens
ctggcacacagcaggctctcag

SEQ ID NO: 8197622 - DNA, 22 bp, Homo sapiens
ctggcacacagaggccctcggg

SEQ ID NO: 8197623 - DNA, 22 bp, Homo sapiens
ctggcacacagcaggctctcag

SEQ ID NO: 8197624 - DNA, 22 bp, Homo sapiens
ctggcacacagcaggctctcag

SEQ ID NO: 8197625 - DNA, 22 bp, Homo sapiens
ctggcacacaagtatttccttt

SEQ ID NO: 8197626 - DNA, 22 bp, Homo sapiens
ctggcacacaagtatttccttt

SEQ ID NO: 8197627 - DNA, 22 bp, Homo sapiens
ctggcacaatgtcacttttgct

SEQ ID NO: 8197628 - DNA, 22 bp, Homo sapiens
ctggcacacagtaggcaccaat

SEQ ID NO: 8197629 - DNA, 22 bp, Homo sapiens
ctggcacacagcaggctctcag

SEQ ID NO: 8197630 - DNA, 22 bp, Homo sapiens
ctggcacacagtaggcaccaat

SEQ ID NO: 8197631 - DNA, 22 bp, Homo sapiens
ctggcacacgtggcagggtagg

SEQ ID NO: 8197632 - DNA, 22 bp, Homo sapiens
ctggcacacgtggcagggtagg

SEQ ID NO: 8197633 - DNA, 22 bp, Homo sapiens
ctggcacacagtaggcaccaat

SEQ ID NO: 8197634 - DNA, 22 bp, Homo sapiens
ctggcacagagacagaaggatt

SEQ ID NO: 8197635 - DNA, 22 bp, Homo sapiens
ctggcacagagacagaaggatt

SEQ ID NO: 8197636 - DNA, 22 bp, Homo sapiens
ctggcacagagacagaaggatt

SEQ ID NO: 8197637 - DNA, 22 bp, Homo sapiens
ctggcacacgtggcagggtagg

SEQ ID NO: 8197638 - DNA, 22 bp, Homo sapiens
ctggcacagccactgcaggcag

SEQ ID NO: 8197639 - DNA, 22 bp, Homo sapiens
ctggcacagccactgcaggcag

SEQ ID NO: 8197640 - DNA, 22 bp, Homo sapiens
ctggcacagagtgagcattcaa

SEQ ID NO: 8197641 - DNA, 22 bp, Homo sapiens
ctggcacagagtgagcattcaa

SEQ ID NO: 8197642 - DNA, 22 bp, Homo sapiens
ctggcacagagtgagcattcaa

SEQ ID NO: 8197643 - DNA, 22 bp, Homo sapiens
ctggcacagagtgagcattcaa

SEQ ID NO: 8197644 - DNA, 22 bp, Homo sapiens
ctggcctcacctcagacttact

SEQ ID NO: 8197645 - DNA, 22 bp, Homo sapiens
ctggcctaggaatggttttccg

SEQ ID NO: 8197646 - DNA, 22 bp, Homo sapiens
ctggcctaaaattgcttctgca

SEQ ID NO: 8197647 - DNA, 22 bp, Homo sapiens
ctggcccttgacttacagcagg

SEQ ID NO: 8197648 - DNA, 20 bp, Homo sapiens
ctggccagaacgcctacaca

SEQ ID NO: 8197649 - DNA, 22 bp, Homo sapiens
ctggccagaagcacctttggcg

SEQ ID NO: 8197650 - DNA, 20 bp, Homo sapiens
ctggccagaacgcctacaca

SEQ ID NO: 8197651 - DNA, 20 bp, Homo sapiens
ctggccagaacgcctacaca

SEQ ID NO: 8197652 - DNA, 20 bp, Homo sapiens
ctggccagaacgcctacaca

SEQ ID NO: 8197653 - DNA, 20 bp, Homo sapiens
ctggccagaacgcctacaca

SEQ ID NO: 8197654 - DNA, 22 bp, Homo sapiens
ctggccagactacacatgtgtg

SEQ ID NO: 8197655 - DNA, 22 bp, Homo sapiens
ctggccagactacacatgtgtg

SEQ ID NO: 8197656 - DNA, 22 bp, Homo sapiens
ctggcccttgacttacagcagg

SEQ ID NO: 8197657 - DNA, 22 bp, Homo sapiens
ctggcccttctcttgcttcctg

SEQ ID NO: 8197658 - DNA, 22 bp, Homo sapiens
ctggccctatgagcctcctgat

SEQ ID NO: 8197659 - DNA, 22 bp, Homo sapiens
ctggccctaggcaaacacagat

SEQ ID NO: 8197660 - DNA, 22 bp, Homo sapiens
ctggccagaggttcctctgccc

SEQ ID NO: 8197661 - DNA, 22 bp, Homo sapiens
ctggccagactacacatgtgtg

SEQ ID NO: 8197662 - DNA, 22 bp, Homo sapiens
ctggcaggtggaggttgcagtg

SEQ ID NO: 8197663 - DNA, 22 bp, Homo sapiens
ctggcaggtggaggttgcagtg

SEQ ID NO: 8197664 - DNA, 22 bp, Homo sapiens
ctggcaggtggatggggactcc

SEQ ID NO: 8197665 - DNA, 22 bp, Homo sapiens
ctggcaggtggatggggactcc

SEQ ID NO: 8197666 - DNA, 22 bp, Homo sapiens
ctggcaggtggatggggactcc

SEQ ID NO: 8197667 - DNA, 22 bp, Homo sapiens
ctggcaggtggatggggactcc

SEQ ID NO: 8197668 - DNA, 22 bp, Homo sapiens
ctggcaggtggaggttgcagtg

SEQ ID NO: 8197669 - DNA, 22 bp, Homo sapiens
ctggcaggtggatggggactcc

SEQ ID NO: 8197670 - DNA, 22 bp, Homo sapiens
ctggcaggttatagagctgccc

SEQ ID NO: 8197671 - DNA, 22 bp, Homo sapiens
ctggcaggttatagagctgccc

SEQ ID NO: 8197672 - DNA, 22 bp, Homo sapiens
ctggcaggttatagagctgccc

SEQ ID NO: 8197673 - DNA, 22 bp, Homo sapiens
ctggcaggttatagagctgccc

SEQ ID NO: 8197674 - DNA, 22 bp, Homo sapiens
ctggcaggttatagagctgccc

SEQ ID NO: 8197675 - DNA, 22 bp, Homo sapiens
ctggcaggtggaggttgcagtg

SEQ ID NO: 8197676 - DNA, 22 bp, Homo sapiens
ctggcaggtggaggttgcagtg

SEQ ID NO: 8197677 - DNA, 22 bp, Homo sapiens
ctggcaggtggaggttgcagtg

SEQ ID NO: 8197678 - DNA, 22 bp, Homo sapiens
ctggcaggtctcgctgacgtgt

SEQ ID NO: 8197679 - DNA, 22 bp, Homo sapiens
ctggcaggtctcgctgacgtgt

SEQ ID NO: 8197680 - DNA, 22 bp, Homo sapiens
ctggcaggtccagctggactca

SEQ ID NO: 8197681 - DNA, 22 bp, Homo sapiens
ctggcaggtccagctggactca

SEQ ID NO: 8197682 - DNA, 22 bp, Homo sapiens
ctggcaggtccagctggactca

SEQ ID NO: 8197683 - DNA, 22 bp, Homo sapiens
ctggcagcttattagaaatgca

SEQ ID NO: 8197684 - DNA, 22 bp, Homo sapiens
ctggcaggtctcgctgacgtgt

SEQ ID NO: 8197685 - DNA, 22 bp, Homo sapiens
ctggcaggtccagctggactca

SEQ ID NO: 8197686 - DNA, 22 bp, Homo sapiens
ctggcaggtttggtgtctggtg

SEQ ID NO: 8197687 - DNA, 22 bp, Homo sapiens
ctggcaggtttggtgtctggtg

SEQ ID NO: 8197688 - DNA, 22 bp, Homo sapiens
ctggcaggtttggtgtctggtg

SEQ ID NO: 8197689 - DNA, 22 bp, Homo sapiens
ctggcaggtttggtgtctggtg

SEQ ID NO: 8197690 - DNA, 22 bp, Homo sapiens
ctggcaggtttggtgtctggtg

SEQ ID NO: 8197691 - DNA, 22 bp, Homo sapiens
ctggccactgcgggcctctgcc

SEQ ID NO: 8197692 - DNA, 22 bp, Homo sapiens
ctggcagtattaagagaagtga

SEQ ID NO: 8197693 - DNA, 22 bp, Homo sapiens
ctggcaggttatagagctgccc

SEQ ID NO: 8197694 - DNA, 22 bp, Homo sapiens
ctggcaggtttggtgtctggtg

SEQ ID NO: 8197695 - DNA, 20 bp, Homo sapiens
ctggccagaacgcctacaca

SEQ ID NO: 8197696 - DNA, 22 bp, Homo sapiens
ctggccactggaggtggcaccc

SEQ ID NO: 8197697 - DNA, 22 bp, Homo sapiens
ctggccactggaggtggcaccc

SEQ ID NO: 8197698 - DNA, 22 bp, Homo sapiens
ctggccactggaggtggcaccc

SEQ ID NO: 8197699 - DNA, 22 bp, Homo sapiens
ctggccactgcgggcctctgcc

SEQ ID NO: 8197700 - DNA, 22 bp, Homo sapiens
ctggccactgcgggcctctgcc

SEQ ID NO: 8197701 - DNA, 22 bp, Homo sapiens
ctggccactggaggtggcaccc

SEQ ID NO: 8197702 - DNA, 22 bp, Homo sapiens
ctggccactgcgggcctctgcc

SEQ ID NO: 8197703 - DNA, 22 bp, Homo sapiens
ctggccactgcgggcctctgcc

SEQ ID NO: 8197704 - DNA, 22 bp, Homo sapiens
ctgggagctgtcaggagcgtgt

SEQ ID NO: 8197705 - DNA, 22 bp, Homo sapiens
ctgggagcttgttaggaatgca

SEQ ID NO: 8197706 - DNA, 22 bp, Homo sapiens
ctgggagcttggagcctttggt

SEQ ID NO: 8197707 - DNA, 22 bp, Homo sapiens
ctgggagctgtcaggagcgtgt

SEQ ID NO: 8197708 - DNA, 22 bp, Homo sapiens
ctgggagctggatgccctgccc

SEQ ID NO: 8197709 - DNA, 22 bp, Homo sapiens
ctgggagctggaatgggagaag

SEQ ID NO: 8197710 - DNA, 22 bp, Homo sapiens
ctgggagctggaatgggagaag

SEQ ID NO: 8197711 - DNA, 22 bp, Homo sapiens
atatacttggagactatcattg

SEQ ID NO: 8197712 - DNA, 22 bp, Homo sapiens
atatacttggagactatcattg

SEQ ID NO: 8197713 - DNA, 22 bp, Homo sapiens
atatacttggagactatcattg

SEQ ID NO: 8197714 - DNA, 22 bp, Homo sapiens
atatacttggagactatcattg

SEQ ID NO: 8197715 - DNA, 22 bp, Homo sapiens
atatacttggagactatcattg

SEQ ID NO: 8197716 - DNA, 22 bp, Homo sapiens
atatacttggagactatcattg

SEQ ID NO: 8197717 - DNA, 22 bp, Homo sapiens
atatacctcattctttgagtgc

SEQ ID NO: 8197718 - DNA, 22 bp, Homo sapiens
atatacttggagactatcattg

SEQ ID NO: 8197719 - DNA, 22 bp, Homo sapiens
atatacttccccattatggggg

SEQ ID NO: 8197720 - DNA, 22 bp, Homo sapiens
atatacatgggaatatgtggag

SEQ ID NO: 8197721 - DNA, 22 bp, Homo sapiens
atatacatgggaatatgtggag

SEQ ID NO: 8197722 - DNA, 20 bp, Homo sapiens
atataccatcccacaacagg

SEQ ID NO: 8197723 - DNA, 22 bp, Homo sapiens
atatacctcattctttgagtgc

SEQ ID NO: 8197724 - DNA, 22 bp, Homo sapiens
atataccctgttcgagtcccag

SEQ ID NO: 8197725 - DNA, 22 bp, Homo sapiens
atatacatgggaatatgtggag

SEQ ID NO: 8197726 - DNA, 22 bp, Homo sapiens
atatacatgggaatatgtggag

SEQ ID NO: 8197727 - DNA, 19 bp, Homo sapiens
atatacatactgtgtgcat

SEQ ID NO: 8197728 - DNA, 19 bp, Homo sapiens
atatacatactgtgtgcat

SEQ ID NO: 8197729 - DNA, 22 bp, Homo sapiens
atatacagttttacagggtttc

SEQ ID NO: 8197730 - DNA, 19 bp, Homo sapiens
atatacatactgtgtgcat

SEQ ID NO: 8197731 - DNA, 22 bp, Homo sapiens
atatacactccactgatacagg

SEQ ID NO: 8197732 - DNA, 22 bp, Homo sapiens
atatacactcaccatggtattt

SEQ ID NO: 8197733 - DNA, 22 bp, Homo sapiens
atatacactccactgatacagg

SEQ ID NO: 8197734 - DNA, 22 bp, Homo sapiens
atatacactccactgatacagg

SEQ ID NO: 8197735 - DNA, 22 bp, Homo sapiens
atatacactccactgatacagg

SEQ ID NO: 8197736 - DNA, 22 bp, Homo sapiens
atatacactccactgatacagg

SEQ ID NO: 8197737 - DNA, 22 bp, Homo sapiens
atatacagggagaaacagctta

SEQ ID NO: 8197738 - DNA, 22 bp, Homo sapiens
atatacactgtttcagttgaag

SEQ ID NO: 8197739 - DNA, 22 bp, Homo sapiens
atatacaggtggtatgtgtaaa

SEQ ID NO: 8197740 - DNA, 22 bp, Homo sapiens
atatacaggtggtatgtgtaaa

SEQ ID NO: 8197741 - DNA, 22 bp, Homo sapiens
atatacaggtggtatgtgtaaa

SEQ ID NO: 8197742 - DNA, 22 bp, Homo sapiens
atatacaggtggtatgtgtaaa

SEQ ID NO: 8197743 - DNA, 22 bp, Homo sapiens
atatacaggtggtatgtgtaaa

SEQ ID NO: 8197744 - DNA, 22 bp, Homo sapiens
atatacaggtggtatgtgtaaa

SEQ ID NO: 8197745 - DNA, 22 bp, Homo sapiens
atatacacatttgcttatgtgt

SEQ ID NO: 8197746 - DNA, 22 bp, Homo sapiens
atatacacatttgcttatgtgt

SEQ ID NO: 8197747 - DNA, 22 bp, Homo sapiens
atatacacatgtgtatacattt

SEQ ID NO: 8197748 - DNA, 22 bp, Homo sapiens
atatacacatgtgtatacattt

SEQ ID NO: 8197749 - DNA, 22 bp, Homo sapiens
atatacacatgtgtatacattt

SEQ ID NO: 8197750 - DNA, 22 bp, Homo sapiens
atatacacatgtgtatacattt

SEQ ID NO: 8197751 - DNA, 22 bp, Homo sapiens
atataatacaacctgctaagtg

SEQ ID NO: 8197752 - DNA, 19 bp, Homo sapiens
ctggctgcaatgccagggt

SEQ ID NO: 8197753 - DNA, 19 bp, Homo sapiens
ctggctgcaatgccagggt

SEQ ID NO: 8197754 - DNA, 22 bp, Homo sapiens
atataatacaacctgctaagtg

SEQ ID NO: 8197755 - DNA, 19 bp, Homo sapiens
ctggctgcaatgccagggt

SEQ ID NO: 8197756 - DNA, 22 bp, Homo sapiens
ctggctgcaaaatctattcact

SEQ ID NO: 8197757 - DNA, 22 bp, Homo sapiens
ctggctgcaaaatctattcact

SEQ ID NO: 8197758 - DNA, 22 bp, Homo sapiens
ctggctgattttctcacttctc

SEQ ID NO: 8197759 - DNA, 22 bp, Homo sapiens
ctggctgagctagagtccatgg

SEQ ID NO: 8197760 - DNA, 22 bp, Homo sapiens
ctggctgaggcagagcctgggg

SEQ ID NO: 8197761 - DNA, 22 bp, Homo sapiens
ctggctgaggcagagcctgggg

SEQ ID NO: 8197762 - DNA, 22 bp, Homo sapiens
ctggctgagttactccactgag

SEQ ID NO: 8197763 - DNA, 22 bp, Homo sapiens
ctggctgagttactccactgag

SEQ ID NO: 8197764 - DNA, 22 bp, Homo sapiens
ctggctgaggtcaccagtagct

SEQ ID NO: 8197765 - DNA, 22 bp, Homo sapiens
ctggctcacaggtgagatgcat

SEQ ID NO: 8197766 - DNA, 22 bp, Homo sapiens
ctggcgagggtcgctggggact

SEQ ID NO: 8197767 - DNA, 22 bp, Homo sapiens
ctggcgtgaaggtggccatgag

SEQ ID NO: 8197768 - DNA, 22 bp, Homo sapiens
ctggcgtgaaggtggccatgag

SEQ ID NO: 8197769 - DNA, 22 bp, Homo sapiens
atagtttgggcaaagaggacct

SEQ ID NO: 8197770 - DNA, 21 bp, Homo sapiens
atagtttggagtgggaaagtc

SEQ ID NO: 8197771 - DNA, 22 bp, Homo sapiens
atagtttaccttccagatggct

SEQ ID NO: 8197772 - DNA, 22 bp, Homo sapiens
atagtttaccttccagatggct

SEQ ID NO: 8197773 - DNA, 22 bp, Homo sapiens
atagtgcagccccttttctatt

SEQ ID NO: 8197774 - DNA, 22 bp, Homo sapiens
atagtgggtacaggggcagaga

SEQ ID NO: 8197775 - DNA, 21 bp, Homo sapiens
atagtgctagaatcagaggct

SEQ ID NO: 8197776 - DNA, 22 bp, Homo sapiens
ctggctcacaggtgagatgcat

SEQ ID NO: 8197777 - DNA, 22 bp, Homo sapiens
ctggctcacaggtgagatgcat

SEQ ID NO: 8197778 - DNA, 22 bp, Homo sapiens
ctggctcacaggtgagatgcat

SEQ ID NO: 8197779 - DNA, 22 bp, Homo sapiens
ctggcctctctgagcagggagc

SEQ ID NO: 8197780 - DNA, 22 bp, Homo sapiens
ctggcctctctgagcagggagc

SEQ ID NO: 8197781 - DNA, 19 bp, Homo sapiens
ctggcctgtgtcctgtgct

SEQ ID NO: 8197782 - DNA, 22 bp, Homo sapiens
ctggcctgtgggctgtctccgg

SEQ ID NO: 8197783 - DNA, 22 bp, Homo sapiens
ctggcctttcgtgagagctggg

SEQ ID NO: 8197784 - DNA, 22 bp, Homo sapiens
ctggcctttagccccagtgtct

SEQ ID NO: 8197785 - DNA, 22 bp, Homo sapiens
ctggcctttttagaaaacagct

SEQ ID NO: 8197786 - DNA, 22 bp, Homo sapiens
ctggccttttgtttctggagaa

SEQ ID NO: 8197787 - DNA, 22 bp, Homo sapiens
ctggcctttcgtgagagctggg

SEQ ID NO: 8197788 - DNA, 22 bp, Homo sapiens
atagttttaaaacctcaggaag

SEQ ID NO: 8197789 - DNA, 22 bp, Homo sapiens
atagttttatagatattgtgta

SEQ ID NO: 8197790 - DNA, 22 bp, Homo sapiens
atagttttctatgcactgttat

SEQ ID NO: 8197791 - DNA, 23 bp, Homo sapiens
atataaacaccagatagattgta

SEQ ID NO: 8197792 - DNA, 23 bp, Homo sapiens
atataaacaccagatagattgta

SEQ ID NO: 8197793 - DNA, 22 bp, Homo sapiens
atataaagaagtggaaaatgag

SEQ ID NO: 8197794 - DNA, 22 bp, Homo sapiens
atataaagaagtggaaaatgag

SEQ ID NO: 8197795 - DNA, 22 bp, Homo sapiens
atataaagagcttagtatagtg

SEQ ID NO: 8197796 - DNA, 22 bp, Homo sapiens
atataaagagcttagtatagtg

SEQ ID NO: 8197797 - DNA, 22 bp, Homo sapiens
atataaagaagtggaaaatgag

SEQ ID NO: 8197798 - DNA, 22 bp, Homo sapiens
ctggctctttcctagctaggct

SEQ ID NO: 8197799 - DNA, 22 bp, Homo sapiens
ctggctgaatcctagtctcata

SEQ ID NO: 8197800 - DNA, 22 bp, Homo sapiens
ctggctgaagctgggctctcct

SEQ ID NO: 8197801 - DNA, 22 bp, Homo sapiens
ctggctgacaccttgatagcag

SEQ ID NO: 8197802 - DNA, 22 bp, Homo sapiens
ctggctgacaccttgatagcag

SEQ ID NO: 8197803 - DNA, 22 bp, Homo sapiens
ctggctgacacaaaggtatcga

SEQ ID NO: 8197804 - DNA, 22 bp, Homo sapiens
ctggctgacacaaaggtatcga

SEQ ID NO: 8197805 - DNA, 22 bp, Homo sapiens
atataaagtgtttagaaagctg

SEQ ID NO: 8197806 - DNA, 22 bp, Homo sapiens
atataaagtgtttagaaagctg

SEQ ID NO: 8197807 - DNA, 22 bp, Homo sapiens
atataaagtgtttagaaagctg

SEQ ID NO: 8197808 - DNA, 22 bp, Homo sapiens
atataaagtgtttagaaagctg

SEQ ID NO: 8197809 - DNA, 22 bp, Homo sapiens
ctggctcttgcgactcagcttg

SEQ ID NO: 8197810 - DNA, 22 bp, Homo sapiens
ctgctgggggacacaggtccgg

SEQ ID NO: 8197811 - DNA, 22 bp, Homo sapiens
ctgctggggtcagagcactggg

SEQ ID NO: 8197812 - DNA, 22 bp, Homo sapiens
ctgctgtgcagacagactctct

SEQ ID NO: 8197813 - DNA, 22 bp, Homo sapiens
ctgctggggtcagagcactggg

SEQ ID NO: 8197814 - DNA, 22 bp, Homo sapiens
ctgctggggtcagagcactggg

SEQ ID NO: 8197815 - DNA, 22 bp, Homo sapiens
ctgctggggtcagagcactggg

SEQ ID NO: 8197816 - DNA, 22 bp, Homo sapiens
ctgctggggtcagagcactggg

SEQ ID NO: 8197817 - DNA, 22 bp, Homo sapiens
ctgctgtgcctcttttcacgtg

SEQ ID NO: 8197818 - DNA, 22 bp, Homo sapiens
ctgctgtgcatatttatctagg

SEQ ID NO: 8197819 - DNA, 22 bp, Homo sapiens
ctgctgtgcaggtgcctatgat

SEQ ID NO: 8197820 - DNA, 22 bp, Homo sapiens
ctgctgtgcaggtgcctatgat

SEQ ID NO: 8197821 - DNA, 22 bp, Homo sapiens
ctgctgtgccttaaaatgcaag

SEQ ID NO: 8197822 - DNA, 22 bp, Homo sapiens
ctgctgtgccttaaaatgcaag

SEQ ID NO: 8197823 - DNA, 22 bp, Homo sapiens
ctgctgtgcttgtggccacccg

SEQ ID NO: 8197824 - DNA, 22 bp, Homo sapiens
ctgctgtgcttgtggccacccg

SEQ ID NO: 8197825 - DNA, 22 bp, Homo sapiens
atacaagttaatgagaatgaca

SEQ ID NO: 8197826 - DNA, 18 bp, Homo sapiens
ctgctgtgtcgtctgggc

SEQ ID NO: 8197827 - DNA, 22 bp, Homo sapiens
ctgctgtgtcagagtccagggg

SEQ ID NO: 8197828 - DNA, 22 bp, Homo sapiens
ctgctgtgtatcattttagatg

SEQ ID NO: 8197829 - DNA, 22 bp, Homo sapiens
ctgctgtggtgtcaagcatctc

SEQ ID NO: 8197830 - DNA, 22 bp, Homo sapiens
ctgctgtggtgtcaagcatctc

SEQ ID NO: 8197831 - DNA, 22 bp, Homo sapiens
ctgctgtgtcagagtccagggg

SEQ ID NO: 8197832 - DNA, 22 bp, Homo sapiens
ctgctgtgtcagagtccagggg

SEQ ID NO: 8197833 - DNA, 22 bp, Homo sapiens
ctgctgtgtcagagtccagggg

SEQ ID NO: 8197834 - DNA, 22 bp, Homo sapiens
ctgctgtgggcagggtagctgg

SEQ ID NO: 8197835 - DNA, 21 bp, Homo sapiens
ctgctgtggcccccgacatgc

SEQ ID NO: 8197836 - DNA, 22 bp, Homo sapiens
ctgctgtggatgcaggacctca

SEQ ID NO: 8197837 - DNA, 22 bp, Homo sapiens
ctgctgtggccagccaggtcaa

SEQ ID NO: 8197838 - DNA, 22 bp, Homo sapiens
ctgctgtgggcagggtagctgg

SEQ ID NO: 8197839 - DNA, 20 bp, Homo sapiens
ctgctgtggtcctttatttt

SEQ ID NO: 8197840 - DNA, 22 bp, Homo sapiens
ctgctgtgggttaagacactgt

SEQ ID NO: 8197841 - DNA, 22 bp, Homo sapiens
ctgctgtgggttaagacactgt

SEQ ID NO: 8197842 - DNA, 19 bp, Homo sapiens
atacacatacgtaaactga

SEQ ID NO: 8197843 - DNA, 19 bp, Homo sapiens
atacacatacgtaaactga

SEQ ID NO: 8197844 - DNA, 19 bp, Homo sapiens
atacacatacgtaaactga

SEQ ID NO: 8197845 - DNA, 21 bp, Homo sapiens
atacacatacacataaatgtg

SEQ ID NO: 8197846 - DNA, 22 bp, Homo sapiens
atacacaggtgctaggtcaata

SEQ ID NO: 8197847 - DNA, 21 bp, Homo sapiens
atacacatacacataaatgtg

SEQ ID NO: 8197848 - DNA, 21 bp, Homo sapiens
atacacatacacataaatgtg

SEQ ID NO: 8197849 - DNA, 21 bp, Homo sapiens
atacacatacacataaatgtg

SEQ ID NO: 8197850 - DNA, 22 bp, Homo sapiens
atacaagttgcccaaatgatta

SEQ ID NO: 8197851 - DNA, 22 bp, Homo sapiens
atacacaggcatgcttctgatt

SEQ ID NO: 8197852 - DNA, 22 bp, Homo sapiens
atacaagttctcatgtgtatct

SEQ ID NO: 8197853 - DNA, 22 bp, Homo sapiens
atacacatatcaggtgtataca

SEQ ID NO: 8197854 - DNA, 22 bp, Homo sapiens
atacacatatgtgtgtatatgt

SEQ ID NO: 8197855 - DNA, 22 bp, Homo sapiens
atacacatatgtgtgtatatgt

SEQ ID NO: 8197856 - DNA, 22 bp, Homo sapiens
atacacatatgtgtgtatatgt

SEQ ID NO: 8197857 - DNA, 20 bp, Homo sapiens
atacacatattcttgcaact

SEQ ID NO: 8197858 - DNA, 20 bp, Homo sapiens
atacacatattcttgcaact

SEQ ID NO: 8197859 - DNA, 22 bp, Homo sapiens
atacacatatgtgtgtatatgt

SEQ ID NO: 8197860 - DNA, 22 bp, Homo sapiens
atacacatctatttaagagaca

SEQ ID NO: 8197861 - DNA, 22 bp, Homo sapiens
atacacatctatttaagagaca

SEQ ID NO: 8197862 - DNA, 22 bp, Homo sapiens
atacacatctatttaagagaca

SEQ ID NO: 8197863 - DNA, 20 bp, Homo sapiens
atacacatgcagacagatgc

SEQ ID NO: 8197864 - DNA, 22 bp, Homo sapiens
atacacatgcacacatgtgtgt

SEQ ID NO: 8197865 - DNA, 22 bp, Homo sapiens
ctgctgggcctggtctctgagg

SEQ ID NO: 8197866 - DNA, 22 bp, Homo sapiens
ctgctgggcctggtctctgagg

SEQ ID NO: 8197867 - DNA, 22 bp, Homo sapiens
ctgctgcccagtgtgcattggg

SEQ ID NO: 8197868 - DNA, 22 bp, Homo sapiens
ctgctgggcagaggctgcatga

SEQ ID NO: 8197869 - DNA, 22 bp, Homo sapiens
ctgctgggcagaggctgcatga

SEQ ID NO: 8197870 - DNA, 22 bp, Homo sapiens
ctgctgcccagtgtgcattggg

SEQ ID NO: 8197871 - DNA, 22 bp, Homo sapiens
ctgctgcccagtgtgcattggg

SEQ ID NO: 8197872 - DNA, 22 bp, Homo sapiens
ctgctgccattagggcacagac

SEQ ID NO: 8197873 - DNA, 22 bp, Homo sapiens
ctgctggggaggcgcctcgacg

SEQ ID NO: 8197874 - DNA, 22 bp, Homo sapiens
ctgctggggaggcgcctcgacg

SEQ ID NO: 8197875 - DNA, 22 bp, Homo sapiens
ctgctgggctcctcatgtgact

SEQ ID NO: 8197876 - DNA, 22 bp, Homo sapiens
ctgctgggggacacaggtccgg

SEQ ID NO: 8197877 - DNA, 22 bp, Homo sapiens
ctgctgggctcctcatgtgact

SEQ ID NO: 8197878 - DNA, 22 bp, Homo sapiens
ctgctgggctcctcatgtgact

SEQ ID NO: 8197879 - DNA, 22 bp, Homo sapiens
ctgctgggctcctcatgtgact

SEQ ID NO: 8197880 - DNA, 22 bp, Homo sapiens
ctgctgggctcctcatgtgact

SEQ ID NO: 8197881 - DNA, 19 bp, Homo sapiens
ctgctcagagcagctccag

SEQ ID NO: 8197882 - DNA, 20 bp, Homo sapiens
ctgctcagaccaactcttct

SEQ ID NO: 8197883 - DNA, 20 bp, Homo sapiens
ctgctcagaccaactcttct

SEQ ID NO: 8197884 - DNA, 19 bp, Homo sapiens
ctgctcagagcagctccag

SEQ ID NO: 8197885 - DNA, 19 bp, Homo sapiens
ctgctcagagcagctccag

SEQ ID NO: 8197886 - DNA, 19 bp, Homo sapiens
ctgctcagagcagctccag

SEQ ID NO: 8197887 - DNA, 19 bp, Homo sapiens
ctgctcaggtcagtctgtc

SEQ ID NO: 8197888 - DNA, 22 bp, Homo sapiens
ctgctcaattccggcacgctgg

SEQ ID NO: 8197889 - DNA, 22 bp, Homo sapiens
ctgctagcccaggatgcaggga

SEQ ID NO: 8197890 - DNA, 22 bp, Homo sapiens
ctgctaccctagagctcactct

SEQ ID NO: 8197891 - DNA, 22 bp, Homo sapiens
ctgctaaacctctctgagagct

SEQ ID NO: 8197892 - DNA, 22 bp, Homo sapiens
ctgctaaacctctctgagagct

SEQ ID NO: 8197893 - DNA, 22 bp, Homo sapiens
ctgctaaacctctctgagagct

SEQ ID NO: 8197894 - DNA, 22 bp, Homo sapiens
ctgcctgtgccaccgcctcatt

SEQ ID NO: 8197895 - DNA, 22 bp, Homo sapiens
ctgcctgtgccaatgctccttt

SEQ ID NO: 8197896 - DNA, 22 bp, Homo sapiens
ctgcctgtgccaatgctccttt

SEQ ID NO: 8197897 - DNA, 22 bp, Homo sapiens
ctgcctgtgccaatgctccttt

SEQ ID NO: 8197898 - DNA, 22 bp, Homo sapiens
ctgcctgtgccaccgcctcatt

SEQ ID NO: 8197899 - DNA, 22 bp, Homo sapiens
ctgcctgtgccaccgcctcatt

SEQ ID NO: 8197900 - DNA, 22 bp, Homo sapiens
ctgcctgtattgtctgcttggg

SEQ ID NO: 8197901 - DNA, 22 bp, Homo sapiens
ctgcctgtgatttttctctagt

SEQ ID NO: 8197902 - DNA, 22 bp, Homo sapiens
ctgcctgtgcatgcagtcagaa

SEQ ID NO: 8197903 - DNA, 22 bp, Homo sapiens
ctgcctgtattgtctgcttggg

SEQ ID NO: 8197904 - DNA, 22 bp, Homo sapiens
ctgcctgtaactttctgaagca

SEQ ID NO: 8197905 - DNA, 22 bp, Homo sapiens
ctgcctggtgcggtgcccaccc

SEQ ID NO: 8197906 - DNA, 22 bp, Homo sapiens
ctgcctggtctcaggcatgggg

SEQ ID NO: 8197907 - DNA, 22 bp, Homo sapiens
ctgcctggtactttaggcactt

SEQ ID NO: 8197908 - DNA, 22 bp, Homo sapiens
ctgcctggtctcaggcatgggg

SEQ ID NO: 8197909 - DNA, 22 bp, Homo sapiens
ctgcctggtctcaggcatgggg

SEQ ID NO: 8197910 - DNA, 22 bp, Homo sapiens
ctgcctgggttcaagtcctgtt

SEQ ID NO: 8197911 - DNA, 22 bp, Homo sapiens
ctgcctgggttcaagtcctgtt

SEQ ID NO: 8197912 - DNA, 22 bp, Homo sapiens
ctgcctgggttcaagtcctgtt

SEQ ID NO: 8197913 - DNA, 22 bp, Homo sapiens
ctgcctgggttcaagtcctgtt

SEQ ID NO: 8197914 - DNA, 22 bp, Homo sapiens
ctgcctggaaggagcaagggga

SEQ ID NO: 8197915 - DNA, 22 bp, Homo sapiens
ctgcctgggttcaagtcctgtt

SEQ ID NO: 8197916 - DNA, 22 bp, Homo sapiens
ctgcctggggcatcagtcaagg

SEQ ID NO: 8197917 - DNA, 22 bp, Homo sapiens
ataaagctttgaaatggagata

SEQ ID NO: 8197918 - DNA, 23 bp, Homo sapiens
agttctcattcatcacggcctat

SEQ ID NO: 8197919 - DNA, 22 bp, Homo sapiens
agttctcatttcacaggcagtg

SEQ ID NO: 8197920 - DNA, 22 bp, Homo sapiens
agttctcagaattgcacctcaa

SEQ ID NO: 8197921 - DNA, 22 bp, Homo sapiens
agttctatttctaacatgttat

SEQ ID NO: 8197922 - DNA, 22 bp, Homo sapiens
agttctataattaaaatgaagg

SEQ ID NO: 8197923 - DNA, 22 bp, Homo sapiens
agttctattgggtaggttctgt

SEQ ID NO: 8197924 - DNA, 22 bp, Homo sapiens
agttctggttgcccatgacatc

SEQ ID NO: 8197925 - DNA, 22 bp, Homo sapiens
agttctgtctgacaccgaagtt

SEQ ID NO: 8197926 - DNA, 22 bp, Homo sapiens
agttctgtcctccccactcttt

SEQ ID NO: 8197927 - DNA, 22 bp, Homo sapiens
agttctgtctgattctaatgca

SEQ ID NO: 8197928 - DNA, 22 bp, Homo sapiens
agttctgtctgattctaatgca

SEQ ID NO: 8197929 - DNA, 22 bp, Homo sapiens
agttctgtctgattctaatgca

SEQ ID NO: 8197930 - DNA, 22 bp, Homo sapiens
agttctggcgcccatgagcaga

SEQ ID NO: 8197931 - DNA, 22 bp, Homo sapiens
agttctggtggtttggagatct

SEQ ID NO: 8197932 - DNA, 22 bp, Homo sapiens
agttctctggctcctttccaga

SEQ ID NO: 8197933 - DNA, 22 bp, Homo sapiens
agttctctcccctgctgttcag

SEQ ID NO: 8197934 - DNA, 22 bp, Homo sapiens
agttctcttggaagttatgtga

SEQ ID NO: 8197935 - DNA, 22 bp, Homo sapiens
agttctctttagctcatatggt

SEQ ID NO: 8197936 - DNA, 20 bp, Homo sapiens
agttctcttccttgggcctg

SEQ ID NO: 8197937 - DNA, 22 bp, Homo sapiens
agttctcttctcatcacccagg

SEQ ID NO: 8197938 - DNA, 22 bp, Homo sapiens
ataaaacttattagaattgtgt

SEQ ID NO: 8197939 - DNA, 22 bp, Homo sapiens
ataaaagaagttttggtacttg

SEQ ID NO: 8197940 - DNA, 22 bp, Homo sapiens
ctgcaggctgagcgcctgccgg

SEQ ID NO: 8197941 - DNA, 22 bp, Homo sapiens
ctgcaggctcgaagacacggat

SEQ ID NO: 8197942 - DNA, 22 bp, Homo sapiens
ctgcaggctcgaagacacggat

SEQ ID NO: 8197943 - DNA, 22 bp, Homo sapiens
ataaaagatcccttctgagctc

SEQ ID NO: 8197944 - DNA, 22 bp, Homo sapiens
ataaaaggaaagcctgttgtga

SEQ ID NO: 8197945 - DNA, 22 bp, Homo sapiens
ataaaaatgagggcggtagcta

SEQ ID NO: 8197946 - DNA, 22 bp, Homo sapiens
ataaaaatgagggcggtagcta

SEQ ID NO: 8197947 - DNA, 22 bp, Homo sapiens
ataaaaatgagggcggtagcta

SEQ ID NO: 8197948 - DNA, 22 bp, Homo sapiens
ataaaaatgagggcggtagcta

SEQ ID NO: 8197949 - DNA, 22 bp, Homo sapiens
agttctgtgacaatatcattac

SEQ ID NO: 8197950 - DNA, 22 bp, Homo sapiens
agttctgtgctcactctacccc

SEQ ID NO: 8197951 - DNA, 22 bp, Homo sapiens
agttctgtggctgtgccctgta

SEQ ID NO: 8197952 - DNA, 21 bp, Homo sapiens
agttctgttatgctggactca

SEQ ID NO: 8197953 - DNA, 22 bp, Homo sapiens
agttctgttgtctagggaagcc

SEQ ID NO: 8197954 - DNA, 22 bp, Homo sapiens
agttctgttgtctagggaagcc

SEQ ID NO: 8197955 - DNA, 17 bp, Homo sapiens
agttttgatataatggc

SEQ ID NO: 8197956 - DNA, 22 bp, Homo sapiens
agttttgtaattctcaaaaata

SEQ ID NO: 8197957 - DNA, 22 bp, Homo sapiens
ctgcagggacccaagtctttgg

SEQ ID NO: 8197958 - DNA, 22 bp, Homo sapiens
ctgcagggacccaagtctttgg

SEQ ID NO: 8197959 - DNA, 22 bp, Homo sapiens
ctgcagggagaggggacagcct

SEQ ID NO: 8197960 - DNA, 22 bp, Homo sapiens
ctgcagggagaggggacagcct

SEQ ID NO: 8197961 - DNA, 22 bp, Homo sapiens
ctgcagggaccacaagcaggtt

SEQ ID NO: 8197962 - DNA, 22 bp, Homo sapiens
ctgcagggaccacaagcaggtt

SEQ ID NO: 8197963 - DNA, 22 bp, Homo sapiens
ctgcagggaccacaagcaggtt

SEQ ID NO: 8197964 - DNA, 22 bp, Homo sapiens
ctgcagggaccacaagcaggtt

SEQ ID NO: 8197965 - DNA, 22 bp, Homo sapiens
ctgcagggaactgaggcccaga

SEQ ID NO: 8197966 - DNA, 22 bp, Homo sapiens
ctgcagggaactgaggcccaga

SEQ ID NO: 8197967 - DNA, 22 bp, Homo sapiens
ctgcagggaactgaggcccaga

SEQ ID NO: 8197968 - DNA, 22 bp, Homo sapiens
ctgcagggaactgaggcccaga

SEQ ID NO: 8197969 - DNA, 22 bp, Homo sapiens
ctgcaggcttccagggctgtgg

SEQ ID NO: 8197970 - DNA, 22 bp, Homo sapiens
ctgcaggctgagcgcctgccgg

SEQ ID NO: 8197971 - DNA, 22 bp, Homo sapiens
ctgcaggctgagcgcctgccgg

SEQ ID NO: 8197972 - DNA, 22 bp, Homo sapiens
ctgcaggctgagcgcctgccgg

SEQ ID NO: 8197973 - DNA, 22 bp, Homo sapiens
ataaaccagaagtaaaagctac

SEQ ID NO: 8197974 - DNA, 22 bp, Homo sapiens
ataaaccagaagtaaaagctac

SEQ ID NO: 8197975 - DNA, 22 bp, Homo sapiens
ataaacatctgtttctcttctg

SEQ ID NO: 8197976 - DNA, 22 bp, Homo sapiens
ataaacatctgtttctcttctg

SEQ ID NO: 8197977 - DNA, 22 bp, Homo sapiens
ataaaatctttatgtgctctgc

SEQ ID NO: 8197978 - DNA, 22 bp, Homo sapiens
ataaacatctgtttctcttctg

SEQ ID NO: 8197979 - DNA, 22 bp, Homo sapiens
ataaaatcagagttggattgga

SEQ ID NO: 8197980 - DNA, 22 bp, Homo sapiens
ctgcagggagaggggacagcct

SEQ ID NO: 8197981 - DNA, 22 bp, Homo sapiens
ataaaatcaactggctccagtt

SEQ ID NO: 8197982 - DNA, 22 bp, Homo sapiens
ataaagcaagcataccattaag

SEQ ID NO: 8197983 - DNA, 22 bp, Homo sapiens
ataaagcaagcataccattaag

SEQ ID NO: 8197984 - DNA, 22 bp, Homo sapiens
ataaagcaagcataccattaag

SEQ ID NO: 8197985 - DNA, 22 bp, Homo sapiens
ataaagcatactttgtatgact

SEQ ID NO: 8197986 - DNA, 22 bp, Homo sapiens
ataaagcatactttgtatgact

SEQ ID NO: 8197987 - DNA, 22 bp, Homo sapiens
ataaagcaggtccccagacact

SEQ ID NO: 8197988 - DNA, 22 bp, Homo sapiens
ataaagcaatagattgtgtaat

SEQ ID NO: 8197989 - DNA, 22 bp, Homo sapiens
ataaagctaagacttacatgaa

SEQ ID NO: 8197990 - DNA, 22 bp, Homo sapiens
ataaagcaaataggactattgc

SEQ ID NO: 8197991 - DNA, 22 bp, Homo sapiens
ataaagatttttaggcatttct

SEQ ID NO: 8197992 - DNA, 22 bp, Homo sapiens
ataaagatttctttttctctac

SEQ ID NO: 8197993 - DNA, 22 bp, Homo sapiens
ataaagaggatgtatttacagc

SEQ ID NO: 8197994 - DNA, 22 bp, Homo sapiens
ataaactttagcggaaggagga

SEQ ID NO: 8197995 - DNA, 22 bp, Homo sapiens
ataaacttgagtctcagagtat

SEQ ID NO: 8197996 - DNA, 22 bp, Homo sapiens
ataaacttgagtctcagagtat

SEQ ID NO: 8197997 - DNA, 22 bp, Homo sapiens
ataaactggtaggaaaacagta

SEQ ID NO: 8197998 - DNA, 22 bp, Homo sapiens
agggttttggctgaagttcagc

SEQ ID NO: 8197999 - DNA, 22 bp, Homo sapiens
agggttgcttgagcccaggagt

SEQ ID NO: 8198000 - DNA, 23 bp, Homo sapiens
agggttgtgtgcttcatgatcat

SEQ ID NO: 8198001 - DNA, 22 bp, Homo sapiens
aggtaaagaaaggtgtaacatt

SEQ ID NO: 8198002 - DNA, 22 bp, Homo sapiens
aggtaaaatagatagtatttct

SEQ ID NO: 8198003 - DNA, 22 bp, Homo sapiens
agggttgaagtctggtcctcat

SEQ ID NO: 8198004 - DNA, 22 bp, Homo sapiens
agggttgcagcagaggcccagt

SEQ ID NO: 8198005 - DNA, 22 bp, Homo sapiens
agggttgcaggggccatgccca

SEQ ID NO: 8198006 - DNA, 22 bp, Homo sapiens
agggttagtctttgcagctagg

SEQ ID NO: 8198007 - DNA, 22 bp, Homo sapiens
agggttaggtcacgctgcctgg

SEQ ID NO: 8198008 - DNA, 22 bp, Homo sapiens
cctgagtcaagatgtatggtaa

SEQ ID NO: 8198009 - DNA, 22 bp, Homo sapiens
cctgagtccaaaagtctttagc

SEQ ID NO: 8198010 - DNA, 21 bp, Homo sapiens
cctgaggtttctggcctctgt

SEQ ID NO: 8198011 - DNA, 22 bp, Homo sapiens
cctgaggtttttggatagttgt

SEQ ID NO: 8198012 - DNA, 22 bp, Homo sapiens
cctgaggtttttggatagttgt

SEQ ID NO: 8198013 - DNA, 22 bp, Homo sapiens
cctgagtagctggaattaaagg

SEQ ID NO: 8198014 - DNA, 22 bp, Homo sapiens
cctgagtagctggaattaaagg

SEQ ID NO: 8198015 - DNA, 22 bp, Homo sapiens
cctgagtaacatggtgagaacc

SEQ ID NO: 8198016 - DNA, 22 bp, Homo sapiens
cctgaggtttttggatagttgt

SEQ ID NO: 8198017 - DNA, 18 bp, Homo sapiens
cctgaggtgggaggaagg

SEQ ID NO: 8198018 - DNA, 22 bp, Homo sapiens
cctgaggtggctgcagcactgc

SEQ ID NO: 8198019 - DNA, 22 bp, Homo sapiens
cctgaggtggctgcagcactgc

SEQ ID NO: 8198020 - DNA, 22 bp, Homo sapiens
cctgaggtggctgcagcactgc

SEQ ID NO: 8198021 - DNA, 18 bp, Homo sapiens
cctgaggtgggaggaagg

SEQ ID NO: 8198022 - DNA, 19 bp, Homo sapiens
cctgaggtggggtggaagg

SEQ ID NO: 8198023 - DNA, 18 bp, Homo sapiens
cctgaggtgggaggaagg

SEQ ID NO: 8198024 - DNA, 19 bp, Homo sapiens
cctgaggtggggtggaagg

SEQ ID NO: 8198025 - DNA, 19 bp, Homo sapiens
cctgaggtggggtggaagg

SEQ ID NO: 8198026 - DNA, 22 bp, Homo sapiens
cctgaggttgaagtataaattg

SEQ ID NO: 8198027 - DNA, 22 bp, Homo sapiens
cctgaggttgaagtataaattg

SEQ ID NO: 8198028 - DNA, 22 bp, Homo sapiens
cctgaggttatccatctacctg

SEQ ID NO: 8198029 - DNA, 22 bp, Homo sapiens
aggtaaggctgtaagctaagcc

SEQ ID NO: 8198030 - DNA, 22 bp, Homo sapiens
aggtaaggaaattgaggcaatt

SEQ ID NO: 8198031 - DNA, 22 bp, Homo sapiens
aggtaaggaaattgaggcaatt

SEQ ID NO: 8198032 - DNA, 22 bp, Homo sapiens
aggtaaggctgtaagctaagcc

SEQ ID NO: 8198033 - DNA, 22 bp, Homo sapiens
aggtaagcatggtggctgctgt

SEQ ID NO: 8198034 - DNA, 22 bp, Homo sapiens
aggtaagcctggaggcttctat

SEQ ID NO: 8198035 - DNA, 22 bp, Homo sapiens
aggtaaagactgcaaggagaat

SEQ ID NO: 8198036 - DNA, 22 bp, Homo sapiens
aggtaaagactgcaaggagaat

SEQ ID NO: 8198037 - DNA, 22 bp, Homo sapiens
aggtaaagacagtgaaagaggg

SEQ ID NO: 8198038 - DNA, 22 bp, Homo sapiens
aggtaaagacagtgaaagaggg

SEQ ID NO: 8198039 - DNA, 22 bp, Homo sapiens
aggtaaagacagtgaaagaggg

SEQ ID NO: 8198040 - DNA, 22 bp, Homo sapiens
aggtaaattcagcagtgacatt

SEQ ID NO: 8198041 - DNA, 22 bp, Homo sapiens
aggtaacactacttagtatact

SEQ ID NO: 8198042 - DNA, 22 bp, Homo sapiens
aggtaaggtttggaggcagtgg

SEQ ID NO: 8198043 - DNA, 22 bp, Homo sapiens
aggtaatagggttcagaattat

SEQ ID NO: 8198044 - DNA, 22 bp, Homo sapiens
aggtaaggtttggaggcagtgg

SEQ ID NO: 8198045 - DNA, 22 bp, Homo sapiens
aggtacaaaagagtatatgaga

SEQ ID NO: 8198046 - DNA, 22 bp, Homo sapiens
aggtacagatgaaagtctagtt

SEQ ID NO: 8198047 - DNA, 22 bp, Homo sapiens
aggtcacacaactgtcagaggc

SEQ ID NO: 8198048 - DNA, 22 bp, Homo sapiens
aggtcacagctttctcgtgagg

SEQ ID NO: 8198049 - DNA, 22 bp, Homo sapiens
aggtcacaggctttgaaatcaa

SEQ ID NO: 8198050 - DNA, 22 bp, Homo sapiens
aggtacagcaatataagaggtc

SEQ ID NO: 8198051 - DNA, 22 bp, Homo sapiens
aggtatttatgagagcacatat

SEQ ID NO: 8198052 - DNA, 22 bp, Homo sapiens
aggtatttatgagagcacatat

SEQ ID NO: 8198053 - DNA, 22 bp, Homo sapiens
aggtcacacaactgtcagaggc

SEQ ID NO: 8198054 - DNA, 22 bp, Homo sapiens
cctgggagaactgctgggttgg

SEQ ID NO: 8198055 - DNA, 20 bp, Homo sapiens
aggtcagtagaatgattttg

SEQ ID NO: 8198056 - DNA, 22 bp, Homo sapiens
aggtcaggtatcagcaggtatt

SEQ ID NO: 8198057 - DNA, 22 bp, Homo sapiens
aggtcaggtatcagcaggtatt

SEQ ID NO: 8198058 - DNA, 22 bp, Homo sapiens
aggtcaggtatcagcaggtatt

SEQ ID NO: 8198059 - DNA, 22 bp, Homo sapiens
aggtcaggtatcagcaggtatt

SEQ ID NO: 8198060 - DNA, 22 bp, Homo sapiens
aggtcaggtatcagcaggtatt

SEQ ID NO: 8198061 - DNA, 22 bp, Homo sapiens
aggtcaggaggttaagagtctt

SEQ ID NO: 8198062 - DNA, 22 bp, Homo sapiens
aggtcagggtattcacgtctgt

SEQ ID NO: 8198063 - DNA, 22 bp, Homo sapiens
aggtcaggaggttaagagtctt

SEQ ID NO: 8198064 - DNA, 22 bp, Homo sapiens
aggtcaggaggttaagagtctt

SEQ ID NO: 8198065 - DNA, 22 bp, Homo sapiens
cctgggaggctgtgggtctgct

SEQ ID NO: 8198066 - DNA, 22 bp, Homo sapiens
cctgggaggctgtgggtctgct

SEQ ID NO: 8198067 - DNA, 22 bp, Homo sapiens
cctgggaggctgaggctgcagt

SEQ ID NO: 8198068 - DNA, 22 bp, Homo sapiens
cctgggaggctgaggctgcagt

SEQ ID NO: 8198069 - DNA, 21 bp, Homo sapiens
cctgggagaattgggtgtggc

SEQ ID NO: 8198070 - DNA, 22 bp, Homo sapiens
cctgggaggctgaggctgcagt

SEQ ID NO: 8198071 - DNA, 22 bp, Homo sapiens
cctgggaggctgaggctgcagt

SEQ ID NO: 8198072 - DNA, 21 bp, Homo sapiens
cctgggagaattgggtgtggc

SEQ ID NO: 8198073 - DNA, 21 bp, Homo sapiens
cctgggagaattgggtgtggc

SEQ ID NO: 8198074 - DNA, 22 bp, Homo sapiens
cctgggaggctgaggctgcagt

SEQ ID NO: 8198075 - DNA, 22 bp, Homo sapiens
cctgggaggctgaggctgcagt

SEQ ID NO: 8198076 - DNA, 22 bp, Homo sapiens
cctgggaggctgaggctgcagt

SEQ ID NO: 8198077 - DNA, 22 bp, Homo sapiens
cctgggaggctgtttccagcct

SEQ ID NO: 8198078 - DNA, 22 bp, Homo sapiens
cctgggaggctgtttccagcct

SEQ ID NO: 8198079 - DNA, 22 bp, Homo sapiens
cctgggaggctgtgggtctgct

SEQ ID NO: 8198080 - DNA, 22 bp, Homo sapiens
cctgggaggctgtgggtctgct

SEQ ID NO: 8198081 - DNA, 22 bp, Homo sapiens
cctgggagggcaagtgctgatg

SEQ ID NO: 8198082 - DNA, 22 bp, Homo sapiens
cctgggagggcaagtgctgatg

SEQ ID NO: 8198083 - DNA, 22 bp, Homo sapiens
cctgggaggctgtttccagcct

SEQ ID NO: 8198084 - DNA, 22 bp, Homo sapiens
cctgggaggctgtttccagcct

SEQ ID NO: 8198085 - DNA, 22 bp, Homo sapiens
cctgggagggcaagtgctgatg

SEQ ID NO: 8198086 - DNA, 22 bp, Homo sapiens
cctgggaggtggaggttgcagc

SEQ ID NO: 8198087 - DNA, 22 bp, Homo sapiens
cctgggaggtggaggttgcagt

SEQ ID NO: 8198088 - DNA, 22 bp, Homo sapiens
cctgggaggtggaggttgcagt

SEQ ID NO: 8198089 - DNA, 22 bp, Homo sapiens
cctgggaggtggaggttgcagt

SEQ ID NO: 8198090 - DNA, 22 bp, Homo sapiens
cctgggaggtggaggttgcagt

SEQ ID NO: 8198091 - DNA, 22 bp, Homo sapiens
cctgggagggcaagtgctgatg

SEQ ID NO: 8198092 - DNA, 22 bp, Homo sapiens
cctgggaggtggaggttgcagc

SEQ ID NO: 8198093 - DNA, 22 bp, Homo sapiens
cctgggaggtggaggttgcagc

SEQ ID NO: 8198094 - DNA, 22 bp, Homo sapiens
cctgggaggtggaggttgcagc

SEQ ID NO: 8198095 - DNA, 22 bp, Homo sapiens
aggtcacagggttgaagtactt

SEQ ID NO: 8198096 - DNA, 22 bp, Homo sapiens
aggtcacagggttgaagtactt

SEQ ID NO: 8198097 - DNA, 22 bp, Homo sapiens
aggtcacccgtttgactatcca

SEQ ID NO: 8198098 - DNA, 22 bp, Homo sapiens
aggtcacccgtttgactatcca

SEQ ID NO: 8198099 - DNA, 22 bp, Homo sapiens
aggtcacccgtttgactatcca

SEQ ID NO: 8198100 - DNA, 22 bp, Homo sapiens
aggtcaccatggcatgctccac

SEQ ID NO: 8198101 - DNA, 22 bp, Homo sapiens
aggtcaccatggcatgctccac

SEQ ID NO: 8198102 - DNA, 22 bp, Homo sapiens
aggtcaccatggcatgctccac

SEQ ID NO: 8198103 - DNA, 22 bp, Homo sapiens
aggtcacttcctgtctggataa

SEQ ID NO: 8198104 - DNA, 22 bp, Homo sapiens
aggtcacttcctgtctggataa

SEQ ID NO: 8198105 - DNA, 22 bp, Homo sapiens
aggtcacttcacacgttaatgt

SEQ ID NO: 8198106 - DNA, 22 bp, Homo sapiens
aggtcacgtcctgtgatgtcat

SEQ ID NO: 8198107 - DNA, 22 bp, Homo sapiens
aggtcactgatttttttaatga

SEQ ID NO: 8198108 - DNA, 22 bp, Homo sapiens
aggtcagaagtgccagggaatt

SEQ ID NO: 8198109 - DNA, 22 bp, Homo sapiens
aggtcagaaaaggagagcattg

SEQ ID NO: 8198110 - DNA, 22 bp, Homo sapiens
aggtcagcatgagtagaaggta

SEQ ID NO: 8198111 - DNA, 22 bp, Homo sapiens
aggtcagctgcactggtgtaat

SEQ ID NO: 8198112 - DNA, 22 bp, Homo sapiens
aggtcagccctctctgggcagg

SEQ ID NO: 8198113 - DNA, 21 bp, Homo sapiens
aggtcagcccagctctggaag

SEQ ID NO: 8198114 - DNA, 22 bp, Homo sapiens
aggtcagatgggagatgggatg

SEQ ID NO: 8198115 - DNA, 22 bp, Homo sapiens
aggtcagcatgagtagaaggta

SEQ ID NO: 8198116 - DNA, 23 bp, Homo sapiens
aggtcagcaggcaaggaaatggc

SEQ ID NO: 8198117 - DNA, 22 bp, Homo sapiens
aggtcagctgctgataggcagc

SEQ ID NO: 8198118 - DNA, 22 bp, Homo sapiens
aggtcagctgctgataggcagc

SEQ ID NO: 8198119 - DNA, 22 bp, Homo sapiens
aggtcagctgtgtgtgcatgag

SEQ ID NO: 8198120 - DNA, 22 bp, Homo sapiens
aggtcaggaggttaagagtctt

SEQ ID NO: 8198121 - DNA, 22 bp, Homo sapiens
aggtcaggaggcctctgccatt

SEQ ID NO: 8198122 - DNA, 22 bp, Homo sapiens
aggtcaggaggcctctgccatt

SEQ ID NO: 8198123 - DNA, 18 bp, Homo sapiens
aggtcaggaaagcagagt

SEQ ID NO: 8198124 - DNA, 22 bp, Homo sapiens
aggtggcagcagcctggtgaaa

SEQ ID NO: 8198125 - DNA, 22 bp, Homo sapiens
aggtggcagcagcctggtgaaa

SEQ ID NO: 8198126 - DNA, 22 bp, Homo sapiens
aggtggcagcaggagatgtgga

SEQ ID NO: 8198127 - DNA, 22 bp, Homo sapiens
aggtggcagcaggagatgtgga

SEQ ID NO: 8198128 - DNA, 22 bp, Homo sapiens
aggtggcagcaggagatgtgga

SEQ ID NO: 8198129 - DNA, 22 bp, Homo sapiens
aggtggcagcaggagatgtgga

SEQ ID NO: 8198130 - DNA, 22 bp, Homo sapiens
aggtggcagcagcctggtgaaa

SEQ ID NO: 8198131 - DNA, 22 bp, Homo sapiens
aggtggcagagtgacaggctga

SEQ ID NO: 8198132 - DNA, 22 bp, Homo sapiens
aggtggcagagtgacaggctga

SEQ ID NO: 8198133 - DNA, 22 bp, Homo sapiens
aggtggcagatgggggtgctcg

SEQ ID NO: 8198134 - DNA, 22 bp, Homo sapiens
aggtggcagatgggggtgctcg

SEQ ID NO: 8198135 - DNA, 22 bp, Homo sapiens
aggtggcagcagaatcagggag

SEQ ID NO: 8198136 - DNA, 22 bp, Homo sapiens
aggtggcaggaggtcagagaaa

SEQ ID NO: 8198137 - DNA, 22 bp, Homo sapiens
aggtggcaggaggtcagagaaa

SEQ ID NO: 8198138 - DNA, 22 bp, Homo sapiens
aggtggcagccgagacataagg

SEQ ID NO: 8198139 - DNA, 22 bp, Homo sapiens
aggtggcagttgtggaaccatc

SEQ ID NO: 8198140 - DNA, 22 bp, Homo sapiens
ccttcattcagctatagcatcc

SEQ ID NO: 8198141 - DNA, 22 bp, Homo sapiens
ccttcattcagctatagcatcc

SEQ ID NO: 8198142 - DNA, 22 bp, Homo sapiens
ccttcattcattaatttagccc

SEQ ID NO: 8198143 - DNA, 22 bp, Homo sapiens
ccttccagagttcagtctgccc

SEQ ID NO: 8198144 - DNA, 22 bp, Homo sapiens
ccttccagagttcagtctgccc

SEQ ID NO: 8198145 - DNA, 22 bp, Homo sapiens
ccttccagaggcgtgacaccct

SEQ ID NO: 8198146 - DNA, 22 bp, Homo sapiens
ccttccaagtgctgctttttcc

SEQ ID NO: 8198147 - DNA, 21 bp, Homo sapiens
ccttccaccttctgccatgtg

SEQ ID NO: 8198148 - DNA, 21 bp, Homo sapiens
ccttccaccttctgccatgtg

SEQ ID NO: 8198149 - DNA, 22 bp, Homo sapiens
ccttccagaggcgtgacaccct

SEQ ID NO: 8198150 - DNA, 22 bp, Homo sapiens
ccttccaggctggaggcttggg

SEQ ID NO: 8198151 - DNA, 22 bp, Homo sapiens
ccttccagggagcaggcagtgt

SEQ ID NO: 8198152 - DNA, 22 bp, Homo sapiens
ccttccagggctctccagaacc

SEQ ID NO: 8198153 - DNA, 22 bp, Homo sapiens
ccttccaggagtctctgcaggt

SEQ ID NO: 8198154 - DNA, 19 bp, Homo sapiens
ccttccagctccttttcag

SEQ ID NO: 8198155 - DNA, 22 bp, Homo sapiens
ccttccagatgtaagagctgat

SEQ ID NO: 8198156 - DNA, 22 bp, Homo sapiens
cctgtgggagcccaggcagata

SEQ ID NO: 8198157 - DNA, 22 bp, Homo sapiens
cctgtgggagggagcggctgga

SEQ ID NO: 8198158 - DNA, 22 bp, Homo sapiens
cctgtgggagggagcggctgga

SEQ ID NO: 8198159 - DNA, 22 bp, Homo sapiens
cctgtgggagggagcggctgga

SEQ ID NO: 8198160 - DNA, 22 bp, Homo sapiens
cctgtgggaggttctgtgagtc

SEQ ID NO: 8198161 - DNA, 22 bp, Homo sapiens
cctgtgggaggttctgtgagtc

SEQ ID NO: 8198162 - DNA, 23 bp, Homo sapiens
cctgtgggatggcttaatatttt

SEQ ID NO: 8198163 - DNA, 22 bp, Homo sapiens
cctgtgggaggttctgtgagtc

SEQ ID NO: 8198164 - DNA, 22 bp, Homo sapiens
cctgtgggaggggcctggcgcg

SEQ ID NO: 8198165 - DNA, 22 bp, Homo sapiens
cctgtgggaggggcctggcgcg

SEQ ID NO: 8198166 - DNA, 22 bp, Homo sapiens
cctgtgggaggggcctggcgcg

SEQ ID NO: 8198167 - DNA, 22 bp, Homo sapiens
cctgtgggaggttctgtgagtc

SEQ ID NO: 8198168 - DNA, 22 bp, Homo sapiens
cctgtgggcctgcacgtgggga

SEQ ID NO: 8198169 - DNA, 22 bp, Homo sapiens
cctgtgggcctgcacgtgggga

SEQ ID NO: 8198170 - DNA, 22 bp, Homo sapiens
cctgtgggcgcagctggagtca

SEQ ID NO: 8198171 - DNA, 22 bp, Homo sapiens
cctgtgggcgcagctggagtca

SEQ ID NO: 8198172 - DNA, 22 bp, Homo sapiens
cctgtgggcgcagctggagtca

SEQ ID NO: 8198173 - DNA, 22 bp, Homo sapiens
cctgtgggctgagaacaagggc

SEQ ID NO: 8198174 - DNA, 22 bp, Homo sapiens
cctgtgggctgagaacaagggc

SEQ ID NO: 8198175 - DNA, 22 bp, Homo sapiens
cctgtgggcgcagctggagtca

SEQ ID NO: 8198176 - DNA, 22 bp, Homo sapiens
cctgtgggccctggacagagac

SEQ ID NO: 8198177 - DNA, 22 bp, Homo sapiens
cctgtgggccctggacagagac

SEQ ID NO: 8198178 - DNA, 22 bp, Homo sapiens
cctgtgggccctggacagagac

SEQ ID NO: 8198179 - DNA, 22 bp, Homo sapiens
cctgtgggccaaggacctgcca

SEQ ID NO: 8198180 - DNA, 22 bp, Homo sapiens
cctgtgggccaaggacctgcca

SEQ ID NO: 8198181 - DNA, 22 bp, Homo sapiens
aggtggcaaggggcgcctctct

SEQ ID NO: 8198182 - DNA, 22 bp, Homo sapiens
cctgtgggtcacatgggtgact

SEQ ID NO: 8198183 - DNA, 22 bp, Homo sapiens
cctgtgggtacaacagggtcac

SEQ ID NO: 8198184 - DNA, 22 bp, Homo sapiens
cctgtggggctgaaagaggctt

SEQ ID NO: 8198185 - DNA, 22 bp, Homo sapiens
cctgtggggctgaaagaggctt

SEQ ID NO: 8198186 - DNA, 22 bp, Homo sapiens
cctgtgggtacaacagggtcac

SEQ ID NO: 8198187 - DNA, 22 bp, Homo sapiens
cctgtgggtacaacagggtcac

SEQ ID NO: 8198188 - DNA, 22 bp, Homo sapiens
cctgtggggccatctcagtcac

SEQ ID NO: 8198189 - DNA, 22 bp, Homo sapiens
cctgtggggccatctcagtcac

SEQ ID NO: 8198190 - DNA, 22 bp, Homo sapiens
cctgtggggagagatctcttag

SEQ ID NO: 8198191 - DNA, 22 bp, Homo sapiens
cctgtggggagagatctcttag

SEQ ID NO: 8198192 - DNA, 22 bp, Homo sapiens
cctgtgggcttgagtgtagggt

SEQ ID NO: 8198193 - DNA, 22 bp, Homo sapiens
cctgtgggcgcagctggagtca

SEQ ID NO: 8198194 - DNA, 22 bp, Homo sapiens
cctgtgggcttgagtgtagggt

SEQ ID NO: 8198195 - DNA, 22 bp, Homo sapiens
cctgtgggcttgagtgtagggt

SEQ ID NO: 8198196 - DNA, 22 bp, Homo sapiens
cctgtgggcttgagtgtagggt

SEQ ID NO: 8198197 - DNA, 22 bp, Homo sapiens
aggtggcagactaacagaagga

SEQ ID NO: 8198198 - DNA, 22 bp, Homo sapiens
aggtggcagagctggcccagcg

SEQ ID NO: 8198199 - DNA, 22 bp, Homo sapiens
aggtggcagactaacagaagga

SEQ ID NO: 8198200 - DNA, 22 bp, Homo sapiens
aggtggcagagctggcccagcg

SEQ ID NO: 8198201 - DNA, 22 bp, Homo sapiens
aggtggcagagctggcccagcg

SEQ ID NO: 8198202 - DNA, 22 bp, Homo sapiens
aggtggcagaggactcctcctg

SEQ ID NO: 8198203 - DNA, 22 bp, Homo sapiens
aggtggcagaggactcctcctg

SEQ ID NO: 8198204 - DNA, 22 bp, Homo sapiens
aggtggcagagtgacaggctga

SEQ ID NO: 8198205 - DNA, 22 bp, Homo sapiens
aggtggcagagtgacaggctga

SEQ ID NO: 8198206 - DNA, 22 bp, Homo sapiens
aggtgcagctggtggagtctgg

SEQ ID NO: 8198207 - DNA, 22 bp, Homo sapiens
aggtgcaggagctgtgcaggga

SEQ ID NO: 8198208 - DNA, 22 bp, Homo sapiens
cctgtgccagctgggccctgcc

SEQ ID NO: 8198209 - DNA, 22 bp, Homo sapiens
cctgtgggagcccaggcagata

SEQ ID NO: 8198210 - DNA, 22 bp, Homo sapiens
cctgtgggagcccaggcagata

SEQ ID NO: 8198211 - DNA, 22 bp, Homo sapiens
cctgtgggagcccaggcagata

SEQ ID NO: 8198212 - DNA, 22 bp, Homo sapiens
aggtgcagcatgagtccaacgg

SEQ ID NO: 8198213 - DNA, 18 bp, Homo sapiens
aggtgcagcctctgaggc

SEQ ID NO: 8198214 - DNA, 18 bp, Homo sapiens
aggtgcagcctctgaggc

SEQ ID NO: 8198215 - DNA, 22 bp, Homo sapiens
aggtgcagcatgagtccaacgg

SEQ ID NO: 8198216 - DNA, 22 bp, Homo sapiens
aggtgcagctggtggagtctgg

SEQ ID NO: 8198217 - DNA, 22 bp, Homo sapiens
aggtgcagctgacaccatgtgg

SEQ ID NO: 8198218 - DNA, 22 bp, Homo sapiens
aggtgcagctggtggagtctgg

SEQ ID NO: 8198219 - DNA, 22 bp, Homo sapiens
aggtgcagctgacaccatgtgg

SEQ ID NO: 8198220 - DNA, 17 bp, Homo sapiens
aggtgcagaggcagagc

SEQ ID NO: 8198221 - DNA, 17 bp, Homo sapiens
aggtgcagaggcagagc

SEQ ID NO: 8198222 - DNA, 17 bp, Homo sapiens
aggtgcagaggcagagc

SEQ ID NO: 8198223 - DNA, 17 bp, Homo sapiens
aggtgcagaggcagagc

SEQ ID NO: 8198224 - DNA, 21 bp, Homo sapiens
aggtgcagagccagggaccag

SEQ ID NO: 8198225 - DNA, 21 bp, Homo sapiens
aggtgcagagccagggaccag

SEQ ID NO: 8198226 - DNA, 22 bp, Homo sapiens
cctgggtccaccctgtgaagta

SEQ ID NO: 8198227 - DNA, 22 bp, Homo sapiens
cctgggtccaccctgtgaagta

SEQ ID NO: 8198228 - DNA, 22 bp, Homo sapiens
cctggggtcacttgcagccgca

SEQ ID NO: 8198229 - DNA, 22 bp, Homo sapiens
cctggggtcacttgcagccgca

SEQ ID NO: 8198230 - DNA, 22 bp, Homo sapiens
cctggggtcagggacgctgtgc

SEQ ID NO: 8198231 - DNA, 22 bp, Homo sapiens
cctggggtcagggacgctgtgc

SEQ ID NO: 8198232 - DNA, 22 bp, Homo sapiens
cctggggtcacttgcagccgca

SEQ ID NO: 8198233 - DNA, 22 bp, Homo sapiens
cctggggtcagggacgctgtgc

SEQ ID NO: 8198234 - DNA, 22 bp, Homo sapiens
cctgggtacgcagggctcctct

SEQ ID NO: 8198235 - DNA, 22 bp, Homo sapiens
cctgggtagactttgaagcatt

SEQ ID NO: 8198236 - DNA, 22 bp, Homo sapiens
cctgggtacgcagggctcctct

SEQ ID NO: 8198237 - DNA, 22 bp, Homo sapiens
cctgggtcactcaggcaggcgg

SEQ ID NO: 8198238 - DNA, 22 bp, Homo sapiens
cctgggtcactcaggcaggcgg

SEQ ID NO: 8198239 - DNA, 22 bp, Homo sapiens
cctgggtcactcaggcaggcgg

SEQ ID NO: 8198240 - DNA, 22 bp, Homo sapiens
cctgggtcaccaggcccaggca

SEQ ID NO: 8198241 - DNA, 22 bp, Homo sapiens
cctggggctctgcacagagcag

SEQ ID NO: 8198242 - DNA, 22 bp, Homo sapiens
cctggggctctgcacagagcag

SEQ ID NO: 8198243 - DNA, 20 bp, Homo sapiens
aggtcctggttctctgggat

SEQ ID NO: 8198244 - DNA, 20 bp, Homo sapiens
aggtcctggttctctgggat

SEQ ID NO: 8198245 - DNA, 20 bp, Homo sapiens
aggtcctggttctctgggat

SEQ ID NO: 8198246 - DNA, 22 bp, Homo sapiens
cctgggctttgagggcaggatg

SEQ ID NO: 8198247 - DNA, 22 bp, Homo sapiens
cctgggctttgagggcaggatg

SEQ ID NO: 8198248 - DNA, 22 bp, Homo sapiens
cctgggctttgagggcaggatg

SEQ ID NO: 8198249 - DNA, 20 bp, Homo sapiens
cctggggtacactggcatgt

SEQ ID NO: 8198250 - DNA, 22 bp, Homo sapiens
cctgggggccaggaaggtgtga

SEQ ID NO: 8198251 - DNA, 20 bp, Homo sapiens
cctggggtacactggcatgt

SEQ ID NO: 8198252 - DNA, 22 bp, Homo sapiens
cctggggtatataggtgaatat

SEQ ID NO: 8198253 - DNA, 22 bp, Homo sapiens
cctggggtatataggtgaatat

SEQ ID NO: 8198254 - DNA, 22 bp, Homo sapiens
cctggggctttctttgtatcat

SEQ ID NO: 8198255 - DNA, 22 bp, Homo sapiens
aggtcctggtgaccatggagtt

SEQ ID NO: 8198256 - DNA, 22 bp, Homo sapiens
aggtcctggtgaccatggagtt

SEQ ID NO: 8198257 - DNA, 22 bp, Homo sapiens
aggtcctggtcttgagtcttaa

SEQ ID NO: 8198258 - DNA, 22 bp, Homo sapiens
aggtcctggtcttgagtcttaa

SEQ ID NO: 8198259 - DNA, 20 bp, Homo sapiens
aggtcctgggactggcagag

SEQ ID NO: 8198260 - DNA, 20 bp, Homo sapiens
aggtcctgggactggcagag

SEQ ID NO: 8198261 - DNA, 20 bp, Homo sapiens
aggtcctgggactggcagag

SEQ ID NO: 8198262 - DNA, 22 bp, Homo sapiens
aggtcctgggagttctagtgtg

SEQ ID NO: 8198263 - DNA, 22 bp, Homo sapiens
aggtcctgatgatctctgagag

SEQ ID NO: 8198264 - DNA, 22 bp, Homo sapiens
aggtcctgatgatctctgagag

SEQ ID NO: 8198265 - DNA, 23 bp, Homo sapiens
aggtcctggacatatgtgcatca

SEQ ID NO: 8198266 - DNA, 23 bp, Homo sapiens
aggtcctggacatatgtgcatca

SEQ ID NO: 8198267 - DNA, 22 bp, Homo sapiens
aggtcctggactgctcttgtta

SEQ ID NO: 8198268 - DNA, 22 bp, Homo sapiens
aggtcctggactgctcttgtta

SEQ ID NO: 8198269 - DNA, 18 bp, Homo sapiens
agtaggcactgtggggtt

SEQ ID NO: 8198270 - DNA, 22 bp, Homo sapiens
agtaggaggcgggagcatgaag

SEQ ID NO: 8198271 - DNA, 22 bp, Homo sapiens
agtaggaggcgggagcatgaag

SEQ ID NO: 8198272 - DNA, 22 bp, Homo sapiens
agtagcttggccctttgttctt

SEQ ID NO: 8198273 - DNA, 22 bp, Homo sapiens
agtaggaggcgggagcatgaag

SEQ ID NO: 8198274 - DNA, 22 bp, Homo sapiens
agtagcttggccctttgttctt

SEQ ID NO: 8198275 - DNA, 22 bp, Homo sapiens
agtagccaaagatagagccgtt

SEQ ID NO: 8198276 - DNA, 22 bp, Homo sapiens
agtagccaattaagtggcaagc

SEQ ID NO: 8198277 - DNA, 19 bp, Homo sapiens
agtagcagaaagtgcagtg

SEQ ID NO: 8198278 - DNA, 22 bp, Homo sapiens
agtagcagagttggactatgca

SEQ ID NO: 8198279 - DNA, 20 bp, Homo sapiens
agtagcagtaatatggaaga

SEQ ID NO: 8198280 - DNA, 22 bp, Homo sapiens
agtagcagtgacagctgaggta

SEQ ID NO: 8198281 - DNA, 22 bp, Homo sapiens
agtagcagtgacagctgaggta

SEQ ID NO: 8198282 - DNA, 22 bp, Homo sapiens
agtagcagtgacagctgaggta

SEQ ID NO: 8198283 - DNA, 20 bp, Homo sapiens
agtagcagtgtgacattgac

SEQ ID NO: 8198284 - DNA, 22 bp, Homo sapiens
agtatttctgaatattatcata

SEQ ID NO: 8198285 - DNA, 22 bp, Homo sapiens
agtatttcttcatatgattact

SEQ ID NO: 8198286 - DNA, 22 bp, Homo sapiens
agtcaagattctggcactagca

SEQ ID NO: 8198287 - DNA, 22 bp, Homo sapiens
agtagggagaccggaggccgcc

SEQ ID NO: 8198288 - DNA, 22 bp, Homo sapiens
agtagggaatacattggggtaa

SEQ ID NO: 8198289 - DNA, 22 bp, Homo sapiens
agtagggagaccggaggccgcc

SEQ ID NO: 8198290 - DNA, 22 bp, Homo sapiens
agtagggagaccggaggccgcc

SEQ ID NO: 8198291 - DNA, 22 bp, Homo sapiens
agtagggaatacattggggtaa

SEQ ID NO: 8198292 - DNA, 22 bp, Homo sapiens
agtagattttagattacatagt

SEQ ID NO: 8198293 - DNA, 19 bp, Homo sapiens
agtagcagaaagtgcagtg

SEQ ID NO: 8198294 - DNA, 22 bp, Homo sapiens
agtagattttagattacatagt

SEQ ID NO: 8198295 - DNA, 22 bp, Homo sapiens
agtagatttttgaatgtaagtt

SEQ ID NO: 8198296 - DNA, 22 bp, Homo sapiens
agtagatttttgaatgtaagtt

SEQ ID NO: 8198297 - DNA, 19 bp, Homo sapiens
agtagacattttcatgttt

SEQ ID NO: 8198298 - DNA, 22 bp, Homo sapiens
agtagacatgagcaatgataat

SEQ ID NO: 8198299 - DNA, 22 bp, Homo sapiens
agtacatacttcaaatgtactt

SEQ ID NO: 8198300 - DNA, 22 bp, Homo sapiens
agtaacagaaggcctgacttaa

SEQ ID NO: 8198301 - DNA, 22 bp, Homo sapiens
agtagaaagttgcaggaggaat

SEQ ID NO: 8198302 - DNA, 22 bp, Homo sapiens
agtagaaatgtaagaaggatta

SEQ ID NO: 8198303 - DNA, 22 bp, Homo sapiens
ccttctcccctctgcagggtgt

SEQ ID NO: 8198304 - DNA, 21 bp, Homo sapiens
ccttctccattacagtaagct

SEQ ID NO: 8198305 - DNA, 21 bp, Homo sapiens
ccttctccattacagtaagct

SEQ ID NO: 8198306 - DNA, 22 bp, Homo sapiens
ccttctccctctgagaggaacc

SEQ ID NO: 8198307 - DNA, 22 bp, Homo sapiens
ccttctcccctctgcagggtgt

SEQ ID NO: 8198308 - DNA, 22 bp, Homo sapiens
ccttctcccctctgcagggtgt

SEQ ID NO: 8198309 - DNA, 22 bp, Homo sapiens
ccttctcccctctgcagggtgt

SEQ ID NO: 8198310 - DNA, 20 bp, Homo sapiens
ccttctccagcttgttcttg

SEQ ID NO: 8198311 - DNA, 21 bp, Homo sapiens
ccttctccattacagtaagct

SEQ ID NO: 8198312 - DNA, 21 bp, Homo sapiens
ccttctccattacagtaagct

SEQ ID NO: 8198313 - DNA, 21 bp, Homo sapiens
ccttctccattacagtaagct

SEQ ID NO: 8198314 - DNA, 22 bp, Homo sapiens
ccttccagtgactaaggaggaa

SEQ ID NO: 8198315 - DNA, 20 bp, Homo sapiens
ccttctccagcttgttcttg

SEQ ID NO: 8198316 - DNA, 22 bp, Homo sapiens
ccttctcctgccttgggttcat

SEQ ID NO: 8198317 - DNA, 22 bp, Homo sapiens
ccttctctaccatgtgaggaaa

SEQ ID NO: 8198318 - DNA, 22 bp, Homo sapiens
ccttctctaccatgtgaggaaa

SEQ ID NO: 8198319 - DNA, 22 bp, Homo sapiens
ccttctctactcctgatgcatg

SEQ ID NO: 8198320 - DNA, 22 bp, Homo sapiens
ccttctctactcctgatgcatg

SEQ ID NO: 8198321 - DNA, 22 bp, Homo sapiens
ccttctctactcctgatgcatg

SEQ ID NO: 8198322 - DNA, 22 bp, Homo sapiens
ccttctctactcctgatgcatg

SEQ ID NO: 8198323 - DNA, 22 bp, Homo sapiens
ccttctcctgccttgggttcat

SEQ ID NO: 8198324 - DNA, 22 bp, Homo sapiens
ccttctcctgccttgggttcat

SEQ ID NO: 8198325 - DNA, 22 bp, Homo sapiens
ccttctccctctgagaggaacc

SEQ ID NO: 8198326 - DNA, 22 bp, Homo sapiens
ccttctccctctgagaggaacc

SEQ ID NO: 8198327 - DNA, 22 bp, Homo sapiens
ccttctccctctgagaggaacc

SEQ ID NO: 8198328 - DNA, 22 bp, Homo sapiens
agtaaacagtaggaactgagaa

SEQ ID NO: 8198329 - DNA, 22 bp, Homo sapiens
agtaaacagtttcttagaagaa

SEQ ID NO: 8198330 - DNA, 22 bp, Homo sapiens
agtaaacagtttcttagaagaa

SEQ ID NO: 8198331 - DNA, 22 bp, Homo sapiens
ccttctctctgaagaccccaaa

SEQ ID NO: 8198332 - DNA, 22 bp, Homo sapiens
ccttctctctgaagaccccaaa

SEQ ID NO: 8198333 - DNA, 22 bp, Homo sapiens
agtaaaaatatgcttgtggcta

SEQ ID NO: 8198334 - DNA, 22 bp, Homo sapiens
agtaaataacagagaaaatggg

SEQ ID NO: 8198335 - DNA, 22 bp, Homo sapiens
agtaaataacagagaaaatggg

SEQ ID NO: 8198336 - DNA, 22 bp, Homo sapiens
agtaaataacagagaaaatggg

SEQ ID NO: 8198337 - DNA, 22 bp, Homo sapiens
agtaaataacagagaaaatggg

SEQ ID NO: 8198338 - DNA, 22 bp, Homo sapiens
agtaaagtaccaaagtgtgagt

SEQ ID NO: 8198339 - DNA, 22 bp, Homo sapiens
agtaaataacagagaaaatggg

SEQ ID NO: 8198340 - DNA, 22 bp, Homo sapiens
agtaaagcggtgtcacagaatg

SEQ ID NO: 8198341 - DNA, 18 bp, Homo sapiens
agtaaatgttaaatattg

SEQ ID NO: 8198342 - DNA, 18 bp, Homo sapiens
agtaaatgttaaatattg

SEQ ID NO: 8198343 - DNA, 22 bp, Homo sapiens
agtaaatgaaagcaattttaga

SEQ ID NO: 8198344 - DNA, 22 bp, Homo sapiens
agtaaacattttcatattttct

SEQ ID NO: 8198345 - DNA, 22 bp, Homo sapiens
agtaaacatttcagatttattt

SEQ ID NO: 8198346 - DNA, 22 bp, Homo sapiens
agtaaactgtgggtacagatgt

SEQ ID NO: 8198347 - DNA, 22 bp, Homo sapiens
agtaaactgtgggtacagatgt

SEQ ID NO: 8198348 - DNA, 22 bp, Homo sapiens
agtaaactttctcaggctccct

SEQ ID NO: 8198349 - DNA, 22 bp, Homo sapiens
agtaaagcagagttgcagtaca

SEQ ID NO: 8198350 - DNA, 22 bp, Homo sapiens
agtaaagcagagttgcagtaca

SEQ ID NO: 8198351 - DNA, 22 bp, Homo sapiens
agtaaagcattgtcttcagagt

SEQ ID NO: 8198352 - DNA, 22 bp, Homo sapiens
agtaaacagtttcttagaagaa

SEQ ID NO: 8198353 - DNA, 22 bp, Homo sapiens
agtaaacagtttcttagaagaa

SEQ ID NO: 8198354 - DNA, 22 bp, Homo sapiens
agtaaacatgtaattgttcatt

SEQ ID NO: 8198355 - DNA, 22 bp, Homo sapiens
agtaaacatcaccctggggtga

SEQ ID NO: 8198356 - DNA, 22 bp, Homo sapiens
agtaaacatttcagatttattt

SEQ ID NO: 8198357 - DNA, 22 bp, Homo sapiens
agtaaacatgtaattgttcatt

SEQ ID NO: 8198358 - DNA, 22 bp, Homo sapiens
agtaaacatgtaattgttcatt

SEQ ID NO: 8198359 - DNA, 22 bp, Homo sapiens
ctagcctgggatttgaacttat

SEQ ID NO: 8198360 - DNA, 22 bp, Homo sapiens
ctagcctgggatttgaacttat

SEQ ID NO: 8198361 - DNA, 22 bp, Homo sapiens
ctagcctgggatttgaacttat

SEQ ID NO: 8198362 - DNA, 22 bp, Homo sapiens
ctagctttttatgacaatcttg

SEQ ID NO: 8198363 - DNA, 22 bp, Homo sapiens
ctagctttgtccattgtcttgc

SEQ ID NO: 8198364 - DNA, 19 bp, Homo sapiens
ctagcttgtcatttgtgtg

SEQ ID NO: 8198365 - DNA, 22 bp, Homo sapiens
ctagctgtgtaaaccgagctgc

SEQ ID NO: 8198366 - DNA, 22 bp, Homo sapiens
ctagacttcagctttgtgatct

SEQ ID NO: 8198367 - DNA, 22 bp, Homo sapiens
agtcacatgggattagaaccca

SEQ ID NO: 8198368 - DNA, 22 bp, Homo sapiens
agtcacatgggattagaaccca

SEQ ID NO: 8198369 - DNA, 22 bp, Homo sapiens
ctaggaaagacacagagagttt

SEQ ID NO: 8198370 - DNA, 22 bp, Homo sapiens
ctaggaaatgaatacagtacac

SEQ ID NO: 8198371 - DNA, 22 bp, Homo sapiens
ctaggaatagcaaagtaggaca

SEQ ID NO: 8198372 - DNA, 22 bp, Homo sapiens
ctaggcagactgagctctaggg

SEQ ID NO: 8198373 - DNA, 22 bp, Homo sapiens
ctaggcagactgagctctaggg

SEQ ID NO: 8198374 - DNA, 22 bp, Homo sapiens
ctaggcacttgtaaggccgctc

SEQ ID NO: 8198375 - DNA, 22 bp, Homo sapiens
ctaggcactcacgtggctttag

SEQ ID NO: 8198376 - DNA, 22 bp, Homo sapiens
ctaggaggcgggggctgcagta

SEQ ID NO: 8198377 - DNA, 22 bp, Homo sapiens
ctaggaggcgggggctgcagta

SEQ ID NO: 8198378 - DNA, 22 bp, Homo sapiens
ctaggaggcgggggctgcagta

SEQ ID NO: 8198379 - DNA, 22 bp, Homo sapiens
ctaggaccactgtaacaaagta

SEQ ID NO: 8198380 - DNA, 22 bp, Homo sapiens
ctaggaatggtacctcttacaa

SEQ ID NO: 8198381 - DNA, 22 bp, Homo sapiens
ctaggaatcaccaagattctag

SEQ ID NO: 8198382 - DNA, 22 bp, Homo sapiens
ctaggaatccttttagagttgg

SEQ ID NO: 8198383 - DNA, 22 bp, Homo sapiens
agtcacagaaacccaggtgtgg

SEQ ID NO: 8198384 - DNA, 22 bp, Homo sapiens
agtcacagaaacccaggtgtgg

SEQ ID NO: 8198385 - DNA, 22 bp, Homo sapiens
agtcacagaaacccaggtgtgg

SEQ ID NO: 8198386 - DNA, 22 bp, Homo sapiens
agtcacaataccgtgtgtcagt

SEQ ID NO: 8198387 - DNA, 22 bp, Homo sapiens
agtcacacactgtcagttctgc

SEQ ID NO: 8198388 - DNA, 22 bp, Homo sapiens
agtcacactggttgtttacagt

SEQ ID NO: 8198389 - DNA, 22 bp, Homo sapiens
agtcacagggggcccctgcaac

SEQ ID NO: 8198390 - DNA, 22 bp, Homo sapiens
agtcacaggcaagagggctcca

SEQ ID NO: 8198391 - DNA, 20 bp, Homo sapiens
agtcacaggcctggaacatg

SEQ ID NO: 8198392 - DNA, 20 bp, Homo sapiens
agtcacaggcctggaacatg

SEQ ID NO: 8198393 - DNA, 22 bp, Homo sapiens
agtcacaggcaagagggctcca

SEQ ID NO: 8198394 - DNA, 22 bp, Homo sapiens
agtcacagttctgctgtctgag

SEQ ID NO: 8198395 - DNA, 20 bp, Homo sapiens
agtcacagtatcagtcttag

SEQ ID NO: 8198396 - DNA, 22 bp, Homo sapiens
agtcacaggttcttgggattag

SEQ ID NO: 8198397 - DNA, 22 bp, Homo sapiens
agtcacaggttcttgggattag

SEQ ID NO: 8198398 - DNA, 20 bp, Homo sapiens
agtcacatgcatacacaagt

SEQ ID NO: 8198399 - DNA, 22 bp, Homo sapiens
agtcacatgcattttcttcaat

SEQ ID NO: 8198400 - DNA, 22 bp, Homo sapiens
agtcacatcgattataaaattt

SEQ ID NO: 8198401 - DNA, 22 bp, Homo sapiens
agtcacatagtgttttggaatc

SEQ ID NO: 8198402 - DNA, 22 bp, Homo sapiens
agtcacatgagcactaattagg

SEQ ID NO: 8198403 - DNA, 22 bp, Homo sapiens
agtcacatcgattataaaattt

SEQ ID NO: 8198404 - DNA, 22 bp, Homo sapiens
ctatatttggtgagggatgtct

SEQ ID NO: 8198405 - DNA, 22 bp, Homo sapiens
ctatatttggtgagggatgtct

SEQ ID NO: 8198406 - DNA, 22 bp, Homo sapiens
ctatatttcttggctttaaaca

SEQ ID NO: 8198407 - DNA, 22 bp, Homo sapiens
ctatatttcttggctttaaaca

SEQ ID NO: 8198408 - DNA, 22 bp, Homo sapiens
ctatatttcttggctttaaaca

SEQ ID NO: 8198409 - DNA, 22 bp, Homo sapiens
ctatatttggtgagggatgtct

SEQ ID NO: 8198410 - DNA, 22 bp, Homo sapiens
ctatatttggtgagggatgtct

SEQ ID NO: 8198411 - DNA, 22 bp, Homo sapiens
ctatccatatcctgggcatggc

SEQ ID NO: 8198412 - DNA, 22 bp, Homo sapiens
agtcaggatttaaactcagaca

SEQ ID NO: 8198413 - DNA, 22 bp, Homo sapiens
ctagtgaaatttgcaagtaatt

SEQ ID NO: 8198414 - DNA, 22 bp, Homo sapiens
ctatattggtggccatttggaa

SEQ ID NO: 8198415 - DNA, 22 bp, Homo sapiens
ctatatctacatttgctgtttg

SEQ ID NO: 8198416 - DNA, 22 bp, Homo sapiens
agtcaggagctgctgcattgta

SEQ ID NO: 8198417 - DNA, 22 bp, Homo sapiens
agtcaggatatgccttgtgggc

SEQ ID NO: 8198418 - DNA, 22 bp, Homo sapiens
agtcaggagctgctgcattgta

SEQ ID NO: 8198419 - DNA, 22 bp, Homo sapiens
agtcagcttgtctctagggttg

SEQ ID NO: 8198420 - DNA, 22 bp, Homo sapiens
agtcaggaacctcagcaagtct

SEQ ID NO: 8198421 - DNA, 22 bp, Homo sapiens
agtcagcagcctggccaggaga

SEQ ID NO: 8198422 - DNA, 22 bp, Homo sapiens
ctaggcagactgagctctaggg

SEQ ID NO: 8198423 - DNA, 22 bp, Homo sapiens
agtcagcagtgaaagcacagcc

SEQ ID NO: 8198424 - DNA, 22 bp, Homo sapiens
agtcagcagtgaaagcacagcc

SEQ ID NO: 8198425 - DNA, 22 bp, Homo sapiens
agtcagctgcagcagctttggt

SEQ ID NO: 8198426 - DNA, 22 bp, Homo sapiens
agtcagctgctgcacacagcag

SEQ ID NO: 8198427 - DNA, 22 bp, Homo sapiens
agtcagcattttcactgagcta

SEQ ID NO: 8198428 - DNA, 18 bp, Homo sapiens
ctatccctggagcttggg

SEQ ID NO: 8198429 - DNA, 22 bp, Homo sapiens
ctatccattttcctatgacact

SEQ ID NO: 8198430 - DNA, 22 bp, Homo sapiens
ctatccattaaagccttggaaa

SEQ ID NO: 8198431 - DNA, 22 bp, Homo sapiens
ctatctgtaaatttgaggttct

SEQ ID NO: 8198432 - DNA, 22 bp, Homo sapiens
ctattctagattacagtataaa

SEQ ID NO: 8198433 - DNA, 22 bp, Homo sapiens
ctattctgcttgaaattattct

SEQ ID NO: 8198434 - DNA, 22 bp, Homo sapiens
agtcctgggtctggagaatgga

SEQ ID NO: 8198435 - DNA, 22 bp, Homo sapiens
ctatttatctatttctgaatga

SEQ ID NO: 8198436 - DNA, 22 bp, Homo sapiens
ctatttacgctgctggggatca

SEQ ID NO: 8198437 - DNA, 22 bp, Homo sapiens
ctatttatctatttctgaatga

SEQ ID NO: 8198438 - DNA, 22 bp, Homo sapiens
ctatttaagaataaaaggggca

SEQ ID NO: 8198439 - DNA, 22 bp, Homo sapiens
ctattggtatttgaaacataaa

SEQ ID NO: 8198440 - DNA, 22 bp, Homo sapiens
ctattgttataattgttgacat

SEQ ID NO: 8198441 - DNA, 22 bp, Homo sapiens
ctattgtttctatgctctgagg

SEQ ID NO: 8198442 - DNA, 22 bp, Homo sapiens
ctattgaggacataaggactct

SEQ ID NO: 8198443 - DNA, 22 bp, Homo sapiens
ctattgaatagcccaaatcatt

SEQ ID NO: 8198444 - DNA, 22 bp, Homo sapiens
ctattgaatagcccaaatcatt

SEQ ID NO: 8198445 - DNA, 22 bp, Homo sapiens
ctattgaaagtgtacaattcaa

SEQ ID NO: 8198446 - DNA, 22 bp, Homo sapiens
ctattgaaagtgtacaattcaa

SEQ ID NO: 8198447 - DNA, 22 bp, Homo sapiens
ctattgaattaactattaaagt

SEQ ID NO: 8198448 - DNA, 22 bp, Homo sapiens
ctattgaattaactattaaagt

SEQ ID NO: 8198449 - DNA, 22 bp, Homo sapiens
ctattgaattaactattaaagt

SEQ ID NO: 8198450 - DNA, 22 bp, Homo sapiens
ctcacatgagatctgtacatcc

SEQ ID NO: 8198451 - DNA, 22 bp, Homo sapiens
ctcacatgatggcctttttcat

SEQ ID NO: 8198452 - DNA, 23 bp, Homo sapiens
ctcaccaagcgccgccgctgtgt

SEQ ID NO: 8198453 - DNA, 22 bp, Homo sapiens
ctcaccacagagcctgtccagc

SEQ ID NO: 8198454 - DNA, 22 bp, Homo sapiens
ctcaccacagagcctgtccagc

SEQ ID NO: 8198455 - DNA, 22 bp, Homo sapiens
agtctttatgattgtcaaagta

SEQ ID NO: 8198456 - DNA, 22 bp, Homo sapiens
agtctttatacagaaatatatg

SEQ ID NO: 8198457 - DNA, 22 bp, Homo sapiens
agtctttatctcgctcctggat

SEQ ID NO: 8198458 - DNA, 22 bp, Homo sapiens
agtctttagggaggtcagagtt

SEQ ID NO: 8198459 - DNA, 18 bp, Homo sapiens
agtcttctgatccatttt

SEQ ID NO: 8198460 - DNA, 18 bp, Homo sapiens
agtctttatttctttcat

SEQ ID NO: 8198461 - DNA, 19 bp, Homo sapiens
agtctttcccactcgtctt

SEQ ID NO: 8198462 - DNA, 19 bp, Homo sapiens
agtctttcccactcgtctt

SEQ ID NO: 8198463 - DNA, 22 bp, Homo sapiens
agtctttattcagccaagtact

SEQ ID NO: 8198464 - DNA, 22 bp, Homo sapiens
agtctttcctgcttgactgttc

SEQ ID NO: 8198465 - DNA, 22 bp, Homo sapiens
agtctattgcctaacagagagg

SEQ ID NO: 8198466 - DNA, 22 bp, Homo sapiens
agtctacaatcttaaatgaact

SEQ ID NO: 8198467 - DNA, 22 bp, Homo sapiens
agtcctgggtctggagaatgga

SEQ ID NO: 8198468 - DNA, 22 bp, Homo sapiens
agtctacagtctgggtcgggtg

SEQ ID NO: 8198469 - DNA, 22 bp, Homo sapiens
agtctatttcagtcttactagt

SEQ ID NO: 8198470 - DNA, 22 bp, Homo sapiens
agtctcaagcaccgaaagctgt

SEQ ID NO: 8198471 - DNA, 22 bp, Homo sapiens
agtctatttttggttcttcggg

SEQ ID NO: 8198472 - DNA, 23 bp, Homo sapiens
agtctcaagctggagaattacct

SEQ ID NO: 8198473 - DNA, 22 bp, Homo sapiens
agtctcaagggatgtctctata

SEQ ID NO: 8198474 - DNA, 22 bp, Homo sapiens
agtgaaatagcatttatgaagc

SEQ ID NO: 8198475 - DNA, 22 bp, Homo sapiens
agtgaaatagcatttatgaagc

SEQ ID NO: 8198476 - DNA, 22 bp, Homo sapiens
agtgaaatactgtcgtttttag

SEQ ID NO: 8198477 - DNA, 22 bp, Homo sapiens
agtgaaatcaggttttgactgc

SEQ ID NO: 8198478 - DNA, 22 bp, Homo sapiens
agtgaaatcaggttttgactgc

SEQ ID NO: 8198479 - DNA, 22 bp, Homo sapiens
agtgaaatatgcccattgctgt

SEQ ID NO: 8198480 - DNA, 22 bp, Homo sapiens
agtgaaaacctaatcatgcagt

SEQ ID NO: 8198481 - DNA, 22 bp, Homo sapiens
agtgaaaagatgcatttctctg

SEQ ID NO: 8198482 - DNA, 22 bp, Homo sapiens
agtgaaaacactagttcttgcc

SEQ ID NO: 8198483 - DNA, 22 bp, Homo sapiens
agtgacttctcctaatgtcata

SEQ ID NO: 8198484 - DNA, 22 bp, Homo sapiens
agtgaaattcctggtctttgtt

SEQ ID NO: 8198485 - DNA, 21 bp, Homo sapiens
agtgaaattgcatcagaggga

SEQ ID NO: 8198486 - DNA, 22 bp, Homo sapiens
agtgaaattgctgtaagaggaa

SEQ ID NO: 8198487 - DNA, 22 bp, Homo sapiens
agtgaggctaataggcaatggt

SEQ ID NO: 8198488 - DNA, 22 bp, Homo sapiens
agtgagggactagtgctgggga

SEQ ID NO: 8198489 - DNA, 17 bp, Homo sapiens
agtgacttggaaagagc

SEQ ID NO: 8198490 - DNA, 22 bp, Homo sapiens
agtgacttggcatgatgagaag

SEQ ID NO: 8198491 - DNA, 22 bp, Homo sapiens
agtgaaattcctggtctttgtt

SEQ ID NO: 8198492 - DNA, 22 bp, Homo sapiens
agtgaaatgatagtgtaaatac

SEQ ID NO: 8198493 - DNA, 22 bp, Homo sapiens
agtgaaatgatagtgtaaatac

SEQ ID NO: 8198494 - DNA, 22 bp, Homo sapiens
agtgaaatgattctgagcaaga

SEQ ID NO: 8198495 - DNA, 22 bp, Homo sapiens
agtgaaatgatagtgtaaatac

SEQ ID NO: 8198496 - DNA, 22 bp, Homo sapiens
agtgaaatgactgaatcagata

SEQ ID NO: 8198497 - DNA, 22 bp, Homo sapiens
agtgaaatcctggtcaacaggt

SEQ ID NO: 8198498 - DNA, 22 bp, Homo sapiens
agtgaaatcctggtcaacaggt

SEQ ID NO: 8198499 - DNA, 22 bp, Homo sapiens
agtgaaatcctggtcaacaggt

SEQ ID NO: 8198500 - DNA, 22 bp, Homo sapiens
agtgagggactccatgactcct

SEQ ID NO: 8198501 - DNA, 22 bp, Homo sapiens
agtgagggactagtgctgggga

SEQ ID NO: 8198502 - DNA, 22 bp, Homo sapiens
agtgagggactagtgctgggga

SEQ ID NO: 8198503 - DNA, 22 bp, Homo sapiens
agtgagggatgaagaactgcgg

SEQ ID NO: 8198504 - DNA, 22 bp, Homo sapiens
agtgagggactccatgactcct

SEQ ID NO: 8198505 - DNA, 22 bp, Homo sapiens
agtgagggactccatgactcct

SEQ ID NO: 8198506 - DNA, 22 bp, Homo sapiens
agtgagggactccatgactcct

SEQ ID NO: 8198507 - DNA, 22 bp, Homo sapiens
agtgaggggattcaggcaaggt

SEQ ID NO: 8198508 - DNA, 22 bp, Homo sapiens
agtgaggggattcaggcaaggt

SEQ ID NO: 8198509 - DNA, 22 bp, Homo sapiens
agtgaggggcagctgagtgggc

SEQ ID NO: 8198510 - DNA, 22 bp, Homo sapiens
agtgaggggcagctgagtgggc

SEQ ID NO: 8198511 - DNA, 22 bp, Homo sapiens
agtgaggtaattagagctgctg

SEQ ID NO: 8198512 - DNA, 22 bp, Homo sapiens
agtgaggtcaggatctcaggga

SEQ ID NO: 8198513 - DNA, 22 bp, Homo sapiens
agtgaggtcatactggagaggg

SEQ ID NO: 8198514 - DNA, 22 bp, Homo sapiens
agtgaggtcatactggagaggg

SEQ ID NO: 8198515 - DNA, 22 bp, Homo sapiens
agtgaggtggggtcacagggac

SEQ ID NO: 8198516 - DNA, 22 bp, Homo sapiens
agtgagtcaaacatatcctgac

SEQ ID NO: 8198517 - DNA, 22 bp, Homo sapiens
agtgagtatttgttgagtgcta

SEQ ID NO: 8198518 - DNA, 22 bp, Homo sapiens
agtgataatgtggtaattattt

SEQ ID NO: 8198519 - DNA, 18 bp, Homo sapiens
agtgagttgttgaaagaa

SEQ ID NO: 8198520 - DNA, 22 bp, Homo sapiens
agtgataatgtggtaattattt

SEQ ID NO: 8198521 - DNA, 20 bp, Homo sapiens
agtgagttatcagctacagt

SEQ ID NO: 8198522 - DNA, 22 bp, Homo sapiens
agtgagttgatggaaaactcag

SEQ ID NO: 8198523 - DNA, 22 bp, Homo sapiens
agtgataaaggtgtgatatgaa

SEQ ID NO: 8198524 - DNA, 22 bp, Homo sapiens
agtgagtttagggtgcaggtgt

SEQ ID NO: 8198525 - DNA, 22 bp, Homo sapiens
agtgatggttcagcttggttag

SEQ ID NO: 8198526 - DNA, 22 bp, Homo sapiens
agtgatgtaacaaacagagtta

SEQ ID NO: 8198527 - DNA, 22 bp, Homo sapiens
agtgatgtaggtggattctggc

SEQ ID NO: 8198528 - DNA, 22 bp, Homo sapiens
agtgatggtttccagtcactga

SEQ ID NO: 8198529 - DNA, 23 bp, Homo sapiens
agtgatctgtgtttgaagaatgc

SEQ ID NO: 8198530 - DNA, 22 bp, Homo sapiens
agtgatctgactcccagttaga

SEQ ID NO: 8198531 - DNA, 22 bp, Homo sapiens
agtgatggagcttcctctgcta

SEQ ID NO: 8198532 - DNA, 22 bp, Homo sapiens
agtgatggggccctgcactgat

SEQ ID NO: 8198533 - DNA, 22 bp, Homo sapiens
agtgcttttgtcattgaatctt

SEQ ID NO: 8198534 - DNA, 22 bp, Homo sapiens
agtgcttttatatcattaatcc

SEQ ID NO: 8198535 - DNA, 22 bp, Homo sapiens
agtgctgtcagttttatagata

SEQ ID NO: 8198536 - DNA, 22 bp, Homo sapiens
agtgctttgtagtttcattgtg

SEQ ID NO: 8198537 - DNA, 22 bp, Homo sapiens
agtgctttgtagtttcattgtg

SEQ ID NO: 8198538 - DNA, 22 bp, Homo sapiens
agtgctttgtgctctcactgca

SEQ ID NO: 8198539 - DNA, 22 bp, Homo sapiens
agtgctttgtgctctcactgca

SEQ ID NO: 8198540 - DNA, 22 bp, Homo sapiens
agtgctttgtgctctcactgca

SEQ ID NO: 8198541 - DNA, 22 bp, Homo sapiens
agtggaacactacattgttgtt

SEQ ID NO: 8198542 - DNA, 21 bp, Homo sapiens
agtggaacccttagggtcagg

SEQ ID NO: 8198543 - DNA, 22 bp, Homo sapiens
agtggaaagaaccctggactca

SEQ ID NO: 8198544 - DNA, 18 bp, Homo sapiens
agtggaaaacaaatacac

SEQ ID NO: 8198545 - DNA, 22 bp, Homo sapiens
agtggacaaccatgctgagatt

SEQ ID NO: 8198546 - DNA, 22 bp, Homo sapiens
agtggagaccccacttctacat

SEQ ID NO: 8198547 - DNA, 22 bp, Homo sapiens
agtggaggcactaattggattt

SEQ ID NO: 8198548 - DNA, 22 bp, Homo sapiens
agtggaggttacagctgtacat

SEQ ID NO: 8198549 - DNA, 22 bp, Homo sapiens
agtggaggttacagctgtacat

SEQ ID NO: 8198550 - DNA, 22 bp, Homo sapiens
agtggagaagaggatggtctcc

SEQ ID NO: 8198551 - DNA, 22 bp, Homo sapiens
agtggaccagaagactgaagct

SEQ ID NO: 8198552 - DNA, 22 bp, Homo sapiens
agtggagaccccacttctacat

SEQ ID NO: 8198553 - DNA, 22 bp, Homo sapiens
agtggagacaggacagtcgata

SEQ ID NO: 8198554 - DNA, 22 bp, Homo sapiens
agtggagaatatgcagaaagcc

SEQ ID NO: 8198555 - DNA, 22 bp, Homo sapiens
agtggagaagaggatggtctcc

SEQ ID NO: 8198556 - DNA, 22 bp, Homo sapiens
agtggagtgagtggcagaagga

SEQ ID NO: 8198557 - DNA, 22 bp, Homo sapiens
agtggatggtattgggaccagg

SEQ ID NO: 8198558 - DNA, 22 bp, Homo sapiens
agtggatggtattgggaccagg

SEQ ID NO: 8198559 - DNA, 22 bp, Homo sapiens
agtggagttgagttgatggatt

SEQ ID NO: 8198560 - DNA, 22 bp, Homo sapiens
agtggattgcatgagctcagga

SEQ ID NO: 8198561 - DNA, 22 bp, Homo sapiens
agtggcaagtcaatgatagtga

SEQ ID NO: 8198562 - DNA, 22 bp, Homo sapiens
agtggcagaagccaagtctgca

SEQ ID NO: 8198563 - DNA, 22 bp, Homo sapiens
agtggcaggcggagatgtagga

SEQ ID NO: 8198564 - DNA, 22 bp, Homo sapiens
agtggcacaattttgactcccc

SEQ ID NO: 8198565 - DNA, 22 bp, Homo sapiens
agtggcacaactgtttagctac

SEQ ID NO: 8198566 - DNA, 22 bp, Homo sapiens
agtggcaattgacaacaaagga

SEQ ID NO: 8198567 - DNA, 22 bp, Homo sapiens
agtggcagggctggctgctgca

SEQ ID NO: 8198568 - DNA, 22 bp, Homo sapiens
agtggcagtggggcagggccct

SEQ ID NO: 8198569 - DNA, 22 bp, Homo sapiens
agtggcagtggggcagggccct

SEQ ID NO: 8198570 - DNA, 22 bp, Homo sapiens
agtggccacccactgagacagg

SEQ ID NO: 8198571 - DNA, 22 bp, Homo sapiens
agtggccaccatgccagctctc

SEQ ID NO: 8198572 - DNA, 22 bp, Homo sapiens
agtggccaccatgccagctctc

SEQ ID NO: 8198573 - DNA, 22 bp, Homo sapiens
agtggccaccatgccagctctc

SEQ ID NO: 8198574 - DNA, 22 bp, Homo sapiens
agtggccactagaagctcagct

SEQ ID NO: 8198575 - DNA, 22 bp, Homo sapiens
agtggccactagaagctcagct

SEQ ID NO: 8198576 - DNA, 22 bp, Homo sapiens
agtggccactagaagctcagct

SEQ ID NO: 8198577 - DNA, 22 bp, Homo sapiens
agtggccacccactgagacagg

SEQ ID NO: 8198578 - DNA, 22 bp, Homo sapiens
agtggccactagaagctcagct

SEQ ID NO: 8198579 - DNA, 22 bp, Homo sapiens
agtggccacccactgagacagg

SEQ ID NO: 8198580 - DNA, 22 bp, Homo sapiens
agtggccacccactgagacagg

SEQ ID NO: 8198581 - DNA, 22 bp, Homo sapiens
agtggccagcagcctagcctag

SEQ ID NO: 8198582 - DNA, 22 bp, Homo sapiens
agtggccagcagcctagcctag

SEQ ID NO: 8198583 - DNA, 22 bp, Homo sapiens
agtggccaggaaaggtccagcc

SEQ ID NO: 8198584 - DNA, 22 bp, Homo sapiens
agtggccaggaaaggtccagcc

SEQ ID NO: 8198585 - DNA, 22 bp, Homo sapiens
agtggccactgacttggaaatc

SEQ ID NO: 8198586 - DNA, 22 bp, Homo sapiens
agtggccactgacttggaaatc

SEQ ID NO: 8198587 - DNA, 22 bp, Homo sapiens
agtggccactagaagctcagct

SEQ ID NO: 8198588 - DNA, 20 bp, Homo sapiens
agtggccactgcagagatgc

SEQ ID NO: 8198589 - DNA, 22 bp, Homo sapiens
agtggcagtggggcagggccct

SEQ ID NO: 8198590 - DNA, 22 bp, Homo sapiens
agtggcagtttgggagctacag

SEQ ID NO: 8198591 - DNA, 22 bp, Homo sapiens
agtggcatccctttaacagggt

SEQ ID NO: 8198592 - DNA, 22 bp, Homo sapiens
agtggcatctaagttttagaaa

SEQ ID NO: 8198593 - DNA, 22 bp, Homo sapiens
agtggcatcaactttatctgta

SEQ ID NO: 8198594 - DNA, 22 bp, Homo sapiens
agtggcatatcatagctctctt

SEQ ID NO: 8198595 - DNA, 22 bp, Homo sapiens
agtggcatcaaatcaaggtttg

SEQ ID NO: 8198596 - DNA, 22 bp, Homo sapiens
agtggcatcaactttatctgta

SEQ ID NO: 8198597 - DNA, 22 bp, Homo sapiens
agtggcattttaatggatgtca

SEQ ID NO: 8198598 - DNA, 22 bp, Homo sapiens
agtggcattttaatggatgtca

SEQ ID NO: 8198599 - DNA, 22 bp, Homo sapiens
agtggcatctctctaatgacga

SEQ ID NO: 8198600 - DNA, 22 bp, Homo sapiens
agtggccaatatgtcatgctct

SEQ ID NO: 8198601 - DNA, 22 bp, Homo sapiens
agtggccaacttatatgaaaaa

SEQ ID NO: 8198602 - DNA, 22 bp, Homo sapiens
agtggccaacttatatgaaaaa

SEQ ID NO: 8198603 - DNA, 22 bp, Homo sapiens
agtgccctcgtgcccagggcct

SEQ ID NO: 8198604 - DNA, 20 bp, Homo sapiens
agtgccctccgacattgttt

SEQ ID NO: 8198605 - DNA, 22 bp, Homo sapiens
agtgccctcgtgcccagggcct

SEQ ID NO: 8198606 - DNA, 22 bp, Homo sapiens
agtgcccagttaggttggagca

SEQ ID NO: 8198607 - DNA, 22 bp, Homo sapiens
agtgccctggcccagctggacc

SEQ ID NO: 8198608 - DNA, 22 bp, Homo sapiens
agtgccctggacggcggcccca

SEQ ID NO: 8198609 - DNA, 22 bp, Homo sapiens
agtgccctgctggggcaggaga

SEQ ID NO: 8198610 - DNA, 22 bp, Homo sapiens
agtgccaggagcaaggagctcc

SEQ ID NO: 8198611 - DNA, 20 bp, Homo sapiens
agtgccagggcaggtgagag

SEQ ID NO: 8198612 - DNA, 20 bp, Homo sapiens
agtgccagggcaggtgagag

SEQ ID NO: 8198613 - DNA, 23 bp, Homo sapiens
agtgccagggagatcaggacgga

SEQ ID NO: 8198614 - DNA, 23 bp, Homo sapiens
agtgccagggagatcaggacgga

SEQ ID NO: 8198615 - DNA, 22 bp, Homo sapiens
agtgccaggagcaaggagctcc

SEQ ID NO: 8198616 - DNA, 22 bp, Homo sapiens
agtgccaggagcaaggagctcc

SEQ ID NO: 8198617 - DNA, 20 bp, Homo sapiens
agtgccagggcaggtgagag

SEQ ID NO: 8198618 - DNA, 22 bp, Homo sapiens
agtgccatgtagtccagcagaa

SEQ ID NO: 8198619 - DNA, 23 bp, Homo sapiens
agtgccattgaccctatgtctat

SEQ ID NO: 8198620 - DNA, 22 bp, Homo sapiens
agtgccttctctgggctaggtc

SEQ ID NO: 8198621 - DNA, 22 bp, Homo sapiens
agtgccttcagatttgccccag

SEQ ID NO: 8198622 - DNA, 22 bp, Homo sapiens
agtgcctggcacatggaaggtg

SEQ ID NO: 8198623 - DNA, 22 bp, Homo sapiens
agtgcctggaccccatgacata

SEQ ID NO: 8198624 - DNA, 22 bp, Homo sapiens
agtgcccttcatgaagcaagag

SEQ ID NO: 8198625 - DNA, 22 bp, Homo sapiens
agtgcctggaccccatgacata

SEQ ID NO: 8198626 - DNA, 22 bp, Homo sapiens
agtgccttgtgtgtgggcagcc

SEQ ID NO: 8198627 - DNA, 22 bp, Homo sapiens
agtgccttgtgtgtgggcagcc

SEQ ID NO: 8198628 - DNA, 22 bp, Homo sapiens
agtgctgtaacaacttatttgg

SEQ ID NO: 8198629 - DNA, 22 bp, Homo sapiens
agtgctgtcagttttatagata

SEQ ID NO: 8198630 - DNA, 22 bp, Homo sapiens
agtgctgggtactgttcccatt

SEQ ID NO: 8198631 - DNA, 22 bp, Homo sapiens
agtgctaccctgggaggagctc

SEQ ID NO: 8198632 - DNA, 22 bp, Homo sapiens
agtgcattctctaattacaggt

SEQ ID NO: 8198633 - DNA, 22 bp, Homo sapiens
agtgcattctggcagaacaggt

SEQ ID NO: 8198634 - DNA, 22 bp, Homo sapiens
agtgcattgcatctctgcttca

SEQ ID NO: 8198635 - DNA, 22 bp, Homo sapiens
agtgcattcctggggaagaagc

SEQ ID NO: 8198636 - DNA, 22 bp, Homo sapiens
agtgcattctctaattacaggt

SEQ ID NO: 8198637 - DNA, 22 bp, Homo sapiens
agtgcattctctaattacaggt

SEQ ID NO: 8198638 - DNA, 22 bp, Homo sapiens
agtgcatgttcactggcatggt

SEQ ID NO: 8198639 - DNA, 22 bp, Homo sapiens
agtgcattcctggggaagaagc

SEQ ID NO: 8198640 - DNA, 22 bp, Homo sapiens
agtgcattcagtattcataggc

SEQ ID NO: 8198641 - DNA, 22 bp, Homo sapiens
agtgcattcagtattcataggc

SEQ ID NO: 8198642 - DNA, 22 bp, Homo sapiens
agtgcattatatgtttcaatgg

SEQ ID NO: 8198643 - DNA, 22 bp, Homo sapiens
agtgccagctccacacagcagc

SEQ ID NO: 8198644 - DNA, 22 bp, Homo sapiens
agtgccagctccacacagcagc

SEQ ID NO: 8198645 - DNA, 22 bp, Homo sapiens
agtgattaaagctaggataaaa

SEQ ID NO: 8198646 - DNA, 22 bp, Homo sapiens
agtgatgttgactagctataag

SEQ ID NO: 8198647 - DNA, 22 bp, Homo sapiens
agtgatgtgggagagtatagct

SEQ ID NO: 8198648 - DNA, 22 bp, Homo sapiens
agtgatgttgactagctataag

SEQ ID NO: 8198649 - DNA, 23 bp, Homo sapiens
agtgatgtcacccacagacaagg

SEQ ID NO: 8198650 - DNA, 22 bp, Homo sapiens
agtgatgtcacaaactatggtg

SEQ ID NO: 8198651 - DNA, 22 bp, Homo sapiens
agtgatgtcttttaaattacat

SEQ ID NO: 8198652 - DNA, 22 bp, Homo sapiens
agtgatgtgaggtgtgagaggg

SEQ ID NO: 8198653 - DNA, 22 bp, Homo sapiens
agtgattgagtgttagcagtct

SEQ ID NO: 8198654 - DNA, 22 bp, Homo sapiens
agtgattgcttgcttaaggaca

SEQ ID NO: 8198655 - DNA, 22 bp, Homo sapiens
agtgattagaaagtacacttgg

SEQ ID NO: 8198656 - DNA, 22 bp, Homo sapiens
agtgattgttttaaaaatgcct

SEQ ID NO: 8198657 - DNA, 22 bp, Homo sapiens
agtgatttactaccatattggg

SEQ ID NO: 8198658 - DNA, 22 bp, Homo sapiens
agtgattgttttaaaaatgcct

SEQ ID NO: 8198659 - DNA, 22 bp, Homo sapiens
agtgattgtgtagaaccatccc

SEQ ID NO: 8198660 - DNA, 20 bp, Homo sapiens
agtgatttatctttttccac

SEQ ID NO: 8198661 - DNA, 21 bp, Homo sapiens
agtgatttatgagagaatgac

SEQ ID NO: 8198662 - DNA, 22 bp, Homo sapiens
agtgatttcatcattttatcaa

SEQ ID NO: 8198663 - DNA, 22 bp, Homo sapiens
agtgatttcacgcttagggcta

SEQ ID NO: 8198664 - DNA, 22 bp, Homo sapiens
agtgatttatgtatgtgcacgt

SEQ ID NO: 8198665 - DNA, 22 bp, Homo sapiens
agtgatttatggaaggccaaaa

SEQ ID NO: 8198666 - DNA, 22 bp, Homo sapiens
agtgatttatgtatgtgcacgt

SEQ ID NO: 8198667 - DNA, 22 bp, Homo sapiens
agtgcagggcctgcccagcagg

SEQ ID NO: 8198668 - DNA, 22 bp, Homo sapiens
agtgcagggggaaagggtgtct

SEQ ID NO: 8198669 - DNA, 22 bp, Homo sapiens
agtgcagggcctgcccagcagg

SEQ ID NO: 8198670 - DNA, 22 bp, Homo sapiens
agtgatttcctggcaccctaca

SEQ ID NO: 8198671 - DNA, 22 bp, Homo sapiens
agtgtttgagacacatttcact

SEQ ID NO: 8198672 - DNA, 22 bp, Homo sapiens
agtgtttctggaatcagtgttt

SEQ ID NO: 8198673 - DNA, 22 bp, Homo sapiens
agtgtttctggaatcagtgttt

SEQ ID NO: 8198674 - DNA, 22 bp, Homo sapiens
agtgtttgagacacatttcact

SEQ ID NO: 8198675 - DNA, 22 bp, Homo sapiens
agtgtttctgtgccccagtgtt

SEQ ID NO: 8198676 - DNA, 22 bp, Homo sapiens
agtgtttcaccgtatgttctca

SEQ ID NO: 8198677 - DNA, 20 bp, Homo sapiens
agtgtttctcaacatggggc

SEQ ID NO: 8198678 - DNA, 17 bp, Homo sapiens
agtgtttccttatcatt

SEQ ID NO: 8198679 - DNA, 22 bp, Homo sapiens
agtgtttgtcccgttagaaatg

SEQ ID NO: 8198680 - DNA, 22 bp, Homo sapiens
agtgttttatttcagcactttg

SEQ ID NO: 8198681 - DNA, 22 bp, Homo sapiens
agtgttttattagaacacagcc

SEQ ID NO: 8198682 - DNA, 22 bp, Homo sapiens
agtgttttatttcagcactttg

SEQ ID NO: 8198683 - DNA, 22 bp, Homo sapiens
agtgtttttgggtagggtgagt

SEQ ID NO: 8198684 - DNA, 22 bp, Homo sapiens
agtgtttttcaggagcagaaca

SEQ ID NO: 8198685 - DNA, 22 bp, Homo sapiens
agtgttttggagtgggaaggca

SEQ ID NO: 8198686 - DNA, 22 bp, Homo sapiens
agttaaatcattactgacagag

SEQ ID NO: 8198687 - DNA, 22 bp, Homo sapiens
agttaaactctagtagatacaa

SEQ ID NO: 8198688 - DNA, 22 bp, Homo sapiens
agttaacacaagtaagattcca

SEQ ID NO: 8198689 - DNA, 22 bp, Homo sapiens
agtgtgggccacgcagctgagc

SEQ ID NO: 8198690 - DNA, 22 bp, Homo sapiens
agtgtgggcccccaggttagcc

SEQ ID NO: 8198691 - DNA, 22 bp, Homo sapiens
agtgtgggcccccaggttagcc

SEQ ID NO: 8198692 - DNA, 22 bp, Homo sapiens
agtgtgggggctttggtgtcac

SEQ ID NO: 8198693 - DNA, 22 bp, Homo sapiens
agtgtggatttagttgtgcttt

SEQ ID NO: 8198694 - DNA, 22 bp, Homo sapiens
agtgtggcaggaatgactagaa

SEQ ID NO: 8198695 - DNA, 22 bp, Homo sapiens
agtgtggccaatgaggatgggc

SEQ ID NO: 8198696 - DNA, 22 bp, Homo sapiens
agtgtggctgcgtagggctctc

SEQ ID NO: 8198697 - DNA, 22 bp, Homo sapiens
agtgtttattagatttcccttt

SEQ ID NO: 8198698 - DNA, 18 bp, Homo sapiens
agtgtttatttaggtgaa

SEQ ID NO: 8198699 - DNA, 22 bp, Homo sapiens
agtgtttatggaatcttagtta

SEQ ID NO: 8198700 - DNA, 18 bp, Homo sapiens
agtgttctcgttttataa

SEQ ID NO: 8198701 - DNA, 18 bp, Homo sapiens
agtgttctcgttttataa

SEQ ID NO: 8198702 - DNA, 22 bp, Homo sapiens
agtgtggatttagttgtgcttt

SEQ ID NO: 8198703 - DNA, 22 bp, Homo sapiens
agtgtggattggctggagctat

SEQ ID NO: 8198704 - DNA, 22 bp, Homo sapiens
agtgtggacttttcctaggagg

SEQ ID NO: 8198705 - DNA, 22 bp, Homo sapiens
agtgtggacttttcctaggagg

SEQ ID NO: 8198706 - DNA, 22 bp, Homo sapiens
agtgtgctgtttccagaagggc

SEQ ID NO: 8198707 - DNA, 22 bp, Homo sapiens
agtgtgctgtttccagaagggc

SEQ ID NO: 8198708 - DNA, 22 bp, Homo sapiens
agtgtgagtttggttgagactt

SEQ ID NO: 8198709 - DNA, 22 bp, Homo sapiens
agtgtgagttacaaagtgtgaa

SEQ ID NO: 8198710 - DNA, 22 bp, Homo sapiens
agtgtgcccagtaattggctga

SEQ ID NO: 8198711 - DNA, 20 bp, Homo sapiens
agtgtgcatttagagtctgc

SEQ ID NO: 8198712 - DNA, 22 bp, Homo sapiens
agttatttcagtaacataatag

SEQ ID NO: 8198713 - DNA, 22 bp, Homo sapiens
agttatttcagtaacataatag

SEQ ID NO: 8198714 - DNA, 22 bp, Homo sapiens
ctgagctgctcccgctgcagcg

SEQ ID NO: 8198715 - DNA, 22 bp, Homo sapiens
ctgagctgctcccgctgcagcg

SEQ ID NO: 8198716 - DNA, 22 bp, Homo sapiens
ctgagctgcggcaggcacctgg

SEQ ID NO: 8198717 - DNA, 22 bp, Homo sapiens
ctgagctgcggcaggcacctgg

SEQ ID NO: 8198718 - DNA, 22 bp, Homo sapiens
ctgagctgcagtcctggctctg

SEQ ID NO: 8198719 - DNA, 22 bp, Homo sapiens
ctgagctgctcccgctgcagcg

SEQ ID NO: 8198720 - DNA, 22 bp, Homo sapiens
ctgagctgcggcaggcacctgg

SEQ ID NO: 8198721 - DNA, 22 bp, Homo sapiens
ctgagctgctcccgctgcagcg

SEQ ID NO: 8198722 - DNA, 22 bp, Homo sapiens
ctgagctgctcccgctgcagcg

SEQ ID NO: 8198723 - DNA, 22 bp, Homo sapiens
ctgagctgaaacttgagaggct

SEQ ID NO: 8198724 - DNA, 22 bp, Homo sapiens
ctgagctgaaacttgagaggct

SEQ ID NO: 8198725 - DNA, 22 bp, Homo sapiens
ctgagctgaaacttgagaggct

SEQ ID NO: 8198726 - DNA, 22 bp, Homo sapiens
ctgagctgacatcttcctcttt

SEQ ID NO: 8198727 - DNA, 20 bp, Homo sapiens
ctgagctgagctccatgggt

SEQ ID NO: 8198728 - DNA, 20 bp, Homo sapiens
ctgagctgagctccatgggt

SEQ ID NO: 8198729 - DNA, 20 bp, Homo sapiens
ctgagctgagctccatgggt

SEQ ID NO: 8198730 - DNA, 22 bp, Homo sapiens
ctgagctgcagtcctggctctg

SEQ ID NO: 8198731 - DNA, 22 bp, Homo sapiens
ctgagctgcagtcctggctctg

SEQ ID NO: 8198732 - DNA, 22 bp, Homo sapiens
ctgagctgcagtcctggctctg

SEQ ID NO: 8198733 - DNA, 22 bp, Homo sapiens
ctgagctgcagtcctggctctg

SEQ ID NO: 8198734 - DNA, 22 bp, Homo sapiens
ctgagctgcggcaggcacctgg

SEQ ID NO: 8198735 - DNA, 22 bp, Homo sapiens
agttcatttaaatcaggtactt

SEQ ID NO: 8198736 - DNA, 22 bp, Homo sapiens
agttcattttatttgtcagggt

SEQ ID NO: 8198737 - DNA, 23 bp, Homo sapiens
agttccagaaaaatgctcaagca

SEQ ID NO: 8198738 - DNA, 22 bp, Homo sapiens
agttcctggatttggggttgca

SEQ ID NO: 8198739 - DNA, 22 bp, Homo sapiens
agttccagctgtgaccagaaaa

SEQ ID NO: 8198740 - DNA, 22 bp, Homo sapiens
agttcccaaattacaggccaca

SEQ ID NO: 8198741 - DNA, 22 bp, Homo sapiens
agttccatccttccactgccct

SEQ ID NO: 8198742 - DNA, 22 bp, Homo sapiens
ctgagccagcgggctcactttt

SEQ ID NO: 8198743 - DNA, 22 bp, Homo sapiens
ctgagccagcgggctcactttt

SEQ ID NO: 8198744 - DNA, 22 bp, Homo sapiens
ctgagccactgcttgttcagtg

SEQ ID NO: 8198745 - DNA, 22 bp, Homo sapiens
ctgagccactgcttgttcagtg

SEQ ID NO: 8198746 - DNA, 22 bp, Homo sapiens
ctgagccagagggagtcgggtc

SEQ ID NO: 8198747 - DNA, 22 bp, Homo sapiens
ctgagccaaggggacagtgaca

SEQ ID NO: 8198748 - DNA, 22 bp, Homo sapiens
ctgagccaaggggacagtgaca

SEQ ID NO: 8198749 - DNA, 22 bp, Homo sapiens
ctgagccactgcttgttcagtg

SEQ ID NO: 8198750 - DNA, 19 bp, Homo sapiens
ctgagcagcggcagcactt

SEQ ID NO: 8198751 - DNA, 22 bp, Homo sapiens
ctgagcagccccaccagccatt

SEQ ID NO: 8198752 - DNA, 22 bp, Homo sapiens
agttaactcattttataatgcc

SEQ ID NO: 8198753 - DNA, 22 bp, Homo sapiens
ctgagcagccccaccagccatt

SEQ ID NO: 8198754 - DNA, 22 bp, Homo sapiens
agttaactaaactgtgagtaaa

SEQ ID NO: 8198755 - DNA, 22 bp, Homo sapiens
agttaacatttgagctaaaagg

SEQ ID NO: 8198756 - DNA, 22 bp, Homo sapiens
ctgagctcaagcgatcctccca

SEQ ID NO: 8198757 - DNA, 22 bp, Homo sapiens
ctgagctcaagcgatcctccca

SEQ ID NO: 8198758 - DNA, 22 bp, Homo sapiens
ctgagctcaagcgatcctccca

SEQ ID NO: 8198759 - DNA, 22 bp, Homo sapiens
ctgagctctaatgtcagccttg

SEQ ID NO: 8198760 - DNA, 22 bp, Homo sapiens
ctgagctcacgccattctcctt

SEQ ID NO: 8198761 - DNA, 22 bp, Homo sapiens
ctgagccagctggcatgtgcta

SEQ ID NO: 8198762 - DNA, 22 bp, Homo sapiens
ctgagccagcgggctcactttt

SEQ ID NO: 8198763 - DNA, 22 bp, Homo sapiens
ctgagccagcgggctcactttt

SEQ ID NO: 8198764 - DNA, 22 bp, Homo sapiens
ctgagccagctggcatgtgcta

SEQ ID NO: 8198765 - DNA, 22 bp, Homo sapiens
ctgagccagctggcatgtgcta

SEQ ID NO: 8198766 - DNA, 22 bp, Homo sapiens
ctgagccagggccacacatgga

SEQ ID NO: 8198767 - DNA, 22 bp, Homo sapiens
agtgtcagttgccttgtcataa

SEQ ID NO: 8198768 - DNA, 18 bp, Homo sapiens
agtgtcagctgcagctca

SEQ ID NO: 8198769 - DNA, 22 bp, Homo sapiens
agtgtcagctaattattcatga

SEQ ID NO: 8198770 - DNA, 22 bp, Homo sapiens
agtgtcagctaattattcatga

SEQ ID NO: 8198771 - DNA, 21 bp, Homo sapiens
agtgtcatttgatcattgtta

SEQ ID NO: 8198772 - DNA, 19 bp, Homo sapiens
agtgtcatcagctactcag

SEQ ID NO: 8198773 - DNA, 22 bp, Homo sapiens
agtgtcatatgccactgcatcc

SEQ ID NO: 8198774 - DNA, 19 bp, Homo sapiens
agtgtcagaattcattgaa

SEQ ID NO: 8198775 - DNA, 22 bp, Homo sapiens
agtgtcaattctcaaatctcgg

SEQ ID NO: 8198776 - DNA, 22 bp, Homo sapiens
agtgtcacagacccaatcagga

SEQ ID NO: 8198777 - DNA, 22 bp, Homo sapiens
agtgtcaatgccaacagtatat

SEQ ID NO: 8198778 - DNA, 22 bp, Homo sapiens
agtgtattcagaatgtagcaaa

SEQ ID NO: 8198779 - DNA, 22 bp, Homo sapiens
agtgtattgattggaacagcct

SEQ ID NO: 8198780 - DNA, 22 bp, Homo sapiens
agtgtattgattggaacagcct

SEQ ID NO: 8198781 - DNA, 22 bp, Homo sapiens
agtgtacaaaatgatagataaa

SEQ ID NO: 8198782 - DNA, 22 bp, Homo sapiens
ctctggatatgcactgggtgag

SEQ ID NO: 8198783 - DNA, 21 bp, Homo sapiens
ctctggagtttgaaggctggg

SEQ ID NO: 8198784 - DNA, 21 bp, Homo sapiens
ctctggagtttgaaggctggg

SEQ ID NO: 8198785 - DNA, 21 bp, Homo sapiens
ctctggagtttgaaggctggg

SEQ ID NO: 8198786 - DNA, 22 bp, Homo sapiens
agtgtatttgcctataaaaatg

SEQ ID NO: 8198787 - DNA, 20 bp, Homo sapiens
agtgtatttgggtagagtgt

SEQ ID NO: 8198788 - DNA, 22 bp, Homo sapiens
agtgtatttgcctataaaaatg

SEQ ID NO: 8198789 - DNA, 19 bp, Homo sapiens
agtgtatttttttctgtag

SEQ ID NO: 8198790 - DNA, 22 bp, Homo sapiens
agtgtattttcttgctaggaat

SEQ ID NO: 8198791 - DNA, 20 bp, Homo sapiens
agtgtatttgggtagagtgt

SEQ ID NO: 8198792 - DNA, 19 bp, Homo sapiens
agtgtatttttttctgtag

SEQ ID NO: 8198793 - DNA, 22 bp, Homo sapiens
agtgtattgtctcacagttctt

SEQ ID NO: 8198794 - DNA, 22 bp, Homo sapiens
agtgtcaaattaaataatctgg

SEQ ID NO: 8198795 - DNA, 22 bp, Homo sapiens
agtgtcaactcggaataaggat

SEQ ID NO: 8198796 - DNA, 22 bp, Homo sapiens
agtgtcctacagctcctgcctg

SEQ ID NO: 8198797 - DNA, 19 bp, Homo sapiens
agtgtcctagtcatttgcc

SEQ ID NO: 8198798 - DNA, 22 bp, Homo sapiens
agtgtcctagcaagccggtcct

SEQ ID NO: 8198799 - DNA, 22 bp, Homo sapiens
agtgtcctacagctcctgcctg

SEQ ID NO: 8198800 - DNA, 22 bp, Homo sapiens
agtgtcctcaggctttgttcct

SEQ ID NO: 8198801 - DNA, 22 bp, Homo sapiens
agtgtcctcaggctttgttcct

SEQ ID NO: 8198802 - DNA, 22 bp, Homo sapiens
agtgtcctagcaagccggtcct

SEQ ID NO: 8198803 - DNA, 19 bp, Homo sapiens
agtgtcctagtcatttgcc

SEQ ID NO: 8198804 - DNA, 22 bp, Homo sapiens
agtgtcctcatctgtaaaatga

SEQ ID NO: 8198805 - DNA, 22 bp, Homo sapiens
agtgtcctcaggctttgttcct

SEQ ID NO: 8198806 - DNA, 22 bp, Homo sapiens
agtgtcccctacagaggcattc

SEQ ID NO: 8198807 - DNA, 22 bp, Homo sapiens
agtgtccaactcagcttgtcaa

SEQ ID NO: 8198808 - DNA, 22 bp, Homo sapiens
agtgtcccctccaagggcctgg

SEQ ID NO: 8198809 - DNA, 22 bp, Homo sapiens
agtgtcctacagctcctgcctg

SEQ ID NO: 8198810 - DNA, 22 bp, Homo sapiens
agtgtcctcctctgggagccag

SEQ ID NO: 8198811 - DNA, 22 bp, Homo sapiens
agtgtcctcctctgggagccag

SEQ ID NO: 8198812 - DNA, 22 bp, Homo sapiens
agtgtcctcatctgtaaaatga

SEQ ID NO: 8198813 - DNA, 20 bp, Homo sapiens
agtgtctgggcctcaggccc

SEQ ID NO: 8198814 - DNA, 22 bp, Homo sapiens
agtgtctttgtcaaattacagg

SEQ ID NO: 8198815 - DNA, 22 bp, Homo sapiens
agtgtctttgtctctcaagcac

SEQ ID NO: 8198816 - DNA, 22 bp, Homo sapiens
agtgtctggtctctgaactaaa

SEQ ID NO: 8198817 - DNA, 22 bp, Homo sapiens
agtgtctggtctctgaactaaa

SEQ ID NO: 8198818 - DNA, 22 bp, Homo sapiens
agtgtctttgacacattcaaag

SEQ ID NO: 8198819 - DNA, 22 bp, Homo sapiens
agtgtgagcctacaggccaaag

SEQ ID NO: 8198820 - DNA, 22 bp, Homo sapiens
agtgtgagtaattgagtctgtc

SEQ ID NO: 8198821 - DNA, 22 bp, Homo sapiens
agtgtgagtaattcagggaggg

SEQ ID NO: 8198822 - DNA, 22 bp, Homo sapiens
agtgtgagtaattcagggaggg

SEQ ID NO: 8198823 - DNA, 22 bp, Homo sapiens
agtgtgaggggttctttgatat

SEQ ID NO: 8198824 - DNA, 22 bp, Homo sapiens
agtgtgagctaatagcagagcc

SEQ ID NO: 8198825 - DNA, 22 bp, Homo sapiens
agtgtgagatgattgaggagca

SEQ ID NO: 8198826 - DNA, 22 bp, Homo sapiens
agtgtgagatgattgaggagca

SEQ ID NO: 8198827 - DNA, 19 bp, Homo sapiens
agtgtgagactccatctca

SEQ ID NO: 8198828 - DNA, 22 bp, Homo sapiens
agtggccagtgaaggcggcagc

SEQ ID NO: 8198829 - DNA, 22 bp, Homo sapiens
agtggccagcagcctagcctag

SEQ ID NO: 8198830 - DNA, 22 bp, Homo sapiens
agtggccagtgctgctctgggg

SEQ ID NO: 8198831 - DNA, 22 bp, Homo sapiens
agtggccagtgaaggcggcagc

SEQ ID NO: 8198832 - DNA, 22 bp, Homo sapiens
agtggccagtgaaggcggcagc

SEQ ID NO: 8198833 - DNA, 22 bp, Homo sapiens
agtggccaggaaaggtccagcc

SEQ ID NO: 8198834 - DNA, 22 bp, Homo sapiens
agtggccaggaaaggtccagcc

SEQ ID NO: 8198835 - DNA, 22 bp, Homo sapiens
agtggccagtgctgctctgggg

SEQ ID NO: 8198836 - DNA, 22 bp, Homo sapiens
agtggccagtgaaggcggcagc

SEQ ID NO: 8198837 - DNA, 22 bp, Homo sapiens
agtggccatccctcaggtaggc

SEQ ID NO: 8198838 - DNA, 22 bp, Homo sapiens
agtggccagtgctgctctgggg

SEQ ID NO: 8198839 - DNA, 22 bp, Homo sapiens
agtggccatggcaggtgagcat

SEQ ID NO: 8198840 - DNA, 22 bp, Homo sapiens
agtggccatggcaggtgagcat

SEQ ID NO: 8198841 - DNA, 22 bp, Homo sapiens
agtggccatggcaggtgagcat

SEQ ID NO: 8198842 - DNA, 22 bp, Homo sapiens
agtggccatccctcaggtaggc

SEQ ID NO: 8198843 - DNA, 22 bp, Homo sapiens
agtggccatccctcaggtaggc

SEQ ID NO: 8198844 - DNA, 22 bp, Homo sapiens
agtggcccttagtggcaaagtc

SEQ ID NO: 8198845 - DNA, 22 bp, Homo sapiens
agtggcccctagggaacagcct

SEQ ID NO: 8198846 - DNA, 22 bp, Homo sapiens
agtggccatggcaggtgagcat

SEQ ID NO: 8198847 - DNA, 22 bp, Homo sapiens
agtggccccacagtagggctta

SEQ ID NO: 8198848 - DNA, 22 bp, Homo sapiens
agtggccccacagtagggctta

SEQ ID NO: 8198849 - DNA, 22 bp, Homo sapiens
agtggcctggagccccgcctgg

SEQ ID NO: 8198850 - DNA, 22 bp, Homo sapiens
agtggcctggagccccgcctgg

SEQ ID NO: 8198851 - DNA, 22 bp, Homo sapiens
agtggcggggattagcagtgtt

SEQ ID NO: 8198852 - DNA, 22 bp, Homo sapiens
agtggcggggattagcagtgtt

SEQ ID NO: 8198853 - DNA, 22 bp, Homo sapiens
agtggcgtcctaggaaaggagg

SEQ ID NO: 8198854 - DNA, 22 bp, Homo sapiens
agtggctcagagtctattgagg

SEQ ID NO: 8198855 - DNA, 22 bp, Homo sapiens
agtggctagatcatgagtgagc

SEQ ID NO: 8198856 - DNA, 20 bp, Homo sapiens
agtgggtgatgaaggaatag

SEQ ID NO: 8198857 - DNA, 20 bp, Homo sapiens
agtgggtgatgaaggaatag

SEQ ID NO: 8198858 - DNA, 22 bp, Homo sapiens
agtgggtgagcttggtctagat

SEQ ID NO: 8198859 - DNA, 22 bp, Homo sapiens
agtgggtgagcttggtctagat

SEQ ID NO: 8198860 - DNA, 22 bp, Homo sapiens
agtgggtgagcttggtctagat

SEQ ID NO: 8198861 - DNA, 22 bp, Homo sapiens
agtgggtcagagagctccagat

SEQ ID NO: 8198862 - DNA, 22 bp, Homo sapiens
agtgggtgacagtgaacacgta

SEQ ID NO: 8198863 - DNA, 22 bp, Homo sapiens
agtgggtactgggcaggcagag

SEQ ID NO: 8198864 - DNA, 19 bp, Homo sapiens
agtgggtaatagaggctcc

SEQ ID NO: 8198865 - DNA, 22 bp, Homo sapiens
agtgggtaggcctctggtgcct

SEQ ID NO: 8198866 - DNA, 22 bp, Homo sapiens
agtgggtactgggcaggcagag

SEQ ID NO: 8198867 - DNA, 22 bp, Homo sapiens
agtggggagtttccagatgtgt

SEQ ID NO: 8198868 - DNA, 22 bp, Homo sapiens
agtggggccgcggtcctgccct

SEQ ID NO: 8198869 - DNA, 21 bp, Homo sapiens
agtggctctcagcttgctaag

SEQ ID NO: 8198870 - DNA, 22 bp, Homo sapiens
agtggctccaaaccgtagtcat

SEQ ID NO: 8198871 - DNA, 22 bp, Homo sapiens
agtggctctccaagaagtcaca

SEQ ID NO: 8198872 - DNA, 22 bp, Homo sapiens
agtggctctccaagaagtcaca

SEQ ID NO: 8198873 - DNA, 22 bp, Homo sapiens
agtggctcttgggtcactgggc

SEQ ID NO: 8198874 - DNA, 22 bp, Homo sapiens
agtggctcttgggtcactgggc

SEQ ID NO: 8198875 - DNA, 22 bp, Homo sapiens
agtggctcttgggtcactgggc

SEQ ID NO: 8198876 - DNA, 22 bp, Homo sapiens
ctctggagtgtctggccagggt

SEQ ID NO: 8198877 - DNA, 22 bp, Homo sapiens
ctctggagtgtctggccagggt

SEQ ID NO: 8198878 - DNA, 22 bp, Homo sapiens
agtggtctatttaatagttttc

SEQ ID NO: 8198879 - DNA, 22 bp, Homo sapiens
ctctggagtgtctggccagggt

SEQ ID NO: 8198880 - DNA, 22 bp, Homo sapiens
ctctggagtgtctggccagggt

SEQ ID NO: 8198881 - DNA, 22 bp, Homo sapiens
ctctggagttcccttgatctga

SEQ ID NO: 8198882 - DNA, 22 bp, Homo sapiens
ctctggagttcccttgatctga

SEQ ID NO: 8198883 - DNA, 22 bp, Homo sapiens
ctctggagttagtgatctgggc

SEQ ID NO: 8198884 - DNA, 22 bp, Homo sapiens
ctctggagttctcatgaggaac

SEQ ID NO: 8198885 - DNA, 22 bp, Homo sapiens
ctctggagttcttcaagctact

SEQ ID NO: 8198886 - DNA, 22 bp, Homo sapiens
ctctggagttctcatgaggaac

SEQ ID NO: 8198887 - DNA, 22 bp, Homo sapiens
ctctggagttctcatgaggaac

SEQ ID NO: 8198888 - DNA, 22 bp, Homo sapiens
ctctggagttcttcaagctact

SEQ ID NO: 8198889 - DNA, 20 bp, Homo sapiens
ctctggagttggggaacatt

SEQ ID NO: 8198890 - DNA, 20 bp, Homo sapiens
ctctggagttggggaacatt

SEQ ID NO: 8198891 - DNA, 21 bp, Homo sapiens
ctctggagtttgaaggctggg

SEQ ID NO: 8198892 - DNA, 20 bp, Homo sapiens
ctctggagttggggaacatt

SEQ ID NO: 8198893 - DNA, 22 bp, Homo sapiens
agtgggtgcaaccatggctagg

SEQ ID NO: 8198894 - DNA, 22 bp, Homo sapiens
agtgggtggcgcagaggaggaa

SEQ ID NO: 8198895 - DNA, 20 bp, Homo sapiens
agtgggtgatgaaggaatag

SEQ ID NO: 8198896 - DNA, 22 bp, Homo sapiens
agtgggtgcaaccatggctagg

SEQ ID NO: 8198897 - DNA, 22 bp, Homo sapiens
agtgggtggcgcagaggaggaa

SEQ ID NO: 8198898 - DNA, 22 bp, Homo sapiens
agtgggtggcgcagaggaggaa

SEQ ID NO: 8198899 - DNA, 22 bp, Homo sapiens
agtgggtgggtgtctgacagtt

SEQ ID NO: 8198900 - DNA, 22 bp, Homo sapiens
agtgggtggcgcagaggaggaa

SEQ ID NO: 8198901 - DNA, 19 bp, Homo sapiens
agtggtagatgagcaggag

SEQ ID NO: 8198902 - DNA, 19 bp, Homo sapiens
agtggtagatgagcaggag

SEQ ID NO: 8198903 - DNA, 22 bp, Homo sapiens
agtggtagaaaatgcagctcga

SEQ ID NO: 8198904 - DNA, 22 bp, Homo sapiens
agtggtctagtctgaggattat

SEQ ID NO: 8198905 - DNA, 20 bp, Homo sapiens
agtggtctagtttctctgca

SEQ ID NO: 8198906 - DNA, 22 bp, Homo sapiens
acccttctgtgacctgcctgtc

SEQ ID NO: 8198907 - DNA, 22 bp, Homo sapiens
acccttccaaatgagcttatta

SEQ ID NO: 8198908 - DNA, 22 bp, Homo sapiens
aggtatttgtctcagattgggt

SEQ ID NO: 8198909 - DNA, 22 bp, Homo sapiens
aggtatttgttatttgagagtg

SEQ ID NO: 8198910 - DNA, 22 bp, Homo sapiens
aggtatttgttatttgagagtg

SEQ ID NO: 8198911 - DNA, 22 bp, Homo sapiens
aggtattttatagataagtaaa

SEQ ID NO: 8198912 - DNA, 22 bp, Homo sapiens
aggtattttatagataagtaaa

SEQ ID NO: 8198913 - DNA, 22 bp, Homo sapiens
aggtatttcccaaagtggcatg

SEQ ID NO: 8198914 - DNA, 22 bp, Homo sapiens
aggtcaagagtaaatttgggta

SEQ ID NO: 8198915 - DNA, 22 bp, Homo sapiens
aggtcaagagtaaatttgggta

SEQ ID NO: 8198916 - DNA, 22 bp, Homo sapiens
aggtcaagagtaaatttgggta

SEQ ID NO: 8198917 - DNA, 22 bp, Homo sapiens
aggtcaagaattgatgtggttt

SEQ ID NO: 8198918 - DNA, 22 bp, Homo sapiens
aggtcaagagtaaatttgggta

SEQ ID NO: 8198919 - DNA, 22 bp, Homo sapiens
aggtcaaggccaaaagagtggt

SEQ ID NO: 8198920 - DNA, 20 bp, Homo sapiens
aggtcaacacctagtaagtg

SEQ ID NO: 8198921 - DNA, 22 bp, Homo sapiens
aggtcaaaccacagctctaggc

SEQ ID NO: 8198922 - DNA, 22 bp, Homo sapiens
aggtccacagttcagctgccca

SEQ ID NO: 8198923 - DNA, 22 bp, Homo sapiens
aggtcaagtttagatagagtta

SEQ ID NO: 8198924 - DNA, 22 bp, Homo sapiens
aggtcaaggttcacaggggatc

SEQ ID NO: 8198925 - DNA, 22 bp, Homo sapiens
aggtcaaggctgcagtgagctg

SEQ ID NO: 8198926 - DNA, 22 bp, Homo sapiens
aggtcaaggctgcagtgagctg

SEQ ID NO: 8198927 - DNA, 22 bp, Homo sapiens
aggtcaagggagctgagggcca

SEQ ID NO: 8198928 - DNA, 22 bp, Homo sapiens
aggtcaagggcaagagtgaggt

SEQ ID NO: 8198929 - DNA, 22 bp, Homo sapiens
aggtcaagggcaagagtgaggt

SEQ ID NO: 8198930 - DNA, 22 bp, Homo sapiens
acctttatgtttgattacaatt

SEQ ID NO: 8198931 - DNA, 22 bp, Homo sapiens
accttccaggaatctgccagat

SEQ ID NO: 8198932 - DNA, 22 bp, Homo sapiens
accttccaggaatctgccagat

SEQ ID NO: 8198933 - DNA, 21 bp, Homo sapiens
aggtccagttctgtcttggac

SEQ ID NO: 8198934 - DNA, 22 bp, Homo sapiens
aggtccagtgctcttggtggtt

SEQ ID NO: 8198935 - DNA, 22 bp, Homo sapiens
aggtccagtgctcttggtggtt

SEQ ID NO: 8198936 - DNA, 22 bp, Homo sapiens
aggtccagtgaaactttatttg

SEQ ID NO: 8198937 - DNA, 22 bp, Homo sapiens
acctttctgcaagttctgggac

SEQ ID NO: 8198938 - DNA, 19 bp, Homo sapiens
acctttcctttctcagatg

SEQ ID NO: 8198939 - DNA, 20 bp, Homo sapiens
aggtccactgaggctgcctc

SEQ ID NO: 8198940 - DNA, 22 bp, Homo sapiens
aggtcatttttgccttctattt

SEQ ID NO: 8198941 - DNA, 22 bp, Homo sapiens
aggtccagaacgtgcctactct

SEQ ID NO: 8198942 - DNA, 22 bp, Homo sapiens
aggtccagactgtgtaccctag

SEQ ID NO: 8198943 - DNA, 22 bp, Homo sapiens
aggtccagaggctccttattac

SEQ ID NO: 8198944 - DNA, 22 bp, Homo sapiens
aggtccagctctattgaaaaga

SEQ ID NO: 8198945 - DNA, 22 bp, Homo sapiens
aggtccagcctgccctctctcc

SEQ ID NO: 8198946 - DNA, 22 bp, Homo sapiens
aggtccagagttgagatacaga

SEQ ID NO: 8198947 - DNA, 22 bp, Homo sapiens
aggtccagagttgagatacaga

SEQ ID NO: 8198948 - DNA, 22 bp, Homo sapiens
aggtccagaggttgaacggtgg

SEQ ID NO: 8198949 - DNA, 22 bp, Homo sapiens
aggtccagaggttgaacggtgg

SEQ ID NO: 8198950 - DNA, 22 bp, Homo sapiens
aggtccaggagatttggcaatt

SEQ ID NO: 8198951 - DNA, 22 bp, Homo sapiens
aggtccaggagatttggcaatt

SEQ ID NO: 8198952 - DNA, 22 bp, Homo sapiens
aggtccagctgttgcagcctcc

SEQ ID NO: 8198953 - DNA, 22 bp, Homo sapiens
aggtccagctgttgcagcctcc

SEQ ID NO: 8198954 - DNA, 22 bp, Homo sapiens
aggtccagctgttgcagcctcc

SEQ ID NO: 8198955 - DNA, 22 bp, Homo sapiens
aggtccaggcatttgggttggg

SEQ ID NO: 8198956 - DNA, 22 bp, Homo sapiens
aggtccaggcatttgggttggg

SEQ ID NO: 8198957 - DNA, 22 bp, Homo sapiens
aggtccaggatttgtggggtct

SEQ ID NO: 8198958 - DNA, 22 bp, Homo sapiens
aggtccaggcctcatgatggcc

SEQ ID NO: 8198959 - DNA, 22 bp, Homo sapiens
aggtccaggttccgtttctgcg

SEQ ID NO: 8198960 - DNA, 22 bp, Homo sapiens
aggtgggcactccgctcgaggt

SEQ ID NO: 8198961 - DNA, 21 bp, Homo sapiens
aggtgggcaggtggagtggcc

SEQ ID NO: 8198962 - DNA, 22 bp, Homo sapiens
actagaaattactcagaataaa

SEQ ID NO: 8198963 - DNA, 22 bp, Homo sapiens
actagaaagtttccagagttat

SEQ ID NO: 8198964 - DNA, 22 bp, Homo sapiens
actagaaagtttccagagttat

SEQ ID NO: 8198965 - DNA, 22 bp, Homo sapiens
actagaaatgtattggtagctg

SEQ ID NO: 8198966 - DNA, 22 bp, Homo sapiens
actagaaattactcagaataaa

SEQ ID NO: 8198967 - DNA, 22 bp, Homo sapiens
actagaaaattcctagaaacta

SEQ ID NO: 8198968 - DNA, 22 bp, Homo sapiens
actagaaaattcctagaaacta

SEQ ID NO: 8198969 - DNA, 22 bp, Homo sapiens
actagaaaattcctagaaacta

SEQ ID NO: 8198970 - DNA, 22 bp, Homo sapiens
actagaaactaatggattatta

SEQ ID NO: 8198971 - DNA, 22 bp, Homo sapiens
actagaaactaatggattatta

SEQ ID NO: 8198972 - DNA, 22 bp, Homo sapiens
actagaaagcaaaagccatttc

SEQ ID NO: 8198973 - DNA, 22 bp, Homo sapiens
actagaaagcaaaagccatttc

SEQ ID NO: 8198974 - DNA, 22 bp, Homo sapiens
actagaaagaagttttttgaga

SEQ ID NO: 8198975 - DNA, 20 bp, Homo sapiens
actagaaagtcactgggggg

SEQ ID NO: 8198976 - DNA, 20 bp, Homo sapiens
actagaaagtcactgggggg

SEQ ID NO: 8198977 - DNA, 22 bp, Homo sapiens
actagaaagtttccagagttat

SEQ ID NO: 8198978 - DNA, 22 bp, Homo sapiens
actagaaagcactaagctaggc

SEQ ID NO: 8198979 - DNA, 22 bp, Homo sapiens
actacagtgtgataagaggggc

SEQ ID NO: 8198980 - DNA, 22 bp, Homo sapiens
actacttgagctgaggctagca

SEQ ID NO: 8198981 - DNA, 23 bp, Homo sapiens
actagaaaatgactttctccctg

SEQ ID NO: 8198982 - DNA, 21 bp, Homo sapiens
actactggtgaaagcctagat

SEQ ID NO: 8198983 - DNA, 22 bp, Homo sapiens
actaaatatttgagaggtgtag

SEQ ID NO: 8198984 - DNA, 22 bp, Homo sapiens
aggtgacttaggctgtggctcg

SEQ ID NO: 8198985 - DNA, 22 bp, Homo sapiens
aggtgactggtttatctggcag

SEQ ID NO: 8198986 - DNA, 22 bp, Homo sapiens
aggtgactgagtttcagtgtga

SEQ ID NO: 8198987 - DNA, 22 bp, Homo sapiens
actaaatctgcagagtttagtg

SEQ ID NO: 8198988 - DNA, 22 bp, Homo sapiens
actacagtactatatctatagg

SEQ ID NO: 8198989 - DNA, 22 bp, Homo sapiens
accttttacggtgtgactagca

SEQ ID NO: 8198990 - DNA, 22 bp, Homo sapiens
acctttggataatttgagtttg

SEQ ID NO: 8198991 - DNA, 21 bp, Homo sapiens
acctttgggtgtttataatag

SEQ ID NO: 8198992 - DNA, 22 bp, Homo sapiens
accttttatgtaaatatatgtt

SEQ ID NO: 8198993 - DNA, 22 bp, Homo sapiens
acgatcagcttagtctaccatg

SEQ ID NO: 8198994 - DNA, 22 bp, Homo sapiens
acgatgagatggggctggaagg

SEQ ID NO: 8198995 - DNA, 22 bp, Homo sapiens
aggtctgttggtaccagtgtgg

SEQ ID NO: 8198996 - DNA, 22 bp, Homo sapiens
acgaaggaatgtgcttgagcat

SEQ ID NO: 8198997 - DNA, 20 bp, Homo sapiens
aggtcttccaatcagctcct

SEQ ID NO: 8198998 - DNA, 19 bp, Homo sapiens
aggtcttgactctgttctt

SEQ ID NO: 8198999 - DNA, 22 bp, Homo sapiens
aggtcttggtaggccagagtct

SEQ ID NO: 8199000 - DNA, 22 bp, Homo sapiens
aggtcttgtgaaggactgtgcc

SEQ ID NO: 8199001 - DNA, 22 bp, Homo sapiens
aggtgaagttgaggaggcagaa

SEQ ID NO: 8199002 - DNA, 22 bp, Homo sapiens
aggtgaagttaaaaaccagtct

SEQ ID NO: 8199003 - DNA, 22 bp, Homo sapiens
aggtgacaggacaggagctggt

SEQ ID NO: 8199004 - DNA, 22 bp, Homo sapiens
aggtgaatgcctgaggcctctg

SEQ ID NO: 8199005 - DNA, 22 bp, Homo sapiens
aggtgaagttgaggaggcagaa

SEQ ID NO: 8199006 - DNA, 22 bp, Homo sapiens
aggtgaagttgaggaggcagaa

SEQ ID NO: 8199007 - DNA, 22 bp, Homo sapiens
aggtgaagttgaggaggcagaa

SEQ ID NO: 8199008 - DNA, 22 bp, Homo sapiens
aggtgacaggacaggagctggt

SEQ ID NO: 8199009 - DNA, 22 bp, Homo sapiens
aggtgacaggacaggagctggt

SEQ ID NO: 8199010 - DNA, 22 bp, Homo sapiens
aggtgacaggatgcagataaac

SEQ ID NO: 8199011 - DNA, 22 bp, Homo sapiens
aggtgacatcccggcagcagag

SEQ ID NO: 8199012 - DNA, 22 bp, Homo sapiens
aggtgacatcccggcagcagag

SEQ ID NO: 8199013 - DNA, 22 bp, Homo sapiens
aggtgacatcccggcagcagag

SEQ ID NO: 8199014 - DNA, 22 bp, Homo sapiens
aggtgacatgaaaaatgttgag

SEQ ID NO: 8199015 - DNA, 19 bp, Homo sapiens
aggtgacatgtgacagcct

SEQ ID NO: 8199016 - DNA, 22 bp, Homo sapiens
actcctgggtgctgaccagcgt

SEQ ID NO: 8199017 - DNA, 22 bp, Homo sapiens
actcctgggttccggagattct

SEQ ID NO: 8199018 - DNA, 22 bp, Homo sapiens
agtcaccaggttttagagacct

SEQ ID NO: 8199019 - DNA, 22 bp, Homo sapiens
agtcaccattttcacctgcctc

SEQ ID NO: 8199020 - DNA, 22 bp, Homo sapiens
agtcaccatctgtggcagcctg

SEQ ID NO: 8199021 - DNA, 22 bp, Homo sapiens
agtcaccctccaactctccact

SEQ ID NO: 8199022 - DNA, 22 bp, Homo sapiens
agtcactctgctacatgacagc

SEQ ID NO: 8199023 - DNA, 22 bp, Homo sapiens
actcctggggatccattccttt

SEQ ID NO: 8199024 - DNA, 22 bp, Homo sapiens
actcctggaaaagaacgcaggg

SEQ ID NO: 8199025 - DNA, 22 bp, Homo sapiens
actcctgcttcttccctgagga

SEQ ID NO: 8199026 - DNA, 22 bp, Homo sapiens
actcctggggatccattccttt

SEQ ID NO: 8199027 - DNA, 22 bp, Homo sapiens
actcctggggctgccatcacag

SEQ ID NO: 8199028 - DNA, 22 bp, Homo sapiens
actcctggggctgccatcacag

SEQ ID NO: 8199029 - DNA, 22 bp, Homo sapiens
actcctgggtgcatttctgatt

SEQ ID NO: 8199030 - DNA, 22 bp, Homo sapiens
actcctgggtgctgaccagcgt

SEQ ID NO: 8199031 - DNA, 22 bp, Homo sapiens
actcctgggtgctgaccagcgt

SEQ ID NO: 8199032 - DNA, 22 bp, Homo sapiens
actcctgggtgcatttctgatt

SEQ ID NO: 8199033 - DNA, 21 bp, Homo sapiens
actccctgcataagtgattta

SEQ ID NO: 8199034 - DNA, 21 bp, Homo sapiens
actccctgcataagtgattta

SEQ ID NO: 8199035 - DNA, 22 bp, Homo sapiens
actccctgcaagattttccatg

SEQ ID NO: 8199036 - DNA, 22 bp, Homo sapiens
actccctctctagtccttgcaa

SEQ ID NO: 8199037 - DNA, 22 bp, Homo sapiens
actccagggttttgcacctgga

SEQ ID NO: 8199038 - DNA, 22 bp, Homo sapiens
actccctccaaatctgcacagt

SEQ ID NO: 8199039 - DNA, 22 bp, Homo sapiens
actcctcagccagcatcaggga

SEQ ID NO: 8199040 - DNA, 22 bp, Homo sapiens
actcctgcttcttccctgagga

SEQ ID NO: 8199041 - DNA, 22 bp, Homo sapiens
actcctgctgtcactgcagttc

SEQ ID NO: 8199042 - DNA, 22 bp, Homo sapiens
actcctgccacacagatgctgt

SEQ ID NO: 8199043 - DNA, 22 bp, Homo sapiens
actctctgtgatggaggccagc

SEQ ID NO: 8199044 - DNA, 22 bp, Homo sapiens
actctcttgggggagagcagag

SEQ ID NO: 8199045 - DNA, 22 bp, Homo sapiens
actctctgagctaccaggtgag

SEQ ID NO: 8199046 - DNA, 22 bp, Homo sapiens
actctctctgatggaactttag

SEQ ID NO: 8199047 - DNA, 22 bp, Homo sapiens
actctctctgatggaactttag

SEQ ID NO: 8199048 - DNA, 22 bp, Homo sapiens
actctcccttggagcctcaggc

SEQ ID NO: 8199049 - DNA, 22 bp, Homo sapiens
actctcccttggagcctcaggc

SEQ ID NO: 8199050 - DNA, 22 bp, Homo sapiens
actctctcacagcttggctgat

SEQ ID NO: 8199051 - DNA, 22 bp, Homo sapiens
actctctcacagcttggctgat

SEQ ID NO: 8199052 - DNA, 22 bp, Homo sapiens
actctctctgatggaactttag

SEQ ID NO: 8199053 - DNA, 22 bp, Homo sapiens
actctctcacagcttggctgat

SEQ ID NO: 8199054 - DNA, 22 bp, Homo sapiens
actctctcacacacgcctatat

SEQ ID NO: 8199055 - DNA, 22 bp, Homo sapiens
actctctcacagcttggctgat

SEQ ID NO: 8199056 - DNA, 22 bp, Homo sapiens
actctctcacagcttggctgat

SEQ ID NO: 8199057 - DNA, 22 bp, Homo sapiens
actctctcacacacgcctatat

SEQ ID NO: 8199058 - DNA, 22 bp, Homo sapiens
actctctcacacacgcctatat

SEQ ID NO: 8199059 - DNA, 22 bp, Homo sapiens
agtcacttcatggtttcttgga

SEQ ID NO: 8199060 - DNA, 22 bp, Homo sapiens
actctaaaccccactctgctgg

SEQ ID NO: 8199061 - DNA, 22 bp, Homo sapiens
actctaaatagataaccatgca

SEQ ID NO: 8199062 - DNA, 22 bp, Homo sapiens
actctaaaccccactctgctgg

SEQ ID NO: 8199063 - DNA, 22 bp, Homo sapiens
actctaaatagcctcttaaaca

SEQ ID NO: 8199064 - DNA, 22 bp, Homo sapiens
agtcactgtttcagaactgagt

SEQ ID NO: 8199065 - DNA, 22 bp, Homo sapiens
agtcacttaacatttgctgcag

SEQ ID NO: 8199066 - DNA, 22 bp, Homo sapiens
agtcacttaatctaagtctcag

SEQ ID NO: 8199067 - DNA, 22 bp, Homo sapiens
agtcacttaatctaagtctcag

SEQ ID NO: 8199068 - DNA, 22 bp, Homo sapiens
agtcacttcatggtttcttgga

SEQ ID NO: 8199069 - DNA, 22 bp, Homo sapiens
agtcactgggctgcttcctata

SEQ ID NO: 8199070 - DNA, 22 bp, Homo sapiens
agtcactggttctgtaattaat

SEQ ID NO: 8199071 - DNA, 22 bp, Homo sapiens
agtcactgagatggtgaggcta

SEQ ID NO: 8199072 - DNA, 22 bp, Homo sapiens
agtcactgggctgcttcctata

SEQ ID NO: 8199073 - DNA, 21 bp, Homo sapiens
agtagtttagcacagggtttg

SEQ ID NO: 8199074 - DNA, 22 bp, Homo sapiens
agtataattagatatcaaaagt

SEQ ID NO: 8199075 - DNA, 22 bp, Homo sapiens
agtataaagtggttttcagcac

SEQ ID NO: 8199076 - DNA, 22 bp, Homo sapiens
agtataaagtggttttcagcac

SEQ ID NO: 8199077 - DNA, 22 bp, Homo sapiens
agtatacagtaatgacatatct

SEQ ID NO: 8199078 - DNA, 22 bp, Homo sapiens
agtatacagtaatgacatatct

SEQ ID NO: 8199079 - DNA, 22 bp, Homo sapiens
agtatacagtaatgacatatct

SEQ ID NO: 8199080 - DNA, 22 bp, Homo sapiens
agtatacaaataaatgtgtaat

SEQ ID NO: 8199081 - DNA, 22 bp, Homo sapiens
agtatacaaataaatgtgtaat

SEQ ID NO: 8199082 - DNA, 22 bp, Homo sapiens
agtatacaaataaatgtgtaat

SEQ ID NO: 8199083 - DNA, 22 bp, Homo sapiens
agtatacagtaatgacatatct

SEQ ID NO: 8199084 - DNA, 22 bp, Homo sapiens
agtatacaaataaatgtgtaat

SEQ ID NO: 8199085 - DNA, 22 bp, Homo sapiens
agtactttgcactttgctcaga

SEQ ID NO: 8199086 - DNA, 22 bp, Homo sapiens
agtactttacttcttacagttt

SEQ ID NO: 8199087 - DNA, 20 bp, Homo sapiens
agtaccttttgtatgttacc

SEQ ID NO: 8199088 - DNA, 22 bp, Homo sapiens
agtacccttttcactgtcacaa

SEQ ID NO: 8199089 - DNA, 22 bp, Homo sapiens
agtactttttgttcaattgtgc

SEQ ID NO: 8199090 - DNA, 22 bp, Homo sapiens
agtacttttttgatatctgagt

SEQ ID NO: 8199091 - DNA, 22 bp, Homo sapiens
agtagaaagaaggcactgggcc

SEQ ID NO: 8199092 - DNA, 22 bp, Homo sapiens
agtagaaagaaggcactgggcc

SEQ ID NO: 8199093 - DNA, 22 bp, Homo sapiens
agtagtgtacatctgttgattt

SEQ ID NO: 8199094 - DNA, 22 bp, Homo sapiens
aggtgggcggattcatgaggtc

SEQ ID NO: 8199095 - DNA, 22 bp, Homo sapiens
aggtgggcggattcatgaggtc

SEQ ID NO: 8199096 - DNA, 22 bp, Homo sapiens
aggtggggaaaccagcgatccc

SEQ ID NO: 8199097 - DNA, 22 bp, Homo sapiens
aggtggggaaaccagcgatccc

SEQ ID NO: 8199098 - DNA, 22 bp, Homo sapiens
aggtggggaaaccagcgatccc

SEQ ID NO: 8199099 - DNA, 22 bp, Homo sapiens
aggtggggaaaccagcgatccc

SEQ ID NO: 8199100 - DNA, 22 bp, Homo sapiens
aggtgggcggattcatgaggtc

SEQ ID NO: 8199101 - DNA, 22 bp, Homo sapiens
aggtgggcggattcatgaggtc

SEQ ID NO: 8199102 - DNA, 21 bp, Homo sapiens
aggtgggcaggtggagtggcc

SEQ ID NO: 8199103 - DNA, 21 bp, Homo sapiens
aggtgggcaggtggagtggcc

SEQ ID NO: 8199104 - DNA, 22 bp, Homo sapiens
agtacatgtggtcctggccaga

SEQ ID NO: 8199105 - DNA, 23 bp, Homo sapiens
agtacattcgaaaaattctgtga

SEQ ID NO: 8199106 - DNA, 22 bp, Homo sapiens
agtacatttattaatggtaaaa

SEQ ID NO: 8199107 - DNA, 21 bp, Homo sapiens
agtacatctcaaatgtaaatc

SEQ ID NO: 8199108 - DNA, 22 bp, Homo sapiens
agtaataatttatattagggag

SEQ ID NO: 8199109 - DNA, 22 bp, Homo sapiens
agtaccattatccagtaaagga

SEQ ID NO: 8199110 - DNA, 22 bp, Homo sapiens
agtacccttttcactgtcacaa

SEQ ID NO: 8199111 - DNA, 22 bp, Homo sapiens
agtaccattatccagtaaagga

SEQ ID NO: 8199112 - DNA, 22 bp, Homo sapiens
agtaccattagattaggatgac

SEQ ID NO: 8199113 - DNA, 22 bp, Homo sapiens
agtaccatcatttagatgtgtt

SEQ ID NO: 8199114 - DNA, 21 bp, Homo sapiens
actggctgtcttcctactggt

SEQ ID NO: 8199115 - DNA, 22 bp, Homo sapiens
actggctgtgcagagggcagta

SEQ ID NO: 8199116 - DNA, 22 bp, Homo sapiens
actggctgtgcagagggcagta

SEQ ID NO: 8199117 - DNA, 21 bp, Homo sapiens
actggctgtcttcctactggt

SEQ ID NO: 8199118 - DNA, 21 bp, Homo sapiens
actggctggtggctaagaatc

SEQ ID NO: 8199119 - DNA, 21 bp, Homo sapiens
actggctggtggctaagaatc

SEQ ID NO: 8199120 - DNA, 22 bp, Homo sapiens
actggctggccacaccctggta

SEQ ID NO: 8199121 - DNA, 22 bp, Homo sapiens
actggctggccgcgctcttcgc

SEQ ID NO: 8199122 - DNA, 21 bp, Homo sapiens
actggctggtggctaagaatc

SEQ ID NO: 8199123 - DNA, 21 bp, Homo sapiens
actggctggctgagtttcctg

SEQ ID NO: 8199124 - DNA, 22 bp, Homo sapiens
actggctgtgtaacctcaggca

SEQ ID NO: 8199125 - DNA, 22 bp, Homo sapiens
actggctgtgcccatagagctc

SEQ ID NO: 8199126 - DNA, 22 bp, Homo sapiens
actggctgtggccacggctgct

SEQ ID NO: 8199127 - DNA, 22 bp, Homo sapiens
agtgtcctggcaagggtttcag

SEQ ID NO: 8199128 - DNA, 22 bp, Homo sapiens
agtgtcctggggccctaaggcc

SEQ ID NO: 8199129 - DNA, 22 bp, Homo sapiens
agtgtcctggcaagggtttcag

SEQ ID NO: 8199130 - DNA, 22 bp, Homo sapiens
agtgtcctgtgtcccagactgt

SEQ ID NO: 8199131 - DNA, 22 bp, Homo sapiens
agtgtcctggggccctaaggcc

SEQ ID NO: 8199132 - DNA, 22 bp, Homo sapiens
agtgtcctggggccctaaggcc

SEQ ID NO: 8199133 - DNA, 20 bp, Homo sapiens
actgggcatacctgtcctgt

SEQ ID NO: 8199134 - DNA, 22 bp, Homo sapiens
actgggcagcagctcgagccgc

SEQ ID NO: 8199135 - DNA, 22 bp, Homo sapiens
actgggcagggaaggagaccga

SEQ ID NO: 8199136 - DNA, 22 bp, Homo sapiens
actgggaggcaaagagcaagga

SEQ ID NO: 8199137 - DNA, 21 bp, Homo sapiens
agtgtctctggaagcacgtgt

SEQ ID NO: 8199138 - DNA, 21 bp, Homo sapiens
agtgtccttttactgtgaata

SEQ ID NO: 8199139 - DNA, 21 bp, Homo sapiens
agtgtccttttactgtgaata

SEQ ID NO: 8199140 - DNA, 22 bp, Homo sapiens
agtgtcctttctgttccagcca

SEQ ID NO: 8199141 - DNA, 22 bp, Homo sapiens
agtgtctcagccccaactagag

SEQ ID NO: 8199142 - DNA, 22 bp, Homo sapiens
agtgtcctttctgttccagcca

SEQ ID NO: 8199143 - DNA, 22 bp, Homo sapiens
agtgtccttgttattactgctc

SEQ ID NO: 8199144 - DNA, 22 bp, Homo sapiens
agtgtccttgttattactgctc

SEQ ID NO: 8199145 - DNA, 22 bp, Homo sapiens
agtgtccttgttattactgctc

SEQ ID NO: 8199146 - DNA, 22 bp, Homo sapiens
agtgtccttgattcctgttgtt

SEQ ID NO: 8199147 - DNA, 22 bp, Homo sapiens
agtgtccttgaggttcctagga

SEQ ID NO: 8199148 - DNA, 21 bp, Homo sapiens
agtgtccttgatcttgccttg

SEQ ID NO: 8199149 - DNA, 21 bp, Homo sapiens
agtgtccttgatcttgccttg

SEQ ID NO: 8199150 - DNA, 21 bp, Homo sapiens
agtgtccttgatcttgccttg

SEQ ID NO: 8199151 - DNA, 22 bp, Homo sapiens
agtgtccttgattcctgttgtt

SEQ ID NO: 8199152 - DNA, 21 bp, Homo sapiens
agtgtccttgatcttgccttg

SEQ ID NO: 8199153 - DNA, 21 bp, Homo sapiens
agtgtccttgatcttgccttg

SEQ ID NO: 8199154 - DNA, 22 bp, Homo sapiens
agtgtccttgaggttcctagga

SEQ ID NO: 8199155 - DNA, 22 bp, Homo sapiens
agtgtccttagttagctttggg

SEQ ID NO: 8199156 - DNA, 22 bp, Homo sapiens
agtgtccttagttagctttggg

SEQ ID NO: 8199157 - DNA, 22 bp, Homo sapiens
agtgtcctgtgtcccagactgt

SEQ ID NO: 8199158 - DNA, 22 bp, Homo sapiens
agtgtccttagttagctttggg

SEQ ID NO: 8199159 - DNA, 22 bp, Homo sapiens
actgggcattttgaacgttctt

SEQ ID NO: 8199160 - DNA, 22 bp, Homo sapiens
actgggcatcccatggcagagc

SEQ ID NO: 8199161 - DNA, 22 bp, Homo sapiens
actgggcatgatgagtcaccta

SEQ ID NO: 8199162 - DNA, 20 bp, Homo sapiens
actgggcatacctgtcctgt

SEQ ID NO: 8199163 - DNA, 18 bp, Homo sapiens
actgggccagcaggcagg

SEQ ID NO: 8199164 - DNA, 22 bp, Homo sapiens
actgggcctggattggcgtgtc

SEQ ID NO: 8199165 - DNA, 22 bp, Homo sapiens
actgggccgcgctgcagagggc

SEQ ID NO: 8199166 - DNA, 22 bp, Homo sapiens
actgggccggtgcagagtagtt

SEQ ID NO: 8199167 - DNA, 22 bp, Homo sapiens
actggctgcgatcttggcgctt

SEQ ID NO: 8199168 - DNA, 20 bp, Homo sapiens
actggctgcctggaatgcgc

SEQ ID NO: 8199169 - DNA, 20 bp, Homo sapiens
actggctgcctggaatgcgc

SEQ ID NO: 8199170 - DNA, 22 bp, Homo sapiens
actggctgcggggtggaagaag

SEQ ID NO: 8199171 - DNA, 22 bp, Homo sapiens
actggctggagttgccaaggct

SEQ ID NO: 8199172 - DNA, 22 bp, Homo sapiens
actggctggactctgacctctt

SEQ ID NO: 8199173 - DNA, 22 bp, Homo sapiens
actggctggactctgacctctt

SEQ ID NO: 8199174 - DNA, 22 bp, Homo sapiens
actggctgcgttcctgtgagac

SEQ ID NO: 8199175 - DNA, 22 bp, Homo sapiens
actggctgcgttcctgtgagac

SEQ ID NO: 8199176 - DNA, 21 bp, Homo sapiens
actggctgccatgatccaggg

SEQ ID NO: 8199177 - DNA, 22 bp, Homo sapiens
actggctgcctccaaagtgtgc

SEQ ID NO: 8199178 - DNA, 22 bp, Homo sapiens
actggctgcctccaaagtgtgc

SEQ ID NO: 8199179 - DNA, 22 bp, Homo sapiens
actggctgatcacctgcctcag

SEQ ID NO: 8199180 - DNA, 22 bp, Homo sapiens
actggctgatcacctgcctcag

SEQ ID NO: 8199181 - DNA, 21 bp, Homo sapiens
actggccaccactggcagggg

SEQ ID NO: 8199182 - DNA, 21 bp, Homo sapiens
actggccaccactggcagggg

SEQ ID NO: 8199183 - DNA, 22 bp, Homo sapiens
actgcctgtagctcttcatctc

SEQ ID NO: 8199184 - DNA, 21 bp, Homo sapiens
actggccaccactggcagggg

SEQ ID NO: 8199185 - DNA, 22 bp, Homo sapiens
actggctgatatggctaggaag

SEQ ID NO: 8199186 - DNA, 19 bp, Homo sapiens
actgcctgaggctcacagg

SEQ ID NO: 8199187 - DNA, 22 bp, Homo sapiens
actgcctgatgtggttctaaat

SEQ ID NO: 8199188 - DNA, 22 bp, Homo sapiens
actgcctgctcataacattgct

SEQ ID NO: 8199189 - DNA, 23 bp, Homo sapiens
actgccagttttaccacagacgg

SEQ ID NO: 8199190 - DNA, 22 bp, Homo sapiens
actgccaggtgctccatctgaa

SEQ ID NO: 8199191 - DNA, 22 bp, Homo sapiens
actgccaggtaagtgctcctgc

SEQ ID NO: 8199192 - DNA, 22 bp, Homo sapiens
actgccaggatggcactagagg

SEQ ID NO: 8199193 - DNA, 22 bp, Homo sapiens
actgccaggatggcactagagg

SEQ ID NO: 8199194 - DNA, 21 bp, Homo sapiens
actgccaggagagtaggggga

SEQ ID NO: 8199195 - DNA, 21 bp, Homo sapiens
actgccaggagagtaggggga

SEQ ID NO: 8199196 - DNA, 22 bp, Homo sapiens
actgccaatggtagtttgatgg

SEQ ID NO: 8199197 - DNA, 22 bp, Homo sapiens
actgccaatggtagtttgatgg

SEQ ID NO: 8199198 - DNA, 22 bp, Homo sapiens
actgcccagtgattggtggtta

SEQ ID NO: 8199199 - DNA, 22 bp, Homo sapiens
actgccctcccatctattgcaa

SEQ ID NO: 8199200 - DNA, 22 bp, Homo sapiens
actgccctccagcctgggtgac

SEQ ID NO: 8199201 - DNA, 22 bp, Homo sapiens
actgccctccagcctgggtgac

SEQ ID NO: 8199202 - DNA, 22 bp, Homo sapiens
actgcctcttggtgctgagaga

SEQ ID NO: 8199203 - DNA, 22 bp, Homo sapiens
actgcctgagctattggaaaag

SEQ ID NO: 8199204 - DNA, 22 bp, Homo sapiens
actgccctgtaactgccaggta

SEQ ID NO: 8199205 - DNA, 22 bp, Homo sapiens
actgcccttgtcctggcacacc

SEQ ID NO: 8199206 - DNA, 22 bp, Homo sapiens
actctgaagaagacttccagac

SEQ ID NO: 8199207 - DNA, 22 bp, Homo sapiens
actctgaatgtgcatgtaaatc

SEQ ID NO: 8199208 - DNA, 22 bp, Homo sapiens
actctgaattaattgctctcaa

SEQ ID NO: 8199209 - DNA, 22 bp, Homo sapiens
actctgaagaagacttccagac

SEQ ID NO: 8199210 - DNA, 22 bp, Homo sapiens
actctgaactccaggaggctca

SEQ ID NO: 8199211 - DNA, 22 bp, Homo sapiens
actctgaactccaggaggctca

SEQ ID NO: 8199212 - DNA, 22 bp, Homo sapiens
actctgaaccagagatcatacc

SEQ ID NO: 8199213 - DNA, 22 bp, Homo sapiens
actctgaaatagaggctggtgg

SEQ ID NO: 8199214 - DNA, 22 bp, Homo sapiens
actctgaaacttgcaacacatt

SEQ ID NO: 8199215 - DNA, 21 bp, Homo sapiens
actctgaaaattaatagttat

SEQ ID NO: 8199216 - DNA, 22 bp, Homo sapiens
actctgaaccaattcgcaatga

SEQ ID NO: 8199217 - DNA, 22 bp, Homo sapiens
actctgaaccagagatcatacc

SEQ ID NO: 8199218 - DNA, 22 bp, Homo sapiens
actctgaaccagagatcatacc

SEQ ID NO: 8199219 - DNA, 22 bp, Homo sapiens
actctgaggagtgactagaggt

SEQ ID NO: 8199220 - DNA, 19 bp, Homo sapiens
actctgaggctgagacaag

SEQ ID NO: 8199221 - DNA, 22 bp, Homo sapiens
actctgagcatcccaagtctta

SEQ ID NO: 8199222 - DNA, 22 bp, Homo sapiens
actctgagaaaacactatgctg

SEQ ID NO: 8199223 - DNA, 18 bp, Homo sapiens
actctgcggaggccccag

SEQ ID NO: 8199224 - DNA, 22 bp, Homo sapiens
actctgcctttcagcagatgaa

SEQ ID NO: 8199225 - DNA, 18 bp, Homo sapiens
actctgcggaggccccag

SEQ ID NO: 8199226 - DNA, 22 bp, Homo sapiens
actgaatttgtgtagatggtct

SEQ ID NO: 8199227 - DNA, 22 bp, Homo sapiens
actgaattttaattagatctgc

SEQ ID NO: 8199228 - DNA, 21 bp, Homo sapiens
actctgccagtctcctgcact

SEQ ID NO: 8199229 - DNA, 22 bp, Homo sapiens
actctgcaatgtggcaagaaca

SEQ ID NO: 8199230 - DNA, 22 bp, Homo sapiens
actctgcctgaacctcctgcaa

SEQ ID NO: 8199231 - DNA, 22 bp, Homo sapiens
actgagcagggttccgcatgga

SEQ ID NO: 8199232 - DNA, 22 bp, Homo sapiens
actgagagttgaaaagggagga

SEQ ID NO: 8199233 - DNA, 22 bp, Homo sapiens
actgagagtcttagaaacacat

SEQ ID NO: 8199234 - DNA, 22 bp, Homo sapiens
actgagagttgtgcattcatgc

SEQ ID NO: 8199235 - DNA, 22 bp, Homo sapiens
actgagatttacatgttctagt

SEQ ID NO: 8199236 - DNA, 22 bp, Homo sapiens
actgagagggaggctgtccggt

SEQ ID NO: 8199237 - DNA, 22 bp, Homo sapiens
actgagaggtgatagtgacatt

SEQ ID NO: 8199238 - DNA, 22 bp, Homo sapiens
actgagaggtgatagtgacatt

SEQ ID NO: 8199239 - DNA, 22 bp, Homo sapiens
actgagaggtgatagtgacatt

SEQ ID NO: 8199240 - DNA, 22 bp, Homo sapiens
actgagagtcaagatagcatgg

SEQ ID NO: 8199241 - DNA, 22 bp, Homo sapiens
actgagagcgtgtacaaactta

SEQ ID NO: 8199242 - DNA, 22 bp, Homo sapiens
actgagaggaaattgagactat

SEQ ID NO: 8199243 - DNA, 22 bp, Homo sapiens
actgagagagctgggtatctcc

SEQ ID NO: 8199244 - DNA, 22 bp, Homo sapiens
actgagagagctgggtatctcc

SEQ ID NO: 8199245 - DNA, 22 bp, Homo sapiens
actgagagagctgggtatctcc

SEQ ID NO: 8199246 - DNA, 22 bp, Homo sapiens
actgaattttcacttattttag

SEQ ID NO: 8199247 - DNA, 22 bp, Homo sapiens
actgagccttgaagctagatag

SEQ ID NO: 8199248 - DNA, 22 bp, Homo sapiens
actgagccttgaagctagatag

SEQ ID NO: 8199249 - DNA, 22 bp, Homo sapiens
actgagctccctgagggcaggc

SEQ ID NO: 8199250 - DNA, 22 bp, Homo sapiens
agtgaaatttgtttagataggt

SEQ ID NO: 8199251 - DNA, 22 bp, Homo sapiens
actgagcctctcttcccacctc

SEQ ID NO: 8199252 - DNA, 22 bp, Homo sapiens
actgagcctgtgccctcatcag

SEQ ID NO: 8199253 - DNA, 23 bp, Homo sapiens
actgagccagggcctgggtcagc

SEQ ID NO: 8199254 - DNA, 22 bp, Homo sapiens
agtgaagaggaagtggggcaca

SEQ ID NO: 8199255 - DNA, 22 bp, Homo sapiens
agtgaagaggaagtggggcaca

SEQ ID NO: 8199256 - DNA, 22 bp, Homo sapiens
agtgaacagtttggaacacatg

SEQ ID NO: 8199257 - DNA, 19 bp, Homo sapiens
agtgaactccatatcaggt

SEQ ID NO: 8199258 - DNA, 22 bp, Homo sapiens
actgcactcctgcctgggtaac

SEQ ID NO: 8199259 - DNA, 22 bp, Homo sapiens
actgcactcctgcctgggtaac

SEQ ID NO: 8199260 - DNA, 22 bp, Homo sapiens
actgcacttacatagaggaggc

SEQ ID NO: 8199261 - DNA, 22 bp, Homo sapiens
actgcacttcaccctgggtgac

SEQ ID NO: 8199262 - DNA, 22 bp, Homo sapiens
actgcactccagcctgggtgat

SEQ ID NO: 8199263 - DNA, 22 bp, Homo sapiens
actgcactccagcctgggtgat

SEQ ID NO: 8199264 - DNA, 22 bp, Homo sapiens
actgcactccagcctgggtgat

SEQ ID NO: 8199265 - DNA, 22 bp, Homo sapiens
actgcacatagtgggctggcct

SEQ ID NO: 8199266 - DNA, 22 bp, Homo sapiens
agtgaatacatgtcactcagca

SEQ ID NO: 8199267 - DNA, 20 bp, Homo sapiens
agtgaatagagacattgccc

SEQ ID NO: 8199268 - DNA, 22 bp, Homo sapiens
agtgaagaggaagtggggcaca

SEQ ID NO: 8199269 - DNA, 22 bp, Homo sapiens
agtgaagatatactgttgtcct

SEQ ID NO: 8199270 - DNA, 22 bp, Homo sapiens
agtgctccacattgcactattc

SEQ ID NO: 8199271 - DNA, 23 bp, Homo sapiens
agtgctcccaggacctggggcag

SEQ ID NO: 8199272 - DNA, 22 bp, Homo sapiens
agtgctccaaaggttggtcatt

SEQ ID NO: 8199273 - DNA, 23 bp, Homo sapiens
agtgctcagggcattaggctaga

SEQ ID NO: 8199274 - DNA, 23 bp, Homo sapiens
agtgctcagggcattaggctaga

SEQ ID NO: 8199275 - DNA, 22 bp, Homo sapiens
agtgctcactctccacagtgcc

SEQ ID NO: 8199276 - DNA, 22 bp, Homo sapiens
agtgctcacctgtcaggtcaag

SEQ ID NO: 8199277 - DNA, 22 bp, Homo sapiens
actgcacttcaccctgggtgac

SEQ ID NO: 8199278 - DNA, 22 bp, Homo sapiens
actgcacttcagcctgggtgac

SEQ ID NO: 8199279 - DNA, 22 bp, Homo sapiens
actgcacttcaccctgggtgac

SEQ ID NO: 8199280 - DNA, 22 bp, Homo sapiens
agtgctcctcagaagagttgga

SEQ ID NO: 8199281 - DNA, 22 bp, Homo sapiens
agtgctcctcagaagagttgga

SEQ ID NO: 8199282 - DNA, 22 bp, Homo sapiens
agtgctcctatggatcagttgt

SEQ ID NO: 8199283 - DNA, 22 bp, Homo sapiens
agtgctccctagagttgtgcaa

SEQ ID NO: 8199284 - DNA, 22 bp, Homo sapiens
agtgctcctgaagcttgaggca

SEQ ID NO: 8199285 - DNA, 22 bp, Homo sapiens
agtgctcctgccagctttctgg

SEQ ID NO: 8199286 - DNA, 22 bp, Homo sapiens
agtgctcctttcattgctgccc

SEQ ID NO: 8199287 - DNA, 22 bp, Homo sapiens
actgccaatggtagtttgatgg

SEQ ID NO: 8199288 - DNA, 23 bp, Homo sapiens
actgcagcctccgcctgccgggt

SEQ ID NO: 8199289 - DNA, 22 bp, Homo sapiens
actgcagcctagggaccacagt

SEQ ID NO: 8199290 - DNA, 22 bp, Homo sapiens
agtgctctgtcattggtgggat

SEQ ID NO: 8199291 - DNA, 22 bp, Homo sapiens
agtgctctgtcattggtgggat

SEQ ID NO: 8199292 - DNA, 21 bp, Homo sapiens
agtgctgaaaaagcatgtctc

SEQ ID NO: 8199293 - DNA, 22 bp, Homo sapiens
atccccagaaaataggtgccta

SEQ ID NO: 8199294 - DNA, 22 bp, Homo sapiens
agaacagggactggaggcttca

SEQ ID NO: 8199295 - DNA, 22 bp, Homo sapiens
agaacagtcgtggtgagagaaa

SEQ ID NO: 8199296 - DNA, 22 bp, Homo sapiens
atccccagaaaataggtgccta

SEQ ID NO: 8199297 - DNA, 22 bp, Homo sapiens
agaacatatctgttttctaact

SEQ ID NO: 8199298 - DNA, 22 bp, Homo sapiens
agaacatatctgttttctaact

SEQ ID NO: 8199299 - DNA, 22 bp, Homo sapiens
agaacatttgtcgatcaatttg

SEQ ID NO: 8199300 - DNA, 22 bp, Homo sapiens
agaacatttgtcaaaaagccaa

SEQ ID NO: 8199301 - DNA, 22 bp, Homo sapiens
agaacattaatgcgaggtatta

SEQ ID NO: 8199302 - DNA, 22 bp, Homo sapiens
atctctggcaatgcagcatcgt

SEQ ID NO: 8199303 - DNA, 22 bp, Homo sapiens
atctctggcccctggggtccga

SEQ ID NO: 8199304 - DNA, 19 bp, Homo sapiens
atcccaaggagctgggact

SEQ ID NO: 8199305 - DNA, 22 bp, Homo sapiens
atcccacacccctacaacatat

SEQ ID NO: 8199306 - DNA, 22 bp, Homo sapiens
atcccacacccctacaacatat

SEQ ID NO: 8199307 - DNA, 22 bp, Homo sapiens
atcccagatagtgaccctcagg

SEQ ID NO: 8199308 - DNA, 22 bp, Homo sapiens
atcccagatggaggctggtcac

SEQ ID NO: 8199309 - DNA, 21 bp, Homo sapiens
atcccagcacccaggagtgca

SEQ ID NO: 8199310 - DNA, 22 bp, Homo sapiens
atcccaggcggcacaggttgca

SEQ ID NO: 8199311 - DNA, 22 bp, Homo sapiens
atcccaggaggctgcgcagtta

SEQ ID NO: 8199312 - DNA, 22 bp, Homo sapiens
atcccatagggttatcataggg

SEQ ID NO: 8199313 - DNA, 22 bp, Homo sapiens
atccaggcattctgacttcaag

SEQ ID NO: 8199314 - DNA, 22 bp, Homo sapiens
agaaatcctgatggagtctgaa

SEQ ID NO: 8199315 - DNA, 22 bp, Homo sapiens
agaaatctgactgctgtgcaca

SEQ ID NO: 8199316 - DNA, 22 bp, Homo sapiens
agaaggcacagtgctgctaaga

SEQ ID NO: 8199317 - DNA, 22 bp, Homo sapiens
agaaggagtgtacaggtcatgc

SEQ ID NO: 8199318 - DNA, 22 bp, Homo sapiens
agaaggcaccgtggccaatatt

SEQ ID NO: 8199319 - DNA, 22 bp, Homo sapiens
agaaggcaccgtggccaatatt

SEQ ID NO: 8199320 - DNA, 22 bp, Homo sapiens
agaaggcaccgtggccaatatt

SEQ ID NO: 8199321 - DNA, 21 bp, Homo sapiens
agaaggcaccagcaaggactg

SEQ ID NO: 8199322 - DNA, 21 bp, Homo sapiens
agaaggcaccagcaaggactg

SEQ ID NO: 8199323 - DNA, 22 bp, Homo sapiens
agaaggcacagtgctgctaaga

SEQ ID NO: 8199324 - DNA, 22 bp, Homo sapiens
agaaggagtgtacaggtcatgc

SEQ ID NO: 8199325 - DNA, 22 bp, Homo sapiens
agaagccacaggcctcgtctgg

SEQ ID NO: 8199326 - DNA, 22 bp, Homo sapiens
agaagccacaggcctcgtctgg

SEQ ID NO: 8199327 - DNA, 22 bp, Homo sapiens
agaagccacaggcctcgtctgg

SEQ ID NO: 8199328 - DNA, 22 bp, Homo sapiens
agaaggcagatgggacggagca

SEQ ID NO: 8199329 - DNA, 22 bp, Homo sapiens
agaaggcagatgggacggagca

SEQ ID NO: 8199330 - DNA, 22 bp, Homo sapiens
agaaggcagatgggacggagca

SEQ ID NO: 8199331 - DNA, 22 bp, Homo sapiens
agaaggcagatgggacggagca

SEQ ID NO: 8199332 - DNA, 22 bp, Homo sapiens
agaaggcagatgggacggagca

SEQ ID NO: 8199333 - DNA, 22 bp, Homo sapiens
agaaggcactcacactggcacg

SEQ ID NO: 8199334 - DNA, 22 bp, Homo sapiens
agaaggcactcacactggcacg

SEQ ID NO: 8199335 - DNA, 22 bp, Homo sapiens
agaaggcagaaagtccaggtat

SEQ ID NO: 8199336 - DNA, 22 bp, Homo sapiens
atctgcccttgattgccctagg

SEQ ID NO: 8199337 - DNA, 22 bp, Homo sapiens
atctgccctggggccaaaccca

SEQ ID NO: 8199338 - DNA, 22 bp, Homo sapiens
atctgccaatgccatgagaaga

SEQ ID NO: 8199339 - DNA, 22 bp, Homo sapiens
atctgccaatgccatgagaaga

SEQ ID NO: 8199340 - DNA, 20 bp, Homo sapiens
agaaggcaggagacaaaagg

SEQ ID NO: 8199341 - DNA, 22 bp, Homo sapiens
agaaggcatcagaagtgtgtag

SEQ ID NO: 8199342 - DNA, 22 bp, Homo sapiens
agaaggcaggttttaaaatgtc

SEQ ID NO: 8199343 - DNA, 22 bp, Homo sapiens
agaagccaattctgtgtgagtc

SEQ ID NO: 8199344 - DNA, 22 bp, Homo sapiens
agaagccaatccttgtctctct

SEQ ID NO: 8199345 - DNA, 22 bp, Homo sapiens
agaagccaatccttgtctctct

SEQ ID NO: 8199346 - DNA, 22 bp, Homo sapiens
agaagccaatccttgtctctct

SEQ ID NO: 8199347 - DNA, 22 bp, Homo sapiens
agaagccaatccttgtctctct

SEQ ID NO: 8199348 - DNA, 22 bp, Homo sapiens
agaagccaatcagctctctgct

SEQ ID NO: 8199349 - DNA, 22 bp, Homo sapiens
agaagccaatcagctctctgct

SEQ ID NO: 8199350 - DNA, 22 bp, Homo sapiens
agaagccacaggcctcgtctgg

SEQ ID NO: 8199351 - DNA, 22 bp, Homo sapiens
agaagccacaggaaagcagctt

SEQ ID NO: 8199352 - DNA, 22 bp, Homo sapiens
agaagccaattctgtgtgagtc

SEQ ID NO: 8199353 - DNA, 22 bp, Homo sapiens
agaagccaatcagctctctgct

SEQ ID NO: 8199354 - DNA, 22 bp, Homo sapiens
agaagccaatcagctctctgct

SEQ ID NO: 8199355 - DNA, 20 bp, Homo sapiens
agaagccaagtgacatgttt

SEQ ID NO: 8199356 - DNA, 22 bp, Homo sapiens
atctctggccttccttttccaa

SEQ ID NO: 8199357 - DNA, 22 bp, Homo sapiens
atctctgggctttgagtttgtt

SEQ ID NO: 8199358 - DNA, 22 bp, Homo sapiens
atctctggttgttttgctccca

SEQ ID NO: 8199359 - DNA, 22 bp, Homo sapiens
atctctggtccaaatgttacct

SEQ ID NO: 8199360 - DNA, 22 bp, Homo sapiens
atctctgggtccatagaagaga

SEQ ID NO: 8199361 - DNA, 22 bp, Homo sapiens
atctctggtccaaatgttacct

SEQ ID NO: 8199362 - DNA, 22 bp, Homo sapiens
atctctgggtccatagaagaga

SEQ ID NO: 8199363 - DNA, 22 bp, Homo sapiens
atctctgtaattacatgatatt

SEQ ID NO: 8199364 - DNA, 22 bp, Homo sapiens
atctcttctgagcaattcctgt

SEQ ID NO: 8199365 - DNA, 22 bp, Homo sapiens
atctcttctgagcaattcctgt

SEQ ID NO: 8199366 - DNA, 22 bp, Homo sapiens
atctcttctcccaacacctggc

SEQ ID NO: 8199367 - DNA, 22 bp, Homo sapiens
atatttttccatgtgggactct

SEQ ID NO: 8199368 - DNA, 22 bp, Homo sapiens
atatttttccatgtgggactct

SEQ ID NO: 8199369 - DNA, 22 bp, Homo sapiens
atatttttccatgtgggactct

SEQ ID NO: 8199370 - DNA, 22 bp, Homo sapiens
atatttttccatgtgggactct

SEQ ID NO: 8199371 - DNA, 22 bp, Homo sapiens
atattttgtaacttggaatagg

SEQ ID NO: 8199372 - DNA, 22 bp, Homo sapiens
atattttgtaacttggaatagg

SEQ ID NO: 8199373 - DNA, 22 bp, Homo sapiens
atattttgtaacttggaatagg

SEQ ID NO: 8199374 - DNA, 22 bp, Homo sapiens
atattttggtagctctcaatga

SEQ ID NO: 8199375 - DNA, 21 bp, Homo sapiens
atatttttgtttggactgtca

SEQ ID NO: 8199376 - DNA, 21 bp, Homo sapiens
atatttttgtttggactgtca

SEQ ID NO: 8199377 - DNA, 21 bp, Homo sapiens
atatttttgtttggactgtca

SEQ ID NO: 8199378 - DNA, 22 bp, Homo sapiens
atcaaaaccttgacttttaatg

SEQ ID NO: 8199379 - DNA, 22 bp, Homo sapiens
atcaaaaccttgacttttaatg

SEQ ID NO: 8199380 - DNA, 21 bp, Homo sapiens
atatttttgtttggactgtca

SEQ ID NO: 8199381 - DNA, 21 bp, Homo sapiens
atatttttgtttggactgtca

SEQ ID NO: 8199382 - DNA, 21 bp, Homo sapiens
atatttttgtttggactgtca

SEQ ID NO: 8199383 - DNA, 21 bp, Homo sapiens
atatttttgtttggactgtca

SEQ ID NO: 8199384 - DNA, 22 bp, Homo sapiens
atatttttccatgtgggactct

SEQ ID NO: 8199385 - DNA, 22 bp, Homo sapiens
atatttctccaaatgttttcaa

SEQ ID NO: 8199386 - DNA, 22 bp, Homo sapiens
atatttctccaaatgttttcaa

SEQ ID NO: 8199387 - DNA, 22 bp, Homo sapiens
atattttggtagctctcaatga

SEQ ID NO: 8199388 - DNA, 22 bp, Homo sapiens
agaaaaagtcaaggaattggac

SEQ ID NO: 8199389 - DNA, 22 bp, Homo sapiens
agaaaaactaagagtgggtggt

SEQ ID NO: 8199390 - DNA, 22 bp, Homo sapiens
acttttctaagcaatggtcttg

SEQ ID NO: 8199391 - DNA, 22 bp, Homo sapiens
acttttctccctcctgccttca

SEQ ID NO: 8199392 - DNA, 22 bp, Homo sapiens
acttttctccctcctgccttca

SEQ ID NO: 8199393 - DNA, 22 bp, Homo sapiens
acttttctgcagatgatctctt

SEQ ID NO: 8199394 - DNA, 23 bp, Homo sapiens
acttttcaattagctatgcttaa

SEQ ID NO: 8199395 - DNA, 22 bp, Homo sapiens
acttttcccttggtagagttgc

SEQ ID NO: 8199396 - DNA, 22 bp, Homo sapiens
acttttctgcagatgatctctt

SEQ ID NO: 8199397 - DNA, 22 bp, Homo sapiens
acttttcttatcagaaaggcca

SEQ ID NO: 8199398 - DNA, 22 bp, Homo sapiens
acttttgaagaattatgcaaaa

SEQ ID NO: 8199399 - DNA, 22 bp, Homo sapiens
actttttacagggtgtatacca

SEQ ID NO: 8199400 - DNA, 22 bp, Homo sapiens
actttttacagggtgtatacca

SEQ ID NO: 8199401 - DNA, 22 bp, Homo sapiens
acttttttataaggaagaagat

SEQ ID NO: 8199402 - DNA, 22 bp, Homo sapiens
actttttgcatagtaagtgtct

SEQ ID NO: 8199403 - DNA, 22 bp, Homo sapiens
actttttctcagaaggattggt

SEQ ID NO: 8199404 - DNA, 21 bp, Homo sapiens
agaaaaacacgatataagccc

SEQ ID NO: 8199405 - DNA, 21 bp, Homo sapiens
agaaaaacacgatataagccc

SEQ ID NO: 8199406 - DNA, 21 bp, Homo sapiens
agaaaaacacgatataagccc

SEQ ID NO: 8199407 - DNA, 22 bp, Homo sapiens
agaaagaggatgcagatctcat

SEQ ID NO: 8199408 - DNA, 22 bp, Homo sapiens
atcaaaatgctccagtgatggt

SEQ ID NO: 8199409 - DNA, 22 bp, Homo sapiens
atcaaaacttctttagagttta

SEQ ID NO: 8199410 - DNA, 22 bp, Homo sapiens
atcaaaacttctttagagttta

SEQ ID NO: 8199411 - DNA, 20 bp, Homo sapiens
atcaaaatcctattgaggtt

SEQ ID NO: 8199412 - DNA, 20 bp, Homo sapiens
atcaaaatcctattgaggtt

SEQ ID NO: 8199413 - DNA, 22 bp, Homo sapiens
agaaagcacgggccccaggctc

SEQ ID NO: 8199414 - DNA, 22 bp, Homo sapiens
agaaagcactctgtcttttacc

SEQ ID NO: 8199415 - DNA, 22 bp, Homo sapiens
atcagcaagtcctgttaattct

SEQ ID NO: 8199416 - DNA, 20 bp, Homo sapiens
atcaggtgtattccttatct

SEQ ID NO: 8199417 - DNA, 22 bp, Homo sapiens
atcaggtgtggtccaatcagca

SEQ ID NO: 8199418 - DNA, 22 bp, Homo sapiens
atcagcaagtcctgttaattct

SEQ ID NO: 8199419 - DNA, 22 bp, Homo sapiens
agaaagcatctccattgtaggt

SEQ ID NO: 8199420 - DNA, 22 bp, Homo sapiens
agaaagcagcatttatgatctc

SEQ ID NO: 8199421 - DNA, 22 bp, Homo sapiens
agaaagcagcatttatgatctc

SEQ ID NO: 8199422 - DNA, 22 bp, Homo sapiens
atcagtaaatattcattgtgca

SEQ ID NO: 8199423 - DNA, 22 bp, Homo sapiens
atcagtctgttggaatatcgct

SEQ ID NO: 8199424 - DNA, 22 bp, Homo sapiens
atcagtgacctgaaatgttttt

SEQ ID NO: 8199425 - DNA, 22 bp, Homo sapiens
atcagtgccccatggctaatgc

SEQ ID NO: 8199426 - DNA, 22 bp, Homo sapiens
atcagtgctaaagcaaatgccc

SEQ ID NO: 8199427 - DNA, 22 bp, Homo sapiens
atcagtgctgagagactatcaa

SEQ ID NO: 8199428 - DNA, 22 bp, Homo sapiens
atcagtgctaagagagggcctg

SEQ ID NO: 8199429 - DNA, 19 bp, Homo sapiens
atcagtgcatgagtgctgt

SEQ ID NO: 8199430 - DNA, 19 bp, Homo sapiens
atcagtgcatgagtgctgt

SEQ ID NO: 8199431 - DNA, 22 bp, Homo sapiens
atcagtgcatcctgccacaaag

SEQ ID NO: 8199432 - DNA, 22 bp, Homo sapiens
atcagtgacttcttccaaagtt

SEQ ID NO: 8199433 - DNA, 22 bp, Homo sapiens
atcagtgctgggagatgtcaga

SEQ ID NO: 8199434 - DNA, 22 bp, Homo sapiens
atcagtgcttcatagccctggt

SEQ ID NO: 8199435 - DNA, 22 bp, Homo sapiens
atcagtgtattcatagggaata

SEQ ID NO: 8199436 - DNA, 22 bp, Homo sapiens
atcagtgttccttgagactgcc

SEQ ID NO: 8199437 - DNA, 22 bp, Homo sapiens
agaaatcatgtcttatttctat

SEQ ID NO: 8199438 - DNA, 22 bp, Homo sapiens
agaaatcatgactaagagcagt

SEQ ID NO: 8199439 - DNA, 22 bp, Homo sapiens
agaaatcatgactaagagcagt

SEQ ID NO: 8199440 - DNA, 22 bp, Homo sapiens
atcagttatttttaagctataa

SEQ ID NO: 8199441 - DNA, 22 bp, Homo sapiens
atcagtgtttgcatgggagctt

SEQ ID NO: 8199442 - DNA, 22 bp, Homo sapiens
actgttgtcaggctgctttgga

SEQ ID NO: 8199443 - DNA, 22 bp, Homo sapiens
actgttgtcaggctgctttgga

SEQ ID NO: 8199444 - DNA, 22 bp, Homo sapiens
actgttatttgtaatccattat

SEQ ID NO: 8199445 - DNA, 22 bp, Homo sapiens
ataaaaactgacccatcctttg

SEQ ID NO: 8199446 - DNA, 23 bp, Homo sapiens
agtttttaatggtcatagctgag

SEQ ID NO: 8199447 - DNA, 23 bp, Homo sapiens
agtttttaatggtcatagctgag

SEQ ID NO: 8199448 - DNA, 23 bp, Homo sapiens
agtttttaatggtcatagctgag

SEQ ID NO: 8199449 - DNA, 23 bp, Homo sapiens
agtttttaatggtcatagctgag

SEQ ID NO: 8199450 - DNA, 22 bp, Homo sapiens
agttttatgttcacagaaggat

SEQ ID NO: 8199451 - DNA, 22 bp, Homo sapiens
agttttatgtagacaattcatt

SEQ ID NO: 8199452 - DNA, 21 bp, Homo sapiens
agtttttactcttaactgtgg

SEQ ID NO: 8199453 - DNA, 18 bp, Homo sapiens
agtttttaggaagaaatg

SEQ ID NO: 8199454 - DNA, 21 bp, Homo sapiens
agtttttactcttaactgtgg

SEQ ID NO: 8199455 - DNA, 18 bp, Homo sapiens
agtttttaggaagaaatg

SEQ ID NO: 8199456 - DNA, 18 bp, Homo sapiens
agtttttaggaagaaatg

SEQ ID NO: 8199457 - DNA, 18 bp, Homo sapiens
agtttttaggaagaaatg

SEQ ID NO: 8199458 - DNA, 18 bp, Homo sapiens
agtttttaggaagaaatg

SEQ ID NO: 8199459 - DNA, 18 bp, Homo sapiens
agtttttaggaagaaatg

SEQ ID NO: 8199460 - DNA, 22 bp, Homo sapiens
actgggctccagatgtgatacg

SEQ ID NO: 8199461 - DNA, 22 bp, Homo sapiens
actgggctcaagtgattgtcct

SEQ ID NO: 8199462 - DNA, 22 bp, Homo sapiens
actgggctcataatgtcataga

SEQ ID NO: 8199463 - DNA, 22 bp, Homo sapiens
actgggctccaaggacctggag

SEQ ID NO: 8199464 - DNA, 22 bp, Homo sapiens
actgggctccaaggacctggag

SEQ ID NO: 8199465 - DNA, 22 bp, Homo sapiens
actgggctaccccaccattacc

SEQ ID NO: 8199466 - DNA, 22 bp, Homo sapiens
actgggctaccccaccattacc

SEQ ID NO: 8199467 - DNA, 22 bp, Homo sapiens
actgggccttgccatggcagcc

SEQ ID NO: 8199468 - DNA, 22 bp, Homo sapiens
actgggctagagtggaagctgg

SEQ ID NO: 8199469 - DNA, 22 bp, Homo sapiens
actgggctagagtggaagctgg

SEQ ID NO: 8199470 - DNA, 22 bp, Homo sapiens
actgggctagagtggaagctgg

SEQ ID NO: 8199471 - DNA, 22 bp, Homo sapiens
actgggctagagtggaagctgg

SEQ ID NO: 8199472 - DNA, 21 bp, Homo sapiens
actgggctagcctgacttctg

SEQ ID NO: 8199473 - DNA, 21 bp, Homo sapiens
actgggctagcctgacttctg

SEQ ID NO: 8199474 - DNA, 22 bp, Homo sapiens
agttttatatcttccattggtt

SEQ ID NO: 8199475 - DNA, 22 bp, Homo sapiens
agttttataaaggcacctcagt

SEQ ID NO: 8199476 - DNA, 21 bp, Homo sapiens
agttttatattataagctaaa

SEQ ID NO: 8199477 - DNA, 22 bp, Homo sapiens
agttttatgcagtgttctgata

SEQ ID NO: 8199478 - DNA, 22 bp, Homo sapiens
agttttatgcagtgttctgata

SEQ ID NO: 8199479 - DNA, 22 bp, Homo sapiens
agttttatggctcaacctaata

SEQ ID NO: 8199480 - DNA, 22 bp, Homo sapiens
agttttatggctcaacctaata

SEQ ID NO: 8199481 - DNA, 22 bp, Homo sapiens
agttttatggctcaacctaata

SEQ ID NO: 8199482 - DNA, 22 bp, Homo sapiens
agttttatctgtaagctgttca

SEQ ID NO: 8199483 - DNA, 22 bp, Homo sapiens
agttttatgcagtgttctgata

SEQ ID NO: 8199484 - DNA, 22 bp, Homo sapiens
agttttatctgtaagctgttca

SEQ ID NO: 8199485 - DNA, 21 bp, Homo sapiens
agttttatattataagctaaa

SEQ ID NO: 8199486 - DNA, 19 bp, Homo sapiens
ataaataaaaagtgggaga

SEQ ID NO: 8199487 - DNA, 19 bp, Homo sapiens
ataaataaaaagtgggaga

SEQ ID NO: 8199488 - DNA, 19 bp, Homo sapiens
ataaataaaaagtgggaga

SEQ ID NO: 8199489 - DNA, 22 bp, Homo sapiens
acttcctggctgggtgacctgg

SEQ ID NO: 8199490 - DNA, 22 bp, Homo sapiens
ataaagttctgctggcatatat

SEQ ID NO: 8199491 - DNA, 19 bp, Homo sapiens
ataaataaaaagtgggaga

SEQ ID NO: 8199492 - DNA, 19 bp, Homo sapiens
ataaataaaaagtgggaga

SEQ ID NO: 8199493 - DNA, 22 bp, Homo sapiens
acttccttgtcaggtgcatcat

SEQ ID NO: 8199494 - DNA, 22 bp, Homo sapiens
acttccttgtactgactccatt

SEQ ID NO: 8199495 - DNA, 22 bp, Homo sapiens
acttccttttgggaaactgttt

SEQ ID NO: 8199496 - DNA, 22 bp, Homo sapiens
acttccttttgggaaactgttt

SEQ ID NO: 8199497 - DNA, 22 bp, Homo sapiens
acttccttttgggaaactgttt

SEQ ID NO: 8199498 - DNA, 22 bp, Homo sapiens
acttcgtcataatttactgttc

SEQ ID NO: 8199499 - DNA, 18 bp, Homo sapiens
acttctcatttctctgca

SEQ ID NO: 8199500 - DNA, 22 bp, Homo sapiens
acttctctcattcagacatagc

SEQ ID NO: 8199501 - DNA, 22 bp, Homo sapiens
acttctattggtcatgataaaa

SEQ ID NO: 8199502 - DNA, 22 bp, Homo sapiens
acttctcagattgttgaacatc

SEQ ID NO: 8199503 - DNA, 22 bp, Homo sapiens
acttcctgggcatgcagagtcc

SEQ ID NO: 8199504 - DNA, 22 bp, Homo sapiens
acttcctgggtgttgtaaggtc

SEQ ID NO: 8199505 - DNA, 22 bp, Homo sapiens
acttcctgggtgttgtaaggtc

SEQ ID NO: 8199506 - DNA, 22 bp, Homo sapiens
acttcctgggtgttgtaaggtc

SEQ ID NO: 8199507 - DNA, 22 bp, Homo sapiens
ataaagtctaccgtattaaaga

SEQ ID NO: 8199508 - DNA, 22 bp, Homo sapiens
ataaagtctcatgggtaaatgt

SEQ ID NO: 8199509 - DNA, 22 bp, Homo sapiens
ataaagtctgggccaggcatgg

SEQ ID NO: 8199510 - DNA, 22 bp, Homo sapiens
ataaagtcatttcaaaagttga

SEQ ID NO: 8199511 - DNA, 22 bp, Homo sapiens
ataaagtcatggcagctagaat

SEQ ID NO: 8199512 - DNA, 22 bp, Homo sapiens
ataaagtcattatgaagatcta

SEQ ID NO: 8199513 - DNA, 22 bp, Homo sapiens
ataaagtcaaggcattttatga

SEQ ID NO: 8199514 - DNA, 22 bp, Homo sapiens
ataaagtcatggcagctagaat

SEQ ID NO: 8199515 - DNA, 22 bp, Homo sapiens
ataaagtcaaggcattttatga

SEQ ID NO: 8199516 - DNA, 22 bp, Homo sapiens
acttaaagaggctacttttggt

SEQ ID NO: 8199517 - DNA, 22 bp, Homo sapiens
acttaaagtagttttactgtgg

SEQ ID NO: 8199518 - DNA, 22 bp, Homo sapiens
ataaagtagctttcagtgccaa

SEQ ID NO: 8199519 - DNA, 22 bp, Homo sapiens
acttaaaaagaatcttttcacg

SEQ ID NO: 8199520 - DNA, 22 bp, Homo sapiens
actgttttcttagctccctgct

SEQ ID NO: 8199521 - DNA, 22 bp, Homo sapiens
acttaaaaacagatccagcagg

SEQ ID NO: 8199522 - DNA, 22 bp, Homo sapiens
actgtttatagttttgagctga

SEQ ID NO: 8199523 - DNA, 22 bp, Homo sapiens
atacaaaatatatactggagac

SEQ ID NO: 8199524 - DNA, 22 bp, Homo sapiens
atacaaaaattagccgggagta

SEQ ID NO: 8199525 - DNA, 22 bp, Homo sapiens
atacaaaaattagccgggagta

SEQ ID NO: 8199526 - DNA, 22 bp, Homo sapiens
atacaaaaattagccgggagta

SEQ ID NO: 8199527 - DNA, 22 bp, Homo sapiens
atacaaaaattagccgggagta

SEQ ID NO: 8199528 - DNA, 22 bp, Homo sapiens
atacaaaaattagccgggagta

SEQ ID NO: 8199529 - DNA, 22 bp, Homo sapiens
acttctctgctacctgcaaaga

SEQ ID NO: 8199530 - DNA, 22 bp, Homo sapiens
acttctctccacccaagtccct

SEQ ID NO: 8199531 - DNA, 22 bp, Homo sapiens
acttctctcattcagacatagc

SEQ ID NO: 8199532 - DNA, 22 bp, Homo sapiens
acttctcttcataggtggcaat

SEQ ID NO: 8199533 - DNA, 22 bp, Homo sapiens
acttctcttcataggtggcaat

SEQ ID NO: 8199534 - DNA, 22 bp, Homo sapiens
acttctctggttgaggtccaat

SEQ ID NO: 8199535 - DNA, 22 bp, Homo sapiens
acttctcttcataggtggcaat

SEQ ID NO: 8199536 - DNA, 22 bp, Homo sapiens
ataatttttgtttgatgtccaa

SEQ ID NO: 8199537 - DNA, 22 bp, Homo sapiens
atacaaaatatatactggagac

SEQ ID NO: 8199538 - DNA, 22 bp, Homo sapiens
atacaaaatatatactggagac

SEQ ID NO: 8199539 - DNA, 22 bp, Homo sapiens
atacaaaatatatactggagac

SEQ ID NO: 8199540 - DNA, 22 bp, Homo sapiens
atacaaaatatatactggagac

SEQ ID NO: 8199541 - DNA, 22 bp, Homo sapiens
atacaaaatatatactggagac

SEQ ID NO: 8199542 - DNA, 22 bp, Homo sapiens
atacaaaatatatactggagac

SEQ ID NO: 8199543 - DNA, 22 bp, Homo sapiens
acttggttgatgtcataaggtt

SEQ ID NO: 8199544 - DNA, 22 bp, Homo sapiens
actttaaagcagaatggctatg

SEQ ID NO: 8199545 - DNA, 22 bp, Homo sapiens
actttaaaactgatcatcagag

SEQ ID NO: 8199546 - DNA, 22 bp, Homo sapiens
atacatcaaggatgatggtgta

SEQ ID NO: 8199547 - DNA, 22 bp, Homo sapiens
atacatatgaatgatttggctc

SEQ ID NO: 8199548 - DNA, 22 bp, Homo sapiens
atacatatgaatgatttggctc

SEQ ID NO: 8199549 - DNA, 22 bp, Homo sapiens
atacatatgaatgatttggctc

SEQ ID NO: 8199550 - DNA, 22 bp, Homo sapiens
atacatcacctatatattcaca

SEQ ID NO: 8199551 - DNA, 22 bp, Homo sapiens
atacatcacctatatattcaca

SEQ ID NO: 8199552 - DNA, 22 bp, Homo sapiens
atacatcacctatatattcaca

SEQ ID NO: 8199553 - DNA, 22 bp, Homo sapiens
actttacacatcttttctcatt

SEQ ID NO: 8199554 - DNA, 22 bp, Homo sapiens
actttacacatcttttctcatt

SEQ ID NO: 8199555 - DNA, 20 bp, Homo sapiens
actttacagagaagactgac

SEQ ID NO: 8199556 - DNA, 22 bp, Homo sapiens
atacatatccacaggagataaa

SEQ ID NO: 8199557 - DNA, 22 bp, Homo sapiens
atacatatccacaggagataaa

SEQ ID NO: 8199558 - DNA, 22 bp, Homo sapiens
atacatatccacaggagataaa

SEQ ID NO: 8199559 - DNA, 21 bp, Homo sapiens
actttacaatttacatagtga

SEQ ID NO: 8199560 - DNA, 21 bp, Homo sapiens
actttacaatttacatagtga

SEQ ID NO: 8199561 - DNA, 21 bp, Homo sapiens
actttacaatttacatagtga

SEQ ID NO: 8199562 - DNA, 21 bp, Homo sapiens
actttacaatttacatagtga

SEQ ID NO: 8199563 - DNA, 22 bp, Homo sapiens
actttacacatcttttctcatt

SEQ ID NO: 8199564 - DNA, 21 bp, Homo sapiens
actttaatatacatgaggagg

SEQ ID NO: 8199565 - DNA, 22 bp, Homo sapiens
actttaaagcagaatggctatg

SEQ ID NO: 8199566 - DNA, 22 bp, Homo sapiens
actttaaagcagaatggctatg

SEQ ID NO: 8199567 - DNA, 22 bp, Homo sapiens
actttaaagcagaatggctatg

SEQ ID NO: 8199568 - DNA, 21 bp, Homo sapiens
actttacaatttacatagtga

SEQ ID NO: 8199569 - DNA, 21 bp, Homo sapiens
actttacaatttacatagtga

SEQ ID NO: 8199570 - DNA, 21 bp, Homo sapiens
actttacaatttacatagtga

SEQ ID NO: 8199571 - DNA, 22 bp, Homo sapiens
actttacaatatcctgtgactt

SEQ ID NO: 8199572 - DNA, 22 bp, Homo sapiens
actttacaatatcctgtgactt

SEQ ID NO: 8199573 - DNA, 22 bp, Homo sapiens
actttacaatatcctgtgactt

SEQ ID NO: 8199574 - DNA, 21 bp, Homo sapiens
actttacaatttacatagtga

SEQ ID NO: 8199575 - DNA, 22 bp, Homo sapiens
actttacaatatcctgtgactt

SEQ ID NO: 8199576 - DNA, 22 bp, Homo sapiens
actttacaagcttatagcctag

SEQ ID NO: 8199577 - DNA, 22 bp, Homo sapiens
actttacaagcttatagcctag

SEQ ID NO: 8199578 - DNA, 22 bp, Homo sapiens
actttacaaactcctcactgtt

SEQ ID NO: 8199579 - DNA, 22 bp, Homo sapiens
actttacaaactcctcactgtt

SEQ ID NO: 8199580 - DNA, 22 bp, Homo sapiens
acttttcaaatgggaaactcag

SEQ ID NO: 8199581 - DNA, 22 bp, Homo sapiens
actttgttcctttcacaaagaa

SEQ ID NO: 8199582 - DNA, 22 bp, Homo sapiens
actttgttcctttcacaaagaa

SEQ ID NO: 8199583 - DNA, 22 bp, Homo sapiens
atagatcaatatttagaaactt

SEQ ID NO: 8199584 - DNA, 20 bp, Homo sapiens
atagatcagtgagactaaag

SEQ ID NO: 8199585 - DNA, 22 bp, Homo sapiens
atagatcatgttaaaagctcca

SEQ ID NO: 8199586 - DNA, 22 bp, Homo sapiens
atagatattagcaaaattttat

SEQ ID NO: 8199587 - DNA, 22 bp, Homo sapiens
atagatattagcaaaattttat

SEQ ID NO: 8199588 - DNA, 22 bp, Homo sapiens
atagatatttgagttgtttcca

SEQ ID NO: 8199589 - DNA, 22 bp, Homo sapiens
atagatatttgagttgtttcca

SEQ ID NO: 8199590 - DNA, 22 bp, Homo sapiens
atagatattagcaaaattttat

SEQ ID NO: 8199591 - DNA, 22 bp, Homo sapiens
atagatattagcaaaattttat

SEQ ID NO: 8199592 - DNA, 22 bp, Homo sapiens
atagatacttataacaattgtg

SEQ ID NO: 8199593 - DNA, 22 bp, Homo sapiens
atagatacttaactgaaatctt

SEQ ID NO: 8199594 - DNA, 22 bp, Homo sapiens
atagatacttataacaattgtg

SEQ ID NO: 8199595 - DNA, 20 bp, Homo sapiens
atagatatcatctttagaag

SEQ ID NO: 8199596 - DNA, 20 bp, Homo sapiens
atagatatcatctttagaag

SEQ ID NO: 8199597 - DNA, 20 bp, Homo sapiens
atagatatcatctttagaag

SEQ ID NO: 8199598 - DNA, 22 bp, Homo sapiens
actttggacaatttattactgt

SEQ ID NO: 8199599 - DNA, 22 bp, Homo sapiens
actttggatctgatgtaatcag

SEQ ID NO: 8199600 - DNA, 17 bp, Homo sapiens
actttggaggcagctgt

SEQ ID NO: 8199601 - DNA, 22 bp, Homo sapiens
actttggagggtgttgtagatg

SEQ ID NO: 8199602 - DNA, 22 bp, Homo sapiens
actttggacgccatgctgtttg

SEQ ID NO: 8199603 - DNA, 22 bp, Homo sapiens
atagatacattgttatatttgt

SEQ ID NO: 8199604 - DNA, 22 bp, Homo sapiens
atagatacattgttatatttgt

SEQ ID NO: 8199605 - DNA, 22 bp, Homo sapiens
atagagttttattttccaataa

SEQ ID NO: 8199606 - DNA, 22 bp, Homo sapiens
atagagtgatgtaaggtatgtg

SEQ ID NO: 8199607 - DNA, 22 bp, Homo sapiens
atagagtgatgtaaggtatgtg

SEQ ID NO: 8199608 - DNA, 22 bp, Homo sapiens
atagagtgatgtaaggtatgtg

SEQ ID NO: 8199609 - DNA, 22 bp, Homo sapiens
atacatctagagtcataaaaac

SEQ ID NO: 8199610 - DNA, 22 bp, Homo sapiens
atacatcatttatgatgtgtgt

SEQ ID NO: 8199611 - DNA, 22 bp, Homo sapiens
atacatcatgctccatatattt

SEQ ID NO: 8199612 - DNA, 22 bp, Homo sapiens
atacatcatgctccatatattt

SEQ ID NO: 8199613 - DNA, 22 bp, Homo sapiens
atacatcatgctccatatattt

SEQ ID NO: 8199614 - DNA, 22 bp, Homo sapiens
atacatcatttcccatcaatcg

SEQ ID NO: 8199615 - DNA, 22 bp, Homo sapiens
atacatcatttcccatcaatcg

SEQ ID NO: 8199616 - DNA, 22 bp, Homo sapiens
atacatcatttcccatcaatcg

SEQ ID NO: 8199617 - DNA, 22 bp, Homo sapiens
atacatcatttcccatcaatcg

SEQ ID NO: 8199618 - DNA, 22 bp, Homo sapiens
atacatcatttcccatcaatcg

SEQ ID NO: 8199619 - DNA, 22 bp, Homo sapiens
actttgcaggccttttcttgtg

SEQ ID NO: 8199620 - DNA, 22 bp, Homo sapiens
actttgcagggcttgatatcca

SEQ ID NO: 8199621 - DNA, 19 bp, Homo sapiens
actttgcatgtgtgtctaa

SEQ ID NO: 8199622 - DNA, 20 bp, Homo sapiens
actttgcatttcctgatttt

SEQ ID NO: 8199623 - DNA, 22 bp, Homo sapiens
actttgctcatattgagtttct

SEQ ID NO: 8199624 - DNA, 22 bp, Homo sapiens
actttggaagatggctgtattt

SEQ ID NO: 8199625 - DNA, 22 bp, Homo sapiens
actttgctgcaggtttaaagag

SEQ ID NO: 8199626 - DNA, 22 bp, Homo sapiens
actttggaagatggctgtattt

SEQ ID NO: 8199627 - DNA, 22 bp, Homo sapiens
accacagaggaatttgaagagg

SEQ ID NO: 8199628 - DNA, 22 bp, Homo sapiens
accacaggaattgctctgtggt

SEQ ID NO: 8199629 - DNA, 22 bp, Homo sapiens
accacaggaattgctctgtggt

SEQ ID NO: 8199630 - DNA, 22 bp, Homo sapiens
accacaggaattgctctgtggt

SEQ ID NO: 8199631 - DNA, 17 bp, Homo sapiens
accaatgtcagacaaag

SEQ ID NO: 8199632 - DNA, 22 bp, Homo sapiens
accaataagacacattgagcta

SEQ ID NO: 8199633 - DNA, 22 bp, Homo sapiens
accaatgcatgattttgtctgg

SEQ ID NO: 8199634 - DNA, 22 bp, Homo sapiens
accaagtgagtacttggcagaa

SEQ ID NO: 8199635 - DNA, 22 bp, Homo sapiens
accaataagacacattgagcta

SEQ ID NO: 8199636 - DNA, 22 bp, Homo sapiens
accaaggagtttggtattttag

SEQ ID NO: 8199637 - DNA, 22 bp, Homo sapiens
accaagcacaaagatgagtaaa

SEQ ID NO: 8199638 - DNA, 22 bp, Homo sapiens
accaagagccctcatgctaaga

SEQ ID NO: 8199639 - DNA, 22 bp, Homo sapiens
accaagagtccaagtgaggttg

SEQ ID NO: 8199640 - DNA, 22 bp, Homo sapiens
accaaggaagagattctcagtt

SEQ ID NO: 8199641 - DNA, 22 bp, Homo sapiens
accaaggagacaaaggtgtatt

SEQ ID NO: 8199642 - DNA, 22 bp, Homo sapiens
accaaatgtttttccagaaatg

SEQ ID NO: 8199643 - DNA, 22 bp, Homo sapiens
accaggagccatagagtcaggc

SEQ ID NO: 8199644 - DNA, 22 bp, Homo sapiens
accaggaggcctggagcacaaa

SEQ ID NO: 8199645 - DNA, 22 bp, Homo sapiens
accaggaggcctggagcacaaa

SEQ ID NO: 8199646 - DNA, 22 bp, Homo sapiens
accaggaggctacactgtccca

SEQ ID NO: 8199647 - DNA, 22 bp, Homo sapiens
accaggaggccttggttctgag

SEQ ID NO: 8199648 - DNA, 22 bp, Homo sapiens
accaggagccacaggaggagcc

SEQ ID NO: 8199649 - DNA, 22 bp, Homo sapiens
accaggagccacaggaggagcc

SEQ ID NO: 8199650 - DNA, 23 bp, Homo sapiens
accaggagccaagatctccctgg

SEQ ID NO: 8199651 - DNA, 22 bp, Homo sapiens
accaggagccacaggaggagcc

SEQ ID NO: 8199652 - DNA, 20 bp, Homo sapiens
accaggagatggaggcaggg

SEQ ID NO: 8199653 - DNA, 20 bp, Homo sapiens
accaggagatggaggcaggg

SEQ ID NO: 8199654 - DNA, 19 bp, Homo sapiens
accaggagacagtgagctt

SEQ ID NO: 8199655 - DNA, 22 bp, Homo sapiens
accaggactttgtattcagctt

SEQ ID NO: 8199656 - DNA, 22 bp, Homo sapiens
accagtgggtgtcattccctta

SEQ ID NO: 8199657 - DNA, 22 bp, Homo sapiens
accagtgggaagtggaaaatga

SEQ ID NO: 8199658 - DNA, 22 bp, Homo sapiens
accagtggatgaatgctggacc

SEQ ID NO: 8199659 - DNA, 22 bp, Homo sapiens
accagtgcttcctgctggagct

SEQ ID NO: 8199660 - DNA, 22 bp, Homo sapiens
accagtggaattattctgtggt

SEQ ID NO: 8199661 - DNA, 22 bp, Homo sapiens
accagtggatactgcttgcttt

SEQ ID NO: 8199662 - DNA, 22 bp, Homo sapiens
accagtcttgttgccatgtctg

SEQ ID NO: 8199663 - DNA, 22 bp, Homo sapiens
accagtcttgttgccatgtctg

SEQ ID NO: 8199664 - DNA, 22 bp, Homo sapiens
accagtgagtatttgtaacaga

SEQ ID NO: 8199665 - DNA, 20 bp, Homo sapiens
accaggtggctgatgacacc

SEQ ID NO: 8199666 - DNA, 22 bp, Homo sapiens
accagtaagatcctgtacatac

SEQ ID NO: 8199667 - DNA, 22 bp, Homo sapiens
accaggttggtgtccttctggc

SEQ ID NO: 8199668 - DNA, 22 bp, Homo sapiens
accaggtggccccagcgtggtt

SEQ ID NO: 8199669 - DNA, 22 bp, Homo sapiens
accagtcatagaaagcagtggt

SEQ ID NO: 8199670 - DNA, 22 bp, Homo sapiens
accagtctgttgttgcagagtg

SEQ ID NO: 8199671 - DNA, 23 bp, Homo sapiens
agggcccaagcctggacagcagg

SEQ ID NO: 8199672 - DNA, 22 bp, Homo sapiens
agggcctcctaatttcctcata

SEQ ID NO: 8199673 - DNA, 22 bp, Homo sapiens
agggcctcctaatttcctcata

SEQ ID NO: 8199674 - DNA, 21 bp, Homo sapiens
agggcctctcatttgtgccag

SEQ ID NO: 8199675 - DNA, 22 bp, Homo sapiens
agggcctctaccatccaaggtt

SEQ ID NO: 8199676 - DNA, 22 bp, Homo sapiens
agggcctcgaaggcagagggat

SEQ ID NO: 8199677 - DNA, 22 bp, Homo sapiens
agggcctcgggctcagtgggtc

SEQ ID NO: 8199678 - DNA, 22 bp, Homo sapiens
accagtttgtaacctgttttca

SEQ ID NO: 8199679 - DNA, 22 bp, Homo sapiens
accagttttttatacatcttct

SEQ ID NO: 8199680 - DNA, 20 bp, Homo sapiens
accataatgttaattacaaa

SEQ ID NO: 8199681 - DNA, 20 bp, Homo sapiens
accataatgttaattacaaa

SEQ ID NO: 8199682 - DNA, 22 bp, Homo sapiens
accataattacttggctttttc

SEQ ID NO: 8199683 - DNA, 22 bp, Homo sapiens
accaggctgtgaagtgagacta

SEQ ID NO: 8199684 - DNA, 22 bp, Homo sapiens
accaggagttgggggtgggacc

SEQ ID NO: 8199685 - DNA, 22 bp, Homo sapiens
accagggcacattccggccaga

SEQ ID NO: 8199686 - DNA, 22 bp, Homo sapiens
accagggcagccgaggtgtgtc

SEQ ID NO: 8199687 - DNA, 22 bp, Homo sapiens
accaggctgttgggcccagtgt

SEQ ID NO: 8199688 - DNA, 22 bp, Homo sapiens
accagggcacattccggccaga

SEQ ID NO: 8199689 - DNA, 19 bp, Homo sapiens
accaggagtatcagagctg

SEQ ID NO: 8199690 - DNA, 22 bp, Homo sapiens
accaggagggaccctggtggcc

SEQ ID NO: 8199691 - DNA, 22 bp, Homo sapiens
accaggagggaccctggtggcc

SEQ ID NO: 8199692 - DNA, 22 bp, Homo sapiens
accaggagtaacagtgagtggt

SEQ ID NO: 8199693 - DNA, 22 bp, Homo sapiens
accagggcccgggagagctctc

SEQ ID NO: 8199694 - DNA, 22 bp, Homo sapiens
accagggcagccgaggtgtgtc

SEQ ID NO: 8199695 - DNA, 22 bp, Homo sapiens
accagggcccgggagagctctc

SEQ ID NO: 8199696 - DNA, 22 bp, Homo sapiens
accagggcggcttgaggaggca

SEQ ID NO: 8199697 - DNA, 22 bp, Homo sapiens
accagggcggcttgaggaggca

SEQ ID NO: 8199698 - DNA, 22 bp, Homo sapiens
accagggctgggataggtcagg

SEQ ID NO: 8199699 - DNA, 22 bp, Homo sapiens
accagggctgacaatctgatgg

SEQ ID NO: 8199700 - DNA, 22 bp, Homo sapiens
accagggcttacagcagtagct

SEQ ID NO: 8199701 - DNA, 22 bp, Homo sapiens
accctgggtatttcccaaactt

SEQ ID NO: 8199702 - DNA, 16 bp, Homo sapiens
accctgggtagtcctg

SEQ ID NO: 8199703 - DNA, 22 bp, Homo sapiens
accctgggtcatatacagtgtg

SEQ ID NO: 8199704 - DNA, 22 bp, Homo sapiens
accctgggtcatatacagtgtg

SEQ ID NO: 8199705 - DNA, 22 bp, Homo sapiens
accctgggtcatatacagtgtg

SEQ ID NO: 8199706 - DNA, 22 bp, Homo sapiens
accctgggggtggccagtgcca

SEQ ID NO: 8199707 - DNA, 22 bp, Homo sapiens
accctgggggtggccagtgcca

SEQ ID NO: 8199708 - DNA, 22 bp, Homo sapiens
accctggggtcacccttctctg

SEQ ID NO: 8199709 - DNA, 22 bp, Homo sapiens
accctgggtctcaatcatccta

SEQ ID NO: 8199710 - DNA, 22 bp, Homo sapiens
accctgggtgagaggcaaacag

SEQ ID NO: 8199711 - DNA, 22 bp, Homo sapiens
accctgggttcccgcagcacca

SEQ ID NO: 8199712 - DNA, 22 bp, Homo sapiens
accctgggttcccgcagcacca

SEQ ID NO: 8199713 - DNA, 22 bp, Homo sapiens
accctggtctctacttcacaga

SEQ ID NO: 8199714 - DNA, 22 bp, Homo sapiens
accctggtgatttgagagagta

SEQ ID NO: 8199715 - DNA, 22 bp, Homo sapiens
accctggtgatttgagagagta

SEQ ID NO: 8199716 - DNA, 22 bp, Homo sapiens
accctggtgttgccccgctttt

SEQ ID NO: 8199717 - DNA, 22 bp, Homo sapiens
accctggtttgaataatctgtg

SEQ ID NO: 8199718 - DNA, 21 bp, Homo sapiens
accctgggttctccataccct

SEQ ID NO: 8199719 - DNA, 23 bp, Homo sapiens
accctgggcaagtcacctaacct

SEQ ID NO: 8199720 - DNA, 18 bp, Homo sapiens
accctgggcaattcactc

SEQ ID NO: 8199721 - DNA, 22 bp, Homo sapiens
accctgggcttggcctgctcag

SEQ ID NO: 8199722 - DNA, 22 bp, Homo sapiens
accctgggcacaccatttcccc

SEQ ID NO: 8199723 - DNA, 22 bp, Homo sapiens
accctgggcacaccatttcccc

SEQ ID NO: 8199724 - DNA, 22 bp, Homo sapiens
accctgggagggagaaatcaga

SEQ ID NO: 8199725 - DNA, 22 bp, Homo sapiens
accctgggacttccgagttgag

SEQ ID NO: 8199726 - DNA, 22 bp, Homo sapiens
accctgggacctggaggtggat

SEQ ID NO: 8199727 - DNA, 22 bp, Homo sapiens
accctgggaactggaaactgga

SEQ ID NO: 8199728 - DNA, 22 bp, Homo sapiens
accctggaggtctacagtgcag

SEQ ID NO: 8199729 - DNA, 22 bp, Homo sapiens
accctgcttggccccacttcta

SEQ ID NO: 8199730 - DNA, 22 bp, Homo sapiens
accctgcttctggattaatcca

SEQ ID NO: 8199731 - DNA, 22 bp, Homo sapiens
accctgcttggccccacttcta

SEQ ID NO: 8199732 - DNA, 22 bp, Homo sapiens
accctgctgacctgaaagaggg

SEQ ID NO: 8199733 - DNA, 22 bp, Homo sapiens
accctgctttatgccgtcctct

SEQ ID NO: 8199734 - DNA, 21 bp, Homo sapiens
accctgctttatgccgtcctc

SEQ ID NO: 8199735 - DNA, 22 bp, Homo sapiens
accctctgccttgagcagtgcc

SEQ ID NO: 8199736 - DNA, 22 bp, Homo sapiens
accccagcgcatatggtctgcg

SEQ ID NO: 8199737 - DNA, 22 bp, Homo sapiens
accccagctctgagccacacca

SEQ ID NO: 8199738 - DNA, 22 bp, Homo sapiens
accccagaggcggaggctgcag

SEQ ID NO: 8199739 - DNA, 20 bp, Homo sapiens
accccagcccctctatctga

SEQ ID NO: 8199740 - DNA, 20 bp, Homo sapiens
accccagcccctctatctga

SEQ ID NO: 8199741 - DNA, 22 bp, Homo sapiens
accccagccctgcttctgggag

SEQ ID NO: 8199742 - DNA, 22 bp, Homo sapiens
accccagccctgcttctgggag

SEQ ID NO: 8199743 - DNA, 22 bp, Homo sapiens
accccagaagcagcagtggcag

SEQ ID NO: 8199744 - DNA, 22 bp, Homo sapiens
accccagaggcggaggctgcag

SEQ ID NO: 8199745 - DNA, 22 bp, Homo sapiens
accccagaggcggaggctgcag

SEQ ID NO: 8199746 - DNA, 22 bp, Homo sapiens
accccaagacagtagaagagaa

SEQ ID NO: 8199747 - DNA, 17 bp, Homo sapiens
acccattttgcacaggc

SEQ ID NO: 8199748 - DNA, 22 bp, Homo sapiens
accccaaaagagtaatagaatt

SEQ ID NO: 8199749 - DNA, 22 bp, Homo sapiens
acccattcctttacttcatctg

SEQ ID NO: 8199750 - DNA, 22 bp, Homo sapiens
acccatgtgctcttttgtaccc

SEQ ID NO: 8199751 - DNA, 22 bp, Homo sapiens
acccatggtctggtggggccct

SEQ ID NO: 8199752 - DNA, 23 bp, Homo sapiens
acccatctctcctgtcatgcaga

SEQ ID NO: 8199753 - DNA, 17 bp, Homo sapiens
acccatccccagggcag

SEQ ID NO: 8199754 - DNA, 22 bp, Homo sapiens
acccatccagtgtccctgctag

SEQ ID NO: 8199755 - DNA, 22 bp, Homo sapiens
acccagggttcctgggtcccag

SEQ ID NO: 8199756 - DNA, 22 bp, Homo sapiens
acccagggtttgagctctgcag

SEQ ID NO: 8199757 - DNA, 19 bp, Homo sapiens
acccagggttgatgtccag

SEQ ID NO: 8199758 - DNA, 19 bp, Homo sapiens
acccagggttgatgtccag

SEQ ID NO: 8199759 - DNA, 22 bp, Homo sapiens
acccagggttcctgggtcccag

SEQ ID NO: 8199760 - DNA, 22 bp, Homo sapiens
acccaggtctctcgacttctgg

SEQ ID NO: 8199761 - DNA, 18 bp, Homo sapiens
acccaggttttgaagctt

SEQ ID NO: 8199762 - DNA, 22 bp, Homo sapiens
acccagggtttgagctctgcag

SEQ ID NO: 8199763 - DNA, 22 bp, Homo sapiens
acccagggtttgagctctgcag

SEQ ID NO: 8199764 - DNA, 22 bp, Homo sapiens
acccagtgttgggcagaactgt

SEQ ID NO: 8199765 - DNA, 22 bp, Homo sapiens
acccagtgacatcctttacctg

SEQ ID NO: 8199766 - DNA, 22 bp, Homo sapiens
acccagggtagagtgcagtggc

SEQ ID NO: 8199767 - DNA, 22 bp, Homo sapiens
acccagggagtgctcctgttct

SEQ ID NO: 8199768 - DNA, 22 bp, Homo sapiens
acccagggtagagtgcagtggc

SEQ ID NO: 8199769 - DNA, 22 bp, Homo sapiens
acccagggtagagtgcagtggc

SEQ ID NO: 8199770 - DNA, 22 bp, Homo sapiens
acccagggtcaccccgtagggt

SEQ ID NO: 8199771 - DNA, 22 bp, Homo sapiens
acccagagaactgtgccttgag

SEQ ID NO: 8199772 - DNA, 17 bp, Homo sapiens
acccagagaaggaggtc

SEQ ID NO: 8199773 - DNA, 22 bp, Homo sapiens
acccagagactagcacggtaca

SEQ ID NO: 8199774 - DNA, 22 bp, Homo sapiens
acccagagcacagatgcaacgt

SEQ ID NO: 8199775 - DNA, 22 bp, Homo sapiens
acccagagcacagatgcaacgt

SEQ ID NO: 8199776 - DNA, 22 bp, Homo sapiens
acccagagcacagatgcaacgt

SEQ ID NO: 8199777 - DNA, 22 bp, Homo sapiens
acccagagcactgggtgtgggc

SEQ ID NO: 8199778 - DNA, 22 bp, Homo sapiens
agggcctgagaccgtggcttga

SEQ ID NO: 8199779 - DNA, 22 bp, Homo sapiens
agggcctgacacccttgccagc

SEQ ID NO: 8199780 - DNA, 22 bp, Homo sapiens
agggcctgacacccttgccagc

SEQ ID NO: 8199781 - DNA, 22 bp, Homo sapiens
agggcctgacacccttgccagc

SEQ ID NO: 8199782 - DNA, 19 bp, Homo sapiens
agggcctgagcagatgttg

SEQ ID NO: 8199783 - DNA, 21 bp, Homo sapiens
agggcctctgtgtactggggg

SEQ ID NO: 8199784 - DNA, 23 bp, Homo sapiens
agggcctctgtcccccagcactc

SEQ ID NO: 8199785 - DNA, 23 bp, Homo sapiens
agggcctctgtcccccagcactc

SEQ ID NO: 8199786 - DNA, 23 bp, Homo sapiens
agggcctctgtcccccagcactc

SEQ ID NO: 8199787 - DNA, 23 bp, Homo sapiens
agggcctctgtcccccagcactc

SEQ ID NO: 8199788 - DNA, 22 bp, Homo sapiens
agggcctctggaacactgaggg

SEQ ID NO: 8199789 - DNA, 22 bp, Homo sapiens
agggcctctggaacactgaggg

SEQ ID NO: 8199790 - DNA, 22 bp, Homo sapiens
agggcctctggaacactgaggg

SEQ ID NO: 8199791 - DNA, 22 bp, Homo sapiens
agggcctctgagccagttctgg

SEQ ID NO: 8199792 - DNA, 22 bp, Homo sapiens
agggcctctgagccagttctgg

SEQ ID NO: 8199793 - DNA, 22 bp, Homo sapiens
agggcctctgcctccccgttgt

SEQ ID NO: 8199794 - DNA, 22 bp, Homo sapiens
agggcctctgacgcccccagcc

SEQ ID NO: 8199795 - DNA, 22 bp, Homo sapiens
agggcctctctgggcctttcct

SEQ ID NO: 8199796 - DNA, 22 bp, Homo sapiens
acccagagaactgaggcatgaa

SEQ ID NO: 8199797 - DNA, 22 bp, Homo sapiens
acccagagaactgaggcatgaa

SEQ ID NO: 8199798 - DNA, 22 bp, Homo sapiens
acccagagaactgtgccttgag

SEQ ID NO: 8199799 - DNA, 22 bp, Homo sapiens
acccacgaagatgagcggcatg

SEQ ID NO: 8199800 - DNA, 22 bp, Homo sapiens
acccacgaagatgagcggcatg

SEQ ID NO: 8199801 - DNA, 22 bp, Homo sapiens
acccacgaagatgagcggcatg

SEQ ID NO: 8199802 - DNA, 22 bp, Homo sapiens
agggcctgagctctcctccagt

SEQ ID NO: 8199803 - DNA, 22 bp, Homo sapiens
agggcctgagctctcctccagt

SEQ ID NO: 8199804 - DNA, 22 bp, Homo sapiens
agggcctgagctctcctccagt

SEQ ID NO: 8199805 - DNA, 22 bp, Homo sapiens
acccacagaacctgtgacaaca

SEQ ID NO: 8199806 - DNA, 22 bp, Homo sapiens
agggcctgagctctcctccagt

SEQ ID NO: 8199807 - DNA, 19 bp, Homo sapiens
agggcctgagcagatgttg

SEQ ID NO: 8199808 - DNA, 19 bp, Homo sapiens
agggcctgagcagatgttg

SEQ ID NO: 8199809 - DNA, 22 bp, Homo sapiens
acccacagccgctgtgcgtccc

SEQ ID NO: 8199810 - DNA, 22 bp, Homo sapiens
acccacagccgctgtgcgtccc

SEQ ID NO: 8199811 - DNA, 22 bp, Homo sapiens
acccacagccgctgtgcgtccc

SEQ ID NO: 8199812 - DNA, 20 bp, Homo sapiens
aggccctgccagggacggag

SEQ ID NO: 8199813 - DNA, 22 bp, Homo sapiens
aggccctgcattgtactgaggg

SEQ ID NO: 8199814 - DNA, 22 bp, Homo sapiens
aggccctgcattgtactgaggg

SEQ ID NO: 8199815 - DNA, 20 bp, Homo sapiens
aggccctgccagggacggag

SEQ ID NO: 8199816 - DNA, 22 bp, Homo sapiens
acattaatgaggtgatgacaca

SEQ ID NO: 8199817 - DNA, 22 bp, Homo sapiens
acattaatgaggtgatgacaca

SEQ ID NO: 8199818 - DNA, 23 bp, Homo sapiens
acattacacgcagtaattgcccc

SEQ ID NO: 8199819 - DNA, 22 bp, Homo sapiens
acattacactgtggtcctgttc

SEQ ID NO: 8199820 - DNA, 22 bp, Homo sapiens
aggccctgcattgtactgaggg

SEQ ID NO: 8199821 - DNA, 22 bp, Homo sapiens
aggccctgcaggagtggggaca

SEQ ID NO: 8199822 - DNA, 22 bp, Homo sapiens
aggccctgcaggagtggggaca

SEQ ID NO: 8199823 - DNA, 22 bp, Homo sapiens
aggccctgcaggaagcaggatg

SEQ ID NO: 8199824 - DNA, 22 bp, Homo sapiens
aggccctgcaggaagcaggatg

SEQ ID NO: 8199825 - DNA, 22 bp, Homo sapiens
aggccctgcaggagtggggaca

SEQ ID NO: 8199826 - DNA, 22 bp, Homo sapiens
aggccctgcaggaagcaggatg

SEQ ID NO: 8199827 - DNA, 22 bp, Homo sapiens
aggccctgcaggaagcaggatg

SEQ ID NO: 8199828 - DNA, 22 bp, Homo sapiens
acattcattccaggtcagtcag

SEQ ID NO: 8199829 - DNA, 22 bp, Homo sapiens
acattcatgtcccacttctagc

SEQ ID NO: 8199830 - DNA, 22 bp, Homo sapiens
acattcaaggccttctgacaca

SEQ ID NO: 8199831 - DNA, 22 bp, Homo sapiens
acattcaagtttctgctcatgg

SEQ ID NO: 8199832 - DNA, 22 bp, Homo sapiens
acattctttcgatgtctgattt

SEQ ID NO: 8199833 - DNA, 22 bp, Homo sapiens
acattctttgagttttgttaaa

SEQ ID NO: 8199834 - DNA, 22 bp, Homo sapiens
acattctagatatgttatattt

SEQ ID NO: 8199835 - DNA, 22 bp, Homo sapiens
acattctagatatgttatattt

SEQ ID NO: 8199836 - DNA, 22 bp, Homo sapiens
acattctatgaagataatttta

SEQ ID NO: 8199837 - DNA, 22 bp, Homo sapiens
acattctagatatgttatattt

SEQ ID NO: 8199838 - DNA, 22 bp, Homo sapiens
acattctagatatgttatattt

SEQ ID NO: 8199839 - DNA, 22 bp, Homo sapiens
acattctagaagtctttgcaat

SEQ ID NO: 8199840 - DNA, 22 bp, Homo sapiens
acattcctgaatgggcacattt

SEQ ID NO: 8199841 - DNA, 22 bp, Homo sapiens
acattcctcagtgccagttgag

SEQ ID NO: 8199842 - DNA, 22 bp, Homo sapiens
acattccaggttggtgcagggt

SEQ ID NO: 8199843 - DNA, 22 bp, Homo sapiens
acattccaaaaactagcagata

SEQ ID NO: 8199844 - DNA, 22 bp, Homo sapiens
acattcattgccagggtggaag

SEQ ID NO: 8199845 - DNA, 22 bp, Homo sapiens
acattcccttggcttgaagcag

SEQ ID NO: 8199846 - DNA, 22 bp, Homo sapiens
acattccaggttggtgcagggt

SEQ ID NO: 8199847 - DNA, 22 bp, Homo sapiens
acattcctttcttgagcacagt

SEQ ID NO: 8199848 - DNA, 18 bp, Homo sapiens
aggcttcccaggcaggcc

SEQ ID NO: 8199849 - DNA, 22 bp, Homo sapiens
aggcttcccaagcagctgcaaa

SEQ ID NO: 8199850 - DNA, 22 bp, Homo sapiens
aggcttcccagctgagctcagc

SEQ ID NO: 8199851 - DNA, 22 bp, Homo sapiens
aggcttcattgtggcatcagga

SEQ ID NO: 8199852 - DNA, 22 bp, Homo sapiens
aggcttcattacagtggttcaa

SEQ ID NO: 8199853 - DNA, 22 bp, Homo sapiens
aggcttcatatttaggcatatg

SEQ ID NO: 8199854 - DNA, 22 bp, Homo sapiens
aggcttcagttgtaccttcttg

SEQ ID NO: 8199855 - DNA, 19 bp, Homo sapiens
aggcttcaggccacatgct

SEQ ID NO: 8199856 - DNA, 19 bp, Homo sapiens
aggcttcaggccacatgct

SEQ ID NO: 8199857 - DNA, 22 bp, Homo sapiens
aggctgtgcaattagggtaaga

SEQ ID NO: 8199858 - DNA, 22 bp, Homo sapiens
aggctccagtctcctctggcag

SEQ ID NO: 8199859 - DNA, 22 bp, Homo sapiens
aggctccaggcctccctgcatg

SEQ ID NO: 8199860 - DNA, 22 bp, Homo sapiens
aggctccagcccaaggctgcag

SEQ ID NO: 8199861 - DNA, 22 bp, Homo sapiens
aggcttcagcagccctctcttg

SEQ ID NO: 8199862 - DNA, 19 bp, Homo sapiens
aggcttcaggccacatgct

SEQ ID NO: 8199863 - DNA, 22 bp, Homo sapiens
aggcttcaggaagtctcctggg

SEQ ID NO: 8199864 - DNA, 22 bp, Homo sapiens
acattgaactacttgtaatgag

SEQ ID NO: 8199865 - DNA, 22 bp, Homo sapiens
acattgaacagtacaaatgatc

SEQ ID NO: 8199866 - DNA, 22 bp, Homo sapiens
acattgaaagcatattatctcc

SEQ ID NO: 8199867 - DNA, 22 bp, Homo sapiens
acattgaacagtacaaatgatc

SEQ ID NO: 8199868 - DNA, 22 bp, Homo sapiens
acattgaatgtatgtgatgaaa

SEQ ID NO: 8199869 - DNA, 19 bp, Homo sapiens
acattgaattttcttcttt

SEQ ID NO: 8199870 - DNA, 22 bp, Homo sapiens
acattgaatttcacttttgtac

SEQ ID NO: 8199871 - DNA, 22 bp, Homo sapiens
acattgaagggaatgcaaagat

SEQ ID NO: 8199872 - DNA, 22 bp, Homo sapiens
acattgaagggaatgcaaagat

SEQ ID NO: 8199873 - DNA, 22 bp, Homo sapiens
acattgagagttttgaagagta

SEQ ID NO: 8199874 - DNA, 22 bp, Homo sapiens
acattgacctgattttgaagac

SEQ ID NO: 8199875 - DNA, 23 bp, Homo sapiens
aggctccactccctgggatgtgg

SEQ ID NO: 8199876 - DNA, 22 bp, Homo sapiens
acattgatatttcaaatacagg

SEQ ID NO: 8199877 - DNA, 22 bp, Homo sapiens
aggctccacggtcactggctct

SEQ ID NO: 8199878 - DNA, 22 bp, Homo sapiens
aggctccagcagccagaggaag

SEQ ID NO: 8199879 - DNA, 22 bp, Homo sapiens
aggctccagcagccagaggaag

SEQ ID NO: 8199880 - DNA, 22 bp, Homo sapiens
aggctccagcagccagaggaag

SEQ ID NO: 8199881 - DNA, 22 bp, Homo sapiens
aggctccagccaatgggtctgt

SEQ ID NO: 8199882 - DNA, 22 bp, Homo sapiens
aggctccagccaatgggtctgt

SEQ ID NO: 8199883 - DNA, 22 bp, Homo sapiens
aggctccagcccaaggctgcag

SEQ ID NO: 8199884 - DNA, 22 bp, Homo sapiens
aggctccagcccaaggctgcag

SEQ ID NO: 8199885 - DNA, 22 bp, Homo sapiens
aggcccagggctgctctctgaa

SEQ ID NO: 8199886 - DNA, 22 bp, Homo sapiens
aggcccagggctgctctctgaa

SEQ ID NO: 8199887 - DNA, 22 bp, Homo sapiens
aggcccagggctgctctctgaa

SEQ ID NO: 8199888 - DNA, 22 bp, Homo sapiens
aggcccagggctgctctctgaa

SEQ ID NO: 8199889 - DNA, 21 bp, Homo sapiens
aggcccaggaatatgcatttt

SEQ ID NO: 8199890 - DNA, 21 bp, Homo sapiens
aggcccaggaatatgcatttt

SEQ ID NO: 8199891 - DNA, 22 bp, Homo sapiens
aggccctgagcatccgagggca

SEQ ID NO: 8199892 - DNA, 22 bp, Homo sapiens
aggccctgatccgaatccagat

SEQ ID NO: 8199893 - DNA, 22 bp, Homo sapiens
aggccctgagcatccgagggca

SEQ ID NO: 8199894 - DNA, 22 bp, Homo sapiens
aggccctgagcatccgagggca

SEQ ID NO: 8199895 - DNA, 22 bp, Homo sapiens
aggccctgagaaaatccctgca

SEQ ID NO: 8199896 - DNA, 22 bp, Homo sapiens
aggcccagtagtcgacggcgct

SEQ ID NO: 8199897 - DNA, 22 bp, Homo sapiens
aggccctgagaaaatccctgca

SEQ ID NO: 8199898 - DNA, 22 bp, Homo sapiens
aggccaggtggtcatgcttgct

SEQ ID NO: 8199899 - DNA, 22 bp, Homo sapiens
acatgaaacctgagtctaactc

SEQ ID NO: 8199900 - DNA, 22 bp, Homo sapiens
acatgaaactgttgcattagaa

SEQ ID NO: 8199901 - DNA, 22 bp, Homo sapiens
aggcccagcttgaagtgggaag

SEQ ID NO: 8199902 - DNA, 22 bp, Homo sapiens
aggcccagcttgaagtgggaag

SEQ ID NO: 8199903 - DNA, 22 bp, Homo sapiens
aggcccagcttgaagtgggaag

SEQ ID NO: 8199904 - DNA, 22 bp, Homo sapiens
aggccaggtggtcatgcttgct

SEQ ID NO: 8199905 - DNA, 22 bp, Homo sapiens
aggccaggtggtcatgcttgct

SEQ ID NO: 8199906 - DNA, 21 bp, Homo sapiens
aggcccagctttcctcttgct

SEQ ID NO: 8199907 - DNA, 21 bp, Homo sapiens
aggcccagctttcctcttgct

SEQ ID NO: 8199908 - DNA, 21 bp, Homo sapiens
aggcccagctttcctcttgct

SEQ ID NO: 8199909 - DNA, 21 bp, Homo sapiens
aggcccagctttcctcttgct

SEQ ID NO: 8199910 - DNA, 22 bp, Homo sapiens
aggccagcctcaggcagggacc

SEQ ID NO: 8199911 - DNA, 22 bp, Homo sapiens
aggccagcctcaggcagggacc

SEQ ID NO: 8199912 - DNA, 22 bp, Homo sapiens
acatgaaaaatgtttgcagttt

SEQ ID NO: 8199913 - DNA, 22 bp, Homo sapiens
acatgaaaaatgtttgcagttt

SEQ ID NO: 8199914 - DNA, 22 bp, Homo sapiens
acatgaaaactggttccttcag

SEQ ID NO: 8199915 - DNA, 22 bp, Homo sapiens
acatgaaaactggttccttcag

SEQ ID NO: 8199916 - DNA, 22 bp, Homo sapiens
acatgaaaagactatctgatta

SEQ ID NO: 8199917 - DNA, 22 bp, Homo sapiens
acatgaaaagactatctgatta

SEQ ID NO: 8199918 - DNA, 22 bp, Homo sapiens
acatgaaaagactatctgatta

SEQ ID NO: 8199919 - DNA, 22 bp, Homo sapiens
aggccagcagacgtgggactga

SEQ ID NO: 8199920 - DNA, 22 bp, Homo sapiens
aggccagcagacgtgggactga

SEQ ID NO: 8199921 - DNA, 22 bp, Homo sapiens
aggccagcattctctctccagg

SEQ ID NO: 8199922 - DNA, 22 bp, Homo sapiens
aggccagcattctctctccagg

SEQ ID NO: 8199923 - DNA, 22 bp, Homo sapiens
aggccagcattctctctccagg

SEQ ID NO: 8199924 - DNA, 22 bp, Homo sapiens
aggccagcattctctctccagg

SEQ ID NO: 8199925 - DNA, 22 bp, Homo sapiens
aggccagcattctctctccagg

SEQ ID NO: 8199926 - DNA, 22 bp, Homo sapiens
aggccagcattctctctccagg

SEQ ID NO: 8199927 - DNA, 22 bp, Homo sapiens
aggccagccctcacctgtgttc

SEQ ID NO: 8199928 - DNA, 22 bp, Homo sapiens
aggccagccctcacctgtgttc

SEQ ID NO: 8199929 - DNA, 22 bp, Homo sapiens
aggccagccctgggctgagaga

SEQ ID NO: 8199930 - DNA, 18 bp, Homo sapiens
aggccagccctgctactg

SEQ ID NO: 8199931 - DNA, 18 bp, Homo sapiens
aggccagccctgctactg

SEQ ID NO: 8199932 - DNA, 18 bp, Homo sapiens
aggccacactccagaaca

SEQ ID NO: 8199933 - DNA, 22 bp, Homo sapiens
aggccacaatttgatttggttt

SEQ ID NO: 8199934 - DNA, 22 bp, Homo sapiens
aggcatgtcatttcttttctga

SEQ ID NO: 8199935 - DNA, 22 bp, Homo sapiens
aggccacacaactcttagagat

SEQ ID NO: 8199936 - DNA, 22 bp, Homo sapiens
aggccacagagagtgcatgtgc

SEQ ID NO: 8199937 - DNA, 22 bp, Homo sapiens
aggccacagagagtgcatgtgc

SEQ ID NO: 8199938 - DNA, 22 bp, Homo sapiens
aggccacagatactgtgaagta

SEQ ID NO: 8199939 - DNA, 22 bp, Homo sapiens
aggccacagagagtgcatgtgc

SEQ ID NO: 8199940 - DNA, 18 bp, Homo sapiens
aggcatggtggtgcgcac

SEQ ID NO: 8199941 - DNA, 18 bp, Homo sapiens
aggcatggtggtgcgcac

SEQ ID NO: 8199942 - DNA, 18 bp, Homo sapiens
aggcatggtggtgcgcac

SEQ ID NO: 8199943 - DNA, 17 bp, Homo sapiens
aggcatggtctggggtg

SEQ ID NO: 8199944 - DNA, 18 bp, Homo sapiens
aggcatggtggtgcgcac

SEQ ID NO: 8199945 - DNA, 22 bp, Homo sapiens
aggccacaagaactaccccatc

SEQ ID NO: 8199946 - DNA, 22 bp, Homo sapiens
aggcatgtcagttgttttagtg

SEQ ID NO: 8199947 - DNA, 17 bp, Homo sapiens
aggcatggtctggggtg

SEQ ID NO: 8199948 - DNA, 17 bp, Homo sapiens
aggcatggtctggggtg

SEQ ID NO: 8199949 - DNA, 17 bp, Homo sapiens
aggcatggtctggggtg

SEQ ID NO: 8199950 - DNA, 22 bp, Homo sapiens
aggcatgggtagaagagaagcc

SEQ ID NO: 8199951 - DNA, 22 bp, Homo sapiens
aggccacaggtggaagccagag

SEQ ID NO: 8199952 - DNA, 22 bp, Homo sapiens
aggccacaggtggaagccagag

SEQ ID NO: 8199953 - DNA, 22 bp, Homo sapiens
aggccagcaccagagtcaagaa

SEQ ID NO: 8199954 - DNA, 22 bp, Homo sapiens
aggccagcacgacagccgcagg

SEQ ID NO: 8199955 - DNA, 22 bp, Homo sapiens
aggccacaggattgcacagcat

SEQ ID NO: 8199956 - DNA, 22 bp, Homo sapiens
aggccacaggattgcacagcat

SEQ ID NO: 8199957 - DNA, 22 bp, Homo sapiens
aggccacaggattgcacagcat

SEQ ID NO: 8199958 - DNA, 22 bp, Homo sapiens
aggccacaggattgcacagcat

SEQ ID NO: 8199959 - DNA, 22 bp, Homo sapiens
aggccacagcctgggaggtgac

SEQ ID NO: 8199960 - DNA, 22 bp, Homo sapiens
aggccacagcctgggaggtgac

SEQ ID NO: 8199961 - DNA, 22 bp, Homo sapiens
aggcagtgttcttctaagggca

SEQ ID NO: 8199962 - DNA, 22 bp, Homo sapiens
aggcagtgttcttctaagggca

SEQ ID NO: 8199963 - DNA, 22 bp, Homo sapiens
aggcatggcatggggcagatgt

SEQ ID NO: 8199964 - DNA, 22 bp, Homo sapiens
aggcatggctttaggcaggcgt

SEQ ID NO: 8199965 - DNA, 22 bp, Homo sapiens
acatacatggttctcagccctt

SEQ ID NO: 8199966 - DNA, 22 bp, Homo sapiens
acatacatgggattaaaaaatt

SEQ ID NO: 8199967 - DNA, 22 bp, Homo sapiens
acatacatggtgctttcttggt

SEQ ID NO: 8199968 - DNA, 22 bp, Homo sapiens
acatacatggattcatggattc

SEQ ID NO: 8199969 - DNA, 22 bp, Homo sapiens
acatacatggattcatggattc

SEQ ID NO: 8199970 - DNA, 22 bp, Homo sapiens
aggcatggctttaggcaggcgt

SEQ ID NO: 8199971 - DNA, 22 bp, Homo sapiens
aggcatggctttaggcaggcgt

SEQ ID NO: 8199972 - DNA, 22 bp, Homo sapiens
aggcatggctttaggcaggcgt

SEQ ID NO: 8199973 - DNA, 22 bp, Homo sapiens
aggcatggctttaggcaggcgt

SEQ ID NO: 8199974 - DNA, 22 bp, Homo sapiens
aggcatggctttaggcaggcgt

SEQ ID NO: 8199975 - DNA, 22 bp, Homo sapiens
aggcatggctttaggcaggcgt

SEQ ID NO: 8199976 - DNA, 22 bp, Homo sapiens
aggcatggcattcctcaagcaa

SEQ ID NO: 8199977 - DNA, 19 bp, Homo sapiens
aggcatgggaagagaagtc

SEQ ID NO: 8199978 - DNA, 19 bp, Homo sapiens
aggcatgggaagagaagtc

SEQ ID NO: 8199979 - DNA, 20 bp, Homo sapiens
aggcatgggatgcccagatt

SEQ ID NO: 8199980 - DNA, 22 bp, Homo sapiens
aggcatggggctgcagtcaggt

SEQ ID NO: 8199981 - DNA, 22 bp, Homo sapiens
aggcatggggctgcagtcaggt

SEQ ID NO: 8199982 - DNA, 20 bp, Homo sapiens
aggcatgggatgcccagatt

SEQ ID NO: 8199983 - DNA, 22 bp, Homo sapiens
aggcatggggctgcagtcaggt

SEQ ID NO: 8199984 - DNA, 22 bp, Homo sapiens
aggcatggggctgcagtcaggt

SEQ ID NO: 8199985 - DNA, 22 bp, Homo sapiens
aggcatgggtagaagagaagcc

SEQ ID NO: 8199986 - DNA, 22 bp, Homo sapiens
acatacacgggaaacctctttt

SEQ ID NO: 8199987 - DNA, 17 bp, Homo sapiens
acatacactggtgaaca

SEQ ID NO: 8199988 - DNA, 22 bp, Homo sapiens
acatacagacctgcagggcagc

SEQ ID NO: 8199989 - DNA, 22 bp, Homo sapiens
acatacacatgaatatattttt

SEQ ID NO: 8199990 - DNA, 22 bp, Homo sapiens
acatacacgggaaacctctttt

SEQ ID NO: 8199991 - DNA, 23 bp, Homo sapiens
acatacataagcaccacattttg

SEQ ID NO: 8199992 - DNA, 23 bp, Homo sapiens
acatacataagcaccacattttg

SEQ ID NO: 8199993 - DNA, 23 bp, Homo sapiens
acatacataagcaccacattttg

SEQ ID NO: 8199994 - DNA, 23 bp, Homo sapiens
acatacataagcaccacattttg

SEQ ID NO: 8199995 - DNA, 22 bp, Homo sapiens
acatacacaagcgtacatgaac

SEQ ID NO: 8199996 - DNA, 22 bp, Homo sapiens
acatacacaagcgtacatgaac

SEQ ID NO: 8199997 - DNA, 22 bp, Homo sapiens
acataacaatcataggacatag

SEQ ID NO: 8199998 - DNA, 22 bp, Homo sapiens
acataacaatcataggacatag

SEQ ID NO: 8199999 - DNA, 22 bp, Homo sapiens
acatacacaagcgtacatgaac

SEQ ID NO: 8200000 - DNA, 22 bp, Homo sapiens
acatacacaagcgtacatgaac

SEQ ID NO: 8200001 - DNA, 22 bp, Homo sapiens
acatacacatgaatatattttt

SEQ ID NO: 8200002 - DNA, 22 bp, Homo sapiens
acatacacatgaatatattttt

SEQ ID NO: 8200003 - DNA, 22 bp, Homo sapiens
acatacatatgtttaaatgcat

SEQ ID NO: 8200004 - DNA, 22 bp, Homo sapiens
acatacatcaagtatcacaaga

SEQ ID NO: 8200005 - DNA, 22 bp, Homo sapiens
acatacatcaagtatcacaaga

SEQ ID NO: 8200006 - DNA, 21 bp, Homo sapiens
acatacataccttaccacctt

SEQ ID NO: 8200007 - DNA, 21 bp, Homo sapiens
acatacataccttaccacctt

SEQ ID NO: 8200008 - DNA, 23 bp, Homo sapiens
acatacatggagataaagtgatg

SEQ ID NO: 8200009 - DNA, 23 bp, Homo sapiens
acatacatggagataaagtgatg

SEQ ID NO: 8200010 - DNA, 22 bp, Homo sapiens
acatacatcaagtatcacaaga

SEQ ID NO: 8200011 - DNA, 23 bp, Homo sapiens
acatacatggagataaagtgatg

SEQ ID NO: 8200012 - DNA, 22 bp, Homo sapiens
acatacatcaagtatcacaaga

SEQ ID NO: 8200013 - DNA, 22 bp, Homo sapiens
acatacatcaagtatcacaaga

SEQ ID NO: 8200014 - DNA, 22 bp, Homo sapiens
acatacatcaagtatcacaaga

SEQ ID NO: 8200015 - DNA, 22 bp, Homo sapiens
acataaatttcactgttccgtg

SEQ ID NO: 8200016 - DNA, 22 bp, Homo sapiens
aggcacagatttggggaaagca

SEQ ID NO: 8200017 - DNA, 22 bp, Homo sapiens
aggcacagatttggggaaagca

SEQ ID NO: 8200018 - DNA, 18 bp, Homo sapiens
aggcacagagcatacata

SEQ ID NO: 8200019 - DNA, 18 bp, Homo sapiens
aggcacagagcatacata

SEQ ID NO: 8200020 - DNA, 18 bp, Homo sapiens
aggcacagagcatacata

SEQ ID NO: 8200021 - DNA, 22 bp, Homo sapiens
aggcacagatttggggaaagca

SEQ ID NO: 8200022 - DNA, 22 bp, Homo sapiens
aggcacagagaatgccctccat

SEQ ID NO: 8200023 - DNA, 22 bp, Homo sapiens
aggcacagaatggcattcagtg

SEQ ID NO: 8200024 - DNA, 18 bp, Homo sapiens
aggcacagagcatacata

SEQ ID NO: 8200025 - DNA, 18 bp, Homo sapiens
aggcacagagcatacata

SEQ ID NO: 8200026 - DNA, 22 bp, Homo sapiens
aggcacagagaatgccctccat

SEQ ID NO: 8200027 - DNA, 22 bp, Homo sapiens
aggcaacaggaaaccacatgat

SEQ ID NO: 8200028 - DNA, 22 bp, Homo sapiens
aggcaacaggaaaccacatgat

SEQ ID NO: 8200029 - DNA, 22 bp, Homo sapiens
aggcaacaggaaaccacatgat

SEQ ID NO: 8200030 - DNA, 22 bp, Homo sapiens
aggcaacaggaaaccacatgat

SEQ ID NO: 8200031 - DNA, 22 bp, Homo sapiens
aggcaacaagggtagtcagtga

SEQ ID NO: 8200032 - DNA, 22 bp, Homo sapiens
aggcaacatgggccaggcagaa

SEQ ID NO: 8200033 - DNA, 22 bp, Homo sapiens
aggcaacatgggccaggcagaa

SEQ ID NO: 8200034 - DNA, 19 bp, Homo sapiens
aggcaaccaatgaggcaaa

SEQ ID NO: 8200035 - DNA, 22 bp, Homo sapiens
aggcaactaggcctctgcctca

SEQ ID NO: 8200036 - DNA, 22 bp, Homo sapiens
aggcacaagaaactgctcccca

SEQ ID NO: 8200037 - DNA, 22 bp, Homo sapiens
aggcacaaagacagaaaagcac

SEQ ID NO: 8200038 - DNA, 19 bp, Homo sapiens
aggcacaattctgagaagc

SEQ ID NO: 8200039 - DNA, 22 bp, Homo sapiens
aggcacagaatggcattcagtg

SEQ ID NO: 8200040 - DNA, 22 bp, Homo sapiens
aggcaaaagaatgtcataaatg

SEQ ID NO: 8200041 - DNA, 22 bp, Homo sapiens
aggatggcttgcaggaggctgt

SEQ ID NO: 8200042 - DNA, 22 bp, Homo sapiens
aggattttgctttataaaagcc

SEQ ID NO: 8200043 - DNA, 23 bp, Homo sapiens
aggcaaacctataaaataggaat

SEQ ID NO: 8200044 - DNA, 22 bp, Homo sapiens
aggcaaagaagttggtcaggag

SEQ ID NO: 8200045 - DNA, 22 bp, Homo sapiens
aggcaaagaagttggtcaggag

SEQ ID NO: 8200046 - DNA, 22 bp, Homo sapiens
aggcaaagaagttggtcaggag

SEQ ID NO: 8200047 - DNA, 22 bp, Homo sapiens
aggcaaagcgataccagagcta

SEQ ID NO: 8200048 - DNA, 22 bp, Homo sapiens
aggcaaagagccagcaaatctg

SEQ ID NO: 8200049 - DNA, 22 bp, Homo sapiens
aggcaaagagccagcaaatctg

SEQ ID NO: 8200050 - DNA, 22 bp, Homo sapiens
aggaggggttctcgggtgctga

SEQ ID NO: 8200051 - DNA, 22 bp, Homo sapiens
aggaggggttctcgggtgctga

SEQ ID NO: 8200052 - DNA, 22 bp, Homo sapiens
aggaggggttctcgggtgctga

SEQ ID NO: 8200053 - DNA, 22 bp, Homo sapiens
aggaggggttctcgggtgctga

SEQ ID NO: 8200054 - DNA, 22 bp, Homo sapiens
aggaggggttctcgggtgctga

SEQ ID NO: 8200055 - DNA, 22 bp, Homo sapiens
aggaggggttctcgggtgctga

SEQ ID NO: 8200056 - DNA, 22 bp, Homo sapiens
aggagggtacaatgggtggaaa

SEQ ID NO: 8200057 - DNA, 22 bp, Homo sapiens
aggagggtcatgttgaagtgta

SEQ ID NO: 8200058 - DNA, 20 bp, Homo sapiens
aggatggcaagcaagtgcat

SEQ ID NO: 8200059 - DNA, 20 bp, Homo sapiens
aggatggcaagcaagtgcat

SEQ ID NO: 8200060 - DNA, 22 bp, Homo sapiens
aggaggcttttgcaggtgccac

SEQ ID NO: 8200061 - DNA, 22 bp, Homo sapiens
aggaggcttttgcaggtgccac

SEQ ID NO: 8200062 - DNA, 22 bp, Homo sapiens
aggaggcttttgcaggtgccac

SEQ ID NO: 8200063 - DNA, 22 bp, Homo sapiens
aggaggcttttgcaggtgccac

SEQ ID NO: 8200064 - DNA, 22 bp, Homo sapiens
aggaggccgatttcagaggtcg

SEQ ID NO: 8200065 - DNA, 22 bp, Homo sapiens
aggaggccgctgatgggctccc

SEQ ID NO: 8200066 - DNA, 22 bp, Homo sapiens
aggaggctgtggagcactccat

SEQ ID NO: 8200067 - DNA, 22 bp, Homo sapiens
aggagggacaccaatatatgtt

SEQ ID NO: 8200068 - DNA, 22 bp, Homo sapiens
aggagggaataagaaagagtca

SEQ ID NO: 8200069 - DNA, 21 bp, Homo sapiens
aggaggggtctttcccactga

SEQ ID NO: 8200070 - DNA, 22 bp, Homo sapiens
aggaggggcatagaaatgtaat

SEQ ID NO: 8200071 - DNA, 22 bp, Homo sapiens
aggaggggcatagaaatgtaat

SEQ ID NO: 8200072 - DNA, 22 bp, Homo sapiens
aggagggagatgcccatcctgg

SEQ ID NO: 8200073 - DNA, 22 bp, Homo sapiens
aggagggagatgcccatcctgg

SEQ ID NO: 8200074 - DNA, 22 bp, Homo sapiens
aggagggacctaggaatattgc

SEQ ID NO: 8200075 - DNA, 20 bp, Homo sapiens
aggagggacctggattggcg

SEQ ID NO: 8200076 - DNA, 20 bp, Homo sapiens
aggagggacctggattggcg

SEQ ID NO: 8200077 - DNA, 20 bp, Homo sapiens
aggagggacctggattggcg

SEQ ID NO: 8200078 - DNA, 20 bp, Homo sapiens
aggagggacctggattggcg

SEQ ID NO: 8200079 - DNA, 22 bp, Homo sapiens
acagggtggggatggtgagctt

SEQ ID NO: 8200080 - DNA, 22 bp, Homo sapiens
aggagcagaccgtagtcctgca

SEQ ID NO: 8200081 - DNA, 22 bp, Homo sapiens
acagggtgactttgtgacagat

SEQ ID NO: 8200082 - DNA, 22 bp, Homo sapiens
acagggtgactttgtgacagat

SEQ ID NO: 8200083 - DNA, 22 bp, Homo sapiens
acagggtgactttgtgacagat

SEQ ID NO: 8200084 - DNA, 22 bp, Homo sapiens
acagggtgactttgtgacagat

SEQ ID NO: 8200085 - DNA, 22 bp, Homo sapiens
acagggtgaatgtgacattatc

SEQ ID NO: 8200086 - DNA, 22 bp, Homo sapiens
acagggtcaagggtgctacaag

SEQ ID NO: 8200087 - DNA, 22 bp, Homo sapiens
acagggtcttagagatcacctg

SEQ ID NO: 8200088 - DNA, 22 bp, Homo sapiens
acagggtcattttatgatctgt

SEQ ID NO: 8200089 - DNA, 22 bp, Homo sapiens
acagggggtcccatggcctgga

SEQ ID NO: 8200090 - DNA, 22 bp, Homo sapiens
aggagccatgagtgacatcaca

SEQ ID NO: 8200091 - DNA, 22 bp, Homo sapiens
acagggtggggatggtgagctt

SEQ ID NO: 8200092 - DNA, 22 bp, Homo sapiens
aggagcagaccgtagtcctgca

SEQ ID NO: 8200093 - DNA, 22 bp, Homo sapiens
aggagcagaccgtagtcctgca

SEQ ID NO: 8200094 - DNA, 22 bp, Homo sapiens
aggagccatggaggtgaggcgg

SEQ ID NO: 8200095 - DNA, 22 bp, Homo sapiens
aggagccatggaggtgaggcgg

SEQ ID NO: 8200096 - DNA, 21 bp, Homo sapiens
aggagccatgtggtctgatgg

SEQ ID NO: 8200097 - DNA, 20 bp, Homo sapiens
aggagccattgactgcagca

SEQ ID NO: 8200098 - DNA, 20 bp, Homo sapiens
aggagccattgactgcagca

SEQ ID NO: 8200099 - DNA, 22 bp, Homo sapiens
aggagccattgcaggatggcag

SEQ ID NO: 8200100 - DNA, 22 bp, Homo sapiens
aggagccattgcaggatggcag

SEQ ID NO: 8200101 - DNA, 22 bp, Homo sapiens
aggagccattttccaagggcga

SEQ ID NO: 8200102 - DNA, 22 bp, Homo sapiens
aggagctgcactgggagttttt

SEQ ID NO: 8200103 - DNA, 22 bp, Homo sapiens
aggagctgcactgggagttttt

SEQ ID NO: 8200104 - DNA, 22 bp, Homo sapiens
aggagctgcactgggagttttt

SEQ ID NO: 8200105 - DNA, 22 bp, Homo sapiens
aggagctgcagattctgccttg

SEQ ID NO: 8200106 - DNA, 22 bp, Homo sapiens
aggagctgcagattctgccttg

SEQ ID NO: 8200107 - DNA, 22 bp, Homo sapiens
aggagctgcagattctgccttg

SEQ ID NO: 8200108 - DNA, 22 bp, Homo sapiens
aggagctgcatggatacctggt

SEQ ID NO: 8200109 - DNA, 22 bp, Homo sapiens
aggagctgcagattctgccttg

SEQ ID NO: 8200110 - DNA, 22 bp, Homo sapiens
aggagctgcatggatacctggt

SEQ ID NO: 8200111 - DNA, 22 bp, Homo sapiens
aggagctgcatggatacctggt

SEQ ID NO: 8200112 - DNA, 22 bp, Homo sapiens
aggagctgcatggatacctggt

SEQ ID NO: 8200113 - DNA, 22 bp, Homo sapiens
aggagctgcatggatacctggt

SEQ ID NO: 8200114 - DNA, 22 bp, Homo sapiens
aggagctgctttggtgcggttt

SEQ ID NO: 8200115 - DNA, 22 bp, Homo sapiens
aggagctgctttggtgcggttt

SEQ ID NO: 8200116 - DNA, 22 bp, Homo sapiens
aggagctgctttggtgcggttt

SEQ ID NO: 8200117 - DNA, 22 bp, Homo sapiens
aggagctggaatggtccttttg

SEQ ID NO: 8200118 - DNA, 22 bp, Homo sapiens
aggagctggaatggtccttttg

SEQ ID NO: 8200119 - DNA, 22 bp, Homo sapiens
aggagctggaatggtccttttg

SEQ ID NO: 8200120 - DNA, 22 bp, Homo sapiens
aggagctggagtccaggcaagt

SEQ ID NO: 8200121 - DNA, 21 bp, Homo sapiens
aggagctggagaaaactttcc

SEQ ID NO: 8200122 - DNA, 22 bp, Homo sapiens
aggagctgcttaaatggttggt

SEQ ID NO: 8200123 - DNA, 22 bp, Homo sapiens
aggagctgcttaaatggttggt

SEQ ID NO: 8200124 - DNA, 22 bp, Homo sapiens
aggagctgcttaaatggttggt

SEQ ID NO: 8200125 - DNA, 22 bp, Homo sapiens
aggagctgcttaaatggttggt

SEQ ID NO: 8200126 - DNA, 22 bp, Homo sapiens
aggagctgctttggtgcggttt

SEQ ID NO: 8200127 - DNA, 22 bp, Homo sapiens
aggagctgctttggtgcggttt

SEQ ID NO: 8200128 - DNA, 22 bp, Homo sapiens
aggagctgcttaaatggttggt

SEQ ID NO: 8200129 - DNA, 22 bp, Homo sapiens
aggagctgcaaaaccggccgct

SEQ ID NO: 8200130 - DNA, 22 bp, Homo sapiens
aggagctgcaaaaccggccgct

SEQ ID NO: 8200131 - DNA, 22 bp, Homo sapiens
aggagctgcaaatattagtaat

SEQ ID NO: 8200132 - DNA, 22 bp, Homo sapiens
aggagcctggctggcccacagg

SEQ ID NO: 8200133 - DNA, 22 bp, Homo sapiens
aggagcctccttctcatgtgca

SEQ ID NO: 8200134 - DNA, 22 bp, Homo sapiens
aggagcctgaatcagagggtga

SEQ ID NO: 8200135 - DNA, 22 bp, Homo sapiens
aggagccctgcgggaggcagag

SEQ ID NO: 8200136 - DNA, 22 bp, Homo sapiens
aggagccctccgttgcttcatc

SEQ ID NO: 8200137 - DNA, 23 bp, Homo sapiens
aggagcccctaattctgggcagc

SEQ ID NO: 8200138 - DNA, 22 bp, Homo sapiens
aggagcccctcttcagtcctgg

SEQ ID NO: 8200139 - DNA, 22 bp, Homo sapiens
aggagcccctcttcagtcctgg

SEQ ID NO: 8200140 - DNA, 22 bp, Homo sapiens
aggagccattttccaagggcga

SEQ ID NO: 8200141 - DNA, 19 bp, Homo sapiens
aggaaggcggcggctgccc

SEQ ID NO: 8200142 - DNA, 22 bp, Homo sapiens
aggaaggctgatcactgcttgt

SEQ ID NO: 8200143 - DNA, 22 bp, Homo sapiens
aggaaggctgatcactgcttgt

SEQ ID NO: 8200144 - DNA, 20 bp, Homo sapiens
aggaaggctgttggccttgc

SEQ ID NO: 8200145 - DNA, 20 bp, Homo sapiens
aggaaggctgttggccttgc

SEQ ID NO: 8200146 - DNA, 19 bp, Homo sapiens
aggaaggcggcggctgccc

SEQ ID NO: 8200147 - DNA, 22 bp, Homo sapiens
aggaaggctgatcactgcttgt

SEQ ID NO: 8200148 - DNA, 22 bp, Homo sapiens
aggaaggcacattgttggctaa

SEQ ID NO: 8200149 - DNA, 22 bp, Homo sapiens
aggaaggagggcagatattaag

SEQ ID NO: 8200150 - DNA, 22 bp, Homo sapiens
aggaagcctggcattaaaaagc

SEQ ID NO: 8200151 - DNA, 22 bp, Homo sapiens
aggaagcctggagtcctgccca

SEQ ID NO: 8200152 - DNA, 22 bp, Homo sapiens
aggaagcctgcaggtgactgct

SEQ ID NO: 8200153 - DNA, 22 bp, Homo sapiens
aggaagcctgcaggtgactgct

SEQ ID NO: 8200154 - DNA, 22 bp, Homo sapiens
aggaagcccaagtctcatcttc

SEQ ID NO: 8200155 - DNA, 22 bp, Homo sapiens
aggaagccatggtggacgtcta

SEQ ID NO: 8200156 - DNA, 22 bp, Homo sapiens
aggaagcccttgtcatttctgt

SEQ ID NO: 8200157 - DNA, 17 bp, Homo sapiens
aggaagcgagctggcct

SEQ ID NO: 8200158 - DNA, 22 bp, Homo sapiens
aggaagcgtgggtctggctgga

SEQ ID NO: 8200159 - DNA, 17 bp, Homo sapiens
aggaagcgagctggcct

SEQ ID NO: 8200160 - DNA, 22 bp, Homo sapiens
aggaagcctggggctgccctcg

SEQ ID NO: 8200161 - DNA, 22 bp, Homo sapiens
aggaagcctggggctgccctcg

SEQ ID NO: 8200162 - DNA, 22 bp, Homo sapiens
aggaagctagaaggtcttcttt

SEQ ID NO: 8200163 - DNA, 23 bp, Homo sapiens
aggaagctaccaattttgtaggc

SEQ ID NO: 8200164 - DNA, 22 bp, Homo sapiens
aggaagctagagccaccggact

SEQ ID NO: 8200165 - DNA, 20 bp, Homo sapiens
aggaaggagaatctgagcaa

SEQ ID NO: 8200166 - DNA, 23 bp, Homo sapiens
aggaagctaagtgtggctgcgga

SEQ ID NO: 8200167 - DNA, 23 bp, Homo sapiens
aggaagctaagtgtggctgcgga

SEQ ID NO: 8200168 - DNA, 22 bp, Homo sapiens
aggaagctaaccagggagtgag

SEQ ID NO: 8200169 - DNA, 22 bp, Homo sapiens
aggaagctaaccagggagtgag

SEQ ID NO: 8200170 - DNA, 22 bp, Homo sapiens
aggagacatactataggaatat

SEQ ID NO: 8200171 - DNA, 20 bp, Homo sapiens
aggagaccaagccaagtgga

SEQ ID NO: 8200172 - DNA, 22 bp, Homo sapiens
aggagacatctaactgtaggtt

SEQ ID NO: 8200173 - DNA, 22 bp, Homo sapiens
acaggggctccgaaggtgaggg

SEQ ID NO: 8200174 - DNA, 22 bp, Homo sapiens
acaggggctccgaaggtgaggg

SEQ ID NO: 8200175 - DNA, 22 bp, Homo sapiens
acaggggctccgaaggtgaggg

SEQ ID NO: 8200176 - DNA, 22 bp, Homo sapiens
aggagaccttttgagtgtgaga

SEQ ID NO: 8200177 - DNA, 22 bp, Homo sapiens
aggagaccttttgagtgtgaga

SEQ ID NO: 8200178 - DNA, 22 bp, Homo sapiens
aggagactcagagacctggccg

SEQ ID NO: 8200179 - DNA, 22 bp, Homo sapiens
aggagactcagagacctggccg

SEQ ID NO: 8200180 - DNA, 22 bp, Homo sapiens
aggagacccagaatgttgctgt

SEQ ID NO: 8200181 - DNA, 22 bp, Homo sapiens
aggagacccaatgccagaaaga

SEQ ID NO: 8200182 - DNA, 21 bp, Homo sapiens
aggagaccggcttgtttgtgc

SEQ ID NO: 8200183 - DNA, 21 bp, Homo sapiens
aggagaccggcttgtttgtgc

SEQ ID NO: 8200184 - DNA, 22 bp, Homo sapiens
aggagaccttcaccacttccac

SEQ ID NO: 8200185 - DNA, 22 bp, Homo sapiens
aggaagggctgtttctccaaga

SEQ ID NO: 8200186 - DNA, 20 bp, Homo sapiens
aggacttgtttgggcagagt

SEQ ID NO: 8200187 - DNA, 22 bp, Homo sapiens
aggaagggatacataggatagt

SEQ ID NO: 8200188 - DNA, 22 bp, Homo sapiens
aggaagggatacataggatagt

SEQ ID NO: 8200189 - DNA, 22 bp, Homo sapiens
aggaagggatacataggatagt

SEQ ID NO: 8200190 - DNA, 22 bp, Homo sapiens
aggaagggatacataggatagt

SEQ ID NO: 8200191 - DNA, 22 bp, Homo sapiens
aggaagggatacataggatagt

SEQ ID NO: 8200192 - DNA, 17 bp, Homo sapiens
aggaagggcaagtttct

SEQ ID NO: 8200193 - DNA, 17 bp, Homo sapiens
aggaagggcaagtttct

SEQ ID NO: 8200194 - DNA, 23 bp, Homo sapiens
aggagacagggaagtgcctggct

SEQ ID NO: 8200195 - DNA, 22 bp, Homo sapiens
aggagacagccaggggcctgag

SEQ ID NO: 8200196 - DNA, 23 bp, Homo sapiens
aggagacagggaagtgcctggct

SEQ ID NO: 8200197 - DNA, 23 bp, Homo sapiens
agctttgtgaaagcagacatggg

SEQ ID NO: 8200198 - DNA, 22 bp, Homo sapiens
agctttattaactctccaggtg

SEQ ID NO: 8200199 - DNA, 22 bp, Homo sapiens
agctttatggtgcctcacttga

SEQ ID NO: 8200200 - DNA, 22 bp, Homo sapiens
agctttggtgctgtcacacaaa

SEQ ID NO: 8200201 - DNA, 22 bp, Homo sapiens
agctttggttgaggggagtgtg

SEQ ID NO: 8200202 - DNA, 22 bp, Homo sapiens
agctttatggtgcctcacttga

SEQ ID NO: 8200203 - DNA, 22 bp, Homo sapiens
agctttatggtgcctcacttga

SEQ ID NO: 8200204 - DNA, 22 bp, Homo sapiens
agcttccaatttctccaagaga

SEQ ID NO: 8200205 - DNA, 22 bp, Homo sapiens
agcttcatgcctaaagacagcg

SEQ ID NO: 8200206 - DNA, 22 bp, Homo sapiens
aggaaaaagagttgctgccttc

SEQ ID NO: 8200207 - DNA, 19 bp, Homo sapiens
agcttttactaacagcaga

SEQ ID NO: 8200208 - DNA, 22 bp, Homo sapiens
agcttttacataatgatcttga

SEQ ID NO: 8200209 - DNA, 22 bp, Homo sapiens
agcttttattggctgtcatttg

SEQ ID NO: 8200210 - DNA, 22 bp, Homo sapiens
agcttttagtacgttaaaattg

SEQ ID NO: 8200211 - DNA, 21 bp, Homo sapiens
agcttttctgttttatatcta

SEQ ID NO: 8200212 - DNA, 22 bp, Homo sapiens
agctttttcactttggatggga

SEQ ID NO: 8200213 - DNA, 22 bp, Homo sapiens
aggaagagcattcacatggtag

SEQ ID NO: 8200214 - DNA, 18 bp, Homo sapiens
aggaaagaaaggcaggtg

SEQ ID NO: 8200215 - DNA, 22 bp, Homo sapiens
aggaaagaaaggaggtgcattt

SEQ ID NO: 8200216 - DNA, 18 bp, Homo sapiens
aggaagcaggaggaaggc

SEQ ID NO: 8200217 - DNA, 22 bp, Homo sapiens
aggaagagcattcacatggtag

SEQ ID NO: 8200218 - DNA, 18 bp, Homo sapiens
aggaagcaggaggaaggc

SEQ ID NO: 8200219 - DNA, 22 bp, Homo sapiens
aggaagcagtttataatgcatt

SEQ ID NO: 8200220 - DNA, 20 bp, Homo sapiens
aggaagccaaaggctgtctt

SEQ ID NO: 8200221 - DNA, 22 bp, Homo sapiens
aggaagccatggtggacgtcta

SEQ ID NO: 8200222 - DNA, 22 bp, Homo sapiens
aggaagccacgagtggcacggg

SEQ ID NO: 8200223 - DNA, 22 bp, Homo sapiens
aggaaactgatgttttttacaa

SEQ ID NO: 8200224 - DNA, 22 bp, Homo sapiens
aggaaactgggcctcaggttag

SEQ ID NO: 8200225 - DNA, 22 bp, Homo sapiens
aggaaactgatgttttttacaa

SEQ ID NO: 8200226 - DNA, 22 bp, Homo sapiens
aggaaactgggtatggttatac

SEQ ID NO: 8200227 - DNA, 22 bp, Homo sapiens
aggaaactgtcccctcatccta

SEQ ID NO: 8200228 - DNA, 22 bp, Homo sapiens
aggaaactgggtatggttatac

SEQ ID NO: 8200229 - DNA, 19 bp, Homo sapiens
aggaaactgtcttttccag

SEQ ID NO: 8200230 - DNA, 22 bp, Homo sapiens
aggaaacttcagagttttggtc

SEQ ID NO: 8200231 - DNA, 22 bp, Homo sapiens
aggaaacttcagagttttggtc

SEQ ID NO: 8200232 - DNA, 22 bp, Homo sapiens
aggaaactttcttttgcttcat

SEQ ID NO: 8200233 - DNA, 22 bp, Homo sapiens
aggaaactcaaagtgtcaggta

SEQ ID NO: 8200234 - DNA, 22 bp, Homo sapiens
aggaaactcccctacatctcaa

SEQ ID NO: 8200235 - DNA, 22 bp, Homo sapiens
aggaaactgaagcccagagagg

SEQ ID NO: 8200236 - DNA, 23 bp, Homo sapiens
aggaaactgaaggggccctctat

SEQ ID NO: 8200237 - DNA, 22 bp, Homo sapiens
aggaaactgaggttacgggact

SEQ ID NO: 8200238 - DNA, 22 bp, Homo sapiens
aggaaactctgagcggaccagc

SEQ ID NO: 8200239 - DNA, 22 bp, Homo sapiens
aggaaactgaagcccagagagg

SEQ ID NO: 8200240 - DNA, 22 bp, Homo sapiens
aggaaactaaggctcagtgaag

SEQ ID NO: 8200241 - DNA, 22 bp, Homo sapiens
aggaaactaattagtagaataa

SEQ ID NO: 8200242 - DNA, 22 bp, Homo sapiens
aggaaactaattagtagaataa

SEQ ID NO: 8200243 - DNA, 22 bp, Homo sapiens
aggaaactaacttatctttata

SEQ ID NO: 8200244 - DNA, 22 bp, Homo sapiens
agctgggatgataacctcagtc

SEQ ID NO: 8200245 - DNA, 22 bp, Homo sapiens
agctgggcaaaatgtgaggttg

SEQ ID NO: 8200246 - DNA, 22 bp, Homo sapiens
agctgggatgataacctcagtc

SEQ ID NO: 8200247 - DNA, 21 bp, Homo sapiens
agctgtggcgaggggaacatg

SEQ ID NO: 8200248 - DNA, 22 bp, Homo sapiens
agctggttcagaaattagatgg

SEQ ID NO: 8200249 - DNA, 22 bp, Homo sapiens
agctggttcagaaattagatgg

SEQ ID NO: 8200250 - DNA, 22 bp, Homo sapiens
agctgtgggagaatctctgggt

SEQ ID NO: 8200251 - DNA, 22 bp, Homo sapiens
agctgtgggcctgggagagctg

SEQ ID NO: 8200252 - DNA, 22 bp, Homo sapiens
agctgggagcagagccacagcc

SEQ ID NO: 8200253 - DNA, 22 bp, Homo sapiens
agctgggagcagagccacagcc

SEQ ID NO: 8200254 - DNA, 22 bp, Homo sapiens
agctgggagcagagccacagcc

SEQ ID NO: 8200255 - DNA, 22 bp, Homo sapiens
agctgggagcagagccacagcc

SEQ ID NO: 8200256 - DNA, 22 bp, Homo sapiens
agctgggagcagagccacagcc

SEQ ID NO: 8200257 - DNA, 22 bp, Homo sapiens
agctgggagctgaaggctgatt

SEQ ID NO: 8200258 - DNA, 22 bp, Homo sapiens
agctgggagctgaaggctgatt

SEQ ID NO: 8200259 - DNA, 22 bp, Homo sapiens
agctgggagctgaaggctgatt

SEQ ID NO: 8200260 - DNA, 22 bp, Homo sapiens
agctgggaggctcctctgtgac

SEQ ID NO: 8200261 - DNA, 22 bp, Homo sapiens
agctgggaggtgggcagtgaga

SEQ ID NO: 8200262 - DNA, 22 bp, Homo sapiens
agctgggaggtgggcagtgaga

SEQ ID NO: 8200263 - DNA, 22 bp, Homo sapiens
agctgggaggtgggcagtgaga

SEQ ID NO: 8200264 - DNA, 22 bp, Homo sapiens
agctgggatgaggagcatcctt

SEQ ID NO: 8200265 - DNA, 22 bp, Homo sapiens
agctgggatgaggagcatcctt

SEQ ID NO: 8200266 - DNA, 22 bp, Homo sapiens
agctgggatgaggagcatcctt

SEQ ID NO: 8200267 - DNA, 22 bp, Homo sapiens
agcttagtggttgtatgagtta

SEQ ID NO: 8200268 - DNA, 22 bp, Homo sapiens
agcttattaatttttctgcatg

SEQ ID NO: 8200269 - DNA, 22 bp, Homo sapiens
agcttatcttgttagtttcatt

SEQ ID NO: 8200270 - DNA, 22 bp, Homo sapiens
agcttattaatttttctgcatg

SEQ ID NO: 8200271 - DNA, 22 bp, Homo sapiens
agcttattatcttatcaagctt

SEQ ID NO: 8200272 - DNA, 22 bp, Homo sapiens
agcttattatcttatcaagctt

SEQ ID NO: 8200273 - DNA, 22 bp, Homo sapiens
agcttattatcttatcaagctt

SEQ ID NO: 8200274 - DNA, 22 bp, Homo sapiens
agcttcaaagctaggaagatct

SEQ ID NO: 8200275 - DNA, 22 bp, Homo sapiens
agcttattcatcttgtgaccta

SEQ ID NO: 8200276 - DNA, 22 bp, Homo sapiens
agctgtggttagatagagtcct

SEQ ID NO: 8200277 - DNA, 22 bp, Homo sapiens
agctgtggttagatagagtcct

SEQ ID NO: 8200278 - DNA, 22 bp, Homo sapiens
agctgtggtgttttcaagccct

SEQ ID NO: 8200279 - DNA, 22 bp, Homo sapiens
agctgtggtacttgattcacaa

SEQ ID NO: 8200280 - DNA, 22 bp, Homo sapiens
agctgtggtcttcaagttgcct

SEQ ID NO: 8200281 - DNA, 21 bp, Homo sapiens
agctgtggttttacatctttt

SEQ ID NO: 8200282 - DNA, 22 bp, Homo sapiens
agctgtggggaggaggctagca

SEQ ID NO: 8200283 - DNA, 22 bp, Homo sapiens
agctgtgggcctgggagagctg

SEQ ID NO: 8200284 - DNA, 22 bp, Homo sapiens
agctgtggggcaggcagcgagg

SEQ ID NO: 8200285 - DNA, 22 bp, Homo sapiens
agctgtggggcaggcagcgagg

SEQ ID NO: 8200286 - DNA, 19 bp, Homo sapiens
agctgtggggcctagcacc

SEQ ID NO: 8200287 - DNA, 21 bp, Homo sapiens
acagcctccatctcctgggct

SEQ ID NO: 8200288 - DNA, 22 bp, Homo sapiens
acagcccgttctctggcacaca

SEQ ID NO: 8200289 - DNA, 22 bp, Homo sapiens
acagcccgttctctggcacaca

SEQ ID NO: 8200290 - DNA, 22 bp, Homo sapiens
acagccccccgctcagtttcca

SEQ ID NO: 8200291 - DNA, 22 bp, Homo sapiens
acagcccgtgtcatcagctgct

SEQ ID NO: 8200292 - DNA, 22 bp, Homo sapiens
acagcccaggactccagtgggc

SEQ ID NO: 8200293 - DNA, 22 bp, Homo sapiens
acagccccagcgcggcggggtc

SEQ ID NO: 8200294 - DNA, 23 bp, Homo sapiens
acagccccatgcaggtgtgtttg

SEQ ID NO: 8200295 - DNA, 22 bp, Homo sapiens
acagccccagcgcggcggggtc

SEQ ID NO: 8200296 - DNA, 22 bp, Homo sapiens
acagcccagaaagcctaagggg

SEQ ID NO: 8200297 - DNA, 22 bp, Homo sapiens
agctgcttgggaaccatcaatt

SEQ ID NO: 8200298 - DNA, 18 bp, Homo sapiens
agctgcttgcaggccttc

SEQ ID NO: 8200299 - DNA, 22 bp, Homo sapiens
agctgcttcaaaatgggctcct

SEQ ID NO: 8200300 - DNA, 22 bp, Homo sapiens
agctgctgtggccacatctggc

SEQ ID NO: 8200301 - DNA, 22 bp, Homo sapiens
agctgctgtcctaggcactgta

SEQ ID NO: 8200302 - DNA, 22 bp, Homo sapiens
agctgctgtcctaggcactgta

SEQ ID NO: 8200303 - DNA, 22 bp, Homo sapiens
agctgctgtcctaggcactgta

SEQ ID NO: 8200304 - DNA, 22 bp, Homo sapiens
agctgctgtcctaggcactgta

SEQ ID NO: 8200305 - DNA, 22 bp, Homo sapiens
agctgctggtttaagggatggg

SEQ ID NO: 8200306 - DNA, 22 bp, Homo sapiens
agctgctggtttaagggatggg

SEQ ID NO: 8200307 - DNA, 22 bp, Homo sapiens
agctgctggtttaagggatggg

SEQ ID NO: 8200308 - DNA, 22 bp, Homo sapiens
agctgctgtggccacatctggc

SEQ ID NO: 8200309 - DNA, 22 bp, Homo sapiens
agctgctgtggccacatctggc

SEQ ID NO: 8200310 - DNA, 21 bp, Homo sapiens
agctgctgtggccagaatcca

SEQ ID NO: 8200311 - DNA, 21 bp, Homo sapiens
agctgctgtggccagaatcca

SEQ ID NO: 8200312 - DNA, 22 bp, Homo sapiens
agctggcctgttagagctgagt

SEQ ID NO: 8200313 - DNA, 22 bp, Homo sapiens
agctggcctgttagagctgagt

SEQ ID NO: 8200314 - DNA, 22 bp, Homo sapiens
agctggcctgttagagctgagt

SEQ ID NO: 8200315 - DNA, 22 bp, Homo sapiens
agctggcctgttagagctgagt

SEQ ID NO: 8200316 - DNA, 22 bp, Homo sapiens
agctggccttagtgagcacctg

SEQ ID NO: 8200317 - DNA, 22 bp, Homo sapiens
agctggccttagtgagcacctg

SEQ ID NO: 8200318 - DNA, 22 bp, Homo sapiens
agctggccttcggtgtcactgg

SEQ ID NO: 8200319 - DNA, 22 bp, Homo sapiens
agctggctatacttgaaaagtc

SEQ ID NO: 8200320 - DNA, 22 bp, Homo sapiens
agctggccttcggtgtcactgg

SEQ ID NO: 8200321 - DNA, 22 bp, Homo sapiens
agctggctatacttgaaaagtc

SEQ ID NO: 8200322 - DNA, 22 bp, Homo sapiens
agctggctatacttgaaaagtc

SEQ ID NO: 8200323 - DNA, 22 bp, Homo sapiens
agctggctatacttgaaaagtc

SEQ ID NO: 8200324 - DNA, 21 bp, Homo sapiens
agctggctatagttagtgatg

SEQ ID NO: 8200325 - DNA, 22 bp, Homo sapiens
agctggctatgccctgtgaacc

SEQ ID NO: 8200326 - DNA, 21 bp, Homo sapiens
agctggctatagttagtgatg

SEQ ID NO: 8200327 - DNA, 22 bp, Homo sapiens
agctggctcagccgggtggtct

SEQ ID NO: 8200328 - DNA, 21 bp, Homo sapiens
agctggctctctctggagaga

SEQ ID NO: 8200329 - DNA, 21 bp, Homo sapiens
agctggctctctctggagaga

SEQ ID NO: 8200330 - DNA, 21 bp, Homo sapiens
agctggctctctctggagaga

SEQ ID NO: 8200331 - DNA, 22 bp, Homo sapiens
acagcctgagagtggagctggc

SEQ ID NO: 8200332 - DNA, 22 bp, Homo sapiens
acagcctgagagtggagctggc

SEQ ID NO: 8200333 - DNA, 22 bp, Homo sapiens
acagcctgatttatggagcagt

SEQ ID NO: 8200334 - DNA, 22 bp, Homo sapiens
acagcctgatttatggagcagt

SEQ ID NO: 8200335 - DNA, 22 bp, Homo sapiens
acagcctgcagccccaggtcgc

SEQ ID NO: 8200336 - DNA, 19 bp, Homo sapiens
agctggcagcttccacttc

SEQ ID NO: 8200337 - DNA, 22 bp, Homo sapiens
agctggcaggggttcacactgc

SEQ ID NO: 8200338 - DNA, 22 bp, Homo sapiens
agctggcaggggttcacactgc

SEQ ID NO: 8200339 - DNA, 22 bp, Homo sapiens
agctggcagctctcaggggtac

SEQ ID NO: 8200340 - DNA, 22 bp, Homo sapiens
agctggcctgttagagctgagt

SEQ ID NO: 8200341 - DNA, 20 bp, Homo sapiens
agctggcctgtcctaggcct

SEQ ID NO: 8200342 - DNA, 20 bp, Homo sapiens
agctggcctgtcctaggcct

SEQ ID NO: 8200343 - DNA, 20 bp, Homo sapiens
agctggcctgtcctaggcct

SEQ ID NO: 8200344 - DNA, 20 bp, Homo sapiens
agctggcctgtcctaggcct

SEQ ID NO: 8200345 - DNA, 22 bp, Homo sapiens
agctcccagaagccagagtcgg

SEQ ID NO: 8200346 - DNA, 22 bp, Homo sapiens
acagccagaggtggtcctgggt

SEQ ID NO: 8200347 - DNA, 22 bp, Homo sapiens
acagccagaggtggtcctgggt

SEQ ID NO: 8200348 - DNA, 22 bp, Homo sapiens
acagccagaggtggtcctgggt

SEQ ID NO: 8200349 - DNA, 22 bp, Homo sapiens
agctccagtttcctgactgagc

SEQ ID NO: 8200350 - DNA, 18 bp, Homo sapiens
agctccatctgtcagcat

SEQ ID NO: 8200351 - DNA, 22 bp, Homo sapiens
agctcccaattgacttgaacta

SEQ ID NO: 8200352 - DNA, 22 bp, Homo sapiens
agctcccaattgacttgaacta

SEQ ID NO: 8200353 - DNA, 20 bp, Homo sapiens
agctccatgaagtagtcact

SEQ ID NO: 8200354 - DNA, 22 bp, Homo sapiens
agctccaggtgcaagtcatggt

SEQ ID NO: 8200355 - DNA, 22 bp, Homo sapiens
agctccaggtgcaagtcatggt

SEQ ID NO: 8200356 - DNA, 22 bp, Homo sapiens
agctccaggtgcaagtcatggt

SEQ ID NO: 8200357 - DNA, 20 bp, Homo sapiens
agctccagtgctgacgcttc

SEQ ID NO: 8200358 - DNA, 20 bp, Homo sapiens
agctccagtgctgacgcttc

SEQ ID NO: 8200359 - DNA, 20 bp, Homo sapiens
agctccagtgctgacgcttc

SEQ ID NO: 8200360 - DNA, 22 bp, Homo sapiens
agctccagttacttacctagag

SEQ ID NO: 8200361 - DNA, 22 bp, Homo sapiens
acagccagtaatctacccctgt

SEQ ID NO: 8200362 - DNA, 22 bp, Homo sapiens
acagccagtcatctcagcaggg

SEQ ID NO: 8200363 - DNA, 22 bp, Homo sapiens
acagccagtgactgcagaccct

SEQ ID NO: 8200364 - DNA, 22 bp, Homo sapiens
acagccagtcctcccacagggt

SEQ ID NO: 8200365 - DNA, 22 bp, Homo sapiens
acagccaggtaaaggcatggca

SEQ ID NO: 8200366 - DNA, 22 bp, Homo sapiens
acagccagtaaggaaagaccca

SEQ ID NO: 8200367 - DNA, 22 bp, Homo sapiens
acagccagtaaggaaagaccca

SEQ ID NO: 8200368 - DNA, 22 bp, Homo sapiens
acagccagtaaggaaagaccca

SEQ ID NO: 8200369 - DNA, 22 bp, Homo sapiens
acagccagggtctcaggaggcg

SEQ ID NO: 8200370 - DNA, 22 bp, Homo sapiens
acagccaggtaaaggcatggca

SEQ ID NO: 8200371 - DNA, 22 bp, Homo sapiens
acagccaggtaaaggcatggca

SEQ ID NO: 8200372 - DNA, 22 bp, Homo sapiens
acagccagggtctcaggaggcg

SEQ ID NO: 8200373 - DNA, 22 bp, Homo sapiens
agctgcagccgcagctgtggcc

SEQ ID NO: 8200374 - DNA, 22 bp, Homo sapiens
agctgcagcctcatgattcggt

SEQ ID NO: 8200375 - DNA, 22 bp, Homo sapiens
agctgcagccgcagctgtggcc

SEQ ID NO: 8200376 - DNA, 22 bp, Homo sapiens
agctgcagccgcagctgtggcc

SEQ ID NO: 8200377 - DNA, 22 bp, Homo sapiens
agctgcagccgcagctgtggcc

SEQ ID NO: 8200378 - DNA, 22 bp, Homo sapiens
agctgcagccctcctgcatggc

SEQ ID NO: 8200379 - DNA, 22 bp, Homo sapiens
agctgcagccctcctgcatggc

SEQ ID NO: 8200380 - DNA, 22 bp, Homo sapiens
acagccatagatgcttatgtaa

SEQ ID NO: 8200381 - DNA, 22 bp, Homo sapiens
agctgcagccctcctgcatggc

SEQ ID NO: 8200382 - DNA, 23 bp, Homo sapiens
acagccagttcacctctccttgg

SEQ ID NO: 8200383 - DNA, 23 bp, Homo sapiens
acagccagttcacctctccttgg

SEQ ID NO: 8200384 - DNA, 22 bp, Homo sapiens
acagcccaagtcacctgcagga

SEQ ID NO: 8200385 - DNA, 22 bp, Homo sapiens
acagccagtgactggacaagct

SEQ ID NO: 8200386 - DNA, 22 bp, Homo sapiens
acagccagtgactggacaagct

SEQ ID NO: 8200387 - DNA, 22 bp, Homo sapiens
acagccagtgctccgtgaggac

SEQ ID NO: 8200388 - DNA, 22 bp, Homo sapiens
agctgcaggcccatgctcagtc

SEQ ID NO: 8200389 - DNA, 22 bp, Homo sapiens
agctgcaggattatggaatgga

SEQ ID NO: 8200390 - DNA, 22 bp, Homo sapiens
agctgcaggattatggaatgga

SEQ ID NO: 8200391 - DNA, 22 bp, Homo sapiens
agctgcaggagtcgcctaggat

SEQ ID NO: 8200392 - DNA, 22 bp, Homo sapiens
agctgctcattactttctgttg

SEQ ID NO: 8200393 - DNA, 22 bp, Homo sapiens
agctgctcattactttctgttg

SEQ ID NO: 8200394 - DNA, 22 bp, Homo sapiens
agctgctcaggagagccaggtc

SEQ ID NO: 8200395 - DNA, 22 bp, Homo sapiens
agctgctcaggagagccaggtc

SEQ ID NO: 8200396 - DNA, 22 bp, Homo sapiens
agctgcagctacagtgttggtt

SEQ ID NO: 8200397 - DNA, 22 bp, Homo sapiens
agctgcagctgttttctgagtg

SEQ ID NO: 8200398 - DNA, 22 bp, Homo sapiens
agctgcagctgttttctgagtg

SEQ ID NO: 8200399 - DNA, 22 bp, Homo sapiens
agctgcagcgttcatttttcca

SEQ ID NO: 8200400 - DNA, 22 bp, Homo sapiens
agctgcagctacagtgttggtt

SEQ ID NO: 8200401 - DNA, 22 bp, Homo sapiens
agctgcagctacagtgttggtt

SEQ ID NO: 8200402 - DNA, 22 bp, Homo sapiens
agctgcaggaagtagaagcgga

SEQ ID NO: 8200403 - DNA, 22 bp, Homo sapiens
agctgcaggagtcgcctaggat

SEQ ID NO: 8200404 - DNA, 22 bp, Homo sapiens
agctgcaggagtcgcctaggat

SEQ ID NO: 8200405 - DNA, 22 bp, Homo sapiens
agctgcagcttcctagtccagc

SEQ ID NO: 8200406 - DNA, 22 bp, Homo sapiens
agctgcagcttcctagtccagc

SEQ ID NO: 8200407 - DNA, 22 bp, Homo sapiens
agctgcaggaagtagaagcgga

SEQ ID NO: 8200408 - DNA, 22 bp, Homo sapiens
agatggaggaaggctgaactca

SEQ ID NO: 8200409 - DNA, 22 bp, Homo sapiens
agatggagttagtaccagagtc

SEQ ID NO: 8200410 - DNA, 22 bp, Homo sapiens
agatggagtctcactcttgttg

SEQ ID NO: 8200411 - DNA, 22 bp, Homo sapiens
agatggagttgtagcagtgact

SEQ ID NO: 8200412 - DNA, 17 bp, Homo sapiens
agatggcaggaggcaga

SEQ ID NO: 8200413 - DNA, 17 bp, Homo sapiens
agatggcaggaggcaga

SEQ ID NO: 8200414 - DNA, 17 bp, Homo sapiens
agatggcaggaggcaga

SEQ ID NO: 8200415 - DNA, 22 bp, Homo sapiens
agatggctgatataaagataag

SEQ ID NO: 8200416 - DNA, 22 bp, Homo sapiens
agatggctgatggcaggagcca

SEQ ID NO: 8200417 - DNA, 22 bp, Homo sapiens
agatggctgatggcaggagcca

SEQ ID NO: 8200418 - DNA, 22 bp, Homo sapiens
agatggctgatggcaggagcca

SEQ ID NO: 8200419 - DNA, 22 bp, Homo sapiens
agatggctctcaagtctgatta

SEQ ID NO: 8200420 - DNA, 22 bp, Homo sapiens
agatggctctcaagtctgatta

SEQ ID NO: 8200421 - DNA, 22 bp, Homo sapiens
agatggctctttgaaggggaat

SEQ ID NO: 8200422 - DNA, 21 bp, Homo sapiens
agatggctcccaggtctctgg

SEQ ID NO: 8200423 - DNA, 21 bp, Homo sapiens
agatggctcccaggtctctgg

SEQ ID NO: 8200424 - DNA, 22 bp, Homo sapiens
agatggctccagtgtccagagg

SEQ ID NO: 8200425 - DNA, 22 bp, Homo sapiens
agatggcaggggtacctggaag

SEQ ID NO: 8200426 - DNA, 22 bp, Homo sapiens
agatggcaggccctgtgggggt

SEQ ID NO: 8200427 - DNA, 22 bp, Homo sapiens
agatggctatagatagcctttc

SEQ ID NO: 8200428 - DNA, 22 bp, Homo sapiens
agatggctatagatagcctttc

SEQ ID NO: 8200429 - DNA, 22 bp, Homo sapiens
agatggctccagtgtccagagg

SEQ ID NO: 8200430 - DNA, 22 bp, Homo sapiens
agatggctagattgcaagaact

SEQ ID NO: 8200431 - DNA, 22 bp, Homo sapiens
agatggctagattgcaagaact

SEQ ID NO: 8200432 - DNA, 19 bp, Homo sapiens
agatggctaggatcaccct

SEQ ID NO: 8200433 - DNA, 22 bp, Homo sapiens
agatggcttccttctcactgtg

SEQ ID NO: 8200434 - DNA, 22 bp, Homo sapiens
agatggcttagcctggctccca

SEQ ID NO: 8200435 - DNA, 22 bp, Homo sapiens
agatggcttagcctggctccca

SEQ ID NO: 8200436 - DNA, 20 bp, Homo sapiens
agatggctgtcatttctgtc

SEQ ID NO: 8200437 - DNA, 22 bp, Homo sapiens
agatggctgggctcgtccgcag

SEQ ID NO: 8200438 - DNA, 22 bp, Homo sapiens
agatggctgggagctctgtttg

SEQ ID NO: 8200439 - DNA, 22 bp, Homo sapiens
agatggctgggagctctgtttg

SEQ ID NO: 8200440 - DNA, 22 bp, Homo sapiens
agatggctggaggtagatgctc

SEQ ID NO: 8200441 - DNA, 22 bp, Homo sapiens
agatggctggaggtagatgctc

SEQ ID NO: 8200442 - DNA, 22 bp, Homo sapiens
agatggctgattaactccatgg

SEQ ID NO: 8200443 - DNA, 22 bp, Homo sapiens
agatggctgggagctctgtttg

SEQ ID NO: 8200444 - DNA, 22 bp, Homo sapiens
agatggctgggccccaccccag

SEQ ID NO: 8200445 - DNA, 19 bp, Homo sapiens
agatggcttggactgaaaa

SEQ ID NO: 8200446 - DNA, 19 bp, Homo sapiens
agatggcttggactgaaaa

SEQ ID NO: 8200447 - DNA, 22 bp, Homo sapiens
agatggcttccttctcactgtg

SEQ ID NO: 8200448 - DNA, 22 bp, Homo sapiens
agatggctttgcttttagaagc

SEQ ID NO: 8200449 - DNA, 22 bp, Homo sapiens
agatggcttgtgagatgaacaa

SEQ ID NO: 8200450 - DNA, 22 bp, Homo sapiens
attttaaccctcttatatatac

SEQ ID NO: 8200451 - DNA, 22 bp, Homo sapiens
agatggctttgcttttagaagc

SEQ ID NO: 8200452 - DNA, 22 bp, Homo sapiens
agatccaggatgtcccaaaata

SEQ ID NO: 8200453 - DNA, 22 bp, Homo sapiens
agatccactcgaatccaggaat

SEQ ID NO: 8200454 - DNA, 22 bp, Homo sapiens
agatcatattgtaactttattg

SEQ ID NO: 8200455 - DNA, 22 bp, Homo sapiens
agatcatattgtaactttattg

SEQ ID NO: 8200456 - DNA, 22 bp, Homo sapiens
agatcagtaagaggaagaatgg

SEQ ID NO: 8200457 - DNA, 22 bp, Homo sapiens
agatcactttgatgctacctgg

SEQ ID NO: 8200458 - DNA, 22 bp, Homo sapiens
agatcagactttgtgactagga

SEQ ID NO: 8200459 - DNA, 21 bp, Homo sapiens
agatgctgtgctccaggagca

SEQ ID NO: 8200460 - DNA, 22 bp, Homo sapiens
agatgctgtgtctgttcccttg

SEQ ID NO: 8200461 - DNA, 17 bp, Homo sapiens
agatgctggccacatgt

SEQ ID NO: 8200462 - DNA, 22 bp, Homo sapiens
agatgcagaaaaactaagtgat

SEQ ID NO: 8200463 - DNA, 17 bp, Homo sapiens
agatgctggccacatgt

SEQ ID NO: 8200464 - DNA, 22 bp, Homo sapiens
agatgctgtcacacacactgtt

SEQ ID NO: 8200465 - DNA, 22 bp, Homo sapiens
agatgctgtgaggaagctagga

SEQ ID NO: 8200466 - DNA, 21 bp, Homo sapiens
agatgctgtgctccaggagca

SEQ ID NO: 8200467 - DNA, 22 bp, Homo sapiens
agatgctggggcccctcggatg

SEQ ID NO: 8200468 - DNA, 22 bp, Homo sapiens
agatgctgtcacacacactgtt

SEQ ID NO: 8200469 - DNA, 22 bp, Homo sapiens
agatgctgtcacacacactgtt

SEQ ID NO: 8200470 - DNA, 22 bp, Homo sapiens
agatcacagttctctattcgta

SEQ ID NO: 8200471 - DNA, 22 bp, Homo sapiens
agatcacagtggcaactccctt

SEQ ID NO: 8200472 - DNA, 22 bp, Homo sapiens
agatcacagtcaattgcaagtt

SEQ ID NO: 8200473 - DNA, 22 bp, Homo sapiens
agatcacagtggcaactccctt

SEQ ID NO: 8200474 - DNA, 22 bp, Homo sapiens
agatcacagtggcaactccctt

SEQ ID NO: 8200475 - DNA, 23 bp, Homo sapiens
agatcacatgctgatggaaaatg

SEQ ID NO: 8200476 - DNA, 23 bp, Homo sapiens
agatcacatagttatcagatgac

SEQ ID NO: 8200477 - DNA, 22 bp, Homo sapiens
agatcactggttacttaatgaa

SEQ ID NO: 8200478 - DNA, 22 bp, Homo sapiens
agatcactggttacttaatgaa

SEQ ID NO: 8200479 - DNA, 22 bp, Homo sapiens
agatattttgtgtgatgtttca

SEQ ID NO: 8200480 - DNA, 22 bp, Homo sapiens
agatattttgtgtgatgtttca

SEQ ID NO: 8200481 - DNA, 22 bp, Homo sapiens
agatcaaagccatgagagattt

SEQ ID NO: 8200482 - DNA, 22 bp, Homo sapiens
agatcaaagccatgagagattt

SEQ ID NO: 8200483 - DNA, 22 bp, Homo sapiens
agatcacagagccaagattcca

SEQ ID NO: 8200484 - DNA, 22 bp, Homo sapiens
agatcacagcccccagatgcca

SEQ ID NO: 8200485 - DNA, 22 bp, Homo sapiens
agatcacagcccccagatgcca

SEQ ID NO: 8200486 - DNA, 22 bp, Homo sapiens
agatattttgtgtgatgtttca

SEQ ID NO: 8200487 - DNA, 22 bp, Homo sapiens
agatatttgtatcttgctattg

SEQ ID NO: 8200488 - DNA, 22 bp, Homo sapiens
agatatttgtatcttgctattg

SEQ ID NO: 8200489 - DNA, 22 bp, Homo sapiens
agatatttgtatcttgctattg

SEQ ID NO: 8200490 - DNA, 22 bp, Homo sapiens
agatatttgtatcttgctattg

SEQ ID NO: 8200491 - DNA, 22 bp, Homo sapiens
agatatttaaatcagacaaaga

SEQ ID NO: 8200492 - DNA, 22 bp, Homo sapiens
agatattaggaggattcataat

SEQ ID NO: 8200493 - DNA, 22 bp, Homo sapiens
agatattaggaggattcataat

SEQ ID NO: 8200494 - DNA, 22 bp, Homo sapiens
agatataataatttacaagtgt

SEQ ID NO: 8200495 - DNA, 22 bp, Homo sapiens
agatattaccagcagtctatgc

SEQ ID NO: 8200496 - DNA, 22 bp, Homo sapiens
agatattaccagcagtctatgc

SEQ ID NO: 8200497 - DNA, 22 bp, Homo sapiens
agatattaatcgtacataaggt

SEQ ID NO: 8200498 - DNA, 22 bp, Homo sapiens
agatattaatcgtacataaggt

SEQ ID NO: 8200499 - DNA, 22 bp, Homo sapiens
attggtagttttgtatttctct

SEQ ID NO: 8200500 - DNA, 22 bp, Homo sapiens
attggtagttttgtatttctct

SEQ ID NO: 8200501 - DNA, 22 bp, Homo sapiens
attgggctttatgtaggggaag

SEQ ID NO: 8200502 - DNA, 22 bp, Homo sapiens
attgggctggattaggactgtt

SEQ ID NO: 8200503 - DNA, 22 bp, Homo sapiens
attgggctggccttctggagag

SEQ ID NO: 8200504 - DNA, 22 bp, Homo sapiens
attggtcagagtaaatttattt

SEQ ID NO: 8200505 - DNA, 21 bp, Homo sapiens
agatagttgggcatgcagctg

SEQ ID NO: 8200506 - DNA, 22 bp, Homo sapiens
agatataataatttacaagtgt

SEQ ID NO: 8200507 - DNA, 22 bp, Homo sapiens
agagtggagagaaacaactctg

SEQ ID NO: 8200508 - DNA, 21 bp, Homo sapiens
agagtggcaaagtgtccaaga

SEQ ID NO: 8200509 - DNA, 22 bp, Homo sapiens
agagtggcagcaaaaagtgtgc

SEQ ID NO: 8200510 - DNA, 22 bp, Homo sapiens
agagtggcagcaagtcaggtag

SEQ ID NO: 8200511 - DNA, 22 bp, Homo sapiens
agagtggcagcaagtcaggtag

SEQ ID NO: 8200512 - DNA, 22 bp, Homo sapiens
agagtggcagcaagtcaggtag

SEQ ID NO: 8200513 - DNA, 22 bp, Homo sapiens
attggcatattggctactttca

SEQ ID NO: 8200514 - DNA, 22 bp, Homo sapiens
attggcatactttctatattca

SEQ ID NO: 8200515 - DNA, 21 bp, Homo sapiens
attggcctgtttacagagtga

SEQ ID NO: 8200516 - DNA, 22 bp, Homo sapiens
attggcatttctcacagtcccc

SEQ ID NO: 8200517 - DNA, 20 bp, Homo sapiens
attggctggggttctgatgc

SEQ ID NO: 8200518 - DNA, 22 bp, Homo sapiens
attgggaagatttagatccact

SEQ ID NO: 8200519 - DNA, 22 bp, Homo sapiens
agcaagaaaatctctgtccaat

SEQ ID NO: 8200520 - DNA, 22 bp, Homo sapiens
agcaagaaaatctctgtccaat

SEQ ID NO: 8200521 - DNA, 20 bp, Homo sapiens
agcaagagtaaggacagcga

SEQ ID NO: 8200522 - DNA, 20 bp, Homo sapiens
agcaagaaggttgtgggagc

SEQ ID NO: 8200523 - DNA, 22 bp, Homo sapiens
agcaagaagggcaaggaagttt

SEQ ID NO: 8200524 - DNA, 21 bp, Homo sapiens
agcaagaatcaggaaggctct

SEQ ID NO: 8200525 - DNA, 22 bp, Homo sapiens
agcaacaggaccatggagccca

SEQ ID NO: 8200526 - DNA, 19 bp, Homo sapiens
agcaacctgtcagagatgc

SEQ ID NO: 8200527 - DNA, 22 bp, Homo sapiens
agcaacctggatcatggtgaaa

SEQ ID NO: 8200528 - DNA, 22 bp, Homo sapiens
agcaacctgccagtcactcagt

SEQ ID NO: 8200529 - DNA, 19 bp, Homo sapiens
agcaacctgggccaatgta

SEQ ID NO: 8200530 - DNA, 19 bp, Homo sapiens
agcaacctgtcagagatgc

SEQ ID NO: 8200531 - DNA, 17 bp, Homo sapiens
agcaacctcctcttcct

SEQ ID NO: 8200532 - DNA, 22 bp, Homo sapiens
agcaacctgccaccacaggcaa

SEQ ID NO: 8200533 - DNA, 22 bp, Homo sapiens
agcaacctcatgagagtgaaat

SEQ ID NO: 8200534 - DNA, 22 bp, Homo sapiens
agcaacatttttcaattaacat

SEQ ID NO: 8200535 - DNA, 22 bp, Homo sapiens
agcaacattgagactgcagttg

SEQ ID NO: 8200536 - DNA, 22 bp, Homo sapiens
caaagcaagggctgaagactcc

SEQ ID NO: 8200537 - DNA, 22 bp, Homo sapiens
caaagcagacgcagtaagggta

SEQ ID NO: 8200538 - DNA, 22 bp, Homo sapiens
caaagcagacgcagtaagggta

SEQ ID NO: 8200539 - DNA, 22 bp, Homo sapiens
caaagcaccacaaaccaggtga

SEQ ID NO: 8200540 - DNA, 22 bp, Homo sapiens
caaaggcaggtgctgaatattc

SEQ ID NO: 8200541 - DNA, 22 bp, Homo sapiens
caaaggcaggtcatggccactt

SEQ ID NO: 8200542 - DNA, 22 bp, Homo sapiens
caaagataatcacagaataccc

SEQ ID NO: 8200543 - DNA, 22 bp, Homo sapiens
caaaccagtaggaagtctatta

SEQ ID NO: 8200544 - DNA, 22 bp, Homo sapiens
caaagatatgacatggaaaatg

SEQ ID NO: 8200545 - DNA, 22 bp, Homo sapiens
caaagatatgacatggaaaatg

SEQ ID NO: 8200546 - DNA, 22 bp, Homo sapiens
attttagtacctcaagtatcca

SEQ ID NO: 8200547 - DNA, 22 bp, Homo sapiens
attttaaccctcttatatatac

SEQ ID NO: 8200548 - DNA, 22 bp, Homo sapiens
agatgggcgccctggactgagg

SEQ ID NO: 8200549 - DNA, 22 bp, Homo sapiens
attttaaccctcttatatatac

SEQ ID NO: 8200550 - DNA, 22 bp, Homo sapiens
attttaaccctcttatatatac

SEQ ID NO: 8200551 - DNA, 22 bp, Homo sapiens
attttagcaaatgcaagatgga

SEQ ID NO: 8200552 - DNA, 22 bp, Homo sapiens
attttagatttaagaataaggt

SEQ ID NO: 8200553 - DNA, 22 bp, Homo sapiens
attttagttttagcatccatgc

SEQ ID NO: 8200554 - DNA, 22 bp, Homo sapiens
attttatccccactggattaca

SEQ ID NO: 8200555 - DNA, 22 bp, Homo sapiens
attttcaaaacatctgctgtgt

SEQ ID NO: 8200556 - DNA, 22 bp, Homo sapiens
attttatgacacgattcttcca

SEQ ID NO: 8200557 - DNA, 22 bp, Homo sapiens
attttatgacacgattcttcca

SEQ ID NO: 8200558 - DNA, 22 bp, Homo sapiens
attttcaccctgaatatattga

SEQ ID NO: 8200559 - DNA, 22 bp, Homo sapiens
attttcaccctgaatatattga

SEQ ID NO: 8200560 - DNA, 22 bp, Homo sapiens
attttcagaacattcattcact

SEQ ID NO: 8200561 - DNA, 22 bp, Homo sapiens
attttcagaacattcattcact

SEQ ID NO: 8200562 - DNA, 22 bp, Homo sapiens
attttcagagacatctggactt

SEQ ID NO: 8200563 - DNA, 22 bp, Homo sapiens
attttcagaacattcattcact

SEQ ID NO: 8200564 - DNA, 22 bp, Homo sapiens
agatgtggcctttgggagatta

SEQ ID NO: 8200565 - DNA, 19 bp, Homo sapiens
agcaacaccgtttatttcc

SEQ ID NO: 8200566 - DNA, 22 bp, Homo sapiens
agcaacagcaacgacatttctc

SEQ ID NO: 8200567 - DNA, 22 bp, Homo sapiens
agcaaatattttgttgaagtgc

SEQ ID NO: 8200568 - DNA, 22 bp, Homo sapiens
agcaaagctgattaagagcaca

SEQ ID NO: 8200569 - DNA, 22 bp, Homo sapiens
agcaaagctcatgacattacag

SEQ ID NO: 8200570 - DNA, 22 bp, Homo sapiens
agcaaagctatctctatggaga

SEQ ID NO: 8200571 - DNA, 18 bp, Homo sapiens
agatgttcaatatttctc

SEQ ID NO: 8200572 - DNA, 22 bp, Homo sapiens
agatgtgtttctagttcctgca

SEQ ID NO: 8200573 - DNA, 22 bp, Homo sapiens
agatgtgtttctagttcctgca

SEQ ID NO: 8200574 - DNA, 22 bp, Homo sapiens
agatgtgggtgtcaggcagtga

SEQ ID NO: 8200575 - DNA, 22 bp, Homo sapiens
agatgtgggcaatggaatggag

SEQ ID NO: 8200576 - DNA, 22 bp, Homo sapiens
agaggggagtcctaatctgatt

SEQ ID NO: 8200577 - DNA, 22 bp, Homo sapiens
agaggggcaagtaaagagtctt

SEQ ID NO: 8200578 - DNA, 18 bp, Homo sapiens
agaggggaggtaagtctg

SEQ ID NO: 8200579 - DNA, 22 bp, Homo sapiens
agaggggctcaagcagtggtct

SEQ ID NO: 8200580 - DNA, 22 bp, Homo sapiens
agaggggaagtaatgaatgata

SEQ ID NO: 8200581 - DNA, 22 bp, Homo sapiens
agaggggacagccacctgcccg

SEQ ID NO: 8200582 - DNA, 22 bp, Homo sapiens
agaggggagagctaagcaattc

SEQ ID NO: 8200583 - DNA, 22 bp, Homo sapiens
agaggggaggcgaaccagagtc

SEQ ID NO: 8200584 - DNA, 22 bp, Homo sapiens
agaggggaggcgaaccagagtc

SEQ ID NO: 8200585 - DNA, 23 bp, Homo sapiens
agaggggagcatctgctggctga

SEQ ID NO: 8200586 - DNA, 22 bp, Homo sapiens
agaggggaggcgaaccagagtc

SEQ ID NO: 8200587 - DNA, 22 bp, Homo sapiens
agagggcagtctcagattggga

SEQ ID NO: 8200588 - DNA, 22 bp, Homo sapiens
agagggcagtctcagattggga

SEQ ID NO: 8200589 - DNA, 22 bp, Homo sapiens
agagggcagtctcagattggga

SEQ ID NO: 8200590 - DNA, 22 bp, Homo sapiens
agagggcagggcggtaagtcct

SEQ ID NO: 8200591 - DNA, 22 bp, Homo sapiens
agagggcagggcggtaagtcct

SEQ ID NO: 8200592 - DNA, 22 bp, Homo sapiens
agaggctgtctcatattttgta

SEQ ID NO: 8200593 - DNA, 22 bp, Homo sapiens
agagggcataaaatagagcacg

SEQ ID NO: 8200594 - DNA, 22 bp, Homo sapiens
agagggctggacgcaggttgga

SEQ ID NO: 8200595 - DNA, 22 bp, Homo sapiens
agagggctgggatgtgctgtgt

SEQ ID NO: 8200596 - DNA, 22 bp, Homo sapiens
agagggctgggatgtgctgtgt

SEQ ID NO: 8200597 - DNA, 22 bp, Homo sapiens
agagggctgggatgtgctgtgt

SEQ ID NO: 8200598 - DNA, 22 bp, Homo sapiens
agagggcttccctaggagtgag

SEQ ID NO: 8200599 - DNA, 22 bp, Homo sapiens
agagggcttccctaggagtgag

SEQ ID NO: 8200600 - DNA, 22 bp, Homo sapiens
agagggcttccctaggagtgag

SEQ ID NO: 8200601 - DNA, 22 bp, Homo sapiens
agaggggaaggatgtgatgtga

SEQ ID NO: 8200602 - DNA, 22 bp, Homo sapiens
agaggctgggcaggacccacag

SEQ ID NO: 8200603 - DNA, 22 bp, Homo sapiens
agaggctgggaagggtccccgg

SEQ ID NO: 8200604 - DNA, 22 bp, Homo sapiens
agaggctgggtacgggccacct

SEQ ID NO: 8200605 - DNA, 22 bp, Homo sapiens
agaggctgggtacgggccacct

SEQ ID NO: 8200606 - DNA, 16 bp, Homo sapiens
agaggctgtaatggaa

SEQ ID NO: 8200607 - DNA, 16 bp, Homo sapiens
agaggctgtaatggaa

SEQ ID NO: 8200608 - DNA, 19 bp, Homo sapiens
agaggctgtcacctgtagc

SEQ ID NO: 8200609 - DNA, 16 bp, Homo sapiens
agaggctgtaatggaa

SEQ ID NO: 8200610 - DNA, 22 bp, Homo sapiens
agaggctgggtacgggccacct

SEQ ID NO: 8200611 - DNA, 19 bp, Homo sapiens
agaggctgtcacctgtagc

SEQ ID NO: 8200612 - DNA, 22 bp, Homo sapiens
agaggctgtcccttgctattcc

SEQ ID NO: 8200613 - DNA, 22 bp, Homo sapiens
agaggctgtcccttgctattcc

SEQ ID NO: 8200614 - DNA, 22 bp, Homo sapiens
agagtcaccttttcctcaggat

SEQ ID NO: 8200615 - DNA, 22 bp, Homo sapiens
agagtattttgattatcctgga

SEQ ID NO: 8200616 - DNA, 22 bp, Homo sapiens
agagtatattgaagcagtcagg

SEQ ID NO: 8200617 - DNA, 22 bp, Homo sapiens
agaggtggagctcttggcatca

SEQ ID NO: 8200618 - DNA, 22 bp, Homo sapiens
agaggtgagtcattacctagtg

SEQ ID NO: 8200619 - DNA, 22 bp, Homo sapiens
agaggtgacataggagaggctc

SEQ ID NO: 8200620 - DNA, 22 bp, Homo sapiens
agagtactgcctcagttatgaa

SEQ ID NO: 8200621 - DNA, 22 bp, Homo sapiens
agagtataattagtgtcttcta

SEQ ID NO: 8200622 - DNA, 22 bp, Homo sapiens
agagtataggcaggatgccagt

SEQ ID NO: 8200623 - DNA, 18 bp, Homo sapiens
agagtatacagacaacaa

SEQ ID NO: 8200624 - DNA, 20 bp, Homo sapiens
agagtagaggtagatttatg

SEQ ID NO: 8200625 - DNA, 21 bp, Homo sapiens
agagtataataaaggcatgtc

SEQ ID NO: 8200626 - DNA, 22 bp, Homo sapiens
agagtagcctcatagacactca

SEQ ID NO: 8200627 - DNA, 22 bp, Homo sapiens
agagtcagaaccaagatgaggc

SEQ ID NO: 8200628 - DNA, 22 bp, Homo sapiens
agagtcagaaagcagacagggg

SEQ ID NO: 8200629 - DNA, 22 bp, Homo sapiens
agagtcagcttatgacacagtc

SEQ ID NO: 8200630 - DNA, 22 bp, Homo sapiens
agagtcagcttatgacacagtc

SEQ ID NO: 8200631 - DNA, 22 bp, Homo sapiens
agagtcagaaccaagatgaggc

SEQ ID NO: 8200632 - DNA, 22 bp, Homo sapiens
agagtcagactaagccatggtg

SEQ ID NO: 8200633 - DNA, 22 bp, Homo sapiens
agagtccaccctggggtcaggc

SEQ ID NO: 8200634 - DNA, 22 bp, Homo sapiens
agagtccaaatgtgcagttatg

SEQ ID NO: 8200635 - DNA, 22 bp, Homo sapiens
agagtcagttatgtcaagtgct

SEQ ID NO: 8200636 - DNA, 22 bp, Homo sapiens
agagtcagcttatgacacagtc

SEQ ID NO: 8200637 - DNA, 22 bp, Homo sapiens
agagtgccctgctctgagctct

SEQ ID NO: 8200638 - DNA, 20 bp, Homo sapiens
agagtgagactccatctcag

SEQ ID NO: 8200639 - DNA, 22 bp, Homo sapiens
agagtgagggggcactgagacg

SEQ ID NO: 8200640 - DNA, 22 bp, Homo sapiens
agagtgagggggcactgagacg

SEQ ID NO: 8200641 - DNA, 22 bp, Homo sapiens
agagtgcaaccgaaacaagcag

SEQ ID NO: 8200642 - DNA, 22 bp, Homo sapiens
agagtgatgggttgtgctgacc

SEQ ID NO: 8200643 - DNA, 22 bp, Homo sapiens
agagtgatcagatatcaggtgt

SEQ ID NO: 8200644 - DNA, 22 bp, Homo sapiens
agagtgattcgttcaagaacca

SEQ ID NO: 8200645 - DNA, 18 bp, Homo sapiens
agagtccagggtgaggtg

SEQ ID NO: 8200646 - DNA, 22 bp, Homo sapiens
agagtccatatgtgggaggagt

SEQ ID NO: 8200647 - DNA, 22 bp, Homo sapiens
agagtccatgaagacagctgag

SEQ ID NO: 8200648 - DNA, 22 bp, Homo sapiens
agagtccatgaagacagctgag

SEQ ID NO: 8200649 - DNA, 22 bp, Homo sapiens
agagtctgaggcagctgcagcc

SEQ ID NO: 8200650 - DNA, 19 bp, Homo sapiens
agagtcggggggacatagg

SEQ ID NO: 8200651 - DNA, 22 bp, Homo sapiens
agagtctgatatttgtaccaga

SEQ ID NO: 8200652 - DNA, 22 bp, Homo sapiens
agagtctgaggcagctgcagcc

SEQ ID NO: 8200653 - DNA, 22 bp, Homo sapiens
agagtctgaggcagctgcagcc

SEQ ID NO: 8200654 - DNA, 21 bp, Homo sapiens
attacagcagtggccaaatgc

SEQ ID NO: 8200655 - DNA, 22 bp, Homo sapiens
attacagcttgctcagtttgca

SEQ ID NO: 8200656 - DNA, 22 bp, Homo sapiens
attacagtaaatgctacaggca

SEQ ID NO: 8200657 - DNA, 22 bp, Homo sapiens
attacagtaaatgctacaggca

SEQ ID NO: 8200658 - DNA, 22 bp, Homo sapiens
attacagtaacagctacaatgc

SEQ ID NO: 8200659 - DNA, 22 bp, Homo sapiens
attacagtaacagctacaatgc

SEQ ID NO: 8200660 - DNA, 22 bp, Homo sapiens
attacagtaacagctacaatgc

SEQ ID NO: 8200661 - DNA, 22 bp, Homo sapiens
attacagagtcttgggaggtca

SEQ ID NO: 8200662 - DNA, 22 bp, Homo sapiens
attacagaatgcagttccttat

SEQ ID NO: 8200663 - DNA, 22 bp, Homo sapiens
attacagatagactttgaagct

SEQ ID NO: 8200664 - DNA, 22 bp, Homo sapiens
agaggcactaagggaagagcag

SEQ ID NO: 8200665 - DNA, 22 bp, Homo sapiens
agaggcacggaggctgcatgga

SEQ ID NO: 8200666 - DNA, 22 bp, Homo sapiens
agaggcaccgtctgcagcgtgc

SEQ ID NO: 8200667 - DNA, 22 bp, Homo sapiens
agaggcacccgcgcgcggccat

SEQ ID NO: 8200668 - DNA, 22 bp, Homo sapiens
agaggcaccatctggaacagcc

SEQ ID NO: 8200669 - DNA, 22 bp, Homo sapiens
attacacatagacattcgttca

SEQ ID NO: 8200670 - DNA, 22 bp, Homo sapiens
attacactaatgtgacaacaat

SEQ ID NO: 8200671 - DNA, 22 bp, Homo sapiens
attacacaggctggctctttga

SEQ ID NO: 8200672 - DNA, 22 bp, Homo sapiens
attacacatagacattcgttca

SEQ ID NO: 8200673 - DNA, 22 bp, Homo sapiens
attacacaggctggctctttga

SEQ ID NO: 8200674 - DNA, 22 bp, Homo sapiens
attacacaggatttgccttact

SEQ ID NO: 8200675 - DNA, 22 bp, Homo sapiens
attacacagcggttactactag

SEQ ID NO: 8200676 - DNA, 22 bp, Homo sapiens
attacacaggatttgccttact

SEQ ID NO: 8200677 - DNA, 22 bp, Homo sapiens
attacacaggatttgccttact

SEQ ID NO: 8200678 - DNA, 22 bp, Homo sapiens
attacacagcggttactactag

SEQ ID NO: 8200679 - DNA, 22 bp, Homo sapiens
agaggaggtccttttctgatgt

SEQ ID NO: 8200680 - DNA, 22 bp, Homo sapiens
agaggcaagattatcagggcat

SEQ ID NO: 8200681 - DNA, 21 bp, Homo sapiens
agagctgggacttgcctgaga

SEQ ID NO: 8200682 - DNA, 22 bp, Homo sapiens
agaggaggctgggtccagataa

SEQ ID NO: 8200683 - DNA, 21 bp, Homo sapiens
agagctgggacttgcctgaga

SEQ ID NO: 8200684 - DNA, 21 bp, Homo sapiens
agagctgggacttgcctgaga

SEQ ID NO: 8200685 - DNA, 21 bp, Homo sapiens
agagctgggacttgcctgaga

SEQ ID NO: 8200686 - DNA, 22 bp, Homo sapiens
agagctgggaccgtctggaagt

SEQ ID NO: 8200687 - DNA, 22 bp, Homo sapiens
agagctggctgtgggtgacttt

SEQ ID NO: 8200688 - DNA, 22 bp, Homo sapiens
agagctggctgtgggtgacttt

SEQ ID NO: 8200689 - DNA, 20 bp, Homo sapiens
agagctgggaagctccctat

SEQ ID NO: 8200690 - DNA, 20 bp, Homo sapiens
agagctgggaagctccctat

SEQ ID NO: 8200691 - DNA, 20 bp, Homo sapiens
agagctgggaagctccctat

SEQ ID NO: 8200692 - DNA, 22 bp, Homo sapiens
agagctgggaccgtctggaagt

SEQ ID NO: 8200693 - DNA, 22 bp, Homo sapiens
agagctgggaccgtctggaagt

SEQ ID NO: 8200694 - DNA, 23 bp, Homo sapiens
agaggcacagcacttggctggcc

SEQ ID NO: 8200695 - DNA, 23 bp, Homo sapiens
agaggcacagcacttggctggcc

SEQ ID NO: 8200696 - DNA, 22 bp, Homo sapiens
agaggcacagaggcagtcccct

SEQ ID NO: 8200697 - DNA, 22 bp, Homo sapiens
agaggcaccatctggaacagcc

SEQ ID NO: 8200698 - DNA, 22 bp, Homo sapiens
agaggcaccatctggaacagcc

SEQ ID NO: 8200699 - DNA, 23 bp, Homo sapiens
agaggcacagcacttggctggcc

SEQ ID NO: 8200700 - DNA, 22 bp, Homo sapiens
agaggcaatgaaagcagtctct

SEQ ID NO: 8200701 - DNA, 22 bp, Homo sapiens
agaggcaatgaaagcagtctct

SEQ ID NO: 8200702 - DNA, 22 bp, Homo sapiens
agaggcaagttcagagctagga

SEQ ID NO: 8200703 - DNA, 19 bp, Homo sapiens
agaggcaagggtggaagta

SEQ ID NO: 8200704 - DNA, 22 bp, Homo sapiens
agaggcaagggacctttctggg

SEQ ID NO: 8200705 - DNA, 19 bp, Homo sapiens
agaggcaagggctcatgac

SEQ ID NO: 8200706 - DNA, 22 bp, Homo sapiens
agaggcaaggcaggattcttct

SEQ ID NO: 8200707 - DNA, 22 bp, Homo sapiens
agaggctgcaggctggaaatca

SEQ ID NO: 8200708 - DNA, 23 bp, Homo sapiens
agaggctgcagggtattgagaat

SEQ ID NO: 8200709 - DNA, 22 bp, Homo sapiens
agaggctgcaggctggaaatca

SEQ ID NO: 8200710 - DNA, 18 bp, Homo sapiens
agaggctggacaggggat

SEQ ID NO: 8200711 - DNA, 23 bp, Homo sapiens
agaggctgcagggtattgagaat

SEQ ID NO: 8200712 - DNA, 22 bp, Homo sapiens
agaggctggattgagcatagac

SEQ ID NO: 8200713 - DNA, 18 bp, Homo sapiens
agaggctggacaggggat

SEQ ID NO: 8200714 - DNA, 18 bp, Homo sapiens
agaggctggacaggggat

SEQ ID NO: 8200715 - DNA, 22 bp, Homo sapiens
agaggctgggaagggtccccgg

SEQ ID NO: 8200716 - DNA, 22 bp, Homo sapiens
agaggctggattgagcatagac

SEQ ID NO: 8200717 - DNA, 22 bp, Homo sapiens
agaggctggattgagcatagac

SEQ ID NO: 8200718 - DNA, 22 bp, Homo sapiens
agaggctggattgagcatagac

SEQ ID NO: 8200719 - DNA, 22 bp, Homo sapiens
agaggccagctagcgggccatc

SEQ ID NO: 8200720 - DNA, 22 bp, Homo sapiens
agaggccaggcagcccaaggtg

SEQ ID NO: 8200721 - DNA, 22 bp, Homo sapiens
agaggccaggctgcagagggat

SEQ ID NO: 8200722 - DNA, 22 bp, Homo sapiens
agaggctccttcactctggcac

SEQ ID NO: 8200723 - DNA, 22 bp, Homo sapiens
agaggctcctcggtgcctcgtg

SEQ ID NO: 8200724 - DNA, 22 bp, Homo sapiens
agaggctgatggagtagtgtct

SEQ ID NO: 8200725 - DNA, 22 bp, Homo sapiens
agaggctccttcactctggcac

SEQ ID NO: 8200726 - DNA, 22 bp, Homo sapiens
agaggctccttcactctggcac

SEQ ID NO: 8200727 - DNA, 22 bp, Homo sapiens
agaggctgatggagtagtgtct

SEQ ID NO: 8200728 - DNA, 22 bp, Homo sapiens
agaggctgcacttgctcatgat

SEQ ID NO: 8200729 - DNA, 22 bp, Homo sapiens
agaggctgcacttgctcatgat

SEQ ID NO: 8200730 - DNA, 22 bp, Homo sapiens
agaggctgcacttgctcatgat

SEQ ID NO: 8200731 - DNA, 22 bp, Homo sapiens
agaggctgcacttgctcatgat

SEQ ID NO: 8200732 - DNA, 22 bp, Homo sapiens
agaggctgcacttgctcatgat

SEQ ID NO: 8200733 - DNA, 22 bp, Homo sapiens
agaggctgcacttgctcatgat

SEQ ID NO: 8200734 - DNA, 22 bp, Homo sapiens
agaggctgcacttgctcatgat

SEQ ID NO: 8200735 - DNA, 22 bp, Homo sapiens
agaggccactttgcctgtgatg

SEQ ID NO: 8200736 - DNA, 22 bp, Homo sapiens
agaggccagaaggcgcaccccg

SEQ ID NO: 8200737 - DNA, 22 bp, Homo sapiens
agaggccagaaagtatgccacc

SEQ ID NO: 8200738 - DNA, 22 bp, Homo sapiens
agaggccagaaggcgcaccccg

SEQ ID NO: 8200739 - DNA, 22 bp, Homo sapiens
agaggccaccactgtcagggac

SEQ ID NO: 8200740 - DNA, 22 bp, Homo sapiens
agaggccaccagaggtggtgcc

SEQ ID NO: 8200741 - DNA, 23 bp, Homo sapiens
agaggcaggagtggcttgcccgg

SEQ ID NO: 8200742 - DNA, 16 bp, Homo sapiens
agaggccacagacaga

SEQ ID NO: 8200743 - DNA, 22 bp, Homo sapiens
agaggccacaccagcctcccgt

SEQ ID NO: 8200744 - DNA, 22 bp, Homo sapiens
agaggccagcactgcagggaag

SEQ ID NO: 8200745 - DNA, 22 bp, Homo sapiens
agaggccagcaaccacagtaaa

SEQ ID NO: 8200746 - DNA, 22 bp, Homo sapiens
agaggccagatcatcatagatg

SEQ ID NO: 8200747 - DNA, 22 bp, Homo sapiens
agaggccagcagtgcctatctg

SEQ ID NO: 8200748 - DNA, 22 bp, Homo sapiens
agaggccagcactgcagggaag

SEQ ID NO: 8200749 - DNA, 22 bp, Homo sapiens
agaggccagcactgcagggaag

SEQ ID NO: 8200750 - DNA, 22 bp, Homo sapiens
agaggccagcccaggccaccga

SEQ ID NO: 8200751 - DNA, 22 bp, Homo sapiens
agaggccagcagtgcctatctg

SEQ ID NO: 8200752 - DNA, 23 bp, Homo sapiens
agaggccagcctttggagacacc

SEQ ID NO: 8200753 - DNA, 23 bp, Homo sapiens
agaggccagcctttggagacacc

SEQ ID NO: 8200754 - DNA, 22 bp, Homo sapiens
agagattgtgctactcacccaa

SEQ ID NO: 8200755 - DNA, 22 bp, Homo sapiens
agagcacaggctcaccattgtt

SEQ ID NO: 8200756 - DNA, 22 bp, Homo sapiens
agagatttacacatgccttttc

SEQ ID NO: 8200757 - DNA, 22 bp, Homo sapiens
agagcacaggctcaccattgtt

SEQ ID NO: 8200758 - DNA, 22 bp, Homo sapiens
agagcacaggctctggagtcta

SEQ ID NO: 8200759 - DNA, 22 bp, Homo sapiens
agagagttgaggaagcaacact

SEQ ID NO: 8200760 - DNA, 22 bp, Homo sapiens
agagagttctttctagttgaag

SEQ ID NO: 8200761 - DNA, 22 bp, Homo sapiens
agagaggtttgctggaagattc

SEQ ID NO: 8200762 - DNA, 22 bp, Homo sapiens
agagcacagtatctgcacatca

SEQ ID NO: 8200763 - DNA, 22 bp, Homo sapiens
agagcacagtgcaggatccccg

SEQ ID NO: 8200764 - DNA, 22 bp, Homo sapiens
agagcacagtgcaggatccccg

SEQ ID NO: 8200765 - DNA, 22 bp, Homo sapiens
agagcacagtatctgcacatca

SEQ ID NO: 8200766 - DNA, 22 bp, Homo sapiens
agagcacaggctctggagtcta

SEQ ID NO: 8200767 - DNA, 22 bp, Homo sapiens
agagcacagtgcaggatccccg

SEQ ID NO: 8200768 - DNA, 22 bp, Homo sapiens
agagcactgcgccggctcggaa

SEQ ID NO: 8200769 - DNA, 22 bp, Homo sapiens
agagcactgctgatttacagtc

SEQ ID NO: 8200770 - DNA, 22 bp, Homo sapiens
agagcagagggctctgggacaa

SEQ ID NO: 8200771 - DNA, 22 bp, Homo sapiens
agagcagaggcatggccgtggg

SEQ ID NO: 8200772 - DNA, 22 bp, Homo sapiens
agagcagagggctctgggacaa

SEQ ID NO: 8200773 - DNA, 22 bp, Homo sapiens
agagcagatggagctggaagag

SEQ ID NO: 8200774 - DNA, 22 bp, Homo sapiens
agagcagagtggctgtagcttg

SEQ ID NO: 8200775 - DNA, 22 bp, Homo sapiens
agagcagagggctctgggacaa

SEQ ID NO: 8200776 - DNA, 22 bp, Homo sapiens
agagcagagggctctgggacaa

SEQ ID NO: 8200777 - DNA, 20 bp, Homo sapiens
agagcagcagttggtgaggt

SEQ ID NO: 8200778 - DNA, 22 bp, Homo sapiens
agagcagcctcagctccctgtg

SEQ ID NO: 8200779 - DNA, 22 bp, Homo sapiens
agagccaggcaggcaatgttga

SEQ ID NO: 8200780 - DNA, 20 bp, Homo sapiens
agagcagcagttggtgaggt

SEQ ID NO: 8200781 - DNA, 22 bp, Homo sapiens
agagcagcacgttgtccccaca

SEQ ID NO: 8200782 - DNA, 22 bp, Homo sapiens
agagcagatggccagggggcct

SEQ ID NO: 8200783 - DNA, 22 bp, Homo sapiens
agagcagatggccagggggcct

SEQ ID NO: 8200784 - DNA, 22 bp, Homo sapiens
agagcagatggagctggaagag

SEQ ID NO: 8200785 - DNA, 22 bp, Homo sapiens
agagcagatggagctggaagag

SEQ ID NO: 8200786 - DNA, 22 bp, Homo sapiens
agagcagatggccagggggcct

SEQ ID NO: 8200787 - DNA, 22 bp, Homo sapiens
agagcagatggccagggggcct

SEQ ID NO: 8200788 - DNA, 22 bp, Homo sapiens
agagcagatggagctggaagag

SEQ ID NO: 8200789 - DNA, 22 bp, Homo sapiens
agagcagatggagctggaagag

SEQ ID NO: 8200790 - DNA, 22 bp, Homo sapiens
agagcagatggagctggaagag

SEQ ID NO: 8200791 - DNA, 22 bp, Homo sapiens
agagcccagtgacatcagcaca

SEQ ID NO: 8200792 - DNA, 22 bp, Homo sapiens
agagcccagtgacatcagcaca

SEQ ID NO: 8200793 - DNA, 22 bp, Homo sapiens
agagcccatcagtggcagtgga

SEQ ID NO: 8200794 - DNA, 22 bp, Homo sapiens
agagcccatcagtggcagtgga

SEQ ID NO: 8200795 - DNA, 22 bp, Homo sapiens
agagcccatcagtggcagtgga

SEQ ID NO: 8200796 - DNA, 22 bp, Homo sapiens
agagcccctggtggagtgagaa

SEQ ID NO: 8200797 - DNA, 22 bp, Homo sapiens
agagcccaggtcctggagaggg

SEQ ID NO: 8200798 - DNA, 22 bp, Homo sapiens
agagcccaggtcctggagaggg

SEQ ID NO: 8200799 - DNA, 22 bp, Homo sapiens
agagcccaggcaggcatccagg

SEQ ID NO: 8200800 - DNA, 22 bp, Homo sapiens
agagcccagaaagtatgtcata

SEQ ID NO: 8200801 - DNA, 22 bp, Homo sapiens
agagcccagaaagtatgtcata

SEQ ID NO: 8200802 - DNA, 20 bp, Homo sapiens
agagcccagatgtctgtatt

SEQ ID NO: 8200803 - DNA, 22 bp, Homo sapiens
agagccaggccaggccggggca

SEQ ID NO: 8200804 - DNA, 22 bp, Homo sapiens
agagccaggccaggccggggca

SEQ ID NO: 8200805 - DNA, 22 bp, Homo sapiens
agagccctgccaatggatgagg

SEQ ID NO: 8200806 - DNA, 22 bp, Homo sapiens
agagccctggagggcagtcccg

SEQ ID NO: 8200807 - DNA, 22 bp, Homo sapiens
agagccctggagggcagtcccg

SEQ ID NO: 8200808 - DNA, 22 bp, Homo sapiens
agagccctgtggactgtcaagt

SEQ ID NO: 8200809 - DNA, 23 bp, Homo sapiens
agagcctgaaagacttctggcac

SEQ ID NO: 8200810 - DNA, 22 bp, Homo sapiens
agagccctcttcactgcccctt

SEQ ID NO: 8200811 - DNA, 22 bp, Homo sapiens
agagccctcttcactgcccctt

SEQ ID NO: 8200812 - DNA, 22 bp, Homo sapiens
agagccctctgcaatgcctcag

SEQ ID NO: 8200813 - DNA, 22 bp, Homo sapiens
agagccctaaaccctgccttgg

SEQ ID NO: 8200814 - DNA, 22 bp, Homo sapiens
agagccctctcattggcttatt

SEQ ID NO: 8200815 - DNA, 22 bp, Homo sapiens
agagccctctcattggcttatt

SEQ ID NO: 8200816 - DNA, 22 bp, Homo sapiens
agagccctgaagcagagctaaa

SEQ ID NO: 8200817 - DNA, 22 bp, Homo sapiens
agagccctgacggggacagatg

SEQ ID NO: 8200818 - DNA, 22 bp, Homo sapiens
agagccctgagtcagttctgga

SEQ ID NO: 8200819 - DNA, 22 bp, Homo sapiens
agagcctgaggatgtcccagct

SEQ ID NO: 8200820 - DNA, 22 bp, Homo sapiens
agagcctgaggatgtcccagct

SEQ ID NO: 8200821 - DNA, 22 bp, Homo sapiens
agagcctgaggatgtcccagct

SEQ ID NO: 8200822 - DNA, 22 bp, Homo sapiens
agagcctgaggccaggaaaatg

SEQ ID NO: 8200823 - DNA, 22 bp, Homo sapiens
agagcctgagcctgatcttgaa

SEQ ID NO: 8200824 - DNA, 22 bp, Homo sapiens
agagcctgagcctgaaagccct

SEQ ID NO: 8200825 - DNA, 21 bp, Homo sapiens
agagcctgagatcttccagca

SEQ ID NO: 8200826 - DNA, 21 bp, Homo sapiens
agagcctgagatcttccagca

SEQ ID NO: 8200827 - DNA, 22 bp, Homo sapiens
agagcctgagaggataatgggg

SEQ ID NO: 8200828 - DNA, 22 bp, Homo sapiens
agagcctgagaggataatgggg

SEQ ID NO: 8200829 - DNA, 22 bp, Homo sapiens
agagcctgcagctgtgaagaaa

SEQ ID NO: 8200830 - DNA, 22 bp, Homo sapiens
agagcctgaggtctaacagggg

SEQ ID NO: 8200831 - DNA, 22 bp, Homo sapiens
agagcctgcagctgtgaagaaa

SEQ ID NO: 8200832 - DNA, 22 bp, Homo sapiens
agagctgaaaaagctgacccgg

SEQ ID NO: 8200833 - DNA, 22 bp, Homo sapiens
agagctgaaaaagctgacccgg

SEQ ID NO: 8200834 - DNA, 22 bp, Homo sapiens
agagcctgaggccctgagaggg

SEQ ID NO: 8200835 - DNA, 22 bp, Homo sapiens
agagcctgaggccctgagaggg

SEQ ID NO: 8200836 - DNA, 22 bp, Homo sapiens
agagcctgaggccctgagaggg

SEQ ID NO: 8200837 - DNA, 22 bp, Homo sapiens
agagcctgaggccaggaaaatg

SEQ ID NO: 8200838 - DNA, 22 bp, Homo sapiens
agagctggaatcagacctcagg

SEQ ID NO: 8200839 - DNA, 22 bp, Homo sapiens
agagctgaaaaagctgacccgg

SEQ ID NO: 8200840 - DNA, 22 bp, Homo sapiens
agagctggaatcagacctcagg

SEQ ID NO: 8200841 - DNA, 22 bp, Homo sapiens
agagctggacgtctgagcccta

SEQ ID NO: 8200842 - DNA, 22 bp, Homo sapiens
agagctggacgtctgagcccta

SEQ ID NO: 8200843 - DNA, 22 bp, Homo sapiens
agagctggagatgcaggtttcg

SEQ ID NO: 8200844 - DNA, 22 bp, Homo sapiens
agagctggagatgcaggtttcg

SEQ ID NO: 8200845 - DNA, 22 bp, Homo sapiens
agagctggagcagccccactgg

SEQ ID NO: 8200846 - DNA, 22 bp, Homo sapiens
agagctggcagcagcttctcct

SEQ ID NO: 8200847 - DNA, 22 bp, Homo sapiens
agagctggcagcagcttctcct

SEQ ID NO: 8200848 - DNA, 22 bp, Homo sapiens
agagctggcagcagcttctcct

SEQ ID NO: 8200849 - DNA, 22 bp, Homo sapiens
agagctggcactgaccctcacc

SEQ ID NO: 8200850 - DNA, 22 bp, Homo sapiens
agagctggatggtcaagatggc

SEQ ID NO: 8200851 - DNA, 22 bp, Homo sapiens
agagctggatggtcaagatggc

SEQ ID NO: 8200852 - DNA, 22 bp, Homo sapiens
agagctggatggtcaagatggc

SEQ ID NO: 8200853 - DNA, 22 bp, Homo sapiens
agagctggatggtcaagatggc

SEQ ID NO: 8200854 - DNA, 21 bp, Homo sapiens
agagctggcctgccaggccct

SEQ ID NO: 8200855 - DNA, 22 bp, Homo sapiens
agagctggctgctgcggtgctt

SEQ ID NO: 8200856 - DNA, 22 bp, Homo sapiens
agagctggccagggatcactct

SEQ ID NO: 8200857 - DNA, 22 bp, Homo sapiens
agagctggccagggatcactct

SEQ ID NO: 8200858 - DNA, 22 bp, Homo sapiens
agagctggccagggatcactct

SEQ ID NO: 8200859 - DNA, 22 bp, Homo sapiens
agagctggctggtagccctgat

SEQ ID NO: 8200860 - DNA, 22 bp, Homo sapiens
agagctggctggtagccctgat

SEQ ID NO: 8200861 - DNA, 22 bp, Homo sapiens
agagctggctggtagccctgat

SEQ ID NO: 8200862 - DNA, 22 bp, Homo sapiens
agagctggctgtgggtgacttt

SEQ ID NO: 8200863 - DNA, 22 bp, Homo sapiens
agagctggctgtgggtgacttt

SEQ ID NO: 8200864 - DNA, 22 bp, Homo sapiens
agagctggctgtgggtgacttt

SEQ ID NO: 8200865 - DNA, 22 bp, Homo sapiens
agagctggctggtagccctgat

SEQ ID NO: 8200866 - DNA, 22 bp, Homo sapiens
agagctggctgctgcggtgctt

SEQ ID NO: 8200867 - DNA, 22 bp, Homo sapiens
agagctggctgctgcggtgctt

SEQ ID NO: 8200868 - DNA, 22 bp, Homo sapiens
agagctggctggtagccctgat

SEQ ID NO: 8200869 - DNA, 22 bp, Homo sapiens
agagagcatggcacagaggggt

SEQ ID NO: 8200870 - DNA, 22 bp, Homo sapiens
agagagcattgaggaaatcttc

SEQ ID NO: 8200871 - DNA, 22 bp, Homo sapiens
agagagcattgaggaaatcttc

SEQ ID NO: 8200872 - DNA, 22 bp, Homo sapiens
agagagcccgggccagggcaca

SEQ ID NO: 8200873 - DNA, 21 bp, Homo sapiens
agagagaaggccatatggtcc

SEQ ID NO: 8200874 - DNA, 22 bp, Homo sapiens
agagagcatggcacagaggggt

SEQ ID NO: 8200875 - DNA, 22 bp, Homo sapiens
agagagcatggcacagaggggt

SEQ ID NO: 8200876 - DNA, 21 bp, Homo sapiens
agagacagagaaagtaacatt

SEQ ID NO: 8200877 - DNA, 22 bp, Homo sapiens
agagagaagcaatcagtggcca

SEQ ID NO: 8200878 - DNA, 21 bp, Homo sapiens
agagacagagaaagtaacatt

SEQ ID NO: 8200879 - DNA, 21 bp, Homo sapiens
agagacagagaaagtaacatt

SEQ ID NO: 8200880 - DNA, 22 bp, Homo sapiens
agagacagacacatcgggctgc

SEQ ID NO: 8200881 - DNA, 22 bp, Homo sapiens
agagaattttaaaagccttgaa

SEQ ID NO: 8200882 - DNA, 21 bp, Homo sapiens
agagaattgccttagatgttc

SEQ ID NO: 8200883 - DNA, 22 bp, Homo sapiens
agagacaatgccaatgcacacg

SEQ ID NO: 8200884 - DNA, 22 bp, Homo sapiens
agagacaccgcgcatcatggct

SEQ ID NO: 8200885 - DNA, 22 bp, Homo sapiens
agagacaatgccaatgcacacg

SEQ ID NO: 8200886 - DNA, 22 bp, Homo sapiens
agagacacatcatataagtata

SEQ ID NO: 8200887 - DNA, 22 bp, Homo sapiens
agagacaagggacctctggaga

SEQ ID NO: 8200888 - DNA, 22 bp, Homo sapiens
agagacaagggacctctggaga

SEQ ID NO: 8200889 - DNA, 22 bp, Homo sapiens
agagacaaacactgcaacttct

SEQ ID NO: 8200890 - DNA, 22 bp, Homo sapiens
agagaggttggctaggatgttt

SEQ ID NO: 8200891 - DNA, 21 bp, Homo sapiens
agagagggagatgaaacatcc

SEQ ID NO: 8200892 - DNA, 22 bp, Homo sapiens
agagagggcatagaaaaaggga

SEQ ID NO: 8200893 - DNA, 19 bp, Homo sapiens
agagaggctgtgtgaggga

SEQ ID NO: 8200894 - DNA, 19 bp, Homo sapiens
agagaggctgtgtgaggga

SEQ ID NO: 8200895 - DNA, 22 bp, Homo sapiens
agagaggctgctggactatatg

SEQ ID NO: 8200896 - DNA, 22 bp, Homo sapiens
agagagggaatatttggggtat

SEQ ID NO: 8200897 - DNA, 22 bp, Homo sapiens
agagagggaatatttggggtat

SEQ ID NO: 8200898 - DNA, 19 bp, Homo sapiens
agagaggctgtgtgaggga

SEQ ID NO: 8200899 - DNA, 22 bp, Homo sapiens
agagaggcattcggtgatccca

SEQ ID NO: 8200900 - DNA, 22 bp, Homo sapiens
agagaggcattcggtgatccca

SEQ ID NO: 8200901 - DNA, 22 bp, Homo sapiens
agagagctgtcctgggacaccc

SEQ ID NO: 8200902 - DNA, 22 bp, Homo sapiens
agagagcttccattctagtgat

SEQ ID NO: 8200903 - DNA, 22 bp, Homo sapiens
agagaggatttgtttttctcct

SEQ ID NO: 8200904 - DNA, 22 bp, Homo sapiens
agagagctctgatgggaggtga

SEQ ID NO: 8200905 - DNA, 22 bp, Homo sapiens
agagagctctggctgggtgacc

SEQ ID NO: 8200906 - DNA, 22 bp, Homo sapiens
agagagctctggctgggtgacc

SEQ ID NO: 8200907 - DNA, 22 bp, Homo sapiens
agagagctgactttggagtcag

SEQ ID NO: 8200908 - DNA, 22 bp, Homo sapiens
agagagctgactttggagtcag

SEQ ID NO: 8200909 - DNA, 22 bp, Homo sapiens
agactttaatgtgcaaatgaaa

SEQ ID NO: 8200910 - DNA, 22 bp, Homo sapiens
agacttctctccttgacttgca

SEQ ID NO: 8200911 - DNA, 22 bp, Homo sapiens
agacttctcttggctatattat

SEQ ID NO: 8200912 - DNA, 22 bp, Homo sapiens
agacttctcttggctatattat

SEQ ID NO: 8200913 - DNA, 22 bp, Homo sapiens
agacttcttgagctggcacttc

SEQ ID NO: 8200914 - DNA, 22 bp, Homo sapiens
agacttctttgtgagcattttc

SEQ ID NO: 8200915 - DNA, 22 bp, Homo sapiens
agacttctttgtgagcattttc

SEQ ID NO: 8200916 - DNA, 22 bp, Homo sapiens
agactttataaatcttaatttc

SEQ ID NO: 8200917 - DNA, 22 bp, Homo sapiens
agactttatagtttttggctat

SEQ ID NO: 8200918 - DNA, 22 bp, Homo sapiens
agactttatccctgtttttctc

SEQ ID NO: 8200919 - DNA, 22 bp, Homo sapiens
agactttagatacgtcttcttc

SEQ ID NO: 8200920 - DNA, 22 bp, Homo sapiens
agactttagaatcagatagcct

SEQ ID NO: 8200921 - DNA, 22 bp, Homo sapiens
agactttagaatcagatagcct

SEQ ID NO: 8200922 - DNA, 22 bp, Homo sapiens
agactttagggccatggtaggt

SEQ ID NO: 8200923 - DNA, 22 bp, Homo sapiens
agactttataaatcttaatttc

SEQ ID NO: 8200924 - DNA, 22 bp, Homo sapiens
agactttataaatcttaatttc

SEQ ID NO: 8200925 - DNA, 21 bp, Homo sapiens
agacttccatcctgagagagg

SEQ ID NO: 8200926 - DNA, 22 bp, Homo sapiens
agacttctaaatagcagcttct

SEQ ID NO: 8200927 - DNA, 21 bp, Homo sapiens
agacttctagaagtgagatag

SEQ ID NO: 8200928 - DNA, 22 bp, Homo sapiens
agacttcaaagcctttgttcat

SEQ ID NO: 8200929 - DNA, 21 bp, Homo sapiens
agacttctagaagtgagatag

SEQ ID NO: 8200930 - DNA, 21 bp, Homo sapiens
agacttctagaagtgagatag

SEQ ID NO: 8200931 - DNA, 22 bp, Homo sapiens
agacttctcagttttattagta

SEQ ID NO: 8200932 - DNA, 23 bp, Homo sapiens
agacttctccaacaagcttggct

SEQ ID NO: 8200933 - DNA, 22 bp, Homo sapiens
agacttctataaatttgggaat

SEQ ID NO: 8200934 - DNA, 22 bp, Homo sapiens
agacttctctaacttgaggacc

SEQ ID NO: 8200935 - DNA, 22 bp, Homo sapiens
agacttctctccttgacttgca

SEQ ID NO: 8200936 - DNA, 22 bp, Homo sapiens
agactgtgagaagatggctgcg

SEQ ID NO: 8200937 - DNA, 22 bp, Homo sapiens
agacttaatagaagcatgacat

SEQ ID NO: 8200938 - DNA, 19 bp, Homo sapiens
agacttttgtaagttgaga

SEQ ID NO: 8200939 - DNA, 22 bp, Homo sapiens
agagaaaactcattgaggtgtc

SEQ ID NO: 8200940 - DNA, 19 bp, Homo sapiens
agagaaggatcctatggtt

SEQ ID NO: 8200941 - DNA, 22 bp, Homo sapiens
agagaagggtgtagcctgggcc

SEQ ID NO: 8200942 - DNA, 22 bp, Homo sapiens
agagaaggtcactaaggaccca

SEQ ID NO: 8200943 - DNA, 22 bp, Homo sapiens
agagaagggtgtagcctgggcc

SEQ ID NO: 8200944 - DNA, 22 bp, Homo sapiens
agagaagggtgtagcctgggcc

SEQ ID NO: 8200945 - DNA, 22 bp, Homo sapiens
agagaagggtgtagcctgggcc

SEQ ID NO: 8200946 - DNA, 22 bp, Homo sapiens
agagaaggtcactaaggaccca

SEQ ID NO: 8200947 - DNA, 22 bp, Homo sapiens
agagaagtgagcttgttcactc

SEQ ID NO: 8200948 - DNA, 22 bp, Homo sapiens
agagaatacaaagaagatatgt

SEQ ID NO: 8200949 - DNA, 22 bp, Homo sapiens
agagaagtgtcatttcagtttt

SEQ ID NO: 8200950 - DNA, 22 bp, Homo sapiens
agagaagtgagcttgttcactc

SEQ ID NO: 8200951 - DNA, 22 bp, Homo sapiens
atgatatagagagtagattaaa

SEQ ID NO: 8200952 - DNA, 22 bp, Homo sapiens
atgatatacttcctagaacagt

SEQ ID NO: 8200953 - DNA, 22 bp, Homo sapiens
atgatatagagagtagattaaa

SEQ ID NO: 8200954 - DNA, 22 bp, Homo sapiens
atgatatagagagtagattaaa

SEQ ID NO: 8200955 - DNA, 22 bp, Homo sapiens
atgatatacttcctagaacagt

SEQ ID NO: 8200956 - DNA, 22 bp, Homo sapiens
atgatatacttcctagaacagt

SEQ ID NO: 8200957 - DNA, 22 bp, Homo sapiens
atgatatacttcctagaacagt

SEQ ID NO: 8200958 - DNA, 22 bp, Homo sapiens
atgatatacttcctagaacagt

SEQ ID NO: 8200959 - DNA, 22 bp, Homo sapiens
atgatatacttcctagaacagt

SEQ ID NO: 8200960 - DNA, 22 bp, Homo sapiens
atgatatacttcctagaacagt

SEQ ID NO: 8200961 - DNA, 22 bp, Homo sapiens
atgatacattgcaaaattttaa

SEQ ID NO: 8200962 - DNA, 22 bp, Homo sapiens
atgatactctaggtgatttaca

SEQ ID NO: 8200963 - DNA, 22 bp, Homo sapiens
atgatagaaaggacacttggtg

SEQ ID NO: 8200964 - DNA, 21 bp, Homo sapiens
atgatactgaagcacaactat

SEQ ID NO: 8200965 - DNA, 22 bp, Homo sapiens
atgatactctaggtgatttaca

SEQ ID NO: 8200966 - DNA, 22 bp, Homo sapiens
atgatacattgcaaaattttaa

SEQ ID NO: 8200967 - DNA, 22 bp, Homo sapiens
atgatacatcttgtttatttca

SEQ ID NO: 8200968 - DNA, 22 bp, Homo sapiens
atgatacatcttcatgtcagtg

SEQ ID NO: 8200969 - DNA, 22 bp, Homo sapiens
atgatacatcttcatgtcagtg

SEQ ID NO: 8200970 - DNA, 22 bp, Homo sapiens
agacagacatagaaattagtaa

SEQ ID NO: 8200971 - DNA, 22 bp, Homo sapiens
atgatacatcttcatgtcagtg

SEQ ID NO: 8200972 - DNA, 15 bp, Homo sapiens
agacagacagtggga

SEQ ID NO: 8200973 - DNA, 18 bp, Homo sapiens
agacagacaggtttgtgc

SEQ ID NO: 8200974 - DNA, 22 bp, Homo sapiens
agacagacagagaatttaaata

SEQ ID NO: 8200975 - DNA, 22 bp, Homo sapiens
agacagacacatggtaacagat

SEQ ID NO: 8200976 - DNA, 22 bp, Homo sapiens
agacagacaaaattcctgcctg

SEQ ID NO: 8200977 - DNA, 22 bp, Homo sapiens
agacagaacagaataattgttg

SEQ ID NO: 8200978 - DNA, 22 bp, Homo sapiens
atgcatttgtaaaatataatcg

SEQ ID NO: 8200979 - DNA, 22 bp, Homo sapiens
atgcatttgtaaaatataatcg

SEQ ID NO: 8200980 - DNA, 22 bp, Homo sapiens
atgcatttttgagtatgaatga

SEQ ID NO: 8200981 - DNA, 22 bp, Homo sapiens
atgcatttgtaaaatataatcg

SEQ ID NO: 8200982 - DNA, 22 bp, Homo sapiens
atgcatattttctactatatcg

SEQ ID NO: 8200983 - DNA, 22 bp, Homo sapiens
atgcatttgtaaaatataatcg

SEQ ID NO: 8200984 - DNA, 22 bp, Homo sapiens
atgcatttttgagtatgaatga

SEQ ID NO: 8200985 - DNA, 22 bp, Homo sapiens
atgcatttttgagtatgaatga

SEQ ID NO: 8200986 - DNA, 22 bp, Homo sapiens
atgcatttttgagtatgaatga

SEQ ID NO: 8200987 - DNA, 22 bp, Homo sapiens
atgcatttttgagtatgaatga

SEQ ID NO: 8200988 - DNA, 22 bp, Homo sapiens
atgccaaagggagcactttggg

SEQ ID NO: 8200989 - DNA, 22 bp, Homo sapiens
atgccaaagcccaagttcatca

SEQ ID NO: 8200990 - DNA, 22 bp, Homo sapiens
atgcatattgattatagattca

SEQ ID NO: 8200991 - DNA, 22 bp, Homo sapiens
atgcatattttctactatatcg

SEQ ID NO: 8200992 - DNA, 22 bp, Homo sapiens
agacccagagggctgctgggag

SEQ ID NO: 8200993 - DNA, 22 bp, Homo sapiens
atgccaagttgacaaggggtgg

SEQ ID NO: 8200994 - DNA, 22 bp, Homo sapiens
atgccaagctctatccctgacc

SEQ ID NO: 8200995 - DNA, 20 bp, Homo sapiens
atgccaagctatctagaatc

SEQ ID NO: 8200996 - DNA, 22 bp, Homo sapiens
agacctggagtggggcctcagg

SEQ ID NO: 8200997 - DNA, 22 bp, Homo sapiens
agacctggagtgaagagttccc

SEQ ID NO: 8200998 - DNA, 22 bp, Homo sapiens
agacctggtgatagctgtccta

SEQ ID NO: 8200999 - DNA, 22 bp, Homo sapiens
agacctggtgatagctgtccta

SEQ ID NO: 8201000 - DNA, 21 bp, Homo sapiens
agaccttttctcagataactt

SEQ ID NO: 8201001 - DNA, 22 bp, Homo sapiens
agacctttatttcatgatagga

SEQ ID NO: 8201002 - DNA, 22 bp, Homo sapiens
agaccttagtagcttttaatgg

SEQ ID NO: 8201003 - DNA, 22 bp, Homo sapiens
agacctggatgtgagggaagta

SEQ ID NO: 8201004 - DNA, 22 bp, Homo sapiens
agacctgggtgccctgtgcttt

SEQ ID NO: 8201005 - DNA, 22 bp, Homo sapiens
agacctgggttcgagtcctaac

SEQ ID NO: 8201006 - DNA, 22 bp, Homo sapiens
atgcctttgccacagattagga

SEQ ID NO: 8201007 - DNA, 22 bp, Homo sapiens
agactggtttttaacttcacct

SEQ ID NO: 8201008 - DNA, 22 bp, Homo sapiens
agactgggtttgagacttagca

SEQ ID NO: 8201009 - DNA, 22 bp, Homo sapiens
agactctgcatttctaataagc

SEQ ID NO: 8201010 - DNA, 22 bp, Homo sapiens
agactggggttctggcaaggag

SEQ ID NO: 8201011 - DNA, 22 bp, Homo sapiens
atgcgctttgtgtgaagcagtg

SEQ ID NO: 8201012 - DNA, 22 bp, Homo sapiens
atgcctgtaatcccagtgcttt

SEQ ID NO: 8201013 - DNA, 22 bp, Homo sapiens
atgcctgtaatcccagtgcttt

SEQ ID NO: 8201014 - DNA, 22 bp, Homo sapiens
atgcctgtgggaaaaacttgtt

SEQ ID NO: 8201015 - DNA, 22 bp, Homo sapiens
atgcctggtatgaagcaaggaa

SEQ ID NO: 8201016 - DNA, 22 bp, Homo sapiens
agacgagggcccccaggacagc

SEQ ID NO: 8201017 - DNA, 22 bp, Homo sapiens
atgcctggtcccacctctaggt

SEQ ID NO: 8201018 - DNA, 22 bp, Homo sapiens
atgcctggtatgaagcaaggaa

SEQ ID NO: 8201019 - DNA, 22 bp, Homo sapiens
agacaacaccaaatgctagtgt

SEQ ID NO: 8201020 - DNA, 22 bp, Homo sapiens
agacaagactaggcagttgttg

SEQ ID NO: 8201021 - DNA, 22 bp, Homo sapiens
agacaagaaactgggagtctct

SEQ ID NO: 8201022 - DNA, 22 bp, Homo sapiens
agacaaggcaaggcggccagat

SEQ ID NO: 8201023 - DNA, 22 bp, Homo sapiens
agacaaggcccccttgggctct

SEQ ID NO: 8201024 - DNA, 22 bp, Homo sapiens
agacaagagctgaggacatatt

SEQ ID NO: 8201025 - DNA, 22 bp, Homo sapiens
agacaagagctgaggacatatt

SEQ ID NO: 8201026 - DNA, 22 bp, Homo sapiens
agacacattttacattaactgt

SEQ ID NO: 8201027 - DNA, 22 bp, Homo sapiens
agacaccagaatctgttgagca

SEQ ID NO: 8201028 - DNA, 22 bp, Homo sapiens
agacaaggcccccttgggctct

SEQ ID NO: 8201029 - DNA, 22 bp, Homo sapiens
agacacttatttagtgggagtt

SEQ ID NO: 8201030 - DNA, 22 bp, Homo sapiens
agacactgtgtacagaaaaaga

SEQ ID NO: 8201031 - DNA, 22 bp, Homo sapiens
agacactgttctcacatgcttg

SEQ ID NO: 8201032 - DNA, 22 bp, Homo sapiens
agacagaaataggagaaaccag

SEQ ID NO: 8201033 - DNA, 22 bp, Homo sapiens
agacactttcagaagtgtttgc

SEQ ID NO: 8201034 - DNA, 21 bp, Homo sapiens
agacagaacaactgctctcca

SEQ ID NO: 8201035 - DNA, 21 bp, Homo sapiens
agacagaacaactgctctcca

SEQ ID NO: 8201036 - DNA, 22 bp, Homo sapiens
atgaggctgaaacacagaggct

SEQ ID NO: 8201037 - DNA, 22 bp, Homo sapiens
atgaggctctcaggggagctgt

SEQ ID NO: 8201038 - DNA, 22 bp, Homo sapiens
atgaggctctcaacaccttgag

SEQ ID NO: 8201039 - DNA, 22 bp, Homo sapiens
atgaggcttaaactgctgcaac

SEQ ID NO: 8201040 - DNA, 22 bp, Homo sapiens
atgagggaggcaaggagatgct

SEQ ID NO: 8201041 - DNA, 22 bp, Homo sapiens
atgagggaggcaaggagatgct

SEQ ID NO: 8201042 - DNA, 22 bp, Homo sapiens
atgagggaggcaaggagatgct

SEQ ID NO: 8201043 - DNA, 22 bp, Homo sapiens
atgaggccatggctgtcactaa

SEQ ID NO: 8201044 - DNA, 22 bp, Homo sapiens
atgaggccatggctgtcactaa

SEQ ID NO: 8201045 - DNA, 22 bp, Homo sapiens
atgaggcccaaacattacaaat

SEQ ID NO: 8201046 - DNA, 22 bp, Homo sapiens
atgaggcccaaacattacaaat

SEQ ID NO: 8201047 - DNA, 22 bp, Homo sapiens
atgaggcctatcttggcagagg

SEQ ID NO: 8201048 - DNA, 22 bp, Homo sapiens
atgaggcccaggaatctgtatt

SEQ ID NO: 8201049 - DNA, 22 bp, Homo sapiens
atgaggctatgaatggggagat

SEQ ID NO: 8201050 - DNA, 22 bp, Homo sapiens
atgaggcctttcttcacccttt

SEQ ID NO: 8201051 - DNA, 22 bp, Homo sapiens
atgaggcctatcttggcagagg

SEQ ID NO: 8201052 - DNA, 22 bp, Homo sapiens
atgaggcctatcttggcagagg

SEQ ID NO: 8201053 - DNA, 22 bp, Homo sapiens
agaatcaattagattctatgag

SEQ ID NO: 8201054 - DNA, 22 bp, Homo sapiens
agaatcaaagagaaatactttg

SEQ ID NO: 8201055 - DNA, 22 bp, Homo sapiens
agaatattgaaagttcttgaca

SEQ ID NO: 8201056 - DNA, 22 bp, Homo sapiens
agaatattgaaagttcttgaca

SEQ ID NO: 8201057 - DNA, 22 bp, Homo sapiens
agaatcaaagagaaatactttg

SEQ ID NO: 8201058 - DNA, 22 bp, Homo sapiens
atgaggccagggtgccatgaaa

SEQ ID NO: 8201059 - DNA, 22 bp, Homo sapiens
atgaggccagggtgccatgaaa

SEQ ID NO: 8201060 - DNA, 22 bp, Homo sapiens
atgaggccagggtgccatgaaa

SEQ ID NO: 8201061 - DNA, 20 bp, Homo sapiens
atgaggccagcagggctcag

SEQ ID NO: 8201062 - DNA, 20 bp, Homo sapiens
atgaggccagcagggctcag

SEQ ID NO: 8201063 - DNA, 22 bp, Homo sapiens
atgaggccagaccactctgcat

SEQ ID NO: 8201064 - DNA, 22 bp, Homo sapiens
atgaggcagaaaaaagtcggag

SEQ ID NO: 8201065 - DNA, 22 bp, Homo sapiens
atgaggcacttaaaagtgaaga

SEQ ID NO: 8201066 - DNA, 22 bp, Homo sapiens
atgaggcacgtgttactggcct

SEQ ID NO: 8201067 - DNA, 22 bp, Homo sapiens
atgaacaatgactacatattga

SEQ ID NO: 8201068 - DNA, 22 bp, Homo sapiens
atgaacaatgactacatattga

SEQ ID NO: 8201069 - DNA, 22 bp, Homo sapiens
atgaacaatgactacatattga

SEQ ID NO: 8201070 - DNA, 22 bp, Homo sapiens
atctgctgtgtgtaatggaatg

SEQ ID NO: 8201071 - DNA, 22 bp, Homo sapiens
atctgctgtgtgtaatggaatg

SEQ ID NO: 8201072 - DNA, 18 bp, Homo sapiens
atctgctggcaggtctgg

SEQ ID NO: 8201073 - DNA, 20 bp, Homo sapiens
atctgctgagaatgaaaggc

SEQ ID NO: 8201074 - DNA, 19 bp, Homo sapiens
atctgccttagtgctgctg

SEQ ID NO: 8201075 - DNA, 17 bp, Homo sapiens
atctgctgacattctgt

SEQ ID NO: 8201076 - DNA, 22 bp, Homo sapiens
atctgcccatctgtcctgcttc

SEQ ID NO: 8201077 - DNA, 22 bp, Homo sapiens
atctgcccttgattgccctagg

SEQ ID NO: 8201078 - DNA, 22 bp, Homo sapiens
atctgcctgtatttaccatcat

SEQ ID NO: 8201079 - DNA, 22 bp, Homo sapiens
atgaagggaatataagtgctgc

SEQ ID NO: 8201080 - DNA, 22 bp, Homo sapiens
atgaaggcagttaaacgtcatc

SEQ ID NO: 8201081 - DNA, 22 bp, Homo sapiens
atgaagtctagcaagcattgaa

SEQ ID NO: 8201082 - DNA, 22 bp, Homo sapiens
atgaagggtgtccctgtgagca

SEQ ID NO: 8201083 - DNA, 22 bp, Homo sapiens
atgaagggtgtccctgtgagca

SEQ ID NO: 8201084 - DNA, 20 bp, Homo sapiens
atgaagtccccatctgatgt

SEQ ID NO: 8201085 - DNA, 22 bp, Homo sapiens
atgaagctgaccttgtcttgct

SEQ ID NO: 8201086 - DNA, 22 bp, Homo sapiens
atgaagctgaaaaaggcatata

SEQ ID NO: 8201087 - DNA, 22 bp, Homo sapiens
atgaagctctaaatgtacttag

SEQ ID NO: 8201088 - DNA, 22 bp, Homo sapiens
atgaagctactgaatatttggt

SEQ ID NO: 8201089 - DNA, 22 bp, Homo sapiens
atgaagctaaaccctgcagcca

SEQ ID NO: 8201090 - DNA, 22 bp, Homo sapiens
atgaagctgtttattttagcag

SEQ ID NO: 8201091 - DNA, 22 bp, Homo sapiens
atgaagcttgaggtgagagctg

SEQ ID NO: 8201092 - DNA, 22 bp, Homo sapiens
atgaaggatagggcaaaatttt

SEQ ID NO: 8201093 - DNA, 22 bp, Homo sapiens
atgaaggatagggcaaaatttt

SEQ ID NO: 8201094 - DNA, 22 bp, Homo sapiens
agaatatgatcggaatacagat

SEQ ID NO: 8201095 - DNA, 22 bp, Homo sapiens
agaatatatgactgcaagacta

SEQ ID NO: 8201096 - DNA, 22 bp, Homo sapiens
agaatattcatctgtattctta

SEQ ID NO: 8201097 - DNA, 22 bp, Homo sapiens
agaatattcatctgtattctta

SEQ ID NO: 8201098 - DNA, 22 bp, Homo sapiens
agaatattcatctgtattctta

SEQ ID NO: 8201099 - DNA, 22 bp, Homo sapiens
agaatatatgactgcaagacta

SEQ ID NO: 8201100 - DNA, 22 bp, Homo sapiens
agaatatagttaccaaattctg

SEQ ID NO: 8201101 - DNA, 22 bp, Homo sapiens
atgaagttctcaataatcatgt

SEQ ID NO: 8201102 - DNA, 22 bp, Homo sapiens
atgaagttccagtatatgcagt

SEQ ID NO: 8201103 - DNA, 22 bp, Homo sapiens
atgaagtggttctattggtttt

SEQ ID NO: 8201104 - DNA, 22 bp, Homo sapiens
atgaagttccagtatatgcagt

SEQ ID NO: 8201105 - DNA, 22 bp, Homo sapiens
atgaagttctagtgagaaatgc

SEQ ID NO: 8201106 - DNA, 22 bp, Homo sapiens
caatacaattaccagttaatca

SEQ ID NO: 8201107 - DNA, 20 bp, Homo sapiens
caataatttacttccctatt

SEQ ID NO: 8201108 - DNA, 22 bp, Homo sapiens
caatacaattaccagttaatca

SEQ ID NO: 8201109 - DNA, 20 bp, Homo sapiens
caataatttacttccctatt

SEQ ID NO: 8201110 - DNA, 22 bp, Homo sapiens
caataatttacattggatacca

SEQ ID NO: 8201111 - DNA, 22 bp, Homo sapiens
caataattgctttccagagtta

SEQ ID NO: 8201112 - DNA, 22 bp, Homo sapiens
caataatatcctgtgctgtttg

SEQ ID NO: 8201113 - DNA, 22 bp, Homo sapiens
caagtgagtgaccagagttggt

SEQ ID NO: 8201114 - DNA, 22 bp, Homo sapiens
caagtgacagtttgaaagccag

SEQ ID NO: 8201115 - DNA, 22 bp, Homo sapiens
caagtgacattcaatactagag

SEQ ID NO: 8201116 - DNA, 22 bp, Homo sapiens
agcagagtctgtgtgcacttta

SEQ ID NO: 8201117 - DNA, 22 bp, Homo sapiens
agcagaggtttgttggaaacct

SEQ ID NO: 8201118 - DNA, 22 bp, Homo sapiens
agcagaggtttgttggaaacct

SEQ ID NO: 8201119 - DNA, 20 bp, Homo sapiens
agcagagtgcccatcccgga

SEQ ID NO: 8201120 - DNA, 20 bp, Homo sapiens
agcagagtgcccatcccgga

SEQ ID NO: 8201121 - DNA, 22 bp, Homo sapiens
agcagaggtgtttattatggga

SEQ ID NO: 8201122 - DNA, 16 bp, Homo sapiens
agcagaggtgagtgaa

SEQ ID NO: 8201123 - DNA, 22 bp, Homo sapiens
agcagaggtgtttattatggga

SEQ ID NO: 8201124 - DNA, 21 bp, Homo sapiens
agcagaggggacatgtttgat

SEQ ID NO: 8201125 - DNA, 21 bp, Homo sapiens
agcagaggggacatgtttgat

SEQ ID NO: 8201126 - DNA, 21 bp, Homo sapiens
agcagaggggacatgtttgat

SEQ ID NO: 8201127 - DNA, 22 bp, Homo sapiens
agcactgtgatttataacattt

SEQ ID NO: 8201128 - DNA, 22 bp, Homo sapiens
agcactgtggggaactcacaga

SEQ ID NO: 8201129 - DNA, 22 bp, Homo sapiens
agcagagaggaggtggccctgt

SEQ ID NO: 8201130 - DNA, 22 bp, Homo sapiens
agcagagaccatatagcccaga

SEQ ID NO: 8201131 - DNA, 22 bp, Homo sapiens
agcagagctattcttgtgcaat

SEQ ID NO: 8201132 - DNA, 22 bp, Homo sapiens
agcagagcggggcctccggaag

SEQ ID NO: 8201133 - DNA, 22 bp, Homo sapiens
agcagagctgcagtggcctgct

SEQ ID NO: 8201134 - DNA, 22 bp, Homo sapiens
agcagagctgcagtggcctgct

SEQ ID NO: 8201135 - DNA, 22 bp, Homo sapiens
agcagagctgcagtggcctgct

SEQ ID NO: 8201136 - DNA, 21 bp, Homo sapiens
agcagaggctgcctggtgact

SEQ ID NO: 8201137 - DNA, 21 bp, Homo sapiens
agcagaggctgcctggtgact

SEQ ID NO: 8201138 - DNA, 21 bp, Homo sapiens
agcagaggcagaatgtatgca

SEQ ID NO: 8201139 - DNA, 21 bp, Homo sapiens
agcagaggcagaatgtatgca

SEQ ID NO: 8201140 - DNA, 21 bp, Homo sapiens
agcagaggcagaatgtatgca

SEQ ID NO: 8201141 - DNA, 22 bp, Homo sapiens
agcagaggacagttcttaggaa

SEQ ID NO: 8201142 - DNA, 22 bp, Homo sapiens
agcagaggaggatttagttagg

SEQ ID NO: 8201143 - DNA, 22 bp, Homo sapiens
agcagaggaggatttagttagg

SEQ ID NO: 8201144 - DNA, 22 bp, Homo sapiens
agcagagctgggatcctgggtc

SEQ ID NO: 8201145 - DNA, 22 bp, Homo sapiens
agcagagctttttggactcaga

SEQ ID NO: 8201146 - DNA, 22 bp, Homo sapiens
agcagagctgggatcctgggtc

SEQ ID NO: 8201147 - DNA, 22 bp, Homo sapiens
caaagggcatggcctgagcact

SEQ ID NO: 8201148 - DNA, 22 bp, Homo sapiens
caaagggcattttagtgaactg

SEQ ID NO: 8201149 - DNA, 22 bp, Homo sapiens
caaagggcattttagtgaactg

SEQ ID NO: 8201150 - DNA, 22 bp, Homo sapiens
caaaggcatcggcaattaggga

SEQ ID NO: 8201151 - DNA, 22 bp, Homo sapiens
caaaggctgccactgtggctgt

SEQ ID NO: 8201152 - DNA, 22 bp, Homo sapiens
caaaggcctgagaactgagggg

SEQ ID NO: 8201153 - DNA, 22 bp, Homo sapiens
caaaggcctgagaactgagggg

SEQ ID NO: 8201154 - DNA, 22 bp, Homo sapiens
agcacctgtcacaagcagaagg

SEQ ID NO: 8201155 - DNA, 17 bp, Homo sapiens
agcacctgtccagtccc

SEQ ID NO: 8201156 - DNA, 23 bp, Homo sapiens
agcacctgtgatttcctagctct

SEQ ID NO: 8201157 - DNA, 20 bp, Homo sapiens
agcaccagtgggggcagccc

SEQ ID NO: 8201158 - DNA, 22 bp, Homo sapiens
agcaccaggtcgctggcacgct

SEQ ID NO: 8201159 - DNA, 22 bp, Homo sapiens
agcacctgggaagctattctca

SEQ ID NO: 8201160 - DNA, 22 bp, Homo sapiens
agcacctgttgcacttcataat

SEQ ID NO: 8201161 - DNA, 21 bp, Homo sapiens
agcaccttacagctataatgg

SEQ ID NO: 8201162 - DNA, 22 bp, Homo sapiens
agcacctgtgttcatgcctcat

SEQ ID NO: 8201163 - DNA, 22 bp, Homo sapiens
agcacctgtgtggtagggaggt

SEQ ID NO: 8201164 - DNA, 22 bp, Homo sapiens
agcacctgtggctcatgctcgt

SEQ ID NO: 8201165 - DNA, 23 bp, Homo sapiens
agcacgggtacagcctggccagg

SEQ ID NO: 8201166 - DNA, 22 bp, Homo sapiens
agcaccttgagatcaagcagtg

SEQ ID NO: 8201167 - DNA, 22 bp, Homo sapiens
agcaccttgatcttggacttcc

SEQ ID NO: 8201168 - DNA, 22 bp, Homo sapiens
agcaccttgctcttggccttcc

SEQ ID NO: 8201169 - DNA, 22 bp, Homo sapiens
agcactggagtttagtgggatt

SEQ ID NO: 8201170 - DNA, 22 bp, Homo sapiens
agcactgggaacgcatggggcc

SEQ ID NO: 8201171 - DNA, 22 bp, Homo sapiens
agcactgggaacgcatggggcc

SEQ ID NO: 8201172 - DNA, 22 bp, Homo sapiens
agcactctaagtgcaagacact

SEQ ID NO: 8201173 - DNA, 22 bp, Homo sapiens
agcactctaagtgcaagacact

SEQ ID NO: 8201174 - DNA, 22 bp, Homo sapiens
agcactctggagtaggagtggg

SEQ ID NO: 8201175 - DNA, 22 bp, Homo sapiens
agcactgatttaaactggattt

SEQ ID NO: 8201176 - DNA, 22 bp, Homo sapiens
agcactgattttgttgcactta

SEQ ID NO: 8201177 - DNA, 22 bp, Homo sapiens
agcactctggagtaggagtggg

SEQ ID NO: 8201178 - DNA, 22 bp, Homo sapiens
agcactagctttaagcattctg

SEQ ID NO: 8201179 - DNA, 19 bp, Homo sapiens
agcagcagaagtgtgcctt

SEQ ID NO: 8201180 - DNA, 22 bp, Homo sapiens
agcagcagagctctggtctgca

SEQ ID NO: 8201181 - DNA, 19 bp, Homo sapiens
agcagcagaagtgtgcctt

SEQ ID NO: 8201182 - DNA, 19 bp, Homo sapiens
agcagcagaagtgtgcctt

SEQ ID NO: 8201183 - DNA, 19 bp, Homo sapiens
agcagcagaagtgtgcctt

SEQ ID NO: 8201184 - DNA, 19 bp, Homo sapiens
agcagcagaagtgtgcctt

SEQ ID NO: 8201185 - DNA, 16 bp, Homo sapiens
caatacatggcatttc

SEQ ID NO: 8201186 - DNA, 22 bp, Homo sapiens
caatacaattaccagttaatca

SEQ ID NO: 8201187 - DNA, 22 bp, Homo sapiens
caatacaattaccagttaatca

SEQ ID NO: 8201188 - DNA, 22 bp, Homo sapiens
caatacatcaggtcaaaatgtg

SEQ ID NO: 8201189 - DNA, 22 bp, Homo sapiens
caatacatcaggtcaaaatgtg

SEQ ID NO: 8201190 - DNA, 22 bp, Homo sapiens
caatacatcaggtcaaaatgtg

SEQ ID NO: 8201191 - DNA, 22 bp, Homo sapiens
agcagcagatcaaacaggcttg

SEQ ID NO: 8201192 - DNA, 22 bp, Homo sapiens
agcagcagatcaaacaggcttg

SEQ ID NO: 8201193 - DNA, 22 bp, Homo sapiens
agcagcagatcaaacaggcttg

SEQ ID NO: 8201194 - DNA, 21 bp, Homo sapiens
agcagcagatctggtgagggc

SEQ ID NO: 8201195 - DNA, 22 bp, Homo sapiens
agcagcagatccaaaaaatgtg

SEQ ID NO: 8201196 - DNA, 22 bp, Homo sapiens
agcagcagatccaaaaaatgtg

SEQ ID NO: 8201197 - DNA, 21 bp, Homo sapiens
agcagcagatctggtgagggc

SEQ ID NO: 8201198 - DNA, 22 bp, Homo sapiens
agcagcagagctctggtctgca

SEQ ID NO: 8201199 - DNA, 22 bp, Homo sapiens
agcagcagagctctggtctgca

SEQ ID NO: 8201200 - DNA, 22 bp, Homo sapiens
agcagcagaggtcagaaaggta

SEQ ID NO: 8201201 - DNA, 22 bp, Homo sapiens
agcagcagaggtcagaaaggta

SEQ ID NO: 8201202 - DNA, 22 bp, Homo sapiens
agcagcagaggtcagaaaggta

SEQ ID NO: 8201203 - DNA, 22 bp, Homo sapiens
agcagcagaggtcagaaaggta

SEQ ID NO: 8201204 - DNA, 22 bp, Homo sapiens
agcagcctggacttggatgtgg

SEQ ID NO: 8201205 - DNA, 21 bp, Homo sapiens
agcagccttgtgtgccaggca

SEQ ID NO: 8201206 - DNA, 22 bp, Homo sapiens
agcagccttaggtattgtgatt

SEQ ID NO: 8201207 - DNA, 22 bp, Homo sapiens
agcagcctcccagggagcagcc

SEQ ID NO: 8201208 - DNA, 22 bp, Homo sapiens
agcagcctctgtagaggtctcc

SEQ ID NO: 8201209 - DNA, 22 bp, Homo sapiens
agcagcctcccagggagcagcc

SEQ ID NO: 8201210 - DNA, 22 bp, Homo sapiens
agcagcctattcttctcttgga

SEQ ID NO: 8201211 - DNA, 22 bp, Homo sapiens
agcagcctattcttctcttgga

SEQ ID NO: 8201212 - DNA, 23 bp, Homo sapiens
agcagccctgggacctggcctgc

SEQ ID NO: 8201213 - DNA, 23 bp, Homo sapiens
agcagccctgggacctggcctgc

SEQ ID NO: 8201214 - DNA, 23 bp, Homo sapiens
agcagccctgggacctggcctgc

SEQ ID NO: 8201215 - DNA, 23 bp, Homo sapiens
agcagccctgggacctggcctgc

SEQ ID NO: 8201216 - DNA, 22 bp, Homo sapiens
agcagcccgaggatcatgtgtc

SEQ ID NO: 8201217 - DNA, 22 bp, Homo sapiens
agcagcccgaggatcatgtgtc

SEQ ID NO: 8201218 - DNA, 22 bp, Homo sapiens
agcagcccgaggatcatgtgtc

SEQ ID NO: 8201219 - DNA, 22 bp, Homo sapiens
agcagcccgaggatcatgtgtc

SEQ ID NO: 8201220 - DNA, 22 bp, Homo sapiens
agcagcccctcggcgggtgcgc

SEQ ID NO: 8201221 - DNA, 22 bp, Homo sapiens
agcagcccctcggcgggtgcgc

SEQ ID NO: 8201222 - DNA, 22 bp, Homo sapiens
agcagccctagggattgctgtt

SEQ ID NO: 8201223 - DNA, 22 bp, Homo sapiens
agcagccctagggattgctgtt

SEQ ID NO: 8201224 - DNA, 22 bp, Homo sapiens
agcagccctatgtaattggact

SEQ ID NO: 8201225 - DNA, 22 bp, Homo sapiens
agcagcccagttgtactgagtg

SEQ ID NO: 8201226 - DNA, 22 bp, Homo sapiens
agcagcccaggcaaagataaaa

SEQ ID NO: 8201227 - DNA, 22 bp, Homo sapiens
agcagcccagttgtactgagtg

SEQ ID NO: 8201228 - DNA, 23 bp, Homo sapiens
agcagcccagatgccttccatcc

SEQ ID NO: 8201229 - DNA, 23 bp, Homo sapiens
agcagcccagatgccttccatcc

SEQ ID NO: 8201230 - DNA, 21 bp, Homo sapiens
agcagcagatctggtgagggc

SEQ ID NO: 8201231 - DNA, 21 bp, Homo sapiens
agcagcagatctggtgagggc

SEQ ID NO: 8201232 - DNA, 20 bp, Homo sapiens
agcagcagatgttggaggtg

SEQ ID NO: 8201233 - DNA, 21 bp, Homo sapiens
agcagcagatctggtgagggc

SEQ ID NO: 8201234 - DNA, 22 bp, Homo sapiens
agcagccagagaatgatgcagt

SEQ ID NO: 8201235 - DNA, 22 bp, Homo sapiens
agcagccagagaatgatgcagt

SEQ ID NO: 8201236 - DNA, 23 bp, Homo sapiens
agcagcccaatggcaagctctgg

SEQ ID NO: 8201237 - DNA, 22 bp, Homo sapiens
agcagcccagataaagctcagg

SEQ ID NO: 8201238 - DNA, 22 bp, Homo sapiens
agcagctggcagcttcttctct

SEQ ID NO: 8201239 - DNA, 22 bp, Homo sapiens
agcagctggcagcttcttctct

SEQ ID NO: 8201240 - DNA, 17 bp, Homo sapiens
agcagctggcacaggag

SEQ ID NO: 8201241 - DNA, 21 bp, Homo sapiens
agcagctgggcaacatggagg

SEQ ID NO: 8201242 - DNA, 21 bp, Homo sapiens
agcagctgggcaacatggagg

SEQ ID NO: 8201243 - DNA, 21 bp, Homo sapiens
agcagctgggcaacatggagg

SEQ ID NO: 8201244 - DNA, 19 bp, Homo sapiens
agcagctggaggtggagtg

SEQ ID NO: 8201245 - DNA, 19 bp, Homo sapiens
agcagctggaggtggagtg

SEQ ID NO: 8201246 - DNA, 22 bp, Homo sapiens
agcagctggaactaatagtggt

SEQ ID NO: 8201247 - DNA, 19 bp, Homo sapiens
agcagctggaggtggagtg

SEQ ID NO: 8201248 - DNA, 19 bp, Homo sapiens
agcagctggaggtggagtg

SEQ ID NO: 8201249 - DNA, 17 bp, Homo sapiens
agcagctggcacaggag

SEQ ID NO: 8201250 - DNA, 17 bp, Homo sapiens
agcagctggcacaggag

SEQ ID NO: 8201251 - DNA, 17 bp, Homo sapiens
agcagctggcacaggag

SEQ ID NO: 8201252 - DNA, 22 bp, Homo sapiens
cacagagatggccagggcacat

SEQ ID NO: 8201253 - DNA, 22 bp, Homo sapiens
cacagagatggtctggcaggtg

SEQ ID NO: 8201254 - DNA, 22 bp, Homo sapiens
cacagagattagaattagacta

SEQ ID NO: 8201255 - DNA, 22 bp, Homo sapiens
cacagagattagaattagacta

SEQ ID NO: 8201256 - DNA, 22 bp, Homo sapiens
agcagctggaacatatgaagaa

SEQ ID NO: 8201257 - DNA, 22 bp, Homo sapiens
agcagctggaacatatgaagaa

SEQ ID NO: 8201258 - DNA, 22 bp, Homo sapiens
agcagctggaacatatgaagaa

SEQ ID NO: 8201259 - DNA, 22 bp, Homo sapiens
agcagctggaactaatagtggt

SEQ ID NO: 8201260 - DNA, 22 bp, Homo sapiens
cacagagcaggtgctgggaaga

SEQ ID NO: 8201261 - DNA, 22 bp, Homo sapiens
cacagagcaactcaaatcagct

SEQ ID NO: 8201262 - DNA, 22 bp, Homo sapiens
agcagctgcttttcttcattgg

SEQ ID NO: 8201263 - DNA, 22 bp, Homo sapiens
agcagctacttaaccttgtaca

SEQ ID NO: 8201264 - DNA, 22 bp, Homo sapiens
agcagcgagccagctctgcggg

SEQ ID NO: 8201265 - DNA, 22 bp, Homo sapiens
agcagctacttaacccatgaca

SEQ ID NO: 8201266 - DNA, 22 bp, Homo sapiens
agcagcctttgatcatctggga

SEQ ID NO: 8201267 - DNA, 22 bp, Homo sapiens
agcagcctttgatcatctggga

SEQ ID NO: 8201268 - DNA, 21 bp, Homo sapiens
agcagccttgtgtgccaggca

SEQ ID NO: 8201269 - DNA, 22 bp, Homo sapiens
agcagccttgtgactccggggt

SEQ ID NO: 8201270 - DNA, 22 bp, Homo sapiens
agcagcctttgatcatctggga

SEQ ID NO: 8201271 - DNA, 22 bp, Homo sapiens
agcagcctttgatcatctggga

SEQ ID NO: 8201272 - DNA, 22 bp, Homo sapiens
agcagctcaaagcctgcaagga

SEQ ID NO: 8201273 - DNA, 19 bp, Homo sapiens
agcagctcagggaggcacc

SEQ ID NO: 8201274 - DNA, 22 bp, Homo sapiens
agcagctcatggagtaggcact

SEQ ID NO: 8201275 - DNA, 22 bp, Homo sapiens
cacagagatggccagggcacat

SEQ ID NO: 8201276 - DNA, 22 bp, Homo sapiens
cacagagatcggaacagaagta

SEQ ID NO: 8201277 - DNA, 22 bp, Homo sapiens
cacagagaggcttgtctccaag

SEQ ID NO: 8201278 - DNA, 22 bp, Homo sapiens
agcagctcccctcatgctccac

SEQ ID NO: 8201279 - DNA, 22 bp, Homo sapiens
agcaggtgtttgtatcataagg

SEQ ID NO: 8201280 - DNA, 18 bp, Homo sapiens
agcaggttctcacagcca

SEQ ID NO: 8201281 - DNA, 22 bp, Homo sapiens
agcaggttgttttgtggccagg

SEQ ID NO: 8201282 - DNA, 22 bp, Homo sapiens
agcagtaagcaactgagcttgc

SEQ ID NO: 8201283 - DNA, 22 bp, Homo sapiens
agcagtccaactgaggtggcat

SEQ ID NO: 8201284 - DNA, 22 bp, Homo sapiens
agcagtccaactgaggtggcat

SEQ ID NO: 8201285 - DNA, 20 bp, Homo sapiens
agcagtccaaaagggcagac

SEQ ID NO: 8201286 - DNA, 22 bp, Homo sapiens
agcagtattctcctgtggtgga

SEQ ID NO: 8201287 - DNA, 22 bp, Homo sapiens
agcagtaagtgaagactagttt

SEQ ID NO: 8201288 - DNA, 22 bp, Homo sapiens
agcagtaagtgaagactagttt

SEQ ID NO: 8201289 - DNA, 22 bp, Homo sapiens
agcagggctggggcacgagcca

SEQ ID NO: 8201290 - DNA, 22 bp, Homo sapiens
agcagggctggggcacgagcca

SEQ ID NO: 8201291 - DNA, 22 bp, Homo sapiens
agcagggctggatttggcaaga

SEQ ID NO: 8201292 - DNA, 22 bp, Homo sapiens
agcagggctggatttggcaaga

SEQ ID NO: 8201293 - DNA, 22 bp, Homo sapiens
agcagggctggggcacgagcca

SEQ ID NO: 8201294 - DNA, 22 bp, Homo sapiens
agcaggtgggcatgaaagctga

SEQ ID NO: 8201295 - DNA, 22 bp, Homo sapiens
agcaggtgggcatgaaagctga

SEQ ID NO: 8201296 - DNA, 19 bp, Homo sapiens
agcaggtgggtaagaaaat

SEQ ID NO: 8201297 - DNA, 22 bp, Homo sapiens
agcaggtgtcggcgagggtctt

SEQ ID NO: 8201298 - DNA, 22 bp, Homo sapiens
agcaggtgtcggcgagggtctt

SEQ ID NO: 8201299 - DNA, 22 bp, Homo sapiens
agcaggtgtcggcgagggtctt

SEQ ID NO: 8201300 - DNA, 22 bp, Homo sapiens
agcaggtgttagggatccaatg

SEQ ID NO: 8201301 - DNA, 18 bp, Homo sapiens
agcaggtgtgcagaatgt

SEQ ID NO: 8201302 - DNA, 18 bp, Homo sapiens
agcaggtgtgcagaatgt

SEQ ID NO: 8201303 - DNA, 18 bp, Homo sapiens
agcaggtgtgcagaatgt

SEQ ID NO: 8201304 - DNA, 22 bp, Homo sapiens
agcaggtgtttgtatcataagg

SEQ ID NO: 8201305 - DNA, 22 bp, Homo sapiens
agcaggtgttagggatccaatg

SEQ ID NO: 8201306 - DNA, 22 bp, Homo sapiens
agcaggtgttggctgggccatc

SEQ ID NO: 8201307 - DNA, 22 bp, Homo sapiens
agcaggtgttggctgggccatc

SEQ ID NO: 8201308 - DNA, 22 bp, Homo sapiens
agcaggtgttggctgggccatc

SEQ ID NO: 8201309 - DNA, 22 bp, Homo sapiens
agcatgaaaggcgtgccaactt

SEQ ID NO: 8201310 - DNA, 22 bp, Homo sapiens
agcatgaaagcataggacagtc

SEQ ID NO: 8201311 - DNA, 22 bp, Homo sapiens
agcatgaagacttcagagctag

SEQ ID NO: 8201312 - DNA, 22 bp, Homo sapiens
agcatgaaaggcgtgccaactt

SEQ ID NO: 8201313 - DNA, 21 bp, Homo sapiens
agcatgcactacttcatctta

SEQ ID NO: 8201314 - DNA, 18 bp, Homo sapiens
agcatgagtcaggggtgc

SEQ ID NO: 8201315 - DNA, 22 bp, Homo sapiens
agcatattgtatgtctatatgt

SEQ ID NO: 8201316 - DNA, 22 bp, Homo sapiens
agcatgaaagcataggacagtc

SEQ ID NO: 8201317 - DNA, 22 bp, Homo sapiens
agcatcagcagactctcagcta

SEQ ID NO: 8201318 - DNA, 22 bp, Homo sapiens
agcagtggcctggggctctgtg

SEQ ID NO: 8201319 - DNA, 22 bp, Homo sapiens
agcagtggagcgagatgtttaa

SEQ ID NO: 8201320 - DNA, 22 bp, Homo sapiens
agcagtgagtgggaggaccatg

SEQ ID NO: 8201321 - DNA, 23 bp, Homo sapiens
agcagtgagtaaacagataggat

SEQ ID NO: 8201322 - DNA, 22 bp, Homo sapiens
agcagtggacctcagtgctatt

SEQ ID NO: 8201323 - DNA, 22 bp, Homo sapiens
agcagtggacctcagtgctatt

SEQ ID NO: 8201324 - DNA, 22 bp, Homo sapiens
agcagtggacctcagtgctatt

SEQ ID NO: 8201325 - DNA, 22 bp, Homo sapiens
agcagtgcttgccttagtgtga

SEQ ID NO: 8201326 - DNA, 21 bp, Homo sapiens
agcagtgctcctgggatgagg

SEQ ID NO: 8201327 - DNA, 22 bp, Homo sapiens
agcagtgcccattctgccccct

SEQ ID NO: 8201328 - DNA, 22 bp, Homo sapiens
agcagtgctatggccaggctaa

SEQ ID NO: 8201329 - DNA, 22 bp, Homo sapiens
agcagtgccgcatcttgtgacc

SEQ ID NO: 8201330 - DNA, 22 bp, Homo sapiens
agcagtgccgcatcttgtgacc

SEQ ID NO: 8201331 - DNA, 22 bp, Homo sapiens
agcagtgcccattctgccccct

SEQ ID NO: 8201332 - DNA, 22 bp, Homo sapiens
agcatgcatgaagattcagcaa

SEQ ID NO: 8201333 - DNA, 22 bp, Homo sapiens
agcatgcatttttggactgtgc

SEQ ID NO: 8201334 - DNA, 22 bp, Homo sapiens
agcatgcgcttgatcagctcca

SEQ ID NO: 8201335 - DNA, 22 bp, Homo sapiens
agcatgcgcttgatcagctcca

SEQ ID NO: 8201336 - DNA, 22 bp, Homo sapiens
agcatgcaggaaccacatggca

SEQ ID NO: 8201337 - DNA, 20 bp, Homo sapiens
agcatgcagccagagccaac

SEQ ID NO: 8201338 - DNA, 18 bp, Homo sapiens
agcatggcacaggctccc

SEQ ID NO: 8201339 - DNA, 23 bp, Homo sapiens
agcatggaataggaaagaggcag

SEQ ID NO: 8201340 - DNA, 22 bp, Homo sapiens
agcatggcactcaaggctcctg

SEQ ID NO: 8201341 - DNA, 22 bp, Homo sapiens
agcatggcactcaaggctcctg

SEQ ID NO: 8201342 - DNA, 18 bp, Homo sapiens
agcatggcacaggctccc

SEQ ID NO: 8201343 - DNA, 22 bp, Homo sapiens
agcatggcattattggaaggac

SEQ ID NO: 8201344 - DNA, 22 bp, Homo sapiens
agcatggcattattggaaggac

SEQ ID NO: 8201345 - DNA, 22 bp, Homo sapiens
agcatggggctccgcaatgaac

SEQ ID NO: 8201346 - DNA, 22 bp, Homo sapiens
agcatggtctgatcaggtggct

SEQ ID NO: 8201347 - DNA, 22 bp, Homo sapiens
agcatggtctgatcaggtggct

SEQ ID NO: 8201348 - DNA, 22 bp, Homo sapiens
agcatggggctccgcaatgaac

SEQ ID NO: 8201349 - DNA, 22 bp, Homo sapiens
agcatggggcaatgcatgtgct

SEQ ID NO: 8201350 - DNA, 22 bp, Homo sapiens
agcatggggcaatgcatgtgct

SEQ ID NO: 8201351 - DNA, 22 bp, Homo sapiens
agcatggggcaatgcatgtgct

SEQ ID NO: 8201352 - DNA, 22 bp, Homo sapiens
agcatggctttggaggatagca

SEQ ID NO: 8201353 - DNA, 22 bp, Homo sapiens
agcatggctttggaggatagca

SEQ ID NO: 8201354 - DNA, 22 bp, Homo sapiens
agcatggggcaatgcatgtgct

SEQ ID NO: 8201355 - DNA, 22 bp, Homo sapiens
agcatggcctcccgggcctggc

SEQ ID NO: 8201356 - DNA, 22 bp, Homo sapiens
agcatggcctcccgggcctggc

SEQ ID NO: 8201357 - DNA, 22 bp, Homo sapiens
agcatggcctgcagcggccacc

SEQ ID NO: 8201358 - DNA, 22 bp, Homo sapiens
agcatggcctgcagcggccacc

SEQ ID NO: 8201359 - DNA, 19 bp, Homo sapiens
agcatggcctacagtgtgc

SEQ ID NO: 8201360 - DNA, 19 bp, Homo sapiens
agcatggcctacagtgtgc

SEQ ID NO: 8201361 - DNA, 22 bp, Homo sapiens
agcatggccatctgggccgtcc

SEQ ID NO: 8201362 - DNA, 22 bp, Homo sapiens
agcatggccacgggggtaggta

SEQ ID NO: 8201363 - DNA, 22 bp, Homo sapiens
agcatggccatctgggccgtcc

SEQ ID NO: 8201364 - DNA, 22 bp, Homo sapiens
cactgtttttatgtaatcagtg

SEQ ID NO: 8201365 - DNA, 22 bp, Homo sapiens
cacttaaagtcttagcttacag

SEQ ID NO: 8201366 - DNA, 22 bp, Homo sapiens
cactttactatctataaaataa

SEQ ID NO: 8201367 - DNA, 22 bp, Homo sapiens
cactttacccttgttactcatg

SEQ ID NO: 8201368 - DNA, 22 bp, Homo sapiens
cactttactatctataaaataa

SEQ ID NO: 8201369 - DNA, 22 bp, Homo sapiens
cactgtttggctcctgtactta

SEQ ID NO: 8201370 - DNA, 22 bp, Homo sapiens
cactgttcatcaaaactgctct

SEQ ID NO: 8201371 - DNA, 22 bp, Homo sapiens
cactgttattactactatacat

SEQ ID NO: 8201372 - DNA, 22 bp, Homo sapiens
cactgtgtctggagtgagctgg

SEQ ID NO: 8201373 - DNA, 19 bp, Homo sapiens
cactgtggtccttcactgc

SEQ ID NO: 8201374 - DNA, 19 bp, Homo sapiens
cactgtggtccttcactgc

SEQ ID NO: 8201375 - DNA, 22 bp, Homo sapiens
cactgtggttattatcactgtt

SEQ ID NO: 8201376 - DNA, 22 bp, Homo sapiens
cactgtgtaagaagatgggctt

SEQ ID NO: 8201377 - DNA, 22 bp, Homo sapiens
cactgtgtcagagtatgatgat

SEQ ID NO: 8201378 - DNA, 22 bp, Homo sapiens
cactgtgtcagtttggttagac

SEQ ID NO: 8201379 - DNA, 22 bp, Homo sapiens
cactggtgagtccagaagtcat

SEQ ID NO: 8201380 - DNA, 22 bp, Homo sapiens
cactggtgacttctgagctgga

SEQ ID NO: 8201381 - DNA, 22 bp, Homo sapiens
agcattactattctcaaaaaca

SEQ ID NO: 8201382 - DNA, 22 bp, Homo sapiens
agcattacagtggtacccaggg

SEQ ID NO: 8201383 - DNA, 22 bp, Homo sapiens
agcattaataagaaatggctcc

SEQ ID NO: 8201384 - DNA, 22 bp, Homo sapiens
caccagcagaagactgagggtg

SEQ ID NO: 8201385 - DNA, 22 bp, Homo sapiens
caccagcagaagactgagggtg

SEQ ID NO: 8201386 - DNA, 22 bp, Homo sapiens
caccagccagagtgacagctcc

SEQ ID NO: 8201387 - DNA, 22 bp, Homo sapiens
caccagagttgtccaaatgatt

SEQ ID NO: 8201388 - DNA, 22 bp, Homo sapiens
caccagagtgagtggactgtcg

SEQ ID NO: 8201389 - DNA, 22 bp, Homo sapiens
caccagaacaagacaggagaat

SEQ ID NO: 8201390 - DNA, 23 bp, Homo sapiens
caccactttctccttctccttgg

SEQ ID NO: 8201391 - DNA, 22 bp, Homo sapiens
caccagctacagactactgtgt

SEQ ID NO: 8201392 - DNA, 22 bp, Homo sapiens
agcagggctctgccatgggccc

SEQ ID NO: 8201393 - DNA, 22 bp, Homo sapiens
caccagctacagactactgtgt

SEQ ID NO: 8201394 - DNA, 22 bp, Homo sapiens
agcagggctctgtggagggtgg

SEQ ID NO: 8201395 - DNA, 22 bp, Homo sapiens
agcagggctctgtggagggtgg

SEQ ID NO: 8201396 - DNA, 22 bp, Homo sapiens
agcagggctgcagtgtgtcttt

SEQ ID NO: 8201397 - DNA, 22 bp, Homo sapiens
agcagggctgcagtgtgtcttt

SEQ ID NO: 8201398 - DNA, 22 bp, Homo sapiens
agcagggctgcggccccaccac

SEQ ID NO: 8201399 - DNA, 22 bp, Homo sapiens
agcagggctgcagtgtgtcttt

SEQ ID NO: 8201400 - DNA, 22 bp, Homo sapiens
agcagggctctgtggagggtgg

SEQ ID NO: 8201401 - DNA, 22 bp, Homo sapiens
agcagggctctgtggagggtgg

SEQ ID NO: 8201402 - DNA, 22 bp, Homo sapiens
agcagggctctgtggagggtgg

SEQ ID NO: 8201403 - DNA, 22 bp, Homo sapiens
agcagggctctgtggagggtgg

SEQ ID NO: 8201404 - DNA, 22 bp, Homo sapiens
agcagggctctgtggagggtgg

SEQ ID NO: 8201405 - DNA, 22 bp, Homo sapiens
agcagggcaggtaaggatcaga

SEQ ID NO: 8201406 - DNA, 22 bp, Homo sapiens
agcagggcaggtaaggatcaga

SEQ ID NO: 8201407 - DNA, 22 bp, Homo sapiens
agcagggcaggtaaggatcaga

SEQ ID NO: 8201408 - DNA, 22 bp, Homo sapiens
agcagggcaggtaaggatcaga

SEQ ID NO: 8201409 - DNA, 22 bp, Homo sapiens
agcagggcaggtaaggatcaga

SEQ ID NO: 8201410 - DNA, 22 bp, Homo sapiens
agcagggcaggtaaggatcaga

SEQ ID NO: 8201411 - DNA, 22 bp, Homo sapiens
agcagggcaggtaaggatcaga

SEQ ID NO: 8201412 - DNA, 22 bp, Homo sapiens
agcagggcagcttttttcagaa

SEQ ID NO: 8201413 - DNA, 22 bp, Homo sapiens
agcagggcagcttttttcagaa

SEQ ID NO: 8201414 - DNA, 22 bp, Homo sapiens
cacatttaattggtttagggtg

SEQ ID NO: 8201415 - DNA, 22 bp, Homo sapiens
caccactgtatccctagcactt

SEQ ID NO: 8201416 - DNA, 23 bp, Homo sapiens
caccactttctccttctccttgg

SEQ ID NO: 8201417 - DNA, 23 bp, Homo sapiens
caccactttctccttctccttgg

SEQ ID NO: 8201418 - DNA, 22 bp, Homo sapiens
cacatttaattggtttagggtg

SEQ ID NO: 8201419 - DNA, 22 bp, Homo sapiens
cacatttaatcctttataagta

SEQ ID NO: 8201420 - DNA, 22 bp, Homo sapiens
cacatttaatcctttataagta

SEQ ID NO: 8201421 - DNA, 22 bp, Homo sapiens
agcagggcagtgatcagaaagg

SEQ ID NO: 8201422 - DNA, 22 bp, Homo sapiens
agcagggcagtgatcagaaagg

SEQ ID NO: 8201423 - DNA, 22 bp, Homo sapiens
agcagggcagtgatcagaaagg

SEQ ID NO: 8201424 - DNA, 22 bp, Homo sapiens
agcagggcagtgatcagaaagg

SEQ ID NO: 8201425 - DNA, 22 bp, Homo sapiens
agcagggcactggaaggcactg

SEQ ID NO: 8201426 - DNA, 22 bp, Homo sapiens
agcagggcactggaaggcactg

SEQ ID NO: 8201427 - DNA, 22 bp, Homo sapiens
agcagggcactggaaggcactg

SEQ ID NO: 8201428 - DNA, 22 bp, Homo sapiens
agcagggcaaagtcaggctaac

SEQ ID NO: 8201429 - DNA, 22 bp, Homo sapiens
agcagggcaaagtcaggctaac

SEQ ID NO: 8201430 - DNA, 22 bp, Homo sapiens
agcagggcagctgatgcgcacg

SEQ ID NO: 8201431 - DNA, 22 bp, Homo sapiens
agcagggcagctgatgcgcacg

SEQ ID NO: 8201432 - DNA, 22 bp, Homo sapiens
agcagggcagctgatgcgcacg

SEQ ID NO: 8201433 - DNA, 17 bp, Homo sapiens
agcagggagtcaaggga

SEQ ID NO: 8201434 - DNA, 17 bp, Homo sapiens
agcagggagtcaaggga

SEQ ID NO: 8201435 - DNA, 19 bp, Homo sapiens
agcagggagtggttgtggg

SEQ ID NO: 8201436 - DNA, 22 bp, Homo sapiens
agcagggcaaagtcaggctaac

SEQ ID NO: 8201437 - DNA, 22 bp, Homo sapiens
agcagggcaaagtcaggctaac

SEQ ID NO: 8201438 - DNA, 22 bp, Homo sapiens
agcagggcaaagtcaggctaac

SEQ ID NO: 8201439 - DNA, 22 bp, Homo sapiens
agcagggcaaagtcaggctaac

SEQ ID NO: 8201440 - DNA, 22 bp, Homo sapiens
agcagggcaaagtcaggctaac

SEQ ID NO: 8201441 - DNA, 22 bp, Homo sapiens
agcaggaactcagggagttctc

SEQ ID NO: 8201442 - DNA, 22 bp, Homo sapiens
agcaggaactcagggagttctc

SEQ ID NO: 8201443 - DNA, 22 bp, Homo sapiens
agcaggaaggctttgggggttc

SEQ ID NO: 8201444 - DNA, 22 bp, Homo sapiens
agcaggaaggctttgggggttc

SEQ ID NO: 8201445 - DNA, 22 bp, Homo sapiens
agcagcttgaggctggattcca

SEQ ID NO: 8201446 - DNA, 22 bp, Homo sapiens
agcagcttgagctggggctggc

SEQ ID NO: 8201447 - DNA, 22 bp, Homo sapiens
agcagcttctttcactcctgga

SEQ ID NO: 8201448 - DNA, 22 bp, Homo sapiens
agcagcttctttcactcctgga

SEQ ID NO: 8201449 - DNA, 22 bp, Homo sapiens
agcaggaaggctttgggggttc

SEQ ID NO: 8201450 - DNA, 22 bp, Homo sapiens
agcaggaaggggatgatgggca

SEQ ID NO: 8201451 - DNA, 22 bp, Homo sapiens
agcaggaaggtctgtgtgagtc

SEQ ID NO: 8201452 - DNA, 22 bp, Homo sapiens
agcaggaaggtctgtgtgagtc

SEQ ID NO: 8201453 - DNA, 22 bp, Homo sapiens
agcaggaaggtctgtgtgagtc

SEQ ID NO: 8201454 - DNA, 22 bp, Homo sapiens
cacagcaagagctaaatgacca

SEQ ID NO: 8201455 - DNA, 18 bp, Homo sapiens
agcaggactgtggggtgg

SEQ ID NO: 8201456 - DNA, 22 bp, Homo sapiens
agcaggaagtagtctgtaagca

SEQ ID NO: 8201457 - DNA, 22 bp, Homo sapiens
agcaggaagtcctctcaggaga

SEQ ID NO: 8201458 - DNA, 22 bp, Homo sapiens
agcaggaatctgttctgtataa

SEQ ID NO: 8201459 - DNA, 20 bp, Homo sapiens
agcaggaatgatgctttcat

SEQ ID NO: 8201460 - DNA, 22 bp, Homo sapiens
agcaggacaatatgggatcagg

SEQ ID NO: 8201461 - DNA, 22 bp, Homo sapiens
cacagcagaaatatgaaggcag

SEQ ID NO: 8201462 - DNA, 22 bp, Homo sapiens
cacagcagaaagtgtaggagga

SEQ ID NO: 8201463 - DNA, 22 bp, Homo sapiens
cacagcagaaagtgtaggagga

SEQ ID NO: 8201464 - DNA, 22 bp, Homo sapiens
cacagcagaaatatgaaggcag

SEQ ID NO: 8201465 - DNA, 22 bp, Homo sapiens
cacagcagaaagtgtaggagga

SEQ ID NO: 8201466 - DNA, 22 bp, Homo sapiens
cacagcagagggagccattgaa

SEQ ID NO: 8201467 - DNA, 22 bp, Homo sapiens
cacagcagagggagccattgaa

SEQ ID NO: 8201468 - DNA, 22 bp, Homo sapiens
cacagcagagggagccattgaa

SEQ ID NO: 8201469 - DNA, 22 bp, Homo sapiens
cacagcagacagggaggcggct

SEQ ID NO: 8201470 - DNA, 22 bp, Homo sapiens
cacagcagacagggaggcggct

SEQ ID NO: 8201471 - DNA, 22 bp, Homo sapiens
cacagcagagggagccattgaa

SEQ ID NO: 8201472 - DNA, 22 bp, Homo sapiens
cacagcagagggagccattgaa

SEQ ID NO: 8201473 - DNA, 22 bp, Homo sapiens
agcaggctgggcaatatgggca

SEQ ID NO: 8201474 - DNA, 22 bp, Homo sapiens
agcagggagaccatctcttcct

SEQ ID NO: 8201475 - DNA, 22 bp, Homo sapiens
agcagggaggcccagggcactg

SEQ ID NO: 8201476 - DNA, 22 bp, Homo sapiens
agcaggcttactttctgattag

SEQ ID NO: 8201477 - DNA, 22 bp, Homo sapiens
agcagggagaccatctcttcct

SEQ ID NO: 8201478 - DNA, 22 bp, Homo sapiens
agcagggaggcggtgtgctggc

SEQ ID NO: 8201479 - DNA, 22 bp, Homo sapiens
agcagggaggcccagggcactg

SEQ ID NO: 8201480 - DNA, 22 bp, Homo sapiens
agcagggaggcccagggcactg

SEQ ID NO: 8201481 - DNA, 22 bp, Homo sapiens
agcagggaggcggtgtgctggc

SEQ ID NO: 8201482 - DNA, 22 bp, Homo sapiens
agcagggaggcggtgtgctggc

SEQ ID NO: 8201483 - DNA, 22 bp, Homo sapiens
agcagggaggcggtgtgctggc

SEQ ID NO: 8201484 - DNA, 22 bp, Homo sapiens
agcagggaggtctagcacgtgg

SEQ ID NO: 8201485 - DNA, 22 bp, Homo sapiens
agcagggaggtctagcacgtgg

SEQ ID NO: 8201486 - DNA, 22 bp, Homo sapiens
agcagggaggcggtgtgctggc

SEQ ID NO: 8201487 - DNA, 22 bp, Homo sapiens
agcagggaggcggtgtgctggc

SEQ ID NO: 8201488 - DNA, 17 bp, Homo sapiens
agcagggagtcaaggga

SEQ ID NO: 8201489 - DNA, 17 bp, Homo sapiens
agcagggagtcaaggga

SEQ ID NO: 8201490 - DNA, 22 bp, Homo sapiens
cagagacattcagtaaattatc

SEQ ID NO: 8201491 - DNA, 22 bp, Homo sapiens
cagagacattctccccattgga

SEQ ID NO: 8201492 - DNA, 22 bp, Homo sapiens
cagagacattaagtgccatgat

SEQ ID NO: 8201493 - DNA, 22 bp, Homo sapiens
cagagacattaagtgccatgat

SEQ ID NO: 8201494 - DNA, 22 bp, Homo sapiens
cagagacatccattttatatgc

SEQ ID NO: 8201495 - DNA, 22 bp, Homo sapiens
cagagacatccattttatatgc

SEQ ID NO: 8201496 - DNA, 22 bp, Homo sapiens
cagagacatgtggcctgcacgt

SEQ ID NO: 8201497 - DNA, 22 bp, Homo sapiens
cagagacatgtggcctgcacgt

SEQ ID NO: 8201498 - DNA, 22 bp, Homo sapiens
cagagaactccagtggctggcg

SEQ ID NO: 8201499 - DNA, 21 bp, Homo sapiens
agccagctatcacacagcatt

SEQ ID NO: 8201500 - DNA, 20 bp, Homo sapiens
cagagaccaggccaggtgtc

SEQ ID NO: 8201501 - DNA, 20 bp, Homo sapiens
cagagacccaggcttcagct

SEQ ID NO: 8201502 - DNA, 22 bp, Homo sapiens
cagagacccctggcatggtggt

SEQ ID NO: 8201503 - DNA, 22 bp, Homo sapiens
cagagacccctggcatggtggt

SEQ ID NO: 8201504 - DNA, 22 bp, Homo sapiens
cagagaccctaggcaggtgaca

SEQ ID NO: 8201505 - DNA, 22 bp, Homo sapiens
cagagacctcaaattatttcct

SEQ ID NO: 8201506 - DNA, 22 bp, Homo sapiens
cagagacccttctcagtggcca

SEQ ID NO: 8201507 - DNA, 17 bp, Homo sapiens
agccaggcatatgaagt

SEQ ID NO: 8201508 - DNA, 17 bp, Homo sapiens
agccaggcatatgaagt

SEQ ID NO: 8201509 - DNA, 22 bp, Homo sapiens
agccaggccagactcacaccct

SEQ ID NO: 8201510 - DNA, 22 bp, Homo sapiens
agccaggccagactcacaccct

SEQ ID NO: 8201511 - DNA, 22 bp, Homo sapiens
agccaggccttttctcaaggtt

SEQ ID NO: 8201512 - DNA, 22 bp, Homo sapiens
agccaggccttttctcaaggtt

SEQ ID NO: 8201513 - DNA, 22 bp, Homo sapiens
cagagcccagggcctacgtccc

SEQ ID NO: 8201514 - DNA, 20 bp, Homo sapiens
cagagcccactttcttatca

SEQ ID NO: 8201515 - DNA, 21 bp, Homo sapiens
cagagcctgtgttgacagttg

SEQ ID NO: 8201516 - DNA, 21 bp, Homo sapiens
cagagcctgtgttgacagttg

SEQ ID NO: 8201517 - DNA, 22 bp, Homo sapiens
agccaggccttagggagaggca

SEQ ID NO: 8201518 - DNA, 22 bp, Homo sapiens
agccaggccttagggagaggca

SEQ ID NO: 8201519 - DNA, 20 bp, Homo sapiens
agccaggcctcaagttaagt

SEQ ID NO: 8201520 - DNA, 22 bp, Homo sapiens
agccaggccagctgtcttgagt

SEQ ID NO: 8201521 - DNA, 22 bp, Homo sapiens
agccaggccagctgtcttgagt

SEQ ID NO: 8201522 - DNA, 22 bp, Homo sapiens
cagagccttagttctcctagaa

SEQ ID NO: 8201523 - DNA, 22 bp, Homo sapiens
cagagccttagttctcctagaa

SEQ ID NO: 8201524 - DNA, 22 bp, Homo sapiens
cagagccttagttctcctagaa

SEQ ID NO: 8201525 - DNA, 22 bp, Homo sapiens
cagagccttagttctcctagaa

SEQ ID NO: 8201526 - DNA, 22 bp, Homo sapiens
cagagccttcctagcagactct

SEQ ID NO: 8201527 - DNA, 19 bp, Homo sapiens
cagagccttcagtgactcc

SEQ ID NO: 8201528 - DNA, 22 bp, Homo sapiens
cagagccttcctagcagactct

SEQ ID NO: 8201529 - DNA, 22 bp, Homo sapiens
cagagcctttgtgtccacattt

SEQ ID NO: 8201530 - DNA, 22 bp, Homo sapiens
cagagccttcctagcagactct

SEQ ID NO: 8201531 - DNA, 18 bp, Homo sapiens
cagagctcctggatgcag

SEQ ID NO: 8201532 - DNA, 22 bp, Homo sapiens
cagagctcagagctgccaggca

SEQ ID NO: 8201533 - DNA, 18 bp, Homo sapiens
cagagctcctggatgcag

SEQ ID NO: 8201534 - DNA, 18 bp, Homo sapiens
cagagctcctggatgcag

SEQ ID NO: 8201535 - DNA, 22 bp, Homo sapiens
cagagctcagagcagggcactc

SEQ ID NO: 8201536 - DNA, 22 bp, Homo sapiens
cagagctcagagcagggcactc

SEQ ID NO: 8201537 - DNA, 22 bp, Homo sapiens
cagagctcagagctgccaggca

SEQ ID NO: 8201538 - DNA, 19 bp, Homo sapiens
cactttatttctgttttgt

SEQ ID NO: 8201539 - DNA, 19 bp, Homo sapiens
cactttatttctgttttgt

SEQ ID NO: 8201540 - DNA, 22 bp, Homo sapiens
cactttattataaatttgagag

SEQ ID NO: 8201541 - DNA, 22 bp, Homo sapiens
cactttattataaatttgagag

SEQ ID NO: 8201542 - DNA, 22 bp, Homo sapiens
cactttctgtgtatcttccatt

SEQ ID NO: 8201543 - DNA, 22 bp, Homo sapiens
cactttctgtgtatcttccatt

SEQ ID NO: 8201544 - DNA, 22 bp, Homo sapiens
cactttatatgcattacctcat

SEQ ID NO: 8201545 - DNA, 22 bp, Homo sapiens
cactttatatgcattacctcat

SEQ ID NO: 8201546 - DNA, 22 bp, Homo sapiens
cactttataaaattggtgtgag

SEQ ID NO: 8201547 - DNA, 22 bp, Homo sapiens
cactttataaaattggtgtgag

SEQ ID NO: 8201548 - DNA, 22 bp, Homo sapiens
cactttactatctataaaataa

SEQ ID NO: 8201549 - DNA, 22 bp, Homo sapiens
cactttataaaattggtgtgag

SEQ ID NO: 8201550 - DNA, 22 bp, Homo sapiens
cactttatattctaagacggcc

SEQ ID NO: 8201551 - DNA, 22 bp, Homo sapiens
cactttatattctaagacggcc

SEQ ID NO: 8201552 - DNA, 22 bp, Homo sapiens
cactttatattctaagacggcc

SEQ ID NO: 8201553 - DNA, 22 bp, Homo sapiens
cactttatgggaagcaaaaatt

SEQ ID NO: 8201554 - DNA, 22 bp, Homo sapiens
cactttatgggaagcaaaaatt

SEQ ID NO: 8201555 - DNA, 22 bp, Homo sapiens
cactttatgggaagcaaaaatt

SEQ ID NO: 8201556 - DNA, 19 bp, Homo sapiens
agccagagtggcccagggg

SEQ ID NO: 8201557 - DNA, 22 bp, Homo sapiens
agccagagagtgttggagatgt

SEQ ID NO: 8201558 - DNA, 22 bp, Homo sapiens
agccagagatccatccctagga

SEQ ID NO: 8201559 - DNA, 22 bp, Homo sapiens
agccagcacggatttcccagga

SEQ ID NO: 8201560 - DNA, 21 bp, Homo sapiens
agccagcaacacagcatctcc

SEQ ID NO: 8201561 - DNA, 19 bp, Homo sapiens
agccagcagcgtagcatct

SEQ ID NO: 8201562 - DNA, 22 bp, Homo sapiens
agccagcacggcgccatggagt

SEQ ID NO: 8201563 - DNA, 22 bp, Homo sapiens
agccagcacggcgccatggagt

SEQ ID NO: 8201564 - DNA, 22 bp, Homo sapiens
agccagcctgatctcttcttgc

SEQ ID NO: 8201565 - DNA, 22 bp, Homo sapiens
agccagctaagggaagcatgat

SEQ ID NO: 8201566 - DNA, 22 bp, Homo sapiens
agccagcctgatctcttcttgc

SEQ ID NO: 8201567 - DNA, 22 bp, Homo sapiens
agccagccgggggaccacagtg

SEQ ID NO: 8201568 - DNA, 22 bp, Homo sapiens
agccagcccctgactgtgtcct

SEQ ID NO: 8201569 - DNA, 22 bp, Homo sapiens
agccagcccctgactgtgtcct

SEQ ID NO: 8201570 - DNA, 22 bp, Homo sapiens
agccagcccctgactgtgtcct

SEQ ID NO: 8201571 - DNA, 20 bp, Homo sapiens
agccagccacttcctgctcc

SEQ ID NO: 8201572 - DNA, 20 bp, Homo sapiens
agccagccacttcctgctcc

SEQ ID NO: 8201573 - DNA, 22 bp, Homo sapiens
agccagccagttcactaggaaa

SEQ ID NO: 8201574 - DNA, 22 bp, Homo sapiens
agccagcaggtgagtgcagcct

SEQ ID NO: 8201575 - DNA, 22 bp, Homo sapiens
agccagcagggcttagaggaca

SEQ ID NO: 8201576 - DNA, 22 bp, Homo sapiens
agccagcagggcttagaggaca

SEQ ID NO: 8201577 - DNA, 19 bp, Homo sapiens
agccagcaggcctctgagc

SEQ ID NO: 8201578 - DNA, 17 bp, Homo sapiens
agccagcagtagctggt

SEQ ID NO: 8201579 - DNA, 17 bp, Homo sapiens
agccagcagtagctggt

SEQ ID NO: 8201580 - DNA, 22 bp, Homo sapiens
agccagcaggtgagtgcagcct

SEQ ID NO: 8201581 - DNA, 22 bp, Homo sapiens
agccagtgcagctggaaattca

SEQ ID NO: 8201582 - DNA, 22 bp, Homo sapiens
agccagtgcaacagcagtgaag

SEQ ID NO: 8201583 - DNA, 22 bp, Homo sapiens
cagagctctgacagctacagcc

SEQ ID NO: 8201584 - DNA, 22 bp, Homo sapiens
agccagtggaattcccaggggt

SEQ ID NO: 8201585 - DNA, 22 bp, Homo sapiens
agccagtgccagtcatgcctgc

SEQ ID NO: 8201586 - DNA, 22 bp, Homo sapiens
agccagtgccagtcatgcctgc

SEQ ID NO: 8201587 - DNA, 22 bp, Homo sapiens
agccagtgccagtcatgcctgc

SEQ ID NO: 8201588 - DNA, 22 bp, Homo sapiens
agccagtgccagtcatgcctgc

SEQ ID NO: 8201589 - DNA, 22 bp, Homo sapiens
agccagtgcaacagcagtgaag

SEQ ID NO: 8201590 - DNA, 22 bp, Homo sapiens
cagagctctctttgctactaca

SEQ ID NO: 8201591 - DNA, 22 bp, Homo sapiens
cagagctctgacagctacagcc

SEQ ID NO: 8201592 - DNA, 22 bp, Homo sapiens
cagagctctatgttcatggagg

SEQ ID NO: 8201593 - DNA, 22 bp, Homo sapiens
cagagctctatgttcatggagg

SEQ ID NO: 8201594 - DNA, 22 bp, Homo sapiens
agccagtgttaagtgactggtt

SEQ ID NO: 8201595 - DNA, 22 bp, Homo sapiens
agccagtgttaagtgactggtt

SEQ ID NO: 8201596 - DNA, 22 bp, Homo sapiens
agccagttccagcacaccactg

SEQ ID NO: 8201597 - DNA, 22 bp, Homo sapiens
agccagttccagcacaccactg

SEQ ID NO: 8201598 - DNA, 17 bp, Homo sapiens
agccagttcatagcact

SEQ ID NO: 8201599 - DNA, 22 bp, Homo sapiens
agccagttcaagttatggcgtt

SEQ ID NO: 8201600 - DNA, 22 bp, Homo sapiens
agccagtgggattagagcctct

SEQ ID NO: 8201601 - DNA, 22 bp, Homo sapiens
agccagtgggattagagcctct

SEQ ID NO: 8201602 - DNA, 22 bp, Homo sapiens
agccagtggaattcccaggggt

SEQ ID NO: 8201603 - DNA, 22 bp, Homo sapiens
agccagtggtgtaatgccgtct

SEQ ID NO: 8201604 - DNA, 22 bp, Homo sapiens
agccagtgtcgtgtgacatgag

SEQ ID NO: 8201605 - DNA, 22 bp, Homo sapiens
agccagtgtcgtgtgacatgag

SEQ ID NO: 8201606 - DNA, 22 bp, Homo sapiens
agccagtgtcgtgtgacatgag

SEQ ID NO: 8201607 - DNA, 22 bp, Homo sapiens
agccagtttccagatattaact

SEQ ID NO: 8201608 - DNA, 22 bp, Homo sapiens
agcccagggacagggcggatgt

SEQ ID NO: 8201609 - DNA, 23 bp, Homo sapiens
agccagttgtagccacagaactc

SEQ ID NO: 8201610 - DNA, 22 bp, Homo sapiens
agccagttgtggggctagccct

SEQ ID NO: 8201611 - DNA, 22 bp, Homo sapiens
agccagttgtggggctagccct

SEQ ID NO: 8201612 - DNA, 22 bp, Homo sapiens
agccagtttaagcaggaggggt

SEQ ID NO: 8201613 - DNA, 19 bp, Homo sapiens
agccagttctagacaatgg

SEQ ID NO: 8201614 - DNA, 22 bp, Homo sapiens
agccagttgatgggtttccaat

SEQ ID NO: 8201615 - DNA, 22 bp, Homo sapiens
agccagttctctagtgatattt

SEQ ID NO: 8201616 - DNA, 19 bp, Homo sapiens
agccagttggtaagaggct

SEQ ID NO: 8201617 - DNA, 23 bp, Homo sapiens
agccagttgtagccacagaactc

SEQ ID NO: 8201618 - DNA, 22 bp, Homo sapiens
agccagttggctatgaggagga

SEQ ID NO: 8201619 - DNA, 22 bp, Homo sapiens
agcccagggagttgattagcat

SEQ ID NO: 8201620 - DNA, 22 bp, Homo sapiens
agcccagggagttgattagcat

SEQ ID NO: 8201621 - DNA, 22 bp, Homo sapiens
agcccagggacagggcggatgt

SEQ ID NO: 8201622 - DNA, 22 bp, Homo sapiens
agcccaggttctaaagccaaac

SEQ ID NO: 8201623 - DNA, 22 bp, Homo sapiens
agcccaggttgaggctgcagtg

SEQ ID NO: 8201624 - DNA, 22 bp, Homo sapiens
agcccaggttgaggctgcagtg

SEQ ID NO: 8201625 - DNA, 22 bp, Homo sapiens
agccccaggatgggccgcagga

SEQ ID NO: 8201626 - DNA, 22 bp, Homo sapiens
agccccagcccctctctcacaa

SEQ ID NO: 8201627 - DNA, 20 bp, Homo sapiens
agccccacccttgtcctggc

SEQ ID NO: 8201628 - DNA, 22 bp, Homo sapiens
agccccacgttgtctagcacct

SEQ ID NO: 8201629 - DNA, 22 bp, Homo sapiens
agccccacgttgtctagcacct

SEQ ID NO: 8201630 - DNA, 22 bp, Homo sapiens
agccccagcccctctctcacaa

SEQ ID NO: 8201631 - DNA, 22 bp, Homo sapiens
agccccaggatgggccgcagga

SEQ ID NO: 8201632 - DNA, 22 bp, Homo sapiens
agccccaggcccggacgcctct

SEQ ID NO: 8201633 - DNA, 22 bp, Homo sapiens
agccccaggcccggacgcctct

SEQ ID NO: 8201634 - DNA, 22 bp, Homo sapiens
agccccagtaagggagggcctg

SEQ ID NO: 8201635 - DNA, 22 bp, Homo sapiens
agccccagtaagggagggcctg

SEQ ID NO: 8201636 - DNA, 22 bp, Homo sapiens
agccccagtccgctgcgggcgg

SEQ ID NO: 8201637 - DNA, 22 bp, Homo sapiens
agccccacactctctctgagaa

SEQ ID NO: 8201638 - DNA, 22 bp, Homo sapiens
agccccacactctctctgagaa

SEQ ID NO: 8201639 - DNA, 22 bp, Homo sapiens
agcccatgcaacaggcctagcg

SEQ ID NO: 8201640 - DNA, 22 bp, Homo sapiens
agcccatgcaaatactcggtga

SEQ ID NO: 8201641 - DNA, 22 bp, Homo sapiens
agcccatgcaaatactcggtga

SEQ ID NO: 8201642 - DNA, 22 bp, Homo sapiens
agcccatggtgtactctgtggc

SEQ ID NO: 8201643 - DNA, 22 bp, Homo sapiens
agcccatggtgtactctgtggc

SEQ ID NO: 8201644 - DNA, 22 bp, Homo sapiens
agcccaggttgaggctgcagtg

SEQ ID NO: 8201645 - DNA, 22 bp, Homo sapiens
agcccaggttgaggctgcagtg

SEQ ID NO: 8201646 - DNA, 22 bp, Homo sapiens
agcccaggttgaggctgcagtg

SEQ ID NO: 8201647 - DNA, 22 bp, Homo sapiens
agcccagttgctccacgctgca

SEQ ID NO: 8201648 - DNA, 22 bp, Homo sapiens
agcccaggttgaggctgcagtg

SEQ ID NO: 8201649 - DNA, 22 bp, Homo sapiens
agccctgggcacctgtgagggg

SEQ ID NO: 8201650 - DNA, 22 bp, Homo sapiens
agccctgggaggccagcttgta

SEQ ID NO: 8201651 - DNA, 22 bp, Homo sapiens
agccctgggaggccagcttgta

SEQ ID NO: 8201652 - DNA, 22 bp, Homo sapiens
agccctggcccggctgtgcttt

SEQ ID NO: 8201653 - DNA, 22 bp, Homo sapiens
agccctggcccggctgtgcttt

SEQ ID NO: 8201654 - DNA, 22 bp, Homo sapiens
agccctggcccggctgtgcttt

SEQ ID NO: 8201655 - DNA, 22 bp, Homo sapiens
agccctggcccggctgtgcttt

SEQ ID NO: 8201656 - DNA, 22 bp, Homo sapiens
agccctggctcccagcagcgct

SEQ ID NO: 8201657 - DNA, 22 bp, Homo sapiens
agccctggctcccagcagcgct

SEQ ID NO: 8201658 - DNA, 22 bp, Homo sapiens
agccctggcccggctgtgcttt

SEQ ID NO: 8201659 - DNA, 22 bp, Homo sapiens
cagatgaagatcatagaatagt

SEQ ID NO: 8201660 - DNA, 22 bp, Homo sapiens
cagatgaaggcctgaatgtcta

SEQ ID NO: 8201661 - DNA, 22 bp, Homo sapiens
cagatgaagtaggtgacgagca

SEQ ID NO: 8201662 - DNA, 22 bp, Homo sapiens
cagatgaaggcctgaatgtcta

SEQ ID NO: 8201663 - DNA, 22 bp, Homo sapiens
agccctgggcgttactgggatg

SEQ ID NO: 8201664 - DNA, 22 bp, Homo sapiens
agccctgggcgttactgggatg

SEQ ID NO: 8201665 - DNA, 22 bp, Homo sapiens
agccctgggcagccaaggaagc

SEQ ID NO: 8201666 - DNA, 22 bp, Homo sapiens
agccctgggcagccaaggaagc

SEQ ID NO: 8201667 - DNA, 22 bp, Homo sapiens
agccctgggcagccaaggaagc

SEQ ID NO: 8201668 - DNA, 22 bp, Homo sapiens
cagatggccagaggcagctgca

SEQ ID NO: 8201669 - DNA, 22 bp, Homo sapiens
cagatggcagggcagctctgca

SEQ ID NO: 8201670 - DNA, 22 bp, Homo sapiens
cagatggcagggcagctctgca

SEQ ID NO: 8201671 - DNA, 22 bp, Homo sapiens
cagatggctgccttcttgctgt

SEQ ID NO: 8201672 - DNA, 22 bp, Homo sapiens
cagatggctgccttcttgctgt

SEQ ID NO: 8201673 - DNA, 22 bp, Homo sapiens
cagatggccagaggcagctgca

SEQ ID NO: 8201674 - DNA, 22 bp, Homo sapiens
agccctggattctgaggtccaa

SEQ ID NO: 8201675 - DNA, 22 bp, Homo sapiens
agccctggattctgaggtccaa

SEQ ID NO: 8201676 - DNA, 22 bp, Homo sapiens
agccctggcagagccaggtagt

SEQ ID NO: 8201677 - DNA, 22 bp, Homo sapiens
agccctggcagagccaggtagt

SEQ ID NO: 8201678 - DNA, 22 bp, Homo sapiens
agccctgcttcaccatttactt

SEQ ID NO: 8201679 - DNA, 22 bp, Homo sapiens
agccctgcttcaccatttactt

SEQ ID NO: 8201680 - DNA, 22 bp, Homo sapiens
agccctgctgcttcttgtattt

SEQ ID NO: 8201681 - DNA, 22 bp, Homo sapiens
agccctgctgcttcttgtattt

SEQ ID NO: 8201682 - DNA, 22 bp, Homo sapiens
agccctggaagccacagtccta

SEQ ID NO: 8201683 - DNA, 22 bp, Homo sapiens
agccctggagcaaaggtgtctt

SEQ ID NO: 8201684 - DNA, 22 bp, Homo sapiens
agccctggagcaaaggtgtctt

SEQ ID NO: 8201685 - DNA, 22 bp, Homo sapiens
agccctgagctggcctgggctt

SEQ ID NO: 8201686 - DNA, 17 bp, Homo sapiens
agcccccactcccaagt

SEQ ID NO: 8201687 - DNA, 22 bp, Homo sapiens
agccccagttccctggaagtct

SEQ ID NO: 8201688 - DNA, 22 bp, Homo sapiens
agcccccaaaagtgcttatgat

SEQ ID NO: 8201689 - DNA, 23 bp, Homo sapiens
agccctgctgagacccagctccc

SEQ ID NO: 8201690 - DNA, 23 bp, Homo sapiens
agccctgctgagacccagctccc

SEQ ID NO: 8201691 - DNA, 23 bp, Homo sapiens
agccctgctgagacccagctccc

SEQ ID NO: 8201692 - DNA, 23 bp, Homo sapiens
agccctgctgagacccagctccc

SEQ ID NO: 8201693 - DNA, 22 bp, Homo sapiens
agccctgctgcctgaattagct

SEQ ID NO: 8201694 - DNA, 22 bp, Homo sapiens
agccctgctgcctgaattagct

SEQ ID NO: 8201695 - DNA, 22 bp, Homo sapiens
agccctgctcatctggatcccg

SEQ ID NO: 8201696 - DNA, 22 bp, Homo sapiens
agccctgctcatctggatcccg

SEQ ID NO: 8201697 - DNA, 22 bp, Homo sapiens
agccctgctcatctggatcccg

SEQ ID NO: 8201698 - DNA, 23 bp, Homo sapiens
agccctgctgagacccagctccc

SEQ ID NO: 8201699 - DNA, 22 bp, Homo sapiens
agccctgcgtgccaggggactg

SEQ ID NO: 8201700 - DNA, 22 bp, Homo sapiens
agccctgattaaccttggcttt

SEQ ID NO: 8201701 - DNA, 22 bp, Homo sapiens
agctccagcctcttctggaggt

SEQ ID NO: 8201702 - DNA, 23 bp, Homo sapiens
agctccagctgacgtgggcagcc

SEQ ID NO: 8201703 - DNA, 22 bp, Homo sapiens
agctccagcggatggtcttata

SEQ ID NO: 8201704 - DNA, 23 bp, Homo sapiens
agctccagctgacgtgggcagcc

SEQ ID NO: 8201705 - DNA, 23 bp, Homo sapiens
agctccagctgacgtgggcagcc

SEQ ID NO: 8201706 - DNA, 22 bp, Homo sapiens
agctccaggcagcattaataaa

SEQ ID NO: 8201707 - DNA, 22 bp, Homo sapiens
agctccaggatctgaaagttcg

SEQ ID NO: 8201708 - DNA, 22 bp, Homo sapiens
agctccaggataagacaggtgc

SEQ ID NO: 8201709 - DNA, 22 bp, Homo sapiens
agctccaggataagacaggtgc

SEQ ID NO: 8201710 - DNA, 22 bp, Homo sapiens
agctccaggataagacaggtgc

SEQ ID NO: 8201711 - DNA, 22 bp, Homo sapiens
agctccaggataagacaggtgc

SEQ ID NO: 8201712 - DNA, 22 bp, Homo sapiens
agctccaggataagacaggtgc

SEQ ID NO: 8201713 - DNA, 21 bp, Homo sapiens
agctccaggctcctggggttc

SEQ ID NO: 8201714 - DNA, 21 bp, Homo sapiens
agctccaggctcctggggttc

SEQ ID NO: 8201715 - DNA, 21 bp, Homo sapiens
agctccaggctcctggggttc

SEQ ID NO: 8201716 - DNA, 22 bp, Homo sapiens
agctccagggaaagagtggatc

SEQ ID NO: 8201717 - DNA, 22 bp, Homo sapiens
agctccagggaaagagtggatc

SEQ ID NO: 8201718 - DNA, 19 bp, Homo sapiens
agctcctgattgtgcctcg

SEQ ID NO: 8201719 - DNA, 19 bp, Homo sapiens
agctcctgattgtgcctcg

SEQ ID NO: 8201720 - DNA, 19 bp, Homo sapiens
agctcctgattgtgcctcg

SEQ ID NO: 8201721 - DNA, 22 bp, Homo sapiens
agctcctggaggtgcgcactcg

SEQ ID NO: 8201722 - DNA, 22 bp, Homo sapiens
agctcctggacgaacagggagt

SEQ ID NO: 8201723 - DNA, 19 bp, Homo sapiens
agctcaggcccatcgtccc

SEQ ID NO: 8201724 - DNA, 19 bp, Homo sapiens
agctcaggcccatcgtccc

SEQ ID NO: 8201725 - DNA, 19 bp, Homo sapiens
agctcaggcccatcgtccc

SEQ ID NO: 8201726 - DNA, 22 bp, Homo sapiens
agctcaggccggagctacaggc

SEQ ID NO: 8201727 - DNA, 23 bp, Homo sapiens
agctccagaacatagcacaggaa

SEQ ID NO: 8201728 - DNA, 23 bp, Homo sapiens
agctccagaacatagcacaggaa

SEQ ID NO: 8201729 - DNA, 23 bp, Homo sapiens
agctccagaacatagcacaggaa

SEQ ID NO: 8201730 - DNA, 23 bp, Homo sapiens
agctccagaacatagcacaggaa

SEQ ID NO: 8201731 - DNA, 23 bp, Homo sapiens
agctccagaacatagcacaggaa

SEQ ID NO: 8201732 - DNA, 22 bp, Homo sapiens
agctagccatgtggctcctgtg

SEQ ID NO: 8201733 - DNA, 22 bp, Homo sapiens
agctagccatgtggctcctgtg

SEQ ID NO: 8201734 - DNA, 22 bp, Homo sapiens
agctaggacaggtagagatggg

SEQ ID NO: 8201735 - DNA, 20 bp, Homo sapiens
agctaggagaaagcatggag

SEQ ID NO: 8201736 - DNA, 22 bp, Homo sapiens
agctccagattaattgtaggag

SEQ ID NO: 8201737 - DNA, 22 bp, Homo sapiens
agctccagcccatctgctcgtg

SEQ ID NO: 8201738 - DNA, 22 bp, Homo sapiens
agctccagcccatctgctcgtg

SEQ ID NO: 8201739 - DNA, 22 bp, Homo sapiens
agctccagccctagtacagctg

SEQ ID NO: 8201740 - DNA, 22 bp, Homo sapiens
agctccagccgctgatgggttt

SEQ ID NO: 8201741 - DNA, 22 bp, Homo sapiens
agctccagccctagtacagctg

SEQ ID NO: 8201742 - DNA, 22 bp, Homo sapiens
agctccagccctagtacagctg

SEQ ID NO: 8201743 - DNA, 22 bp, Homo sapiens
agctccagccgctgatgggttt

SEQ ID NO: 8201744 - DNA, 22 bp, Homo sapiens
agctccagcctcttctggaggt

SEQ ID NO: 8201745 - DNA, 22 bp, Homo sapiens
agctccagagtctgaactattc

SEQ ID NO: 8201746 - DNA, 22 bp, Homo sapiens
agctccagaggcagtgatgaag

SEQ ID NO: 8201747 - DNA, 22 bp, Homo sapiens
agctccagagccacatccatca

SEQ ID NO: 8201748 - DNA, 22 bp, Homo sapiens
agctccagaagcctgcaaggta

SEQ ID NO: 8201749 - DNA, 22 bp, Homo sapiens
agctccagaagcctgcaaggta

SEQ ID NO: 8201750 - DNA, 22 bp, Homo sapiens
agctcctggtgcctcagccgaa

SEQ ID NO: 8201751 - DNA, 22 bp, Homo sapiens
agctcctggtctttgtccagag

SEQ ID NO: 8201752 - DNA, 22 bp, Homo sapiens
agctcctgtctcaagggagcct

SEQ ID NO: 8201753 - DNA, 22 bp, Homo sapiens
agctcctgtctcaagggagcct

SEQ ID NO: 8201754 - DNA, 18 bp, Homo sapiens
agctcctggtctcaggga

SEQ ID NO: 8201755 - DNA, 22 bp, Homo sapiens
agctcctgggggttccaagcag

SEQ ID NO: 8201756 - DNA, 22 bp, Homo sapiens
agctcctgggagcaggtggtac

SEQ ID NO: 8201757 - DNA, 22 bp, Homo sapiens
agctcctggctttcctctcacc

SEQ ID NO: 8201758 - DNA, 22 bp, Homo sapiens
agctcctggcaaggtcatggtg

SEQ ID NO: 8201759 - DNA, 22 bp, Homo sapiens
agctcctgggccaagcccatgc

SEQ ID NO: 8201760 - DNA, 22 bp, Homo sapiens
agctcctgggccatcacaacca

SEQ ID NO: 8201761 - DNA, 19 bp, Homo sapiens
agctcctgggctctgggcc

SEQ ID NO: 8201762 - DNA, 19 bp, Homo sapiens
agctcctgggctctgggcc

SEQ ID NO: 8201763 - DNA, 22 bp, Homo sapiens
agctctttctacaagcaggcag

SEQ ID NO: 8201764 - DNA, 22 bp, Homo sapiens
agctctttctacaagcaggcag

SEQ ID NO: 8201765 - DNA, 22 bp, Homo sapiens
agctctttcccctccctatggc

SEQ ID NO: 8201766 - DNA, 15 bp, Homo sapiens
agctctttcagctac

SEQ ID NO: 8201767 - DNA, 22 bp, Homo sapiens
agctctttgagaaggcagtgtg

SEQ ID NO: 8201768 - DNA, 22 bp, Homo sapiens
agctctttgagaaggcagtgtg

SEQ ID NO: 8201769 - DNA, 22 bp, Homo sapiens
agctctttgactaatcttgctt

SEQ ID NO: 8201770 - DNA, 19 bp, Homo sapiens
agctctttgctgcattcca

SEQ ID NO: 8201771 - DNA, 22 bp, Homo sapiens
agctctttgagcaaggcagctc

SEQ ID NO: 8201772 - DNA, 22 bp, Homo sapiens
agctctttgagcaaggcagctc

SEQ ID NO: 8201773 - DNA, 19 bp, Homo sapiens
agctctttgctgcattcca

SEQ ID NO: 8201774 - DNA, 22 bp, Homo sapiens
agctctttgctggcagtaggct

SEQ ID NO: 8201775 - DNA, 22 bp, Homo sapiens
agctctttgctggcagtaggct

SEQ ID NO: 8201776 - DNA, 22 bp, Homo sapiens
agctctttggaaggtgtgcact

SEQ ID NO: 8201777 - DNA, 22 bp, Homo sapiens
agctcttcctgcacctgtggct

SEQ ID NO: 8201778 - DNA, 22 bp, Homo sapiens
agctcttacatttaggtctatg

SEQ ID NO: 8201779 - DNA, 22 bp, Homo sapiens
agctcttacatttaggtctatg

SEQ ID NO: 8201780 - DNA, 22 bp, Homo sapiens
agctcttacatttaggtctatg

SEQ ID NO: 8201781 - DNA, 22 bp, Homo sapiens
agctctttatgtggaagaggca

SEQ ID NO: 8201782 - DNA, 22 bp, Homo sapiens
agctctttatgtggaagaggca

SEQ ID NO: 8201783 - DNA, 22 bp, Homo sapiens
agctctttagagtctcccttct

SEQ ID NO: 8201784 - DNA, 22 bp, Homo sapiens
agctctttatgggtaaatgcca

SEQ ID NO: 8201785 - DNA, 22 bp, Homo sapiens
agctctttaatcttagccccag

SEQ ID NO: 8201786 - DNA, 22 bp, Homo sapiens
agctctttacacagagtccctc

SEQ ID NO: 8201787 - DNA, 22 bp, Homo sapiens
agctctggtttagaaggggaaa

SEQ ID NO: 8201788 - DNA, 22 bp, Homo sapiens
agctctggtttagaaggggaaa

SEQ ID NO: 8201789 - DNA, 22 bp, Homo sapiens
agctctgggccaggaaccctaa

SEQ ID NO: 8201790 - DNA, 22 bp, Homo sapiens
agctctggtttagaaggggaaa

SEQ ID NO: 8201791 - DNA, 22 bp, Homo sapiens
agctctgtggccttgggtgaat

SEQ ID NO: 8201792 - DNA, 20 bp, Homo sapiens
agctcttaagaagaagatga

SEQ ID NO: 8201793 - DNA, 22 bp, Homo sapiens
agctctgtctttctcttagtaa

SEQ ID NO: 8201794 - DNA, 22 bp, Homo sapiens
agctctgtggccttgggtgaat

SEQ ID NO: 8201795 - DNA, 22 bp, Homo sapiens
agctctgggccaggaaccctaa

SEQ ID NO: 8201796 - DNA, 22 bp, Homo sapiens
agctctgggattctcaggccac

SEQ ID NO: 8201797 - DNA, 22 bp, Homo sapiens
agctcctgtggcagctcttctg

SEQ ID NO: 8201798 - DNA, 22 bp, Homo sapiens
agctcctgtggcagctcttctg

SEQ ID NO: 8201799 - DNA, 22 bp, Homo sapiens
cagcaacttggacagcagtctt

SEQ ID NO: 8201800 - DNA, 22 bp, Homo sapiens
cagcaacatatatgaaactgtg

SEQ ID NO: 8201801 - DNA, 22 bp, Homo sapiens
cagatgtggaatgcagcaggct

SEQ ID NO: 8201802 - DNA, 22 bp, Homo sapiens
cagcaacatgtggtagtgtagg

SEQ ID NO: 8201803 - DNA, 22 bp, Homo sapiens
cagatgtacatgaagggcaatg

SEQ ID NO: 8201804 - DNA, 22 bp, Homo sapiens
cagatgtgcctccagggctttg

SEQ ID NO: 8201805 - DNA, 23 bp, Homo sapiens
cagatgtgcaactctaggcaatg

SEQ ID NO: 8201806 - DNA, 22 bp, Homo sapiens
cagatgtgcatgatgggaaggg

SEQ ID NO: 8201807 - DNA, 20 bp, Homo sapiens
cagatgggacgtggaggagt

SEQ ID NO: 8201808 - DNA, 18 bp, Homo sapiens
cagatggtggagttttta

SEQ ID NO: 8201809 - DNA, 22 bp, Homo sapiens
cagatggggcaaggccatctgt

SEQ ID NO: 8201810 - DNA, 22 bp, Homo sapiens
cagatgtacatgaagggcaatg

SEQ ID NO: 8201811 - DNA, 22 bp, Homo sapiens
cagatgtaatctgacagctgga

SEQ ID NO: 8201812 - DNA, 19 bp, Homo sapiens
agcctggctttgctctgct

SEQ ID NO: 8201813 - DNA, 17 bp, Homo sapiens
agcctgggaaggagtga

SEQ ID NO: 8201814 - DNA, 17 bp, Homo sapiens
agcctgggaaggagtga

SEQ ID NO: 8201815 - DNA, 22 bp, Homo sapiens
agcctggcttagctctctcact

SEQ ID NO: 8201816 - DNA, 19 bp, Homo sapiens
agcctggctttgctctgct

SEQ ID NO: 8201817 - DNA, 19 bp, Homo sapiens
agcctggctttgctctgct

SEQ ID NO: 8201818 - DNA, 22 bp, Homo sapiens
cagcaagaaaattcacatgctc

SEQ ID NO: 8201819 - DNA, 22 bp, Homo sapiens
agcctggccactcagggcctga

SEQ ID NO: 8201820 - DNA, 22 bp, Homo sapiens
agcctggccactcagggcctga

SEQ ID NO: 8201821 - DNA, 22 bp, Homo sapiens
agcctggccactcagggcctga

SEQ ID NO: 8201822 - DNA, 22 bp, Homo sapiens
agcctgggcaacaacacagcga

SEQ ID NO: 8201823 - DNA, 22 bp, Homo sapiens
agcctgggcaacagagcaaaac

SEQ ID NO: 8201824 - DNA, 22 bp, Homo sapiens
agcctgggcatgggacgggagg

SEQ ID NO: 8201825 - DNA, 22 bp, Homo sapiens
agcctgggcaactccattcact

SEQ ID NO: 8201826 - DNA, 21 bp, Homo sapiens
agcctgggaggcggaggttgc

SEQ ID NO: 8201827 - DNA, 22 bp, Homo sapiens
agcctgggagacactaagttgt

SEQ ID NO: 8201828 - DNA, 22 bp, Homo sapiens
agcctgggaatttagagttcgg

SEQ ID NO: 8201829 - DNA, 22 bp, Homo sapiens
agctacctggcttatcactgtc

SEQ ID NO: 8201830 - DNA, 22 bp, Homo sapiens
agctacctgatccttcttctga

SEQ ID NO: 8201831 - DNA, 22 bp, Homo sapiens
agctacagggaactaaaagcta

SEQ ID NO: 8201832 - DNA, 22 bp, Homo sapiens
agctacagctgtactctgcagg

SEQ ID NO: 8201833 - DNA, 22 bp, Homo sapiens
agctacagttgccctcagcagg

SEQ ID NO: 8201834 - DNA, 22 bp, Homo sapiens
agctacagtggacaagtgaact

SEQ ID NO: 8201835 - DNA, 22 bp, Homo sapiens
agctactagggtgccagacatg

SEQ ID NO: 8201836 - DNA, 22 bp, Homo sapiens
agctacaaatgtatgtgctgat

SEQ ID NO: 8201837 - DNA, 22 bp, Homo sapiens
agctacagatgagcccagtatc

SEQ ID NO: 8201838 - DNA, 22 bp, Homo sapiens
agctaaggaactctgtaacacc

SEQ ID NO: 8201839 - DNA, 22 bp, Homo sapiens
agcctgggttagggttcttccc

SEQ ID NO: 8201840 - DNA, 22 bp, Homo sapiens
agcctgggttagggttcttccc

SEQ ID NO: 8201841 - DNA, 22 bp, Homo sapiens
agcctgggtgggggttcggaga

SEQ ID NO: 8201842 - DNA, 22 bp, Homo sapiens
agcctgggtttttattaaggag

SEQ ID NO: 8201843 - DNA, 22 bp, Homo sapiens
agcctggtgtggggctgcagag

SEQ ID NO: 8201844 - DNA, 22 bp, Homo sapiens
agcctggtttaagcattttata

SEQ ID NO: 8201845 - DNA, 22 bp, Homo sapiens
agcctggtgtggggctgcagag

SEQ ID NO: 8201846 - DNA, 22 bp, Homo sapiens
agctaagacttagtgacttagt

SEQ ID NO: 8201847 - DNA, 22 bp, Homo sapiens
agctaagaacttgagctctgga

SEQ ID NO: 8201848 - DNA, 22 bp, Homo sapiens
agctaacatgactagaagcttc

SEQ ID NO: 8201849 - DNA, 20 bp, Homo sapiens
agcggcagcttcctgcttcg

SEQ ID NO: 8201850 - DNA, 23 bp, Homo sapiens
agctaacagatcgacaaagtata

SEQ ID NO: 8201851 - DNA, 22 bp, Homo sapiens
agcggagctagtttttgtcctc

SEQ ID NO: 8201852 - DNA, 22 bp, Homo sapiens
agcctggtttaagcattttata

SEQ ID NO: 8201853 - DNA, 18 bp, Homo sapiens
agcctgggctctgcctgg

SEQ ID NO: 8201854 - DNA, 22 bp, Homo sapiens
agcctgggcctggcttcccgcc

SEQ ID NO: 8201855 - DNA, 22 bp, Homo sapiens
agcctgggccctgcctcttctc

SEQ ID NO: 8201856 - DNA, 22 bp, Homo sapiens
agcctgggccctgcctcttctc

SEQ ID NO: 8201857 - DNA, 21 bp, Homo sapiens
agcctgggtatcctttgagga

SEQ ID NO: 8201858 - DNA, 22 bp, Homo sapiens
agcctgggggcgcagaaaccgg

SEQ ID NO: 8201859 - DNA, 20 bp, Homo sapiens
agcctggggaattccacccc

SEQ ID NO: 8201860 - DNA, 18 bp, Homo sapiens
agcctgggctctgcctgg

SEQ ID NO: 8201861 - DNA, 22 bp, Homo sapiens
agcctggggcacttctccaaac

SEQ ID NO: 8201862 - DNA, 18 bp, Homo sapiens
aagtgactggcaggccaa

SEQ ID NO: 8201863 - DNA, 22 bp, Homo sapiens
aagtgagtgaaaatgcagaata

SEQ ID NO: 8201864 - DNA, 22 bp, Homo sapiens
aagtgagtcacaagtttgcttt

SEQ ID NO: 8201865 - DNA, 22 bp, Homo sapiens
aagtgatacatctagtctataa

SEQ ID NO: 8201866 - DNA, 18 bp, Homo sapiens
aagtgattcctttccctt

SEQ ID NO: 8201867 - DNA, 22 bp, Homo sapiens
aagtgattcattgatgatgagg

SEQ ID NO: 8201868 - DNA, 22 bp, Homo sapiens
aagtgattccttgcagacacac

SEQ ID NO: 8201869 - DNA, 22 bp, Homo sapiens
aagtgattcattgatgatgagg

SEQ ID NO: 8201870 - DNA, 17 bp, Homo sapiens
aagtgattcagccctca

SEQ ID NO: 8201871 - DNA, 22 bp, Homo sapiens
aagtgattatgtccaggagaac

SEQ ID NO: 8201872 - DNA, 22 bp, Homo sapiens
aagtgattatttaatgcggttt

SEQ ID NO: 8201873 - DNA, 22 bp, Homo sapiens
aagtgattatgtccaggagaac

SEQ ID NO: 8201874 - DNA, 22 bp, Homo sapiens
aagtgattattgttttcaggtt

SEQ ID NO: 8201875 - DNA, 22 bp, Homo sapiens
aagtgattaacatggagctttt

SEQ ID NO: 8201876 - DNA, 22 bp, Homo sapiens
aagtgattaacatggagctttt

SEQ ID NO: 8201877 - DNA, 22 bp, Homo sapiens
aagtgattaagtaacctaatat

SEQ ID NO: 8201878 - DNA, 22 bp, Homo sapiens
aagtgattaaccatgctctgct

SEQ ID NO: 8201879 - DNA, 22 bp, Homo sapiens
aagtgatgctacgactttgaca

SEQ ID NO: 8201880 - DNA, 22 bp, Homo sapiens
aagtgatgctacgactttgaca

SEQ ID NO: 8201881 - DNA, 22 bp, Homo sapiens
aagtgatgctacgactttgaca

SEQ ID NO: 8201882 - DNA, 22 bp, Homo sapiens
aagtgatacctaggaaatcaag

SEQ ID NO: 8201883 - DNA, 22 bp, Homo sapiens
aagtgatacctaggaaatcaag

SEQ ID NO: 8201884 - DNA, 22 bp, Homo sapiens
aagtgattttcctacttgctaa

SEQ ID NO: 8201885 - DNA, 22 bp, Homo sapiens
aagtgattttcttcttagttat

SEQ ID NO: 8201886 - DNA, 22 bp, Homo sapiens
aagtgatttgtacaaaatgtcg

SEQ ID NO: 8201887 - DNA, 22 bp, Homo sapiens
aagtgattttcccaccatctac

SEQ ID NO: 8201888 - DNA, 22 bp, Homo sapiens
aagtgattttcctacttgctaa

SEQ ID NO: 8201889 - DNA, 22 bp, Homo sapiens
aagtgatttgtacaaaatgtcg

SEQ ID NO: 8201890 - DNA, 22 bp, Homo sapiens
aagtgattgttccgttgagtgt

SEQ ID NO: 8201891 - DNA, 22 bp, Homo sapiens
aagtgattgctggttttgccat

SEQ ID NO: 8201892 - DNA, 22 bp, Homo sapiens
aagtgattgttccgttgagtgt

SEQ ID NO: 8201893 - DNA, 22 bp, Homo sapiens
aagtgattctagtcatgattct

SEQ ID NO: 8201894 - DNA, 22 bp, Homo sapiens
aagtgattctgatgtgtttctt

SEQ ID NO: 8201895 - DNA, 22 bp, Homo sapiens
aagtgattctccctacgcggga

SEQ ID NO: 8201896 - DNA, 22 bp, Homo sapiens
aagtgatttgcatgcttaattc

SEQ ID NO: 8201897 - DNA, 22 bp, Homo sapiens
aagtgatttctgcctgcatgtt

SEQ ID NO: 8201898 - DNA, 22 bp, Homo sapiens
aagtgatttagtcttataaagg

SEQ ID NO: 8201899 - DNA, 22 bp, Homo sapiens
aagtgcacttatagtaatatgt

SEQ ID NO: 8201900 - DNA, 22 bp, Homo sapiens
aagtctctttgggtactttatt

SEQ ID NO: 8201901 - DNA, 22 bp, Homo sapiens
aagtctcttttcttcctgtatt

SEQ ID NO: 8201902 - DNA, 22 bp, Homo sapiens
accttgtctgtgcacctgggct

SEQ ID NO: 8201903 - DNA, 20 bp, Homo sapiens
accttgggtgagtgacggtc

SEQ ID NO: 8201904 - DNA, 22 bp, Homo sapiens
accttgtcttttatagaacaag

SEQ ID NO: 8201905 - DNA, 21 bp, Homo sapiens
acctttaattcaagcatcagg

SEQ ID NO: 8201906 - DNA, 22 bp, Homo sapiens
accttgttgtaggtacaaaaga

SEQ ID NO: 8201907 - DNA, 22 bp, Homo sapiens
acctttatagctgattatgaca

SEQ ID NO: 8201908 - DNA, 22 bp, Homo sapiens
aagtgaataccatcaagagctt

SEQ ID NO: 8201909 - DNA, 22 bp, Homo sapiens
aagtgaatttcattccaattct

SEQ ID NO: 8201910 - DNA, 22 bp, Homo sapiens
aagtgaatgtttggtagcagtg

SEQ ID NO: 8201911 - DNA, 22 bp, Homo sapiens
accttctgaccagttatcttga

SEQ ID NO: 8201912 - DNA, 22 bp, Homo sapiens
accttctgaccagttatcttga

SEQ ID NO: 8201913 - DNA, 22 bp, Homo sapiens
acctgggcattttggatgatta

SEQ ID NO: 8201914 - DNA, 22 bp, Homo sapiens
acctgggcattttggatgatta

SEQ ID NO: 8201915 - DNA, 22 bp, Homo sapiens
acctgggtctggtgttgggacg

SEQ ID NO: 8201916 - DNA, 22 bp, Homo sapiens
accttctgaccagttatcttga

SEQ ID NO: 8201917 - DNA, 22 bp, Homo sapiens
accttctggtctgcctgacagc

SEQ ID NO: 8201918 - DNA, 22 bp, Homo sapiens
accttggaaatgcccattgcct

SEQ ID NO: 8201919 - DNA, 22 bp, Homo sapiens
accttgatggggctgttggagt

SEQ ID NO: 8201920 - DNA, 22 bp, Homo sapiens
accttgggcaacctgctcctgc

SEQ ID NO: 8201921 - DNA, 22 bp, Homo sapiens
accttgggcaagttggaaactg

SEQ ID NO: 8201922 - DNA, 22 bp, Homo sapiens
accttgggcaacctgctcctgc

SEQ ID NO: 8201923 - DNA, 23 bp, Homo sapiens
accttggacttcccagcttccag

SEQ ID NO: 8201924 - DNA, 22 bp, Homo sapiens
accttggaactgaagtgttttt

SEQ ID NO: 8201925 - DNA, 22 bp, Homo sapiens
acctgggaggcggaggttgcag

SEQ ID NO: 8201926 - DNA, 22 bp, Homo sapiens
acctgggaggcggaggttgcag

SEQ ID NO: 8201927 - DNA, 22 bp, Homo sapiens
acctgggaggcagaggttgcag

SEQ ID NO: 8201928 - DNA, 22 bp, Homo sapiens
acctgggaggcagaggttgcag

SEQ ID NO: 8201929 - DNA, 22 bp, Homo sapiens
acctgggagtcacacctgagaa

SEQ ID NO: 8201930 - DNA, 22 bp, Homo sapiens
acctgggagtatgcagtggtga

SEQ ID NO: 8201931 - DNA, 22 bp, Homo sapiens
acctgggaaaaggagtggccat

SEQ ID NO: 8201932 - DNA, 22 bp, Homo sapiens
acctgggaacgctttgtggagg

SEQ ID NO: 8201933 - DNA, 22 bp, Homo sapiens
acctgggaaagccgtggaaagg

SEQ ID NO: 8201934 - DNA, 22 bp, Homo sapiens
acctgggaaagccgtggaaagg

SEQ ID NO: 8201935 - DNA, 18 bp, Homo sapiens
acctgcctgttcttctct

SEQ ID NO: 8201936 - DNA, 20 bp, Homo sapiens
acctggcttcctcttggcat

SEQ ID NO: 8201937 - DNA, 18 bp, Homo sapiens
aagtaacagaagagcaca

SEQ ID NO: 8201938 - DNA, 18 bp, Homo sapiens
aagtaacagaagagcaca

SEQ ID NO: 8201939 - DNA, 21 bp, Homo sapiens
aagtaacaccactcctggagt

SEQ ID NO: 8201940 - DNA, 22 bp, Homo sapiens
aagtaacacatgttacttctgc

SEQ ID NO: 8201941 - DNA, 21 bp, Homo sapiens
aagtaaatcagagaaataacc

SEQ ID NO: 8201942 - DNA, 21 bp, Homo sapiens
aagtaaatcagagaaataacc

SEQ ID NO: 8201943 - DNA, 22 bp, Homo sapiens
aagtaaatatctgtagtcttta

SEQ ID NO: 8201944 - DNA, 22 bp, Homo sapiens
aagtaaatatctgtttatagca

SEQ ID NO: 8201945 - DNA, 22 bp, Homo sapiens
aagtaaatatctgtttatagca

SEQ ID NO: 8201946 - DNA, 22 bp, Homo sapiens
aagtaaacattgagagacaaga

SEQ ID NO: 8201947 - DNA, 22 bp, Homo sapiens
aagtaaacagataagaaatctg

SEQ ID NO: 8201948 - DNA, 22 bp, Homo sapiens
aagtaaacttacacatagtaaa

SEQ ID NO: 8201949 - DNA, 22 bp, Homo sapiens
aagtaaactcagtggtcattca

SEQ ID NO: 8201950 - DNA, 22 bp, Homo sapiens
aagtaaaccacagagaagccac

SEQ ID NO: 8201951 - DNA, 22 bp, Homo sapiens
aagtaaaccacagagaagccac

SEQ ID NO: 8201952 - DNA, 23 bp, Homo sapiens
aagtaaacattagaagttgaggt

SEQ ID NO: 8201953 - DNA, 22 bp, Homo sapiens
actcatcaactgttacaaatgt

SEQ ID NO: 8201954 - DNA, 22 bp, Homo sapiens
actcagttatcatgtgtccaca

SEQ ID NO: 8201955 - DNA, 22 bp, Homo sapiens
actcagttatcatgtgtccaca

SEQ ID NO: 8201956 - DNA, 22 bp, Homo sapiens
actcagtggcactttggaattt

SEQ ID NO: 8201957 - DNA, 22 bp, Homo sapiens
actcatcagtggttttaatcaa

SEQ ID NO: 8201958 - DNA, 22 bp, Homo sapiens
actcagtacatctggagttggc

SEQ ID NO: 8201959 - DNA, 22 bp, Homo sapiens
actcagagcagagcagcctgag

SEQ ID NO: 8201960 - DNA, 22 bp, Homo sapiens
actcagagatatggtggttgat

SEQ ID NO: 8201961 - DNA, 23 bp, Homo sapiens
actcagtgagggccttgggctgc

SEQ ID NO: 8201962 - DNA, 22 bp, Homo sapiens
actcagtgaattttcatcaaat

SEQ ID NO: 8201963 - DNA, 22 bp, Homo sapiens
aagtggaggccgagttcacgca

SEQ ID NO: 8201964 - DNA, 22 bp, Homo sapiens
aagtggagtccctacaaccagc

SEQ ID NO: 8201965 - DNA, 22 bp, Homo sapiens
aagtggagctataggctcagat

SEQ ID NO: 8201966 - DNA, 22 bp, Homo sapiens
aagtggagctataggctcagat

SEQ ID NO: 8201967 - DNA, 18 bp, Homo sapiens
aagtggcacaggagtgca

SEQ ID NO: 8201968 - DNA, 20 bp, Homo sapiens
aagtggatccctaagaacag

SEQ ID NO: 8201969 - DNA, 22 bp, Homo sapiens
aagtggcagaatagtggcagga

SEQ ID NO: 8201970 - DNA, 22 bp, Homo sapiens
aagtggcacgctttttggagtt

SEQ ID NO: 8201971 - DNA, 22 bp, Homo sapiens
aagtggcacgctttttggagtt

SEQ ID NO: 8201972 - DNA, 22 bp, Homo sapiens
aagtggcacgctttttggagtt

SEQ ID NO: 8201973 - DNA, 18 bp, Homo sapiens
aagtggcacaggagtgca

SEQ ID NO: 8201974 - DNA, 22 bp, Homo sapiens
actcatctttgaattttcagta

SEQ ID NO: 8201975 - DNA, 19 bp, Homo sapiens
actcatctttccagaatat

SEQ ID NO: 8201976 - DNA, 22 bp, Homo sapiens
actcatgtaagcggaatgtagt

SEQ ID NO: 8201977 - DNA, 22 bp, Homo sapiens
actcatgtcctaggagtaaagc

SEQ ID NO: 8201978 - DNA, 22 bp, Homo sapiens
actcatggtagcacaggctgtg

SEQ ID NO: 8201979 - DNA, 22 bp, Homo sapiens
aagttttaacaagtacttacta

SEQ ID NO: 8201980 - DNA, 22 bp, Homo sapiens
aagtttgttgtacatgttagta

SEQ ID NO: 8201981 - DNA, 22 bp, Homo sapiens
aagttttactgaggacacatgt

SEQ ID NO: 8201982 - DNA, 22 bp, Homo sapiens
aagtttgtggtcatttattata

SEQ ID NO: 8201983 - DNA, 22 bp, Homo sapiens
aagtttgtggtcatttattata

SEQ ID NO: 8201984 - DNA, 22 bp, Homo sapiens
aagtttgtcgaaattatcagca

SEQ ID NO: 8201985 - DNA, 22 bp, Homo sapiens
aagtggcatgtataagaaagaa

SEQ ID NO: 8201986 - DNA, 22 bp, Homo sapiens
aagtggcatgtataagaaagaa

SEQ ID NO: 8201987 - DNA, 22 bp, Homo sapiens
aagtggcagttcaggaagcaga

SEQ ID NO: 8201988 - DNA, 22 bp, Homo sapiens
aagtggcagttcaggaagcaga

SEQ ID NO: 8201989 - DNA, 22 bp, Homo sapiens
aagtggcagttcaggaagcaga

SEQ ID NO: 8201990 - DNA, 22 bp, Homo sapiens
aagtggcagttcaggaagcaga

SEQ ID NO: 8201991 - DNA, 22 bp, Homo sapiens
aagtggcagccttagaaggaga

SEQ ID NO: 8201992 - DNA, 22 bp, Homo sapiens
aagtggcagccttagaaggaga

SEQ ID NO: 8201993 - DNA, 22 bp, Homo sapiens
aagtggcagaatagtggcagga

SEQ ID NO: 8201994 - DNA, 22 bp, Homo sapiens
aagtgggtacatgatgcacttt

SEQ ID NO: 8201995 - DNA, 22 bp, Homo sapiens
aagtgggtacatgatgcacttt

SEQ ID NO: 8201996 - DNA, 22 bp, Homo sapiens
aagtgggtaactggcctttgtt

SEQ ID NO: 8201997 - DNA, 22 bp, Homo sapiens
aagtttggtccttctaagaaga

SEQ ID NO: 8201998 - DNA, 22 bp, Homo sapiens
aataaagacaaacaggggagcc

SEQ ID NO: 8201999 - DNA, 22 bp, Homo sapiens
aataaagacaaacaggggagcc

SEQ ID NO: 8202000 - DNA, 22 bp, Homo sapiens
aataaagcatgaggcatttatc

SEQ ID NO: 8202001 - DNA, 22 bp, Homo sapiens
aataaagtagcgtttaaggtgc

SEQ ID NO: 8202002 - DNA, 22 bp, Homo sapiens
aataaaggcaccataaggcaaa

SEQ ID NO: 8202003 - DNA, 22 bp, Homo sapiens
aataaaggcaccataaggcaaa

SEQ ID NO: 8202004 - DNA, 22 bp, Homo sapiens
aataaagccttattgattttac

SEQ ID NO: 8202005 - DNA, 22 bp, Homo sapiens
aataaagcctgtctctttagag

SEQ ID NO: 8202006 - DNA, 22 bp, Homo sapiens
aataacagaaacttgagcatca

SEQ ID NO: 8202007 - DNA, 22 bp, Homo sapiens
aataaatgtttgttggatgttt

SEQ ID NO: 8202008 - DNA, 22 bp, Homo sapiens
aataacagattttcaagctgtg

SEQ ID NO: 8202009 - DNA, 22 bp, Homo sapiens
aataacagagtcttcaagatag

SEQ ID NO: 8202010 - DNA, 22 bp, Homo sapiens
aataacagagtcttcaagatag

SEQ ID NO: 8202011 - DNA, 22 bp, Homo sapiens
aataaatgaacaaagcaggttg

SEQ ID NO: 8202012 - DNA, 22 bp, Homo sapiens
aataaatgttaagattgtctca

SEQ ID NO: 8202013 - DNA, 22 bp, Homo sapiens
aataaatgttaagattgtctca

SEQ ID NO: 8202014 - DNA, 22 bp, Homo sapiens
aataaatgtttgttggatgttt

SEQ ID NO: 8202015 - DNA, 20 bp, Homo sapiens
actgagaccaataagtagaa

SEQ ID NO: 8202016 - DNA, 22 bp, Homo sapiens
actgagacaactgtgtttctaa

SEQ ID NO: 8202017 - DNA, 22 bp, Homo sapiens
actgagactgagaatgtttctt

SEQ ID NO: 8202018 - DNA, 22 bp, Homo sapiens
aataaaatggtcagttttctca

SEQ ID NO: 8202019 - DNA, 22 bp, Homo sapiens
aataaacttccactgtgttttt

SEQ ID NO: 8202020 - DNA, 22 bp, Homo sapiens
aataaacttccactgtgttttt

SEQ ID NO: 8202021 - DNA, 22 bp, Homo sapiens
actgagaagtcaggttctcttc

SEQ ID NO: 8202022 - DNA, 22 bp, Homo sapiens
actgagaatacaatgttgcagg

SEQ ID NO: 8202023 - DNA, 22 bp, Homo sapiens
actgagaagtcaggttctcttc

SEQ ID NO: 8202024 - DNA, 22 bp, Homo sapiens
actgagaagattctcactctta

SEQ ID NO: 8202025 - DNA, 22 bp, Homo sapiens
actgagaagattctcactctta

SEQ ID NO: 8202026 - DNA, 22 bp, Homo sapiens
actgagaagctcgcagtgatgc

SEQ ID NO: 8202027 - DNA, 22 bp, Homo sapiens
actgagaagctcgcagtgatgc

SEQ ID NO: 8202028 - DNA, 22 bp, Homo sapiens
actgagaactcaagagaaaagg

SEQ ID NO: 8202029 - DNA, 22 bp, Homo sapiens
actgagaacttggggacagagg

SEQ ID NO: 8202030 - DNA, 22 bp, Homo sapiens
actgagaagattctcactctta

SEQ ID NO: 8202031 - DNA, 22 bp, Homo sapiens
aagttttattggaacatagcca

SEQ ID NO: 8202032 - DNA, 22 bp, Homo sapiens
aagttttattggctatagcact

SEQ ID NO: 8202033 - DNA, 22 bp, Homo sapiens
actgactcttgttaacttcagc

SEQ ID NO: 8202034 - DNA, 22 bp, Homo sapiens
actgagaaatagcaagtgtctc

SEQ ID NO: 8202035 - DNA, 22 bp, Homo sapiens
actgagaaatttccagacttgc

SEQ ID NO: 8202036 - DNA, 22 bp, Homo sapiens
actgagaaatttccagacttgc

SEQ ID NO: 8202037 - DNA, 22 bp, Homo sapiens
agaaaccatctttatatatctg

SEQ ID NO: 8202038 - DNA, 22 bp, Homo sapiens
agaaaccagggcttaccagtgc

SEQ ID NO: 8202039 - DNA, 22 bp, Homo sapiens
agaaaccagggcttaccagtgc

SEQ ID NO: 8202040 - DNA, 22 bp, Homo sapiens
agaaacctccatttattcactc

SEQ ID NO: 8202041 - DNA, 22 bp, Homo sapiens
agaaaattactccagagacaag

SEQ ID NO: 8202042 - DNA, 23 bp, Homo sapiens
agaaaccactgaagagatccagt

SEQ ID NO: 8202043 - DNA, 22 bp, Homo sapiens
agaaaattactccagagacaag

SEQ ID NO: 8202044 - DNA, 21 bp, Homo sapiens
agaaaatggcgttttagattt

SEQ ID NO: 8202045 - DNA, 22 bp, Homo sapiens
agaaaatgtgaacttgtgaatt

SEQ ID NO: 8202046 - DNA, 22 bp, Homo sapiens
aatattcatttgcagaagaagt

SEQ ID NO: 8202047 - DNA, 22 bp, Homo sapiens
agaaaataatttcttggctggt

SEQ ID NO: 8202048 - DNA, 22 bp, Homo sapiens
agaaaataatttcttggctggt

SEQ ID NO: 8202049 - DNA, 22 bp, Homo sapiens
agaaaatattcattgagaggct

SEQ ID NO: 8202050 - DNA, 22 bp, Homo sapiens
agaaaatattcattgagaggct

SEQ ID NO: 8202051 - DNA, 22 bp, Homo sapiens
agaaaatattcattgagaggct

SEQ ID NO: 8202052 - DNA, 22 bp, Homo sapiens
agaaaatattcattgagaggct

SEQ ID NO: 8202053 - DNA, 22 bp, Homo sapiens
agaaaatattcattgagaggct

SEQ ID NO: 8202054 - DNA, 22 bp, Homo sapiens
aatatggcttgttactatgttt

SEQ ID NO: 8202055 - DNA, 22 bp, Homo sapiens
aatatgcatgtatacatgtgta

SEQ ID NO: 8202056 - DNA, 22 bp, Homo sapiens
aatatgatccttaaccttcatg

SEQ ID NO: 8202057 - DNA, 22 bp, Homo sapiens
aatatgcactctgatttagcag

SEQ ID NO: 8202058 - DNA, 22 bp, Homo sapiens
aatatgcagcatgatgaagtaa

SEQ ID NO: 8202059 - DNA, 22 bp, Homo sapiens
aatatgcagcatgatgaagtaa

SEQ ID NO: 8202060 - DNA, 22 bp, Homo sapiens
aatatgttccacttaaagctgg

SEQ ID NO: 8202061 - DNA, 22 bp, Homo sapiens
aatatgttgagtctatctttat

SEQ ID NO: 8202062 - DNA, 22 bp, Homo sapiens
aatatgttcaaaatagatcact

SEQ ID NO: 8202063 - DNA, 22 bp, Homo sapiens
aatatgtgggtgctaatcaaaa

SEQ ID NO: 8202064 - DNA, 22 bp, Homo sapiens
aatatgttcaaaatagatcact

SEQ ID NO: 8202065 - DNA, 22 bp, Homo sapiens
aatatgttcaaaatagatcact

SEQ ID NO: 8202066 - DNA, 22 bp, Homo sapiens
aatatgttcaaaatagatcact

SEQ ID NO: 8202067 - DNA, 22 bp, Homo sapiens
aatattagtttctcaagagaga

SEQ ID NO: 8202068 - DNA, 22 bp, Homo sapiens
aatattaatagaaggggttcta

SEQ ID NO: 8202069 - DNA, 22 bp, Homo sapiens
aatatgtttataagatatcttc

SEQ ID NO: 8202070 - DNA, 22 bp, Homo sapiens
aatatgtttataagatatcttc

SEQ ID NO: 8202071 - DNA, 22 bp, Homo sapiens
aatattagtttctcaagagaga

SEQ ID NO: 8202072 - DNA, 22 bp, Homo sapiens
aatcttcactcattcagagttg

SEQ ID NO: 8202073 - DNA, 22 bp, Homo sapiens
aatcttcactcttaactgtgca

SEQ ID NO: 8202074 - DNA, 22 bp, Homo sapiens
aatcttaagctgaattctctcc

SEQ ID NO: 8202075 - DNA, 22 bp, Homo sapiens
aatcttacaccgaatttaaact

SEQ ID NO: 8202076 - DNA, 22 bp, Homo sapiens
aatcttcaacagaatggtagga

SEQ ID NO: 8202077 - DNA, 22 bp, Homo sapiens
aatcttcaacagaatggtagga

SEQ ID NO: 8202078 - DNA, 22 bp, Homo sapiens
aatcttcaaaatgttctgcttg

SEQ ID NO: 8202079 - DNA, 22 bp, Homo sapiens
aatctttcgtttctcctgtctg

SEQ ID NO: 8202080 - DNA, 22 bp, Homo sapiens
aatctttgtaacagtgaggttt

SEQ ID NO: 8202081 - DNA, 21 bp, Homo sapiens
aatctttctaaccctggtggc

SEQ ID NO: 8202082 - DNA, 19 bp, Homo sapiens
aatctttccacaatgaggc

SEQ ID NO: 8202083 - DNA, 22 bp, Homo sapiens
aatctttcaaatttctttgggt

SEQ ID NO: 8202084 - DNA, 22 bp, Homo sapiens
aatctttcaaatttctttgggt

SEQ ID NO: 8202085 - DNA, 22 bp, Homo sapiens
agaaactattatggtaaacaaa

SEQ ID NO: 8202086 - DNA, 22 bp, Homo sapiens
agaaactgaacacaagagtcgg

SEQ ID NO: 8202087 - DNA, 22 bp, Homo sapiens
agaaactaaagccaagggctct

SEQ ID NO: 8202088 - DNA, 22 bp, Homo sapiens
agaaacgcctgtgaaattatct

SEQ ID NO: 8202089 - DNA, 22 bp, Homo sapiens
agaaacgcctgtgaaattatct

SEQ ID NO: 8202090 - DNA, 22 bp, Homo sapiens
agaaacctgtgtgctgtgatga

SEQ ID NO: 8202091 - DNA, 22 bp, Homo sapiens
agaaactatcctgagtagcaaa

SEQ ID NO: 8202092 - DNA, 22 bp, Homo sapiens
aatcttaaagaatattctacca

SEQ ID NO: 8202093 - DNA, 22 bp, Homo sapiens
aatctgtattgttaacaagtaa

SEQ ID NO: 8202094 - DNA, 22 bp, Homo sapiens
aatctgtcgtagtaaaaagcag

SEQ ID NO: 8202095 - DNA, 22 bp, Homo sapiens
aatctgtcccttaactagtcat

SEQ ID NO: 8202096 - DNA, 22 bp, Homo sapiens
aatctgtcccttaactagtcat

SEQ ID NO: 8202097 - DNA, 22 bp, Homo sapiens
acttcctgacttctgggttgga

SEQ ID NO: 8202098 - DNA, 23 bp, Homo sapiens
acttccagttataggaactcttc

SEQ ID NO: 8202099 - DNA, 22 bp, Homo sapiens
aatatcttctaaggatagaact

SEQ ID NO: 8202100 - DNA, 22 bp, Homo sapiens
aatatcttctaaggatagaact

SEQ ID NO: 8202101 - DNA, 22 bp, Homo sapiens
aatatcaggatgcaaagctgtg

SEQ ID NO: 8202102 - DNA, 22 bp, Homo sapiens
aatatgaattattgttacaagt

SEQ ID NO: 8202103 - DNA, 22 bp, Homo sapiens
aatatgagtttgcctttcctgc

SEQ ID NO: 8202104 - DNA, 22 bp, Homo sapiens
aatatgaattattgttacaagt

SEQ ID NO: 8202105 - DNA, 22 bp, Homo sapiens
aatatgaattattgttacaagt

SEQ ID NO: 8202106 - DNA, 22 bp, Homo sapiens
aatatcttctaaggatagaact

SEQ ID NO: 8202107 - DNA, 22 bp, Homo sapiens
acttatttcatggatcataatg

SEQ ID NO: 8202108 - DNA, 22 bp, Homo sapiens
acttccagctgccctgtgtgct

SEQ ID NO: 8202109 - DNA, 22 bp, Homo sapiens
acttatttattcattcagctca

SEQ ID NO: 8202110 - DNA, 22 bp, Homo sapiens
acttatttcatggatcataatg

SEQ ID NO: 8202111 - DNA, 22 bp, Homo sapiens
acttatatttgctttatgcttc

SEQ ID NO: 8202112 - DNA, 22 bp, Homo sapiens
acttatcagttgtctctaatgt

SEQ ID NO: 8202113 - DNA, 22 bp, Homo sapiens
acttatcacacactaaattagg

SEQ ID NO: 8202114 - DNA, 22 bp, Homo sapiens
acttatctgcaattagtacata

SEQ ID NO: 8202115 - DNA, 22 bp, Homo sapiens
acttatcgtagggaatttacta

SEQ ID NO: 8202116 - DNA, 22 bp, Homo sapiens
acttatcttagttcatttgtat

SEQ ID NO: 8202117 - DNA, 22 bp, Homo sapiens
acttatctgcaattagtacata

SEQ ID NO: 8202118 - DNA, 22 bp, Homo sapiens
acttatcttagttcatttgtat

SEQ ID NO: 8202119 - DNA, 22 bp, Homo sapiens
acttattctgagattatgatca

SEQ ID NO: 8202120 - DNA, 22 bp, Homo sapiens
acttatttattcattcagctca

SEQ ID NO: 8202121 - DNA, 22 bp, Homo sapiens
acttataagagtgctatgggga

SEQ ID NO: 8202122 - DNA, 22 bp, Homo sapiens
acttatactaaagtattatttg

SEQ ID NO: 8202123 - DNA, 22 bp, Homo sapiens
acttatactaaagtattatttg

SEQ ID NO: 8202124 - DNA, 22 bp, Homo sapiens
acttatactaaagtattatttg

SEQ ID NO: 8202125 - DNA, 22 bp, Homo sapiens
acttataagagtgctatgggga

SEQ ID NO: 8202126 - DNA, 22 bp, Homo sapiens
acttagcagtttagaatatgtc

SEQ ID NO: 8202127 - DNA, 22 bp, Homo sapiens
acttagcaggtactttcatatt

SEQ ID NO: 8202128 - DNA, 22 bp, Homo sapiens
acttagtgccctggcccttaca

SEQ ID NO: 8202129 - DNA, 22 bp, Homo sapiens
aatagaacaataattgtaaact

SEQ ID NO: 8202130 - DNA, 22 bp, Homo sapiens
actgttgaagtgccagcttgat

SEQ ID NO: 8202131 - DNA, 22 bp, Homo sapiens
actgttggcttctggtagtgac

SEQ ID NO: 8202132 - DNA, 22 bp, Homo sapiens
actgttgaagtgccagcttgat

SEQ ID NO: 8202133 - DNA, 22 bp, Homo sapiens
acttagcagagttgaatgtact

SEQ ID NO: 8202134 - DNA, 22 bp, Homo sapiens
actgtggggtgcgaggcagtga

SEQ ID NO: 8202135 - DNA, 22 bp, Homo sapiens
actgtggggtgcgaggcagtga

SEQ ID NO: 8202136 - DNA, 21 bp, Homo sapiens
actgtggggttcaactggcag

SEQ ID NO: 8202137 - DNA, 21 bp, Homo sapiens
actgtggggttcaactggcag

SEQ ID NO: 8202138 - DNA, 23 bp, Homo sapiens
actgtgggcaccacagagagtgt

SEQ ID NO: 8202139 - DNA, 23 bp, Homo sapiens
actgtgggcaccacagagagtgt

SEQ ID NO: 8202140 - DNA, 23 bp, Homo sapiens
actgtgggcaccacagagagtgt

SEQ ID NO: 8202141 - DNA, 22 bp, Homo sapiens
actgtgggcagcttctgggaac

SEQ ID NO: 8202142 - DNA, 22 bp, Homo sapiens
actgtgggccattgggttctgt

SEQ ID NO: 8202143 - DNA, 22 bp, Homo sapiens
actgtgggcagcttctgggaac

SEQ ID NO: 8202144 - DNA, 22 bp, Homo sapiens
actgtgggagcttatcatttca

SEQ ID NO: 8202145 - DNA, 22 bp, Homo sapiens
actgtgggagcttatcatttca

SEQ ID NO: 8202146 - DNA, 22 bp, Homo sapiens
actgtgggagcgcagtggcagc

SEQ ID NO: 8202147 - DNA, 22 bp, Homo sapiens
actgtgggccattgggttctgt

SEQ ID NO: 8202148 - DNA, 22 bp, Homo sapiens
actgtgggcctttcctttgacc

SEQ ID NO: 8202149 - DNA, 22 bp, Homo sapiens
actgtgggggagccagtcccat

SEQ ID NO: 8202150 - DNA, 22 bp, Homo sapiens
actgtgggggagccagtcccat

SEQ ID NO: 8202151 - DNA, 22 bp, Homo sapiens
actgtggggtgaggcccaagaa

SEQ ID NO: 8202152 - DNA, 22 bp, Homo sapiens
actgtggggtgaggcccaagaa

SEQ ID NO: 8202153 - DNA, 22 bp, Homo sapiens
actgtggggtgcgaggcagtga

SEQ ID NO: 8202154 - DNA, 22 bp, Homo sapiens
actgtggggggctttgctcagt

SEQ ID NO: 8202155 - DNA, 22 bp, Homo sapiens
actgtggggggctttgctcagt

SEQ ID NO: 8202156 - DNA, 22 bp, Homo sapiens
aatacttgtcagatgaataaga

SEQ ID NO: 8202157 - DNA, 22 bp, Homo sapiens
aatacttgggctgagatttttg

SEQ ID NO: 8202158 - DNA, 22 bp, Homo sapiens
aatacttgtgaattcaaagtct

SEQ ID NO: 8202159 - DNA, 22 bp, Homo sapiens
aatacttgtcagatgaataaga

SEQ ID NO: 8202160 - DNA, 22 bp, Homo sapiens
aatactttcctatataaggtgc

SEQ ID NO: 8202161 - DNA, 22 bp, Homo sapiens
aatacttgaatttcatgtcagg

SEQ ID NO: 8202162 - DNA, 22 bp, Homo sapiens
aatacttatgtgacctcatttt

SEQ ID NO: 8202163 - DNA, 22 bp, Homo sapiens
aatactttgccaagttcgaaga

SEQ ID NO: 8202164 - DNA, 22 bp, Homo sapiens
aatacttttgaactgaaaggca

SEQ ID NO: 8202165 - DNA, 22 bp, Homo sapiens
actgtggctcatcaggctggtg

SEQ ID NO: 8202166 - DNA, 22 bp, Homo sapiens
actgtgggacatccctccctat

SEQ ID NO: 8202167 - DNA, 22 bp, Homo sapiens
actgtgggaaccactgaatcag

SEQ ID NO: 8202168 - DNA, 22 bp, Homo sapiens
actgtgggagcgcagtggcagc

SEQ ID NO: 8202169 - DNA, 22 bp, Homo sapiens
actgtgggacatccctccctat

SEQ ID NO: 8202170 - DNA, 22 bp, Homo sapiens
actgtggccaaagcctctggga

SEQ ID NO: 8202171 - DNA, 22 bp, Homo sapiens
actgtggcgtcaggaagaaatt

SEQ ID NO: 8202172 - DNA, 22 bp, Homo sapiens
actgtggccttgtgggttcagg

SEQ ID NO: 8202173 - DNA, 22 bp, Homo sapiens
actgtggagcagtggctaggga

SEQ ID NO: 8202174 - DNA, 22 bp, Homo sapiens
actgtggagaaagaaagactgc

SEQ ID NO: 8202175 - DNA, 22 bp, Homo sapiens
actgtggagcagtggctaggga

SEQ ID NO: 8202176 - DNA, 22 bp, Homo sapiens
actgtggataagtcagagatgt

SEQ ID NO: 8202177 - DNA, 22 bp, Homo sapiens
actgtgctggcaatgactcagg

SEQ ID NO: 8202178 - DNA, 22 bp, Homo sapiens
actgtgctttctctggaggcat

SEQ ID NO: 8202179 - DNA, 22 bp, Homo sapiens
actgtggcaaagaagcaggctc

SEQ ID NO: 8202180 - DNA, 22 bp, Homo sapiens
actgtggcaaaagaacattgga

SEQ ID NO: 8202181 - DNA, 22 bp, Homo sapiens
actgtggataagtcagagatgt

SEQ ID NO: 8202182 - DNA, 22 bp, Homo sapiens
actgtggataagtcagagatgt

SEQ ID NO: 8202183 - DNA, 22 bp, Homo sapiens
aataacagtgccatgaaattga

SEQ ID NO: 8202184 - DNA, 22 bp, Homo sapiens
aataacaggctcatcagatgct

SEQ ID NO: 8202185 - DNA, 22 bp, Homo sapiens
aataacagattttcaagctgtg

SEQ ID NO: 8202186 - DNA, 22 bp, Homo sapiens
aataactggcacatatcacata

SEQ ID NO: 8202187 - DNA, 23 bp, Homo sapiens
actgtctgatatgttttccatca

SEQ ID NO: 8202188 - DNA, 22 bp, Homo sapiens
accagctgtgtcctggctgcag

SEQ ID NO: 8202189 - DNA, 22 bp, Homo sapiens
accagctggtcagttgaagatt

SEQ ID NO: 8202190 - DNA, 22 bp, Homo sapiens
accagctgtgtcctggctgcag

SEQ ID NO: 8202191 - DNA, 22 bp, Homo sapiens
accagctggtcagttgaagatt

SEQ ID NO: 8202192 - DNA, 22 bp, Homo sapiens
accagctgtgtcctggctgcag

SEQ ID NO: 8202193 - DNA, 22 bp, Homo sapiens
accagctggcccatgagcacgt

SEQ ID NO: 8202194 - DNA, 22 bp, Homo sapiens
accagctggtcacctgggcact

SEQ ID NO: 8202195 - DNA, 22 bp, Homo sapiens
accagctggtcacctgggcact

SEQ ID NO: 8202196 - DNA, 22 bp, Homo sapiens
accagctggtcacctgggcact

SEQ ID NO: 8202197 - DNA, 22 bp, Homo sapiens
accagctggtcacctgggcact

SEQ ID NO: 8202198 - DNA, 22 bp, Homo sapiens
accagctgttaggcttggtgct

SEQ ID NO: 8202199 - DNA, 22 bp, Homo sapiens
accagctgtgtgacctgaggca

SEQ ID NO: 8202200 - DNA, 22 bp, Homo sapiens
accaggaaaaacactgtgttgg

SEQ ID NO: 8202201 - DNA, 22 bp, Homo sapiens
accaggaaatttggcaacaaag

SEQ ID NO: 8202202 - DNA, 22 bp, Homo sapiens
accaggaaactctcgtctagtt

SEQ ID NO: 8202203 - DNA, 22 bp, Homo sapiens
accaggcatgatgtggagcaca

SEQ ID NO: 8202204 - DNA, 22 bp, Homo sapiens
accaggcagtcaccgtccagga

SEQ ID NO: 8202205 - DNA, 22 bp, Homo sapiens
accaggcagtatggtgctgcaa

SEQ ID NO: 8202206 - DNA, 22 bp, Homo sapiens
accaggcactcttgtggcagtg

SEQ ID NO: 8202207 - DNA, 22 bp, Homo sapiens
accaggcactcttgtggcagtg

SEQ ID NO: 8202208 - DNA, 22 bp, Homo sapiens
accaggcactcctgaggtctga

SEQ ID NO: 8202209 - DNA, 22 bp, Homo sapiens
accaggcaaaaccacaggagca

SEQ ID NO: 8202210 - DNA, 22 bp, Homo sapiens
accaggcaaaaccacaggagca

SEQ ID NO: 8202211 - DNA, 17 bp, Homo sapiens
accaggcaacacgccca

SEQ ID NO: 8202212 - DNA, 17 bp, Homo sapiens
accaggcaacacgccca

SEQ ID NO: 8202213 - DNA, 22 bp, Homo sapiens
aaggttgatatgtatctaggga

SEQ ID NO: 8202214 - DNA, 22 bp, Homo sapiens
aaggtttaaggtctataaatgt

SEQ ID NO: 8202215 - DNA, 22 bp, Homo sapiens
aaggtgtcactgtttctggcct

SEQ ID NO: 8202216 - DNA, 22 bp, Homo sapiens
aaggtgtcactgggacaggaaa

SEQ ID NO: 8202217 - DNA, 23 bp, Homo sapiens
aaggttgaaattggagcttggat

SEQ ID NO: 8202218 - DNA, 23 bp, Homo sapiens
aaggttgaaattggagcttggat

SEQ ID NO: 8202219 - DNA, 22 bp, Homo sapiens
aaggtgtcactgggacaggaaa

SEQ ID NO: 8202220 - DNA, 22 bp, Homo sapiens
aaggtgtcactgggacaggaaa

SEQ ID NO: 8202221 - DNA, 21 bp, Homo sapiens
accaggccaggaggctggcac

SEQ ID NO: 8202222 - DNA, 21 bp, Homo sapiens
accaggccaggaggctggcac

SEQ ID NO: 8202223 - DNA, 21 bp, Homo sapiens
accaggccaggaggctggcac

SEQ ID NO: 8202224 - DNA, 22 bp, Homo sapiens
accaggccaacagctaagttaa

SEQ ID NO: 8202225 - DNA, 22 bp, Homo sapiens
accaggccaacagctaagttaa

SEQ ID NO: 8202226 - DNA, 22 bp, Homo sapiens
accaggcatgatgtggagcaca

SEQ ID NO: 8202227 - DNA, 22 bp, Homo sapiens
accaggccaaaatcatatttac

SEQ ID NO: 8202228 - DNA, 22 bp, Homo sapiens
accaggccaaaatcatatttac

SEQ ID NO: 8202229 - DNA, 22 bp, Homo sapiens
aagtaaaatgtttcctttatta

SEQ ID NO: 8202230 - DNA, 22 bp, Homo sapiens
aagtaaaattcaatcttcactg

SEQ ID NO: 8202231 - DNA, 22 bp, Homo sapiens
aagtaaaattcaatcttcactg

SEQ ID NO: 8202232 - DNA, 22 bp, Homo sapiens
aagtaaaatgtttcctttatta

SEQ ID NO: 8202233 - DNA, 22 bp, Homo sapiens
aagtaaaagcaggtgtgctggg

SEQ ID NO: 8202234 - DNA, 22 bp, Homo sapiens
aagtaaaacacacagtccaccg

SEQ ID NO: 8202235 - DNA, 22 bp, Homo sapiens
aaggtttttttccagtatctct

SEQ ID NO: 8202236 - DNA, 22 bp, Homo sapiens
accagctgagtaggggagggcc

SEQ ID NO: 8202237 - DNA, 22 bp, Homo sapiens
accagctgagttctcggatggt

SEQ ID NO: 8202238 - DNA, 22 bp, Homo sapiens
accagctgagttctcggatggt

SEQ ID NO: 8202239 - DNA, 22 bp, Homo sapiens
aagggcagctgacagatgctta

SEQ ID NO: 8202240 - DNA, 22 bp, Homo sapiens
aagggcagctgacagatgctta

SEQ ID NO: 8202241 - DNA, 22 bp, Homo sapiens
aagggcagcttaaattggtagc

SEQ ID NO: 8202242 - DNA, 22 bp, Homo sapiens
aagggcagcttaaattggtagc

SEQ ID NO: 8202243 - DNA, 22 bp, Homo sapiens
accagcacttccagaggtcagg

SEQ ID NO: 8202244 - DNA, 22 bp, Homo sapiens
accagcacggattagaatgctt

SEQ ID NO: 8202245 - DNA, 22 bp, Homo sapiens
aagggcagctgacagatgctta

SEQ ID NO: 8202246 - DNA, 22 bp, Homo sapiens
aagggcagctgacagatgctta

SEQ ID NO: 8202247 - DNA, 22 bp, Homo sapiens
aagggcagcctgactcacggtc

SEQ ID NO: 8202248 - DNA, 22 bp, Homo sapiens
aagggcagctattatcgtcatc

SEQ ID NO: 8202249 - DNA, 17 bp, Homo sapiens
accacctctcaccagca

SEQ ID NO: 8202250 - DNA, 22 bp, Homo sapiens
accactgagtgtccttcagggt

SEQ ID NO: 8202251 - DNA, 22 bp, Homo sapiens
accactgcccatggtgaaaact

SEQ ID NO: 8202252 - DNA, 22 bp, Homo sapiens
accacctcatcaagctggattg

SEQ ID NO: 8202253 - DNA, 21 bp, Homo sapiens
accaccctgtttatccagagg

SEQ ID NO: 8202254 - DNA, 22 bp, Homo sapiens
accacctcatcaagctggattg

SEQ ID NO: 8202255 - DNA, 22 bp, Homo sapiens
aagggcagcctgactcacggtc

SEQ ID NO: 8202256 - DNA, 22 bp, Homo sapiens
aagggcagcctgactcacggtc

SEQ ID NO: 8202257 - DNA, 22 bp, Homo sapiens
aagggcagagggaatcccacat

SEQ ID NO: 8202258 - DNA, 22 bp, Homo sapiens
acattttgcccttatttgctga

SEQ ID NO: 8202259 - DNA, 22 bp, Homo sapiens
acattttgcccttatttgctga

SEQ ID NO: 8202260 - DNA, 22 bp, Homo sapiens
acattttgcccttatttgctga

SEQ ID NO: 8202261 - DNA, 22 bp, Homo sapiens
acattttgcccttatttgctga

SEQ ID NO: 8202262 - DNA, 22 bp, Homo sapiens
accacaggaggatggctgctgg

SEQ ID NO: 8202263 - DNA, 22 bp, Homo sapiens
accacaggaggatggctgctgg

SEQ ID NO: 8202264 - DNA, 22 bp, Homo sapiens
acattcttaacagttaaaaact

SEQ ID NO: 8202265 - DNA, 22 bp, Homo sapiens
acattcttaacagttaaaaact

SEQ ID NO: 8202266 - DNA, 22 bp, Homo sapiens
acattcttaacagttaaaaact

SEQ ID NO: 8202267 - DNA, 22 bp, Homo sapiens
acattctgtttccccaaagaga

SEQ ID NO: 8202268 - DNA, 22 bp, Homo sapiens
acattctgtatcatctgtctca

SEQ ID NO: 8202269 - DNA, 22 bp, Homo sapiens
acattctgttgaggctgggtca

SEQ ID NO: 8202270 - DNA, 22 bp, Homo sapiens
acattctgtgagtcatgtttta

SEQ ID NO: 8202271 - DNA, 22 bp, Homo sapiens
accacaggggaggaatgatgcc

SEQ ID NO: 8202272 - DNA, 22 bp, Homo sapiens
accacagtctcgaagcactgca

SEQ ID NO: 8202273 - DNA, 22 bp, Homo sapiens
accacagtttagtccaatgaca

SEQ ID NO: 8202274 - DNA, 22 bp, Homo sapiens
accaccctcagcagagctgaaa

SEQ ID NO: 8202275 - DNA, 22 bp, Homo sapiens
acatgggacagagaaagaggcc

SEQ ID NO: 8202276 - DNA, 21 bp, Homo sapiens
acatgggacctgcgaaaggaa

SEQ ID NO: 8202277 - DNA, 22 bp, Homo sapiens
acatgggagagaaataaatgta

SEQ ID NO: 8202278 - DNA, 22 bp, Homo sapiens
acatgggagagaaataaatgta

SEQ ID NO: 8202279 - DNA, 23 bp, Homo sapiens
acatgggagggacatggaggctg

SEQ ID NO: 8202280 - DNA, 23 bp, Homo sapiens
acatgggagggacatggaggctg

SEQ ID NO: 8202281 - DNA, 23 bp, Homo sapiens
acatgggaaatgcaaagagaagt

SEQ ID NO: 8202282 - DNA, 22 bp, Homo sapiens
acatggctggcaccttaaattt

SEQ ID NO: 8202283 - DNA, 23 bp, Homo sapiens
acatgggaaatgcaaagagaagt

SEQ ID NO: 8202284 - DNA, 19 bp, Homo sapiens
acatggctctccagtctgg

SEQ ID NO: 8202285 - DNA, 22 bp, Homo sapiens
acatggctcagtctcatgacag

SEQ ID NO: 8202286 - DNA, 22 bp, Homo sapiens
acatggctcagtctcatgacag

SEQ ID NO: 8202287 - DNA, 22 bp, Homo sapiens
acatgggttattgtgaggttaa

SEQ ID NO: 8202288 - DNA, 17 bp, Homo sapiens
acatgggctgagactcc

SEQ ID NO: 8202289 - DNA, 22 bp, Homo sapiens
acatgggatgacctccgatggt

SEQ ID NO: 8202290 - DNA, 22 bp, Homo sapiens
acatgggatcaatgaggcaggc

SEQ ID NO: 8202291 - DNA, 22 bp, Homo sapiens
acatgggatcaatgaggcaggc

SEQ ID NO: 8202292 - DNA, 22 bp, Homo sapiens
acatgggatcaatgaggcaggc

SEQ ID NO: 8202293 - DNA, 22 bp, Homo sapiens
acatgcattaaaaatacttgtg

SEQ ID NO: 8202294 - DNA, 22 bp, Homo sapiens
acatgcattctctaaaagcaaa

SEQ ID NO: 8202295 - DNA, 22 bp, Homo sapiens
acatacttatgctaaaaatata

SEQ ID NO: 8202296 - DNA, 22 bp, Homo sapiens
acatacttaacattaaagtcat

SEQ ID NO: 8202297 - DNA, 22 bp, Homo sapiens
acatacttagagtaaacaagta

SEQ ID NO: 8202298 - DNA, 22 bp, Homo sapiens
acatacttctttacattccata

SEQ ID NO: 8202299 - DNA, 22 bp, Homo sapiens
acatacttctttacattccata

SEQ ID NO: 8202300 - DNA, 22 bp, Homo sapiens
acatacttatgtgtatatgtgt

SEQ ID NO: 8202301 - DNA, 22 bp, Homo sapiens
acataataggtacctgaataat

SEQ ID NO: 8202302 - DNA, 22 bp, Homo sapiens
acataagttatggataaaatgt

SEQ ID NO: 8202303 - DNA, 22 bp, Homo sapiens
acataataaaaataacagctca

SEQ ID NO: 8202304 - DNA, 22 bp, Homo sapiens
acataacatagttgacattttt

SEQ ID NO: 8202305 - DNA, 22 bp, Homo sapiens
acataacatgtcaatcacccga

SEQ ID NO: 8202306 - DNA, 22 bp, Homo sapiens
acataagcttctgaagggatgg

SEQ ID NO: 8202307 - DNA, 22 bp, Homo sapiens
acataataggtgcctgaatatt

SEQ ID NO: 8202308 - DNA, 22 bp, Homo sapiens
acataatgaaatgcagaaatca

SEQ ID NO: 8202309 - DNA, 22 bp, Homo sapiens
acatactatgaatacatgtgtc

SEQ ID NO: 8202310 - DNA, 22 bp, Homo sapiens
acatacattgcctcattggtaa

SEQ ID NO: 8202311 - DNA, 22 bp, Homo sapiens
acataccatacatggtgagatg

SEQ ID NO: 8202312 - DNA, 18 bp, Homo sapiens
acatacattctgtctgca

SEQ ID NO: 8202313 - DNA, 22 bp, Homo sapiens
aaggccaggcctagcacggagg

SEQ ID NO: 8202314 - DNA, 22 bp, Homo sapiens
aaggccaggcctagcacggagg

SEQ ID NO: 8202315 - DNA, 22 bp, Homo sapiens
aaggccaggcctagcacggagg

SEQ ID NO: 8202316 - DNA, 22 bp, Homo sapiens
aaggccaggcctagcacggagg

SEQ ID NO: 8202317 - DNA, 22 bp, Homo sapiens
acatgtgttttcctacttatga

SEQ ID NO: 8202318 - DNA, 22 bp, Homo sapiens
acatgtgttaaaattctcacca

SEQ ID NO: 8202319 - DNA, 22 bp, Homo sapiens
aaggccagggatgccagctcgg

SEQ ID NO: 8202320 - DNA, 22 bp, Homo sapiens
acatgtgttaaaattctcacca

SEQ ID NO: 8202321 - DNA, 22 bp, Homo sapiens
aaggccagggatgccagctcgg

SEQ ID NO: 8202322 - DNA, 22 bp, Homo sapiens
aaggccagggatgccagctcgg

SEQ ID NO: 8202323 - DNA, 22 bp, Homo sapiens
aaggccagggatgccagctcgg

SEQ ID NO: 8202324 - DNA, 21 bp, Homo sapiens
acattacagggtgatgtgtct

SEQ ID NO: 8202325 - DNA, 22 bp, Homo sapiens
acattacataagattgtaacct

SEQ ID NO: 8202326 - DNA, 22 bp, Homo sapiens
acatgtgttaaaattctcacca

SEQ ID NO: 8202327 - DNA, 21 bp, Homo sapiens
acattacagggtgatgtgtct

SEQ ID NO: 8202328 - DNA, 22 bp, Homo sapiens
aaggccaggccagatgacagtc

SEQ ID NO: 8202329 - DNA, 22 bp, Homo sapiens
aaggccaggccagatgacagtc

SEQ ID NO: 8202330 - DNA, 22 bp, Homo sapiens
aaggccaggccagatgacagtc

SEQ ID NO: 8202331 - DNA, 22 bp, Homo sapiens
aaggccaggccagatgacagtc

SEQ ID NO: 8202332 - DNA, 22 bp, Homo sapiens
aaggccaggcctagcacggagg

SEQ ID NO: 8202333 - DNA, 22 bp, Homo sapiens
aaggccaggcctagcacggagg

SEQ ID NO: 8202334 - DNA, 22 bp, Homo sapiens
aaggccaggcctagcacggagg

SEQ ID NO: 8202335 - DNA, 22 bp, Homo sapiens
aaggccaggcagggagctgtga

SEQ ID NO: 8202336 - DNA, 22 bp, Homo sapiens
aaggccaggagacttggagtca

SEQ ID NO: 8202337 - DNA, 22 bp, Homo sapiens
aaggccaggagacttggagtca

SEQ ID NO: 8202338 - DNA, 22 bp, Homo sapiens
aaggccaggagacttggagtca

SEQ ID NO: 8202339 - DNA, 22 bp, Homo sapiens
aaggccaggagacttggagtca

SEQ ID NO: 8202340 - DNA, 22 bp, Homo sapiens
aaggccaggcagggagctgtga

SEQ ID NO: 8202341 - DNA, 22 bp, Homo sapiens
aaggccaggcagggagctgtga

SEQ ID NO: 8202342 - DNA, 22 bp, Homo sapiens
aaggccaggcagggagctgtga

SEQ ID NO: 8202343 - DNA, 22 bp, Homo sapiens
aaggccagcgcagaccattgtc

SEQ ID NO: 8202344 - DNA, 22 bp, Homo sapiens
acatgtaaaagataaattaaca

SEQ ID NO: 8202345 - DNA, 22 bp, Homo sapiens
aaggccagcgcagaccattgtc

SEQ ID NO: 8202346 - DNA, 22 bp, Homo sapiens
aaggccagctggagggatgagg

SEQ ID NO: 8202347 - DNA, 22 bp, Homo sapiens
aaggccagctggagggatgagg

SEQ ID NO: 8202348 - DNA, 22 bp, Homo sapiens
aaggccagctggagggatgagg

SEQ ID NO: 8202349 - DNA, 22 bp, Homo sapiens
acatggtatttctattataatt

SEQ ID NO: 8202350 - DNA, 22 bp, Homo sapiens
acatggtatttctattataatt

SEQ ID NO: 8202351 - DNA, 22 bp, Homo sapiens
aaggccaggaaattatccctat

SEQ ID NO: 8202352 - DNA, 22 bp, Homo sapiens
aaggccaggaaattatccctat

SEQ ID NO: 8202353 - DNA, 22 bp, Homo sapiens
aaggccaggacaccaggggact

SEQ ID NO: 8202354 - DNA, 22 bp, Homo sapiens
aaggccaggaaattatccctat

SEQ ID NO: 8202355 - DNA, 22 bp, Homo sapiens
aaggccaggacaccaggggact

SEQ ID NO: 8202356 - DNA, 22 bp, Homo sapiens
aaggccaggacaccaggggact

SEQ ID NO: 8202357 - DNA, 22 bp, Homo sapiens
aaggccaggacaccaggggact

SEQ ID NO: 8202358 - DNA, 22 bp, Homo sapiens
aaggccagctggagggatgagg

SEQ ID NO: 8202359 - DNA, 22 bp, Homo sapiens
aaggccagcttgtagggctggt

SEQ ID NO: 8202360 - DNA, 22 bp, Homo sapiens
aaggccagcttgtagggctggt

SEQ ID NO: 8202361 - DNA, 22 bp, Homo sapiens
aaggccagcttgtagggctggt

SEQ ID NO: 8202362 - DNA, 22 bp, Homo sapiens
aaggccagcttgtagggctggt

SEQ ID NO: 8202363 - DNA, 22 bp, Homo sapiens
aaggccagcttgtagggctggt

SEQ ID NO: 8202364 - DNA, 22 bp, Homo sapiens
aaggccagcttgtagggctggt

SEQ ID NO: 8202365 - DNA, 22 bp, Homo sapiens
acattatgagcccactggtgaa

SEQ ID NO: 8202366 - DNA, 22 bp, Homo sapiens
acattatagttgctacagagta

SEQ ID NO: 8202367 - DNA, 22 bp, Homo sapiens
acattatagctttgagtttgga

SEQ ID NO: 8202368 - DNA, 21 bp, Homo sapiens
acattataattcatattccac

SEQ ID NO: 8202369 - DNA, 21 bp, Homo sapiens
acattataattcatattccac

SEQ ID NO: 8202370 - DNA, 21 bp, Homo sapiens
acattataattcatattccac

SEQ ID NO: 8202371 - DNA, 22 bp, Homo sapiens
acattagaacattaatattggg

SEQ ID NO: 8202372 - DNA, 22 bp, Homo sapiens
acattagagaagcttggagatg

SEQ ID NO: 8202373 - DNA, 22 bp, Homo sapiens
acattagataactcagaaagga

SEQ ID NO: 8202374 - DNA, 22 bp, Homo sapiens
acattagatgactctttctttc

SEQ ID NO: 8202375 - DNA, 22 bp, Homo sapiens
acattctcaaatatttgtggaa

SEQ ID NO: 8202376 - DNA, 22 bp, Homo sapiens
acattctatttcatcatgtcta

SEQ ID NO: 8202377 - DNA, 22 bp, Homo sapiens
acattctcatttggtgatcatt

SEQ ID NO: 8202378 - DNA, 22 bp, Homo sapiens
acattcaaaatatttctgatgt

SEQ ID NO: 8202379 - DNA, 22 bp, Homo sapiens
acattctggatgtctgatgaga

SEQ ID NO: 8202380 - DNA, 22 bp, Homo sapiens
acattctgggtgatgttcttca

SEQ ID NO: 8202381 - DNA, 22 bp, Homo sapiens
acattctgaataggcattttat

SEQ ID NO: 8202382 - DNA, 22 bp, Homo sapiens
acattctggatgtctgatgaga

SEQ ID NO: 8202383 - DNA, 22 bp, Homo sapiens
acattctcttcctaaatatact

SEQ ID NO: 8202384 - DNA, 22 bp, Homo sapiens
acattctgaaaaacagtgtttt

SEQ ID NO: 8202385 - DNA, 22 bp, Homo sapiens
acattctcttcctaaatatact

SEQ ID NO: 8202386 - DNA, 22 bp, Homo sapiens
acaggtctccagagtgagagga

SEQ ID NO: 8202387 - DNA, 22 bp, Homo sapiens
acaggtctgcagtaactgggaa

SEQ ID NO: 8202388 - DNA, 22 bp, Homo sapiens
acaggtctactggcaagcagtg

SEQ ID NO: 8202389 - DNA, 22 bp, Homo sapiens
acaggtcagataaaggctggtg

SEQ ID NO: 8202390 - DNA, 22 bp, Homo sapiens
acaggtcaacgagagcaggcaa

SEQ ID NO: 8202391 - DNA, 22 bp, Homo sapiens
acaggtgaagtattacactaag

SEQ ID NO: 8202392 - DNA, 22 bp, Homo sapiens
acaggtctggtctgggtgggac

SEQ ID NO: 8202393 - DNA, 22 bp, Homo sapiens
acaggtctgtgtgcacagtgct

SEQ ID NO: 8202394 - DNA, 22 bp, Homo sapiens
acaggtctgtgtgcacagtgct

SEQ ID NO: 8202395 - DNA, 22 bp, Homo sapiens
acaggtgaggggttctaggctg

SEQ ID NO: 8202396 - DNA, 22 bp, Homo sapiens
acaggtgagggagctttgtgcc

SEQ ID NO: 8202397 - DNA, 22 bp, Homo sapiens
acaggtgacttgcattttcaca

SEQ ID NO: 8202398 - DNA, 22 bp, Homo sapiens
acaggtgaggatctgagcctca

SEQ ID NO: 8202399 - DNA, 22 bp, Homo sapiens
acaggctttggcgaggcccatc

SEQ ID NO: 8202400 - DNA, 22 bp, Homo sapiens
acaggcttttttagaatgacat

SEQ ID NO: 8202401 - DNA, 23 bp, Homo sapiens
acagggaaaagtcatcagtgtga

SEQ ID NO: 8202402 - DNA, 22 bp, Homo sapiens
acaggcttttttgctctcgaat

SEQ ID NO: 8202403 - DNA, 21 bp, Homo sapiens
acaggctttagaaaatgactc

SEQ ID NO: 8202404 - DNA, 22 bp, Homo sapiens
acaggctttatgtagtgactta

SEQ ID NO: 8202405 - DNA, 20 bp, Homo sapiens
acaggctttggagtctgaat

SEQ ID NO: 8202406 - DNA, 20 bp, Homo sapiens
acaggctttctgaggctggc

SEQ ID NO: 8202407 - DNA, 23 bp, Homo sapiens
acagggcttatctgtcactcatc

SEQ ID NO: 8202408 - DNA, 23 bp, Homo sapiens
acagggcttatctgtcactcatc

SEQ ID NO: 8202409 - DNA, 23 bp, Homo sapiens
acagggcttatctgtcactcatc

SEQ ID NO: 8202410 - DNA, 23 bp, Homo sapiens
acagggcttatctgtcactcatc

SEQ ID NO: 8202411 - DNA, 22 bp, Homo sapiens
acaggtagaaattcatctatat

SEQ ID NO: 8202412 - DNA, 22 bp, Homo sapiens
acaggctgatagaccataaata

SEQ ID NO: 8202413 - DNA, 22 bp, Homo sapiens
acaggctgatagaccataaata

SEQ ID NO: 8202414 - DNA, 22 bp, Homo sapiens
acaggctgccacttgcatccaa

SEQ ID NO: 8202415 - DNA, 22 bp, Homo sapiens
acaggctgccacttgcatccaa

SEQ ID NO: 8202416 - DNA, 22 bp, Homo sapiens
acaggctgccacttgcatccaa

SEQ ID NO: 8202417 - DNA, 22 bp, Homo sapiens
acaggctgttggggtccagggt

SEQ ID NO: 8202418 - DNA, 22 bp, Homo sapiens
acaggcttacaggctgcaagta

SEQ ID NO: 8202419 - DNA, 22 bp, Homo sapiens
acaggcttacaggctgcaagta

SEQ ID NO: 8202420 - DNA, 22 bp, Homo sapiens
acaggctgttggggtccagggt

SEQ ID NO: 8202421 - DNA, 22 bp, Homo sapiens
acaggcttcagatgtattaact

SEQ ID NO: 8202422 - DNA, 22 bp, Homo sapiens
acaggcttagggcttgggcccg

SEQ ID NO: 8202423 - DNA, 22 bp, Homo sapiens
acaggcttctcacagaaaaggg

SEQ ID NO: 8202424 - DNA, 22 bp, Homo sapiens
acaggcttactgtttcataggg

SEQ ID NO: 8202425 - DNA, 18 bp, Homo sapiens
acaggcttaggaaatgtg

SEQ ID NO: 8202426 - DNA, 22 bp, Homo sapiens
acaggcttagggcaggctgacc

SEQ ID NO: 8202427 - DNA, 22 bp, Homo sapiens
acaggcttgcactagggtggca

SEQ ID NO: 8202428 - DNA, 22 bp, Homo sapiens
acaggctgagcgtccatcttca

SEQ ID NO: 8202429 - DNA, 22 bp, Homo sapiens
acaggctgacttcctgccatgt

SEQ ID NO: 8202430 - DNA, 22 bp, Homo sapiens
acaggctgacttcctgccatgt

SEQ ID NO: 8202431 - DNA, 22 bp, Homo sapiens
acaggctgaggatgattgcatc

SEQ ID NO: 8202432 - DNA, 22 bp, Homo sapiens
acaggctgagcgtccatcttca

SEQ ID NO: 8202433 - DNA, 22 bp, Homo sapiens
acaggctgagcgtccatcttca

SEQ ID NO: 8202434 - DNA, 22 bp, Homo sapiens
acaggctgaggatgattgcatc

SEQ ID NO: 8202435 - DNA, 22 bp, Homo sapiens
acaggctgaaagttaagttctg

SEQ ID NO: 8202436 - DNA, 22 bp, Homo sapiens
acaggctgacttcctgccatgt

SEQ ID NO: 8202437 - DNA, 22 bp, Homo sapiens
acaggctgacttcctgccatgt

SEQ ID NO: 8202438 - DNA, 22 bp, Homo sapiens
acaggctgacttcctgccatgt

SEQ ID NO: 8202439 - DNA, 22 bp, Homo sapiens
acaggctgacttcctgccatgt

SEQ ID NO: 8202440 - DNA, 23 bp, Homo sapiens
acaggctcttaatcagtgctcct

SEQ ID NO: 8202441 - DNA, 23 bp, Homo sapiens
acaggctcttaatcagtgctcct

SEQ ID NO: 8202442 - DNA, 22 bp, Homo sapiens
acaggctgaaagttaagttctg

SEQ ID NO: 8202443 - DNA, 22 bp, Homo sapiens
acaggctgaaagttaagttctg

SEQ ID NO: 8202444 - DNA, 22 bp, Homo sapiens
acagtgcaggtctcaacaatta

SEQ ID NO: 8202445 - DNA, 22 bp, Homo sapiens
acagtctttgcaaagtcctggt

SEQ ID NO: 8202446 - DNA, 19 bp, Homo sapiens
acagtgcatgggacctggt

SEQ ID NO: 8202447 - DNA, 20 bp, Homo sapiens
acagtgcatggggggacagc

SEQ ID NO: 8202448 - DNA, 22 bp, Homo sapiens
acagtgctaaacacttcttgaa

SEQ ID NO: 8202449 - DNA, 22 bp, Homo sapiens
acagtgctaaacacttcttgaa

SEQ ID NO: 8202450 - DNA, 22 bp, Homo sapiens
acagtgctaaacacttcttgaa

SEQ ID NO: 8202451 - DNA, 22 bp, Homo sapiens
acaggtgtagaaaacagattat

SEQ ID NO: 8202452 - DNA, 22 bp, Homo sapiens
acaggtgtagcaggagcatcaa

SEQ ID NO: 8202453 - DNA, 22 bp, Homo sapiens
acaggtgtagcaggagcatcaa

SEQ ID NO: 8202454 - DNA, 22 bp, Homo sapiens
acaggtgtagcaggagcatcaa

SEQ ID NO: 8202455 - DNA, 22 bp, Homo sapiens
acaggtgtagcaggagcatcaa

SEQ ID NO: 8202456 - DNA, 22 bp, Homo sapiens
acaggtgtaggtacatttgcat

SEQ ID NO: 8202457 - DNA, 22 bp, Homo sapiens
acaggtgtaggtacatttgcat

SEQ ID NO: 8202458 - DNA, 22 bp, Homo sapiens
acaggtgtatgaatatgttcca

SEQ ID NO: 8202459 - DNA, 22 bp, Homo sapiens
acaggtgtatgaatatgttcca

SEQ ID NO: 8202460 - DNA, 22 bp, Homo sapiens
acaggtgtaggtacatttgcat

SEQ ID NO: 8202461 - DNA, 22 bp, Homo sapiens
acaggtgattcaggctctggga

SEQ ID NO: 8202462 - DNA, 22 bp, Homo sapiens
acaggtgattcaggctctggga

SEQ ID NO: 8202463 - DNA, 22 bp, Homo sapiens
acaggtgtagaaaacagattat

SEQ ID NO: 8202464 - DNA, 22 bp, Homo sapiens
acaggtgatgacatttgaacca

SEQ ID NO: 8202465 - DNA, 22 bp, Homo sapiens
acaggtgtggggctgtggtact

SEQ ID NO: 8202466 - DNA, 22 bp, Homo sapiens
acagtctttctacattctgtgc

SEQ ID NO: 8202467 - DNA, 22 bp, Homo sapiens
acaggtgtgggctgggctctga

SEQ ID NO: 8202468 - DNA, 22 bp, Homo sapiens
acaggtgtgcggaaagctgtga

SEQ ID NO: 8202469 - DNA, 22 bp, Homo sapiens
acaggtgtgggctgggctctga

SEQ ID NO: 8202470 - DNA, 22 bp, Homo sapiens
acaggtgtgagaacatgccttg

SEQ ID NO: 8202471 - DNA, 22 bp, Homo sapiens
acaggtgtctgcaagttactgg

SEQ ID NO: 8202472 - DNA, 22 bp, Homo sapiens
acaggtgtgagaacatgccttg

SEQ ID NO: 8202473 - DNA, 22 bp, Homo sapiens
acaggtgtgcggaaagctgtga

SEQ ID NO: 8202474 - DNA, 22 bp, Homo sapiens
acaggtgtgagaacatgccttg

SEQ ID NO: 8202475 - DNA, 22 bp, Homo sapiens
acaggtgtctgcaagttactgg

SEQ ID NO: 8202476 - DNA, 22 bp, Homo sapiens
acaggtgtctaaggcagacagc

SEQ ID NO: 8202477 - DNA, 22 bp, Homo sapiens
acaggtgtctaaggcagacagc

SEQ ID NO: 8202478 - DNA, 22 bp, Homo sapiens
acaggtgtcctcacagggggtg

SEQ ID NO: 8202479 - DNA, 22 bp, Homo sapiens
acaggtgtctaaggcagacagc

SEQ ID NO: 8202480 - DNA, 22 bp, Homo sapiens
acaggtgtcctcacagggggtg

SEQ ID NO: 8202481 - DNA, 22 bp, Homo sapiens
acaggtgtccaacatttacctt

SEQ ID NO: 8202482 - DNA, 22 bp, Homo sapiens
acaggtgtccaacatttacctt

SEQ ID NO: 8202483 - DNA, 22 bp, Homo sapiens
acagtgtaatatgggagtcagt

SEQ ID NO: 8202484 - DNA, 18 bp, Homo sapiens
acagtggtttgatgtgct

SEQ ID NO: 8202485 - DNA, 22 bp, Homo sapiens
acagtggtgagtgactgatagg

SEQ ID NO: 8202486 - DNA, 22 bp, Homo sapiens
acagtggtgagtgactgatagg

SEQ ID NO: 8202487 - DNA, 18 bp, Homo sapiens
acagtgctgtcactgctt

SEQ ID NO: 8202488 - DNA, 18 bp, Homo sapiens
acagtgctgtcactgctt

SEQ ID NO: 8202489 - DNA, 22 bp, Homo sapiens
acagtgctgtctatctcactaa

SEQ ID NO: 8202490 - DNA, 20 bp, Homo sapiens
acagtgggtggggagcactg

SEQ ID NO: 8202491 - DNA, 22 bp, Homo sapiens
acagtgctaatgatgccaagat

SEQ ID NO: 8202492 - DNA, 22 bp, Homo sapiens
acagtgctatcaatagctagaa

SEQ ID NO: 8202493 - DNA, 22 bp, Homo sapiens
acagtgctcatgtgacatggtg

SEQ ID NO: 8202494 - DNA, 22 bp, Homo sapiens
acagtgctcatgtgacatggtg

SEQ ID NO: 8202495 - DNA, 22 bp, Homo sapiens
acagtgctgaacgacatggaag

SEQ ID NO: 8202496 - DNA, 22 bp, Homo sapiens
acagtgctgatctagactgacc

SEQ ID NO: 8202497 - DNA, 22 bp, Homo sapiens
acagtgctgaacgacatggaag

SEQ ID NO: 8202498 - DNA, 22 bp, Homo sapiens
acagtgctgaacgacatggaag

SEQ ID NO: 8202499 - DNA, 22 bp, Homo sapiens
acagtgctgatctagactgacc

SEQ ID NO: 8202500 - DNA, 22 bp, Homo sapiens
acagtgctggctacaaccctgg

SEQ ID NO: 8202501 - DNA, 22 bp, Homo sapiens
acagtgctggctacaaccctgg

SEQ ID NO: 8202502 - DNA, 22 bp, Homo sapiens
acagtgtaattcatggctgaaa

SEQ ID NO: 8202503 - DNA, 22 bp, Homo sapiens
acagtgtactaggtacatgttc

SEQ ID NO: 8202504 - DNA, 22 bp, Homo sapiens
acagtgtagcatggtagcaatg

SEQ ID NO: 8202505 - DNA, 22 bp, Homo sapiens
acagtgtagtgtgatgtcaaaa

SEQ ID NO: 8202506 - DNA, 22 bp, Homo sapiens
acagtgtatgatatttcacagt

SEQ ID NO: 8202507 - DNA, 22 bp, Homo sapiens
acagtgtcatcagtttctcaac

SEQ ID NO: 8202508 - DNA, 22 bp, Homo sapiens
acagtgtcatgtcgtgttcccc

SEQ ID NO: 8202509 - DNA, 22 bp, Homo sapiens
acagtgtccccagctctgtgag

SEQ ID NO: 8202510 - DNA, 22 bp, Homo sapiens
acagtgtcatgtcgtgttcccc

SEQ ID NO: 8202511 - DNA, 22 bp, Homo sapiens
acagtttacagggatttgagct

SEQ ID NO: 8202512 - DNA, 22 bp, Homo sapiens
acagtttacagggatttgagct

SEQ ID NO: 8202513 - DNA, 22 bp, Homo sapiens
acagtgtccttgtggtccctgt

SEQ ID NO: 8202514 - DNA, 22 bp, Homo sapiens
acagtgtccttgtggtccctgt

SEQ ID NO: 8202515 - DNA, 20 bp, Homo sapiens
acaggagatctgaggaaagg

SEQ ID NO: 8202516 - DNA, 22 bp, Homo sapiens
acaggagcccaggatgggcgga

SEQ ID NO: 8202517 - DNA, 22 bp, Homo sapiens
acaggagccaaacacatgccag

SEQ ID NO: 8202518 - DNA, 22 bp, Homo sapiens
acaggagcaacagactaagaca

SEQ ID NO: 8202519 - DNA, 22 bp, Homo sapiens
acaggaggagcagctgtgtgcc

SEQ ID NO: 8202520 - DNA, 22 bp, Homo sapiens
acaggaggagcagctgtgtgcc

SEQ ID NO: 8202521 - DNA, 22 bp, Homo sapiens
acaggaggagctgtttcaggga

SEQ ID NO: 8202522 - DNA, 22 bp, Homo sapiens
acaggaggagcagctgtgtgcc

SEQ ID NO: 8202523 - DNA, 22 bp, Homo sapiens
acaggagctctagggacagcac

SEQ ID NO: 8202524 - DNA, 22 bp, Homo sapiens
acaggagctctagggacagcac

SEQ ID NO: 8202525 - DNA, 22 bp, Homo sapiens
acaggaggagcagctgtgtgcc

SEQ ID NO: 8202526 - DNA, 19 bp, Homo sapiens
acaggcagaattgggtgtg

SEQ ID NO: 8202527 - DNA, 19 bp, Homo sapiens
acaggcagaattgggtgtg

SEQ ID NO: 8202528 - DNA, 19 bp, Homo sapiens
acaggcagaattgggtgtg

SEQ ID NO: 8202529 - DNA, 22 bp, Homo sapiens
acaggcagagaactcagccaga

SEQ ID NO: 8202530 - DNA, 22 bp, Homo sapiens
acaggcagagaactcagccaga

SEQ ID NO: 8202531 - DNA, 22 bp, Homo sapiens
acaggcagagaactcagccaga

SEQ ID NO: 8202532 - DNA, 22 bp, Homo sapiens
acaggcagagaactcagccaga

SEQ ID NO: 8202533 - DNA, 22 bp, Homo sapiens
acaggcagagaactcagccaga

SEQ ID NO: 8202534 - DNA, 22 bp, Homo sapiens
acaggcagagaactcagccaga

SEQ ID NO: 8202535 - DNA, 22 bp, Homo sapiens
acaggcactttgacatgccatc

SEQ ID NO: 8202536 - DNA, 22 bp, Homo sapiens
acaggcactttgacatgccatc

SEQ ID NO: 8202537 - DNA, 22 bp, Homo sapiens
acaggcactttgacatgccatc

SEQ ID NO: 8202538 - DNA, 22 bp, Homo sapiens
acaggcactgtcaagtcatgaa

SEQ ID NO: 8202539 - DNA, 22 bp, Homo sapiens
acaggcactgtcaagtcatgaa

SEQ ID NO: 8202540 - DNA, 22 bp, Homo sapiens
aagccctggacggcccttcccc

SEQ ID NO: 8202541 - DNA, 22 bp, Homo sapiens
aagccctggacggcccttcccc

SEQ ID NO: 8202542 - DNA, 22 bp, Homo sapiens
acaggctctggggcaggatggc

SEQ ID NO: 8202543 - DNA, 22 bp, Homo sapiens
acaggccagcctggggtaaggt

SEQ ID NO: 8202544 - DNA, 22 bp, Homo sapiens
acaggccagcctggggtaaggt

SEQ ID NO: 8202545 - DNA, 22 bp, Homo sapiens
acaggccagaggtggggcagcc

SEQ ID NO: 8202546 - DNA, 22 bp, Homo sapiens
acaggccagaggtggggcagcc

SEQ ID NO: 8202547 - DNA, 22 bp, Homo sapiens
acaggccagaggtggggcagcc

SEQ ID NO: 8202548 - DNA, 22 bp, Homo sapiens
aagccctgccacccattcactg

SEQ ID NO: 8202549 - DNA, 22 bp, Homo sapiens
acaggcagagagtggcggactc

SEQ ID NO: 8202550 - DNA, 22 bp, Homo sapiens
acaggcagagtcaggttgggtt

SEQ ID NO: 8202551 - DNA, 22 bp, Homo sapiens
acaggcagagaactcagccaga

SEQ ID NO: 8202552 - DNA, 22 bp, Homo sapiens
acaggcagagaactcagccaga

SEQ ID NO: 8202553 - DNA, 22 bp, Homo sapiens
acaggcagagaactcagccaga

SEQ ID NO: 8202554 - DNA, 22 bp, Homo sapiens
acaggaaagagctaggcatagg

SEQ ID NO: 8202555 - DNA, 22 bp, Homo sapiens
acaggaaagagctaggcatagg

SEQ ID NO: 8202556 - DNA, 22 bp, Homo sapiens
acagctttttactaatagattg

SEQ ID NO: 8202557 - DNA, 22 bp, Homo sapiens
acagcttttcaattctgctgag

SEQ ID NO: 8202558 - DNA, 22 bp, Homo sapiens
acagcttgctgtgccccctgcc

SEQ ID NO: 8202559 - DNA, 22 bp, Homo sapiens
acagcttgggatgctttatttc

SEQ ID NO: 8202560 - DNA, 22 bp, Homo sapiens
acagctttagtgtgggtggtgc

SEQ ID NO: 8202561 - DNA, 22 bp, Homo sapiens
acagctttgtgttaatgggaag

SEQ ID NO: 8202562 - DNA, 22 bp, Homo sapiens
acagcttttatgggaccagcca

SEQ ID NO: 8202563 - DNA, 21 bp, Homo sapiens
acaggagaccgcctggcagtc

SEQ ID NO: 8202564 - DNA, 21 bp, Homo sapiens
acaggagaccgcctggcagtc

SEQ ID NO: 8202565 - DNA, 21 bp, Homo sapiens
acaggagaccgcctggcagtc

SEQ ID NO: 8202566 - DNA, 21 bp, Homo sapiens
acaggagaccgcctggcagtc

SEQ ID NO: 8202567 - DNA, 21 bp, Homo sapiens
acaggagaccgcctggcagtc

SEQ ID NO: 8202568 - DNA, 21 bp, Homo sapiens
acaggagaccgcctggcagtc

SEQ ID NO: 8202569 - DNA, 21 bp, Homo sapiens
acaggagaccgcctggcagtc

SEQ ID NO: 8202570 - DNA, 21 bp, Homo sapiens
acaggagaccgcctggcagtc

SEQ ID NO: 8202571 - DNA, 22 bp, Homo sapiens
acaggagaccctgctggttctg

SEQ ID NO: 8202572 - DNA, 22 bp, Homo sapiens
acaggagaccctgctggttctg

SEQ ID NO: 8202573 - DNA, 22 bp, Homo sapiens
acaggaaagagctaggcatagg

SEQ ID NO: 8202574 - DNA, 22 bp, Homo sapiens
acaggaaattggcatatcagtt

SEQ ID NO: 8202575 - DNA, 22 bp, Homo sapiens
acaggaaattggcatatcagtt

SEQ ID NO: 8202576 - DNA, 22 bp, Homo sapiens
acaggaaattggcatatcagtt

SEQ ID NO: 8202577 - DNA, 22 bp, Homo sapiens
acagcaaaagacaagaacttaa

SEQ ID NO: 8202578 - DNA, 22 bp, Homo sapiens
acagatttttggtaaataattt

SEQ ID NO: 8202579 - DNA, 22 bp, Homo sapiens
acagatttttggtaaataattt

SEQ ID NO: 8202580 - DNA, 22 bp, Homo sapiens
acagatttttggtaaataattt

SEQ ID NO: 8202581 - DNA, 22 bp, Homo sapiens
acagctggcaggggggcatgaa

SEQ ID NO: 8202582 - DNA, 22 bp, Homo sapiens
acagctggagtgttggtgaggt

SEQ ID NO: 8202583 - DNA, 22 bp, Homo sapiens
acagattttaaatttgtagttg

SEQ ID NO: 8202584 - DNA, 21 bp, Homo sapiens
acagattttatatctctgctg

SEQ ID NO: 8202585 - DNA, 22 bp, Homo sapiens
acagattttaaatttgtagttg

SEQ ID NO: 8202586 - DNA, 22 bp, Homo sapiens
acagattttattattcaggtat

SEQ ID NO: 8202587 - DNA, 22 bp, Homo sapiens
acagatttttcagctcctgtgt

SEQ ID NO: 8202588 - DNA, 22 bp, Homo sapiens
acagattttggtatttgcaatg

SEQ ID NO: 8202589 - DNA, 22 bp, Homo sapiens
acagattttggtatttgcaatg

SEQ ID NO: 8202590 - DNA, 22 bp, Homo sapiens
acagatttttggtaaataattt

SEQ ID NO: 8202591 - DNA, 22 bp, Homo sapiens
acagattttggtatttgcaatg

SEQ ID NO: 8202592 - DNA, 22 bp, Homo sapiens
acagattttattattcaggtat

SEQ ID NO: 8202593 - DNA, 22 bp, Homo sapiens
acagattttattattcaggtat

SEQ ID NO: 8202594 - DNA, 22 bp, Homo sapiens
acagattttggtatttgcaatg

SEQ ID NO: 8202595 - DNA, 20 bp, Homo sapiens
acagatgaggaaaatgaagt

SEQ ID NO: 8202596 - DNA, 20 bp, Homo sapiens
acagatgaggaaaatgaagt

SEQ ID NO: 8202597 - DNA, 20 bp, Homo sapiens
acagatgaggaaaatgaagt

SEQ ID NO: 8202598 - DNA, 22 bp, Homo sapiens
acagatgaggaaacagggtcag

SEQ ID NO: 8202599 - DNA, 22 bp, Homo sapiens
acagatgaggaaacagggtcag

SEQ ID NO: 8202600 - DNA, 22 bp, Homo sapiens
acagatgaggaagagtcagcca

SEQ ID NO: 8202601 - DNA, 22 bp, Homo sapiens
acagatgaggaagagtcagcca

SEQ ID NO: 8202602 - DNA, 22 bp, Homo sapiens
acagatgaggaagagtcagcca

SEQ ID NO: 8202603 - DNA, 22 bp, Homo sapiens
acagatttaggactgtagcgat

SEQ ID NO: 8202604 - DNA, 22 bp, Homo sapiens
acagatttgactggtacctggc

SEQ ID NO: 8202605 - DNA, 22 bp, Homo sapiens
acagatttgatctgagaacaaa

SEQ ID NO: 8202606 - DNA, 22 bp, Homo sapiens
acagatttgatctgagaacaaa

SEQ ID NO: 8202607 - DNA, 22 bp, Homo sapiens
acagatttggaggcctcacccc

SEQ ID NO: 8202608 - DNA, 22 bp, Homo sapiens
acagatttgatctgagaacaaa

SEQ ID NO: 8202609 - DNA, 22 bp, Homo sapiens
acagatttattgaagctgctgc

SEQ ID NO: 8202610 - DNA, 22 bp, Homo sapiens
acagatttgactggtacctggc

SEQ ID NO: 8202611 - DNA, 22 bp, Homo sapiens
acagatttgttcttttgggcta

SEQ ID NO: 8202612 - DNA, 22 bp, Homo sapiens
acagatttggcccagccaatgc

SEQ ID NO: 8202613 - DNA, 22 bp, Homo sapiens
acagatttggcccagccaatgc

SEQ ID NO: 8202614 - DNA, 22 bp, Homo sapiens
acagattttaaatttgtagttg

SEQ ID NO: 8202615 - DNA, 22 bp, Homo sapiens
acagattttaaatgacactccc

SEQ ID NO: 8202616 - DNA, 22 bp, Homo sapiens
acagattttaaatgacactccc

SEQ ID NO: 8202617 - DNA, 22 bp, Homo sapiens
agctcaggccggagctacaggc

SEQ ID NO: 8202618 - DNA, 22 bp, Homo sapiens
agctcaggctctgcagggacta

SEQ ID NO: 8202619 - DNA, 22 bp, Homo sapiens
agctcaggccggagctacaggc

SEQ ID NO: 8202620 - DNA, 22 bp, Homo sapiens
agctcaagctacacacagagtc

SEQ ID NO: 8202621 - DNA, 22 bp, Homo sapiens
agctcaggctctgcagggacta

SEQ ID NO: 8202622 - DNA, 22 bp, Homo sapiens
agctcagggcaaagactcaaat

SEQ ID NO: 8202623 - DNA, 22 bp, Homo sapiens
agctcagggcaaagactcaaat

SEQ ID NO: 8202624 - DNA, 22 bp, Homo sapiens
agctcagggcaaagactcaaat

SEQ ID NO: 8202625 - DNA, 22 bp, Homo sapiens
agctcagggccaggcgcgtttc

SEQ ID NO: 8202626 - DNA, 22 bp, Homo sapiens
agctcagggcgatctgtctcgg

SEQ ID NO: 8202627 - DNA, 22 bp, Homo sapiens
agctcagggcgatctgtctcgg

SEQ ID NO: 8202628 - DNA, 22 bp, Homo sapiens
agctcagggccatcggcccttt

SEQ ID NO: 8202629 - DNA, 22 bp, Homo sapiens
agctcagggccatcggcccttt

SEQ ID NO: 8202630 - DNA, 22 bp, Homo sapiens
agctcagggccatcggcccttt

SEQ ID NO: 8202631 - DNA, 22 bp, Homo sapiens
agctcagggcgatctgtctcgg

SEQ ID NO: 8202632 - DNA, 22 bp, Homo sapiens
agctcagggctccaggaccgct

SEQ ID NO: 8202633 - DNA, 22 bp, Homo sapiens
agctcagggctccaggaccgct

SEQ ID NO: 8202634 - DNA, 22 bp, Homo sapiens
agctcaggtagactcagcatct

SEQ ID NO: 8202635 - DNA, 22 bp, Homo sapiens
agctcaggtagactcagcatct

SEQ ID NO: 8202636 - DNA, 22 bp, Homo sapiens
agctcaggtcattccagggatg

SEQ ID NO: 8202637 - DNA, 22 bp, Homo sapiens
agctcaggtcattccagggatg

SEQ ID NO: 8202638 - DNA, 22 bp, Homo sapiens
agctcaggtctcaggaggtgtc

SEQ ID NO: 8202639 - DNA, 22 bp, Homo sapiens
agctcaggtctcaggaggtgtc

SEQ ID NO: 8202640 - DNA, 22 bp, Homo sapiens
agctcaggtctcaggaggtgtc

SEQ ID NO: 8202641 - DNA, 22 bp, Homo sapiens
agctccagaaaggtacacacag

SEQ ID NO: 8202642 - DNA, 22 bp, Homo sapiens
agctccagaaaggtacacacag

SEQ ID NO: 8202643 - DNA, 23 bp, Homo sapiens
agctccagggaacaggcagtagg

SEQ ID NO: 8202644 - DNA, 22 bp, Homo sapiens
agctccaggtcagtgcacccct

SEQ ID NO: 8202645 - DNA, 22 bp, Homo sapiens
agctccaggtagtgccttatcg

SEQ ID NO: 8202646 - DNA, 22 bp, Homo sapiens
agctccaggtcagtgcacccct

SEQ ID NO: 8202647 - DNA, 23 bp, Homo sapiens
agctccaggtgattgtaatgtgt

SEQ ID NO: 8202648 - DNA, 22 bp, Homo sapiens
agctccaggtcagtgcacccct

SEQ ID NO: 8202649 - DNA, 22 bp, Homo sapiens
agcctgttctccctccagacac

SEQ ID NO: 8202650 - DNA, 22 bp, Homo sapiens
agcctgtgtgctttggacaggg

SEQ ID NO: 8202651 - DNA, 22 bp, Homo sapiens
agcctgtgtgctttggacaggg

SEQ ID NO: 8202652 - DNA, 22 bp, Homo sapiens
agccttacataaacagccttat

SEQ ID NO: 8202653 - DNA, 21 bp, Homo sapiens
agcctgttggtttactgctca

SEQ ID NO: 8202654 - DNA, 21 bp, Homo sapiens
agcctgttggtttactgctca

SEQ ID NO: 8202655 - DNA, 22 bp, Homo sapiens
agcctgtgtcctcatctgcagc

SEQ ID NO: 8202656 - DNA, 22 bp, Homo sapiens
agcctgtgtgctttggacaggg

SEQ ID NO: 8202657 - DNA, 22 bp, Homo sapiens
agcctgtgtgaagccctcagag

SEQ ID NO: 8202658 - DNA, 22 bp, Homo sapiens
agcctgtgtcctcatctgcagc

SEQ ID NO: 8202659 - DNA, 22 bp, Homo sapiens
agcctgtgacattgactatgaa

SEQ ID NO: 8202660 - DNA, 22 bp, Homo sapiens
agcctgtgagggatgctgcagt

SEQ ID NO: 8202661 - DNA, 22 bp, Homo sapiens
agcctggcttaatcctcctttt

SEQ ID NO: 8202662 - DNA, 22 bp, Homo sapiens
agcctgtgaaatctctgccact

SEQ ID NO: 8202663 - DNA, 22 bp, Homo sapiens
agcctggcttaatcctcctttt

SEQ ID NO: 8202664 - DNA, 22 bp, Homo sapiens
agcctgtctgtctccaaagctg

SEQ ID NO: 8202665 - DNA, 22 bp, Homo sapiens
agcctgtctgtctccaaagctg

SEQ ID NO: 8202666 - DNA, 22 bp, Homo sapiens
agcctggctgggaagagcctct

SEQ ID NO: 8202667 - DNA, 22 bp, Homo sapiens
agcctggctgggaagagcctct

SEQ ID NO: 8202668 - DNA, 22 bp, Homo sapiens
agcctggctgggaagagcctct

SEQ ID NO: 8202669 - DNA, 22 bp, Homo sapiens
agcctggctgtaacctcatggt

SEQ ID NO: 8202670 - DNA, 22 bp, Homo sapiens
agcctggctgtaacctcatggt

SEQ ID NO: 8202671 - DNA, 22 bp, Homo sapiens
agcctggctgggaagagcctct

SEQ ID NO: 8202672 - DNA, 22 bp, Homo sapiens
agcctggctaaattctcccatg

SEQ ID NO: 8202673 - DNA, 22 bp, Homo sapiens
agccctgggttagggtgggagc

SEQ ID NO: 8202674 - DNA, 22 bp, Homo sapiens
agccctgggttagggtgggagc

SEQ ID NO: 8202675 - DNA, 22 bp, Homo sapiens
agccctgggtcccagtcctggc

SEQ ID NO: 8202676 - DNA, 22 bp, Homo sapiens
agccctgggtcccagtcctggc

SEQ ID NO: 8202677 - DNA, 22 bp, Homo sapiens
agccctgggtcccagtcctggc

SEQ ID NO: 8202678 - DNA, 22 bp, Homo sapiens
agccctggggtgcagaaccatg

SEQ ID NO: 8202679 - DNA, 22 bp, Homo sapiens
agccctggggctggtgcttacc

SEQ ID NO: 8202680 - DNA, 22 bp, Homo sapiens
agccctggtagcctgctgccat

SEQ ID NO: 8202681 - DNA, 22 bp, Homo sapiens
agccctggtttgcagcatttgc

SEQ ID NO: 8202682 - DNA, 22 bp, Homo sapiens
agccctggtagcctgctgccat

SEQ ID NO: 8202683 - DNA, 22 bp, Homo sapiens
agccctggtttgcagcatttgc

SEQ ID NO: 8202684 - DNA, 22 bp, Homo sapiens
agccctggtttgcagcatttgc

SEQ ID NO: 8202685 - DNA, 22 bp, Homo sapiens
agcctgctgggaagggaggctt

SEQ ID NO: 8202686 - DNA, 22 bp, Homo sapiens
agcctggccaggcctgcccagg

SEQ ID NO: 8202687 - DNA, 22 bp, Homo sapiens
agcctggccaggcctgcccagg

SEQ ID NO: 8202688 - DNA, 22 bp, Homo sapiens
agcctggccaggcctgcccagg

SEQ ID NO: 8202689 - DNA, 22 bp, Homo sapiens
agcctggccctgctgaactctg

SEQ ID NO: 8202690 - DNA, 22 bp, Homo sapiens
agcctggccctgctgaactctg

SEQ ID NO: 8202691 - DNA, 22 bp, Homo sapiens
agcctggccctgctgaactctg

SEQ ID NO: 8202692 - DNA, 22 bp, Homo sapiens
agcctggccctgctgaactctg

SEQ ID NO: 8202693 - DNA, 21 bp, Homo sapiens
agcctggcccagggggaggct

SEQ ID NO: 8202694 - DNA, 22 bp, Homo sapiens
agcctggcctgggcaggcacat

SEQ ID NO: 8202695 - DNA, 22 bp, Homo sapiens
agcctggcctgggcaggcacat

SEQ ID NO: 8202696 - DNA, 22 bp, Homo sapiens
agcctggcctgggcaggcacat

SEQ ID NO: 8202697 - DNA, 22 bp, Homo sapiens
agcctggcctgggcaggcacat

SEQ ID NO: 8202698 - DNA, 22 bp, Homo sapiens
agccctgcatagaagggaacac

SEQ ID NO: 8202699 - DNA, 22 bp, Homo sapiens
agccctgcatagaagggaacac

SEQ ID NO: 8202700 - DNA, 22 bp, Homo sapiens
agccctgccattctctggagct

SEQ ID NO: 8202701 - DNA, 22 bp, Homo sapiens
agccctgccattctctggagct

SEQ ID NO: 8202702 - DNA, 22 bp, Homo sapiens
agccctgccctgccatgtggca

SEQ ID NO: 8202703 - DNA, 22 bp, Homo sapiens
agccctgccctgccatgtggca

SEQ ID NO: 8202704 - DNA, 22 bp, Homo sapiens
agccctgccctgccatgtggca

SEQ ID NO: 8202705 - DNA, 22 bp, Homo sapiens
agccctgcctctccaatgccca

SEQ ID NO: 8202706 - DNA, 22 bp, Homo sapiens
agccctgcctctccaatgccca

SEQ ID NO: 8202707 - DNA, 22 bp, Homo sapiens
agccctgcctctccaatgccca

SEQ ID NO: 8202708 - DNA, 16 bp, Homo sapiens
agccctgccgtgtact

SEQ ID NO: 8202709 - DNA, 16 bp, Homo sapiens
agccctgccgtgtact

SEQ ID NO: 8202710 - DNA, 22 bp, Homo sapiens
agccctggggctggtgcttacc

SEQ ID NO: 8202711 - DNA, 22 bp, Homo sapiens
agccctggggctggtgcttacc

SEQ ID NO: 8202712 - DNA, 22 bp, Homo sapiens
agccctggggctggtcttggaa

SEQ ID NO: 8202713 - DNA, 22 bp, Homo sapiens
agccctggggctggtcttggaa

SEQ ID NO: 8202714 - DNA, 22 bp, Homo sapiens
agccctgcgctcacgttctgca

SEQ ID NO: 8202715 - DNA, 22 bp, Homo sapiens
agccctggggctggtcttggaa

SEQ ID NO: 8202716 - DNA, 22 bp, Homo sapiens
agccctgcgtgccaggggactg

SEQ ID NO: 8202717 - DNA, 22 bp, Homo sapiens
agccctgcgtgccaggggactg

SEQ ID NO: 8202718 - DNA, 22 bp, Homo sapiens
agccctgcgctcacgttctgca

SEQ ID NO: 8202719 - DNA, 22 bp, Homo sapiens
agccctgcgatcgtgatttctt

SEQ ID NO: 8202720 - DNA, 22 bp, Homo sapiens
agccctgcgatcgtgatttctt

SEQ ID NO: 8202721 - DNA, 22 bp, Homo sapiens
agccctgcacagttcgggagga

SEQ ID NO: 8202722 - DNA, 22 bp, Homo sapiens
agccctgcacagttcgggagga

SEQ ID NO: 8202723 - DNA, 22 bp, Homo sapiens
agccctgcaggaggtgggagag

SEQ ID NO: 8202724 - DNA, 22 bp, Homo sapiens
agccctgcaggaggtgggagag

SEQ ID NO: 8202725 - DNA, 22 bp, Homo sapiens
agccctgcataaatcagttggt

SEQ ID NO: 8202726 - DNA, 22 bp, Homo sapiens
agccctgcataaatcagttggt

SEQ ID NO: 8202727 - DNA, 22 bp, Homo sapiens
agccctgcaggatgagggaggt

SEQ ID NO: 8202728 - DNA, 22 bp, Homo sapiens
agccctgcaggatgagggaggt

SEQ ID NO: 8202729 - DNA, 22 bp, Homo sapiens
agccctgcacaggtctgtggct

SEQ ID NO: 8202730 - DNA, 22 bp, Homo sapiens
agccctgcacaggtctgtggct

SEQ ID NO: 8202731 - DNA, 22 bp, Homo sapiens
agccctgcacaggtctgtggct

SEQ ID NO: 8202732 - DNA, 22 bp, Homo sapiens
agcccctgtttttccagtcaga

SEQ ID NO: 8202733 - DNA, 22 bp, Homo sapiens
agcccctgtcctctctgatgac

SEQ ID NO: 8202734 - DNA, 22 bp, Homo sapiens
agccaggctactccttgctgac

SEQ ID NO: 8202735 - DNA, 22 bp, Homo sapiens
agccaggctactccttgctgac

SEQ ID NO: 8202736 - DNA, 22 bp, Homo sapiens
agccaggctaaatgagccatga

SEQ ID NO: 8202737 - DNA, 22 bp, Homo sapiens
agccaggcgggtctttgctcct

SEQ ID NO: 8202738 - DNA, 22 bp, Homo sapiens
agccaggctaaatgagccatga

SEQ ID NO: 8202739 - DNA, 22 bp, Homo sapiens
agccaggctaaatgagccatga

SEQ ID NO: 8202740 - DNA, 22 bp, Homo sapiens
agccaggctcaaggcctgctcc

SEQ ID NO: 8202741 - DNA, 20 bp, Homo sapiens
agccaggctcaagctccccc

SEQ ID NO: 8202742 - DNA, 20 bp, Homo sapiens
agccaggctcaagctccccc

SEQ ID NO: 8202743 - DNA, 22 bp, Homo sapiens
agccaggctactccttgctgac

SEQ ID NO: 8202744 - DNA, 22 bp, Homo sapiens
agccaggctactccttgctgac

SEQ ID NO: 8202745 - DNA, 22 bp, Homo sapiens
agcatttaagggtggatacagg

SEQ ID NO: 8202746 - DNA, 22 bp, Homo sapiens
agcatttaagcttctgcaaagc

SEQ ID NO: 8202747 - DNA, 22 bp, Homo sapiens
agcatttaagggtggatacagg

SEQ ID NO: 8202748 - DNA, 22 bp, Homo sapiens
agcatttaatcctacatagatc

SEQ ID NO: 8202749 - DNA, 22 bp, Homo sapiens
agcatttaatcctacatagatc

SEQ ID NO: 8202750 - DNA, 22 bp, Homo sapiens
agcatttaatcctacatagatc

SEQ ID NO: 8202751 - DNA, 22 bp, Homo sapiens
agcatttaagcttctgcaaagc

SEQ ID NO: 8202752 - DNA, 22 bp, Homo sapiens
agcattgcctgcctattgctaa

SEQ ID NO: 8202753 - DNA, 22 bp, Homo sapiens
agcattgctaaagctaattttt

SEQ ID NO: 8202754 - DNA, 22 bp, Homo sapiens
agccaggcggggcaggtttcct

SEQ ID NO: 8202755 - DNA, 22 bp, Homo sapiens
agccaggcggggcaggtttcct

SEQ ID NO: 8202756 - DNA, 22 bp, Homo sapiens
agccaggcgcagtggcttatgc

SEQ ID NO: 8202757 - DNA, 22 bp, Homo sapiens
agcatttaattacagtttaatt

SEQ ID NO: 8202758 - DNA, 22 bp, Homo sapiens
agccaggaatgcatgctctgct

SEQ ID NO: 8202759 - DNA, 22 bp, Homo sapiens
agcattctcagaatgtcatttt

SEQ ID NO: 8202760 - DNA, 23 bp, Homo sapiens
agcattctctccaacatttaaca

SEQ ID NO: 8202761 - DNA, 23 bp, Homo sapiens
agcattctctccaacatttaaca

SEQ ID NO: 8202762 - DNA, 22 bp, Homo sapiens
agcattctgtggtcttctatgg

SEQ ID NO: 8202763 - DNA, 22 bp, Homo sapiens
agcattgaggtgggtttctctt

SEQ ID NO: 8202764 - DNA, 22 bp, Homo sapiens
agcattccacactgaagtctgc

SEQ ID NO: 8202765 - DNA, 20 bp, Homo sapiens
agcattctactagacttttc

SEQ ID NO: 8202766 - DNA, 18 bp, Homo sapiens
agcattcggtagtggtag

SEQ ID NO: 8202767 - DNA, 22 bp, Homo sapiens
agcattcatgatgacaacagga

SEQ ID NO: 8202768 - DNA, 22 bp, Homo sapiens
agcattccacactgaagtctgc

SEQ ID NO: 8202769 - DNA, 22 bp, Homo sapiens
agcatctggtgagggcctagtt

SEQ ID NO: 8202770 - DNA, 22 bp, Homo sapiens
agcatcttcaacaggcatttta

SEQ ID NO: 8202771 - DNA, 22 bp, Homo sapiens
acagacatcatcaacatcttcc

SEQ ID NO: 8202772 - DNA, 22 bp, Homo sapiens
acagacatcatcaacatcttcc

SEQ ID NO: 8202773 - DNA, 22 bp, Homo sapiens
acagacagtatggtggggctga

SEQ ID NO: 8202774 - DNA, 21 bp, Homo sapiens
acagacagtccagagaaaaga

SEQ ID NO: 8202775 - DNA, 21 bp, Homo sapiens
acagacagtccagagaaaaga

SEQ ID NO: 8202776 - DNA, 22 bp, Homo sapiens
acagacatatttggcccatagc

SEQ ID NO: 8202777 - DNA, 22 bp, Homo sapiens
acagacagtatggtggggctga

SEQ ID NO: 8202778 - DNA, 22 bp, Homo sapiens
acagacagtaaatagtgtggct

SEQ ID NO: 8202779 - DNA, 22 bp, Homo sapiens
acagacagtaaatagtgtggct

SEQ ID NO: 8202780 - DNA, 22 bp, Homo sapiens
acagacagtaaatagtgtggct

SEQ ID NO: 8202781 - DNA, 21 bp, Homo sapiens
acagacagggccagtgtcccc

SEQ ID NO: 8202782 - DNA, 21 bp, Homo sapiens
acagacagggccagtgtcccc

SEQ ID NO: 8202783 - DNA, 22 bp, Homo sapiens
acagacagtaaatagtgtggct

SEQ ID NO: 8202784 - DNA, 22 bp, Homo sapiens
acagacagtaaatagtgtggct

SEQ ID NO: 8202785 - DNA, 22 bp, Homo sapiens
agcccaggtctggcccagcctg

SEQ ID NO: 8202786 - DNA, 22 bp, Homo sapiens
agcccaggtctggcccagcctg

SEQ ID NO: 8202787 - DNA, 22 bp, Homo sapiens
agcccaggtctcaaagtacagg

SEQ ID NO: 8202788 - DNA, 22 bp, Homo sapiens
agcccaggtctcaaagtacagg

SEQ ID NO: 8202789 - DNA, 22 bp, Homo sapiens
agcccaggtggagtgtgtgggg

SEQ ID NO: 8202790 - DNA, 22 bp, Homo sapiens
agcccaggtggagtgtgtgggg

SEQ ID NO: 8202791 - DNA, 21 bp, Homo sapiens
acagacagggccagtgtcccc

SEQ ID NO: 8202792 - DNA, 22 bp, Homo sapiens
agcccaggtggagtgtgtgggg

SEQ ID NO: 8202793 - DNA, 22 bp, Homo sapiens
agcccaggtgactcatacaccc

SEQ ID NO: 8202794 - DNA, 22 bp, Homo sapiens
agcccaggtgactcatacaccc

SEQ ID NO: 8202795 - DNA, 22 bp, Homo sapiens
agcccaggtgaggggttcgaaa

SEQ ID NO: 8202796 - DNA, 22 bp, Homo sapiens
agcccaggtgaggggttcgaaa

SEQ ID NO: 8202797 - DNA, 22 bp, Homo sapiens
agcccaggtggagtgtgtgggg

SEQ ID NO: 8202798 - DNA, 18 bp, Homo sapiens
acagaactcaggggcacc

SEQ ID NO: 8202799 - DNA, 22 bp, Homo sapiens
acagaacatggatttttgaagt

SEQ ID NO: 8202800 - DNA, 22 bp, Homo sapiens
agcccagctttcacccctctgg

SEQ ID NO: 8202801 - DNA, 22 bp, Homo sapiens
agcccaggtccagttcactgca

SEQ ID NO: 8202802 - DNA, 22 bp, Homo sapiens
agcccaggtctcaaagtacagg

SEQ ID NO: 8202803 - DNA, 22 bp, Homo sapiens
agcccaggtccagttcactgca

SEQ ID NO: 8202804 - DNA, 22 bp, Homo sapiens
agcccaggtccagttcactgca

SEQ ID NO: 8202805 - DNA, 22 bp, Homo sapiens
agcccaggtccagttcactgca

SEQ ID NO: 8202806 - DNA, 22 bp, Homo sapiens
agcccagggctaataggaacca

SEQ ID NO: 8202807 - DNA, 22 bp, Homo sapiens
agcccagggctaataggaacca

SEQ ID NO: 8202808 - DNA, 22 bp, Homo sapiens
agcccagggctaataggaacca

SEQ ID NO: 8202809 - DNA, 22 bp, Homo sapiens
agcccagggctaataggaacca

SEQ ID NO: 8202810 - DNA, 22 bp, Homo sapiens
agcccagggagttgattagcat

SEQ ID NO: 8202811 - DNA, 22 bp, Homo sapiens
agcactttgtgcatttctgaag

SEQ ID NO: 8202812 - DNA, 22 bp, Homo sapiens
agcactttgggagataaagctg

SEQ ID NO: 8202813 - DNA, 22 bp, Homo sapiens
agcactttcctggcaaatgtgg

SEQ ID NO: 8202814 - DNA, 22 bp, Homo sapiens
agcactttgagcagatgaagga

SEQ ID NO: 8202815 - DNA, 22 bp, Homo sapiens
agcactttattcaggaactcca

SEQ ID NO: 8202816 - DNA, 22 bp, Homo sapiens
agcactttagaatttagagttg

SEQ ID NO: 8202817 - DNA, 22 bp, Homo sapiens
agcacttgtagactagaatttt

SEQ ID NO: 8202818 - DNA, 22 bp, Homo sapiens
agcagaaaattggaaatgacaa

SEQ ID NO: 8202819 - DNA, 22 bp, Homo sapiens
agcagaaaattggaaatgacaa

SEQ ID NO: 8202820 - DNA, 22 bp, Homo sapiens
acacactgctcatgaggagcat

SEQ ID NO: 8202821 - DNA, 22 bp, Homo sapiens
acacactgctcatgaggagcat

SEQ ID NO: 8202822 - DNA, 22 bp, Homo sapiens
acacactgctcatgaggagcat

SEQ ID NO: 8202823 - DNA, 22 bp, Homo sapiens
acacactgagtgccataggacc

SEQ ID NO: 8202824 - DNA, 21 bp, Homo sapiens
acacactgagttttccactgt

SEQ ID NO: 8202825 - DNA, 22 bp, Homo sapiens
acacactggaggtaaatggggt

SEQ ID NO: 8202826 - DNA, 22 bp, Homo sapiens
acacactggcaggagctataaa

SEQ ID NO: 8202827 - DNA, 22 bp, Homo sapiens
acacactcaattgcataagcac

SEQ ID NO: 8202828 - DNA, 22 bp, Homo sapiens
acacactcaattgcataagcac

SEQ ID NO: 8202829 - DNA, 21 bp, Homo sapiens
acacactctgagtcttctatt

SEQ ID NO: 8202830 - DNA, 22 bp, Homo sapiens
acacactgaattttgtggaaac

SEQ ID NO: 8202831 - DNA, 22 bp, Homo sapiens
acacactgagtgccataggacc

SEQ ID NO: 8202832 - DNA, 22 bp, Homo sapiens
acacactgaattttgtggaaac

SEQ ID NO: 8202833 - DNA, 19 bp, Homo sapiens
acacaccagtgcctgtgac

SEQ ID NO: 8202834 - DNA, 22 bp, Homo sapiens
acacaccatgatttatttaccc

SEQ ID NO: 8202835 - DNA, 22 bp, Homo sapiens
acacaccatgatttatttaccc

SEQ ID NO: 8202836 - DNA, 22 bp, Homo sapiens
acacactcaattgcataagcac

SEQ ID NO: 8202837 - DNA, 22 bp, Homo sapiens
acacacgtgctcaacacgctcc

SEQ ID NO: 8202838 - DNA, 22 bp, Homo sapiens
acacacgtgctcaacacgctcc

SEQ ID NO: 8202839 - DNA, 22 bp, Homo sapiens
acacacgtatatatacgtatgt

SEQ ID NO: 8202840 - DNA, 22 bp, Homo sapiens
agatttgaaacttgcttcataa

SEQ ID NO: 8202841 - DNA, 22 bp, Homo sapiens
agatttctgtggtcatgtaatg

SEQ ID NO: 8202842 - DNA, 22 bp, Homo sapiens
agatttgagttttctatccttg

SEQ ID NO: 8202843 - DNA, 22 bp, Homo sapiens
agatttgcggctttactttgca

SEQ ID NO: 8202844 - DNA, 22 bp, Homo sapiens
agatttctctttccctggctga

SEQ ID NO: 8202845 - DNA, 22 bp, Homo sapiens
agatttctgggcttcaccacct

SEQ ID NO: 8202846 - DNA, 22 bp, Homo sapiens
agatttctgtcaccttctatgc

SEQ ID NO: 8202847 - DNA, 18 bp, Homo sapiens
agattttgagaaatacaa

SEQ ID NO: 8202848 - DNA, 22 bp, Homo sapiens
acacacagaaggaagccccact

SEQ ID NO: 8202849 - DNA, 22 bp, Homo sapiens
agattttatagataatttccca

SEQ ID NO: 8202850 - DNA, 22 bp, Homo sapiens
agattttagtttggggaggtgc

SEQ ID NO: 8202851 - DNA, 22 bp, Homo sapiens
agattttagtgtagaggacttg

SEQ ID NO: 8202852 - DNA, 21 bp, Homo sapiens
agatttgtcccttcccattta

SEQ ID NO: 8202853 - DNA, 22 bp, Homo sapiens
agatttgttgtgagcaggaata

SEQ ID NO: 8202854 - DNA, 22 bp, Homo sapiens
acacacatggtattgttcagaa

SEQ ID NO: 8202855 - DNA, 22 bp, Homo sapiens
acacacatggtattgttcagaa

SEQ ID NO: 8202856 - DNA, 22 bp, Homo sapiens
acacacatggtattgttcagaa

SEQ ID NO: 8202857 - DNA, 22 bp, Homo sapiens
acacacatgcctttcctaagta

SEQ ID NO: 8202858 - DNA, 22 bp, Homo sapiens
acacacatggtattgttcagaa

SEQ ID NO: 8202859 - DNA, 22 bp, Homo sapiens
acacacatggtattgttcagaa

SEQ ID NO: 8202860 - DNA, 22 bp, Homo sapiens
acacacagaaggaagccccact

SEQ ID NO: 8202861 - DNA, 22 bp, Homo sapiens
acacacagaaggaagccccact

SEQ ID NO: 8202862 - DNA, 22 bp, Homo sapiens
acacacagaaggaagccccact

SEQ ID NO: 8202863 - DNA, 22 bp, Homo sapiens
acacacatgcctttcctaagta

SEQ ID NO: 8202864 - DNA, 22 bp, Homo sapiens
agcagccagagtctgaacatta

SEQ ID NO: 8202865 - DNA, 23 bp, Homo sapiens
agcagccagagatcctcggccct

SEQ ID NO: 8202866 - DNA, 16 bp, Homo sapiens
agcagccagcactgga

SEQ ID NO: 8202867 - DNA, 22 bp, Homo sapiens
agcagccaggaatctgcagagc

SEQ ID NO: 8202868 - DNA, 22 bp, Homo sapiens
agcagccaggaatctgcagagc

SEQ ID NO: 8202869 - DNA, 22 bp, Homo sapiens
agcagccaggaatctgcagagc

SEQ ID NO: 8202870 - DNA, 22 bp, Homo sapiens
agcagccagtgggagtgataca

SEQ ID NO: 8202871 - DNA, 22 bp, Homo sapiens
agcagccaggaatctgcagagc

SEQ ID NO: 8202872 - DNA, 22 bp, Homo sapiens
agcagcatagaagctgggagga

SEQ ID NO: 8202873 - DNA, 22 bp, Homo sapiens
agcagcagttgctgacgttcta

SEQ ID NO: 8202874 - DNA, 23 bp, Homo sapiens
acacagaagaagacccaaggaag

SEQ ID NO: 8202875 - DNA, 22 bp, Homo sapiens
acacagaacctcatagcctctc

SEQ ID NO: 8202876 - DNA, 22 bp, Homo sapiens
acacagaacctcatagcctctc

SEQ ID NO: 8202877 - DNA, 23 bp, Homo sapiens
acacagaagaagacccaaggaag

SEQ ID NO: 8202878 - DNA, 22 bp, Homo sapiens
acacacttttgctaaaaattgt

SEQ ID NO: 8202879 - DNA, 22 bp, Homo sapiens
acacacttttgctaaaaattgt

SEQ ID NO: 8202880 - DNA, 22 bp, Homo sapiens
acacacttcagatgtaatttgt

SEQ ID NO: 8202881 - DNA, 22 bp, Homo sapiens
acacactgttgctcatccaggc

SEQ ID NO: 8202882 - DNA, 22 bp, Homo sapiens
acacactgtaaggactatcact

SEQ ID NO: 8202883 - DNA, 22 bp, Homo sapiens
agcagcagctcattcttcctgt

SEQ ID NO: 8202884 - DNA, 22 bp, Homo sapiens
agcagcagctcattcttcctgt

SEQ ID NO: 8202885 - DNA, 22 bp, Homo sapiens
agcagcagctcagttctcagct

SEQ ID NO: 8202886 - DNA, 22 bp, Homo sapiens
agcagcagctcattcttcctgt

SEQ ID NO: 8202887 - DNA, 22 bp, Homo sapiens
acacactggcccccagtactga

SEQ ID NO: 8202888 - DNA, 22 bp, Homo sapiens
acacactgtaaggactatcact

SEQ ID NO: 8202889 - DNA, 22 bp, Homo sapiens
acacactgtaaggactatcact

SEQ ID NO: 8202890 - DNA, 22 bp, Homo sapiens
acacactgggcatggtttatgc

SEQ ID NO: 8202891 - DNA, 22 bp, Homo sapiens
agcagcagattatggtctacat

SEQ ID NO: 8202892 - DNA, 22 bp, Homo sapiens
agcagcagattatggtctacat

SEQ ID NO: 8202893 - DNA, 22 bp, Homo sapiens
agcagcagattcagcaggaatg

SEQ ID NO: 8202894 - DNA, 22 bp, Homo sapiens
agcagcagattatggtctacat

SEQ ID NO: 8202895 - DNA, 22 bp, Homo sapiens
agcagcagattcagcaggaatg

SEQ ID NO: 8202896 - DNA, 22 bp, Homo sapiens
agcagcagattcagcaggaatg

SEQ ID NO: 8202897 - DNA, 22 bp, Homo sapiens
agcagcagattcagcaggaatg

SEQ ID NO: 8202898 - DNA, 22 bp, Homo sapiens
agcagaaccacagcactgttga

SEQ ID NO: 8202899 - DNA, 22 bp, Homo sapiens
agcagaacattttcagggctgt

SEQ ID NO: 8202900 - DNA, 21 bp, Homo sapiens
agcagaacagtcgagcactgc

SEQ ID NO: 8202901 - DNA, 19 bp, Homo sapiens
agcagcagcaccagggatt

SEQ ID NO: 8202902 - DNA, 19 bp, Homo sapiens
agcagcagcaccagggatt

SEQ ID NO: 8202903 - DNA, 23 bp, Homo sapiens
agcagcagcaattaagtggatat

SEQ ID NO: 8202904 - DNA, 23 bp, Homo sapiens
agcagcagcaattaagtggatat

SEQ ID NO: 8202905 - DNA, 23 bp, Homo sapiens
agcagcagcaattaagtggatat

SEQ ID NO: 8202906 - DNA, 23 bp, Homo sapiens
agcagcagcaattaagtggatat

SEQ ID NO: 8202907 - DNA, 21 bp, Homo sapiens
agcagcagcagtggggcttct

SEQ ID NO: 8202908 - DNA, 19 bp, Homo sapiens
agcagcagcaccagggatt

SEQ ID NO: 8202909 - DNA, 19 bp, Homo sapiens
agcagcagcaccagggatt

SEQ ID NO: 8202910 - DNA, 19 bp, Homo sapiens
agcagcagcaccagggatt

SEQ ID NO: 8202911 - DNA, 22 bp, Homo sapiens
agcagcagctcagttctcagct

SEQ ID NO: 8202912 - DNA, 22 bp, Homo sapiens
agcagcagctcagttctcagct

SEQ ID NO: 8202913 - DNA, 22 bp, Homo sapiens
agcagcagctcagttctcagct

SEQ ID NO: 8202914 - DNA, 19 bp, Homo sapiens
agcagcagctaccacttgt

SEQ ID NO: 8202915 - DNA, 22 bp, Homo sapiens
agcagcagccgtagccttatta

SEQ ID NO: 8202916 - DNA, 22 bp, Homo sapiens
agcagcagcattgagcgcttgt

SEQ ID NO: 8202917 - DNA, 22 bp, Homo sapiens
agcagcagccgtagccttatta

SEQ ID NO: 8202918 - DNA, 22 bp, Homo sapiens
agcagcagcattgagcgcttgt

SEQ ID NO: 8202919 - DNA, 21 bp, Homo sapiens
agcagcagcagtggggcttct

SEQ ID NO: 8202920 - DNA, 21 bp, Homo sapiens
agcaggaggcagtcacagctc

SEQ ID NO: 8202921 - DNA, 22 bp, Homo sapiens
agcaggaggagagcctggcggt

SEQ ID NO: 8202922 - DNA, 22 bp, Homo sapiens
agcaggagctgtgggaagatgg

SEQ ID NO: 8202923 - DNA, 22 bp, Homo sapiens
agcaggagctgtgggaagatgg

SEQ ID NO: 8202924 - DNA, 22 bp, Homo sapiens
agcaggagctgtgggaagatgg

SEQ ID NO: 8202925 - DNA, 22 bp, Homo sapiens
agcaggaacgagttcatgggga

SEQ ID NO: 8202926 - DNA, 22 bp, Homo sapiens
agcaggaacgagttcatgggga

SEQ ID NO: 8202927 - DNA, 22 bp, Homo sapiens
agcaggagcccttatcaccagg

SEQ ID NO: 8202928 - DNA, 22 bp, Homo sapiens
agcaggagcccttatcaccagg

SEQ ID NO: 8202929 - DNA, 22 bp, Homo sapiens
agcagctgagccccagctgtga

SEQ ID NO: 8202930 - DNA, 22 bp, Homo sapiens
agcagctgagatggtaagattc

SEQ ID NO: 8202931 - DNA, 22 bp, Homo sapiens
agcagctgagatggtaagattc

SEQ ID NO: 8202932 - DNA, 22 bp, Homo sapiens
agcagctgagatggtaagattc

SEQ ID NO: 8202933 - DNA, 22 bp, Homo sapiens
agcaggagggttttgtagagtc

SEQ ID NO: 8202934 - DNA, 22 bp, Homo sapiens
agcaggagggttttgtagagtc

SEQ ID NO: 8202935 - DNA, 22 bp, Homo sapiens
agcaggagggttttgtagagtc

SEQ ID NO: 8202936 - DNA, 22 bp, Homo sapiens
agcaggagggttttgtagagtc

SEQ ID NO: 8202937 - DNA, 22 bp, Homo sapiens
agcaggagggttttgtagagtc

SEQ ID NO: 8202938 - DNA, 21 bp, Homo sapiens
agcaggaggcagtcacagctc

SEQ ID NO: 8202939 - DNA, 19 bp, Homo sapiens
agcaggcaggtggcccagg

SEQ ID NO: 8202940 - DNA, 22 bp, Homo sapiens
agcaggcaggctgccagtgaat

SEQ ID NO: 8202941 - DNA, 22 bp, Homo sapiens
agcaggcaggctgccagtgaat

SEQ ID NO: 8202942 - DNA, 22 bp, Homo sapiens
agcaggagtgtcccctggctgt

SEQ ID NO: 8202943 - DNA, 22 bp, Homo sapiens
agcaggcaggctgccagtgaat

SEQ ID NO: 8202944 - DNA, 22 bp, Homo sapiens
agcaggagggttttgtagagtc

SEQ ID NO: 8202945 - DNA, 22 bp, Homo sapiens
agcaggagggttttgtagagtc

SEQ ID NO: 8202946 - DNA, 22 bp, Homo sapiens
agcaggagtgtcccctggctgt

SEQ ID NO: 8202947 - DNA, 22 bp, Homo sapiens
agcaggagggttttgtagagtc

SEQ ID NO: 8202948 - DNA, 22 bp, Homo sapiens
agcagccatagatagcatgcaa

SEQ ID NO: 8202949 - DNA, 22 bp, Homo sapiens
agcagccatagatagcatgcaa

SEQ ID NO: 8202950 - DNA, 22 bp, Homo sapiens
agcagccatagatagcatgcaa

SEQ ID NO: 8202951 - DNA, 22 bp, Homo sapiens
agcagccagttctctgtggtag

SEQ ID NO: 8202952 - DNA, 21 bp, Homo sapiens
agcagccatttcacagagact

SEQ ID NO: 8202953 - DNA, 21 bp, Homo sapiens
agcagccatttcacagagact

SEQ ID NO: 8202954 - DNA, 22 bp, Homo sapiens
agcagcccaaacagactaagac

SEQ ID NO: 8202955 - DNA, 21 bp, Homo sapiens
agcagccatttcacagagact

SEQ ID NO: 8202956 - DNA, 22 bp, Homo sapiens
agcagctcctgccatgagtgct

SEQ ID NO: 8202957 - DNA, 22 bp, Homo sapiens
agcagctcctctaggaacggat

SEQ ID NO: 8202958 - DNA, 21 bp, Homo sapiens
agcagccatggatggtatgta

SEQ ID NO: 8202959 - DNA, 19 bp, Homo sapiens
agcagccatcgaccatgga

SEQ ID NO: 8202960 - DNA, 19 bp, Homo sapiens
agcagccatcgaccatgga

SEQ ID NO: 8202961 - DNA, 17 bp, Homo sapiens
agcagctgaagcagcca

SEQ ID NO: 8202962 - DNA, 22 bp, Homo sapiens
agcagctgaaaggcaaacttct

SEQ ID NO: 8202963 - DNA, 17 bp, Homo sapiens
agcagctgaagcagcca

SEQ ID NO: 8202964 - DNA, 22 bp, Homo sapiens
agcagctgaccagtgagtcctg

SEQ ID NO: 8202965 - DNA, 22 bp, Homo sapiens
agcagctgaccagtgagtcctg

SEQ ID NO: 8202966 - DNA, 22 bp, Homo sapiens
agcagctgaccagtgagtcctg

SEQ ID NO: 8202967 - DNA, 22 bp, Homo sapiens
agcagctgaccagtgagtcctg

SEQ ID NO: 8202968 - DNA, 22 bp, Homo sapiens
agcagctcctgccatgagtgct

SEQ ID NO: 8202969 - DNA, 22 bp, Homo sapiens
agcagctcggccagtcaccagg

SEQ ID NO: 8202970 - DNA, 22 bp, Homo sapiens
agcagctcgggctacagagggg

SEQ ID NO: 8202971 - DNA, 22 bp, Homo sapiens
agcagctctgtttacctggagg

SEQ ID NO: 8202972 - DNA, 22 bp, Homo sapiens
agcagctctggcactgtagcat

SEQ ID NO: 8202973 - DNA, 22 bp, Homo sapiens
agcagctctggcactgtagcat

SEQ ID NO: 8202974 - DNA, 22 bp, Homo sapiens
agcagggcctctggcactggtc

SEQ ID NO: 8202975 - DNA, 19 bp, Homo sapiens
agcaggccacagggccagc

SEQ ID NO: 8202976 - DNA, 19 bp, Homo sapiens
agcaggccacagggccagc

SEQ ID NO: 8202977 - DNA, 19 bp, Homo sapiens
agcaggccacagggccagc

SEQ ID NO: 8202978 - DNA, 23 bp, Homo sapiens
agcaggcatctgtggcacaaggc

SEQ ID NO: 8202979 - DNA, 22 bp, Homo sapiens
agcaggcatagagtagcactca

SEQ ID NO: 8202980 - DNA, 22 bp, Homo sapiens
agcaggcagtgtagagccttca

SEQ ID NO: 8202981 - DNA, 23 bp, Homo sapiens
agcaggcatctgtggcacaaggc

SEQ ID NO: 8202982 - DNA, 22 bp, Homo sapiens
agcaggcatagagtagcactca

SEQ ID NO: 8202983 - DNA, 22 bp, Homo sapiens
agcaggcatagagtagcactca

SEQ ID NO: 8202984 - DNA, 19 bp, Homo sapiens
agcaggcaggtggcccagg

SEQ ID NO: 8202985 - DNA, 19 bp, Homo sapiens
agcaggcaggtggcccagg

SEQ ID NO: 8202986 - DNA, 21 bp, Homo sapiens
agcaggcagtgggctggattt

SEQ ID NO: 8202987 - DNA, 21 bp, Homo sapiens
agcaggcagtgggctggattt

SEQ ID NO: 8202988 - DNA, 22 bp, Homo sapiens
agcaggcagtgtagagccttca

SEQ ID NO: 8202989 - DNA, 22 bp, Homo sapiens
agcagggcctctggcactggtc

SEQ ID NO: 8202990 - DNA, 22 bp, Homo sapiens
agcagggctgtgtaggtaatga

SEQ ID NO: 8202991 - DNA, 22 bp, Homo sapiens
agcagggctgtgctccttccga

SEQ ID NO: 8202992 - DNA, 22 bp, Homo sapiens
agcagggcttctgtgcctgtgc

SEQ ID NO: 8202993 - DNA, 22 bp, Homo sapiens
agcagggcttctgtgcctgtgc

SEQ ID NO: 8202994 - DNA, 22 bp, Homo sapiens
agcagggctgtgtaggtaatga

SEQ ID NO: 8202995 - DNA, 22 bp, Homo sapiens
agcagggcttctgtgcctgtgc

SEQ ID NO: 8202996 - DNA, 22 bp, Homo sapiens
agcagggctgtgtaggtaatga

SEQ ID NO: 8202997 - DNA, 22 bp, Homo sapiens
agcagggctgtgtaggtaatga

SEQ ID NO: 8202998 - DNA, 22 bp, Homo sapiens
agcagggctttgcagacttggg

SEQ ID NO: 8202999 - DNA, 22 bp, Homo sapiens
agcagggctttgcagacttggg

SEQ ID NO: 8203000 - DNA, 22 bp, Homo sapiens
agcagggctttggctggctttc

SEQ ID NO: 8203001 - DNA, 22 bp, Homo sapiens
agcagggcttgccgcttgtcct

SEQ ID NO: 8203002 - DNA, 22 bp, Homo sapiens
agcagggcttgccgcttgtcct

SEQ ID NO: 8203003 - DNA, 22 bp, Homo sapiens
agcagggcttgccgcttgtcct

SEQ ID NO: 8203004 - DNA, 22 bp, Homo sapiens
agcagggcttgccgcttgtcct

SEQ ID NO: 8203005 - DNA, 22 bp, Homo sapiens
agcagggcttctgtgcctgtgc

SEQ ID NO: 8203006 - DNA, 22 bp, Homo sapiens
agcaggtgacccaagcaggctg

SEQ ID NO: 8203007 - DNA, 22 bp, Homo sapiens
agcaggtgacagggctgtggtg

SEQ ID NO: 8203008 - DNA, 22 bp, Homo sapiens
agcaggtgacagggctgtggtg

SEQ ID NO: 8203009 - DNA, 22 bp, Homo sapiens
agcaggtgacagggctgtggtg

SEQ ID NO: 8203010 - DNA, 22 bp, Homo sapiens
agcaggtgacagggctgtggtg

SEQ ID NO: 8203011 - DNA, 22 bp, Homo sapiens
agcaggtgaattcctggatgtg

SEQ ID NO: 8203012 - DNA, 22 bp, Homo sapiens
agcaggtgacccaagcaggctg

SEQ ID NO: 8203013 - DNA, 22 bp, Homo sapiens
agcaggtgacccaagcaggctg

SEQ ID NO: 8203014 - DNA, 20 bp, Homo sapiens
agcaggtgacggggcctgct

SEQ ID NO: 8203015 - DNA, 22 bp, Homo sapiens
agcagggctttgtctctgtgaa

SEQ ID NO: 8203016 - DNA, 22 bp, Homo sapiens
agcagggctttgtctctgtgaa

SEQ ID NO: 8203017 - DNA, 22 bp, Homo sapiens
agcagggctttgtctctgtgaa

SEQ ID NO: 8203018 - DNA, 22 bp, Homo sapiens
agcaggtgaattcctggatgtg

SEQ ID NO: 8203019 - DNA, 22 bp, Homo sapiens
agcaggtgaattcctggatgtg

SEQ ID NO: 8203020 - DNA, 22 bp, Homo sapiens
agcaggtgaattcctggatgtg

SEQ ID NO: 8203021 - DNA, 21 bp, Homo sapiens
agcaggtgaacctccagtaca

SEQ ID NO: 8203022 - DNA, 21 bp, Homo sapiens
agcaggtgaacctccagtaca

SEQ ID NO: 8203023 - DNA, 22 bp, Homo sapiens
agcaggtcttgctctcaacagg

SEQ ID NO: 8203024 - DNA, 21 bp, Homo sapiens
agcaggtgaacctccagtaca

SEQ ID NO: 8203025 - DNA, 22 bp, Homo sapiens
agcaggtcttgctctcaacagg

SEQ ID NO: 8203026 - DNA, 19 bp, Homo sapiens
agcatccagtcatgggatc

SEQ ID NO: 8203027 - DNA, 22 bp, Homo sapiens
agcatccagcatcctatagaaa

SEQ ID NO: 8203028 - DNA, 22 bp, Homo sapiens
agcatccagatgcctgatgtca

SEQ ID NO: 8203029 - DNA, 22 bp, Homo sapiens
agcatcagcctctgtcctggag

SEQ ID NO: 8203030 - DNA, 22 bp, Homo sapiens
agcatccaacaggagggaaggg

SEQ ID NO: 8203031 - DNA, 22 bp, Homo sapiens
agcatccactcactgggagagg

SEQ ID NO: 8203032 - DNA, 22 bp, Homo sapiens
agcaggtgagcacagccaggct

SEQ ID NO: 8203033 - DNA, 22 bp, Homo sapiens
agcaggtgagcacagccaggct

SEQ ID NO: 8203034 - DNA, 22 bp, Homo sapiens
agcaggtgagcacagccaggct

SEQ ID NO: 8203035 - DNA, 20 bp, Homo sapiens
agcaggtgacggggcctgct

SEQ ID NO: 8203036 - DNA, 20 bp, Homo sapiens
agcaggtgacggggcctgct

SEQ ID NO: 8203037 - DNA, 20 bp, Homo sapiens
agcaggtgacggggcctgct

SEQ ID NO: 8203038 - DNA, 23 bp, Homo sapiens
agcagttagggatacaagttatc

SEQ ID NO: 8203039 - DNA, 20 bp, Homo sapiens
agaggttcagtctggagaag

SEQ ID NO: 8203040 - DNA, 22 bp, Homo sapiens
agaggttgggtctgaggtgaga

SEQ ID NO: 8203041 - DNA, 22 bp, Homo sapiens
agaggttgggtctgaggtgaga

SEQ ID NO: 8203042 - DNA, 22 bp, Homo sapiens
agaggttgggtctgaggtgaga

SEQ ID NO: 8203043 - DNA, 22 bp, Homo sapiens
agaggtttcttaggggcttcct

SEQ ID NO: 8203044 - DNA, 22 bp, Homo sapiens
agaggttgttagaatagtggag

SEQ ID NO: 8203045 - DNA, 22 bp, Homo sapiens
agaggttgttagaatagtggag

SEQ ID NO: 8203046 - DNA, 22 bp, Homo sapiens
agaggtttcttaggggcttcct

SEQ ID NO: 8203047 - DNA, 22 bp, Homo sapiens
agaggtgggagcctggtcacat

SEQ ID NO: 8203048 - DNA, 22 bp, Homo sapiens
agaggtggccatgggcgctgga

SEQ ID NO: 8203049 - DNA, 22 bp, Homo sapiens
agaggtggccatgggcgctgga

SEQ ID NO: 8203050 - DNA, 22 bp, Homo sapiens
agaggtggccatgggcgctgga

SEQ ID NO: 8203051 - DNA, 22 bp, Homo sapiens
agaggtggccatgggcgctgga

SEQ ID NO: 8203052 - DNA, 22 bp, Homo sapiens
agaggtggccatgggcgctgga

SEQ ID NO: 8203053 - DNA, 23 bp, Homo sapiens
agaggtgtagtgtctcatctact

SEQ ID NO: 8203054 - DNA, 22 bp, Homo sapiens
agaggtgggagcctggtcacat

SEQ ID NO: 8203055 - DNA, 22 bp, Homo sapiens
agaggtgggagcctggtcacat

SEQ ID NO: 8203056 - DNA, 22 bp, Homo sapiens
agaggtgtggccaggactcaag

SEQ ID NO: 8203057 - DNA, 22 bp, Homo sapiens
agaggtgtggccaggactcaag

SEQ ID NO: 8203058 - DNA, 22 bp, Homo sapiens
aattttgttttagtggaggctg

SEQ ID NO: 8203059 - DNA, 22 bp, Homo sapiens
aattttgttttagtggaggctg

SEQ ID NO: 8203060 - DNA, 22 bp, Homo sapiens
aattttgtttaagtgatctgct

SEQ ID NO: 8203061 - DNA, 22 bp, Homo sapiens
aattttgtttaagtgatctgct

SEQ ID NO: 8203062 - DNA, 22 bp, Homo sapiens
aattttgttcttggaaatcagg

SEQ ID NO: 8203063 - DNA, 22 bp, Homo sapiens
aattttgttcttggaaatcagg

SEQ ID NO: 8203064 - DNA, 22 bp, Homo sapiens
aattttgttcttggaaatcagg

SEQ ID NO: 8203065 - DNA, 22 bp, Homo sapiens
acaaaaaccgtggattcagcat

SEQ ID NO: 8203066 - DNA, 22 bp, Homo sapiens
acaaaaaccgtggattcagcat

SEQ ID NO: 8203067 - DNA, 22 bp, Homo sapiens
acaaaaaccgtggattcagcat

SEQ ID NO: 8203068 - DNA, 22 bp, Homo sapiens
agagggtaacaagaggcctgga

SEQ ID NO: 8203069 - DNA, 22 bp, Homo sapiens
agagggtaacaagaggcctgga

SEQ ID NO: 8203070 - DNA, 22 bp, Homo sapiens
acaaaaagctccattactgtcc

SEQ ID NO: 8203071 - DNA, 22 bp, Homo sapiens
agaggggttaagtgctagtccg

SEQ ID NO: 8203072 - DNA, 22 bp, Homo sapiens
agagtgaaggttgacacttcac

SEQ ID NO: 8203073 - DNA, 22 bp, Homo sapiens
agataatgttctgatccatttc

SEQ ID NO: 8203074 - DNA, 22 bp, Homo sapiens
agatataataatttacaagtgt

SEQ ID NO: 8203075 - DNA, 22 bp, Homo sapiens
agatatacacccatatcacata

SEQ ID NO: 8203076 - DNA, 22 bp, Homo sapiens
agatataataatttacaagtgt

SEQ ID NO: 8203077 - DNA, 22 bp, Homo sapiens
agatataataatttacaagtgt

SEQ ID NO: 8203078 - DNA, 22 bp, Homo sapiens
agatataataatttacaagtgt

SEQ ID NO: 8203079 - DNA, 22 bp, Homo sapiens
agatataataatttacaagtgt

SEQ ID NO: 8203080 - DNA, 22 bp, Homo sapiens
agagtgaaaagctagagcagta

SEQ ID NO: 8203081 - DNA, 22 bp, Homo sapiens
agagtcttccaggcagcctgag

SEQ ID NO: 8203082 - DNA, 22 bp, Homo sapiens
agagtctgtgctttcatcagga

SEQ ID NO: 8203083 - DNA, 22 bp, Homo sapiens
agagtctgttacttgtccccta

SEQ ID NO: 8203084 - DNA, 21 bp, Homo sapiens
agagtctgcatttctgacaag

SEQ ID NO: 8203085 - DNA, 22 bp, Homo sapiens
agagtactgcctcagttatgaa

SEQ ID NO: 8203086 - DNA, 22 bp, Homo sapiens
agagtactgcctcagttatgaa

SEQ ID NO: 8203087 - DNA, 22 bp, Homo sapiens
agagtctggaagcgcttctaaa

SEQ ID NO: 8203088 - DNA, 22 bp, Homo sapiens
agagtctgcctttttctcctgc

SEQ ID NO: 8203089 - DNA, 21 bp, Homo sapiens
agagtctgcatttctgacaag

SEQ ID NO: 8203090 - DNA, 19 bp, Homo sapiens
agagtctgtgctcttccta

SEQ ID NO: 8203091 - DNA, 22 bp, Homo sapiens
agagtctgggcactgggaatgc

SEQ ID NO: 8203092 - DNA, 22 bp, Homo sapiens
agagtctgtgagtccctgagca

SEQ ID NO: 8203093 - DNA, 22 bp, Homo sapiens
agattacagaagaataagtaga

SEQ ID NO: 8203094 - DNA, 22 bp, Homo sapiens
agattacagcatgggaatggga

SEQ ID NO: 8203095 - DNA, 22 bp, Homo sapiens
agattacagcatgggaatggga

SEQ ID NO: 8203096 - DNA, 22 bp, Homo sapiens
agattacagaagaataagtaga

SEQ ID NO: 8203097 - DNA, 22 bp, Homo sapiens
agattatttccagactaatgaa

SEQ ID NO: 8203098 - DNA, 22 bp, Homo sapiens
agattcagaaatgaggagggcc

SEQ ID NO: 8203099 - DNA, 21 bp, Homo sapiens
agattcaggacagcagtcact

SEQ ID NO: 8203100 - DNA, 20 bp, Homo sapiens
agattattcctaagatttct

SEQ ID NO: 8203101 - DNA, 20 bp, Homo sapiens
agattattcctaagatttct

SEQ ID NO: 8203102 - DNA, 22 bp, Homo sapiens
agattatgctggctgctacaag

SEQ ID NO: 8203103 - DNA, 22 bp, Homo sapiens
agattatctcctgattttaagg

SEQ ID NO: 8203104 - DNA, 22 bp, Homo sapiens
agatggtaatcacatttatctg

SEQ ID NO: 8203105 - DNA, 22 bp, Homo sapiens
agatggtaatcacatttatctg

SEQ ID NO: 8203106 - DNA, 22 bp, Homo sapiens
agatgtttgtgttatctccatt

SEQ ID NO: 8203107 - DNA, 21 bp, Homo sapiens
agattaaaatctgtgagaagg

SEQ ID NO: 8203108 - DNA, 20 bp, Homo sapiens
agatctgcctgcaccctctc

SEQ ID NO: 8203109 - DNA, 23 bp, Homo sapiens
agatctgatgttaccaagaattg

SEQ ID NO: 8203110 - DNA, 16 bp, Homo sapiens
agatgggtgggtcact

SEQ ID NO: 8203111 - DNA, 20 bp, Homo sapiens
agatgggttaaagctatggg

SEQ ID NO: 8203112 - DNA, 22 bp, Homo sapiens
agatcttatttagctttaatca

SEQ ID NO: 8203113 - DNA, 18 bp, Homo sapiens
agatatggagggggtggg

SEQ ID NO: 8203114 - DNA, 22 bp, Homo sapiens
agatatgtccctgtctaatatt

SEQ ID NO: 8203115 - DNA, 22 bp, Homo sapiens
agatatgtccctgtctaatatt

SEQ ID NO: 8203116 - DNA, 22 bp, Homo sapiens
agatatctgatgaaaatactct

SEQ ID NO: 8203117 - DNA, 22 bp, Homo sapiens
agatatcttacactttgaagtt

SEQ ID NO: 8203118 - DNA, 22 bp, Homo sapiens
agatatatttaaggtaataagt

SEQ ID NO: 8203119 - DNA, 22 bp, Homo sapiens
agatatatttaaggtaataagt

SEQ ID NO: 8203120 - DNA, 22 bp, Homo sapiens
agatatatttaaggtaataagt

SEQ ID NO: 8203121 - DNA, 22 bp, Homo sapiens
agatatcaccagttttacatac

SEQ ID NO: 8203122 - DNA, 22 bp, Homo sapiens
agatatacagagaattattcac

SEQ ID NO: 8203123 - DNA, 22 bp, Homo sapiens
agatatacacccatatcacata

SEQ ID NO: 8203124 - DNA, 22 bp, Homo sapiens
agatatatttaaggtaataagt

SEQ ID NO: 8203125 - DNA, 22 bp, Homo sapiens
agatatatttaaggtaataagt

SEQ ID NO: 8203126 - DNA, 22 bp, Homo sapiens
agatatgtttgtatatatttgt

SEQ ID NO: 8203127 - DNA, 22 bp, Homo sapiens
agatatgtttgtatatatttgt

SEQ ID NO: 8203128 - DNA, 22 bp, Homo sapiens
agatatgtttgtatatatttgt

SEQ ID NO: 8203129 - DNA, 23 bp, Homo sapiens
agatccatgtgggctggaaactg

SEQ ID NO: 8203130 - DNA, 22 bp, Homo sapiens
agatccatgtgatttggagttc

SEQ ID NO: 8203131 - DNA, 22 bp, Homo sapiens
agatcccaaatcacctgcttat

SEQ ID NO: 8203132 - DNA, 22 bp, Homo sapiens
agatccagttaatagcttcatt

SEQ ID NO: 8203133 - DNA, 22 bp, Homo sapiens
agatcctgccaatggaagcagg

SEQ ID NO: 8203134 - DNA, 21 bp, Homo sapiens
agatcctggggtctggggagg

SEQ ID NO: 8203135 - DNA, 21 bp, Homo sapiens
agatcctggggtctggggagg

SEQ ID NO: 8203136 - DNA, 22 bp, Homo sapiens
agatctgagtggctgcatgtaa

SEQ ID NO: 8203137 - DNA, 22 bp, Homo sapiens
agatctgacctaaccccaccac

SEQ ID NO: 8203138 - DNA, 22 bp, Homo sapiens
agatctgagtatgatttgcctg

SEQ ID NO: 8203139 - DNA, 22 bp, Homo sapiens
agatcggctttgcagacctcat

SEQ ID NO: 8203140 - DNA, 22 bp, Homo sapiens
aattcagtggtttctgcaacaa

SEQ ID NO: 8203141 - DNA, 22 bp, Homo sapiens
aattcagttgtgtctgacctcg

SEQ ID NO: 8203142 - DNA, 22 bp, Homo sapiens
aattcagagacatgaagtgaca

SEQ ID NO: 8203143 - DNA, 22 bp, Homo sapiens
agagcagctgacagcctgccat

SEQ ID NO: 8203144 - DNA, 22 bp, Homo sapiens
agagcagctgacagcctgccat

SEQ ID NO: 8203145 - DNA, 22 bp, Homo sapiens
agagcagctgacagcctgccat

SEQ ID NO: 8203146 - DNA, 22 bp, Homo sapiens
agagcagctgacagcctgccat

SEQ ID NO: 8203147 - DNA, 22 bp, Homo sapiens
agagcagctgcattcagcacct

SEQ ID NO: 8203148 - DNA, 22 bp, Homo sapiens
agagcagcgtttgtggaacact

SEQ ID NO: 8203149 - DNA, 18 bp, Homo sapiens
agagcagcggcatcacac

SEQ ID NO: 8203150 - DNA, 22 bp, Homo sapiens
agagcagctcgctacctctcta

SEQ ID NO: 8203151 - DNA, 22 bp, Homo sapiens
agaggcaacatggggaacagat

SEQ ID NO: 8203152 - DNA, 22 bp, Homo sapiens
agaggcaactgatttctgccag

SEQ ID NO: 8203153 - DNA, 22 bp, Homo sapiens
agaggcaacatggggaacagat

SEQ ID NO: 8203154 - DNA, 22 bp, Homo sapiens
agaggcaacatggggaacagat

SEQ ID NO: 8203155 - DNA, 22 bp, Homo sapiens
agagcaggcataaagctttgaa

SEQ ID NO: 8203156 - DNA, 22 bp, Homo sapiens
agagcaggcataaagctttgaa

SEQ ID NO: 8203157 - DNA, 22 bp, Homo sapiens
agagcaggggcaatgtgttgca

SEQ ID NO: 8203158 - DNA, 22 bp, Homo sapiens
agagcagctgtgacatggacag

SEQ ID NO: 8203159 - DNA, 22 bp, Homo sapiens
agagcagcttttcggaaccact

SEQ ID NO: 8203160 - DNA, 22 bp, Homo sapiens
agagcagctgtgacatggacag

SEQ ID NO: 8203161 - DNA, 22 bp, Homo sapiens
agagcagctgtgacatggacag

SEQ ID NO: 8203162 - DNA, 22 bp, Homo sapiens
agagcagctggggcagagacca

SEQ ID NO: 8203163 - DNA, 22 bp, Homo sapiens
agagcagctggggcagagacca

SEQ ID NO: 8203164 - DNA, 22 bp, Homo sapiens
agagcagctgtgacatggacag

SEQ ID NO: 8203165 - DNA, 22 bp, Homo sapiens
agagcagctggggcagagacca

SEQ ID NO: 8203166 - DNA, 22 bp, Homo sapiens
agagcagctggggcagagacca

SEQ ID NO: 8203167 - DNA, 22 bp, Homo sapiens
agaggccaagccagactgtgca

SEQ ID NO: 8203168 - DNA, 22 bp, Homo sapiens
agaggccaagccagactgtgca

SEQ ID NO: 8203169 - DNA, 23 bp, Homo sapiens
agaggccaacttcttgcccctcc

SEQ ID NO: 8203170 - DNA, 22 bp, Homo sapiens
agaggcatgcacagatgtgctg

SEQ ID NO: 8203171 - DNA, 22 bp, Homo sapiens
agaggcatgcacagatgtgctg

SEQ ID NO: 8203172 - DNA, 22 bp, Homo sapiens
agaggccaaagaatctacaaga

SEQ ID NO: 8203173 - DNA, 22 bp, Homo sapiens
agaggcatgcacagatgtgctg

SEQ ID NO: 8203174 - DNA, 21 bp, Homo sapiens
agaggcaggcattaagtacac

SEQ ID NO: 8203175 - DNA, 19 bp, Homo sapiens
agaggcagtctccaacagg

SEQ ID NO: 8203176 - DNA, 19 bp, Homo sapiens
agaggcagtctccaacagg

SEQ ID NO: 8203177 - DNA, 22 bp, Homo sapiens
aatttcaaagctcactggcata

SEQ ID NO: 8203178 - DNA, 22 bp, Homo sapiens
aatttcaagtcttgaagaagta

SEQ ID NO: 8203179 - DNA, 22 bp, Homo sapiens
aatttcaaactcttgccctcag

SEQ ID NO: 8203180 - DNA, 22 bp, Homo sapiens
aatttatttcctgccagtacac

SEQ ID NO: 8203181 - DNA, 22 bp, Homo sapiens
aatttatttcctgccagtacac

SEQ ID NO: 8203182 - DNA, 22 bp, Homo sapiens
aatttcaagtggcatctttgat

SEQ ID NO: 8203183 - DNA, 22 bp, Homo sapiens
agaggcttggcctcagttctgt

SEQ ID NO: 8203184 - DNA, 22 bp, Homo sapiens
aatttatttcctgccagtacac

SEQ ID NO: 8203185 - DNA, 22 bp, Homo sapiens
aatttatttcctgccagtacac

SEQ ID NO: 8203186 - DNA, 22 bp, Homo sapiens
aatttatttcctgccagtacac

SEQ ID NO: 8203187 - DNA, 22 bp, Homo sapiens
aatttatttcctgccagtacac

SEQ ID NO: 8203188 - DNA, 22 bp, Homo sapiens
aatttattcccgtctctgggct

SEQ ID NO: 8203189 - DNA, 22 bp, Homo sapiens
aatttattcccgtctctgggct

SEQ ID NO: 8203190 - DNA, 22 bp, Homo sapiens
aatttattcccgtctctgggct

SEQ ID NO: 8203191 - DNA, 22 bp, Homo sapiens
aatttattcccgtctctgggct

SEQ ID NO: 8203192 - DNA, 22 bp, Homo sapiens
aatttattcccgtctctgggct

SEQ ID NO: 8203193 - DNA, 22 bp, Homo sapiens
aatttattatatcctaggggaa

SEQ ID NO: 8203194 - DNA, 22 bp, Homo sapiens
aatttattatatcctaggggaa

SEQ ID NO: 8203195 - DNA, 22 bp, Homo sapiens
aatttattatatcctaggggaa

SEQ ID NO: 8203196 - DNA, 22 bp, Homo sapiens
aatttattatatcctaggggaa

SEQ ID NO: 8203197 - DNA, 22 bp, Homo sapiens
agaggccacaccagcctcccgt

SEQ ID NO: 8203198 - DNA, 22 bp, Homo sapiens
agaggccaatagtaggtggcat

SEQ ID NO: 8203199 - DNA, 22 bp, Homo sapiens
agaggccaatagtaggtggcat

SEQ ID NO: 8203200 - DNA, 22 bp, Homo sapiens
agaggccaatagtaggtggcat

SEQ ID NO: 8203201 - DNA, 22 bp, Homo sapiens
agagggcattaactctgtcttg

SEQ ID NO: 8203202 - DNA, 22 bp, Homo sapiens
agagggcccatgttgggctgct

SEQ ID NO: 8203203 - DNA, 22 bp, Homo sapiens
agagggccataggtgcatagtt

SEQ ID NO: 8203204 - DNA, 22 bp, Homo sapiens
agagggcatgcttggtggcctg

SEQ ID NO: 8203205 - DNA, 22 bp, Homo sapiens
agagggcatgcttggtggcctg

SEQ ID NO: 8203206 - DNA, 22 bp, Homo sapiens
agagggcataaaatagagcacg

SEQ ID NO: 8203207 - DNA, 22 bp, Homo sapiens
agagggcataaaatagagcacg

SEQ ID NO: 8203208 - DNA, 22 bp, Homo sapiens
agagggcataaaatagagcacg

SEQ ID NO: 8203209 - DNA, 22 bp, Homo sapiens
agagggcataaaatagagcacg

SEQ ID NO: 8203210 - DNA, 22 bp, Homo sapiens
agagggcccatgttgggctgct

SEQ ID NO: 8203211 - DNA, 22 bp, Homo sapiens
agagggcccatgttgggctgct

SEQ ID NO: 8203212 - DNA, 22 bp, Homo sapiens
agagggctaactgggaagcagg

SEQ ID NO: 8203213 - DNA, 22 bp, Homo sapiens
agagggctaaggtttgggagat

SEQ ID NO: 8203214 - DNA, 22 bp, Homo sapiens
agagggctaactgggaagcagg

SEQ ID NO: 8203215 - DNA, 22 bp, Homo sapiens
agagggctgctgcacagtgctc

SEQ ID NO: 8203216 - DNA, 22 bp, Homo sapiens
agagggctgcctcagtcagcta

SEQ ID NO: 8203217 - DNA, 22 bp, Homo sapiens
aattttctggtgtgtaatgaag

SEQ ID NO: 8203218 - DNA, 22 bp, Homo sapiens
agagggctggacgcaggttgga

SEQ ID NO: 8203219 - DNA, 17 bp, Homo sapiens
agagggctcaaggcatc

SEQ ID NO: 8203220 - DNA, 17 bp, Homo sapiens
agagggctcaaggcatc

SEQ ID NO: 8203221 - DNA, 21 bp, Homo sapiens
aattttgaaggaagattaagg

SEQ ID NO: 8203222 - DNA, 22 bp, Homo sapiens
aattttgtgtgggatcaaagga

SEQ ID NO: 8203223 - DNA, 22 bp, Homo sapiens
aattttgtgtgggatcaaagga

SEQ ID NO: 8203224 - DNA, 22 bp, Homo sapiens
aattttgttcttggaaatcagg

SEQ ID NO: 8203225 - DNA, 22 bp, Homo sapiens
aattttgtgtgggatcaaagga

SEQ ID NO: 8203226 - DNA, 22 bp, Homo sapiens
aatgtagaatgatccttaggat

SEQ ID NO: 8203227 - DNA, 22 bp, Homo sapiens
aatgtagatgagatattttttg

SEQ ID NO: 8203228 - DNA, 22 bp, Homo sapiens
aatgtataaagtgttaataact

SEQ ID NO: 8203229 - DNA, 22 bp, Homo sapiens
aatgtataaagtgttaataact

SEQ ID NO: 8203230 - DNA, 22 bp, Homo sapiens
aatgtataaagtgttaataact

SEQ ID NO: 8203231 - DNA, 22 bp, Homo sapiens
aatgtataaagtgttaataact

SEQ ID NO: 8203232 - DNA, 22 bp, Homo sapiens
aatgtacactgaaagcctatca

SEQ ID NO: 8203233 - DNA, 22 bp, Homo sapiens
aatgtacagctgctgctgaagg

SEQ ID NO: 8203234 - DNA, 22 bp, Homo sapiens
aatgtacagctgtctttcctcc

SEQ ID NO: 8203235 - DNA, 22 bp, Homo sapiens
aatgtacaggctggctatgggg

SEQ ID NO: 8203236 - DNA, 22 bp, Homo sapiens
aatgtacatctcagtgtagtac

SEQ ID NO: 8203237 - DNA, 22 bp, Homo sapiens
aatgtaaacagcaagagaaggg

SEQ ID NO: 8203238 - DNA, 22 bp, Homo sapiens
aatgtacaccgtgggtttttta

SEQ ID NO: 8203239 - DNA, 22 bp, Homo sapiens
aatgtacactgaaagcctatca

SEQ ID NO: 8203240 - DNA, 22 bp, Homo sapiens
aatgtacactgaaagcctatca

SEQ ID NO: 8203241 - DNA, 23 bp, Homo sapiens
agacaaaagcctcagtcttaggc

SEQ ID NO: 8203242 - DNA, 22 bp, Homo sapiens
agaattgtaagcaatttgatta

SEQ ID NO: 8203243 - DNA, 22 bp, Homo sapiens
agaatcttgggcaaattcatct

SEQ ID NO: 8203244 - DNA, 23 bp, Homo sapiens
agaatttcaaagtccagcacatt

SEQ ID NO: 8203245 - DNA, 22 bp, Homo sapiens
agaatttaggcttgtctgctgt

SEQ ID NO: 8203246 - DNA, 22 bp, Homo sapiens
agaatttagctccttggtcata

SEQ ID NO: 8203247 - DNA, 22 bp, Homo sapiens
agaatttaggatgcatgtgaat

SEQ ID NO: 8203248 - DNA, 19 bp, Homo sapiens
agaatctaaattatttctg

SEQ ID NO: 8203249 - DNA, 22 bp, Homo sapiens
agaatccttgactcaggctgag

SEQ ID NO: 8203250 - DNA, 22 bp, Homo sapiens
agaatcctggccaggtcagagc

SEQ ID NO: 8203251 - DNA, 20 bp, Homo sapiens
agaatctgacccagagagac

SEQ ID NO: 8203252 - DNA, 22 bp, Homo sapiens
aatgctttgagggaagatgaaa

SEQ ID NO: 8203253 - DNA, 22 bp, Homo sapiens
aatgctttggggttggtactgt

SEQ ID NO: 8203254 - DNA, 22 bp, Homo sapiens
aatgaaaattggaccctagaac

SEQ ID NO: 8203255 - DNA, 22 bp, Homo sapiens
aatgaaacatatttaggaataa

SEQ ID NO: 8203256 - DNA, 23 bp, Homo sapiens
aatgctggaaattcaggcatgat

SEQ ID NO: 8203257 - DNA, 22 bp, Homo sapiens
aatgctgtaatgaacgtgagag

SEQ ID NO: 8203258 - DNA, 22 bp, Homo sapiens
aatgctgtaaagatgctatctg

SEQ ID NO: 8203259 - DNA, 22 bp, Homo sapiens
aatgcttttgctgtcattgctt

SEQ ID NO: 8203260 - DNA, 21 bp, Homo sapiens
aatggaagtttaaaggtatcc

SEQ ID NO: 8203261 - DNA, 18 bp, Homo sapiens
aatggaaggggtgctgtt

SEQ ID NO: 8203262 - DNA, 22 bp, Homo sapiens
aatgctttttgcgaaatgtgca

SEQ ID NO: 8203263 - DNA, 19 bp, Homo sapiens
aatggacaggcaatagtct

SEQ ID NO: 8203264 - DNA, 22 bp, Homo sapiens
aatggaatacctaggtggccca

SEQ ID NO: 8203265 - DNA, 22 bp, Homo sapiens
aatggaatacctaggtggccca

SEQ ID NO: 8203266 - DNA, 22 bp, Homo sapiens
agaataaatgttggacttagga

SEQ ID NO: 8203267 - DNA, 22 bp, Homo sapiens
agaataaatgttggacttagga

SEQ ID NO: 8203268 - DNA, 22 bp, Homo sapiens
agaataaatgttggacttagga

SEQ ID NO: 8203269 - DNA, 22 bp, Homo sapiens
agaataatactgaaatgctgaa

SEQ ID NO: 8203270 - DNA, 22 bp, Homo sapiens
agaataatactgaaatgctgaa

SEQ ID NO: 8203271 - DNA, 22 bp, Homo sapiens
agaataatcactgaagttcaaa

SEQ ID NO: 8203272 - DNA, 22 bp, Homo sapiens
agaatcattagagagaaaactt

SEQ ID NO: 8203273 - DNA, 19 bp, Homo sapiens
agaatcatcttgaagtgat

SEQ ID NO: 8203274 - DNA, 22 bp, Homo sapiens
agaatcagtgctggctattagc

SEQ ID NO: 8203275 - DNA, 22 bp, Homo sapiens
agaataaaatagtctgaagatg

SEQ ID NO: 8203276 - DNA, 22 bp, Homo sapiens
agaataaaatagtctgaagatg

SEQ ID NO: 8203277 - DNA, 22 bp, Homo sapiens
agaataaaatagtctgaagatg

SEQ ID NO: 8203278 - DNA, 22 bp, Homo sapiens
agaataaaatagtctgaagatg

SEQ ID NO: 8203279 - DNA, 22 bp, Homo sapiens
agaataaaatagtctgaagatg

SEQ ID NO: 8203280 - DNA, 22 bp, Homo sapiens
aatggagaccctaaggaagagg

SEQ ID NO: 8203281 - DNA, 22 bp, Homo sapiens
agaagttttgggaaatactgat

SEQ ID NO: 8203282 - DNA, 22 bp, Homo sapiens
agaataaatcaaatgtcctgag

SEQ ID NO: 8203283 - DNA, 22 bp, Homo sapiens
agaataaatgctacctatcaca

SEQ ID NO: 8203284 - DNA, 22 bp, Homo sapiens
agaataaatgctacctatcaca

SEQ ID NO: 8203285 - DNA, 22 bp, Homo sapiens
agaataaatgctacctatcaca

SEQ ID NO: 8203286 - DNA, 18 bp, Homo sapiens
agagaaagaccaaagcat

SEQ ID NO: 8203287 - DNA, 23 bp, Homo sapiens
agagaaagggataacacgttgaa

SEQ ID NO: 8203288 - DNA, 19 bp, Homo sapiens
agagaaagaattgagtcta

SEQ ID NO: 8203289 - DNA, 23 bp, Homo sapiens
agactggggcataagaagatggc

SEQ ID NO: 8203290 - DNA, 22 bp, Homo sapiens
agagaaacaggtcagctgggag

SEQ ID NO: 8203291 - DNA, 19 bp, Homo sapiens
agactctgtgtgagacttt

SEQ ID NO: 8203292 - DNA, 18 bp, Homo sapiens
agactctgtgtgaaagta

SEQ ID NO: 8203293 - DNA, 22 bp, Homo sapiens
agactgaataggaaagagggaa

SEQ ID NO: 8203294 - DNA, 22 bp, Homo sapiens
agactgaataggaaagagggaa

SEQ ID NO: 8203295 - DNA, 22 bp, Homo sapiens
agactgatattaactttagtgt

SEQ ID NO: 8203296 - DNA, 23 bp, Homo sapiens
agactgaggctgccagggtcaga

SEQ ID NO: 8203297 - DNA, 23 bp, Homo sapiens
agactgaggctgccagggtcaga

SEQ ID NO: 8203298 - DNA, 22 bp, Homo sapiens
aatgtataaccataggaaattt

SEQ ID NO: 8203299 - DNA, 22 bp, Homo sapiens
aatgtataaccataggaaattt

SEQ ID NO: 8203300 - DNA, 22 bp, Homo sapiens
agacacctaatagatgaattca

SEQ ID NO: 8203301 - DNA, 22 bp, Homo sapiens
aatgtataaccataggaaattt

SEQ ID NO: 8203302 - DNA, 22 bp, Homo sapiens
agacactgaaatgtattgaaga

SEQ ID NO: 8203303 - DNA, 22 bp, Homo sapiens
agacactgaatcagagggacat

SEQ ID NO: 8203304 - DNA, 22 bp, Homo sapiens
agacactgaatgtttggtggtc

SEQ ID NO: 8203305 - DNA, 22 bp, Homo sapiens
agacactgatgttcagctcaat

SEQ ID NO: 8203306 - DNA, 22 bp, Homo sapiens
agacactgccacttctgttccc

SEQ ID NO: 8203307 - DNA, 22 bp, Homo sapiens
agacactgccacttctgttccc

SEQ ID NO: 8203308 - DNA, 22 bp, Homo sapiens
agacactgcggaggtcgggtgg

SEQ ID NO: 8203309 - DNA, 19 bp, Homo sapiens
agacactggatggaaaatg

SEQ ID NO: 8203310 - DNA, 17 bp, Homo sapiens
agacactgagccaagta

SEQ ID NO: 8203311 - DNA, 22 bp, Homo sapiens
agacactgatgttcagctcaat

SEQ ID NO: 8203312 - DNA, 22 bp, Homo sapiens
agacactgagcattttcctagc

SEQ ID NO: 8203313 - DNA, 22 bp, Homo sapiens
agacctctgctcccttcatggt

SEQ ID NO: 8203314 - DNA, 22 bp, Homo sapiens
agacactggcactggggaagcc

SEQ ID NO: 8203315 - DNA, 22 bp, Homo sapiens
agacactggtgaagaaatcagg

SEQ ID NO: 8203316 - DNA, 21 bp, Homo sapiens
agacactggtttagcattcat

SEQ ID NO: 8203317 - DNA, 22 bp, Homo sapiens
agacactggtgaagaaatcagg

SEQ ID NO: 8203318 - DNA, 21 bp, Homo sapiens
agactctggggatctctgtcc

SEQ ID NO: 8203319 - DNA, 22 bp, Homo sapiens
agactctgggattttgaaagca

SEQ ID NO: 8203320 - DNA, 22 bp, Homo sapiens
agactctggagtcagctaggat

SEQ ID NO: 8203321 - DNA, 23 bp, Homo sapiens
agagagagtttgtgtcaggtacc

SEQ ID NO: 8203322 - DNA, 23 bp, Homo sapiens
agagagagtttgtgtcaggtacc

SEQ ID NO: 8203323 - DNA, 23 bp, Homo sapiens
agagagagtttgtgtcaggtacc

SEQ ID NO: 8203324 - DNA, 20 bp, Homo sapiens
agagagcacaggcaggaaag

SEQ ID NO: 8203325 - DNA, 22 bp, Homo sapiens
agagagcagtctggaagaaaca

SEQ ID NO: 8203326 - DNA, 22 bp, Homo sapiens
agagatatatatttgtttacca

SEQ ID NO: 8203327 - DNA, 22 bp, Homo sapiens
agagatataagtataaataggg

SEQ ID NO: 8203328 - DNA, 22 bp, Homo sapiens
agagatatgctgcctaaattta

SEQ ID NO: 8203329 - DNA, 22 bp, Homo sapiens
agagatatgctgcctaaattta

SEQ ID NO: 8203330 - DNA, 22 bp, Homo sapiens
aattatgtttgctttagatgga

SEQ ID NO: 8203331 - DNA, 22 bp, Homo sapiens
aattatgtagccatatgaaaca

SEQ ID NO: 8203332 - DNA, 22 bp, Homo sapiens
aattatgtagccatatgaaaca

SEQ ID NO: 8203333 - DNA, 22 bp, Homo sapiens
aattatgtgcttgcttgtttcc

SEQ ID NO: 8203334 - DNA, 22 bp, Homo sapiens
agagatctgtgcttactacaag

SEQ ID NO: 8203335 - DNA, 22 bp, Homo sapiens
agagatctgtctactatttaag

SEQ ID NO: 8203336 - DNA, 21 bp, Homo sapiens
agagatctgaagaaccattag

SEQ ID NO: 8203337 - DNA, 22 bp, Homo sapiens
agagatctctgaagctgctgct

SEQ ID NO: 8203338 - DNA, 22 bp, Homo sapiens
agagatctccatgcccttataa

SEQ ID NO: 8203339 - DNA, 22 bp, Homo sapiens
agagatctctgaagctgctgct

SEQ ID NO: 8203340 - DNA, 22 bp, Homo sapiens
agagatctgaaacaaattagga

SEQ ID NO: 8203341 - DNA, 22 bp, Homo sapiens
agagatctgaaacaaattagga

SEQ ID NO: 8203342 - DNA, 22 bp, Homo sapiens
agagatctatttaatagtgtta

SEQ ID NO: 8203343 - DNA, 22 bp, Homo sapiens
agagatctagcacctgctggtc

SEQ ID NO: 8203344 - DNA, 22 bp, Homo sapiens
agagatccttcaatctagtttt

SEQ ID NO: 8203345 - DNA, 22 bp, Homo sapiens
agagatctagcacctgctggtc

SEQ ID NO: 8203346 - DNA, 22 bp, Homo sapiens
agagatcccttctgcctgggga

SEQ ID NO: 8203347 - DNA, 19 bp, Homo sapiens
agagatccagcttctagct

SEQ ID NO: 8203348 - DNA, 22 bp, Homo sapiens
agagagagggaaactgctaaac

SEQ ID NO: 8203349 - DNA, 22 bp, Homo sapiens
agagagagggaaactgctaaac

SEQ ID NO: 8203350 - DNA, 22 bp, Homo sapiens
agagagaggggcgagcaaacac

SEQ ID NO: 8203351 - DNA, 22 bp, Homo sapiens
agagagaggggcgagcaaacac

SEQ ID NO: 8203352 - DNA, 20 bp, Homo sapiens
agagagaggtaaattgagca

SEQ ID NO: 8203353 - DNA, 20 bp, Homo sapiens
agagagaggtaaattgagca

SEQ ID NO: 8203354 - DNA, 20 bp, Homo sapiens
agagagaggtaaattgagca

SEQ ID NO: 8203355 - DNA, 20 bp, Homo sapiens
agagagaggtaaattgagca

SEQ ID NO: 8203356 - DNA, 17 bp, Homo sapiens
agagagagcatgccacc

SEQ ID NO: 8203357 - DNA, 17 bp, Homo sapiens
agagagagcatgccacc

SEQ ID NO: 8203358 - DNA, 22 bp, Homo sapiens
agagagagaaatgaaatgtgct

SEQ ID NO: 8203359 - DNA, 22 bp, Homo sapiens
agagagacgggggctgctgctt

SEQ ID NO: 8203360 - DNA, 22 bp, Homo sapiens
agagagagaaatgaaatgtgct

SEQ ID NO: 8203361 - DNA, 22 bp, Homo sapiens
agagagagaaatgaaatgtgct

SEQ ID NO: 8203362 - DNA, 22 bp, Homo sapiens
agagaaagtcctgatctctcta

SEQ ID NO: 8203363 - DNA, 22 bp, Homo sapiens
agagaaagtcctgatctctcta

SEQ ID NO: 8203364 - DNA, 21 bp, Homo sapiens
agagaaagtcatggctgtggc

SEQ ID NO: 8203365 - DNA, 21 bp, Homo sapiens
agagaaagtcatggctgtggc

SEQ ID NO: 8203366 - DNA, 21 bp, Homo sapiens
agagaaagtcatggctgtggc

SEQ ID NO: 8203367 - DNA, 21 bp, Homo sapiens
agagaaagtcatggctgtggc

SEQ ID NO: 8203368 - DNA, 20 bp, Homo sapiens
agagagacctaggcctagtc

SEQ ID NO: 8203369 - DNA, 22 bp, Homo sapiens
agagagaattggataaattggt

SEQ ID NO: 8203370 - DNA, 18 bp, Homo sapiens
agagagaattccagtagg

SEQ ID NO: 8203371 - DNA, 18 bp, Homo sapiens
agagagaattccagtagg

SEQ ID NO: 8203372 - DNA, 22 bp, Homo sapiens
agagacagggttttgccatgtt

SEQ ID NO: 8203373 - DNA, 22 bp, Homo sapiens
agagaaatatttaggaaaggag

SEQ ID NO: 8203374 - DNA, 22 bp, Homo sapiens
agagaaatagattggtccagaa

SEQ ID NO: 8203375 - DNA, 22 bp, Homo sapiens
agagaaatgattcctgggcaga

SEQ ID NO: 8203376 - DNA, 22 bp, Homo sapiens
aaacttgaaaggtactgttggt

SEQ ID NO: 8203377 - DNA, 22 bp, Homo sapiens
aaacttgaaaggtactgttggt

SEQ ID NO: 8203378 - DNA, 22 bp, Homo sapiens
aaacttgaacccagctcaggct

SEQ ID NO: 8203379 - DNA, 22 bp, Homo sapiens
aaacttgacagtagacagatta

SEQ ID NO: 8203380 - DNA, 22 bp, Homo sapiens
aaacttgaaaggtactgttggt

SEQ ID NO: 8203381 - DNA, 22 bp, Homo sapiens
aaacttctggctacaagcaata

SEQ ID NO: 8203382 - DNA, 22 bp, Homo sapiens
aaacttgaccctatccaattac

SEQ ID NO: 8203383 - DNA, 23 bp, Homo sapiens
aaacttgctatggctgaaatcat

SEQ ID NO: 8203384 - DNA, 23 bp, Homo sapiens
aaacttgctatggctgaaatcat

SEQ ID NO: 8203385 - DNA, 22 bp, Homo sapiens
aaacttgatttagaactaaggc

SEQ ID NO: 8203386 - DNA, 23 bp, Homo sapiens
aaacttgctatggctgaaatcat

SEQ ID NO: 8203387 - DNA, 22 bp, Homo sapiens
aaacttgatctgtgaccttgct

SEQ ID NO: 8203388 - DNA, 22 bp, Homo sapiens
aaacttgagtcacttctcttcc

SEQ ID NO: 8203389 - DNA, 20 bp, Homo sapiens
aaacttgttggtggatgagg

SEQ ID NO: 8203390 - DNA, 22 bp, Homo sapiens
aaacttgtcattgtaatggtat

SEQ ID NO: 8203391 - DNA, 22 bp, Homo sapiens
aaagatgcataaatgccaatgg

SEQ ID NO: 8203392 - DNA, 22 bp, Homo sapiens
aaagatggcccatgatctcttg

SEQ ID NO: 8203393 - DNA, 22 bp, Homo sapiens
aaagatctccccttcaaagagt

SEQ ID NO: 8203394 - DNA, 22 bp, Homo sapiens
aaagatcattctctggtccaga

SEQ ID NO: 8203395 - DNA, 22 bp, Homo sapiens
aaagagctttccacactagtca

SEQ ID NO: 8203396 - DNA, 18 bp, Homo sapiens
aaagaaggattggagagc

SEQ ID NO: 8203397 - DNA, 18 bp, Homo sapiens
aaagaaggattggagagc

SEQ ID NO: 8203398 - DNA, 17 bp, Homo sapiens
aaagagcttggagtgtt

SEQ ID NO: 8203399 - DNA, 22 bp, Homo sapiens
aaagaagggacagactgcctct

SEQ ID NO: 8203400 - DNA, 22 bp, Homo sapiens
aaagaagacagacatttctttc

SEQ ID NO: 8203401 - DNA, 22 bp, Homo sapiens
aaagaagacagacatttctttc

SEQ ID NO: 8203402 - DNA, 22 bp, Homo sapiens
aaagaagagcaaatttgttgta

SEQ ID NO: 8203403 - DNA, 22 bp, Homo sapiens
aaagaagatggagacctgacta

SEQ ID NO: 8203404 - DNA, 22 bp, Homo sapiens
aaagaagagctggaaggagtct

SEQ ID NO: 8203405 - DNA, 22 bp, Homo sapiens
aaaccattaggttttatctact

SEQ ID NO: 8203406 - DNA, 22 bp, Homo sapiens
aaaccatgctttgatgatttta

SEQ ID NO: 8203407 - DNA, 22 bp, Homo sapiens
aaaccacttatatcgtgatttg

SEQ ID NO: 8203408 - DNA, 22 bp, Homo sapiens
aaaccactcctgattcacttca

SEQ ID NO: 8203409 - DNA, 22 bp, Homo sapiens
aaaccacagttcagtgcttttg

SEQ ID NO: 8203410 - DNA, 22 bp, Homo sapiens
aaaccaaacatttgcggtggtg

SEQ ID NO: 8203411 - DNA, 22 bp, Homo sapiens
aaaccacacttagcagtttcgt

SEQ ID NO: 8203412 - DNA, 22 bp, Homo sapiens
aaacattgttatgataaattac

SEQ ID NO: 8203413 - DNA, 22 bp, Homo sapiens
aaacatgatattgaggctgggc

SEQ ID NO: 8203414 - DNA, 22 bp, Homo sapiens
aaacatgagcatttctgtttaa

SEQ ID NO: 8203415 - DNA, 22 bp, Homo sapiens
aaacatgagcatctcttcaagc

SEQ ID NO: 8203416 - DNA, 23 bp, Homo sapiens
aaacatttctcttttcctgcctc

SEQ ID NO: 8203417 - DNA, 22 bp, Homo sapiens
aaacatttgcaactcggtttgg

SEQ ID NO: 8203418 - DNA, 22 bp, Homo sapiens
aaacatttgcaactcggtttgg

SEQ ID NO: 8203419 - DNA, 22 bp, Homo sapiens
aaacatttttctaggtcttggt

SEQ ID NO: 8203420 - DNA, 22 bp, Homo sapiens
aaacatttttcttcatcatcct

SEQ ID NO: 8203421 - DNA, 22 bp, Homo sapiens
aaacatttttcttcatcatcct

SEQ ID NO: 8203422 - DNA, 22 bp, Homo sapiens
aaacatttttcttcatcatcct

SEQ ID NO: 8203423 - DNA, 22 bp, Homo sapiens
aaacacagggatatatattcca

SEQ ID NO: 8203424 - DNA, 20 bp, Homo sapiens
aaacacagcctctctttaca

SEQ ID NO: 8203425 - DNA, 19 bp, Homo sapiens
aaacacagatttcttacca

SEQ ID NO: 8203426 - DNA, 19 bp, Homo sapiens
aaacacagatttcttacca

SEQ ID NO: 8203427 - DNA, 22 bp, Homo sapiens
aaacacagatttctttgtccca

SEQ ID NO: 8203428 - DNA, 22 bp, Homo sapiens
aaacacagggatatatattcca

SEQ ID NO: 8203429 - DNA, 22 bp, Homo sapiens
aaacacagggatatatattcca

SEQ ID NO: 8203430 - DNA, 22 bp, Homo sapiens
aaacatctgacttgctttttca

SEQ ID NO: 8203431 - DNA, 21 bp, Homo sapiens
aaacatctctgcttttgtgtc

SEQ ID NO: 8203432 - DNA, 22 bp, Homo sapiens
aaacatctttctattgcaagtt

SEQ ID NO: 8203433 - DNA, 22 bp, Homo sapiens
aaacatcttctcttgattcttt

SEQ ID NO: 8203434 - DNA, 22 bp, Homo sapiens
aaacatcttctcttgattcttt

SEQ ID NO: 8203435 - DNA, 22 bp, Homo sapiens
aaacatcttctcttgattcttt

SEQ ID NO: 8203436 - DNA, 22 bp, Homo sapiens
aaacatctgacttgctttttca

SEQ ID NO: 8203437 - DNA, 22 bp, Homo sapiens
aaacatgaatagatattaaaca

SEQ ID NO: 8203438 - DNA, 22 bp, Homo sapiens
aaacatgagcacttgcttcata

SEQ ID NO: 8203439 - DNA, 22 bp, Homo sapiens
aaacatgaatagatattaaaca

SEQ ID NO: 8203440 - DNA, 22 bp, Homo sapiens
aaacatgagcacttgcttcata

SEQ ID NO: 8203441 - DNA, 22 bp, Homo sapiens
aaacatgagcacttgcttcata

SEQ ID NO: 8203442 - DNA, 22 bp, Homo sapiens
aaacatgagcacttgcttcata

SEQ ID NO: 8203443 - DNA, 22 bp, Homo sapiens
aaacatgagcatctcttcaagc

SEQ ID NO: 8203444 - DNA, 22 bp, Homo sapiens
aaacatgagcatctcttcaagc

SEQ ID NO: 8203445 - DNA, 22 bp, Homo sapiens
aaaagtattttggatctcagat

SEQ ID NO: 8203446 - DNA, 22 bp, Homo sapiens
aaaagtattttggatctcagat

SEQ ID NO: 8203447 - DNA, 22 bp, Homo sapiens
aaaagtctctctgagtaaaagt

SEQ ID NO: 8203448 - DNA, 22 bp, Homo sapiens
aaaagtctgctttctattatca

SEQ ID NO: 8203449 - DNA, 22 bp, Homo sapiens
aaaagtctgctctcatttcaga

SEQ ID NO: 8203450 - DNA, 22 bp, Homo sapiens
aaaaatgtgaccacagggtgtt

SEQ ID NO: 8203451 - DNA, 22 bp, Homo sapiens
aaaaatgtcattatggaactga

SEQ ID NO: 8203452 - DNA, 22 bp, Homo sapiens
aaaaatgtcattatggaactga

SEQ ID NO: 8203453 - DNA, 22 bp, Homo sapiens
aaaaatgtcattatggaactga

SEQ ID NO: 8203454 - DNA, 22 bp, Homo sapiens
aaaaatgcttggacttaataaa

SEQ ID NO: 8203455 - DNA, 22 bp, Homo sapiens
aaaaatgcttggacttaataaa

SEQ ID NO: 8203456 - DNA, 22 bp, Homo sapiens
aaaaatgcttggacttaataaa

SEQ ID NO: 8203457 - DNA, 22 bp, Homo sapiens
aaaaatgcttggacttaataaa

SEQ ID NO: 8203458 - DNA, 22 bp, Homo sapiens
aaaaatgctgtggtagctgtgt

SEQ ID NO: 8203459 - DNA, 22 bp, Homo sapiens
aaaaatgctgtggtagctgtgt

SEQ ID NO: 8203460 - DNA, 22 bp, Homo sapiens
aaaaagatgtcctgaagtttag

SEQ ID NO: 8203461 - DNA, 19 bp, Homo sapiens
aaaaagaggctataatatt

SEQ ID NO: 8203462 - DNA, 21 bp, Homo sapiens
aaaaatgaagttgttcaggaa

SEQ ID NO: 8203463 - DNA, 22 bp, Homo sapiens
aaaaatgaaacggctggttggc

SEQ ID NO: 8203464 - DNA, 22 bp, Homo sapiens
aaaaatgaaacggctggttggc

SEQ ID NO: 8203465 - DNA, 22 bp, Homo sapiens
aaaaatgaattcttcagtggca

SEQ ID NO: 8203466 - DNA, 22 bp, Homo sapiens
aaaaatgaattcttcagtggca

SEQ ID NO: 8203467 - DNA, 22 bp, Homo sapiens
aaaaatgaattcttcagtggca

SEQ ID NO: 8203468 - DNA, 21 bp, Homo sapiens
aaaaatgaagttgttcaggaa

SEQ ID NO: 8203469 - DNA, 22 bp, Homo sapiens
aaaaactgtaattacttttgca

SEQ ID NO: 8203470 - DNA, 22 bp, Homo sapiens
aaaaactgtaattacttttgca

SEQ ID NO: 8203471 - DNA, 22 bp, Homo sapiens
aaaaagacagaggatgaggcag

SEQ ID NO: 8203472 - DNA, 22 bp, Homo sapiens
aaaaagacagaggatgaggcag

SEQ ID NO: 8203473 - DNA, 22 bp, Homo sapiens
aaaaagactagtcgagtgcagt

SEQ ID NO: 8203474 - DNA, 22 bp, Homo sapiens
aaaaagacttccaactcaggag

SEQ ID NO: 8203475 - DNA, 22 bp, Homo sapiens
aaaaagactagtcgagtgcagt

SEQ ID NO: 8203476 - DNA, 22 bp, Homo sapiens
aaacacacctttggaactgtga

SEQ ID NO: 8203477 - DNA, 22 bp, Homo sapiens
aaacacacctttggaactgtga

SEQ ID NO: 8203478 - DNA, 22 bp, Homo sapiens
aaacacaatgtttctttgttct

SEQ ID NO: 8203479 - DNA, 22 bp, Homo sapiens
aaacacacagaaatgaatgagg

SEQ ID NO: 8203480 - DNA, 22 bp, Homo sapiens
aaacaagagcttacatggctgc

SEQ ID NO: 8203481 - DNA, 22 bp, Homo sapiens
aaacaacctaaagttactgatc

SEQ ID NO: 8203482 - DNA, 22 bp, Homo sapiens
aaacaacatggtgggtgtgtag

SEQ ID NO: 8203483 - DNA, 22 bp, Homo sapiens
aaacaacatggtgggtgtgtag

SEQ ID NO: 8203484 - DNA, 22 bp, Homo sapiens
aaacaactcggcaactgctttt

SEQ ID NO: 8203485 - DNA, 22 bp, Homo sapiens
aaacaactcggcaactgctttt

SEQ ID NO: 8203486 - DNA, 22 bp, Homo sapiens
aaacaaagcatcttgctatgca

SEQ ID NO: 8203487 - DNA, 22 bp, Homo sapiens
aaacaaagcatcttgctatgca

SEQ ID NO: 8203488 - DNA, 22 bp, Homo sapiens
aaacaaatagtgcatgggaatt

SEQ ID NO: 8203489 - DNA, 22 bp, Homo sapiens
aaacaaatagtgcatgggaatt

SEQ ID NO: 8203490 - DNA, 22 bp, Homo sapiens
aaacaaatagtgcatgggaatt

SEQ ID NO: 8203491 - DNA, 22 bp, Homo sapiens
aaacaaatttcaagctgtgaca

SEQ ID NO: 8203492 - DNA, 22 bp, Homo sapiens
aaaattcattcctcagactgcc

SEQ ID NO: 8203493 - DNA, 22 bp, Homo sapiens
aaaattcatggcttgggaaaag

SEQ ID NO: 8203494 - DNA, 22 bp, Homo sapiens
aaaataggtacggattagaatg

SEQ ID NO: 8203495 - DNA, 22 bp, Homo sapiens
aaaataggtacggattagaatg

SEQ ID NO: 8203496 - DNA, 22 bp, Homo sapiens
aaaatagctatggaatgtcact

SEQ ID NO: 8203497 - DNA, 22 bp, Homo sapiens
aaaatagctatggaatgtcact

SEQ ID NO: 8203498 - DNA, 22 bp, Homo sapiens
aaaatagctatggaatgtcact

SEQ ID NO: 8203499 - DNA, 22 bp, Homo sapiens
aaaatagctatggaatgtcact

SEQ ID NO: 8203500 - DNA, 22 bp, Homo sapiens
aaaatagctatggaatgtcact

SEQ ID NO: 8203501 - DNA, 22 bp, Homo sapiens
aaaatagcctcacataattgct

SEQ ID NO: 8203502 - DNA, 22 bp, Homo sapiens
aaaatagcctcacataattgct

SEQ ID NO: 8203503 - DNA, 22 bp, Homo sapiens
aaaatagcatattgctttcttt

SEQ ID NO: 8203504 - DNA, 22 bp, Homo sapiens
aaaatagcatattgctttcttt

SEQ ID NO: 8203505 - DNA, 22 bp, Homo sapiens
aaaatagcatgaaaggcctttg

SEQ ID NO: 8203506 - DNA, 20 bp, Homo sapiens
aaaatagccccaggctcatt

SEQ ID NO: 8203507 - DNA, 22 bp, Homo sapiens
aaaatagattctaggatgtctt

SEQ ID NO: 8203508 - DNA, 22 bp, Homo sapiens
aaaatagatgaaaggaagtctg

SEQ ID NO: 8203509 - DNA, 22 bp, Homo sapiens
aaaatagattctaggatgtctt

SEQ ID NO: 8203510 - DNA, 22 bp, Homo sapiens
aaaagtcttgtcaaggttccca

SEQ ID NO: 8203511 - DNA, 22 bp, Homo sapiens
aaaagtcttggggaaggccagg

SEQ ID NO: 8203512 - DNA, 22 bp, Homo sapiens
aaaagtcttggggaaggccagg

SEQ ID NO: 8203513 - DNA, 22 bp, Homo sapiens
aaaagtgtccagattatgaaga

SEQ ID NO: 8203514 - DNA, 22 bp, Homo sapiens
aaagtgctaaataagccctgaa

SEQ ID NO: 8203515 - DNA, 22 bp, Homo sapiens
aaagtgcattgtttgtgttcct

SEQ ID NO: 8203516 - DNA, 23 bp, Homo sapiens
aaagtgcagttgaggaatcatag

SEQ ID NO: 8203517 - DNA, 22 bp, Homo sapiens
aaagtgcagtccatgaaattaa

SEQ ID NO: 8203518 - DNA, 22 bp, Homo sapiens
aaacactgtctctggtattgaa

SEQ ID NO: 8203519 - DNA, 22 bp, Homo sapiens
aaagtcatttagccttatctcc

SEQ ID NO: 8203520 - DNA, 22 bp, Homo sapiens
aaacactggtatgatgtatagt

SEQ ID NO: 8203521 - DNA, 22 bp, Homo sapiens
aaacactgtacaatctgcaggg

SEQ ID NO: 8203522 - DNA, 22 bp, Homo sapiens
aaacactgtacaatctgcaggg

SEQ ID NO: 8203523 - DNA, 22 bp, Homo sapiens
aaacactgtacaatctgcaggg

SEQ ID NO: 8203524 - DNA, 22 bp, Homo sapiens
aaacactgtctctggtattgaa

SEQ ID NO: 8203525 - DNA, 22 bp, Homo sapiens
aaacactggtatgatgtatagt

SEQ ID NO: 8203526 - DNA, 22 bp, Homo sapiens
aaacactggtatgatgtatagt

SEQ ID NO: 8203527 - DNA, 22 bp, Homo sapiens
aaacactggtatgatgtatagt

SEQ ID NO: 8203528 - DNA, 22 bp, Homo sapiens
aaacactggtatgatgtatagt

SEQ ID NO: 8203529 - DNA, 22 bp, Homo sapiens
aaacactggcaatttcatgcac

SEQ ID NO: 8203530 - DNA, 20 bp, Homo sapiens
aaacactggctggggcacag

SEQ ID NO: 8203531 - DNA, 22 bp, Homo sapiens
aaacactggcaatttcatgcac

SEQ ID NO: 8203532 - DNA, 22 bp, Homo sapiens
aaacactggcaatttcatgcac

SEQ ID NO: 8203533 - DNA, 22 bp, Homo sapiens
aaacactgcagggtttacttga

SEQ ID NO: 8203534 - DNA, 22 bp, Homo sapiens
aaacactgcagggtttacttga

SEQ ID NO: 8203535 - DNA, 22 bp, Homo sapiens
aaacactgcagggtttacttga

SEQ ID NO: 8203536 - DNA, 22 bp, Homo sapiens
aaacactgcgtggtggcaactc

SEQ ID NO: 8203537 - DNA, 22 bp, Homo sapiens
aaagtgctgaaattacaggtgt

SEQ ID NO: 8203538 - DNA, 22 bp, Homo sapiens
aaagtgctgaagacctagctgt

SEQ ID NO: 8203539 - DNA, 22 bp, Homo sapiens
aaagtgctaggattacaagcgt

SEQ ID NO: 8203540 - DNA, 22 bp, Homo sapiens
aaagtgctcggattacaggtat

SEQ ID NO: 8203541 - DNA, 22 bp, Homo sapiens
aaagtgctgggattacaagcgt

SEQ ID NO: 8203542 - DNA, 22 bp, Homo sapiens
aaagtgctgagattacaagcgt

SEQ ID NO: 8203543 - DNA, 22 bp, Homo sapiens
aaagtgctgaagacctagctgt

SEQ ID NO: 8203544 - DNA, 22 bp, Homo sapiens
aaagtgctgggattacaggtgt

SEQ ID NO: 8203545 - DNA, 22 bp, Homo sapiens
aaagtgctgggattccaggcgt

SEQ ID NO: 8203546 - DNA, 22 bp, Homo sapiens
aaagtgctgggattccaggcgt

SEQ ID NO: 8203547 - DNA, 22 bp, Homo sapiens
aaacagttttctcatttagtgt

SEQ ID NO: 8203548 - DNA, 22 bp, Homo sapiens
aaacagttttctcatttagtgt

SEQ ID NO: 8203549 - DNA, 20 bp, Homo sapiens
aaacatagtggataccacag

SEQ ID NO: 8203550 - DNA, 22 bp, Homo sapiens
aaacagttttttaagtctctag

SEQ ID NO: 8203551 - DNA, 22 bp, Homo sapiens
aaacatctatcagcatttttta

SEQ ID NO: 8203552 - DNA, 22 bp, Homo sapiens
aaacatctatcagcatttttta

SEQ ID NO: 8203553 - DNA, 22 bp, Homo sapiens
aaacatcataggcatgcatgat

SEQ ID NO: 8203554 - DNA, 22 bp, Homo sapiens
aaacatcataggcatgcatgat

SEQ ID NO: 8203555 - DNA, 22 bp, Homo sapiens
aaacatcaccattttacctaat

SEQ ID NO: 8203556 - DNA, 22 bp, Homo sapiens
aaagcaatcagattcagatgtc

SEQ ID NO: 8203557 - DNA, 22 bp, Homo sapiens
aaagatgtgtaagaaataaaca

SEQ ID NO: 8203558 - DNA, 22 bp, Homo sapiens
aaagatgtcatacacattaaga

SEQ ID NO: 8203559 - DNA, 22 bp, Homo sapiens
aaagatgtccaagtaaagttaa

SEQ ID NO: 8203560 - DNA, 22 bp, Homo sapiens
aaagatgtcagtttgaaataac

SEQ ID NO: 8203561 - DNA, 22 bp, Homo sapiens
aaaggcatggatagtgaattca

SEQ ID NO: 8203562 - DNA, 22 bp, Homo sapiens
aaaggcatggaacagattctcc

SEQ ID NO: 8203563 - DNA, 22 bp, Homo sapiens
aaaggaggaatggagagatgct

SEQ ID NO: 8203564 - DNA, 22 bp, Homo sapiens
aaaggccaagcatgaggtggac

SEQ ID NO: 8203565 - DNA, 22 bp, Homo sapiens
aaaggccaagcatgaggtggac

SEQ ID NO: 8203566 - DNA, 22 bp, Homo sapiens
aaaggccaagcatgaggtggac

SEQ ID NO: 8203567 - DNA, 22 bp, Homo sapiens
aaaggcatgtgcaactacaaat

SEQ ID NO: 8203568 - DNA, 22 bp, Homo sapiens
aaaggcatggatagtgaattca

SEQ ID NO: 8203569 - DNA, 22 bp, Homo sapiens
aaaggcatgtgcaactacaaat

SEQ ID NO: 8203570 - DNA, 22 bp, Homo sapiens
aaaggccacactgctctttctc

SEQ ID NO: 8203571 - DNA, 22 bp, Homo sapiens
aaaggccacacagagcagggag

SEQ ID NO: 8203572 - DNA, 22 bp, Homo sapiens
aaaggccacacagagcagggag

SEQ ID NO: 8203573 - DNA, 22 bp, Homo sapiens
aaaggccacacagagcagggag

SEQ ID NO: 8203574 - DNA, 22 bp, Homo sapiens
aaaggccaataaagacaagctg

SEQ ID NO: 8203575 - DNA, 22 bp, Homo sapiens
aaaggcctgtgcttctaatgtg

SEQ ID NO: 8203576 - DNA, 22 bp, Homo sapiens
aaaggccttgagctgggtgcca

SEQ ID NO: 8203577 - DNA, 22 bp, Homo sapiens
aaaggcctctgtcctagtgcct

SEQ ID NO: 8203578 - DNA, 22 bp, Homo sapiens
aaaggccattacttgcttttag

SEQ ID NO: 8203579 - DNA, 22 bp, Homo sapiens
aaaggccttaaagagcatgcct

SEQ ID NO: 8203580 - DNA, 22 bp, Homo sapiens
aaacactgatggatatttttcc

SEQ ID NO: 8203581 - DNA, 22 bp, Homo sapiens
aaacactgatggatatttttcc

SEQ ID NO: 8203582 - DNA, 22 bp, Homo sapiens
aaaggccacttgaaggattttt

SEQ ID NO: 8203583 - DNA, 22 bp, Homo sapiens
aaaggccactgcaagggaaggt

SEQ ID NO: 8203584 - DNA, 22 bp, Homo sapiens
aaaggccactgcaagggaaggt

SEQ ID NO: 8203585 - DNA, 22 bp, Homo sapiens
aaaggccaccaacatgaagcat

SEQ ID NO: 8203586 - DNA, 22 bp, Homo sapiens
aaaggccaccaacatgaagcat

SEQ ID NO: 8203587 - DNA, 22 bp, Homo sapiens
aaaggccaggttggctggtatt

SEQ ID NO: 8203588 - DNA, 22 bp, Homo sapiens
aaaggccaggttggctggtatt

SEQ ID NO: 8203589 - DNA, 22 bp, Homo sapiens
aaaggccaggttggctggtatt

SEQ ID NO: 8203590 - DNA, 22 bp, Homo sapiens
aaaggccacttgaaggattttt

SEQ ID NO: 8203591 - DNA, 22 bp, Homo sapiens
aaaggccatggttggagtgttt

SEQ ID NO: 8203592 - DNA, 22 bp, Homo sapiens
aaaggccatggttggagtgttt

SEQ ID NO: 8203593 - DNA, 22 bp, Homo sapiens
aaaggccatggttggagtgttt

SEQ ID NO: 8203594 - DNA, 21 bp, Homo sapiens
aaaggccataatcacggagca

SEQ ID NO: 8203595 - DNA, 21 bp, Homo sapiens
aaaggccataatcacggagca

SEQ ID NO: 8203596 - DNA, 21 bp, Homo sapiens
aaaggccataatcacggagca

SEQ ID NO: 8203597 - DNA, 22 bp, Homo sapiens
aaatactgtctctgagagagcc

SEQ ID NO: 8203598 - DNA, 22 bp, Homo sapiens
aaatactgtccaccatggagca

SEQ ID NO: 8203599 - DNA, 22 bp, Homo sapiens
aaatacagattctgactcagag

SEQ ID NO: 8203600 - DNA, 22 bp, Homo sapiens
aaatacagattctgactcagag

SEQ ID NO: 8203601 - DNA, 22 bp, Homo sapiens
aaatactgttgaatgaagtaag

SEQ ID NO: 8203602 - DNA, 22 bp, Homo sapiens
aaatagaaaccaacaaggtcag

SEQ ID NO: 8203603 - DNA, 22 bp, Homo sapiens
aaatagaaaccaacaaggtcag

SEQ ID NO: 8203604 - DNA, 22 bp, Homo sapiens
aaatagaattaactagctactg

SEQ ID NO: 8203605 - DNA, 22 bp, Homo sapiens
aaatagaattaactagctactg

SEQ ID NO: 8203606 - DNA, 20 bp, Homo sapiens
aaacgagccatcattctggt

SEQ ID NO: 8203607 - DNA, 20 bp, Homo sapiens
aaacgagccatcattctggt

SEQ ID NO: 8203608 - DNA, 22 bp, Homo sapiens
aaactaaacctggcttagtaag

SEQ ID NO: 8203609 - DNA, 20 bp, Homo sapiens
aaacgagccatcattctggt

SEQ ID NO: 8203610 - DNA, 19 bp, Homo sapiens
aaactaaggggaaatgttt

SEQ ID NO: 8203611 - DNA, 19 bp, Homo sapiens
aaactaaggggaaatgttt

SEQ ID NO: 8203612 - DNA, 22 bp, Homo sapiens
aaactaagggagatgtgggctg

SEQ ID NO: 8203613 - DNA, 23 bp, Homo sapiens
aaactaagggagtagatgagatg

SEQ ID NO: 8203614 - DNA, 20 bp, Homo sapiens
aaactaaaggtgtttggttt

SEQ ID NO: 8203615 - DNA, 20 bp, Homo sapiens
aaactaaaggtgtttggttt

SEQ ID NO: 8203616 - DNA, 23 bp, Homo sapiens
aaactacaacgccaggcactgag

SEQ ID NO: 8203617 - DNA, 22 bp, Homo sapiens
aaactacactttgggaccagca

SEQ ID NO: 8203618 - DNA, 23 bp, Homo sapiens
aaactacaacgccaggcactgag

SEQ ID NO: 8203619 - DNA, 22 bp, Homo sapiens
aaactacatctcatggatgagg

SEQ ID NO: 8203620 - DNA, 23 bp, Homo sapiens
aaactacatttatagtttttctc

SEQ ID NO: 8203621 - DNA, 23 bp, Homo sapiens
aaactacatttatagtttttctc

SEQ ID NO: 8203622 - DNA, 22 bp, Homo sapiens
aaatataatttctgcctcaata

SEQ ID NO: 8203623 - DNA, 22 bp, Homo sapiens
aaatatgtaagattagcactag

SEQ ID NO: 8203624 - DNA, 22 bp, Homo sapiens
aaatatgtaagattagcactag

SEQ ID NO: 8203625 - DNA, 22 bp, Homo sapiens
aaatatgtatggagttcatgaa

SEQ ID NO: 8203626 - DNA, 22 bp, Homo sapiens
aaatatgtgatcagtgaataaa

SEQ ID NO: 8203627 - DNA, 23 bp, Homo sapiens
aaatatgtctgagggcaaagaat

SEQ ID NO: 8203628 - DNA, 22 bp, Homo sapiens
aaatatgagggtgatgcccaga

SEQ ID NO: 8203629 - DNA, 22 bp, Homo sapiens
aaatataatttctgcctcaata

SEQ ID NO: 8203630 - DNA, 22 bp, Homo sapiens
aaatatgagggtgatgcccaga

SEQ ID NO: 8203631 - DNA, 22 bp, Homo sapiens
aaatatgtaaccaaggtgaagt

SEQ ID NO: 8203632 - DNA, 22 bp, Homo sapiens
aaatatgtaaccaaggtgaagt

SEQ ID NO: 8203633 - DNA, 22 bp, Homo sapiens
aaatatgtaagattagcactag

SEQ ID NO: 8203634 - DNA, 22 bp, Homo sapiens
aaatatgttttccagttgtcat

SEQ ID NO: 8203635 - DNA, 22 bp, Homo sapiens
aaatatgtgatcagtgaataaa

SEQ ID NO: 8203636 - DNA, 22 bp, Homo sapiens
aaatatgttttccagttgtcat

SEQ ID NO: 8203637 - DNA, 22 bp, Homo sapiens
aaatattattgcttaaggggag

SEQ ID NO: 8203638 - DNA, 22 bp, Homo sapiens
aaatattagggagaacagggac

SEQ ID NO: 8203639 - DNA, 22 bp, Homo sapiens
aaatattagggagaacagggac

SEQ ID NO: 8203640 - DNA, 22 bp, Homo sapiens
aaatcatagcccccatccgatt

SEQ ID NO: 8203641 - DNA, 22 bp, Homo sapiens
aaatattattgcttaaggggag

SEQ ID NO: 8203642 - DNA, 22 bp, Homo sapiens
aaatcatgttggcacaataaaa

SEQ ID NO: 8203643 - DNA, 22 bp, Homo sapiens
aaatcatgtgcagagatcagga

SEQ ID NO: 8203644 - DNA, 22 bp, Homo sapiens
aaatcattatttacagttctga

SEQ ID NO: 8203645 - DNA, 22 bp, Homo sapiens
aaatcatgttggcacaataaaa

SEQ ID NO: 8203646 - DNA, 22 bp, Homo sapiens
aaatcatgtgcagagatcagga

SEQ ID NO: 8203647 - DNA, 22 bp, Homo sapiens
aaatcatggtggaagaaacaga

SEQ ID NO: 8203648 - DNA, 22 bp, Homo sapiens
aaatcatgaggacattatgcca

SEQ ID NO: 8203649 - DNA, 22 bp, Homo sapiens
aaatcatggtggaagaaacaga

SEQ ID NO: 8203650 - DNA, 22 bp, Homo sapiens
aaatcatggtggaagaaacaga

SEQ ID NO: 8203651 - DNA, 22 bp, Homo sapiens
aaatcatctctgcatccttagc

SEQ ID NO: 8203652 - DNA, 22 bp, Homo sapiens
aaatcatgaggacattatgcca

SEQ ID NO: 8203653 - DNA, 22 bp, Homo sapiens
aaatcattatttacagttctga

SEQ ID NO: 8203654 - DNA, 22 bp, Homo sapiens
aaatccaagctttggtaactga

SEQ ID NO: 8203655 - DNA, 21 bp, Homo sapiens
aaatccaaacactagtccaca

SEQ ID NO: 8203656 - DNA, 21 bp, Homo sapiens
aaatccaaacactagtccaca

SEQ ID NO: 8203657 - DNA, 21 bp, Homo sapiens
aaatccaaacactagtccaca

SEQ ID NO: 8203658 - DNA, 22 bp, Homo sapiens
aaatccaggtagtttggtttga

SEQ ID NO: 8203659 - DNA, 22 bp, Homo sapiens
aaatccagtgggtcctcatgag

SEQ ID NO: 8203660 - DNA, 22 bp, Homo sapiens
aaatccaggtccatgtggggta

SEQ ID NO: 8203661 - DNA, 22 bp, Homo sapiens
aaatccaggaagcagtggtgta

SEQ ID NO: 8203662 - DNA, 22 bp, Homo sapiens
aaatgcctgtgtaaattctagc

SEQ ID NO: 8203663 - DNA, 22 bp, Homo sapiens
aaatgcctgaatggtatttggt

SEQ ID NO: 8203664 - DNA, 22 bp, Homo sapiens
aaatgctaaatgcagcaagtag

SEQ ID NO: 8203665 - DNA, 22 bp, Homo sapiens
aaatgctacatacacatcaggg

SEQ ID NO: 8203666 - DNA, 22 bp, Homo sapiens
aaatgctacatacacatcaggg

SEQ ID NO: 8203667 - DNA, 22 bp, Homo sapiens
aaatgctacacaggaattctca

SEQ ID NO: 8203668 - DNA, 22 bp, Homo sapiens
aaatgctacatacacatcaggg

SEQ ID NO: 8203669 - DNA, 22 bp, Homo sapiens
aaatgcctatttgttccttcag

SEQ ID NO: 8203670 - DNA, 22 bp, Homo sapiens
aaatgcctcccattctactgac

SEQ ID NO: 8203671 - DNA, 22 bp, Homo sapiens
aaatgcctcccattctactgac

SEQ ID NO: 8203672 - DNA, 22 bp, Homo sapiens
aaatgcctctgggttattctag

SEQ ID NO: 8203673 - DNA, 22 bp, Homo sapiens
aaatgcagctgggcatgagagg

SEQ ID NO: 8203674 - DNA, 20 bp, Homo sapiens
aaatgccagtgattctgctt

SEQ ID NO: 8203675 - DNA, 22 bp, Homo sapiens
aaatggcagtagaaaagaatcc

SEQ ID NO: 8203676 - DNA, 23 bp, Homo sapiens
aaatgctgaatctttactgttta

SEQ ID NO: 8203677 - DNA, 18 bp, Homo sapiens
aaatgctaggctacatga

SEQ ID NO: 8203678 - DNA, 18 bp, Homo sapiens
aaatgctaggctacatga

SEQ ID NO: 8203679 - DNA, 22 bp, Homo sapiens
aaatgctctccaaaatgaaagt

SEQ ID NO: 8203680 - DNA, 22 bp, Homo sapiens
aaatgctcgccttggccgagac

SEQ ID NO: 8203681 - DNA, 22 bp, Homo sapiens
aaatgctctccaaaatgaaagt

SEQ ID NO: 8203682 - DNA, 22 bp, Homo sapiens
aaatgctctggggataagactg

SEQ ID NO: 8203683 - DNA, 22 bp, Homo sapiens
aactcactttgtggcttctgaa

SEQ ID NO: 8203684 - DNA, 22 bp, Homo sapiens
aactcactttgtggcttctgaa

SEQ ID NO: 8203685 - DNA, 22 bp, Homo sapiens
aactcacacaagtattgcctgc

SEQ ID NO: 8203686 - DNA, 22 bp, Homo sapiens
aactcacagctgtttggattag

SEQ ID NO: 8203687 - DNA, 22 bp, Homo sapiens
aactcaaagatgcatgacgctt

SEQ ID NO: 8203688 - DNA, 22 bp, Homo sapiens
aactatgataccaatccagctt

SEQ ID NO: 8203689 - DNA, 22 bp, Homo sapiens
aactatcacaaacagagtgtct

SEQ ID NO: 8203690 - DNA, 22 bp, Homo sapiens
aactatgttaataagtttcatt

SEQ ID NO: 8203691 - DNA, 22 bp, Homo sapiens
aacatttgaaaatcaagaatct

SEQ ID NO: 8203692 - DNA, 22 bp, Homo sapiens
aacatttcttctgaaactgagt

SEQ ID NO: 8203693 - DNA, 22 bp, Homo sapiens
aacatttgagaaaaatactctt

SEQ ID NO: 8203694 - DNA, 22 bp, Homo sapiens
aacatttgcagaggaaagctat

SEQ ID NO: 8203695 - DNA, 22 bp, Homo sapiens
aacatttgcagaggaaagctat

SEQ ID NO: 8203696 - DNA, 22 bp, Homo sapiens
aacatttgcagaggaaagctat

SEQ ID NO: 8203697 - DNA, 22 bp, Homo sapiens
aacatttgtgaagtacttagat

SEQ ID NO: 8203698 - DNA, 22 bp, Homo sapiens
aacatttgtactaaagaagttc

SEQ ID NO: 8203699 - DNA, 23 bp, Homo sapiens
aacatttgtaaggtgattttgtt

SEQ ID NO: 8203700 - DNA, 21 bp, Homo sapiens
aacatttggctggcttttgtg

SEQ ID NO: 8203701 - DNA, 22 bp, Homo sapiens
aacatttgcgagtgggtttggg

SEQ ID NO: 8203702 - DNA, 22 bp, Homo sapiens
aacatttgtactaaagaagttc

SEQ ID NO: 8203703 - DNA, 22 bp, Homo sapiens
aactaatacattaatacatgtg

SEQ ID NO: 8203704 - DNA, 22 bp, Homo sapiens
aactaatacattaatacatgtg

SEQ ID NO: 8203705 - DNA, 22 bp, Homo sapiens
aactgagacacgaactatgatt

SEQ ID NO: 8203706 - DNA, 21 bp, Homo sapiens
aactgagaccagctaaagtgg

SEQ ID NO: 8203707 - DNA, 22 bp, Homo sapiens
aactgacagcaggaaccattcc

SEQ ID NO: 8203708 - DNA, 22 bp, Homo sapiens
aactcagtgtgtttcttagtat

SEQ ID NO: 8203709 - DNA, 22 bp, Homo sapiens
aactgaaatcaatcagtgattc

SEQ ID NO: 8203710 - DNA, 22 bp, Homo sapiens
aactgaaacttaggaagtaatc

SEQ ID NO: 8203711 - DNA, 22 bp, Homo sapiens
aactcaggagaatggagggtat

SEQ ID NO: 8203712 - DNA, 22 bp, Homo sapiens
aactcagcatcagtgtccagaa

SEQ ID NO: 8203713 - DNA, 22 bp, Homo sapiens
aactcagatatgatagcaggag

SEQ ID NO: 8203714 - DNA, 22 bp, Homo sapiens
aactcagatgtttggctacctt

SEQ ID NO: 8203715 - DNA, 22 bp, Homo sapiens
aactcagaatagggtgcagggc

SEQ ID NO: 8203716 - DNA, 22 bp, Homo sapiens
aactcagacatgtataaagact

SEQ ID NO: 8203717 - DNA, 20 bp, Homo sapiens
aactcagagatgaaaaagac

SEQ ID NO: 8203718 - DNA, 22 bp, Homo sapiens
aactgatttcaagttcagtttc

SEQ ID NO: 8203719 - DNA, 22 bp, Homo sapiens
aactgatttcaagttcagtttc

SEQ ID NO: 8203720 - DNA, 22 bp, Homo sapiens
aacttgccaagagctttgctag

SEQ ID NO: 8203721 - DNA, 22 bp, Homo sapiens
aactgataatggacacataaaa

SEQ ID NO: 8203722 - DNA, 22 bp, Homo sapiens
aactgaggtctccagtgcagaa

SEQ ID NO: 8203723 - DNA, 22 bp, Homo sapiens
aactgaggtctccagtgcagaa

SEQ ID NO: 8203724 - DNA, 22 bp, Homo sapiens
aactgaggtctccagtgcagaa

SEQ ID NO: 8203725 - DNA, 22 bp, Homo sapiens
aactgaggtatctgctgtgttt

SEQ ID NO: 8203726 - DNA, 22 bp, Homo sapiens
aactgataatggacacataaaa

SEQ ID NO: 8203727 - DNA, 23 bp, Homo sapiens
aactgagataatgtatgtaaagc

SEQ ID NO: 8203728 - DNA, 20 bp, Homo sapiens
aactgagagttcaggaggag

SEQ ID NO: 8203729 - DNA, 22 bp, Homo sapiens
aactgaggaataactgagttgc

SEQ ID NO: 8203730 - DNA, 22 bp, Homo sapiens
aactgaggccaagtgaggaaag

SEQ ID NO: 8203731 - DNA, 22 bp, Homo sapiens
aactgaggaataactgagttgc

SEQ ID NO: 8203732 - DNA, 22 bp, Homo sapiens
aactgaggccaagtgaggaaag

SEQ ID NO: 8203733 - DNA, 22 bp, Homo sapiens
aactgagggccctgctgaagca

SEQ ID NO: 8203734 - DNA, 22 bp, Homo sapiens
aactgaggtatctgctgtgttt

SEQ ID NO: 8203735 - DNA, 22 bp, Homo sapiens
aactgagggccctgctgaagca

SEQ ID NO: 8203736 - DNA, 22 bp, Homo sapiens
aacattcagctgggtggagcag

SEQ ID NO: 8203737 - DNA, 22 bp, Homo sapiens
aacattcacctctacctccttc

SEQ ID NO: 8203738 - DNA, 22 bp, Homo sapiens
aacattctattttgctaaaaca

SEQ ID NO: 8203739 - DNA, 22 bp, Homo sapiens
aacattctatgtgcattcagaa

SEQ ID NO: 8203740 - DNA, 22 bp, Homo sapiens
aacatttcataacttgactttt

SEQ ID NO: 8203741 - DNA, 22 bp, Homo sapiens
aacattctggttctaaaaacct

SEQ ID NO: 8203742 - DNA, 22 bp, Homo sapiens
aacattaattacagtcaaacat

SEQ ID NO: 8203743 - DNA, 22 bp, Homo sapiens
aacattaattacagtcaaacat

SEQ ID NO: 8203744 - DNA, 22 bp, Homo sapiens
aacattaagatggcggaacagt

SEQ ID NO: 8203745 - DNA, 22 bp, Homo sapiens
aacattaagatggcggaacagt

SEQ ID NO: 8203746 - DNA, 22 bp, Homo sapiens
aacatgcaatgtctgaaaatcc

SEQ ID NO: 8203747 - DNA, 22 bp, Homo sapiens
aacatgcaaagctatgatgtat

SEQ ID NO: 8203748 - DNA, 22 bp, Homo sapiens
aacatgcaaagctatgatgtat

SEQ ID NO: 8203749 - DNA, 22 bp, Homo sapiens
aacattagatttgtttttctag

SEQ ID NO: 8203750 - DNA, 21 bp, Homo sapiens
aacattagtaatttgactttt

SEQ ID NO: 8203751 - DNA, 22 bp, Homo sapiens
aacattcaaaacccagttcagt

SEQ ID NO: 8203752 - DNA, 22 bp, Homo sapiens
aacattcaaaacccagttcagt

SEQ ID NO: 8203753 - DNA, 22 bp, Homo sapiens
aacattcaagttctggtttatg

SEQ ID NO: 8203754 - DNA, 22 bp, Homo sapiens
aacattcaagttctggtttatg

SEQ ID NO: 8203755 - DNA, 22 bp, Homo sapiens
aacagtatatgaaatgttagga

SEQ ID NO: 8203756 - DNA, 22 bp, Homo sapiens
aacagtatatgaaatgttagga

SEQ ID NO: 8203757 - DNA, 22 bp, Homo sapiens
aacagtagtggtcaatatgcca

SEQ ID NO: 8203758 - DNA, 20 bp, Homo sapiens
aacagtaccatttatctcag

SEQ ID NO: 8203759 - DNA, 20 bp, Homo sapiens
aacagtaccatttatctcag

SEQ ID NO: 8203760 - DNA, 22 bp, Homo sapiens
aacagtacaactccacaagact

SEQ ID NO: 8203761 - DNA, 22 bp, Homo sapiens
aacaggaatgaggagaaaaggt

SEQ ID NO: 8203762 - DNA, 22 bp, Homo sapiens
aacaggaaaacagcacaatagc

SEQ ID NO: 8203763 - DNA, 22 bp, Homo sapiens
aacaggaaaacagcacaatagc

SEQ ID NO: 8203764 - DNA, 22 bp, Homo sapiens
aacagtgagaaggtggacagga

SEQ ID NO: 8203765 - DNA, 22 bp, Homo sapiens
aacagtgagaaggtggacagga

SEQ ID NO: 8203766 - DNA, 22 bp, Homo sapiens
aacagtcagcttctcgggacat

SEQ ID NO: 8203767 - DNA, 22 bp, Homo sapiens
aacagtcacattgttcaacttt

SEQ ID NO: 8203768 - DNA, 22 bp, Homo sapiens
aacagtatggaagccattagga

SEQ ID NO: 8203769 - DNA, 22 bp, Homo sapiens
aacaaatgtgttttgtaattaa

SEQ ID NO: 8203770 - DNA, 22 bp, Homo sapiens
aacaaattagttgcaagactgg

SEQ ID NO: 8203771 - DNA, 22 bp, Homo sapiens
aacaaattagttgcaagactgg

SEQ ID NO: 8203772 - DNA, 22 bp, Homo sapiens
aacaaattagttgcaagactgg

SEQ ID NO: 8203773 - DNA, 22 bp, Homo sapiens
aacaaattagttgcaagactgg

SEQ ID NO: 8203774 - DNA, 22 bp, Homo sapiens
aacaaatttagctctgagtgct

SEQ ID NO: 8203775 - DNA, 22 bp, Homo sapiens
aacaaatttagctctgagtgct

SEQ ID NO: 8203776 - DNA, 22 bp, Homo sapiens
aaagcacatgagtagtgtagta

SEQ ID NO: 8203777 - DNA, 22 bp, Homo sapiens
aaagcacatagtagaaggattt

SEQ ID NO: 8203778 - DNA, 22 bp, Homo sapiens
aaagcacattacaagctcagtc

SEQ ID NO: 8203779 - DNA, 22 bp, Homo sapiens
aaagcacagagctcccacagga

SEQ ID NO: 8203780 - DNA, 22 bp, Homo sapiens
aaatggtagtagcattccatat

SEQ ID NO: 8203781 - DNA, 22 bp, Homo sapiens
aaatggtataatgtcatgtatt

SEQ ID NO: 8203782 - DNA, 22 bp, Homo sapiens
aaatggtccatcctaaagaagt

SEQ ID NO: 8203783 - DNA, 23 bp, Homo sapiens
aaatgggtttctgttttgtggac

SEQ ID NO: 8203784 - DNA, 22 bp, Homo sapiens
aaatggtaatgtctttctgttt

SEQ ID NO: 8203785 - DNA, 22 bp, Homo sapiens
aaatggtaggttttcttaagaa

SEQ ID NO: 8203786 - DNA, 22 bp, Homo sapiens
aaatggtaccctaatggccaga

SEQ ID NO: 8203787 - DNA, 22 bp, Homo sapiens
aaatggctgactaaattaaatt

SEQ ID NO: 8203788 - DNA, 22 bp, Homo sapiens
aaatggctgcatttgtgtaaat

SEQ ID NO: 8203789 - DNA, 22 bp, Homo sapiens
aaatgggtttgattctcagcca

SEQ ID NO: 8203790 - DNA, 22 bp, Homo sapiens
aaatggtgaagtgtaatttagc

SEQ ID NO: 8203791 - DNA, 17 bp, Homo sapiens
aaatggtcctagggatt

SEQ ID NO: 8203792 - DNA, 22 bp, Homo sapiens
aaatggtgagggaattgaacag

SEQ ID NO: 8203793 - DNA, 22 bp, Homo sapiens
aaagcaatgggtctaaggtaaa

SEQ ID NO: 8203794 - DNA, 22 bp, Homo sapiens
aaagcaattgtggtttttgcca

SEQ ID NO: 8203795 - DNA, 22 bp, Homo sapiens
aacaagaagagagggacgtaat

SEQ ID NO: 8203796 - DNA, 22 bp, Homo sapiens
aacaagaagggaaggcatgatt

SEQ ID NO: 8203797 - DNA, 22 bp, Homo sapiens
aacaagaagggaaggcatgatt

SEQ ID NO: 8203798 - DNA, 22 bp, Homo sapiens
aacaagaacacctacagttcta

SEQ ID NO: 8203799 - DNA, 22 bp, Homo sapiens
aacaattagactgacggtatta

SEQ ID NO: 8203800 - DNA, 22 bp, Homo sapiens
aacaattagactgacggtatta

SEQ ID NO: 8203801 - DNA, 22 bp, Homo sapiens
aacaattactaccaaggcctgt

SEQ ID NO: 8203802 - DNA, 22 bp, Homo sapiens
aacaattactaccaaggcctgt

SEQ ID NO: 8203803 - DNA, 22 bp, Homo sapiens
aacaatgtgaagtgctgttcag

SEQ ID NO: 8203804 - DNA, 22 bp, Homo sapiens
aacacaaagaagctgcaggatc

SEQ ID NO: 8203805 - DNA, 22 bp, Homo sapiens
aacacaaagaagctgcaggatc

SEQ ID NO: 8203806 - DNA, 22 bp, Homo sapiens
aacaattatcatatacattgca

SEQ ID NO: 8203807 - DNA, 22 bp, Homo sapiens
aacaattatcatatacattgca

SEQ ID NO: 8203808 - DNA, 22 bp, Homo sapiens
aacacaaagaagctgcaggatc

SEQ ID NO: 8203809 - DNA, 22 bp, Homo sapiens
aacacataggcagagcatgaca

SEQ ID NO: 8203810 - DNA, 22 bp, Homo sapiens
aacacataggcagagcatgaca

SEQ ID NO: 8203811 - DNA, 22 bp, Homo sapiens
aacacataggcagagcatgaca

SEQ ID NO: 8203812 - DNA, 22 bp, Homo sapiens
aacagcagcatgacagctgggt

SEQ ID NO: 8203813 - DNA, 22 bp, Homo sapiens
aacagcagctgaggagctgggc

SEQ ID NO: 8203814 - DNA, 22 bp, Homo sapiens
aacagctttagaggataatagt

SEQ ID NO: 8203815 - DNA, 22 bp, Homo sapiens
aacagcttgctgcaccttaata

SEQ ID NO: 8203816 - DNA, 22 bp, Homo sapiens
aacagctttgagcagttctgta

SEQ ID NO: 8203817 - DNA, 22 bp, Homo sapiens
aacagctttgcttctggagaca

SEQ ID NO: 8203818 - DNA, 22 bp, Homo sapiens
aacagctttgcttctggagaca

SEQ ID NO: 8203819 - DNA, 22 bp, Homo sapiens
aacagctttgtatacagtaact

SEQ ID NO: 8203820 - DNA, 22 bp, Homo sapiens
aacagctttgtatacagtaact

SEQ ID NO: 8203821 - DNA, 22 bp, Homo sapiens
aacagcttttttggtcagcatt

SEQ ID NO: 8203822 - DNA, 22 bp, Homo sapiens
aacagcttttttggtcagcatt

SEQ ID NO: 8203823 - DNA, 22 bp, Homo sapiens
aacagctttgtgctcagatttg

SEQ ID NO: 8203824 - DNA, 23 bp, Homo sapiens
aacacattgctaattacattcaa

SEQ ID NO: 8203825 - DNA, 23 bp, Homo sapiens
aacacattgctaattacattcaa

SEQ ID NO: 8203826 - DNA, 23 bp, Homo sapiens
aacacattgctaattacattcaa

SEQ ID NO: 8203827 - DNA, 22 bp, Homo sapiens
aacacattgccagagatcagca

SEQ ID NO: 8203828 - DNA, 22 bp, Homo sapiens
aacacatggcaagagcaggaaa

SEQ ID NO: 8203829 - DNA, 22 bp, Homo sapiens
aacacatgccttaagaataagt

SEQ ID NO: 8203830 - DNA, 22 bp, Homo sapiens
aacacatgccttaagaataagt

SEQ ID NO: 8203831 - DNA, 22 bp, Homo sapiens
aacacatatttatatatgcaca

SEQ ID NO: 8203832 - DNA, 22 bp, Homo sapiens
aacacatatttatatatgcaca

SEQ ID NO: 8203833 - DNA, 21 bp, Homo sapiens
aacacatccagagtatttgac

SEQ ID NO: 8203834 - DNA, 22 bp, Homo sapiens
aacacatgaaagttggtgagta

SEQ ID NO: 8203835 - DNA, 22 bp, Homo sapiens
aacacatgaaagttggtgagta

SEQ ID NO: 8203836 - DNA, 22 bp, Homo sapiens
aacacatatttatatatgcaca

SEQ ID NO: 8203837 - DNA, 22 bp, Homo sapiens
aacacatatttttgctgagcat

SEQ ID NO: 8203838 - DNA, 22 bp, Homo sapiens
aagcaaatgtgggtgcagaatt

SEQ ID NO: 8203839 - DNA, 22 bp, Homo sapiens
aagcaaaggaaagctgactttt

SEQ ID NO: 8203840 - DNA, 22 bp, Homo sapiens
aagcaaaggcaggagcttgtga

SEQ ID NO: 8203841 - DNA, 22 bp, Homo sapiens
aagcaaagtgctttgcctccag

SEQ ID NO: 8203842 - DNA, 22 bp, Homo sapiens
aagcaaagtgaattttgccaag

SEQ ID NO: 8203843 - DNA, 18 bp, Homo sapiens
aagaggaggaaacccagg

SEQ ID NO: 8203844 - DNA, 18 bp, Homo sapiens
aagaggaggaaacccagg

SEQ ID NO: 8203845 - DNA, 22 bp, Homo sapiens
aagaggaggacggttcccagaa

SEQ ID NO: 8203846 - DNA, 22 bp, Homo sapiens
aagaggagacttcagcaacttg

SEQ ID NO: 8203847 - DNA, 22 bp, Homo sapiens
aagaggagacttcagcaacttg

SEQ ID NO: 8203848 - DNA, 18 bp, Homo sapiens
aagaggaggagcaggttg

SEQ ID NO: 8203849 - DNA, 18 bp, Homo sapiens
aagaggaggagcaggttg

SEQ ID NO: 8203850 - DNA, 18 bp, Homo sapiens
aagaggaggagcaggttg

SEQ ID NO: 8203851 - DNA, 18 bp, Homo sapiens
aagaggaggagcaggttg

SEQ ID NO: 8203852 - DNA, 19 bp, Homo sapiens
aaatatcagagagatgata

SEQ ID NO: 8203853 - DNA, 19 bp, Homo sapiens
aaatatcagagagatgata

SEQ ID NO: 8203854 - DNA, 22 bp, Homo sapiens
aaatatcattctggtgcacaga

SEQ ID NO: 8203855 - DNA, 22 bp, Homo sapiens
aaatatcattctggtgcacaga

SEQ ID NO: 8203856 - DNA, 22 bp, Homo sapiens
aaatatcattctggtgcacaga

SEQ ID NO: 8203857 - DNA, 22 bp, Homo sapiens
aaatatcatttataacttttaa

SEQ ID NO: 8203858 - DNA, 22 bp, Homo sapiens
aaatatcatttataacttttaa

SEQ ID NO: 8203859 - DNA, 22 bp, Homo sapiens
aaatatcatttataacttttaa

SEQ ID NO: 8203860 - DNA, 22 bp, Homo sapiens
aagcacagctggaacagcagga

SEQ ID NO: 8203861 - DNA, 22 bp, Homo sapiens
aaatatgactagaatgccaggt

SEQ ID NO: 8203862 - DNA, 22 bp, Homo sapiens
aagcacctgcagttgacaaaaa

SEQ ID NO: 8203863 - DNA, 22 bp, Homo sapiens
aagcaccttccagatttgcacg

SEQ ID NO: 8203864 - DNA, 22 bp, Homo sapiens
aagcacctgggttatatcttag

SEQ ID NO: 8203865 - DNA, 22 bp, Homo sapiens
aagcacctgggttatatcttag

SEQ ID NO: 8203866 - DNA, 22 bp, Homo sapiens
aagcacctgcagttgacaaaaa

SEQ ID NO: 8203867 - DNA, 22 bp, Homo sapiens
aaatatgaatgataagagttat

SEQ ID NO: 8203868 - DNA, 22 bp, Homo sapiens
aaatatgaatgataagagttat

SEQ ID NO: 8203869 - DNA, 22 bp, Homo sapiens
aaatatgaatgataagagttat

SEQ ID NO: 8203870 - DNA, 22 bp, Homo sapiens
aaatatgaatgataagagttat

SEQ ID NO: 8203871 - DNA, 17 bp, Homo sapiens
aaatatgacctcaaagt

SEQ ID NO: 8203872 - DNA, 18 bp, Homo sapiens
aagccagagaccactgcc

SEQ ID NO: 8203873 - DNA, 18 bp, Homo sapiens
aagccagagaccactgcc

SEQ ID NO: 8203874 - DNA, 18 bp, Homo sapiens
aagccagagaccactgcc

SEQ ID NO: 8203875 - DNA, 22 bp, Homo sapiens
aagccagattccttaagcacag

SEQ ID NO: 8203876 - DNA, 22 bp, Homo sapiens
aagccagatagaagaactcatt

SEQ ID NO: 8203877 - DNA, 22 bp, Homo sapiens
aagccagagtttttgagaactt

SEQ ID NO: 8203878 - DNA, 22 bp, Homo sapiens
aagccagatagaagaactcatt

SEQ ID NO: 8203879 - DNA, 22 bp, Homo sapiens
aagccactgagatttcactgca

SEQ ID NO: 8203880 - DNA, 22 bp, Homo sapiens
aagccacaatctgcatcagcat

SEQ ID NO: 8203881 - DNA, 22 bp, Homo sapiens
aagccaatggattggttgcttt

SEQ ID NO: 8203882 - DNA, 22 bp, Homo sapiens
aagccaatgttgcctgggtttc

SEQ ID NO: 8203883 - DNA, 22 bp, Homo sapiens
aagccactatggtgattctcaa

SEQ ID NO: 8203884 - DNA, 22 bp, Homo sapiens
aagcagcagacctgattttgaa

SEQ ID NO: 8203885 - DNA, 22 bp, Homo sapiens
aagcagcagacctgattttgaa

SEQ ID NO: 8203886 - DNA, 22 bp, Homo sapiens
aagcagcagcaggattaaagag

SEQ ID NO: 8203887 - DNA, 22 bp, Homo sapiens
aagcagcacgctttgccaacaa

SEQ ID NO: 8203888 - DNA, 22 bp, Homo sapiens
aagcagcacgctttgccaacaa

SEQ ID NO: 8203889 - DNA, 15 bp, Homo sapiens
aagcagcaatatata

SEQ ID NO: 8203890 - DNA, 22 bp, Homo sapiens
aagcagcaagtttatttctatc

SEQ ID NO: 8203891 - DNA, 22 bp, Homo sapiens
aagcagcacagcaatgactcta

SEQ ID NO: 8203892 - DNA, 22 bp, Homo sapiens
aagcagcacagtaatattggtg

SEQ ID NO: 8203893 - DNA, 23 bp, Homo sapiens
aagcatggttcacagttagtact

SEQ ID NO: 8203894 - DNA, 22 bp, Homo sapiens
aagccaatgagagaggcctcag

SEQ ID NO: 8203895 - DNA, 22 bp, Homo sapiens
aagccaatgatacgggtgatct

SEQ ID NO: 8203896 - DNA, 22 bp, Homo sapiens
aagccaatgctagcccacatgc

SEQ ID NO: 8203897 - DNA, 22 bp, Homo sapiens
aagcagcataattgctatttta

SEQ ID NO: 8203898 - DNA, 22 bp, Homo sapiens
aagcagcagcctgaagtacgtc

SEQ ID NO: 8203899 - DNA, 22 bp, Homo sapiens
aagcagcagccatcccccaagg

SEQ ID NO: 8203900 - DNA, 22 bp, Homo sapiens
aagcagcaagtttatttctatc

SEQ ID NO: 8203901 - DNA, 22 bp, Homo sapiens
aagcagcaacaaactggataaa

SEQ ID NO: 8203902 - DNA, 22 bp, Homo sapiens
aagcagattggggatttccatg

SEQ ID NO: 8203903 - DNA, 22 bp, Homo sapiens
aagcagaaaaactgagctccaa

SEQ ID NO: 8203904 - DNA, 22 bp, Homo sapiens
aagcagaaaaactgagctccaa

SEQ ID NO: 8203905 - DNA, 22 bp, Homo sapiens
aagcagaaagaacaactgagtg

SEQ ID NO: 8203906 - DNA, 22 bp, Homo sapiens
aagcactgggaggaggctgaga

SEQ ID NO: 8203907 - DNA, 22 bp, Homo sapiens
aagcactggggccacagacacg

SEQ ID NO: 8203908 - DNA, 22 bp, Homo sapiens
aagcactgtacaaatgtcactt

SEQ ID NO: 8203909 - DNA, 22 bp, Homo sapiens
aagcactttagtgagaataagg

SEQ ID NO: 8203910 - DNA, 22 bp, Homo sapiens
aagcacttggttttggaaagtt

SEQ ID NO: 8203911 - DNA, 22 bp, Homo sapiens
aagcacttagaagagtgcctgc

SEQ ID NO: 8203912 - DNA, 22 bp, Homo sapiens
aagcacttagaagagtgcctgc

SEQ ID NO: 8203913 - DNA, 22 bp, Homo sapiens
aagaatgagctcaaagatctta

SEQ ID NO: 8203914 - DNA, 22 bp, Homo sapiens
aagaatgattacaaagcaacga

SEQ ID NO: 8203915 - DNA, 22 bp, Homo sapiens
aagaatgagctcaaagatctta

SEQ ID NO: 8203916 - DNA, 22 bp, Homo sapiens
aagaatgtgggtggatatgatg

SEQ ID NO: 8203917 - DNA, 22 bp, Homo sapiens
aagaatgtctctggtgaggcgc

SEQ ID NO: 8203918 - DNA, 22 bp, Homo sapiens
aagaatggtggtggggccagca

SEQ ID NO: 8203919 - DNA, 22 bp, Homo sapiens
aagaaagtgggtaatatgattt

SEQ ID NO: 8203920 - DNA, 22 bp, Homo sapiens
aagaaagtgtggagagcctagc

SEQ ID NO: 8203921 - DNA, 22 bp, Homo sapiens
aagaaagtgtggagagcctagc

SEQ ID NO: 8203922 - DNA, 22 bp, Homo sapiens
aagaaaggtgtgtttgcagatg

SEQ ID NO: 8203923 - DNA, 22 bp, Homo sapiens
aagaaagggctattgttctcca

SEQ ID NO: 8203924 - DNA, 22 bp, Homo sapiens
aagaaagtgctttgtaaattat

SEQ ID NO: 8203925 - DNA, 22 bp, Homo sapiens
aagaaagtgctttgtaaattat

SEQ ID NO: 8203926 - DNA, 22 bp, Homo sapiens
aagaaagtgatgagctacagat

SEQ ID NO: 8203927 - DNA, 22 bp, Homo sapiens
aagaaagtgctttgtaaattat

SEQ ID NO: 8203928 - DNA, 22 bp, Homo sapiens
aagaaagtgatgagctacagat

SEQ ID NO: 8203929 - DNA, 22 bp, Homo sapiens
aagaaagggagaaggatggtgt

SEQ ID NO: 8203930 - DNA, 22 bp, Homo sapiens
aagaaaggatatatgggaggta

SEQ ID NO: 8203931 - DNA, 22 bp, Homo sapiens
aagaaagccaaagttcatacct

SEQ ID NO: 8203932 - DNA, 22 bp, Homo sapiens
aacttttctgtgttgtccggga

SEQ ID NO: 8203933 - DNA, 22 bp, Homo sapiens
aacttttgtccgatctcctgga

SEQ ID NO: 8203934 - DNA, 22 bp, Homo sapiens
aacttttaaaatacacagacaa

SEQ ID NO: 8203935 - DNA, 22 bp, Homo sapiens
aacttttaaaatacacagacaa

SEQ ID NO: 8203936 - DNA, 22 bp, Homo sapiens
aacttttacaaattgtcatcat

SEQ ID NO: 8203937 - DNA, 22 bp, Homo sapiens
aacttttacaaattgtcatcat

SEQ ID NO: 8203938 - DNA, 22 bp, Homo sapiens
aacttttagacttgggtataaa

SEQ ID NO: 8203939 - DNA, 23 bp, Homo sapiens
aacttttagagtttaacagtgtt

SEQ ID NO: 8203940 - DNA, 22 bp, Homo sapiens
aacttttcattccaaaggtgct

SEQ ID NO: 8203941 - DNA, 22 bp, Homo sapiens
aacttttcattgaatcatgtca

SEQ ID NO: 8203942 - DNA, 22 bp, Homo sapiens
aacttttcataagggcaaattt

SEQ ID NO: 8203943 - DNA, 22 bp, Homo sapiens
aacttttcattccaaaggtgct

SEQ ID NO: 8203944 - DNA, 22 bp, Homo sapiens
aacttttcacaggctagctctt

SEQ ID NO: 8203945 - DNA, 22 bp, Homo sapiens
aactttctttgcatctaagttt

SEQ ID NO: 8203946 - DNA, 22 bp, Homo sapiens
aactttcttgtgacatttgggg

SEQ ID NO: 8203947 - DNA, 22 bp, Homo sapiens
aacttggcttgcatggctgaaa

SEQ ID NO: 8203948 - DNA, 22 bp, Homo sapiens
aactttgcaagggggccctgcg

SEQ ID NO: 8203949 - DNA, 20 bp, Homo sapiens
aactttgcattttattctcc

SEQ ID NO: 8203950 - DNA, 22 bp, Homo sapiens
aactttgaggtcactgaattcc

SEQ ID NO: 8203951 - DNA, 22 bp, Homo sapiens
aactttgggcctaagtactgtt

SEQ ID NO: 8203952 - DNA, 22 bp, Homo sapiens
aactttgggcctaagtactgtt

SEQ ID NO: 8203953 - DNA, 21 bp, Homo sapiens
aactttgcttaactgtgtgga

SEQ ID NO: 8203954 - DNA, 19 bp, Homo sapiens
aactttgctaccctatcct

SEQ ID NO: 8203955 - DNA, 22 bp, Homo sapiens
aactttgggtaatgcttcaatt

SEQ ID NO: 8203956 - DNA, 22 bp, Homo sapiens
aactttggtaatttactgggaa

SEQ ID NO: 8203957 - DNA, 22 bp, Homo sapiens
aactttgttttattcactgctg

SEQ ID NO: 8203958 - DNA, 22 bp, Homo sapiens
aagagccagctagtgaagaggc

SEQ ID NO: 8203959 - DNA, 22 bp, Homo sapiens
aagagccagtgggaaagtcttg

SEQ ID NO: 8203960 - DNA, 22 bp, Homo sapiens
aagagccaggacagatccagct

SEQ ID NO: 8203961 - DNA, 22 bp, Homo sapiens
aagagccagtgggaaagtcttg

SEQ ID NO: 8203962 - DNA, 22 bp, Homo sapiens
aagagcatgttaattctaggac

SEQ ID NO: 8203963 - DNA, 22 bp, Homo sapiens
aagagcatctatttcacagtgg

SEQ ID NO: 8203964 - DNA, 22 bp, Homo sapiens
aagagccatatatgcagctaga

SEQ ID NO: 8203965 - DNA, 22 bp, Homo sapiens
aagagccctggttgaaaataac

SEQ ID NO: 8203966 - DNA, 22 bp, Homo sapiens
aagaggaagtctccatggagag

SEQ ID NO: 8203967 - DNA, 22 bp, Homo sapiens
aagagcctctgtgtttcagcct

SEQ ID NO: 8203968 - DNA, 22 bp, Homo sapiens
aagaggagaaaggctggctttg

SEQ ID NO: 8203969 - DNA, 22 bp, Homo sapiens
aagaggacttgtgaagatgtac

SEQ ID NO: 8203970 - DNA, 22 bp, Homo sapiens
aagaggaagtctccatggagag

SEQ ID NO: 8203971 - DNA, 22 bp, Homo sapiens
aagaattatctgaaagctgtgt

SEQ ID NO: 8203972 - DNA, 22 bp, Homo sapiens
aagacactaagctttcaggata

SEQ ID NO: 8203973 - DNA, 22 bp, Homo sapiens
aagacactgggggctgcagcca

SEQ ID NO: 8203974 - DNA, 22 bp, Homo sapiens
aagacactgatactctgtgatt

SEQ ID NO: 8203975 - DNA, 22 bp, Homo sapiens
aagacactcattatcactggtt

SEQ ID NO: 8203976 - DNA, 17 bp, Homo sapiens
aagacagaagccatgag

SEQ ID NO: 8203977 - DNA, 22 bp, Homo sapiens
aagacactttctaaatagaagt

SEQ ID NO: 8203978 - DNA, 22 bp, Homo sapiens
aagacactgggttaggcacgtg

SEQ ID NO: 8203979 - DNA, 22 bp, Homo sapiens
aagagagagttcctaggcaaaa

SEQ ID NO: 8203980 - DNA, 22 bp, Homo sapiens
aagagagagttcctaggcaaaa

SEQ ID NO: 8203981 - DNA, 22 bp, Homo sapiens
aagacagagggaagcaatgatg

SEQ ID NO: 8203982 - DNA, 22 bp, Homo sapiens
aagacagagggaagcaatgatg

SEQ ID NO: 8203983 - DNA, 22 bp, Homo sapiens
aagacagagactctgcaacagg

SEQ ID NO: 8203984 - DNA, 20 bp, Homo sapiens
aagagaggaagttatactag

SEQ ID NO: 8203985 - DNA, 22 bp, Homo sapiens
aagagcagtgttttactcagct

SEQ ID NO: 8203986 - DNA, 17 bp, Homo sapiens
aagacagaagccatgag

SEQ ID NO: 8203987 - DNA, 17 bp, Homo sapiens
aagacagaagccatgag

SEQ ID NO: 8203988 - DNA, 22 bp, Homo sapiens
aagacagaccacgtgacagggc

SEQ ID NO: 8203989 - DNA, 22 bp, Homo sapiens
aagacagaagtgatttgatgtg

SEQ ID NO: 8203990 - DNA, 22 bp, Homo sapiens
aagacagagactctgcaacagg

SEQ ID NO: 8203991 - DNA, 22 bp, Homo sapiens
aagacagagactctgcaacagg

SEQ ID NO: 8203992 - DNA, 22 bp, Homo sapiens
aagacagaccacgtgacagggc

SEQ ID NO: 8203993 - DNA, 22 bp, Homo sapiens
aaccaggaattgcagggctgca

SEQ ID NO: 8203994 - DNA, 19 bp, Homo sapiens
aaccaggacaaggggctgg

SEQ ID NO: 8203995 - DNA, 22 bp, Homo sapiens
aaccagatcgactgttaacagc

SEQ ID NO: 8203996 - DNA, 22 bp, Homo sapiens
aatcactttgcactcttatttg

SEQ ID NO: 8203997 - DNA, 22 bp, Homo sapiens
aatcagaaaattcagtggaatt

SEQ ID NO: 8203998 - DNA, 22 bp, Homo sapiens
aatcacttcagtttttggacag

SEQ ID NO: 8203999 - DNA, 22 bp, Homo sapiens
aatcacttgtgccatgggtacc

SEQ ID NO: 8204000 - DNA, 22 bp, Homo sapiens
aatcacttgtaaggaattcaat

SEQ ID NO: 8204001 - DNA, 22 bp, Homo sapiens
aatcacattacagcatatctgt

SEQ ID NO: 8204002 - DNA, 22 bp, Homo sapiens
aatcacattagtgaaacactga

SEQ ID NO: 8204003 - DNA, 22 bp, Homo sapiens
aatcacattagtgaaacactga

SEQ ID NO: 8204004 - DNA, 22 bp, Homo sapiens
aatcacatttacattgctaatt

SEQ ID NO: 8204005 - DNA, 22 bp, Homo sapiens
aaccagtttagtcatgctgtaa

SEQ ID NO: 8204006 - DNA, 22 bp, Homo sapiens
aaccaggtgactcatggtgagc

SEQ ID NO: 8204007 - DNA, 22 bp, Homo sapiens
aaccaggtgactcatggtgagc

SEQ ID NO: 8204008 - DNA, 22 bp, Homo sapiens
aaccagtactttacacagctct

SEQ ID NO: 8204009 - DNA, 22 bp, Homo sapiens
aactatacatatttacatagac

SEQ ID NO: 8204010 - DNA, 22 bp, Homo sapiens
aactcagttacatattagaata

SEQ ID NO: 8204011 - DNA, 22 bp, Homo sapiens
aactatacatatttacatagac

SEQ ID NO: 8204012 - DNA, 22 bp, Homo sapiens
aactcagttacatattagaata

SEQ ID NO: 8204013 - DNA, 22 bp, Homo sapiens
aactcagttacatattagaata

SEQ ID NO: 8204014 - DNA, 22 bp, Homo sapiens
aactcagttacatattagaata

SEQ ID NO: 8204015 - DNA, 22 bp, Homo sapiens
aactataatggggttaggaaat

SEQ ID NO: 8204016 - DNA, 22 bp, Homo sapiens
aactatacatatttacatagac

SEQ ID NO: 8204017 - DNA, 22 bp, Homo sapiens
aactcccactcagcttcttaat

SEQ ID NO: 8204018 - DNA, 20 bp, Homo sapiens
aactccggcgggcgcggagt

SEQ ID NO: 8204019 - DNA, 20 bp, Homo sapiens
aactcctagcctcaagtgat

SEQ ID NO: 8204020 - DNA, 20 bp, Homo sapiens
aactcctagcctcaagtgat

SEQ ID NO: 8204021 - DNA, 22 bp, Homo sapiens
aactccagggggtcaatattta

SEQ ID NO: 8204022 - DNA, 22 bp, Homo sapiens
aactccaggtcctttgaatctg

SEQ ID NO: 8204023 - DNA, 22 bp, Homo sapiens
aactccagctcacacagtgacc

SEQ ID NO: 8204024 - DNA, 22 bp, Homo sapiens
aactccaggcagggaggccact

SEQ ID NO: 8204025 - DNA, 22 bp, Homo sapiens
aactccaggcagggaggccact

SEQ ID NO: 8204026 - DNA, 22 bp, Homo sapiens
aactcatttgcatttttcctgt

SEQ ID NO: 8204027 - DNA, 22 bp, Homo sapiens
aactccagactactaatttagt

SEQ ID NO: 8204028 - DNA, 22 bp, Homo sapiens
aactcattctaagtataccaaa

SEQ ID NO: 8204029 - DNA, 22 bp, Homo sapiens
aatcacatgtgggtcttgtagc

SEQ ID NO: 8204030 - DNA, 22 bp, Homo sapiens
aatcacatgtgggtcttgtagc

SEQ ID NO: 8204031 - DNA, 22 bp, Homo sapiens
aatatttgaacagtcactgagt

SEQ ID NO: 8204032 - DNA, 22 bp, Homo sapiens
aatatttgaacagtcactgagt

SEQ ID NO: 8204033 - DNA, 22 bp, Homo sapiens
aatcacatgcagggcctccacc

SEQ ID NO: 8204034 - DNA, 22 bp, Homo sapiens
aacatttattgagcacctactg

SEQ ID NO: 8204035 - DNA, 22 bp, Homo sapiens
aacatttattgagcacctactg

SEQ ID NO: 8204036 - DNA, 22 bp, Homo sapiens
aacatttattgagcacctactg

SEQ ID NO: 8204037 - DNA, 22 bp, Homo sapiens
aacatttcagcacctgattcct

SEQ ID NO: 8204038 - DNA, 22 bp, Homo sapiens
aacatttatatgggttcatgaa

SEQ ID NO: 8204039 - DNA, 22 bp, Homo sapiens
aacatttatgattgaggtaaat

SEQ ID NO: 8204040 - DNA, 22 bp, Homo sapiens
aacatttatgattgaggtaaat

SEQ ID NO: 8204041 - DNA, 22 bp, Homo sapiens
aacatttatgattgaggtaaat

SEQ ID NO: 8204042 - DNA, 22 bp, Homo sapiens
aacatttatatgggttcatgaa

SEQ ID NO: 8204043 - DNA, 22 bp, Homo sapiens
aacatttaggaaggacctcctc

SEQ ID NO: 8204044 - DNA, 22 bp, Homo sapiens
aacatttattctaattctggga

SEQ ID NO: 8204045 - DNA, 22 bp, Homo sapiens
aacatttattctaattctggga

SEQ ID NO: 8204046 - DNA, 22 bp, Homo sapiens
aacatttattctaattctggga

SEQ ID NO: 8204047 - DNA, 22 bp, Homo sapiens
aacatttattgagcacctactg

SEQ ID NO: 8204048 - DNA, 22 bp, Homo sapiens
aacatttatggtagtcattgca

SEQ ID NO: 8204049 - DNA, 22 bp, Homo sapiens
aacatttatggtagtcattgca

SEQ ID NO: 8204050 - DNA, 22 bp, Homo sapiens
aacattaagatggcggaacagt

SEQ ID NO: 8204051 - DNA, 22 bp, Homo sapiens
aacataaatttgaagtggcaaa

SEQ ID NO: 8204052 - DNA, 22 bp, Homo sapiens
aacagtttgtggatagcttgta

SEQ ID NO: 8204053 - DNA, 20 bp, Homo sapiens
aacattgaaagtctagaaga

SEQ ID NO: 8204054 - DNA, 22 bp, Homo sapiens
aacattgaaatatttgcaatag

SEQ ID NO: 8204055 - DNA, 20 bp, Homo sapiens
aacattgaaagtctagaaga

SEQ ID NO: 8204056 - DNA, 22 bp, Homo sapiens
aacattggatatttattaaaag

SEQ ID NO: 8204057 - DNA, 22 bp, Homo sapiens
aacatttacaaatccttctgca

SEQ ID NO: 8204058 - DNA, 22 bp, Homo sapiens
aacatttacaaatccttctgca

SEQ ID NO: 8204059 - DNA, 22 bp, Homo sapiens
aagtttgatgagtttctggagg

SEQ ID NO: 8204060 - DNA, 20 bp, Homo sapiens
aagtttggagtcaggagacc

SEQ ID NO: 8204061 - DNA, 22 bp, Homo sapiens
aagtttggaatgatagagacct

SEQ ID NO: 8204062 - DNA, 22 bp, Homo sapiens
aataaacaaaggacaaggaggt

SEQ ID NO: 8204063 - DNA, 22 bp, Homo sapiens
aataaaatggtcagttttctca

SEQ ID NO: 8204064 - DNA, 22 bp, Homo sapiens
aataaaatggtcagttttctca

SEQ ID NO: 8204065 - DNA, 22 bp, Homo sapiens
aataaaatggtcagttttctca

SEQ ID NO: 8204066 - DNA, 22 bp, Homo sapiens
aataaaatggtcagttttctca

SEQ ID NO: 8204067 - DNA, 22 bp, Homo sapiens
aataaaatggtcagttttctca

SEQ ID NO: 8204068 - DNA, 22 bp, Homo sapiens
aataaaatggtcagttttctca

SEQ ID NO: 8204069 - DNA, 22 bp, Homo sapiens
aataaaatggtcagttttctca

SEQ ID NO: 8204070 - DNA, 20 bp, Homo sapiens
aagttgcagagagttgtctt

SEQ ID NO: 8204071 - DNA, 22 bp, Homo sapiens
aagtttctgatattgttaaagc

SEQ ID NO: 8204072 - DNA, 22 bp, Homo sapiens
aagtttctgatattgttaaagc

SEQ ID NO: 8204073 - DNA, 22 bp, Homo sapiens
aagtttctggaccttacctgct

SEQ ID NO: 8204074 - DNA, 22 bp, Homo sapiens
aagtttctttattagcttgtcc

SEQ ID NO: 8204075 - DNA, 22 bp, Homo sapiens
aagtttgacagaagtttctaat

SEQ ID NO: 8204076 - DNA, 22 bp, Homo sapiens
aacagtttgagctttgaatttc

SEQ ID NO: 8204077 - DNA, 22 bp, Homo sapiens
aacagtttgcctgaaatgtatt

SEQ ID NO: 8204078 - DNA, 22 bp, Homo sapiens
aataaacttccactgtgttttt

SEQ ID NO: 8204079 - DNA, 22 bp, Homo sapiens
aataaactgctcaattgcatca

SEQ ID NO: 8204080 - DNA, 22 bp, Homo sapiens
aataaactgctcaattgcatca

SEQ ID NO: 8204081 - DNA, 20 bp, Homo sapiens
aataaactactgagagatgt

SEQ ID NO: 8204082 - DNA, 20 bp, Homo sapiens
aataaactactgagagatgt

SEQ ID NO: 8204083 - DNA, 20 bp, Homo sapiens
aataaactactgagagatgt

SEQ ID NO: 8204084 - DNA, 22 bp, Homo sapiens
aataaacaaatctttcctgtgg

SEQ ID NO: 8204085 - DNA, 22 bp, Homo sapiens
aataaacaaatctttcctgtgg

SEQ ID NO: 8204086 - DNA, 22 bp, Homo sapiens
aataaacaaatctttcctgtgg

SEQ ID NO: 8204087 - DNA, 22 bp, Homo sapiens
aataaacaaatccttccttccc

SEQ ID NO: 8204088 - DNA, 22 bp, Homo sapiens
aataaacaaatccttccttccc

SEQ ID NO: 8204089 - DNA, 22 bp, Homo sapiens
aagttgaatcagtaacacagtt

SEQ ID NO: 8204090 - DNA, 22 bp, Homo sapiens
aagttgaatcagtaacacagtt

SEQ ID NO: 8204091 - DNA, 22 bp, Homo sapiens
aagttgatttaaactactagtc

SEQ ID NO: 8204092 - DNA, 22 bp, Homo sapiens
aagttgattgcttcaaatttct

SEQ ID NO: 8204093 - DNA, 22 bp, Homo sapiens
aagttgattaatctttcgagaa

SEQ ID NO: 8204094 - DNA, 22 bp, Homo sapiens
aagttgatttaaactactagtc

SEQ ID NO: 8204095 - DNA, 19 bp, Homo sapiens
aagttgatcattttgacag

SEQ ID NO: 8204096 - DNA, 22 bp, Homo sapiens
aagttgatagcatgttaagctc

SEQ ID NO: 8204097 - DNA, 22 bp, Homo sapiens
aagttgatcaagtagcgagttc

SEQ ID NO: 8204098 - DNA, 19 bp, Homo sapiens
aagttgatcattttgacag

SEQ ID NO: 8204099 - DNA, 22 bp, Homo sapiens
aagttgattaatctttcgagaa

SEQ ID NO: 8204100 - DNA, 23 bp, Homo sapiens
aagttcttaggttgatactaatg

SEQ ID NO: 8204101 - DNA, 22 bp, Homo sapiens
aagttcttgaagactttaaata

SEQ ID NO: 8204102 - DNA, 20 bp, Homo sapiens
aagttacattgtattgtacc

SEQ ID NO: 8204103 - DNA, 20 bp, Homo sapiens
aagttacattgtattgtacc

SEQ ID NO: 8204104 - DNA, 22 bp, Homo sapiens
aacactgtactggaagatggac

SEQ ID NO: 8204105 - DNA, 22 bp, Homo sapiens
aacactgtactggaagatggac

SEQ ID NO: 8204106 - DNA, 22 bp, Homo sapiens
aagttctatatctgcctcacca

SEQ ID NO: 8204107 - DNA, 22 bp, Homo sapiens
aacactgtactggaagatggac

SEQ ID NO: 8204108 - DNA, 22 bp, Homo sapiens
aacactgtaacagcatcatttt

SEQ ID NO: 8204109 - DNA, 22 bp, Homo sapiens
aacactgtaacagcatcatttt

SEQ ID NO: 8204110 - DNA, 22 bp, Homo sapiens
aacactgtaacagcatcatttt

SEQ ID NO: 8204111 - DNA, 22 bp, Homo sapiens
aacactgtaacagcatcatttt

SEQ ID NO: 8204112 - DNA, 22 bp, Homo sapiens
aagtatttcgttctgaaaaagt

SEQ ID NO: 8204113 - DNA, 22 bp, Homo sapiens
aagtatttcgttctgaaaaagt

SEQ ID NO: 8204114 - DNA, 22 bp, Homo sapiens
aagtatttcgttctgaaaaagt

SEQ ID NO: 8204115 - DNA, 22 bp, Homo sapiens
aagtatttcgttctgaaaaagt

SEQ ID NO: 8204116 - DNA, 22 bp, Homo sapiens
aagtatttcgttctgaaaaagt

SEQ ID NO: 8204117 - DNA, 22 bp, Homo sapiens
aagtatttctggcctgtgaaag

SEQ ID NO: 8204118 - DNA, 22 bp, Homo sapiens
aagtatttggaatggcattttt

SEQ ID NO: 8204119 - DNA, 22 bp, Homo sapiens
aagtatttcagcggttctttgt

SEQ ID NO: 8204120 - DNA, 22 bp, Homo sapiens
aagtattgtgggaaagcagaaa

SEQ ID NO: 8204121 - DNA, 22 bp, Homo sapiens
aacactgctgctgggttctgtg

SEQ ID NO: 8204122 - DNA, 22 bp, Homo sapiens
aacactgatggaaagtatgttt

SEQ ID NO: 8204123 - DNA, 22 bp, Homo sapiens
aacactgctccaaaaaaggctt

SEQ ID NO: 8204124 - DNA, 22 bp, Homo sapiens
aacactgagtatcagagttggg

SEQ ID NO: 8204125 - DNA, 22 bp, Homo sapiens
aacactggaagggacatcaagt

SEQ ID NO: 8204126 - DNA, 22 bp, Homo sapiens
aacactgagggaaaagagatag

SEQ ID NO: 8204127 - DNA, 22 bp, Homo sapiens
aagtcaagtactacaggaaaca

SEQ ID NO: 8204128 - DNA, 22 bp, Homo sapiens
aaatttcaagcaaagtagctat

SEQ ID NO: 8204129 - DNA, 20 bp, Homo sapiens
aaatttaggaaattttacgc

SEQ ID NO: 8204130 - DNA, 20 bp, Homo sapiens
aaatttaggaaattttacgc

SEQ ID NO: 8204131 - DNA, 22 bp, Homo sapiens
aaatttcaagcaaagtagctat

SEQ ID NO: 8204132 - DNA, 22 bp, Homo sapiens
aaatttctaagcagccacttcc

SEQ ID NO: 8204133 - DNA, 22 bp, Homo sapiens
aaatttctaagcagccacttcc

SEQ ID NO: 8204134 - DNA, 22 bp, Homo sapiens
aaatttctaagcagccacttcc

SEQ ID NO: 8204135 - DNA, 22 bp, Homo sapiens
aaggccaactaggatgagctag

SEQ ID NO: 8204136 - DNA, 22 bp, Homo sapiens
aaggcatttgttggatttctca

SEQ ID NO: 8204137 - DNA, 23 bp, Homo sapiens
aaggccagaatttcaatggtgcc

SEQ ID NO: 8204138 - DNA, 22 bp, Homo sapiens
aaggccagacaggaccacatct

SEQ ID NO: 8204139 - DNA, 22 bp, Homo sapiens
aaggccagacaggaccacatct

SEQ ID NO: 8204140 - DNA, 22 bp, Homo sapiens
aaggccagacaggaccacatct

SEQ ID NO: 8204141 - DNA, 23 bp, Homo sapiens
aaggccagaatttcaatggtgcc

SEQ ID NO: 8204142 - DNA, 23 bp, Homo sapiens
aaggccagaatttcaatggtgcc

SEQ ID NO: 8204143 - DNA, 23 bp, Homo sapiens
aaggccagaatttcaatggtgcc

SEQ ID NO: 8204144 - DNA, 22 bp, Homo sapiens
aacaaatgtgtggcagtgtggg

SEQ ID NO: 8204145 - DNA, 22 bp, Homo sapiens
aacaaatgtgttttgtaattaa

SEQ ID NO: 8204146 - DNA, 22 bp, Homo sapiens
aaggccagacaggaccacatct

SEQ ID NO: 8204147 - DNA, 22 bp, Homo sapiens
aaggccagactctggaatgaca

SEQ ID NO: 8204148 - DNA, 22 bp, Homo sapiens
aaggccagactctggaatgaca

SEQ ID NO: 8204149 - DNA, 22 bp, Homo sapiens
aaggccagactctggaatgaca

SEQ ID NO: 8204150 - DNA, 22 bp, Homo sapiens
aaggccaccaccagcgaggggg

SEQ ID NO: 8204151 - DNA, 22 bp, Homo sapiens
aaggccacagagcctcagagag

SEQ ID NO: 8204152 - DNA, 22 bp, Homo sapiens
aaggccacagagcctcagagag

SEQ ID NO: 8204153 - DNA, 22 bp, Homo sapiens
aaggccaaggctgcagtgagcc

SEQ ID NO: 8204154 - DNA, 22 bp, Homo sapiens
aagggagacagttgtgtgagga

SEQ ID NO: 8204155 - DNA, 22 bp, Homo sapiens
aacaataattgcggttctctat

SEQ ID NO: 8204156 - DNA, 22 bp, Homo sapiens
aagggagacagttgtgtgagga

SEQ ID NO: 8204157 - DNA, 22 bp, Homo sapiens
aacaataattgcggttctctat

SEQ ID NO: 8204158 - DNA, 22 bp, Homo sapiens
aacaataactagacatgccatg

SEQ ID NO: 8204159 - DNA, 22 bp, Homo sapiens
aacaataactagacatgccatg

SEQ ID NO: 8204160 - DNA, 22 bp, Homo sapiens
aagggagacagttgtgtgagga

SEQ ID NO: 8204161 - DNA, 22 bp, Homo sapiens
aagggagacccaccgtcctgga

SEQ ID NO: 8204162 - DNA, 22 bp, Homo sapiens
aacaataactagacatgccatg

SEQ ID NO: 8204163 - DNA, 22 bp, Homo sapiens
aacaataactagacatgccatg

SEQ ID NO: 8204164 - DNA, 22 bp, Homo sapiens
aacaataactagacatgccatg

SEQ ID NO: 8204165 - DNA, 22 bp, Homo sapiens
aacaagttgttgaaaataatta

SEQ ID NO: 8204166 - DNA, 22 bp, Homo sapiens
aacaagtgtattaatggaaata

SEQ ID NO: 8204167 - DNA, 22 bp, Homo sapiens
aacaagtgatatataatggaag

SEQ ID NO: 8204168 - DNA, 22 bp, Homo sapiens
aacaagtgagtcatttaaactc

SEQ ID NO: 8204169 - DNA, 22 bp, Homo sapiens
aacaagtgagtcatttaaactc

SEQ ID NO: 8204170 - DNA, 22 bp, Homo sapiens
aacaagtgatgctcatgattca

SEQ ID NO: 8204171 - DNA, 22 bp, Homo sapiens
aacaagtgatgctcatgattca

SEQ ID NO: 8204172 - DNA, 22 bp, Homo sapiens
aacaagtgaaagtccttttcga

SEQ ID NO: 8204173 - DNA, 22 bp, Homo sapiens
aacaagatagatatcacttagg

SEQ ID NO: 8204174 - DNA, 22 bp, Homo sapiens
aacaagatagatatcacttagg

SEQ ID NO: 8204175 - DNA, 22 bp, Homo sapiens
aacaagcagatgcaatgcactt

SEQ ID NO: 8204176 - DNA, 22 bp, Homo sapiens
aacaataggctatatgctaggc

SEQ ID NO: 8204177 - DNA, 23 bp, Homo sapiens
aacaatagagataaagtgagatc

SEQ ID NO: 8204178 - DNA, 22 bp, Homo sapiens
aacaataattgcggttctctat

SEQ ID NO: 8204179 - DNA, 18 bp, Homo sapiens
aagtatgcctatgttatt

SEQ ID NO: 8204180 - DNA, 22 bp, Homo sapiens
aagtatgtctttgggtattatt

SEQ ID NO: 8204181 - DNA, 22 bp, Homo sapiens
aagtatgtgtgggatgctggga

SEQ ID NO: 8204182 - DNA, 22 bp, Homo sapiens
aacaatgccacattaagtgtat

SEQ ID NO: 8204183 - DNA, 22 bp, Homo sapiens
aagtacaatctttctgtaaagg

SEQ ID NO: 8204184 - DNA, 22 bp, Homo sapiens
aagtacaatctttctgtaaagg

SEQ ID NO: 8204185 - DNA, 22 bp, Homo sapiens
aaggggcatgcttttgccagga

SEQ ID NO: 8204186 - DNA, 22 bp, Homo sapiens
aaggggcatgcttttgccagga

SEQ ID NO: 8204187 - DNA, 22 bp, Homo sapiens
aaggggcctcacagatgggctt

SEQ ID NO: 8204188 - DNA, 22 bp, Homo sapiens
aaggggcctcacagatgggctt

SEQ ID NO: 8204189 - DNA, 22 bp, Homo sapiens
aaggggctcttgtcaggcgcag

SEQ ID NO: 8204190 - DNA, 22 bp, Homo sapiens
aaggggagttagtgataaaacc

SEQ ID NO: 8204191 - DNA, 22 bp, Homo sapiens
aaggggatttaaggtaagaaga

SEQ ID NO: 8204192 - DNA, 21 bp, Homo sapiens
aaggggcaaacccaggacacc

SEQ ID NO: 8204193 - DNA, 21 bp, Homo sapiens
aaggggcaaacccaggacacc

SEQ ID NO: 8204194 - DNA, 21 bp, Homo sapiens
aaggggcaaacccaggacacc

SEQ ID NO: 8204195 - DNA, 22 bp, Homo sapiens
aaggggaagtagcaccagaggt

SEQ ID NO: 8204196 - DNA, 22 bp, Homo sapiens
aaggggaatagagtgggttgtg

SEQ ID NO: 8204197 - DNA, 22 bp, Homo sapiens
aaggggaagtagcaccagaggt

SEQ ID NO: 8204198 - DNA, 22 bp, Homo sapiens
aaggggagatgtcatgggccct

SEQ ID NO: 8204199 - DNA, 22 bp, Homo sapiens
aaggggagatgtcatgggccct

SEQ ID NO: 8204200 - DNA, 22 bp, Homo sapiens
aagggctggagactgggtcttc

SEQ ID NO: 8204201 - DNA, 22 bp, Homo sapiens
aagggctggagactgggtcttc

SEQ ID NO: 8204202 - DNA, 22 bp, Homo sapiens
aaggggaagtagcaccagaggt

SEQ ID NO: 8204203 - DNA, 22 bp, Homo sapiens
aagggagcttaggagatcaggc

SEQ ID NO: 8204204 - DNA, 21 bp, Homo sapiens
aagggagataggaatcaggcc

SEQ ID NO: 8204205 - DNA, 21 bp, Homo sapiens
aagggagataggaatcaggcc

SEQ ID NO: 8204206 - DNA, 22 bp, Homo sapiens
aagggagcaaatggacagacgg

SEQ ID NO: 8204207 - DNA, 22 bp, Homo sapiens
aagggagcaaatggacagacgg

SEQ ID NO: 8204208 - DNA, 22 bp, Homo sapiens
aagggagccaagaaagcagggc

SEQ ID NO: 8204209 - DNA, 22 bp, Homo sapiens
aaggacctgattttgagcatct

SEQ ID NO: 8204210 - DNA, 21 bp, Homo sapiens
aaggacgaggttttgattaca

SEQ ID NO: 8204211 - DNA, 22 bp, Homo sapiens
aaggacctatattgtcagagga

SEQ ID NO: 8204212 - DNA, 22 bp, Homo sapiens
aaggactagattatacaatagg

SEQ ID NO: 8204213 - DNA, 22 bp, Homo sapiens
aaggactagatattcatacatg

SEQ ID NO: 8204214 - DNA, 22 bp, Homo sapiens
aaggactctccagctagcaaat

SEQ ID NO: 8204215 - DNA, 22 bp, Homo sapiens
aaggagaaatggtagatgtgca

SEQ ID NO: 8204216 - DNA, 22 bp, Homo sapiens
aaggactgtctaaggcctccaa

SEQ ID NO: 8204217 - DNA, 22 bp, Homo sapiens
aaattgcattttaaaggtagat

SEQ ID NO: 8204218 - DNA, 18 bp, Homo sapiens
aaattgtgtaggagtcca

SEQ ID NO: 8204219 - DNA, 22 bp, Homo sapiens
aaattgttgatctacagtaagg

SEQ ID NO: 8204220 - DNA, 22 bp, Homo sapiens
aaattgttgatctacagtaagg

SEQ ID NO: 8204221 - DNA, 20 bp, Homo sapiens
aaattgtgtttgtgagctcc

SEQ ID NO: 8204222 - DNA, 22 bp, Homo sapiens
aaattgtggcgtctgtaagagt

SEQ ID NO: 8204223 - DNA, 22 bp, Homo sapiens
aaattgtgtctcaggcagtggt

SEQ ID NO: 8204224 - DNA, 22 bp, Homo sapiens
aaatttaaaaagcagcattgca

SEQ ID NO: 8204225 - DNA, 22 bp, Homo sapiens
aaatttaaaaagcagcattgca

SEQ ID NO: 8204226 - DNA, 22 bp, Homo sapiens
aaatttaaaaagcagcattgca

SEQ ID NO: 8204227 - DNA, 22 bp, Homo sapiens
aaatttaagaagtgtgtgcgtg

SEQ ID NO: 8204228 - DNA, 22 bp, Homo sapiens
aaatttaaggaggtgctcactt

SEQ ID NO: 8204229 - DNA, 22 bp, Homo sapiens
aaatttaaggaggtgctcactt

SEQ ID NO: 8204230 - DNA, 22 bp, Homo sapiens
aaattattacaagctagttggc

SEQ ID NO: 8204231 - DNA, 22 bp, Homo sapiens
aaattattataggcagagctga

SEQ ID NO: 8204232 - DNA, 22 bp, Homo sapiens
aaattattagttaagttgggca

SEQ ID NO: 8204233 - DNA, 22 bp, Homo sapiens
aaattattaaacagtgggatgc

SEQ ID NO: 8204234 - DNA, 22 bp, Homo sapiens
aaattattaaacagtgggatgc

SEQ ID NO: 8204235 - DNA, 22 bp, Homo sapiens
aaattattacaagctagttggc

SEQ ID NO: 8204236 - DNA, 22 bp, Homo sapiens
aaggacatttctgactaatgca

SEQ ID NO: 8204237 - DNA, 22 bp, Homo sapiens
aaattattataggcagagctga

SEQ ID NO: 8204238 - DNA, 22 bp, Homo sapiens
aaattagatcagtggattttct

SEQ ID NO: 8204239 - DNA, 18 bp, Homo sapiens
aaattagatggacctgtg

SEQ ID NO: 8204240 - DNA, 21 bp, Homo sapiens
aaattagcttcaagttctgca

SEQ ID NO: 8204241 - DNA, 22 bp, Homo sapiens
aaattagtacattgcaaagtcc

SEQ ID NO: 8204242 - DNA, 22 bp, Homo sapiens
aaattagtacattgcaaagtcc

SEQ ID NO: 8204243 - DNA, 22 bp, Homo sapiens
aaattagtcggtttaggaattt

SEQ ID NO: 8204244 - DNA, 22 bp, Homo sapiens
aaattagtcatgttgtattact

SEQ ID NO: 8204245 - DNA, 22 bp, Homo sapiens
aaattagtgttttcttactggt

SEQ ID NO: 8204246 - DNA, 22 bp, Homo sapiens
aaattagtgcaccaggttgaag

SEQ ID NO: 8204247 - DNA, 22 bp, Homo sapiens
aagctttgataattggattact

SEQ ID NO: 8204248 - DNA, 22 bp, Homo sapiens
aagctttgcaccggtggctgga

SEQ ID NO: 8204249 - DNA, 22 bp, Homo sapiens
aagctttgggcagaagaggatt

SEQ ID NO: 8204250 - DNA, 22 bp, Homo sapiens
aagctttatgatctctcagcta

SEQ ID NO: 8204251 - DNA, 22 bp, Homo sapiens
aagctttcagagcagaatgtga

SEQ ID NO: 8204252 - DNA, 22 bp, Homo sapiens
aagctttatgatctctcagcta

SEQ ID NO: 8204253 - DNA, 22 bp, Homo sapiens
aagctttgactactgcctcttg

SEQ ID NO: 8204254 - DNA, 22 bp, Homo sapiens
aagctttgttcttcacagagtg

SEQ ID NO: 8204255 - DNA, 22 bp, Homo sapiens
aagcttttattaaaatcttgcc

SEQ ID NO: 8204256 - DNA, 22 bp, Homo sapiens
aagcttttattaaaatcttgcc

SEQ ID NO: 8204257 - DNA, 21 bp, Homo sapiens
aagcttttcctgagagttgtc

SEQ ID NO: 8204258 - DNA, 22 bp, Homo sapiens
aagctgggacttagcgcagata

SEQ ID NO: 8204259 - DNA, 22 bp, Homo sapiens
aagctgggacttagcgcagata

SEQ ID NO: 8204260 - DNA, 22 bp, Homo sapiens
aagctgggagggagcccagagt

SEQ ID NO: 8204261 - DNA, 22 bp, Homo sapiens
aagctgggagggagcccagagt

SEQ ID NO: 8204262 - DNA, 22 bp, Homo sapiens
aagctgggacttagcgcagata

SEQ ID NO: 8204263 - DNA, 22 bp, Homo sapiens
aagctgggacttagcgcagata

SEQ ID NO: 8204264 - DNA, 22 bp, Homo sapiens
aagctgggacttagcgcagata

SEQ ID NO: 8204265 - DNA, 22 bp, Homo sapiens
aagctggggactcagaccccat

SEQ ID NO: 8204266 - DNA, 20 bp, Homo sapiens
aagctgggtaggagaggagc

SEQ ID NO: 8204267 - DNA, 20 bp, Homo sapiens
aagctgggtaggagaggagc

SEQ ID NO: 8204268 - DNA, 20 bp, Homo sapiens
aagctgggtaggagaggagc

SEQ ID NO: 8204269 - DNA, 20 bp, Homo sapiens
aagctgggtaggagaggagc

SEQ ID NO: 8204270 - DNA, 22 bp, Homo sapiens
aagctgtcaatgtatctagtct

SEQ ID NO: 8204271 - DNA, 22 bp, Homo sapiens
aagctgtcaggaggttaccttt

SEQ ID NO: 8204272 - DNA, 20 bp, Homo sapiens
aagctgtcagaggtggacag

SEQ ID NO: 8204273 - DNA, 22 bp, Homo sapiens
aagctgtcagtgtcaggctaaa

SEQ ID NO: 8204274 - DNA, 19 bp, Homo sapiens
aagctgtcctgttggccct

SEQ ID NO: 8204275 - DNA, 22 bp, Homo sapiens
aagctttatgacttggagacag

SEQ ID NO: 8204276 - DNA, 22 bp, Homo sapiens
aagctttagagatgagttcctt

SEQ ID NO: 8204277 - DNA, 22 bp, Homo sapiens
aagccagtgtttttgagagttg

SEQ ID NO: 8204278 - DNA, 22 bp, Homo sapiens
aagccagttagcacatcattgc

SEQ ID NO: 8204279 - DNA, 22 bp, Homo sapiens
aagccagtcctctactgggcac

SEQ ID NO: 8204280 - DNA, 22 bp, Homo sapiens
aagccagtcctctactgggcac

SEQ ID NO: 8204281 - DNA, 22 bp, Homo sapiens
aagccagtggcttctccctgct

SEQ ID NO: 8204282 - DNA, 22 bp, Homo sapiens
aagccagtgtccagaatgggca

SEQ ID NO: 8204283 - DNA, 21 bp, Homo sapiens
aagccagcccacagtggtttg

SEQ ID NO: 8204284 - DNA, 22 bp, Homo sapiens
aagccagcattttcccattcct

SEQ ID NO: 8204285 - DNA, 22 bp, Homo sapiens
aagccagatttcactcttaatt

SEQ ID NO: 8204286 - DNA, 22 bp, Homo sapiens
aagccagccagtgccagtctta

SEQ ID NO: 8204287 - DNA, 22 bp, Homo sapiens
aagcccagatgagatccctgga

SEQ ID NO: 8204288 - DNA, 22 bp, Homo sapiens
aagctgatgtcccagtttgaag

SEQ ID NO: 8204289 - DNA, 22 bp, Homo sapiens
aagctgatcatccttccaggtt

SEQ ID NO: 8204290 - DNA, 22 bp, Homo sapiens
aagctgatgtcccagtttgaag

SEQ ID NO: 8204291 - DNA, 22 bp, Homo sapiens
aagctgattctaaaatttatta

SEQ ID NO: 8204292 - DNA, 22 bp, Homo sapiens
aagctggcaaacaagcatcatt

SEQ ID NO: 8204293 - DNA, 22 bp, Homo sapiens
aagctggcaaacaagcatcatt

SEQ ID NO: 8204294 - DNA, 22 bp, Homo sapiens
aagctgcaaaaaatttctgtct

SEQ ID NO: 8204295 - DNA, 22 bp, Homo sapiens
aagctgcaaaaaatttctgtct

SEQ ID NO: 8204296 - DNA, 22 bp, Homo sapiens
aagctggcctcaaactcctagc

SEQ ID NO: 8204297 - DNA, 22 bp, Homo sapiens
aagctggcctgtacctgctgag

SEQ ID NO: 8204298 - DNA, 22 bp, Homo sapiens
aagctggcatgtcacctgagaa

SEQ ID NO: 8204299 - DNA, 22 bp, Homo sapiens
aagctggcatgtcacctgagaa

SEQ ID NO: 8204300 - DNA, 22 bp, Homo sapiens
aagctggcaattatcaaaactg

SEQ ID NO: 8204301 - DNA, 19 bp, Homo sapiens
aagctggcagaatattgcc

SEQ ID NO: 8204302 - DNA, 20 bp, Homo sapiens
aagctggcaggtcatagctt

SEQ ID NO: 8204303 - DNA, 20 bp, Homo sapiens
aagctggcaggtcatagctt

SEQ ID NO: 8204304 - DNA, 18 bp, Homo sapiens
aagctgggaaggagacag

SEQ ID NO: 8204305 - DNA, 18 bp, Homo sapiens
aagctgggaaggagacag

SEQ ID NO: 8204306 - DNA, 18 bp, Homo sapiens
aagctgggaaggagacag

SEQ ID NO: 8204307 - DNA, 18 bp, Homo sapiens
aagctgggaaggagacag

SEQ ID NO: 8204308 - DNA, 23 bp, Homo sapiens
aagctggctgggagcagaaggga

SEQ ID NO: 8204309 - DNA, 22 bp, Homo sapiens
aagctggctctgatgtcagaat

SEQ ID NO: 8204310 - DNA, 22 bp, Homo sapiens
aagctggcctgtacctgctgag

SEQ ID NO: 8204311 - DNA, 22 bp, Homo sapiens
aagctggctaaataaaaggtcc

SEQ ID NO: 8204312 - DNA, 22 bp, Homo sapiens
aattcaaattacaatagttgtt

SEQ ID NO: 8204313 - DNA, 22 bp, Homo sapiens
aattcaaattacaatagttgtt

SEQ ID NO: 8204314 - DNA, 22 bp, Homo sapiens
aattcaaattacaatagttgtt

SEQ ID NO: 8204315 - DNA, 22 bp, Homo sapiens
aattcaaattacaatagttgtt

SEQ ID NO: 8204316 - DNA, 22 bp, Homo sapiens
aattcaaagactagaattttgc

SEQ ID NO: 8204317 - DNA, 22 bp, Homo sapiens
aattatttaactcctttggaga

SEQ ID NO: 8204318 - DNA, 22 bp, Homo sapiens
aattcaaagccgcttgggaatc

SEQ ID NO: 8204319 - DNA, 22 bp, Homo sapiens
aattcaaatttgagtttgtgat

SEQ ID NO: 8204320 - DNA, 23 bp, Homo sapiens
aattcaaattcagtgtgactagg

SEQ ID NO: 8204321 - DNA, 23 bp, Homo sapiens
aattcaaattcagtgtgactagg

SEQ ID NO: 8204322 - DNA, 22 bp, Homo sapiens
aattcaatctaagaaatgatca

SEQ ID NO: 8204323 - DNA, 22 bp, Homo sapiens
aattagaatcttatttggggaa

SEQ ID NO: 8204324 - DNA, 22 bp, Homo sapiens
aattagaagggagttattgata

SEQ ID NO: 8204325 - DNA, 22 bp, Homo sapiens
aattagaagggagttattgata

SEQ ID NO: 8204326 - DNA, 22 bp, Homo sapiens
aattagaagctgttagcaaaat

SEQ ID NO: 8204327 - DNA, 22 bp, Homo sapiens
aattagaagctgttagcaaaat

SEQ ID NO: 8204328 - DNA, 22 bp, Homo sapiens
aattagaagctgttagcaaaat

SEQ ID NO: 8204329 - DNA, 22 bp, Homo sapiens
aattagaagctgttagcaaaat

SEQ ID NO: 8204330 - DNA, 22 bp, Homo sapiens
aattagctaattaattgtagcc

SEQ ID NO: 8204331 - DNA, 22 bp, Homo sapiens
aattagcatttcccatataaat

SEQ ID NO: 8204332 - DNA, 22 bp, Homo sapiens
aattagctaattaattgtagcc

SEQ ID NO: 8204333 - DNA, 22 bp, Homo sapiens
aattagcatttcccatataaat

SEQ ID NO: 8204334 - DNA, 20 bp, Homo sapiens
aattagatgtttaatcaata

SEQ ID NO: 8204335 - DNA, 20 bp, Homo sapiens
aattagatgtttaatcaata

SEQ ID NO: 8204336 - DNA, 22 bp, Homo sapiens
aattagagtggcgagtgattta

SEQ ID NO: 8204337 - DNA, 22 bp, Homo sapiens
aagacaacagagatgacagact

SEQ ID NO: 8204338 - DNA, 22 bp, Homo sapiens
aagaatttaaactaaccatatg

SEQ ID NO: 8204339 - DNA, 22 bp, Homo sapiens
aagacaagccttgtttttctgc

SEQ ID NO: 8204340 - DNA, 22 bp, Homo sapiens
aagaattggtttcctctgtcat

SEQ ID NO: 8204341 - DNA, 22 bp, Homo sapiens
aagaattggtcacatgctacaa

SEQ ID NO: 8204342 - DNA, 22 bp, Homo sapiens
aagaattgatgtgaattgcagc

SEQ ID NO: 8204343 - DNA, 22 bp, Homo sapiens
aagaattcactggtagagtcaa

SEQ ID NO: 8204344 - DNA, 22 bp, Homo sapiens
aagaattattgcaatactagat

SEQ ID NO: 8204345 - DNA, 22 bp, Homo sapiens
aagaattattgcaatactagat

SEQ ID NO: 8204346 - DNA, 22 bp, Homo sapiens
aattcaatggtttttaggatat

SEQ ID NO: 8204347 - DNA, 22 bp, Homo sapiens
acaagaagtaaaggtcggatgc

SEQ ID NO: 8204348 - DNA, 22 bp, Homo sapiens
acaagaaaggtaggattcaggt

SEQ ID NO: 8204349 - DNA, 22 bp, Homo sapiens
acaactttctgggttatctgat

SEQ ID NO: 8204350 - DNA, 22 bp, Homo sapiens
acaactttctgggttatctgat

SEQ ID NO: 8204351 - DNA, 22 bp, Homo sapiens
acaactttaatgggtttcagct

SEQ ID NO: 8204352 - DNA, 23 bp, Homo sapiens
acaactttacagatacattttgt

SEQ ID NO: 8204353 - DNA, 22 bp, Homo sapiens
aagacattgtcattttataatt

SEQ ID NO: 8204354 - DNA, 22 bp, Homo sapiens
aagacattgtcattttataatt

SEQ ID NO: 8204355 - DNA, 22 bp, Homo sapiens
aagacattgtcattttataatt

SEQ ID NO: 8204356 - DNA, 22 bp, Homo sapiens
aagacattgtcattttataatt

SEQ ID NO: 8204357 - DNA, 22 bp, Homo sapiens
aagacattgctgcttttaattg

SEQ ID NO: 8204358 - DNA, 22 bp, Homo sapiens
aagacattggcattgactgtaa

SEQ ID NO: 8204359 - DNA, 22 bp, Homo sapiens
aagacattggacaatccagagg

SEQ ID NO: 8204360 - DNA, 22 bp, Homo sapiens
aagacattggacaatccagagg

SEQ ID NO: 8204361 - DNA, 22 bp, Homo sapiens
aagacattgcatgataatgctg

SEQ ID NO: 8204362 - DNA, 22 bp, Homo sapiens
aagacattgcatgataatgctg

SEQ ID NO: 8204363 - DNA, 22 bp, Homo sapiens
aagacattgcatgataatgctg

SEQ ID NO: 8204364 - DNA, 22 bp, Homo sapiens
aagacattccaaagtggctaat

SEQ ID NO: 8204365 - DNA, 22 bp, Homo sapiens
aagacattcacaaatgttcact

SEQ ID NO: 8204366 - DNA, 22 bp, Homo sapiens
aagacattcatgaagaagggat

SEQ ID NO: 8204367 - DNA, 22 bp, Homo sapiens
aagacattagaatcagcctgtt

SEQ ID NO: 8204368 - DNA, 22 bp, Homo sapiens
aagacattcacaaatgttcact

SEQ ID NO: 8204369 - DNA, 22 bp, Homo sapiens
acaactgatgggtcatgtggga

SEQ ID NO: 8204370 - DNA, 22 bp, Homo sapiens
acaactgtcagtaaagaatatt

SEQ ID NO: 8204371 - DNA, 22 bp, Homo sapiens
acaactccttcttgggtcctgg

SEQ ID NO: 8204372 - DNA, 22 bp, Homo sapiens
acaactccttcttgggtcctgg

SEQ ID NO: 8204373 - DNA, 22 bp, Homo sapiens
acaactctcagttaaataaaga

SEQ ID NO: 8204374 - DNA, 22 bp, Homo sapiens
aagacacaatgtagcccagcac

SEQ ID NO: 8204375 - DNA, 22 bp, Homo sapiens
aagacacacacatatgctgagt

SEQ ID NO: 8204376 - DNA, 22 bp, Homo sapiens
aagacacacacatatgctgagt

SEQ ID NO: 8204377 - DNA, 22 bp, Homo sapiens
aagacacagcgaaatgttcctg

SEQ ID NO: 8204378 - DNA, 22 bp, Homo sapiens
aagacacaaagcttcccttttc

SEQ ID NO: 8204379 - DNA, 22 bp, Homo sapiens
aagacaatttgatactagttgc

SEQ ID NO: 8204380 - DNA, 22 bp, Homo sapiens
aagacaattttgagtatgcaca

SEQ ID NO: 8204381 - DNA, 22 bp, Homo sapiens
aagacaatgtttctgatagata

SEQ ID NO: 8204382 - DNA, 22 bp, Homo sapiens
aagacaatgcattactaagaag

SEQ ID NO: 8204383 - DNA, 22 bp, Homo sapiens
aagacaatgcattactaagaag

SEQ ID NO: 8204384 - DNA, 22 bp, Homo sapiens
aatgttattacacttgtgaaat

SEQ ID NO: 8204385 - DNA, 22 bp, Homo sapiens
aatgttatgtggttcaacttaa

SEQ ID NO: 8204386 - DNA, 22 bp, Homo sapiens
aactttacttgaaagaacatgt

SEQ ID NO: 8204387 - DNA, 22 bp, Homo sapiens
aactttatcggaacaggtactc

SEQ ID NO: 8204388 - DNA, 22 bp, Homo sapiens
aactttatcggaacaggtactc

SEQ ID NO: 8204389 - DNA, 22 bp, Homo sapiens
aactttattgttaggggctaaa

SEQ ID NO: 8204390 - DNA, 22 bp, Homo sapiens
aactttatcggaacaggtactc

SEQ ID NO: 8204391 - DNA, 22 bp, Homo sapiens
aactttcagcaagtaattctgg

SEQ ID NO: 8204392 - DNA, 22 bp, Homo sapiens
aactttcagaatcctatgcatt

SEQ ID NO: 8204393 - DNA, 22 bp, Homo sapiens
aactttcagaatcctatgcatt

SEQ ID NO: 8204394 - DNA, 22 bp, Homo sapiens
aactttcagaatcctatgcatt

SEQ ID NO: 8204395 - DNA, 22 bp, Homo sapiens
aactttattgttaggggctaaa

SEQ ID NO: 8204396 - DNA, 22 bp, Homo sapiens
aactttcagaatcctatgcatt

SEQ ID NO: 8204397 - DNA, 22 bp, Homo sapiens
aactttctataggttgggattt

SEQ ID NO: 8204398 - DNA, 22 bp, Homo sapiens
aactttcaggcaatgaatattt

SEQ ID NO: 8204399 - DNA, 22 bp, Homo sapiens
aatgttttttggtctgatgaat

SEQ ID NO: 8204400 - DNA, 22 bp, Homo sapiens
aattagaaccagaagccatatt

SEQ ID NO: 8204401 - DNA, 22 bp, Homo sapiens
aattacttaagagaaactttga

SEQ ID NO: 8204402 - DNA, 22 bp, Homo sapiens
aactttctctggatggcttcct

SEQ ID NO: 8204403 - DNA, 22 bp, Homo sapiens
aactttctgaaaagcttgatca

SEQ ID NO: 8204404 - DNA, 22 bp, Homo sapiens
aatgttttgtatgcctctgagc

SEQ ID NO: 8204405 - DNA, 22 bp, Homo sapiens
aatgtgtttatttagtgattta

SEQ ID NO: 8204406 - DNA, 22 bp, Homo sapiens
aatgtgaaaccgcacagaataa

SEQ ID NO: 8204407 - DNA, 22 bp, Homo sapiens
aatgtgttttatgagagaatat

SEQ ID NO: 8204408 - DNA, 22 bp, Homo sapiens
aatgtgttttcactgaagattc

SEQ ID NO: 8204409 - DNA, 22 bp, Homo sapiens
aatgttaagtttagattataac

SEQ ID NO: 8204410 - DNA, 22 bp, Homo sapiens
aatgttacgatcaacaacacat

SEQ ID NO: 8204411 - DNA, 22 bp, Homo sapiens
aatgttacgatcaacaacacat

SEQ ID NO: 8204412 - DNA, 22 bp, Homo sapiens
aatgttacgatcaacaacacat

SEQ ID NO: 8204413 - DNA, 22 bp, Homo sapiens
aatgttatgtggttcaacttaa

SEQ ID NO: 8204414 - DNA, 22 bp, Homo sapiens
aatgttatgtggttcaacttaa

SEQ ID NO: 8204415 - DNA, 22 bp, Homo sapiens
aatgtcaacacaagagaaatgc

SEQ ID NO: 8204416 - DNA, 20 bp, Homo sapiens
aatgtattgttttgtttcag

SEQ ID NO: 8204417 - DNA, 20 bp, Homo sapiens
aatgtattgttttgtttcag

SEQ ID NO: 8204418 - DNA, 22 bp, Homo sapiens
aatgtattttgggagtttcttt

SEQ ID NO: 8204419 - DNA, 22 bp, Homo sapiens
aatgtcaaaatggaatgagact

SEQ ID NO: 8204420 - DNA, 22 bp, Homo sapiens
aatgtcttgagaagagaaatct

SEQ ID NO: 8204421 - DNA, 22 bp, Homo sapiens
aatgtcttggatacagaggttg

SEQ ID NO: 8204422 - DNA, 22 bp, Homo sapiens
aatgtctttaaagtgcaataga

SEQ ID NO: 8204423 - DNA, 22 bp, Homo sapiens
aatgtctttctcataacagata

SEQ ID NO: 8204424 - DNA, 22 bp, Homo sapiens
aatgtattctgggaaaatgtta

SEQ ID NO: 8204425 - DNA, 22 bp, Homo sapiens
aatgtattctgggaaaatgtta

SEQ ID NO: 8204426 - DNA, 22 bp, Homo sapiens
aatgtacaccgtgggtttttta

SEQ ID NO: 8204427 - DNA, 22 bp, Homo sapiens
aatgtattctgggaaaatgtta

SEQ ID NO: 8204428 - DNA, 22 bp, Homo sapiens
aatgtacaataagacaaagagg

SEQ ID NO: 8204429 - DNA, 22 bp, Homo sapiens
aatgtacaataagacaaagagg

SEQ ID NO: 8204430 - DNA, 22 bp, Homo sapiens
aactctggtttcagactcactt

SEQ ID NO: 8204431 - DNA, 22 bp, Homo sapiens
aactctggttcagtgatttcag

SEQ ID NO: 8204432 - DNA, 22 bp, Homo sapiens
aactctttacatgtttgattca

SEQ ID NO: 8204433 - DNA, 22 bp, Homo sapiens
aactctttcatctgtggcctgg

SEQ ID NO: 8204434 - DNA, 22 bp, Homo sapiens
aactctttccctttggtgccac

SEQ ID NO: 8204435 - DNA, 22 bp, Homo sapiens
aactctttggtctcaggaaagg

SEQ ID NO: 8204436 - DNA, 22 bp, Homo sapiens
aactctttctgaggattgggag

SEQ ID NO: 8204437 - DNA, 22 bp, Homo sapiens
aactctttttttaagtgtagcc

SEQ ID NO: 8204438 - DNA, 22 bp, Homo sapiens
aactctttgtggacattaaatt

SEQ ID NO: 8204439 - DNA, 22 bp, Homo sapiens
aactcttttctgggtcagcaca

SEQ ID NO: 8204440 - DNA, 22 bp, Homo sapiens
aactctttgaacagtgaggcta

SEQ ID NO: 8204441 - DNA, 22 bp, Homo sapiens
aactctatttaccctactaaac

SEQ ID NO: 8204442 - DNA, 22 bp, Homo sapiens
aactctatttaccctactaaac

SEQ ID NO: 8204443 - DNA, 22 bp, Homo sapiens
aactctggctgcttcccaggtc

SEQ ID NO: 8204444 - DNA, 22 bp, Homo sapiens
aactctggtccaggctagtgcc

SEQ ID NO: 8204445 - DNA, 22 bp, Homo sapiens
aactctgggtcactgtgcaatt

SEQ ID NO: 8204446 - DNA, 23 bp, Homo sapiens
aactctggctagcatagaataga

SEQ ID NO: 8204447 - DNA, 22 bp, Homo sapiens
aactctgggaatgggatttaga

SEQ ID NO: 8204448 - DNA, 22 bp, Homo sapiens
aactctggattttagatcaggg

SEQ ID NO: 8204449 - DNA, 22 bp, Homo sapiens
aactctggaagggtgaggctgt

SEQ ID NO: 8204450 - DNA, 22 bp, Homo sapiens
aactctggagcacgccctggcc

SEQ ID NO: 8204451 - DNA, 22 bp, Homo sapiens
aactctggcctcagtcttctgc

SEQ ID NO: 8204452 - DNA, 22 bp, Homo sapiens
aactctggaaatctacatggcc

SEQ ID NO: 8204453 - DNA, 22 bp, Homo sapiens
aactctggaaatctacatggcc

SEQ ID NO: 8204454 - DNA, 22 bp, Homo sapiens
aactctacttgggactcctctg

SEQ ID NO: 8204455 - DNA, 20 bp, Homo sapiens
aactcctagcctcaagtgat

SEQ ID NO: 8204456 - DNA, 22 bp, Homo sapiens
aagattttcagtgcctaaaaca

SEQ ID NO: 8204457 - DNA, 22 bp, Homo sapiens
aagattttcagctaatggtgca

SEQ ID NO: 8204458 - DNA, 22 bp, Homo sapiens
aagattttctcaactgtatttg

SEQ ID NO: 8204459 - DNA, 22 bp, Homo sapiens
aagatttttttccacagactca

SEQ ID NO: 8204460 - DNA, 22 bp, Homo sapiens
aagcaaaaggttacacttctgg

SEQ ID NO: 8204461 - DNA, 22 bp, Homo sapiens
aagcaaaaggttacacttctgg

SEQ ID NO: 8204462 - DNA, 22 bp, Homo sapiens
acagaagcaaaagcaggatctt

SEQ ID NO: 8204463 - DNA, 22 bp, Homo sapiens
acagaagcaaagactcaggcaa

SEQ ID NO: 8204464 - DNA, 22 bp, Homo sapiens
acagaagataatgctgccttgg

SEQ ID NO: 8204465 - DNA, 22 bp, Homo sapiens
acagaagcaaaagcaggatctt

SEQ ID NO: 8204466 - DNA, 22 bp, Homo sapiens
acagaagcaaaagcaggatctt

SEQ ID NO: 8204467 - DNA, 22 bp, Homo sapiens
acagaagcagcgcggctcttct

SEQ ID NO: 8204468 - DNA, 22 bp, Homo sapiens
aagatttcttacttattgatgc

SEQ ID NO: 8204469 - DNA, 22 bp, Homo sapiens
acagaagcagccgtcacagata

SEQ ID NO: 8204470 - DNA, 22 bp, Homo sapiens
acagaagagcacatttagtatg

SEQ ID NO: 8204471 - DNA, 22 bp, Homo sapiens
acagaagagctggctctgtgct

SEQ ID NO: 8204472 - DNA, 22 bp, Homo sapiens
acagaagataatgctgccttgg

SEQ ID NO: 8204473 - DNA, 22 bp, Homo sapiens
acagaagataactgggaccaga

SEQ ID NO: 8204474 - DNA, 22 bp, Homo sapiens
acagaagaccagagagctaact

SEQ ID NO: 8204475 - DNA, 22 bp, Homo sapiens
acagaagagcacatttagtatg

SEQ ID NO: 8204476 - DNA, 22 bp, Homo sapiens
acagaagagcacatttagtatg

SEQ ID NO: 8204477 - DNA, 22 bp, Homo sapiens
acagaagaccagagagctaact

SEQ ID NO: 8204478 - DNA, 22 bp, Homo sapiens
acagaagaagttcaaggtgaag

SEQ ID NO: 8204479 - DNA, 22 bp, Homo sapiens
acagaagacagagtgttcatct

SEQ ID NO: 8204480 - DNA, 22 bp, Homo sapiens
acagaagaagttcaaggtgaag

SEQ ID NO: 8204481 - DNA, 22 bp, Homo sapiens
acagaagaccaagaaagcttcc

SEQ ID NO: 8204482 - DNA, 22 bp, Homo sapiens
acagaagaccaagaaagcttcc

SEQ ID NO: 8204483 - DNA, 22 bp, Homo sapiens
acagaagaccaagaaagcttcc

SEQ ID NO: 8204484 - DNA, 22 bp, Homo sapiens
aagatatactattaagtaccat

SEQ ID NO: 8204485 - DNA, 22 bp, Homo sapiens
aagatatactattaagtaccat

SEQ ID NO: 8204486 - DNA, 22 bp, Homo sapiens
aagatatagataaaactatgca

SEQ ID NO: 8204487 - DNA, 22 bp, Homo sapiens
aagatactgatgatgtaggcta

SEQ ID NO: 8204488 - DNA, 22 bp, Homo sapiens
aagatacttcacttgccgaaat

SEQ ID NO: 8204489 - DNA, 22 bp, Homo sapiens
aagatataataactgttgtcat

SEQ ID NO: 8204490 - DNA, 22 bp, Homo sapiens
aagatacattttcttcagagaa

SEQ ID NO: 8204491 - DNA, 20 bp, Homo sapiens
aagatactccagaaattaaa

SEQ ID NO: 8204492 - DNA, 22 bp, Homo sapiens
aagatactgatgatgtaggcta

SEQ ID NO: 8204493 - DNA, 22 bp, Homo sapiens
aagatacattatgtctctctga

SEQ ID NO: 8204494 - DNA, 22 bp, Homo sapiens
aagatacattatgtctctctga

SEQ ID NO: 8204495 - DNA, 22 bp, Homo sapiens
aagatacatcattcaggagtga

SEQ ID NO: 8204496 - DNA, 22 bp, Homo sapiens
acactagctaaatgctgattaa

SEQ ID NO: 8204497 - DNA, 22 bp, Homo sapiens
aagcacattaaggaacattgaa

SEQ ID NO: 8204498 - DNA, 22 bp, Homo sapiens
aagcacattaaggaacattgaa

SEQ ID NO: 8204499 - DNA, 22 bp, Homo sapiens
aagcacatgagctattcatgct

SEQ ID NO: 8204500 - DNA, 22 bp, Homo sapiens
aagcacatctcaaacttcatct

SEQ ID NO: 8204501 - DNA, 22 bp, Homo sapiens
aagcacatctcctgtgcagaac

SEQ ID NO: 8204502 - DNA, 20 bp, Homo sapiens
aagcacatttctacaataat

SEQ ID NO: 8204503 - DNA, 22 bp, Homo sapiens
aagcacatttggaaaacatgga

SEQ ID NO: 8204504 - DNA, 22 bp, Homo sapiens
aagcacatttggaaaacatgga

SEQ ID NO: 8204505 - DNA, 22 bp, Homo sapiens
aagcacattgcctggcacatag

SEQ ID NO: 8204506 - DNA, 20 bp, Homo sapiens
aagcacatttctacaataat

SEQ ID NO: 8204507 - DNA, 22 bp, Homo sapiens
aagcacattgtacatttgtgct

SEQ ID NO: 8204508 - DNA, 22 bp, Homo sapiens
acagatgaaacccagctagttg

SEQ ID NO: 8204509 - DNA, 23 bp, Homo sapiens
acagatgaaagtgtggctcagag

SEQ ID NO: 8204510 - DNA, 23 bp, Homo sapiens
acagatgaaagtgtggctcagag

SEQ ID NO: 8204511 - DNA, 22 bp, Homo sapiens
acagatgagactccaggacctt

SEQ ID NO: 8204512 - DNA, 22 bp, Homo sapiens
acagagtcattcactgatgaag

SEQ ID NO: 8204513 - DNA, 22 bp, Homo sapiens
acagagtcattcactgatgaag

SEQ ID NO: 8204514 - DNA, 22 bp, Homo sapiens
acagagtcattcactgatgaag

SEQ ID NO: 8204515 - DNA, 22 bp, Homo sapiens
acagagtcatggtagtcaaagg

SEQ ID NO: 8204516 - DNA, 22 bp, Homo sapiens
acagatctcaaagcctggaccc

SEQ ID NO: 8204517 - DNA, 22 bp, Homo sapiens
acagatgaaaaagcttgtggat

SEQ ID NO: 8204518 - DNA, 22 bp, Homo sapiens
acagatgaaacccagctagttg

SEQ ID NO: 8204519 - DNA, 22 bp, Homo sapiens
acagatctacattgtctgaccc

SEQ ID NO: 8204520 - DNA, 18 bp, Homo sapiens
acagaggcagacatgtat

SEQ ID NO: 8204521 - DNA, 22 bp, Homo sapiens
aagcacatacataataaagtcc

SEQ ID NO: 8204522 - DNA, 22 bp, Homo sapiens
acagaggaaggctgagctgccc

SEQ ID NO: 8204523 - DNA, 22 bp, Homo sapiens
acagaggacaactaggcgctca

SEQ ID NO: 8204524 - DNA, 22 bp, Homo sapiens
acagaggacaactaggcgctca

SEQ ID NO: 8204525 - DNA, 22 bp, Homo sapiens
acagaggaaggctgagctgccc

SEQ ID NO: 8204526 - DNA, 22 bp, Homo sapiens
aagcaaagacagtttgagtgga

SEQ ID NO: 8204527 - DNA, 22 bp, Homo sapiens
aagcaaagacagtttgagtgga

SEQ ID NO: 8204528 - DNA, 17 bp, Homo sapiens
acagagcacatcaagat

SEQ ID NO: 8204529 - DNA, 22 bp, Homo sapiens
acagagcacatagattggagtt

SEQ ID NO: 8204530 - DNA, 22 bp, Homo sapiens
acagagcacatagattggagtt

SEQ ID NO: 8204531 - DNA, 17 bp, Homo sapiens
acagagcacatcaagat

SEQ ID NO: 8204532 - DNA, 22 bp, Homo sapiens
acagagcttaattcaggagctt

SEQ ID NO: 8204533 - DNA, 22 bp, Homo sapiens
acagagcttaggatgactccca

SEQ ID NO: 8204534 - DNA, 22 bp, Homo sapiens
acagagcttaggatgactccca

SEQ ID NO: 8204535 - DNA, 22 bp, Homo sapiens
acagagcttaattcaggagctt

SEQ ID NO: 8204536 - DNA, 22 bp, Homo sapiens
acagagcttcccagcctgagca

SEQ ID NO: 8204537 - DNA, 22 bp, Homo sapiens
acagagcttcccagcctgagca

SEQ ID NO: 8204538 - DNA, 22 bp, Homo sapiens
acagaggaagcatatagcacaa

SEQ ID NO: 8204539 - DNA, 22 bp, Homo sapiens
aagaggagggcagattcaaggc

SEQ ID NO: 8204540 - DNA, 19 bp, Homo sapiens
aagaggcaaccctcgagcc

SEQ ID NO: 8204541 - DNA, 22 bp, Homo sapiens
aagaggagtagatgtggttggt

SEQ ID NO: 8204542 - DNA, 22 bp, Homo sapiens
aagaggagtagatgtggttggt

SEQ ID NO: 8204543 - DNA, 22 bp, Homo sapiens
aagaggcagtggtgatgaatgg

SEQ ID NO: 8204544 - DNA, 22 bp, Homo sapiens
aagaggcataaaatttatatgg

SEQ ID NO: 8204545 - DNA, 21 bp, Homo sapiens
aagaggcatcactatttgtgt

SEQ ID NO: 8204546 - DNA, 22 bp, Homo sapiens
aagaggcagaaatatcgctgaa

SEQ ID NO: 8204547 - DNA, 22 bp, Homo sapiens
aagaggcagcccgctgaggctg

SEQ ID NO: 8204548 - DNA, 22 bp, Homo sapiens
aagaggcagcccgctgaggctg

SEQ ID NO: 8204549 - DNA, 22 bp, Homo sapiens
aagaggcagcccgctgaggctg

SEQ ID NO: 8204550 - DNA, 23 bp, Homo sapiens
aagaggaggccctgctcccgtcc

SEQ ID NO: 8204551 - DNA, 22 bp, Homo sapiens
aagaggaggattgatgtgggag

SEQ ID NO: 8204552 - DNA, 22 bp, Homo sapiens
aagaccataatgtaagatgaat

SEQ ID NO: 8204553 - DNA, 22 bp, Homo sapiens
aagaggaggattgatgtgggag

SEQ ID NO: 8204554 - DNA, 22 bp, Homo sapiens
aagacattttagagatagggaa

SEQ ID NO: 8204555 - DNA, 22 bp, Homo sapiens
aagaccagggtgggtacgttcc

SEQ ID NO: 8204556 - DNA, 22 bp, Homo sapiens
aagaggaactgggggctgagtc

SEQ ID NO: 8204557 - DNA, 22 bp, Homo sapiens
aagacattttgaaattggaagc

SEQ ID NO: 8204558 - DNA, 22 bp, Homo sapiens
aagacatttatttgaatcaatt

SEQ ID NO: 8204559 - DNA, 22 bp, Homo sapiens
aagacatttatttgaatcaatt

SEQ ID NO: 8204560 - DNA, 22 bp, Homo sapiens
aagacatttatgaaaagtgctg

SEQ ID NO: 8204561 - DNA, 22 bp, Homo sapiens
aagacattgtggagatgttgct

SEQ ID NO: 8204562 - DNA, 22 bp, Homo sapiens
acacacatgcatgcttgccatt

SEQ ID NO: 8204563 - DNA, 22 bp, Homo sapiens
aagaggctttcagtgaacttgt

SEQ ID NO: 8204564 - DNA, 22 bp, Homo sapiens
acacacatgcatgcttgccatt

SEQ ID NO: 8204565 - DNA, 22 bp, Homo sapiens
acacacatgcatgcttgccatt

SEQ ID NO: 8204566 - DNA, 22 bp, Homo sapiens
acacacatgcatgcttgccatt

SEQ ID NO: 8204567 - DNA, 22 bp, Homo sapiens
aagaggtggaacagcaattcgt

SEQ ID NO: 8204568 - DNA, 22 bp, Homo sapiens
aagaggtggaacagcaattcgt

SEQ ID NO: 8204569 - DNA, 22 bp, Homo sapiens
aagaggtgggttggacagatac

SEQ ID NO: 8204570 - DNA, 22 bp, Homo sapiens
aagaggttattgttcccagctt

SEQ ID NO: 8204571 - DNA, 22 bp, Homo sapiens
aagaggttctaatttaactatc

SEQ ID NO: 8204572 - DNA, 22 bp, Homo sapiens
aagaggtcacactaggtcctag

SEQ ID NO: 8204573 - DNA, 22 bp, Homo sapiens
aagaggtgagaagctacactta

SEQ ID NO: 8204574 - DNA, 20 bp, Homo sapiens
aagaggtgataacaggtgag

SEQ ID NO: 8204575 - DNA, 20 bp, Homo sapiens
acacacagagacatgcgcat

SEQ ID NO: 8204576 - DNA, 22 bp, Homo sapiens
acacacagagtttatacaggca

SEQ ID NO: 8204577 - DNA, 22 bp, Homo sapiens
acacacagagtttatacaggca

SEQ ID NO: 8204578 - DNA, 22 bp, Homo sapiens
acacacagagtttatacaggca

SEQ ID NO: 8204579 - DNA, 21 bp, Homo sapiens
aagaggcatcactatttgtgt

SEQ ID NO: 8204580 - DNA, 22 bp, Homo sapiens
aagaggcatctcagcttcctct

SEQ ID NO: 8204581 - DNA, 21 bp, Homo sapiens
aagaggcatcactatttgtgt

SEQ ID NO: 8204582 - DNA, 20 bp, Homo sapiens
acacacagagacatgcgcat

SEQ ID NO: 8204583 - DNA, 22 bp, Homo sapiens
acacacagcgcctaccatgtgc

SEQ ID NO: 8204584 - DNA, 22 bp, Homo sapiens
acacacagcgcctaccatgtgc

SEQ ID NO: 8204585 - DNA, 22 bp, Homo sapiens
acacacagcgcctaccatgtgc

SEQ ID NO: 8204586 - DNA, 22 bp, Homo sapiens
acacacaggtaaaggagcctgg

SEQ ID NO: 8204587 - DNA, 22 bp, Homo sapiens
acacacaggtaaaggagcctgg

SEQ ID NO: 8204588 - DNA, 22 bp, Homo sapiens
aagagtcgtttcaggacagagg

SEQ ID NO: 8204589 - DNA, 22 bp, Homo sapiens
aagagtctattggaactagaca

SEQ ID NO: 8204590 - DNA, 22 bp, Homo sapiens
aagaggttgtctgtgatgagtt

SEQ ID NO: 8204591 - DNA, 22 bp, Homo sapiens
aagagtaaatgtctaattagga

SEQ ID NO: 8204592 - DNA, 22 bp, Homo sapiens
aagaggtttcatgattttctta

SEQ ID NO: 8204593 - DNA, 22 bp, Homo sapiens
aagaggtttaactgactcacag

SEQ ID NO: 8204594 - DNA, 22 bp, Homo sapiens
aagagttagctcaataacttga

SEQ ID NO: 8204595 - DNA, 22 bp, Homo sapiens
aagagtttaccagtgctgcttc

SEQ ID NO: 8204596 - DNA, 22 bp, Homo sapiens
aagagtttaattttgtctagac

SEQ ID NO: 8204597 - DNA, 21 bp, Homo sapiens
aagagtggctgaggaggtgat

SEQ ID NO: 8204598 - DNA, 22 bp, Homo sapiens
aagagtggagctggaaagtggg

SEQ ID NO: 8204599 - DNA, 22 bp, Homo sapiens
aagagtggagctggaaagtggg

SEQ ID NO: 8204600 - DNA, 20 bp, Homo sapiens
aagagtctttactgagctaa

SEQ ID NO: 8204601 - DNA, 22 bp, Homo sapiens
aagagtttatgatataacatgt

SEQ ID NO: 8204602 - DNA, 23 bp, Homo sapiens
aagagtttagagtcttgcagagt

SEQ ID NO: 8204603 - DNA, 22 bp, Homo sapiens
acacatttctctttttgtaagt

SEQ ID NO: 8204604 - DNA, 22 bp, Homo sapiens
acacatttctctttttgtaagt

SEQ ID NO: 8204605 - DNA, 22 bp, Homo sapiens
acacatttctctttttgtaagt

SEQ ID NO: 8204606 - DNA, 22 bp, Homo sapiens
acacctttgccccaagtcatag

SEQ ID NO: 8204607 - DNA, 22 bp, Homo sapiens
acacctttgccccaagtcatag

SEQ ID NO: 8204608 - DNA, 22 bp, Homo sapiens
acacctttgtgaagtgatgatg

SEQ ID NO: 8204609 - DNA, 22 bp, Homo sapiens
acacgcatgatgatgcacgtac

SEQ ID NO: 8204610 - DNA, 22 bp, Homo sapiens
acacgcataaatacacagtcta

SEQ ID NO: 8204611 - DNA, 22 bp, Homo sapiens
acacctttgccccaagtcatag

SEQ ID NO: 8204612 - DNA, 22 bp, Homo sapiens
acacctggtctttgcatgagca

SEQ ID NO: 8204613 - DNA, 22 bp, Homo sapiens
acaccccaccagtaactgaggg

SEQ ID NO: 8204614 - DNA, 22 bp, Homo sapiens
acacctggtctttgcatgagca

SEQ ID NO: 8204615 - DNA, 22 bp, Homo sapiens
acacctggtctttgcatgagca

SEQ ID NO: 8204616 - DNA, 22 bp, Homo sapiens
acacggcactttaggaaggggc

SEQ ID NO: 8204617 - DNA, 23 bp, Homo sapiens
acacgtgtgtgtacatagatagt

SEQ ID NO: 8204618 - DNA, 22 bp, Homo sapiens
acactacaatctcagaactata

SEQ ID NO: 8204619 - DNA, 22 bp, Homo sapiens
aagatacatcaaagcaaattgg

SEQ ID NO: 8204620 - DNA, 22 bp, Homo sapiens
tcacagcattgtcacaaggctg

SEQ ID NO: 8204621 - DNA, 22 bp, Homo sapiens
tcacagcattcgcaatggacag

SEQ ID NO: 8204622 - DNA, 22 bp, Homo sapiens
tcacagcattcgcaatggacag

SEQ ID NO: 8204623 - DNA, 19 bp, Homo sapiens
tcacagcatctgtctgaac

SEQ ID NO: 8204624 - DNA, 22 bp, Homo sapiens
tcacagcagtaaagaaaacact

SEQ ID NO: 8204625 - DNA, 22 bp, Homo sapiens
tcacagcagggtaacaggaaga

SEQ ID NO: 8204626 - DNA, 22 bp, Homo sapiens
tcacagcagggtaacaggaaga

SEQ ID NO: 8204627 - DNA, 22 bp, Homo sapiens
tcacagcaccaggatctctcca

SEQ ID NO: 8204628 - DNA, 22 bp, Homo sapiens
tcacagcaccaggatctctcca

SEQ ID NO: 8204629 - DNA, 22 bp, Homo sapiens
tcacagcaaccctgaggcgagt

SEQ ID NO: 8204630 - DNA, 22 bp, Homo sapiens
tcacagcacatggaccgagtcc

SEQ ID NO: 8204631 - DNA, 22 bp, Homo sapiens
tcacagcacatggaccgagtcc

SEQ ID NO: 8204632 - DNA, 22 bp, Homo sapiens
tcacagcaacactggggcagac

SEQ ID NO: 8204633 - DNA, 22 bp, Homo sapiens
tcacagcaaccctgaggcgagt

SEQ ID NO: 8204634 - DNA, 22 bp, Homo sapiens
tcacagcagaatttaggaggca

SEQ ID NO: 8204635 - DNA, 22 bp, Homo sapiens
tcacagcagggtaacaggaaga

SEQ ID NO: 8204636 - DNA, 22 bp, Homo sapiens
tcacagcaggcagatattgttg

SEQ ID NO: 8204637 - DNA, 22 bp, Homo sapiens
tcacagcaccctgaggtgctgg

SEQ ID NO: 8204638 - DNA, 22 bp, Homo sapiens
tcacagcaccctgaggtgctgg

SEQ ID NO: 8204639 - DNA, 22 bp, Homo sapiens
tcacagcaccaggatctctcca

SEQ ID NO: 8204640 - DNA, 22 bp, Homo sapiens
tcacagcaccctgaggtgctgg

SEQ ID NO: 8204641 - DNA, 22 bp, Homo sapiens
tcacagcaccctgaggtgctgg

SEQ ID NO: 8204642 - DNA, 17 bp, Homo sapiens
tcacatcacacaagcaa

SEQ ID NO: 8204643 - DNA, 17 bp, Homo sapiens
tcacatcacacaagcaa

SEQ ID NO: 8204644 - DNA, 22 bp, Homo sapiens
tcacatcaggtgtctccccaag

SEQ ID NO: 8204645 - DNA, 22 bp, Homo sapiens
tcacatatttaagaaagttaaa

SEQ ID NO: 8204646 - DNA, 22 bp, Homo sapiens
tcacatatttaagaaagttaaa

SEQ ID NO: 8204647 - DNA, 22 bp, Homo sapiens
tcacagcatttttagaaagatt

SEQ ID NO: 8204648 - DNA, 22 bp, Homo sapiens
tcacatctaattccatttctgc

SEQ ID NO: 8204649 - DNA, 22 bp, Homo sapiens
tcacatctaattccatttctgc

SEQ ID NO: 8204650 - DNA, 22 bp, Homo sapiens
tcacatctaattcggttaggtt

SEQ ID NO: 8204651 - DNA, 22 bp, Homo sapiens
tcacatctaattccatttctgc

SEQ ID NO: 8204652 - DNA, 20 bp, Homo sapiens
tcacatcctctcccaacatg

SEQ ID NO: 8204653 - DNA, 22 bp, Homo sapiens
tcacatctatacccaataattt

SEQ ID NO: 8204654 - DNA, 22 bp, Homo sapiens
tcacatcattaagacttctcct

SEQ ID NO: 8204655 - DNA, 22 bp, Homo sapiens
tcacatcattaagacttctcct

SEQ ID NO: 8204656 - DNA, 20 bp, Homo sapiens
tcacatcctctcccaacatg

SEQ ID NO: 8204657 - DNA, 20 bp, Homo sapiens
tcacatcctctcccaacatg

SEQ ID NO: 8204658 - DNA, 21 bp, Homo sapiens
tcacatctatgttaagcaaac

SEQ ID NO: 8204659 - DNA, 21 bp, Homo sapiens
tcacatctatgttaagcaaac

SEQ ID NO: 8204660 - DNA, 22 bp, Homo sapiens
tcacatctccatgtgttgttca

SEQ ID NO: 8204661 - DNA, 22 bp, Homo sapiens
tcacatctctcattgcctctgc

SEQ ID NO: 8204662 - DNA, 22 bp, Homo sapiens
tcacatctctcattgcctctgc

SEQ ID NO: 8204663 - DNA, 22 bp, Homo sapiens
tcacatctccctggaggacaca

SEQ ID NO: 8204664 - DNA, 22 bp, Homo sapiens
tcacatctctgttttctaaatc

SEQ ID NO: 8204665 - DNA, 22 bp, Homo sapiens
tcacatctctcattgcctctgc

SEQ ID NO: 8204666 - DNA, 22 bp, Homo sapiens
tcacatctgaaaaaatattgag

SEQ ID NO: 8204667 - DNA, 22 bp, Homo sapiens
tcacatctgaaaaaatattgag

SEQ ID NO: 8204668 - DNA, 22 bp, Homo sapiens
tcacatctgattagtgactgat

SEQ ID NO: 8204669 - DNA, 22 bp, Homo sapiens
tcacatctgcaaaatccctttt

SEQ ID NO: 8204670 - DNA, 22 bp, Homo sapiens
tcacatctgcctccatagcacc

SEQ ID NO: 8204671 - DNA, 22 bp, Homo sapiens
tcacagacagaagggatgggat

SEQ ID NO: 8204672 - DNA, 22 bp, Homo sapiens
tcacagacatggtgaggtaaca

SEQ ID NO: 8204673 - DNA, 22 bp, Homo sapiens
tcacagagagaatattgtgttt

SEQ ID NO: 8204674 - DNA, 22 bp, Homo sapiens
tcacagcaaaagtgtgcagagc

SEQ ID NO: 8204675 - DNA, 22 bp, Homo sapiens
tcacagcaaatgctgcttctca

SEQ ID NO: 8204676 - DNA, 22 bp, Homo sapiens
tcacagcaaaagtgtgcagagc

SEQ ID NO: 8204677 - DNA, 22 bp, Homo sapiens
tcacagagttaaaagtttcttt

SEQ ID NO: 8204678 - DNA, 20 bp, Homo sapiens
tcacagagtagccttgtctg

SEQ ID NO: 8204679 - DNA, 21 bp, Homo sapiens
tcacagagccacagaattggt

SEQ ID NO: 8204680 - DNA, 20 bp, Homo sapiens
tcacacataagtgaacgcac

SEQ ID NO: 8204681 - DNA, 22 bp, Homo sapiens
tcacacataaaaagaagactag

SEQ ID NO: 8204682 - DNA, 22 bp, Homo sapiens
tcacacataaaaagaagactag

SEQ ID NO: 8204683 - DNA, 22 bp, Homo sapiens
tcacacatactcatgtgtgagt

SEQ ID NO: 8204684 - DNA, 22 bp, Homo sapiens
tcacacatctcaggtgtttaat

SEQ ID NO: 8204685 - DNA, 22 bp, Homo sapiens
tcacacatgagtaaatacaggg

SEQ ID NO: 8204686 - DNA, 22 bp, Homo sapiens
tcacacatgagtaaatacaggg

SEQ ID NO: 8204687 - DNA, 22 bp, Homo sapiens
tcacacatgagtaaatacaggg

SEQ ID NO: 8204688 - DNA, 22 bp, Homo sapiens
tcacacatctcaggtgtttaat

SEQ ID NO: 8204689 - DNA, 22 bp, Homo sapiens
tcacacaggtttgcaatgattt

SEQ ID NO: 8204690 - DNA, 22 bp, Homo sapiens
tcacacaggtttgcaatgattt

SEQ ID NO: 8204691 - DNA, 22 bp, Homo sapiens
tcacacagggttctggtctcat

SEQ ID NO: 8204692 - DNA, 22 bp, Homo sapiens
tcacacagggttctggtctcat

SEQ ID NO: 8204693 - DNA, 22 bp, Homo sapiens
tcacacagggttctggtctcat

SEQ ID NO: 8204694 - DNA, 22 bp, Homo sapiens
tcacacagtgagaaagtgcgga

SEQ ID NO: 8204695 - DNA, 22 bp, Homo sapiens
tcacagaatttttgcttccagt

SEQ ID NO: 8204696 - DNA, 22 bp, Homo sapiens
tcacagaatgtctagcataatt

SEQ ID NO: 8204697 - DNA, 22 bp, Homo sapiens
tcacagaatgtctagcataatt

SEQ ID NO: 8204698 - DNA, 22 bp, Homo sapiens
tcacagaatgtcagagttgggg

SEQ ID NO: 8204699 - DNA, 18 bp, Homo sapiens
tcacagaatattgagtgg

SEQ ID NO: 8204700 - DNA, 18 bp, Homo sapiens
tcacagaatattgagtgg

SEQ ID NO: 8204701 - DNA, 22 bp, Homo sapiens
tcacagaatagcactgtaagcg

SEQ ID NO: 8204702 - DNA, 22 bp, Homo sapiens
tcacagaatgtcagagttgggg

SEQ ID NO: 8204703 - DNA, 22 bp, Homo sapiens
tcacagaatctctgataagtct

SEQ ID NO: 8204704 - DNA, 22 bp, Homo sapiens
tcacagaatctctgataagtct

SEQ ID NO: 8204705 - DNA, 22 bp, Homo sapiens
tcacagaatctctgataagtct

SEQ ID NO: 8204706 - DNA, 22 bp, Homo sapiens
tcaattactaaccaaataatgt

SEQ ID NO: 8204707 - DNA, 22 bp, Homo sapiens
tcaattaagaggctaagttact

SEQ ID NO: 8204708 - DNA, 22 bp, Homo sapiens
tcaattatgccattgcaatatt

SEQ ID NO: 8204709 - DNA, 22 bp, Homo sapiens
tcaattagggtctatttctagt

SEQ ID NO: 8204710 - DNA, 23 bp, Homo sapiens
tcaattatcaatggaaagaagtt

SEQ ID NO: 8204711 - DNA, 22 bp, Homo sapiens
tcaattattttggctatgctaa

SEQ ID NO: 8204712 - DNA, 22 bp, Homo sapiens
tcaattcaacacatgcacattg

SEQ ID NO: 8204713 - DNA, 21 bp, Homo sapiens
tcaattatggatgtgtgcaaa

SEQ ID NO: 8204714 - DNA, 22 bp, Homo sapiens
tcaattcagtccaacagtaatt

SEQ ID NO: 8204715 - DNA, 22 bp, Homo sapiens
tcaattctagagccttacattg

SEQ ID NO: 8204716 - DNA, 22 bp, Homo sapiens
tcaattctagagccttacattg

SEQ ID NO: 8204717 - DNA, 22 bp, Homo sapiens
tcaattctagagccttacattg

SEQ ID NO: 8204718 - DNA, 22 bp, Homo sapiens
tcaattcatagagttgacacag

SEQ ID NO: 8204719 - DNA, 22 bp, Homo sapiens
tcaattctggtcctcaggaact

SEQ ID NO: 8204720 - DNA, 22 bp, Homo sapiens
tcacacagggtcggaaagagtg

SEQ ID NO: 8204721 - DNA, 22 bp, Homo sapiens
tcacacagggtcggaaagagtg

SEQ ID NO: 8204722 - DNA, 22 bp, Homo sapiens
tcacacagcttggagttatggt

SEQ ID NO: 8204723 - DNA, 23 bp, Homo sapiens
tcacacagctggtcaggtacaga

SEQ ID NO: 8204724 - DNA, 23 bp, Homo sapiens
tcacacagctggtcaggtacaga

SEQ ID NO: 8204725 - DNA, 23 bp, Homo sapiens
tcacacagctggtcaggtacaga

SEQ ID NO: 8204726 - DNA, 22 bp, Homo sapiens
tcacacagcttggagttatggt

SEQ ID NO: 8204727 - DNA, 22 bp, Homo sapiens
tcacacagcttggagttatggt

SEQ ID NO: 8204728 - DNA, 23 bp, Homo sapiens
tcacacagctggtcaggtacaga

SEQ ID NO: 8204729 - DNA, 22 bp, Homo sapiens
tcacacagctcctttccttagt

SEQ ID NO: 8204730 - DNA, 22 bp, Homo sapiens
tcacacagattggtagagctga

SEQ ID NO: 8204731 - DNA, 22 bp, Homo sapiens
tcacacagattggtagagctga

SEQ ID NO: 8204732 - DNA, 22 bp, Homo sapiens
tcacacagattggtagagctga

SEQ ID NO: 8204733 - DNA, 22 bp, Homo sapiens
tcacacagattggtagagctga

SEQ ID NO: 8204734 - DNA, 22 bp, Homo sapiens
tcacacagctagtaagggccga

SEQ ID NO: 8204735 - DNA, 22 bp, Homo sapiens
tcacaatttggatacagctatg

SEQ ID NO: 8204736 - DNA, 22 bp, Homo sapiens
tcaatttaaggtactactttgg

SEQ ID NO: 8204737 - DNA, 22 bp, Homo sapiens
tcaattctggtcctcaggaact

SEQ ID NO: 8204738 - DNA, 22 bp, Homo sapiens
tcacacacatggatagtatttt

SEQ ID NO: 8204739 - DNA, 22 bp, Homo sapiens
tcacacacataatctaagatta

SEQ ID NO: 8204740 - DNA, 22 bp, Homo sapiens
tcacacacataatctaagatta

SEQ ID NO: 8204741 - DNA, 22 bp, Homo sapiens
tcacacacataatctaagatta

SEQ ID NO: 8204742 - DNA, 21 bp, Homo sapiens
tcacacacgtttccaagggca

SEQ ID NO: 8204743 - DNA, 21 bp, Homo sapiens
tcacacacgtttccaagggca

SEQ ID NO: 8204744 - DNA, 22 bp, Homo sapiens
tcacacacatttgctgtctgat

SEQ ID NO: 8204745 - DNA, 22 bp, Homo sapiens
tcacacacatggatagtatttt

SEQ ID NO: 8204746 - DNA, 22 bp, Homo sapiens
tcacacacatttgctgtctgat

SEQ ID NO: 8204747 - DNA, 22 bp, Homo sapiens
tcaaaattctagggagaatggt

SEQ ID NO: 8204748 - DNA, 22 bp, Homo sapiens
tcaaaatttcagcactagccct

SEQ ID NO: 8204749 - DNA, 22 bp, Homo sapiens
tcaaacagaggaacaattgttt

SEQ ID NO: 8204750 - DNA, 18 bp, Homo sapiens
tcaaaatatttctgtgga

SEQ ID NO: 8204751 - DNA, 18 bp, Homo sapiens
tcaaaatatttctgtgga

SEQ ID NO: 8204752 - DNA, 18 bp, Homo sapiens
tcaaaatatttctgtgga

SEQ ID NO: 8204753 - DNA, 18 bp, Homo sapiens
tcaaaatatttctgtgga

SEQ ID NO: 8204754 - DNA, 22 bp, Homo sapiens
tcaaaagtttcacatagagata

SEQ ID NO: 8204755 - DNA, 20 bp, Homo sapiens
tcaaaataggtgtgggcgga

SEQ ID NO: 8204756 - DNA, 22 bp, Homo sapiens
tcaaaaatggtctttgagctgc

SEQ ID NO: 8204757 - DNA, 22 bp, Homo sapiens
tattttcattctgtgtgactgt

SEQ ID NO: 8204758 - DNA, 22 bp, Homo sapiens
tcaaaaatggtctttgagctgc

SEQ ID NO: 8204759 - DNA, 22 bp, Homo sapiens
tcaaaaatggtctttgagctgc

SEQ ID NO: 8204760 - DNA, 22 bp, Homo sapiens
tcaaaaatggtctttgagctgc

SEQ ID NO: 8204761 - DNA, 22 bp, Homo sapiens
tcaaaaatgttttatattggta

SEQ ID NO: 8204762 - DNA, 22 bp, Homo sapiens
tcaaaagaaacaccatgttcct

SEQ ID NO: 8204763 - DNA, 22 bp, Homo sapiens
tcaaaagacacaggaggctagt

SEQ ID NO: 8204764 - DNA, 22 bp, Homo sapiens
tcaatacatacaatgtatagtg

SEQ ID NO: 8204765 - DNA, 22 bp, Homo sapiens
tcaatagaaatgcagagtctca

SEQ ID NO: 8204766 - DNA, 22 bp, Homo sapiens
tcaatacatacaatgtatagtg

SEQ ID NO: 8204767 - DNA, 23 bp, Homo sapiens
tcaaacatattgtgagacacagg

SEQ ID NO: 8204768 - DNA, 22 bp, Homo sapiens
tcaaacaggactacattctcat

SEQ ID NO: 8204769 - DNA, 23 bp, Homo sapiens
tcaaacaggtttcagagcatctt

SEQ ID NO: 8204770 - DNA, 21 bp, Homo sapiens
tcacgtggtcacatgagcttt

SEQ ID NO: 8204771 - DNA, 21 bp, Homo sapiens
tcacgtggtcacatgagcttt

SEQ ID NO: 8204772 - DNA, 21 bp, Homo sapiens
tcacgtggtcacatgagcttt

SEQ ID NO: 8204773 - DNA, 22 bp, Homo sapiens
tcacgtgagggacctgtgtctg

SEQ ID NO: 8204774 - DNA, 22 bp, Homo sapiens
tcacggacctaagaggaagatt

SEQ ID NO: 8204775 - DNA, 22 bp, Homo sapiens
tcacgcatggacggtcaacatc

SEQ ID NO: 8204776 - DNA, 22 bp, Homo sapiens
tcaccttgtgatctccctgcct

SEQ ID NO: 8204777 - DNA, 22 bp, Homo sapiens
tcaccttgtgatctccctgcct

SEQ ID NO: 8204778 - DNA, 22 bp, Homo sapiens
tcaccttgtgatctccctgcct

SEQ ID NO: 8204779 - DNA, 22 bp, Homo sapiens
tcacctgtattaatacagaact

SEQ ID NO: 8204780 - DNA, 22 bp, Homo sapiens
tcacctgggagggctgtggtag

SEQ ID NO: 8204781 - DNA, 22 bp, Homo sapiens
tcacctgggagggctgtggtag

SEQ ID NO: 8204782 - DNA, 22 bp, Homo sapiens
tcaccttgtgatccgcccacct

SEQ ID NO: 8204783 - DNA, 22 bp, Homo sapiens
tcacctctctggccgtctacct

SEQ ID NO: 8204784 - DNA, 21 bp, Homo sapiens
tcacctggcttctgacctggc

SEQ ID NO: 8204785 - DNA, 22 bp, Homo sapiens
tcacctcaccacccttatggtt

SEQ ID NO: 8204786 - DNA, 22 bp, Homo sapiens
tcaccccttgtgaatgctgctc

SEQ ID NO: 8204787 - DNA, 22 bp, Homo sapiens
tcacccttagtgtactatcatg

SEQ ID NO: 8204788 - DNA, 22 bp, Homo sapiens
tcacccttgataatgttcttct

SEQ ID NO: 8204789 - DNA, 22 bp, Homo sapiens
tcaccgaggctggagtgcagtg

SEQ ID NO: 8204790 - DNA, 22 bp, Homo sapiens
tcaccgaggctggagtgcagtg

SEQ ID NO: 8204791 - DNA, 22 bp, Homo sapiens
tcaccggcagacgtggcctgat

SEQ ID NO: 8204792 - DNA, 22 bp, Homo sapiens
tcacccatcctggatgagattc

SEQ ID NO: 8204793 - DNA, 22 bp, Homo sapiens
tcaccccaaagttgagtttgat

SEQ ID NO: 8204794 - DNA, 22 bp, Homo sapiens
tcacccctaccaaggagcactg

SEQ ID NO: 8204795 - DNA, 22 bp, Homo sapiens
tcacccctaccaaggagcactg

SEQ ID NO: 8204796 - DNA, 22 bp, Homo sapiens
tcacatgaggttatgacaaagc

SEQ ID NO: 8204797 - DNA, 22 bp, Homo sapiens
tcacatgaggttatgacaaagc

SEQ ID NO: 8204798 - DNA, 22 bp, Homo sapiens
tcacatgaggttatgacaaagc

SEQ ID NO: 8204799 - DNA, 22 bp, Homo sapiens
tcacatcttgtgatgttttcat

SEQ ID NO: 8204800 - DNA, 22 bp, Homo sapiens
tcacatcttggattacaatttt

SEQ ID NO: 8204801 - DNA, 22 bp, Homo sapiens
tcacatcttattagagtatctc

SEQ ID NO: 8204802 - DNA, 22 bp, Homo sapiens
tcacatctgttgatacagcatc

SEQ ID NO: 8204803 - DNA, 22 bp, Homo sapiens
tcacatcttagtttgggactct

SEQ ID NO: 8204804 - DNA, 22 bp, Homo sapiens
tcacatctgtgtgattgtcatt

SEQ ID NO: 8204805 - DNA, 22 bp, Homo sapiens
tcacatctgtgtgattgtcatt

SEQ ID NO: 8204806 - DNA, 22 bp, Homo sapiens
tcacatctgttgatacagcatc

SEQ ID NO: 8204807 - DNA, 22 bp, Homo sapiens
tcacatctgttgatacagcatc

SEQ ID NO: 8204808 - DNA, 22 bp, Homo sapiens
tcacatctgcctccatagcacc

SEQ ID NO: 8204809 - DNA, 23 bp, Homo sapiens
tcacatctgccgtagtgtattct

SEQ ID NO: 8204810 - DNA, 22 bp, Homo sapiens
tcacatctgcctccatagcacc

SEQ ID NO: 8204811 - DNA, 20 bp, Homo sapiens
tcacatctggcagctgatga

SEQ ID NO: 8204812 - DNA, 20 bp, Homo sapiens
tcacatctggcagctgatga

SEQ ID NO: 8204813 - DNA, 22 bp, Homo sapiens
tcacatgcacatacttcctgtg

SEQ ID NO: 8204814 - DNA, 22 bp, Homo sapiens
tcacatgcagtagcagggattg

SEQ ID NO: 8204815 - DNA, 22 bp, Homo sapiens
tcacatgccacagatgaggcaa

SEQ ID NO: 8204816 - DNA, 20 bp, Homo sapiens
tcacatgcatattcgtttct

SEQ ID NO: 8204817 - DNA, 21 bp, Homo sapiens
tcacatgcccattactggagc

SEQ ID NO: 8204818 - DNA, 22 bp, Homo sapiens
tcacccaggtccaggctctggc

SEQ ID NO: 8204819 - DNA, 22 bp, Homo sapiens
tcacatgccctgtatttaccag

SEQ ID NO: 8204820 - DNA, 21 bp, Homo sapiens
tcactggaatacaattgattt

SEQ ID NO: 8204821 - DNA, 22 bp, Homo sapiens
tcactggaaatgcacagctgta

SEQ ID NO: 8204822 - DNA, 22 bp, Homo sapiens
tcactggaaatgcacagctgta

SEQ ID NO: 8204823 - DNA, 21 bp, Homo sapiens
tcactggaatacaattgattt

SEQ ID NO: 8204824 - DNA, 21 bp, Homo sapiens
tcactggacgtgagccagggg

SEQ ID NO: 8204825 - DNA, 22 bp, Homo sapiens
tcactgctttgtttacaactat

SEQ ID NO: 8204826 - DNA, 22 bp, Homo sapiens
tcactgctttgagccactgagc

SEQ ID NO: 8204827 - DNA, 22 bp, Homo sapiens
tcactggaaatgcacagctgta

SEQ ID NO: 8204828 - DNA, 22 bp, Homo sapiens
tcactggaaagacagcactctt

SEQ ID NO: 8204829 - DNA, 22 bp, Homo sapiens
tcactacaacctccgcctcctg

SEQ ID NO: 8204830 - DNA, 22 bp, Homo sapiens
tcactacaacctccgcctcctg

SEQ ID NO: 8204831 - DNA, 22 bp, Homo sapiens
tcactgcttcttggagaatgtc

SEQ ID NO: 8204832 - DNA, 22 bp, Homo sapiens
tcactgcttcttggagaatgtc

SEQ ID NO: 8204833 - DNA, 22 bp, Homo sapiens
tcactgctttgagccactgagc

SEQ ID NO: 8204834 - DNA, 22 bp, Homo sapiens
tcactgctttcaaaaattattg

SEQ ID NO: 8204835 - DNA, 22 bp, Homo sapiens
tcactgctttcaaaaattattg

SEQ ID NO: 8204836 - DNA, 21 bp, Homo sapiens
tcacgtggtcacatgagcttt

SEQ ID NO: 8204837 - DNA, 21 bp, Homo sapiens
tcacgtggtcacatgagcttt

SEQ ID NO: 8204838 - DNA, 22 bp, Homo sapiens
tcacgttttactgagtgagata

SEQ ID NO: 8204839 - DNA, 22 bp, Homo sapiens
tcactaatgagctaaggaaaag

SEQ ID NO: 8204840 - DNA, 22 bp, Homo sapiens
tcactaatgattttgaaagaag

SEQ ID NO: 8204841 - DNA, 22 bp, Homo sapiens
tcactaatgagctaaggaaaag

SEQ ID NO: 8204842 - DNA, 22 bp, Homo sapiens
tcactaatagggggagcatagg

SEQ ID NO: 8204843 - DNA, 22 bp, Homo sapiens
tcactggattagtttgaactgt

SEQ ID NO: 8204844 - DNA, 20 bp, Homo sapiens
tcactggccagagtagccct

SEQ ID NO: 8204845 - DNA, 22 bp, Homo sapiens
tcactggagaaaagtaatgtat

SEQ ID NO: 8204846 - DNA, 22 bp, Homo sapiens
tcactggactcactgtggccag

SEQ ID NO: 8204847 - DNA, 22 bp, Homo sapiens
tcactggattaagcattgacat

SEQ ID NO: 8204848 - DNA, 22 bp, Homo sapiens
tcactggatcctagctgagcct

SEQ ID NO: 8204849 - DNA, 22 bp, Homo sapiens
tcactggatcctagctgagcct

SEQ ID NO: 8204850 - DNA, 20 bp, Homo sapiens
tcactggccagagtagccct

SEQ ID NO: 8204851 - DNA, 17 bp, Homo sapiens
tcactgggcctgctccc

SEQ ID NO: 8204852 - DNA, 22 bp, Homo sapiens
tcactggggagcactgacatgt

SEQ ID NO: 8204853 - DNA, 22 bp, Homo sapiens
tcactgggtaggacatgctgat

SEQ ID NO: 8204854 - DNA, 22 bp, Homo sapiens
tcactggtgtgagaggagcaaa

SEQ ID NO: 8204855 - DNA, 22 bp, Homo sapiens
tcactgggtaggacatgctgat

SEQ ID NO: 8204856 - DNA, 22 bp, Homo sapiens
tcactgggtaggacatgctgat

SEQ ID NO: 8204857 - DNA, 22 bp, Homo sapiens
tcactggggcctttggtcagga

SEQ ID NO: 8204858 - DNA, 22 bp, Homo sapiens
tcactggggcctttggtcagga

SEQ ID NO: 8204859 - DNA, 22 bp, Homo sapiens
tcactgtaatttgtatctgtgg

SEQ ID NO: 8204860 - DNA, 22 bp, Homo sapiens
tcactgtaatttgtatctgtgg

SEQ ID NO: 8204861 - DNA, 22 bp, Homo sapiens
tcactgtaaagtaatactgtca

SEQ ID NO: 8204862 - DNA, 22 bp, Homo sapiens
tcactgtagtgagcagaatata

SEQ ID NO: 8204863 - DNA, 22 bp, Homo sapiens
tcactgtaccttccatttcatt

SEQ ID NO: 8204864 - DNA, 22 bp, Homo sapiens
tcactgtagagtctgtttccac

SEQ ID NO: 8204865 - DNA, 22 bp, Homo sapiens
tcagaacatcctggtttaaaat

SEQ ID NO: 8204866 - DNA, 23 bp, Homo sapiens
tcagaacagttcttggtgcatag

SEQ ID NO: 8204867 - DNA, 22 bp, Homo sapiens
tcagaacagttcttaatattgc

SEQ ID NO: 8204868 - DNA, 22 bp, Homo sapiens
tcagaacagtgcctggcactaa

SEQ ID NO: 8204869 - DNA, 23 bp, Homo sapiens
tcactgtcctgctcctggaacgc

SEQ ID NO: 8204870 - DNA, 22 bp, Homo sapiens
tcactgtctgaaagaaatggcc

SEQ ID NO: 8204871 - DNA, 22 bp, Homo sapiens
tcactgtccctgtcctcttatc

SEQ ID NO: 8204872 - DNA, 22 bp, Homo sapiens
tcactgtatgtctttttttgat

SEQ ID NO: 8204873 - DNA, 22 bp, Homo sapiens
tcactgtatgtctttttttgat

SEQ ID NO: 8204874 - DNA, 21 bp, Homo sapiens
tcactgtgcaaatgttgatgg

SEQ ID NO: 8204875 - DNA, 22 bp, Homo sapiens
tcactgtgcacatatgataggt

SEQ ID NO: 8204876 - DNA, 22 bp, Homo sapiens
tcactgtcttttaaggtggtta

SEQ ID NO: 8204877 - DNA, 21 bp, Homo sapiens
tcagaggcactgagagcaatg

SEQ ID NO: 8204878 - DNA, 22 bp, Homo sapiens
tcagaggccaaactgagcaggg

SEQ ID NO: 8204879 - DNA, 22 bp, Homo sapiens
tcagaggctcatctgccttgca

SEQ ID NO: 8204880 - DNA, 20 bp, Homo sapiens
tcagaggctgccagctgggg

SEQ ID NO: 8204881 - DNA, 22 bp, Homo sapiens
tcagaggattgcctcagcgagc

SEQ ID NO: 8204882 - DNA, 22 bp, Homo sapiens
tcagaggattgcctcagcgagc

SEQ ID NO: 8204883 - DNA, 18 bp, Homo sapiens
tcagaggagatacctaaa

SEQ ID NO: 8204884 - DNA, 22 bp, Homo sapiens
tcagaggattggacttttatgt

SEQ ID NO: 8204885 - DNA, 19 bp, Homo sapiens
tcagaggatttggctatga

SEQ ID NO: 8204886 - DNA, 22 bp, Homo sapiens
tcagaggagaccaaggggaata

SEQ ID NO: 8204887 - DNA, 22 bp, Homo sapiens
tcagaggagaccaaggggaata

SEQ ID NO: 8204888 - DNA, 22 bp, Homo sapiens
tcagaggagaagttgggaaaat

SEQ ID NO: 8204889 - DNA, 22 bp, Homo sapiens
tcagaggagaagttgggaaaat

SEQ ID NO: 8204890 - DNA, 22 bp, Homo sapiens
tcagaggactaccttctccagt

SEQ ID NO: 8204891 - DNA, 22 bp, Homo sapiens
tcagaggactaccttctccagt

SEQ ID NO: 8204892 - DNA, 22 bp, Homo sapiens
tcagaggacgcactagggttgt

SEQ ID NO: 8204893 - DNA, 18 bp, Homo sapiens
tcagagagaatagtaatt

SEQ ID NO: 8204894 - DNA, 20 bp, Homo sapiens
tcagagagagggtgccactt

SEQ ID NO: 8204895 - DNA, 20 bp, Homo sapiens
tcagagagagggtgccactt

SEQ ID NO: 8204896 - DNA, 22 bp, Homo sapiens
tcagagagcctcaggcactgcc

SEQ ID NO: 8204897 - DNA, 22 bp, Homo sapiens
tcagaggaataatgctgcattt

SEQ ID NO: 8204898 - DNA, 22 bp, Homo sapiens
tcagaggaataatgctgcattt

SEQ ID NO: 8204899 - DNA, 23 bp, Homo sapiens
tcagagagctgttgagagctgcc

SEQ ID NO: 8204900 - DNA, 22 bp, Homo sapiens
tcagagaggattttaataagtg

SEQ ID NO: 8204901 - DNA, 22 bp, Homo sapiens
tcagaggacagcagctaaataa

SEQ ID NO: 8204902 - DNA, 22 bp, Homo sapiens
tcagaggacagcagctaaataa

SEQ ID NO: 8204903 - DNA, 22 bp, Homo sapiens
tcagaggaccttactgagaacc

SEQ ID NO: 8204904 - DNA, 22 bp, Homo sapiens
tcagaggaccttactgagaacc

SEQ ID NO: 8204905 - DNA, 22 bp, Homo sapiens
tcagaggacagcagctaaataa

SEQ ID NO: 8204906 - DNA, 22 bp, Homo sapiens
tcagaggacaagctccctggtg

SEQ ID NO: 8204907 - DNA, 22 bp, Homo sapiens
tcagaggaatttgcttttcatg

SEQ ID NO: 8204908 - DNA, 22 bp, Homo sapiens
tcagaacatggcatgttccatc

SEQ ID NO: 8204909 - DNA, 22 bp, Homo sapiens
tcagaacatcctggtttaaaat

SEQ ID NO: 8204910 - DNA, 22 bp, Homo sapiens
tcagaacattctcattgactgc

SEQ ID NO: 8204911 - DNA, 22 bp, Homo sapiens
tcagaacatttaaaaagtggtt

SEQ ID NO: 8204912 - DNA, 22 bp, Homo sapiens
tcagaactacatggacatgtta

SEQ ID NO: 8204913 - DNA, 22 bp, Homo sapiens
tcagaacattgacattcttatt

SEQ ID NO: 8204914 - DNA, 22 bp, Homo sapiens
tcagaacttaaagccgattggg

SEQ ID NO: 8204915 - DNA, 19 bp, Homo sapiens
tcagaactcagaatgtgta

SEQ ID NO: 8204916 - DNA, 22 bp, Homo sapiens
tcagaactggaagaggttctgc

SEQ ID NO: 8204917 - DNA, 22 bp, Homo sapiens
tcagaagagctggtgctgcctg

SEQ ID NO: 8204918 - DNA, 22 bp, Homo sapiens
tcagaagagtaatagggtgaga

SEQ ID NO: 8204919 - DNA, 22 bp, Homo sapiens
tcagaagagtaatagggtgaga

SEQ ID NO: 8204920 - DNA, 22 bp, Homo sapiens
tcagaagactactaggacacat

SEQ ID NO: 8204921 - DNA, 22 bp, Homo sapiens
tcagaagcaaacatcactctag

SEQ ID NO: 8204922 - DNA, 22 bp, Homo sapiens
tcagaagcaagcttctacttct

SEQ ID NO: 8204923 - DNA, 22 bp, Homo sapiens
tcagaagcagaaaataggtggg

SEQ ID NO: 8204924 - DNA, 22 bp, Homo sapiens
tcagagaaggtaagtgacctgc

SEQ ID NO: 8204925 - DNA, 22 bp, Homo sapiens
tcagagaagtaaggtggggtgc

SEQ ID NO: 8204926 - DNA, 23 bp, Homo sapiens
tcagagaataattctgatagact

SEQ ID NO: 8204927 - DNA, 22 bp, Homo sapiens
tcagagaagtaggctaatggtg

SEQ ID NO: 8204928 - DNA, 22 bp, Homo sapiens
tcagaagcaggagtgtgcacaa

SEQ ID NO: 8204929 - DNA, 22 bp, Homo sapiens
tcagaagcagatatttcaaaat

SEQ ID NO: 8204930 - DNA, 22 bp, Homo sapiens
tcagaagcaggagtgtgcacaa

SEQ ID NO: 8204931 - DNA, 22 bp, Homo sapiens
tcagaagcatccatttcaccac

SEQ ID NO: 8204932 - DNA, 22 bp, Homo sapiens
tcagaagccaccttttgttggg

SEQ ID NO: 8204933 - DNA, 22 bp, Homo sapiens
tcagaagcatgtggggagcctg

SEQ ID NO: 8204934 - DNA, 22 bp, Homo sapiens
tcagaagcatgtggggagcctg

SEQ ID NO: 8204935 - DNA, 23 bp, Homo sapiens
tcagagaatggtatgcttttcct

SEQ ID NO: 8204936 - DNA, 22 bp, Homo sapiens
tcagagaatgtccttcttcatt

SEQ ID NO: 8204937 - DNA, 21 bp, Homo sapiens
tcagagaatggcctactctca

SEQ ID NO: 8204938 - DNA, 22 bp, Homo sapiens
tcagagaatctctccttagttt

SEQ ID NO: 8204939 - DNA, 22 bp, Homo sapiens
tcagagaattcgattaaatgca

SEQ ID NO: 8204940 - DNA, 22 bp, Homo sapiens
tcagagaatgtgaatattaaac

SEQ ID NO: 8204941 - DNA, 22 bp, Homo sapiens
tcagagaatgtccttcttcatt

SEQ ID NO: 8204942 - DNA, 22 bp, Homo sapiens
tcagagaattctcagatgactc

SEQ ID NO: 8204943 - DNA, 22 bp, Homo sapiens
tcagagaattcgattaaatgca

SEQ ID NO: 8204944 - DNA, 22 bp, Homo sapiens
tcagagaattgtttaatggaat

SEQ ID NO: 8204945 - DNA, 22 bp, Homo sapiens
tcagagaattctcagatgactc

SEQ ID NO: 8204946 - DNA, 22 bp, Homo sapiens
tcagagaattgtttaatggaat

SEQ ID NO: 8204947 - DNA, 22 bp, Homo sapiens
tcatatttgggggtgtgtgttt

SEQ ID NO: 8204948 - DNA, 22 bp, Homo sapiens
tcatatttgggggtgtgtgttt

SEQ ID NO: 8204949 - DNA, 20 bp, Homo sapiens
tcataaagaggaaataaata

SEQ ID NO: 8204950 - DNA, 20 bp, Homo sapiens
tcataaagaggaaataaata

SEQ ID NO: 8204951 - DNA, 22 bp, Homo sapiens
tcataaaatgctcctgatattg

SEQ ID NO: 8204952 - DNA, 22 bp, Homo sapiens
tcataaaatgctcctgatattg

SEQ ID NO: 8204953 - DNA, 22 bp, Homo sapiens
tcataaaatgctcctgatattg

SEQ ID NO: 8204954 - DNA, 22 bp, Homo sapiens
tcataaaagtactcatgttcat

SEQ ID NO: 8204955 - DNA, 22 bp, Homo sapiens
tcatattttgcaaggtcagcta

SEQ ID NO: 8204956 - DNA, 20 bp, Homo sapiens
tcatatttttgccctgggcc

SEQ ID NO: 8204957 - DNA, 22 bp, Homo sapiens
tcatcaaaggattgcatgattt

SEQ ID NO: 8204958 - DNA, 22 bp, Homo sapiens
tcatcatctgggcttgggggtg

SEQ ID NO: 8204959 - DNA, 22 bp, Homo sapiens
tcatcatctgcaagctcatgtc

SEQ ID NO: 8204960 - DNA, 22 bp, Homo sapiens
tcatccagagcttcataagtaa

SEQ ID NO: 8204961 - DNA, 22 bp, Homo sapiens
tcatccactggggatcccatgt

SEQ ID NO: 8204962 - DNA, 20 bp, Homo sapiens
tcatggctgctgagaggttc

SEQ ID NO: 8204963 - DNA, 22 bp, Homo sapiens
tcatctctcaggataccagcag

SEQ ID NO: 8204964 - DNA, 22 bp, Homo sapiens
tcatctctcaggataccagcag

SEQ ID NO: 8204965 - DNA, 22 bp, Homo sapiens
tcatctcagggcgacatcatgt

SEQ ID NO: 8204966 - DNA, 22 bp, Homo sapiens
tcatctctagacaggaggctgg

SEQ ID NO: 8204967 - DNA, 22 bp, Homo sapiens
tcatctcctcatgtatctggga

SEQ ID NO: 8204968 - DNA, 22 bp, Homo sapiens
tcatctcaaaattatgctgcac

SEQ ID NO: 8204969 - DNA, 22 bp, Homo sapiens
tcatctcagagaggtatgttag

SEQ ID NO: 8204970 - DNA, 22 bp, Homo sapiens
tcatctaagagtcttacattta

SEQ ID NO: 8204971 - DNA, 22 bp, Homo sapiens
tcatctaagagtcttacattta

SEQ ID NO: 8204972 - DNA, 22 bp, Homo sapiens
tcatctaagagtcttacattta

SEQ ID NO: 8204973 - DNA, 22 bp, Homo sapiens
tcatcctgtatcctcagaccat

SEQ ID NO: 8204974 - DNA, 22 bp, Homo sapiens
tcatcctgtatcctcagaccat

SEQ ID NO: 8204975 - DNA, 22 bp, Homo sapiens
tcatcctggagaagctccttcg

SEQ ID NO: 8204976 - DNA, 22 bp, Homo sapiens
tcatccatctttgatttcatag

SEQ ID NO: 8204977 - DNA, 22 bp, Homo sapiens
tcatccatcctcgcctttgctt

SEQ ID NO: 8204978 - DNA, 22 bp, Homo sapiens
tcatccatctttgatttcatag

SEQ ID NO: 8204979 - DNA, 22 bp, Homo sapiens
tcatccatgaagagtgacagaa

SEQ ID NO: 8204980 - DNA, 22 bp, Homo sapiens
tcatccatatagaaagatgatt

SEQ ID NO: 8204981 - DNA, 22 bp, Homo sapiens
tcatccatagtttggttggact

SEQ ID NO: 8204982 - DNA, 22 bp, Homo sapiens
tcatccatactattgagaggca

SEQ ID NO: 8204983 - DNA, 22 bp, Homo sapiens
tcatccagtatgactggtgtct

SEQ ID NO: 8204984 - DNA, 22 bp, Homo sapiens
tcatccctaaggacagctctgc

SEQ ID NO: 8204985 - DNA, 22 bp, Homo sapiens
tcatcctgcactggctcctcct

SEQ ID NO: 8204986 - DNA, 22 bp, Homo sapiens
tcatccctctgccaggcccagg

SEQ ID NO: 8204987 - DNA, 22 bp, Homo sapiens
tcatcccagtgtccatgctcag

SEQ ID NO: 8204988 - DNA, 22 bp, Homo sapiens
tcatcccagaccacttattttc

SEQ ID NO: 8204989 - DNA, 22 bp, Homo sapiens
tcatccattgtcctcacattag

SEQ ID NO: 8204990 - DNA, 22 bp, Homo sapiens
tcatccattgtcctcacattag

SEQ ID NO: 8204991 - DNA, 22 bp, Homo sapiens
tcatcccagaccacttattttc

SEQ ID NO: 8204992 - DNA, 22 bp, Homo sapiens
tcatccatgtcagagcatgtat

SEQ ID NO: 8204993 - DNA, 22 bp, Homo sapiens
tcatccatgtgcaaactttggt

SEQ ID NO: 8204994 - DNA, 21 bp, Homo sapiens
tcatccatggcttttgtgctt

SEQ ID NO: 8204995 - DNA, 16 bp, Homo sapiens
tcatccatgacagctc

SEQ ID NO: 8204996 - DNA, 22 bp, Homo sapiens
tcagtgcttgcctctggaggag

SEQ ID NO: 8204997 - DNA, 22 bp, Homo sapiens
tcagtgcttgcctctggaggag

SEQ ID NO: 8204998 - DNA, 22 bp, Homo sapiens
tcagtgcttgcctctggaggag

SEQ ID NO: 8204999 - DNA, 22 bp, Homo sapiens
tcagtgcttgacagctctggga

SEQ ID NO: 8205000 - DNA, 22 bp, Homo sapiens
tcagtgcttcggcgagcaccta

SEQ ID NO: 8205001 - DNA, 22 bp, Homo sapiens
tcagtgcttcggcgagcaccta

SEQ ID NO: 8205002 - DNA, 22 bp, Homo sapiens
tcagtgcttgacagctctggga

SEQ ID NO: 8205003 - DNA, 22 bp, Homo sapiens
tcagtgcttatattctgagcct

SEQ ID NO: 8205004 - DNA, 22 bp, Homo sapiens
tcagtgcttatattctgagcct

SEQ ID NO: 8205005 - DNA, 22 bp, Homo sapiens
tcagtgctgtgtaaatgtatta

SEQ ID NO: 8205006 - DNA, 22 bp, Homo sapiens
tcagtgcttcctggaggaagcc

SEQ ID NO: 8205007 - DNA, 22 bp, Homo sapiens
tcagtgcttcctggaggaagcc

SEQ ID NO: 8205008 - DNA, 22 bp, Homo sapiens
tcagtgcttcggcgagcaccta

SEQ ID NO: 8205009 - DNA, 22 bp, Homo sapiens
tcagtgcttgcctctggaggag

SEQ ID NO: 8205010 - DNA, 23 bp, Homo sapiens
tcagtgcttgggggtgacgcgcc

SEQ ID NO: 8205011 - DNA, 22 bp, Homo sapiens
tcagtgcttttgagaagctcct

SEQ ID NO: 8205012 - DNA, 22 bp, Homo sapiens
tcagtgcttttgagaagctcct

SEQ ID NO: 8205013 - DNA, 22 bp, Homo sapiens
tcagtgcttttgagaagctcct

SEQ ID NO: 8205014 - DNA, 22 bp, Homo sapiens
tcagtggaactgtctgggtgag

SEQ ID NO: 8205015 - DNA, 22 bp, Homo sapiens
tcagtgcttttgtcacatggtc

SEQ ID NO: 8205016 - DNA, 22 bp, Homo sapiens
tcagtgcttttgtcacatggtc

SEQ ID NO: 8205017 - DNA, 22 bp, Homo sapiens
tcagtggagagcttccaggatt

SEQ ID NO: 8205018 - DNA, 22 bp, Homo sapiens
tcagtgcttttgtcacatggtc

SEQ ID NO: 8205019 - DNA, 22 bp, Homo sapiens
tcagtggagagcttccaggatt

SEQ ID NO: 8205020 - DNA, 19 bp, Homo sapiens
tcagtggagaaaggggaag

SEQ ID NO: 8205021 - DNA, 22 bp, Homo sapiens
tcagtgcttttgtcacatggtc

SEQ ID NO: 8205022 - DNA, 19 bp, Homo sapiens
tcagtggatgaacatgttt

SEQ ID NO: 8205023 - DNA, 22 bp, Homo sapiens
tcagtggattgacatgaaaaag

SEQ ID NO: 8205024 - DNA, 22 bp, Homo sapiens
tcagtggatatttctgtggctg

SEQ ID NO: 8205025 - DNA, 22 bp, Homo sapiens
tcagtggagtatggatgaagtc

SEQ ID NO: 8205026 - DNA, 22 bp, Homo sapiens
tcagtggagctaagcatgagat

SEQ ID NO: 8205027 - DNA, 22 bp, Homo sapiens
tcagtggattgtagaaggctta

SEQ ID NO: 8205028 - DNA, 22 bp, Homo sapiens
tcagtggattggatgagatctg

SEQ ID NO: 8205029 - DNA, 22 bp, Homo sapiens
tcagtgggaggccattgaatgg

SEQ ID NO: 8205030 - DNA, 22 bp, Homo sapiens
tcagtgggagcaggagagtgac

SEQ ID NO: 8205031 - DNA, 20 bp, Homo sapiens
tcagtgggaaagtgagagtg

SEQ ID NO: 8205032 - DNA, 22 bp, Homo sapiens
tcagtggggtcgatgtgaggga

SEQ ID NO: 8205033 - DNA, 22 bp, Homo sapiens
tcagtggtatgcgtgggagctg

SEQ ID NO: 8205034 - DNA, 22 bp, Homo sapiens
tcagtggtaccaagggggctgg

SEQ ID NO: 8205035 - DNA, 22 bp, Homo sapiens
tcataaaaatagactctaaagt

SEQ ID NO: 8205036 - DNA, 22 bp, Homo sapiens
tcagtttttctatactttgtag

SEQ ID NO: 8205037 - DNA, 22 bp, Homo sapiens
tcagtttttgtttgccagatag

SEQ ID NO: 8205038 - DNA, 22 bp, Homo sapiens
tcagtttttctatactttgtag

SEQ ID NO: 8205039 - DNA, 22 bp, Homo sapiens
tcataaaacacaccaggtagtt

SEQ ID NO: 8205040 - DNA, 19 bp, Homo sapiens
tcataaaaatggtaaccca

SEQ ID NO: 8205041 - DNA, 22 bp, Homo sapiens
tcataaaaatagactctaaagt

SEQ ID NO: 8205042 - DNA, 22 bp, Homo sapiens
tcagtttttaaatgatataatt

SEQ ID NO: 8205043 - DNA, 22 bp, Homo sapiens
tcagtttgaatgttagcacagt

SEQ ID NO: 8205044 - DNA, 23 bp, Homo sapiens
tcagtttgtataatccatatgca

SEQ ID NO: 8205045 - DNA, 22 bp, Homo sapiens
tcagttttaaggtttgagaatt

SEQ ID NO: 8205046 - DNA, 19 bp, Homo sapiens
tcagttttagtcatcagtt

SEQ ID NO: 8205047 - DNA, 22 bp, Homo sapiens
tcagttttcaatttcatcagag

SEQ ID NO: 8205048 - DNA, 22 bp, Homo sapiens
tcagttttcatttcatgagcag

SEQ ID NO: 8205049 - DNA, 22 bp, Homo sapiens
tcagttcctgttgcacagcatc

SEQ ID NO: 8205050 - DNA, 22 bp, Homo sapiens
tcagttcaaacaggtgtctgga

SEQ ID NO: 8205051 - DNA, 22 bp, Homo sapiens
tcagtttctttactcatagaat

SEQ ID NO: 8205052 - DNA, 22 bp, Homo sapiens
tcagtttctttactcatagaat

SEQ ID NO: 8205053 - DNA, 22 bp, Homo sapiens
tcaggtaagtgtaatatataga

SEQ ID NO: 8205054 - DNA, 22 bp, Homo sapiens
tcaggtacttaagactctttag

SEQ ID NO: 8205055 - DNA, 20 bp, Homo sapiens
tcaggtagatctttgaggtc

SEQ ID NO: 8205056 - DNA, 22 bp, Homo sapiens
tcaggtcccactgctagtaagt

SEQ ID NO: 8205057 - DNA, 22 bp, Homo sapiens
tcaggtccagctcctgtgcctc

SEQ ID NO: 8205058 - DNA, 22 bp, Homo sapiens
tcagggggaggagactgccagt

SEQ ID NO: 8205059 - DNA, 19 bp, Homo sapiens
tcagggggctgataggagg

SEQ ID NO: 8205060 - DNA, 22 bp, Homo sapiens
tcagggtcaggacccagctgtt

SEQ ID NO: 8205061 - DNA, 22 bp, Homo sapiens
tcagggtcagattccagagcct

SEQ ID NO: 8205062 - DNA, 22 bp, Homo sapiens
tcagggtatgttctagatctga

SEQ ID NO: 8205063 - DNA, 22 bp, Homo sapiens
tcagggtcagattccagagcct

SEQ ID NO: 8205064 - DNA, 21 bp, Homo sapiens
tcagggttcaaaggaactgat

SEQ ID NO: 8205065 - DNA, 22 bp, Homo sapiens
tcagggtcaggacccagctgtt

SEQ ID NO: 8205066 - DNA, 22 bp, Homo sapiens
tcagggtcaggacccagctgtt

SEQ ID NO: 8205067 - DNA, 22 bp, Homo sapiens
tcaggtcttgagccatcaggat

SEQ ID NO: 8205068 - DNA, 22 bp, Homo sapiens
tcaggtggaattaattaagaga

SEQ ID NO: 8205069 - DNA, 22 bp, Homo sapiens
tcaggtggagacctccttggcc

SEQ ID NO: 8205070 - DNA, 22 bp, Homo sapiens
tcaggtggaattaattaagaga

SEQ ID NO: 8205071 - DNA, 22 bp, Homo sapiens
tcagtgcatcacagaactttgt

SEQ ID NO: 8205072 - DNA, 22 bp, Homo sapiens
tcaggggcttgaggtgcatgtc

SEQ ID NO: 8205073 - DNA, 22 bp, Homo sapiens
tcaggggcttgaggtgcatgtc

SEQ ID NO: 8205074 - DNA, 22 bp, Homo sapiens
tcaggggcttgaggtgcatgtc

SEQ ID NO: 8205075 - DNA, 22 bp, Homo sapiens
tcaggggcccttccctcagcag

SEQ ID NO: 8205076 - DNA, 22 bp, Homo sapiens
tcaggggcagctgtgctttgtg

SEQ ID NO: 8205077 - DNA, 22 bp, Homo sapiens
tcaggggaaatctctcagcgaa

SEQ ID NO: 8205078 - DNA, 22 bp, Homo sapiens
tcagggctgccgggcagaccgt

SEQ ID NO: 8205079 - DNA, 22 bp, Homo sapiens
tcagggctgtggttccttttct

SEQ ID NO: 8205080 - DNA, 22 bp, Homo sapiens
tcagggctggcttttgcagagc

SEQ ID NO: 8205081 - DNA, 21 bp, Homo sapiens
tcagggcagctgctcttcaga

SEQ ID NO: 8205082 - DNA, 22 bp, Homo sapiens
tcagggcagcctaaggcacctc

SEQ ID NO: 8205083 - DNA, 22 bp, Homo sapiens
tcagggcagcctaaggcacctc

SEQ ID NO: 8205084 - DNA, 22 bp, Homo sapiens
tcagggcagaatccaaagaatt

SEQ ID NO: 8205085 - DNA, 16 bp, Homo sapiens
tcagggcagaatggca

SEQ ID NO: 8205086 - DNA, 22 bp, Homo sapiens
tcagggcagcctaaggcacctc

SEQ ID NO: 8205087 - DNA, 16 bp, Homo sapiens
tcagggcagaatggca

SEQ ID NO: 8205088 - DNA, 22 bp, Homo sapiens
tcagggcagaatccaaagaatt

SEQ ID NO: 8205089 - DNA, 22 bp, Homo sapiens
tcagggcagaatccaaagaatt

SEQ ID NO: 8205090 - DNA, 22 bp, Homo sapiens
tcagggcacgtttctgcaatgc

SEQ ID NO: 8205091 - DNA, 22 bp, Homo sapiens
tcagggcacgtttctgcaatgc

SEQ ID NO: 8205092 - DNA, 22 bp, Homo sapiens
tcagggcaccaaaaaagatgcc

SEQ ID NO: 8205093 - DNA, 22 bp, Homo sapiens
tcagggcactgtcacctgatat

SEQ ID NO: 8205094 - DNA, 22 bp, Homo sapiens
tcagggcactgtcacctgatat

SEQ ID NO: 8205095 - DNA, 22 bp, Homo sapiens
tcagggactgttactgcctttg

SEQ ID NO: 8205096 - DNA, 22 bp, Homo sapiens
tcagggacttacaaaccagaag

SEQ ID NO: 8205097 - DNA, 22 bp, Homo sapiens
tcagggagagcctgtctgacgt

SEQ ID NO: 8205098 - DNA, 22 bp, Homo sapiens
tcagggcaaaagggaaaccatt

SEQ ID NO: 8205099 - DNA, 22 bp, Homo sapiens
tcagggcaaaagggaaaccatt

SEQ ID NO: 8205100 - DNA, 22 bp, Homo sapiens
tcagggcaaaagggaaaccatt

SEQ ID NO: 8205101 - DNA, 22 bp, Homo sapiens
tcagggagaggtgagagcctgt

SEQ ID NO: 8205102 - DNA, 22 bp, Homo sapiens
tcaggctgaggtcatctgcatc

SEQ ID NO: 8205103 - DNA, 22 bp, Homo sapiens
tcaggctgagaaaatctggacc

SEQ ID NO: 8205104 - DNA, 22 bp, Homo sapiens
tcaggctgaggtcatctgcatc

SEQ ID NO: 8205105 - DNA, 22 bp, Homo sapiens
tcaggctgaccaggttttgctc

SEQ ID NO: 8205106 - DNA, 22 bp, Homo sapiens
tcaggctgaccaggttttgctc

SEQ ID NO: 8205107 - DNA, 22 bp, Homo sapiens
tcaggctgaccaggttttgctc

SEQ ID NO: 8205108 - DNA, 22 bp, Homo sapiens
tcaggctgagaaaatctggacc

SEQ ID NO: 8205109 - DNA, 22 bp, Homo sapiens
tcagggcacaggcctgtgggtt

SEQ ID NO: 8205110 - DNA, 22 bp, Homo sapiens
tcagggcacattctgcagtggc

SEQ ID NO: 8205111 - DNA, 22 bp, Homo sapiens
tcagggcaatgtccctcagaag

SEQ ID NO: 8205112 - DNA, 22 bp, Homo sapiens
tcagggcacaggcctgtgggtt

SEQ ID NO: 8205113 - DNA, 22 bp, Homo sapiens
tcagggcaatgtccctcagaag

SEQ ID NO: 8205114 - DNA, 22 bp, Homo sapiens
tcagggcaccaaaaaagatgcc

SEQ ID NO: 8205115 - DNA, 22 bp, Homo sapiens
tcagggcaccaaaaaagatgcc

SEQ ID NO: 8205116 - DNA, 22 bp, Homo sapiens
tcagggcacattctgcagtggc

SEQ ID NO: 8205117 - DNA, 22 bp, Homo sapiens
tcagggcaatgtccctcagaag

SEQ ID NO: 8205118 - DNA, 22 bp, Homo sapiens
tcagggcaagtctcagaaggtt

SEQ ID NO: 8205119 - DNA, 22 bp, Homo sapiens
tcagggcaagtctcagaaggtt

SEQ ID NO: 8205120 - DNA, 22 bp, Homo sapiens
tcagggcaagattggttaataa

SEQ ID NO: 8205121 - DNA, 22 bp, Homo sapiens
tcagggcaagattggttaataa

SEQ ID NO: 8205122 - DNA, 22 bp, Homo sapiens
tcagggcaaagggcagagtttg

SEQ ID NO: 8205123 - DNA, 22 bp, Homo sapiens
tcagggcaaagggcagagtttg

SEQ ID NO: 8205124 - DNA, 22 bp, Homo sapiens
tcaggcgaggcttaatccaagg

SEQ ID NO: 8205125 - DNA, 22 bp, Homo sapiens
tcaggctacactcttttcatgg

SEQ ID NO: 8205126 - DNA, 22 bp, Homo sapiens
tcaggctcaggaatgtgtttat

SEQ ID NO: 8205127 - DNA, 22 bp, Homo sapiens
tcaggctcaaagggccggatga

SEQ ID NO: 8205128 - DNA, 22 bp, Homo sapiens
tcaggcctttcttcagagcttc

SEQ ID NO: 8205129 - DNA, 22 bp, Homo sapiens
tcaggcctttcttcagagcttc

SEQ ID NO: 8205130 - DNA, 22 bp, Homo sapiens
tcaggcctttgaacttggagtg

SEQ ID NO: 8205131 - DNA, 22 bp, Homo sapiens
tcaggctcaggttaggggccaa

SEQ ID NO: 8205132 - DNA, 22 bp, Homo sapiens
tcaggctccctgctgggctctg

SEQ ID NO: 8205133 - DNA, 22 bp, Homo sapiens
tcaggctccctgctgggctctg

SEQ ID NO: 8205134 - DNA, 22 bp, Homo sapiens
tcaggctccctgctgggctctg

SEQ ID NO: 8205135 - DNA, 22 bp, Homo sapiens
tcaggctctacacttgacacac

SEQ ID NO: 8205136 - DNA, 22 bp, Homo sapiens
tcaggctctacacttgacacac

SEQ ID NO: 8205137 - DNA, 20 bp, Homo sapiens
tcaggctccgcattaactta

SEQ ID NO: 8205138 - DNA, 18 bp, Homo sapiens
tcaggctctctggctaga

SEQ ID NO: 8205139 - DNA, 18 bp, Homo sapiens
tcaggctctctggctaga

SEQ ID NO: 8205140 - DNA, 22 bp, Homo sapiens
tcaggctctcagaccaacagca

SEQ ID NO: 8205141 - DNA, 22 bp, Homo sapiens
tcaggctgaaaggactccagtt

SEQ ID NO: 8205142 - DNA, 22 bp, Homo sapiens
tcaggctctgggtacacctgac

SEQ ID NO: 8205143 - DNA, 22 bp, Homo sapiens
tcaggctctgggtacacctgac

SEQ ID NO: 8205144 - DNA, 22 bp, Homo sapiens
tcaggctctgggtacacctgac

SEQ ID NO: 8205145 - DNA, 22 bp, Homo sapiens
tcaggctgaaaggactccagtt

SEQ ID NO: 8205146 - DNA, 22 bp, Homo sapiens
tcaggctctgccacctagatta

SEQ ID NO: 8205147 - DNA, 18 bp, Homo sapiens
tcaggctctctggctaga

SEQ ID NO: 8205148 - DNA, 22 bp, Homo sapiens
tcaggctctgagctgatgctaa

SEQ ID NO: 8205149 - DNA, 22 bp, Homo sapiens
tcaggctgaaggaggcctatct

SEQ ID NO: 8205150 - DNA, 22 bp, Homo sapiens
tcaggctgaaggaggcctatct

SEQ ID NO: 8205151 - DNA, 22 bp, Homo sapiens
tcaggctgaaggaggcctatct

SEQ ID NO: 8205152 - DNA, 22 bp, Homo sapiens
tcaggctgaaaggactccagtt

SEQ ID NO: 8205153 - DNA, 22 bp, Homo sapiens
tcaggctgaaggaggcctatct

SEQ ID NO: 8205154 - DNA, 22 bp, Homo sapiens
tcaggctgaaaggactccagtt

SEQ ID NO: 8205155 - DNA, 22 bp, Homo sapiens
tcaggctgaatcatcctagctt

SEQ ID NO: 8205156 - DNA, 22 bp, Homo sapiens
tcaggctgaatcatcctagctt

SEQ ID NO: 8205157 - DNA, 22 bp, Homo sapiens
tcaggctgaatcatcctagctt

SEQ ID NO: 8205158 - DNA, 22 bp, Homo sapiens
tcaggctgaatcatcctagctt

SEQ ID NO: 8205159 - DNA, 22 bp, Homo sapiens
tcagcctcattttctgctctgt

SEQ ID NO: 8205160 - DNA, 22 bp, Homo sapiens
tcagcctcattttctgctctgt

SEQ ID NO: 8205161 - DNA, 22 bp, Homo sapiens
tcagcctcctaatttcctgtga

SEQ ID NO: 8205162 - DNA, 22 bp, Homo sapiens
tcagcctccgaaagtgctggga

SEQ ID NO: 8205163 - DNA, 22 bp, Homo sapiens
tcagcctctctgagtccagacc

SEQ ID NO: 8205164 - DNA, 23 bp, Homo sapiens
tcagcctcttaggacttctcacc

SEQ ID NO: 8205165 - DNA, 22 bp, Homo sapiens
tcagcctcctaatttcctgtga

SEQ ID NO: 8205166 - DNA, 22 bp, Homo sapiens
tcagcctcattttctgctctgt

SEQ ID NO: 8205167 - DNA, 22 bp, Homo sapiens
tcagcctcaggtgttcagattt

SEQ ID NO: 8205168 - DNA, 22 bp, Homo sapiens
tcagcccagcccagcaagtgca

SEQ ID NO: 8205169 - DNA, 18 bp, Homo sapiens
tcagcccagagcccagtt

SEQ ID NO: 8205170 - DNA, 22 bp, Homo sapiens
tcagcccaggaatgagccttct

SEQ ID NO: 8205171 - DNA, 22 bp, Homo sapiens
tcagccagttaaggcttagaca

SEQ ID NO: 8205172 - DNA, 20 bp, Homo sapiens
tcagccattccttacctttc

SEQ ID NO: 8205173 - DNA, 20 bp, Homo sapiens
tcagccattccttacctttc

SEQ ID NO: 8205174 - DNA, 22 bp, Homo sapiens
tcagcccaaccctgcacaagga

SEQ ID NO: 8205175 - DNA, 20 bp, Homo sapiens
tcagccattccttacctttc

SEQ ID NO: 8205176 - DNA, 20 bp, Homo sapiens
tcagccattccttacctttc

SEQ ID NO: 8205177 - DNA, 22 bp, Homo sapiens
tcagccagttgccccagttagt

SEQ ID NO: 8205178 - DNA, 22 bp, Homo sapiens
tcagccagtttgattctatttg

SEQ ID NO: 8205179 - DNA, 22 bp, Homo sapiens
tcagccagtttgtttattccgg

SEQ ID NO: 8205180 - DNA, 22 bp, Homo sapiens
tcagccagtttgattctatttg

SEQ ID NO: 8205181 - DNA, 22 bp, Homo sapiens
tcagccagtgtgcacctggagt

SEQ ID NO: 8205182 - DNA, 22 bp, Homo sapiens
tcagccagtgtgcacctggagt

SEQ ID NO: 8205183 - DNA, 22 bp, Homo sapiens
tcagccagtgtgcacctggagt

SEQ ID NO: 8205184 - DNA, 22 bp, Homo sapiens
tcagccagtgtgcacctggagt

SEQ ID NO: 8205185 - DNA, 22 bp, Homo sapiens
tcagccagttaagtcaagaaat

SEQ ID NO: 8205186 - DNA, 22 bp, Homo sapiens
tcagccagttaaggcttagaca

SEQ ID NO: 8205187 - DNA, 22 bp, Homo sapiens
tcagccagttaaggcttagaca

SEQ ID NO: 8205188 - DNA, 22 bp, Homo sapiens
tcagcttcctctgtggttccag

SEQ ID NO: 8205189 - DNA, 22 bp, Homo sapiens
tcagcttcctctgtggttccag

SEQ ID NO: 8205190 - DNA, 22 bp, Homo sapiens
tcagcttctcaaaatggcttag

SEQ ID NO: 8205191 - DNA, 22 bp, Homo sapiens
tcagcttctcaaaatggcttag

SEQ ID NO: 8205192 - DNA, 22 bp, Homo sapiens
tcagcttccctatctgaccata

SEQ ID NO: 8205193 - DNA, 19 bp, Homo sapiens
tcagcttctgtgtattgta

SEQ ID NO: 8205194 - DNA, 19 bp, Homo sapiens
tcagcttctgtgtattgta

SEQ ID NO: 8205195 - DNA, 22 bp, Homo sapiens
tcagcttctccaagtgacatgg

SEQ ID NO: 8205196 - DNA, 22 bp, Homo sapiens
tcagcttgatccatccaactat

SEQ ID NO: 8205197 - DNA, 22 bp, Homo sapiens
tcagcttgatccatccaactat

SEQ ID NO: 8205198 - DNA, 22 bp, Homo sapiens
tcagcttgcgttctgggattta

SEQ ID NO: 8205199 - DNA, 22 bp, Homo sapiens
tcagcttgtgggtcagcctctg

SEQ ID NO: 8205200 - DNA, 22 bp, Homo sapiens
tcagcttgggggtggcttctca

SEQ ID NO: 8205201 - DNA, 22 bp, Homo sapiens
tcagcttggacagcttggttga

SEQ ID NO: 8205202 - DNA, 22 bp, Homo sapiens
tcagctttcctgcagctaaggg

SEQ ID NO: 8205203 - DNA, 22 bp, Homo sapiens
tcagctttccttgctttagatt

SEQ ID NO: 8205204 - DNA, 22 bp, Homo sapiens
tcagctttctatgttgctaaac

SEQ ID NO: 8205205 - DNA, 22 bp, Homo sapiens
tcagctttctatgttgctaaac

SEQ ID NO: 8205206 - DNA, 23 bp, Homo sapiens
tcagcctcttaggacttctcacc

SEQ ID NO: 8205207 - DNA, 23 bp, Homo sapiens
tcagcctcttaggacttctcacc

SEQ ID NO: 8205208 - DNA, 23 bp, Homo sapiens
tcagcctcttaggacttctcacc

SEQ ID NO: 8205209 - DNA, 23 bp, Homo sapiens
tcagcctcttaggacttctcacc

SEQ ID NO: 8205210 - DNA, 22 bp, Homo sapiens
tcagcctgcgtcatggtgacac

SEQ ID NO: 8205211 - DNA, 22 bp, Homo sapiens
tcagctgtgatccatctatcta

SEQ ID NO: 8205212 - DNA, 22 bp, Homo sapiens
tcagcctgcgtcatggtgacac

SEQ ID NO: 8205213 - DNA, 23 bp, Homo sapiens
tcagcttcattgtcttctatggc

SEQ ID NO: 8205214 - DNA, 23 bp, Homo sapiens
tcagcttcattgtcttctatggc

SEQ ID NO: 8205215 - DNA, 18 bp, Homo sapiens
tcagcttccagcatgttt

SEQ ID NO: 8205216 - DNA, 22 bp, Homo sapiens
tcagcttcagatcagctagaga

SEQ ID NO: 8205217 - DNA, 22 bp, Homo sapiens
tcagcttcagatcagctagaga

SEQ ID NO: 8205218 - DNA, 22 bp, Homo sapiens
tcagccaggccaggcattcaca

SEQ ID NO: 8205219 - DNA, 22 bp, Homo sapiens
tcagccaggccctaagagattg

SEQ ID NO: 8205220 - DNA, 22 bp, Homo sapiens
tcagccaggccctaagagattg

SEQ ID NO: 8205221 - DNA, 22 bp, Homo sapiens
tcagccaggccaggcattcaca

SEQ ID NO: 8205222 - DNA, 22 bp, Homo sapiens
tcagccagggcagagcaggtga

SEQ ID NO: 8205223 - DNA, 22 bp, Homo sapiens
tcagccagggcagagcaggtga

SEQ ID NO: 8205224 - DNA, 22 bp, Homo sapiens
tcagccagggctctggcctcag

SEQ ID NO: 8205225 - DNA, 22 bp, Homo sapiens
tcagccagggctctggcctcag

SEQ ID NO: 8205226 - DNA, 22 bp, Homo sapiens
tcagccagggctctggcctcag

SEQ ID NO: 8205227 - DNA, 22 bp, Homo sapiens
tcagccagtgccttgatcttgc

SEQ ID NO: 8205228 - DNA, 22 bp, Homo sapiens
tcagccagtgccttgatcttgc

SEQ ID NO: 8205229 - DNA, 22 bp, Homo sapiens
tcagccagtgccttgatcttgc

SEQ ID NO: 8205230 - DNA, 22 bp, Homo sapiens
tcagccagtatttgagtgctca

SEQ ID NO: 8205231 - DNA, 22 bp, Homo sapiens
tcagccagtatttgagtgctca

SEQ ID NO: 8205232 - DNA, 22 bp, Homo sapiens
tcagccagggggagagaatgga

SEQ ID NO: 8205233 - DNA, 22 bp, Homo sapiens
tcagccagggggagagaatgga

SEQ ID NO: 8205234 - DNA, 22 bp, Homo sapiens
tcagccagggctctggcctcag

SEQ ID NO: 8205235 - DNA, 22 bp, Homo sapiens
tcagccaggtaatgtggagatg

SEQ ID NO: 8205236 - DNA, 22 bp, Homo sapiens
tcagccaggtaatgtggagatg

SEQ ID NO: 8205237 - DNA, 22 bp, Homo sapiens
tcagagtgaggcccagcaatct

SEQ ID NO: 8205238 - DNA, 22 bp, Homo sapiens
tcagagtgaggcgtcaacatga

SEQ ID NO: 8205239 - DNA, 22 bp, Homo sapiens
tcagagtcctcaccctgaggat

SEQ ID NO: 8205240 - DNA, 21 bp, Homo sapiens
tcagagtctcaggagcaaggg

SEQ ID NO: 8205241 - DNA, 21 bp, Homo sapiens
tcagagtctcaggagcaaggg

SEQ ID NO: 8205242 - DNA, 22 bp, Homo sapiens
tcagagtcaactgttgcctgtt

SEQ ID NO: 8205243 - DNA, 22 bp, Homo sapiens
tcagagtaactacagtatagac

SEQ ID NO: 8205244 - DNA, 22 bp, Homo sapiens
tcagaggttccggccataacca

SEQ ID NO: 8205245 - DNA, 22 bp, Homo sapiens
tcagaggttcttctcagtggcc

SEQ ID NO: 8205246 - DNA, 22 bp, Homo sapiens
tcagaggtggtaaaggacagca

SEQ ID NO: 8205247 - DNA, 22 bp, Homo sapiens
tcagaggttacccatgggacag

SEQ ID NO: 8205248 - DNA, 21 bp, Homo sapiens
tcagagggccctggaggctca

SEQ ID NO: 8205249 - DNA, 22 bp, Homo sapiens
tcagagggtggctgggagcatc

SEQ ID NO: 8205250 - DNA, 22 bp, Homo sapiens
tcagaggcttgaagcccaagcc

SEQ ID NO: 8205251 - DNA, 22 bp, Homo sapiens
tcagaggcttctggccagtctg

SEQ ID NO: 8205252 - DNA, 22 bp, Homo sapiens
tcagaggctggaagagcctcct

SEQ ID NO: 8205253 - DNA, 21 bp, Homo sapiens
tcagaggctgggggaatgccc

SEQ ID NO: 8205254 - DNA, 22 bp, Homo sapiens
tcagaggtaaaaactcactgta

SEQ ID NO: 8205255 - DNA, 18 bp, Homo sapiens
tcagaggtacagaaaagt

SEQ ID NO: 8205256 - DNA, 22 bp, Homo sapiens
tcagaggtaagggctgagagga

SEQ ID NO: 8205257 - DNA, 22 bp, Homo sapiens
tcagaggtagtagcagagttga

SEQ ID NO: 8205258 - DNA, 22 bp, Homo sapiens
tcagaggtcacacagcaagttt

SEQ ID NO: 8205259 - DNA, 22 bp, Homo sapiens
tcagaggtcagcagcttgccca

SEQ ID NO: 8205260 - DNA, 22 bp, Homo sapiens
tcagaggtggcaggggtgtcca

SEQ ID NO: 8205261 - DNA, 22 bp, Homo sapiens
tcagaggtggcaggggtgtcca

SEQ ID NO: 8205262 - DNA, 22 bp, Homo sapiens
tcagaggtggagatagttggga

SEQ ID NO: 8205263 - DNA, 22 bp, Homo sapiens
tcagaggtggcccctgccctca

SEQ ID NO: 8205264 - DNA, 22 bp, Homo sapiens
tcagaggtggtaaaggacagca

SEQ ID NO: 8205265 - DNA, 22 bp, Homo sapiens
tcagaggtggcccctgccctca

SEQ ID NO: 8205266 - DNA, 22 bp, Homo sapiens
tcagaggtgagcttcttgctaa

SEQ ID NO: 8205267 - DNA, 22 bp, Homo sapiens
tcagaggtgagcttcttgctaa

SEQ ID NO: 8205268 - DNA, 22 bp, Homo sapiens
tcagaggtgcaagaagttctga

SEQ ID NO: 8205269 - DNA, 22 bp, Homo sapiens
tcagaggtgagcatgtgaccaa

SEQ ID NO: 8205270 - DNA, 22 bp, Homo sapiens
tcagaggtccctagcaggagtg

SEQ ID NO: 8205271 - DNA, 22 bp, Homo sapiens
tcaggaaagcctagaagagaac

SEQ ID NO: 8205272 - DNA, 22 bp, Homo sapiens
tcagctttctctcgccatcagg

SEQ ID NO: 8205273 - DNA, 22 bp, Homo sapiens
tcagctttctcagaggcctaac

SEQ ID NO: 8205274 - DNA, 22 bp, Homo sapiens
tcagctttctcagaggcctaac

SEQ ID NO: 8205275 - DNA, 22 bp, Homo sapiens
tcagctttctcagaggcctaac

SEQ ID NO: 8205276 - DNA, 22 bp, Homo sapiens
tcagctttctcaaagaagctgg

SEQ ID NO: 8205277 - DNA, 22 bp, Homo sapiens
tcagctttctctcgccatcagg

SEQ ID NO: 8205278 - DNA, 22 bp, Homo sapiens
tcagctttctctcgccatcagg

SEQ ID NO: 8205279 - DNA, 22 bp, Homo sapiens
tcaggagagtgttcagtggagg

SEQ ID NO: 8205280 - DNA, 22 bp, Homo sapiens
tcaggaaatggtgatttggttg

SEQ ID NO: 8205281 - DNA, 22 bp, Homo sapiens
tcaggagcagcatgggtgagag

SEQ ID NO: 8205282 - DNA, 22 bp, Homo sapiens
tcaggagcagccttggagagcg

SEQ ID NO: 8205283 - DNA, 22 bp, Homo sapiens
tcaggagcagcatgggtgagag

SEQ ID NO: 8205284 - DNA, 22 bp, Homo sapiens
tcaggagcaacatctttgaatc

SEQ ID NO: 8205285 - DNA, 22 bp, Homo sapiens
tcaggagatgtaaccttagctg

SEQ ID NO: 8205286 - DNA, 22 bp, Homo sapiens
tcaggagatgtaaccttagctg

SEQ ID NO: 8205287 - DNA, 22 bp, Homo sapiens
tcaggagagtgttcagtggagg

SEQ ID NO: 8205288 - DNA, 22 bp, Homo sapiens
tcaggagatggtctttataggc

SEQ ID NO: 8205289 - DNA, 22 bp, Homo sapiens
tcaggagctcaggctgatggaa

SEQ ID NO: 8205290 - DNA, 22 bp, Homo sapiens
tcaggagctcaggctgatggaa

SEQ ID NO: 8205291 - DNA, 22 bp, Homo sapiens
tcaggagctgcattatcctgtg

SEQ ID NO: 8205292 - DNA, 22 bp, Homo sapiens
tcaggagctcttccctggtgtg

SEQ ID NO: 8205293 - DNA, 22 bp, Homo sapiens
tcaggagctcttccctggtgtg

SEQ ID NO: 8205294 - DNA, 22 bp, Homo sapiens
tcaggagcttagatgctttgac

SEQ ID NO: 8205295 - DNA, 22 bp, Homo sapiens
tcaggagcttagatgctttgac

SEQ ID NO: 8205296 - DNA, 22 bp, Homo sapiens
tcaggagcagggtctgttacca

SEQ ID NO: 8205297 - DNA, 22 bp, Homo sapiens
tcaggagcagggtctgttacca

SEQ ID NO: 8205298 - DNA, 22 bp, Homo sapiens
tcaggagcaggttgtttggttt

SEQ ID NO: 8205299 - DNA, 22 bp, Homo sapiens
tcaggagcctgaaagaggtcta

SEQ ID NO: 8205300 - DNA, 22 bp, Homo sapiens
tcaggagcctgaaagaggtcta

SEQ ID NO: 8205301 - DNA, 22 bp, Homo sapiens
tcaggagcctgaaagaggtcta

SEQ ID NO: 8205302 - DNA, 22 bp, Homo sapiens
tcaggagctatggactgtcaaa

SEQ ID NO: 8205303 - DNA, 20 bp, Homo sapiens
tcaggagcctaggacatgat

SEQ ID NO: 8205304 - DNA, 20 bp, Homo sapiens
tcaggagcctaggacatgat

SEQ ID NO: 8205305 - DNA, 22 bp, Homo sapiens
tcaggagggctaagactgtagc

SEQ ID NO: 8205306 - DNA, 22 bp, Homo sapiens
tcaggagggtgacaggccctgg

SEQ ID NO: 8205307 - DNA, 22 bp, Homo sapiens
tcaggagggtctctattttcct

SEQ ID NO: 8205308 - DNA, 22 bp, Homo sapiens
tcaggagggagtgtggatagag

SEQ ID NO: 8205309 - DNA, 22 bp, Homo sapiens
tcaggagggattgttgcctatt

SEQ ID NO: 8205310 - DNA, 22 bp, Homo sapiens
tcaggagggattgttgcctatt

SEQ ID NO: 8205311 - DNA, 22 bp, Homo sapiens
tcaggagggattgttgcctatt

SEQ ID NO: 8205312 - DNA, 22 bp, Homo sapiens
tcaggagggctaagactgtagc

SEQ ID NO: 8205313 - DNA, 22 bp, Homo sapiens
tcaggaggacagataaggatag

SEQ ID NO: 8205314 - DNA, 22 bp, Homo sapiens
tcaggaggacagataaggatag

SEQ ID NO: 8205315 - DNA, 22 bp, Homo sapiens
tcaggaggagctcataagtttg

SEQ ID NO: 8205316 - DNA, 22 bp, Homo sapiens
tcaggagcttggtagtgtgatt

SEQ ID NO: 8205317 - DNA, 22 bp, Homo sapiens
tcaggagcttggtagtgtgatt

SEQ ID NO: 8205318 - DNA, 22 bp, Homo sapiens
tcaggaggcaagtaggtattga

SEQ ID NO: 8205319 - DNA, 19 bp, Homo sapiens
tcaggaggtcgacctggca

SEQ ID NO: 8205320 - DNA, 22 bp, Homo sapiens
tcaggaggtgtaacgaatacag

SEQ ID NO: 8205321 - DNA, 22 bp, Homo sapiens
tcaggcaccccttgagtagggg

SEQ ID NO: 8205322 - DNA, 22 bp, Homo sapiens
tcaggcaaggcccttagagtgt

SEQ ID NO: 8205323 - DNA, 19 bp, Homo sapiens
tcaggaggtcgacctggca

SEQ ID NO: 8205324 - DNA, 22 bp, Homo sapiens
tcaggaggtccgcccgggaggg

SEQ ID NO: 8205325 - DNA, 22 bp, Homo sapiens
tcaggaggtaggacatactggt

SEQ ID NO: 8205326 - DNA, 22 bp, Homo sapiens
tcaggaggtaaggtaaaacaga

SEQ ID NO: 8205327 - DNA, 22 bp, Homo sapiens
tcaggaggtaggacatactggt

SEQ ID NO: 8205328 - DNA, 22 bp, Homo sapiens
tcaggagggtgacaggccctgg

SEQ ID NO: 8205329 - DNA, 22 bp, Homo sapiens
tcaggcagatgcagggatggat

SEQ ID NO: 8205330 - DNA, 22 bp, Homo sapiens
tcaggcagcattaaacttcagc

SEQ ID NO: 8205331 - DNA, 22 bp, Homo sapiens
tcaggcagagttaatttgctcc

SEQ ID NO: 8205332 - DNA, 22 bp, Homo sapiens
tcaggcagcattaaacttcagc

SEQ ID NO: 8205333 - DNA, 22 bp, Homo sapiens
tcaggcagcattaaacttcagc

SEQ ID NO: 8205334 - DNA, 22 bp, Homo sapiens
tcaggcagctccaggaatggta

SEQ ID NO: 8205335 - DNA, 22 bp, Homo sapiens
tcaggcaggaagcccctgcaca

SEQ ID NO: 8205336 - DNA, 22 bp, Homo sapiens
tcaggcaggaagcccctgcaca

SEQ ID NO: 8205337 - DNA, 23 bp, Homo sapiens
tcaggcagctggggtagttggag

SEQ ID NO: 8205338 - DNA, 22 bp, Homo sapiens
tcaggccttgtcctgacctcct

SEQ ID NO: 8205339 - DNA, 22 bp, Homo sapiens
tcaggcagtagaattgcttgaa

SEQ ID NO: 8205340 - DNA, 22 bp, Homo sapiens
tcaggcaggttggctgcaggtc

SEQ ID NO: 8205341 - DNA, 22 bp, Homo sapiens
tcaggcaggttggctgcaggtc

SEQ ID NO: 8205342 - DNA, 22 bp, Homo sapiens
tcaggcaggtggctggctatgg

SEQ ID NO: 8205343 - DNA, 22 bp, Homo sapiens
tcaggcaggtggctggctatgg

SEQ ID NO: 8205344 - DNA, 21 bp, Homo sapiens
tcaggcaggtcccactgaaca

SEQ ID NO: 8205345 - DNA, 22 bp, Homo sapiens
tcaggcaggctcagaggaaaac

SEQ ID NO: 8205346 - DNA, 22 bp, Homo sapiens
tcaggcaggctcagaggaaaac

SEQ ID NO: 8205347 - DNA, 22 bp, Homo sapiens
tcaggcaggaagggaggacttg

SEQ ID NO: 8205348 - DNA, 22 bp, Homo sapiens
tcaggcaggaagggaggacttg

SEQ ID NO: 8205349 - DNA, 22 bp, Homo sapiens
tcaggcaggaagggaggacttg

SEQ ID NO: 8205350 - DNA, 22 bp, Homo sapiens
tcaggcaggacaattatttagg

SEQ ID NO: 8205351 - DNA, 22 bp, Homo sapiens
tcaggcaggacaattatttagg

SEQ ID NO: 8205352 - DNA, 22 bp, Homo sapiens
tcaggcaggatcccagggaagg

SEQ ID NO: 8205353 - DNA, 21 bp, Homo sapiens
tcaggcaggcgcagagggaag

SEQ ID NO: 8205354 - DNA, 22 bp, Homo sapiens
tcaggcaggcagagggcaaatg

SEQ ID NO: 8205355 - DNA, 21 bp, Homo sapiens
tcaggcaggcgcagagggaag

SEQ ID NO: 8205356 - DNA, 21 bp, Homo sapiens
tccctgtgagcagctcttcct

SEQ ID NO: 8205357 - DNA, 22 bp, Homo sapiens
tccctgtggaagactgccagag

SEQ ID NO: 8205358 - DNA, 22 bp, Homo sapiens
tccctgtggatatctgcagctg

SEQ ID NO: 8205359 - DNA, 20 bp, Homo sapiens
tccctggggccctacttcct

SEQ ID NO: 8205360 - DNA, 20 bp, Homo sapiens
tccctggggccctacttcct

SEQ ID NO: 8205361 - DNA, 20 bp, Homo sapiens
tccctggggccctacttcct

SEQ ID NO: 8205362 - DNA, 22 bp, Homo sapiens
tccctgtctccttgtgtgtcct

SEQ ID NO: 8205363 - DNA, 22 bp, Homo sapiens
tccctgtctaatatgccatgaa

SEQ ID NO: 8205364 - DNA, 22 bp, Homo sapiens
tccctgtcctgggcaatcccag

SEQ ID NO: 8205365 - DNA, 22 bp, Homo sapiens
tccctgggcctcctgctatgca

SEQ ID NO: 8205366 - DNA, 22 bp, Homo sapiens
tccctgggcctatcttagctcc

SEQ ID NO: 8205367 - DNA, 22 bp, Homo sapiens
tccctgggcctatcttagctcc

SEQ ID NO: 8205368 - DNA, 22 bp, Homo sapiens
tccctgggcctatcttagctcc

SEQ ID NO: 8205369 - DNA, 22 bp, Homo sapiens
tccctgggcctatcttagctcc

SEQ ID NO: 8205370 - DNA, 22 bp, Homo sapiens
tccctgggcctatcttagctcc

SEQ ID NO: 8205371 - DNA, 22 bp, Homo sapiens
tccctgggcttctccagacttg

SEQ ID NO: 8205372 - DNA, 22 bp, Homo sapiens
tccctgggcttctccagacttg

SEQ ID NO: 8205373 - DNA, 22 bp, Homo sapiens
tccctgggcttctccagacttg

SEQ ID NO: 8205374 - DNA, 22 bp, Homo sapiens
tccctgggcggacattctccca

SEQ ID NO: 8205375 - DNA, 22 bp, Homo sapiens
tccctgggcggacattctccca

SEQ ID NO: 8205376 - DNA, 22 bp, Homo sapiens
tccctggggaagggcaagcaag

SEQ ID NO: 8205377 - DNA, 22 bp, Homo sapiens
tccctggggaagggcaagcaag

SEQ ID NO: 8205378 - DNA, 22 bp, Homo sapiens
tccctggggaagggcaagcaag

SEQ ID NO: 8205379 - DNA, 22 bp, Homo sapiens
tccctggggatgttggcctgcc

SEQ ID NO: 8205380 - DNA, 22 bp, Homo sapiens
tccctggggcagtggctcggag

SEQ ID NO: 8205381 - DNA, 22 bp, Homo sapiens
tccctggggcagtggctcggag

SEQ ID NO: 8205382 - DNA, 22 bp, Homo sapiens
tccctggggatgttggcctgcc

SEQ ID NO: 8205383 - DNA, 22 bp, Homo sapiens
tccctggggatgttggcctgcc

SEQ ID NO: 8205384 - DNA, 18 bp, Homo sapiens
tcccttctcccttgcctc

SEQ ID NO: 8205385 - DNA, 22 bp, Homo sapiens
tcccttctggcagcagtgtgag

SEQ ID NO: 8205386 - DNA, 22 bp, Homo sapiens
tcccttctggcagcagtgtgag

SEQ ID NO: 8205387 - DNA, 22 bp, Homo sapiens
tcccttctggcagcagtgtgag

SEQ ID NO: 8205388 - DNA, 19 bp, Homo sapiens
tcccttcctgtcgggctcc

SEQ ID NO: 8205389 - DNA, 22 bp, Homo sapiens
tcccttcctcataggcagaagg

SEQ ID NO: 8205390 - DNA, 22 bp, Homo sapiens
tcccttcctcataggcagaagg

SEQ ID NO: 8205391 - DNA, 22 bp, Homo sapiens
tcccttgtgagaacatgtgttg

SEQ ID NO: 8205392 - DNA, 22 bp, Homo sapiens
tcccttgtcctgtgggaagagc

SEQ ID NO: 8205393 - DNA, 22 bp, Homo sapiens
tcccttgtcctcttcgtcactg

SEQ ID NO: 8205394 - DNA, 22 bp, Homo sapiens
tcccttgtcacctcacactatg

SEQ ID NO: 8205395 - DNA, 22 bp, Homo sapiens
tcccttggttaaatatgtagga

SEQ ID NO: 8205396 - DNA, 22 bp, Homo sapiens
tcccttggtaattctgttcctt

SEQ ID NO: 8205397 - DNA, 22 bp, Homo sapiens
tcccttggttaaatatgtagga

SEQ ID NO: 8205398 - DNA, 22 bp, Homo sapiens
tcccttgggagtggtgaccaca

SEQ ID NO: 8205399 - DNA, 21 bp, Homo sapiens
tcccttgggaaactttcttga

SEQ ID NO: 8205400 - DNA, 22 bp, Homo sapiens
tcccttggaaagtagcctcaca

SEQ ID NO: 8205401 - DNA, 22 bp, Homo sapiens
tcccttggaaagtagcctcaca

SEQ ID NO: 8205402 - DNA, 22 bp, Homo sapiens
tcccttctggcagcagtgtgag

SEQ ID NO: 8205403 - DNA, 22 bp, Homo sapiens
tcccttctggcagcagtgtgag

SEQ ID NO: 8205404 - DNA, 22 bp, Homo sapiens
tcccttatctggtattttttag

SEQ ID NO: 8205405 - DNA, 22 bp, Homo sapiens
tcccttcaataattcaacatta

SEQ ID NO: 8205406 - DNA, 22 bp, Homo sapiens
tcccttcatcagtgagcaagcc

SEQ ID NO: 8205407 - DNA, 22 bp, Homo sapiens
tcccttcacagatgcgatgttt

SEQ ID NO: 8205408 - DNA, 23 bp, Homo sapiens
tccctgtgtacagcctgcatgag

SEQ ID NO: 8205409 - DNA, 23 bp, Homo sapiens
tccctgtgtacagcctgcatgag

SEQ ID NO: 8205410 - DNA, 22 bp, Homo sapiens
tccctgtgggcagaggctgcct

SEQ ID NO: 8205411 - DNA, 22 bp, Homo sapiens
tccctgtgggcagaggctgcct

SEQ ID NO: 8205412 - DNA, 22 bp, Homo sapiens
tccctgtgggatgaggactctg

SEQ ID NO: 8205413 - DNA, 22 bp, Homo sapiens
tccctgtggctaagacatgaca

SEQ ID NO: 8205414 - DNA, 23 bp, Homo sapiens
tccctgggcccgtgccagcggtg

SEQ ID NO: 8205415 - DNA, 23 bp, Homo sapiens
tccctgggcccgtgccagcggtg

SEQ ID NO: 8205416 - DNA, 23 bp, Homo sapiens
tccctgggcccgtgccagcggtg

SEQ ID NO: 8205417 - DNA, 22 bp, Homo sapiens
tccctgggccacagctgtgagc

SEQ ID NO: 8205418 - DNA, 22 bp, Homo sapiens
tccctgggcacaatctgctggc

SEQ ID NO: 8205419 - DNA, 22 bp, Homo sapiens
tccctgggcacaatctgctggc

SEQ ID NO: 8205420 - DNA, 22 bp, Homo sapiens
tccctgggcacaatctgctggc

SEQ ID NO: 8205421 - DNA, 22 bp, Homo sapiens
tccctgggcatcacgttgcttc

SEQ ID NO: 8205422 - DNA, 22 bp, Homo sapiens
tccctgggcatcacgttgcttc

SEQ ID NO: 8205423 - DNA, 22 bp, Homo sapiens
tccctgggcatcacgttgcttc

SEQ ID NO: 8205424 - DNA, 22 bp, Homo sapiens
tccctgccctcagtgcacccgg

SEQ ID NO: 8205425 - DNA, 22 bp, Homo sapiens
tccctgccctcagtgcacccgg

SEQ ID NO: 8205426 - DNA, 22 bp, Homo sapiens
tccctgccctcagtgcacccgg

SEQ ID NO: 8205427 - DNA, 22 bp, Homo sapiens
tccctgggcaagtttactcttc

SEQ ID NO: 8205428 - DNA, 22 bp, Homo sapiens
tccctgccaatgattggagcaa

SEQ ID NO: 8205429 - DNA, 22 bp, Homo sapiens
tccctgccagtcctggtctgaa

SEQ ID NO: 8205430 - DNA, 22 bp, Homo sapiens
tccctgccagtcctggtctgaa

SEQ ID NO: 8205431 - DNA, 22 bp, Homo sapiens
tccctgcacccttgctgggccc

SEQ ID NO: 8205432 - DNA, 22 bp, Homo sapiens
tccctgcagacgtcctgcgggt

SEQ ID NO: 8205433 - DNA, 22 bp, Homo sapiens
tccctgcagacgtcctgcgggt

SEQ ID NO: 8205434 - DNA, 22 bp, Homo sapiens
tccctgcacagccgagccatgc

SEQ ID NO: 8205435 - DNA, 22 bp, Homo sapiens
tccctgcacagccgagccatgc

SEQ ID NO: 8205436 - DNA, 22 bp, Homo sapiens
tccctgcacagccgagccatgc

SEQ ID NO: 8205437 - DNA, 21 bp, Homo sapiens
tccctgagttctctgagcatc

SEQ ID NO: 8205438 - DNA, 21 bp, Homo sapiens
tccctgagttctctgagcatc

SEQ ID NO: 8205439 - DNA, 22 bp, Homo sapiens
tccctgagttttctttctgact

SEQ ID NO: 8205440 - DNA, 22 bp, Homo sapiens
tccctgatgccttgatccgtgg

SEQ ID NO: 8205441 - DNA, 22 bp, Homo sapiens
tccctgcagtaggcagccctcc

SEQ ID NO: 8205442 - DNA, 22 bp, Homo sapiens
tccctgcagcccctgagccttc

SEQ ID NO: 8205443 - DNA, 22 bp, Homo sapiens
tccctgcaggtggggtggccag

SEQ ID NO: 8205444 - DNA, 22 bp, Homo sapiens
tccctgcagctgtaggccggcg

SEQ ID NO: 8205445 - DNA, 22 bp, Homo sapiens
tccctgcagcccctgagccttc

SEQ ID NO: 8205446 - DNA, 22 bp, Homo sapiens
tccctgcagcccctgagccttc

SEQ ID NO: 8205447 - DNA, 23 bp, Homo sapiens
tccctgagatgctgctctgtccc

SEQ ID NO: 8205448 - DNA, 21 bp, Homo sapiens
tccctgagcccaaggggctcc

SEQ ID NO: 8205449 - DNA, 22 bp, Homo sapiens
tcccaggcagcttctttcatca

SEQ ID NO: 8205450 - DNA, 22 bp, Homo sapiens
tccctgagagcactggggagcc

SEQ ID NO: 8205451 - DNA, 19 bp, Homo sapiens
tcccaggcaaaggcttctc

SEQ ID NO: 8205452 - DNA, 19 bp, Homo sapiens
tcccaggcaaaggcttctc

SEQ ID NO: 8205453 - DNA, 19 bp, Homo sapiens
tcccaggcaaaggcttctc

SEQ ID NO: 8205454 - DNA, 22 bp, Homo sapiens
tcccaggatgtttatggctggt

SEQ ID NO: 8205455 - DNA, 22 bp, Homo sapiens
tcccaggatgtttatggctggt

SEQ ID NO: 8205456 - DNA, 22 bp, Homo sapiens
tcccaggattttaggctctcag

SEQ ID NO: 8205457 - DNA, 22 bp, Homo sapiens
tcccaggattttaggctctcag

SEQ ID NO: 8205458 - DNA, 22 bp, Homo sapiens
tcccaggcaaaggcagctcatt

SEQ ID NO: 8205459 - DNA, 22 bp, Homo sapiens
tcccaggcaaaggcagctcatt

SEQ ID NO: 8205460 - DNA, 22 bp, Homo sapiens
tcccaggcaaaggcagctcatt

SEQ ID NO: 8205461 - DNA, 22 bp, Homo sapiens
tccctgagctgagctcaacagc

SEQ ID NO: 8205462 - DNA, 22 bp, Homo sapiens
tccctgagctcacatggcagga

SEQ ID NO: 8205463 - DNA, 22 bp, Homo sapiens
tccctgagcttcatcaggcttt

SEQ ID NO: 8205464 - DNA, 23 bp, Homo sapiens
tccctgagctggagagactgcac

SEQ ID NO: 8205465 - DNA, 22 bp, Homo sapiens
tccctgagcttcatcaggcttt

SEQ ID NO: 8205466 - DNA, 22 bp, Homo sapiens
tccctgagcttctctgaaatgg

SEQ ID NO: 8205467 - DNA, 22 bp, Homo sapiens
tccctgagggcagctcaagtcc

SEQ ID NO: 8205468 - DNA, 22 bp, Homo sapiens
tccctgaggatggttgtattta

SEQ ID NO: 8205469 - DNA, 22 bp, Homo sapiens
tccctgaggatgaggctgatca

SEQ ID NO: 8205470 - DNA, 22 bp, Homo sapiens
tccctgaggaaggggtgtggtg

SEQ ID NO: 8205471 - DNA, 19 bp, Homo sapiens
tccctgagttccagcccag

SEQ ID NO: 8205472 - DNA, 22 bp, Homo sapiens
tccctgagtgtatgtggtgaac

SEQ ID NO: 8205473 - DNA, 22 bp, Homo sapiens
tccctgagtgggctggtagtat

SEQ ID NO: 8205474 - DNA, 16 bp, Homo sapiens
tccctgaggttttgga

SEQ ID NO: 8205475 - DNA, 22 bp, Homo sapiens
tcctcatctcggaacctgccac

SEQ ID NO: 8205476 - DNA, 22 bp, Homo sapiens
tcctcagtggggcattcattat

SEQ ID NO: 8205477 - DNA, 23 bp, Homo sapiens
tcctcagtatataaaggcagatg

SEQ ID NO: 8205478 - DNA, 22 bp, Homo sapiens
tccggtccgggtactcctctct

SEQ ID NO: 8205479 - DNA, 22 bp, Homo sapiens
tccggtccgggtactcctctct

SEQ ID NO: 8205480 - DNA, 22 bp, Homo sapiens
tccgggttttacactcacatca

SEQ ID NO: 8205481 - DNA, 22 bp, Homo sapiens
tccgaggcgcaccggcgctcct

SEQ ID NO: 8205482 - DNA, 22 bp, Homo sapiens
tccgataagcaattcttgtgct

SEQ ID NO: 8205483 - DNA, 22 bp, Homo sapiens
tccgagaagcataaagcaggaa

SEQ ID NO: 8205484 - DNA, 22 bp, Homo sapiens
tccgaggccaaagctgtgaata

SEQ ID NO: 8205485 - DNA, 22 bp, Homo sapiens
tccgctggagagggggctgcca

SEQ ID NO: 8205486 - DNA, 22 bp, Homo sapiens
tccgcccgcacgtatggagtgg

SEQ ID NO: 8205487 - DNA, 22 bp, Homo sapiens
tccgcccgcacgtatggagtgg

SEQ ID NO: 8205488 - DNA, 22 bp, Homo sapiens
tccgcgctctcacccgctcccg

SEQ ID NO: 8205489 - DNA, 22 bp, Homo sapiens
tccgggcaactgaagggaggtt

SEQ ID NO: 8205490 - DNA, 22 bp, Homo sapiens
tccgggcaactgaagggaggtt

SEQ ID NO: 8205491 - DNA, 22 bp, Homo sapiens
tcctccactttgtctagcaaca

SEQ ID NO: 8205492 - DNA, 22 bp, Homo sapiens
tcctccagaaactgaggcagaa

SEQ ID NO: 8205493 - DNA, 22 bp, Homo sapiens
tcctccacgatggcacacctgg

SEQ ID NO: 8205494 - DNA, 22 bp, Homo sapiens
tcctccacgatggcacacctgg

SEQ ID NO: 8205495 - DNA, 22 bp, Homo sapiens
tcctccacgtgagggcatacag

SEQ ID NO: 8205496 - DNA, 22 bp, Homo sapiens
tcctccactttgtctagcaaca

SEQ ID NO: 8205497 - DNA, 22 bp, Homo sapiens
tcctccagaaactgaggcagaa

SEQ ID NO: 8205498 - DNA, 20 bp, Homo sapiens
tcctccagaagggcagggtg

SEQ ID NO: 8205499 - DNA, 22 bp, Homo sapiens
tcctccagaaactgaggcagaa

SEQ ID NO: 8205500 - DNA, 22 bp, Homo sapiens
tcctcatctttcaggatttagc

SEQ ID NO: 8205501 - DNA, 20 bp, Homo sapiens
tcctccaaccagctgctaat

SEQ ID NO: 8205502 - DNA, 23 bp, Homo sapiens
tcctccaaccagcagctgcataa

SEQ ID NO: 8205503 - DNA, 23 bp, Homo sapiens
tcctccaatctcatggcccttaa

SEQ ID NO: 8205504 - DNA, 22 bp, Homo sapiens
tcctccacactctggactgttg

SEQ ID NO: 8205505 - DNA, 22 bp, Homo sapiens
tcctccacgatggcacacctgg

SEQ ID NO: 8205506 - DNA, 22 bp, Homo sapiens
tcctccaaggcagggggagaga

SEQ ID NO: 8205507 - DNA, 22 bp, Homo sapiens
tcctccaaggcagggggagaga

SEQ ID NO: 8205508 - DNA, 22 bp, Homo sapiens
tcctccaagcctttgtgaagtg

SEQ ID NO: 8205509 - DNA, 22 bp, Homo sapiens
tcctccaagcgtgggtgtttga

SEQ ID NO: 8205510 - DNA, 22 bp, Homo sapiens
tcctccaagcagaggccctgaa

SEQ ID NO: 8205511 - DNA, 22 bp, Homo sapiens
tcctccaagcctttgtgaagtg

SEQ ID NO: 8205512 - DNA, 22 bp, Homo sapiens
tcctccagctgtatcctgcctg

SEQ ID NO: 8205513 - DNA, 22 bp, Homo sapiens
tcctccagcttctcttttgggg

SEQ ID NO: 8205514 - DNA, 22 bp, Homo sapiens
tcctccaggcacctcactggct

SEQ ID NO: 8205515 - DNA, 22 bp, Homo sapiens
tcctccaggcacctcactggct

SEQ ID NO: 8205516 - DNA, 23 bp, Homo sapiens
tcctccagaggccctccttggcc

SEQ ID NO: 8205517 - DNA, 23 bp, Homo sapiens
tcctccagaggccctccttggcc

SEQ ID NO: 8205518 - DNA, 22 bp, Homo sapiens
tcctccagcaggactgaggccc

SEQ ID NO: 8205519 - DNA, 22 bp, Homo sapiens
tcctccctgggagcttctgagt

SEQ ID NO: 8205520 - DNA, 22 bp, Homo sapiens
tcctccctgggagcttctgagt

SEQ ID NO: 8205521 - DNA, 22 bp, Homo sapiens
tcctccctgtaccattcctctg

SEQ ID NO: 8205522 - DNA, 22 bp, Homo sapiens
tcctccaggtctagggtggctt

SEQ ID NO: 8205523 - DNA, 22 bp, Homo sapiens
tcctccaggtctagggtggctt

SEQ ID NO: 8205524 - DNA, 22 bp, Homo sapiens
tcctccaggtctagggtggctt

SEQ ID NO: 8205525 - DNA, 22 bp, Homo sapiens
tcctccagtggcccagtccttc

SEQ ID NO: 8205526 - DNA, 22 bp, Homo sapiens
tcctccagtggtactggccaat

SEQ ID NO: 8205527 - DNA, 22 bp, Homo sapiens
tcctccagtggcccagtccttc

SEQ ID NO: 8205528 - DNA, 22 bp, Homo sapiens
tcctccagtgtctggggccttg

SEQ ID NO: 8205529 - DNA, 22 bp, Homo sapiens
tcctccagtggtactggccaat

SEQ ID NO: 8205530 - DNA, 22 bp, Homo sapiens
tcctcccctcagggcaacggat

SEQ ID NO: 8205531 - DNA, 22 bp, Homo sapiens
tcctcccctgcccatgaggagg

SEQ ID NO: 8205532 - DNA, 22 bp, Homo sapiens
tcctcccctgcccatgaggagg

SEQ ID NO: 8205533 - DNA, 22 bp, Homo sapiens
tcctcctcctcacagtcacctg

SEQ ID NO: 8205534 - DNA, 22 bp, Homo sapiens
tcctcctcacgctgttgcttgt

SEQ ID NO: 8205535 - DNA, 22 bp, Homo sapiens
tcctcctcctcacagtcacctg

SEQ ID NO: 8205536 - DNA, 22 bp, Homo sapiens
tcctcctctatcagacagtgcc

SEQ ID NO: 8205537 - DNA, 23 bp, Homo sapiens
tcctcctgacacagcctgagtga

SEQ ID NO: 8205538 - DNA, 23 bp, Homo sapiens
tcctcctgacacagcctgagtga

SEQ ID NO: 8205539 - DNA, 23 bp, Homo sapiens
tcctcctgacacagcctgagtga

SEQ ID NO: 8205540 - DNA, 23 bp, Homo sapiens
tcctcctgacacagcctgagtga

SEQ ID NO: 8205541 - DNA, 23 bp, Homo sapiens
tcctcctgacacagcctgagtga

SEQ ID NO: 8205542 - DNA, 21 bp, Homo sapiens
tcctcctggccaggcggcccc

SEQ ID NO: 8205543 - DNA, 23 bp, Homo sapiens
tcctcctggatacaaagggaaca

SEQ ID NO: 8205544 - DNA, 22 bp, Homo sapiens
tcctcctgcctttgcttcttgt

SEQ ID NO: 8205545 - DNA, 22 bp, Homo sapiens
tcctcctgctgttagtcttgaa

SEQ ID NO: 8205546 - DNA, 22 bp, Homo sapiens
tcctcctgctgttagtcttgaa

SEQ ID NO: 8205547 - DNA, 23 bp, Homo sapiens
tcctcctgagtgagagtgccagc

SEQ ID NO: 8205548 - DNA, 23 bp, Homo sapiens
tcctcctgagtgagagtgccagc

SEQ ID NO: 8205549 - DNA, 23 bp, Homo sapiens
tcctcctgagtgagagtgccagc

SEQ ID NO: 8205550 - DNA, 23 bp, Homo sapiens
tcctcctgagtgagagtgccagc

SEQ ID NO: 8205551 - DNA, 22 bp, Homo sapiens
tcctcctgcctttgcttcttgt

SEQ ID NO: 8205552 - DNA, 22 bp, Homo sapiens
tcctcctgcctttgcttcttgt

SEQ ID NO: 8205553 - DNA, 23 bp, Homo sapiens
tcctcctgagtgagagtgccagc

SEQ ID NO: 8205554 - DNA, 21 bp, Homo sapiens
tcctcctggccaggcggcccc

SEQ ID NO: 8205555 - DNA, 22 bp, Homo sapiens
tccaccagcttcttcaccagct

SEQ ID NO: 8205556 - DNA, 22 bp, Homo sapiens
tccaccagccaggcccaggctg

SEQ ID NO: 8205557 - DNA, 20 bp, Homo sapiens
tccaccaggaagggtaggga

SEQ ID NO: 8205558 - DNA, 22 bp, Homo sapiens
tccaccaggctccatgttcagt

SEQ ID NO: 8205559 - DNA, 22 bp, Homo sapiens
tccaccagcagcctgtcagcct

SEQ ID NO: 8205560 - DNA, 22 bp, Homo sapiens
tccaccagagccttcccatgct

SEQ ID NO: 8205561 - DNA, 22 bp, Homo sapiens
tccaccacttcctgcagccatt

SEQ ID NO: 8205562 - DNA, 22 bp, Homo sapiens
tccaccatgtaacaagctctgt

SEQ ID NO: 8205563 - DNA, 22 bp, Homo sapiens
tccaccatgtaacaagctctgt

SEQ ID NO: 8205564 - DNA, 22 bp, Homo sapiens
tccaccatgtaacaagctctgt

SEQ ID NO: 8205565 - DNA, 19 bp, Homo sapiens
tccaccccagccagctctg

SEQ ID NO: 8205566 - DNA, 23 bp, Homo sapiens
tccaccccagctgaggcttagcc

SEQ ID NO: 8205567 - DNA, 23 bp, Homo sapiens
tccaccccagctgaggcttagcc

SEQ ID NO: 8205568 - DNA, 23 bp, Homo sapiens
tccaccccagctgaggcttagcc

SEQ ID NO: 8205569 - DNA, 22 bp, Homo sapiens
tccacccctgggaatgtcaata

SEQ ID NO: 8205570 - DNA, 22 bp, Homo sapiens
tccactcaaggccattgcacat

SEQ ID NO: 8205571 - DNA, 22 bp, Homo sapiens
tccactcatgagatctggctga

SEQ ID NO: 8205572 - DNA, 22 bp, Homo sapiens
tccactctaattactaccttct

SEQ ID NO: 8205573 - DNA, 22 bp, Homo sapiens
tccactgacaggtgaatggata

SEQ ID NO: 8205574 - DNA, 22 bp, Homo sapiens
tccacgttttcaacacagccaa

SEQ ID NO: 8205575 - DNA, 22 bp, Homo sapiens
tccacgtgagcttcgtgtgcag

SEQ ID NO: 8205576 - DNA, 19 bp, Homo sapiens
tccacctttcttcatttgg

SEQ ID NO: 8205577 - DNA, 22 bp, Homo sapiens
tccacctccatgctgggcagag

SEQ ID NO: 8205578 - DNA, 22 bp, Homo sapiens
tccacctgagtttcagttattt

SEQ ID NO: 8205579 - DNA, 22 bp, Homo sapiens
tccaccctgctttcttatctcc

SEQ ID NO: 8205580 - DNA, 22 bp, Homo sapiens
tccacctagcattcacctccta

SEQ ID NO: 8205581 - DNA, 21 bp, Homo sapiens
tccaccctctctgctcccagt

SEQ ID NO: 8205582 - DNA, 22 bp, Homo sapiens
tccactggcccacctcctcagt

SEQ ID NO: 8205583 - DNA, 22 bp, Homo sapiens
tccactgcagcttctgatggaa

SEQ ID NO: 8205584 - DNA, 22 bp, Homo sapiens
tccactggtaatacctagatcc

SEQ ID NO: 8205585 - DNA, 22 bp, Homo sapiens
tccactggcctctgtctttcag

SEQ ID NO: 8205586 - DNA, 22 bp, Homo sapiens
tccacttgccctcttctgtgct

SEQ ID NO: 8205587 - DNA, 20 bp, Homo sapiens
tccacttactagctctgtga

SEQ ID NO: 8205588 - DNA, 22 bp, Homo sapiens
tccacttcatccagggtcacca

SEQ ID NO: 8205589 - DNA, 22 bp, Homo sapiens
tccactttagcaatgattgaat

SEQ ID NO: 8205590 - DNA, 22 bp, Homo sapiens
tccactttagcaatgattgaat

SEQ ID NO: 8205591 - DNA, 22 bp, Homo sapiens
tccagaaaaagtaatttatttg

SEQ ID NO: 8205592 - DNA, 22 bp, Homo sapiens
tccagaaaattcagaaattgtt

SEQ ID NO: 8205593 - DNA, 22 bp, Homo sapiens
tccagaaaattttacagtgcct

SEQ ID NO: 8205594 - DNA, 22 bp, Homo sapiens
tcatgtttctcttacagcagct

SEQ ID NO: 8205595 - DNA, 22 bp, Homo sapiens
tcatgtttctcttacagcagct

SEQ ID NO: 8205596 - DNA, 22 bp, Homo sapiens
tcatgttattgactcataatat

SEQ ID NO: 8205597 - DNA, 22 bp, Homo sapiens
tcatgtttgccctaagaaaaag

SEQ ID NO: 8205598 - DNA, 22 bp, Homo sapiens
tcatgtttggagtttgctcact

SEQ ID NO: 8205599 - DNA, 22 bp, Homo sapiens
tcatgtttgccctaagaaaaag

SEQ ID NO: 8205600 - DNA, 22 bp, Homo sapiens
tcatgtttgttggaaatgtggc

SEQ ID NO: 8205601 - DNA, 22 bp, Homo sapiens
tcatgtttgttggaaatgtggc

SEQ ID NO: 8205602 - DNA, 22 bp, Homo sapiens
tcatgtttttgccatatgactc

SEQ ID NO: 8205603 - DNA, 22 bp, Homo sapiens
tcatgtttttgccatatgactc

SEQ ID NO: 8205604 - DNA, 22 bp, Homo sapiens
tcatgttttagctgcaaaatga

SEQ ID NO: 8205605 - DNA, 22 bp, Homo sapiens
tcatgttttagctgcaaaatga

SEQ ID NO: 8205606 - DNA, 22 bp, Homo sapiens
tcatgttttagtaaagtgaagg

SEQ ID NO: 8205607 - DNA, 22 bp, Homo sapiens
tcatgtgtctgccagtgtttat

SEQ ID NO: 8205608 - DNA, 22 bp, Homo sapiens
tcatgtgtcctagttcatataa

SEQ ID NO: 8205609 - DNA, 22 bp, Homo sapiens
tcatgtgtcctagttcatataa

SEQ ID NO: 8205610 - DNA, 21 bp, Homo sapiens
tcatgtgtaacttttgaccac

SEQ ID NO: 8205611 - DNA, 22 bp, Homo sapiens
tcatggcttcaaggaagcaggc

SEQ ID NO: 8205612 - DNA, 22 bp, Homo sapiens
tcatgtgtctgctgcagctgtt

SEQ ID NO: 8205613 - DNA, 20 bp, Homo sapiens
tcatgtgtgtcctacagaga

SEQ ID NO: 8205614 - DNA, 20 bp, Homo sapiens
tcatgtgtgtcctacagaga

SEQ ID NO: 8205615 - DNA, 22 bp, Homo sapiens
tcatgtgtgtttcatgtatgga

SEQ ID NO: 8205616 - DNA, 22 bp, Homo sapiens
tcatgtgtgtttcatgtatgga

SEQ ID NO: 8205617 - DNA, 20 bp, Homo sapiens
tcatgtgtgtcctacagaga

SEQ ID NO: 8205618 - DNA, 22 bp, Homo sapiens
tcatgtgttgcactgaggacct

SEQ ID NO: 8205619 - DNA, 22 bp, Homo sapiens
tcatgtgttaaactccaagata

SEQ ID NO: 8205620 - DNA, 22 bp, Homo sapiens
tcatgtgtgtttcatgtatgga

SEQ ID NO: 8205621 - DNA, 22 bp, Homo sapiens
tcatgttattgactcataatat

SEQ ID NO: 8205622 - DNA, 22 bp, Homo sapiens
tcattacaagatttccaatttg

SEQ ID NO: 8205623 - DNA, 22 bp, Homo sapiens
tccacacacatttctatgtgca

SEQ ID NO: 8205624 - DNA, 22 bp, Homo sapiens
tccacacacatttctatgtgca

SEQ ID NO: 8205625 - DNA, 22 bp, Homo sapiens
tcattaaaatgcagattctgac

SEQ ID NO: 8205626 - DNA, 22 bp, Homo sapiens
tcattaaatgtttgttgtgcca

SEQ ID NO: 8205627 - DNA, 22 bp, Homo sapiens
tcattaaaatgcagattctgac

SEQ ID NO: 8205628 - DNA, 22 bp, Homo sapiens
tcattaataagtctaactctcc

SEQ ID NO: 8205629 - DNA, 22 bp, Homo sapiens
tccacacacatttctatgtgca

SEQ ID NO: 8205630 - DNA, 22 bp, Homo sapiens
tccacacacatttctatgtgca

SEQ ID NO: 8205631 - DNA, 22 bp, Homo sapiens
tccacagaatgtaagatccaca

SEQ ID NO: 8205632 - DNA, 22 bp, Homo sapiens
tccacagaatgtaagatccaca

SEQ ID NO: 8205633 - DNA, 22 bp, Homo sapiens
tccacagaccagtatctgcagc

SEQ ID NO: 8205634 - DNA, 22 bp, Homo sapiens
tccacagcacaaagccagtgtg

SEQ ID NO: 8205635 - DNA, 22 bp, Homo sapiens
tccacagcacaaagccagtgtg

SEQ ID NO: 8205636 - DNA, 22 bp, Homo sapiens
tccacagcacaaagccagtgtg

SEQ ID NO: 8205637 - DNA, 22 bp, Homo sapiens
tccacagcattattagaaggat

SEQ ID NO: 8205638 - DNA, 22 bp, Homo sapiens
tccacaggcaagtctcttggca

SEQ ID NO: 8205639 - DNA, 22 bp, Homo sapiens
tccacagggatgcctgcggctt

SEQ ID NO: 8205640 - DNA, 22 bp, Homo sapiens
tccacagggatgcctgcggctt

SEQ ID NO: 8205641 - DNA, 22 bp, Homo sapiens
tccacagggatgttgagttctt

SEQ ID NO: 8205642 - DNA, 22 bp, Homo sapiens
tccacaggaaagcacctcccat

SEQ ID NO: 8205643 - DNA, 22 bp, Homo sapiens
tccacaggaaagcacctcccat

SEQ ID NO: 8205644 - DNA, 22 bp, Homo sapiens
tccacaggctgaggcccttctg

SEQ ID NO: 8205645 - DNA, 22 bp, Homo sapiens
tccacaggctgaggcccttctg

SEQ ID NO: 8205646 - DNA, 22 bp, Homo sapiens
tccagccttctcaaggctggct

SEQ ID NO: 8205647 - DNA, 22 bp, Homo sapiens
tccagccttctcaaggctggct

SEQ ID NO: 8205648 - DNA, 22 bp, Homo sapiens
tccagccttctcaaggctggct

SEQ ID NO: 8205649 - DNA, 22 bp, Homo sapiens
tccagccttgccacttttctgt

SEQ ID NO: 8205650 - DNA, 21 bp, Homo sapiens
tccagcctttccctcacttcc

SEQ ID NO: 8205651 - DNA, 22 bp, Homo sapiens
tccaggaacgagaggctgggca

SEQ ID NO: 8205652 - DNA, 22 bp, Homo sapiens
tccaggaactgaagccaggtgt

SEQ ID NO: 8205653 - DNA, 22 bp, Homo sapiens
tccaggaactcttgatggtgat

SEQ ID NO: 8205654 - DNA, 22 bp, Homo sapiens
tccaggaatctgtgcctagccc

SEQ ID NO: 8205655 - DNA, 22 bp, Homo sapiens
tccaggaatagatcagagattt

SEQ ID NO: 8205656 - DNA, 22 bp, Homo sapiens
tccaggaagccacactgggcct

SEQ ID NO: 8205657 - DNA, 22 bp, Homo sapiens
tccaggaagccacactgggcct

SEQ ID NO: 8205658 - DNA, 20 bp, Homo sapiens
tccagccctgcttctctctt

SEQ ID NO: 8205659 - DNA, 22 bp, Homo sapiens
tccagccctgtggcttccaccc

SEQ ID NO: 8205660 - DNA, 20 bp, Homo sapiens
tccagccctgcttctctctt

SEQ ID NO: 8205661 - DNA, 22 bp, Homo sapiens
tccagcctgaactttgtccaga

SEQ ID NO: 8205662 - DNA, 23 bp, Homo sapiens
tccagcctcttgctctcacatgc

SEQ ID NO: 8205663 - DNA, 22 bp, Homo sapiens
tccagcctgaactttgtccaga

SEQ ID NO: 8205664 - DNA, 19 bp, Homo sapiens
tccagcctgctgtttctct

SEQ ID NO: 8205665 - DNA, 19 bp, Homo sapiens
tccagcctgctgtttctct

SEQ ID NO: 8205666 - DNA, 22 bp, Homo sapiens
tccagccttctcaaggctggct

SEQ ID NO: 8205667 - DNA, 22 bp, Homo sapiens
tccagccttccttttcactctc

SEQ ID NO: 8205668 - DNA, 22 bp, Homo sapiens
tccagcctggttgcgggcatcc

SEQ ID NO: 8205669 - DNA, 22 bp, Homo sapiens
tccagccttctcaaggctggct

SEQ ID NO: 8205670 - DNA, 22 bp, Homo sapiens
tccagccttctcaaggctggct

SEQ ID NO: 8205671 - DNA, 22 bp, Homo sapiens
tccaggagcatccaggtgaagc

SEQ ID NO: 8205672 - DNA, 20 bp, Homo sapiens
tccaggagaactgggagccg

SEQ ID NO: 8205673 - DNA, 20 bp, Homo sapiens
tccaggagaactgggagccg

SEQ ID NO: 8205674 - DNA, 22 bp, Homo sapiens
tccaggaggaggaaggctgcca

SEQ ID NO: 8205675 - DNA, 22 bp, Homo sapiens
tccaggaggaggaaggctgcca

SEQ ID NO: 8205676 - DNA, 22 bp, Homo sapiens
tccaggaggactgagggggctg

SEQ ID NO: 8205677 - DNA, 22 bp, Homo sapiens
tccaggaggactgagggggctg

SEQ ID NO: 8205678 - DNA, 23 bp, Homo sapiens
tccaggagcatgctggctggcga

SEQ ID NO: 8205679 - DNA, 23 bp, Homo sapiens
tccaggagcatgctggctggcga

SEQ ID NO: 8205680 - DNA, 23 bp, Homo sapiens
tccaggagcatgctggctggcga

SEQ ID NO: 8205681 - DNA, 22 bp, Homo sapiens
tccaggagctcatccacgtcaa

SEQ ID NO: 8205682 - DNA, 22 bp, Homo sapiens
tccaggacctgactgggcctgc

SEQ ID NO: 8205683 - DNA, 22 bp, Homo sapiens
tccaggactataggaaagacac

SEQ ID NO: 8205684 - DNA, 22 bp, Homo sapiens
tccaggacctcccaggctagag

SEQ ID NO: 8205685 - DNA, 18 bp, Homo sapiens
tccaggactctgcgtggc

SEQ ID NO: 8205686 - DNA, 22 bp, Homo sapiens
tccaggactggttcacacggtg

SEQ ID NO: 8205687 - DNA, 18 bp, Homo sapiens
tccaggactctgcgtggc

SEQ ID NO: 8205688 - DNA, 21 bp, Homo sapiens
tccaggacttgagaattccag

SEQ ID NO: 8205689 - DNA, 22 bp, Homo sapiens
tccaggaccaaagacacatgta

SEQ ID NO: 8205690 - DNA, 22 bp, Homo sapiens
tccaggaccaaagacacatgta

SEQ ID NO: 8205691 - DNA, 23 bp, Homo sapiens
tccaggaccctggtagacacaca

SEQ ID NO: 8205692 - DNA, 22 bp, Homo sapiens
tccaggacagcggcaggcagat

SEQ ID NO: 8205693 - DNA, 22 bp, Homo sapiens
tccaggacagagtagaagcagc

SEQ ID NO: 8205694 - DNA, 22 bp, Homo sapiens
tccaggacagagtagaagcagc

SEQ ID NO: 8205695 - DNA, 22 bp, Homo sapiens
tccaggaatgtgtgtgggctag

SEQ ID NO: 8205696 - DNA, 22 bp, Homo sapiens
tccagccctgcttcctgcctca

SEQ ID NO: 8205697 - DNA, 22 bp, Homo sapiens
tccagccctgcttcctgcctca

SEQ ID NO: 8205698 - DNA, 22 bp, Homo sapiens
tccagccctgcttcctgcctca

SEQ ID NO: 8205699 - DNA, 22 bp, Homo sapiens
tccagccctgcccattctctcg

SEQ ID NO: 8205700 - DNA, 17 bp, Homo sapiens
tccagccctgcccgacg

SEQ ID NO: 8205701 - DNA, 17 bp, Homo sapiens
tccagccctgcccgacg

SEQ ID NO: 8205702 - DNA, 17 bp, Homo sapiens
tccagccctgcccgacg

SEQ ID NO: 8205703 - DNA, 22 bp, Homo sapiens
tccagccctcctgggatcacag

SEQ ID NO: 8205704 - DNA, 22 bp, Homo sapiens
tccagccctcctgggatcacag

SEQ ID NO: 8205705 - DNA, 22 bp, Homo sapiens
tccagccctcctgggatcacag

SEQ ID NO: 8205706 - DNA, 20 bp, Homo sapiens
tccagccctcatgtcgctca

SEQ ID NO: 8205707 - DNA, 20 bp, Homo sapiens
tccagccctcatgtcgctca

SEQ ID NO: 8205708 - DNA, 22 bp, Homo sapiens
tccagccctctggcccgcggtg

SEQ ID NO: 8205709 - DNA, 22 bp, Homo sapiens
tccagccctgcactgattagat

SEQ ID NO: 8205710 - DNA, 22 bp, Homo sapiens
tccagccctgcactgattagat

SEQ ID NO: 8205711 - DNA, 20 bp, Homo sapiens
tccagccctcatgtcgctca

SEQ ID NO: 8205712 - DNA, 22 bp, Homo sapiens
tccagccctcagccaagtggaa

SEQ ID NO: 8205713 - DNA, 22 bp, Homo sapiens
tccagccctcagccaagtggaa

SEQ ID NO: 8205714 - DNA, 22 bp, Homo sapiens
tccagccctcagccaagtggaa

SEQ ID NO: 8205715 - DNA, 22 bp, Homo sapiens
tccagcccgactgggcctgccg

SEQ ID NO: 8205716 - DNA, 22 bp, Homo sapiens
tccagcccgagggcgctgatga

SEQ ID NO: 8205717 - DNA, 22 bp, Homo sapiens
tccagcccgggggcaggtgacc

SEQ ID NO: 8205718 - DNA, 22 bp, Homo sapiens
tccagcccgggggcaggtgacc

SEQ ID NO: 8205719 - DNA, 22 bp, Homo sapiens
tccagcccgggggcaggtgacc

SEQ ID NO: 8205720 - DNA, 22 bp, Homo sapiens
tccagccccttttactcattca

SEQ ID NO: 8205721 - DNA, 20 bp, Homo sapiens
tccagcccctgcatgttgct

SEQ ID NO: 8205722 - DNA, 20 bp, Homo sapiens
tccagcccctgcatgttgct

SEQ ID NO: 8205723 - DNA, 19 bp, Homo sapiens
tccagcccctctgtgtgtg

SEQ ID NO: 8205724 - DNA, 22 bp, Homo sapiens
tccagcccgactgggcctgccg

SEQ ID NO: 8205725 - DNA, 22 bp, Homo sapiens
tccagcccgactgggcctgccg

SEQ ID NO: 8205726 - DNA, 22 bp, Homo sapiens
tccagcccgactgggcctgccg

SEQ ID NO: 8205727 - DNA, 20 bp, Homo sapiens
tccagcccaggtcctgcctg

SEQ ID NO: 8205728 - DNA, 22 bp, Homo sapiens
tccagcccaggctggagtgtag

SEQ ID NO: 8205729 - DNA, 20 bp, Homo sapiens
tccagcccaggtcctgcctg

SEQ ID NO: 8205730 - DNA, 22 bp, Homo sapiens
tccagcccaggctggagtgtag

SEQ ID NO: 8205731 - DNA, 20 bp, Homo sapiens
tccagccacttccgctggtc

SEQ ID NO: 8205732 - DNA, 22 bp, Homo sapiens
tccagccactcagcagggattg

SEQ ID NO: 8205733 - DNA, 22 bp, Homo sapiens
tccagccaccaccttgattgcc

SEQ ID NO: 8205734 - DNA, 22 bp, Homo sapiens
tccagccactcagcagggattg

SEQ ID NO: 8205735 - DNA, 22 bp, Homo sapiens
tccagaaacttttccagtctca

SEQ ID NO: 8205736 - DNA, 22 bp, Homo sapiens
tccagccccggcttccttacag

SEQ ID NO: 8205737 - DNA, 22 bp, Homo sapiens
tccagccccgggatgttcttca

SEQ ID NO: 8205738 - DNA, 19 bp, Homo sapiens
tccagcccctctgtgtgtg

SEQ ID NO: 8205739 - DNA, 19 bp, Homo sapiens
tccagcccctctgtgtgtg

SEQ ID NO: 8205740 - DNA, 22 bp, Homo sapiens
tccagcccctcctgagccaagc

SEQ ID NO: 8205741 - DNA, 22 bp, Homo sapiens
tccagcccctcctgagccaagc

SEQ ID NO: 8205742 - DNA, 22 bp, Homo sapiens
tccagcccctcctgagccaagc

SEQ ID NO: 8205743 - DNA, 22 bp, Homo sapiens
tccagcccatccctagcctggg

SEQ ID NO: 8205744 - DNA, 22 bp, Homo sapiens
tccagcccatccctagcctggg

SEQ ID NO: 8205745 - DNA, 22 bp, Homo sapiens
tccagccccgaggccggcgacg

SEQ ID NO: 8205746 - DNA, 22 bp, Homo sapiens
tccagccccgaggccggcgacg

SEQ ID NO: 8205747 - DNA, 22 bp, Homo sapiens
tccagcccatccctagcctggg

SEQ ID NO: 8205748 - DNA, 20 bp, Homo sapiens
tccagcccaggtcctgcctg

SEQ ID NO: 8205749 - DNA, 22 bp, Homo sapiens
tccagcccagtttggtgaattg

SEQ ID NO: 8205750 - DNA, 22 bp, Homo sapiens
tcccagagtgtgggcatcaagg

SEQ ID NO: 8205751 - DNA, 22 bp, Homo sapiens
tcccagagtgtgggcatcaagg

SEQ ID NO: 8205752 - DNA, 19 bp, Homo sapiens
tcccagagtctagaggttg

SEQ ID NO: 8205753 - DNA, 22 bp, Homo sapiens
tcccagagtcttctcctgtaat

SEQ ID NO: 8205754 - DNA, 22 bp, Homo sapiens
tcccagaagtccagccatgggc

SEQ ID NO: 8205755 - DNA, 22 bp, Homo sapiens
tcccagaagagatgccacttga

SEQ ID NO: 8205756 - DNA, 22 bp, Homo sapiens
tcccagaagagatgccacttga

SEQ ID NO: 8205757 - DNA, 22 bp, Homo sapiens
tcccagaaccctgccaggtcct

SEQ ID NO: 8205758 - DNA, 22 bp, Homo sapiens
tcccagaatggcccagctgccc

SEQ ID NO: 8205759 - DNA, 22 bp, Homo sapiens
tcccagacaatcattggccacc

SEQ ID NO: 8205760 - DNA, 22 bp, Homo sapiens
tcccagagaaagtcaaggtctt

SEQ ID NO: 8205761 - DNA, 22 bp, Homo sapiens
tcccagaatctccagtgctaca

SEQ ID NO: 8205762 - DNA, 22 bp, Homo sapiens
tcccagaatctccagtgctaca

SEQ ID NO: 8205763 - DNA, 22 bp, Homo sapiens
tcccagaatctttggaagagca

SEQ ID NO: 8205764 - DNA, 22 bp, Homo sapiens
tcccactgagcccctgctggtg

SEQ ID NO: 8205765 - DNA, 22 bp, Homo sapiens
tcccacagtggtacagccctga

SEQ ID NO: 8205766 - DNA, 22 bp, Homo sapiens
tcccactgagcccctgctggtg

SEQ ID NO: 8205767 - DNA, 22 bp, Homo sapiens
tcccacagtggtacagccctga

SEQ ID NO: 8205768 - DNA, 22 bp, Homo sapiens
tcccacagtggtacagccctga

SEQ ID NO: 8205769 - DNA, 22 bp, Homo sapiens
tccagttctaggtcactctctg

SEQ ID NO: 8205770 - DNA, 21 bp, Homo sapiens
tccagttgagactgaagatct

SEQ ID NO: 8205771 - DNA, 22 bp, Homo sapiens
tcccacagtgaagttcatgata

SEQ ID NO: 8205772 - DNA, 19 bp, Homo sapiens
tccagtgtagctggtcatt

SEQ ID NO: 8205773 - DNA, 22 bp, Homo sapiens
tccagtggtttgaaaggggtgt

SEQ ID NO: 8205774 - DNA, 22 bp, Homo sapiens
tccagtgttgtcagatcatctg

SEQ ID NO: 8205775 - DNA, 22 bp, Homo sapiens
tccagtgtttttcttcacaggt

SEQ ID NO: 8205776 - DNA, 20 bp, Homo sapiens
tccagtgtggggactggggc

SEQ ID NO: 8205777 - DNA, 21 bp, Homo sapiens
tcccactgccacagcttcagg

SEQ ID NO: 8205778 - DNA, 22 bp, Homo sapiens
tcccactggacgtctgtgctgg

SEQ ID NO: 8205779 - DNA, 22 bp, Homo sapiens
tcccactgtgcctgttgtaatc

SEQ ID NO: 8205780 - DNA, 22 bp, Homo sapiens
tcccactgtgaatccaaggcct

SEQ ID NO: 8205781 - DNA, 22 bp, Homo sapiens
tcccactgtgaatccaaggcct

SEQ ID NO: 8205782 - DNA, 22 bp, Homo sapiens
tcccagaaaaaggaggctatga

SEQ ID NO: 8205783 - DNA, 22 bp, Homo sapiens
tcccagaaaaaggaggctatga

SEQ ID NO: 8205784 - DNA, 22 bp, Homo sapiens
tcccacttccggaggcctttgg

SEQ ID NO: 8205785 - DNA, 17 bp, Homo sapiens
tcccaggaacagggaat

SEQ ID NO: 8205786 - DNA, 17 bp, Homo sapiens
tcccaggaacagggaat

SEQ ID NO: 8205787 - DNA, 19 bp, Homo sapiens
tcccaggaaccttttattt

SEQ ID NO: 8205788 - DNA, 22 bp, Homo sapiens
tcccaggaagatcccagggacc

SEQ ID NO: 8205789 - DNA, 22 bp, Homo sapiens
tcccaggaagatcccagggacc

SEQ ID NO: 8205790 - DNA, 19 bp, Homo sapiens
tcccaggaagcaaatgtca

SEQ ID NO: 8205791 - DNA, 22 bp, Homo sapiens
tcccaggaaggattcggcattt

SEQ ID NO: 8205792 - DNA, 22 bp, Homo sapiens
tcccaggaatccgtcctctaga

SEQ ID NO: 8205793 - DNA, 22 bp, Homo sapiens
tcccaggatctgagggcagaga

SEQ ID NO: 8205794 - DNA, 22 bp, Homo sapiens
tcccaggatgtgcgtgccgccg

SEQ ID NO: 8205795 - DNA, 22 bp, Homo sapiens
tcccaggatgaagacagtgttg

SEQ ID NO: 8205796 - DNA, 22 bp, Homo sapiens
tcccaggatgttggcggcaggt

SEQ ID NO: 8205797 - DNA, 22 bp, Homo sapiens
tcccaggatgttggcggcaggt

SEQ ID NO: 8205798 - DNA, 22 bp, Homo sapiens
tcccaggatgttggcggcaggt

SEQ ID NO: 8205799 - DNA, 21 bp, Homo sapiens
tcccagctgggtcagtgctgc

SEQ ID NO: 8205800 - DNA, 22 bp, Homo sapiens
tcccagctcacatatggtaact

SEQ ID NO: 8205801 - DNA, 22 bp, Homo sapiens
tcccaggaaaacactcgaggac

SEQ ID NO: 8205802 - DNA, 22 bp, Homo sapiens
tcccaggaaaacactcgaggac

SEQ ID NO: 8205803 - DNA, 21 bp, Homo sapiens
tcccagctgggtcagtgctgc

SEQ ID NO: 8205804 - DNA, 21 bp, Homo sapiens
tcccagctgggtcagtgctgc

SEQ ID NO: 8205805 - DNA, 22 bp, Homo sapiens
tcccagctgtgtggaggagatg

SEQ ID NO: 8205806 - DNA, 22 bp, Homo sapiens
tcccagcacagggcagatgtga

SEQ ID NO: 8205807 - DNA, 22 bp, Homo sapiens
tcccagcaagaaagggggtggc

SEQ ID NO: 8205808 - DNA, 22 bp, Homo sapiens
tcccagcacgtctgctgtttct

SEQ ID NO: 8205809 - DNA, 22 bp, Homo sapiens
tcccagcagagccagcaagccg

SEQ ID NO: 8205810 - DNA, 22 bp, Homo sapiens
tcccagcagagccagcaagccg

SEQ ID NO: 8205811 - DNA, 22 bp, Homo sapiens
tcccagcactgtaattctttgg

SEQ ID NO: 8205812 - DNA, 22 bp, Homo sapiens
tcccagattcctgctcttatat

SEQ ID NO: 8205813 - DNA, 22 bp, Homo sapiens
tcccagattcctgctcttatat

SEQ ID NO: 8205814 - DNA, 22 bp, Homo sapiens
tcccagattgttgatggcttaa

SEQ ID NO: 8205815 - DNA, 22 bp, Homo sapiens
tcccagattcctgctcttatat

SEQ ID NO: 8205816 - DNA, 22 bp, Homo sapiens
tcccagattcctgctcttatat

SEQ ID NO: 8205817 - DNA, 22 bp, Homo sapiens
tcccagagttcaatgggaaggt

SEQ ID NO: 8205818 - DNA, 22 bp, Homo sapiens
tcccagattcctgctcttatat

SEQ ID NO: 8205819 - DNA, 22 bp, Homo sapiens
tcccagcagatgagctgaccta

SEQ ID NO: 8205820 - DNA, 22 bp, Homo sapiens
tcccagcagatgagctgaccta

SEQ ID NO: 8205821 - DNA, 22 bp, Homo sapiens
tcccagcagcatagctcagaat

SEQ ID NO: 8205822 - DNA, 22 bp, Homo sapiens
tcccagcagcatagctcagaat

SEQ ID NO: 8205823 - DNA, 22 bp, Homo sapiens
tcccagcagatgagctgaccta

SEQ ID NO: 8205824 - DNA, 22 bp, Homo sapiens
tcccagcagggccgaccagcct

SEQ ID NO: 8205825 - DNA, 22 bp, Homo sapiens
tcccagcagcatagctcagaat

SEQ ID NO: 8205826 - DNA, 22 bp, Homo sapiens
tcccagcaggagtccagttccc

SEQ ID NO: 8205827 - DNA, 22 bp, Homo sapiens
tcccagcaggagtccagttccc

SEQ ID NO: 8205828 - DNA, 22 bp, Homo sapiens
tcccagcctttcttttctgctg

SEQ ID NO: 8205829 - DNA, 22 bp, Homo sapiens
tcccagcctttcttttctgctg

SEQ ID NO: 8205830 - DNA, 22 bp, Homo sapiens
tcccagcagtcagagctatgtg

SEQ ID NO: 8205831 - DNA, 22 bp, Homo sapiens
tcccagcagtcagagctatgtg

SEQ ID NO: 8205832 - DNA, 22 bp, Homo sapiens
tccaggcccactcggtggggct

SEQ ID NO: 8205833 - DNA, 22 bp, Homo sapiens
tccaggcccactcagctgaaat

SEQ ID NO: 8205834 - DNA, 22 bp, Homo sapiens
tccaggcccactcagctgaaat

SEQ ID NO: 8205835 - DNA, 22 bp, Homo sapiens
tccaggcccagacggggtgagg

SEQ ID NO: 8205836 - DNA, 22 bp, Homo sapiens
tccaggcccactcggtggggct

SEQ ID NO: 8205837 - DNA, 22 bp, Homo sapiens
tccaggcccagacggggtgagg

SEQ ID NO: 8205838 - DNA, 22 bp, Homo sapiens
tccaggcccagacggggtgagg

SEQ ID NO: 8205839 - DNA, 20 bp, Homo sapiens
tccaggcccactcagctgaa

SEQ ID NO: 8205840 - DNA, 22 bp, Homo sapiens
tccaggcccactcagctgaaat

SEQ ID NO: 8205841 - DNA, 20 bp, Homo sapiens
tccaggcccactcagctgaa

SEQ ID NO: 8205842 - DNA, 22 bp, Homo sapiens
tccaggccattgactgcatcct

SEQ ID NO: 8205843 - DNA, 22 bp, Homo sapiens
tccaggccattgactgcatcct

SEQ ID NO: 8205844 - DNA, 19 bp, Homo sapiens
tccaggccattcccagagc

SEQ ID NO: 8205845 - DNA, 19 bp, Homo sapiens
tccaggccattcccagagc

SEQ ID NO: 8205846 - DNA, 21 bp, Homo sapiens
tccaggccatggtggggaggc

SEQ ID NO: 8205847 - DNA, 21 bp, Homo sapiens
tccaggccatggtggggaggc

SEQ ID NO: 8205848 - DNA, 21 bp, Homo sapiens
tccaggccatggtggggaggc

SEQ ID NO: 8205849 - DNA, 22 bp, Homo sapiens
tccaggccagggtaagaggaga

SEQ ID NO: 8205850 - DNA, 22 bp, Homo sapiens
tccaggccagggtaagaggaga

SEQ ID NO: 8205851 - DNA, 22 bp, Homo sapiens
tccaggccagggtaagaggaga

SEQ ID NO: 8205852 - DNA, 22 bp, Homo sapiens
tccaggaggcagggctgtgccc

SEQ ID NO: 8205853 - DNA, 22 bp, Homo sapiens
tccaggaggcagggctgtgccc

SEQ ID NO: 8205854 - DNA, 22 bp, Homo sapiens
tccaggaggaggaaggctgcca

SEQ ID NO: 8205855 - DNA, 22 bp, Homo sapiens
tccaggaggcagggctgtgccc

SEQ ID NO: 8205856 - DNA, 22 bp, Homo sapiens
tccaggccgcaggggcagcccc

SEQ ID NO: 8205857 - DNA, 22 bp, Homo sapiens
tccaggccctgggatgggagca

SEQ ID NO: 8205858 - DNA, 22 bp, Homo sapiens
tccaggccgcaggggcagcccc

SEQ ID NO: 8205859 - DNA, 22 bp, Homo sapiens
tccaggccctgggatgggagca

SEQ ID NO: 8205860 - DNA, 22 bp, Homo sapiens
tccaggccctgggatgggagca

SEQ ID NO: 8205861 - DNA, 22 bp, Homo sapiens
tccaggcccatagacacttctc

SEQ ID NO: 8205862 - DNA, 22 bp, Homo sapiens
tccaggcccatagacacttctc

SEQ ID NO: 8205863 - DNA, 22 bp, Homo sapiens
tccaggcccgagatgggctgga

SEQ ID NO: 8205864 - DNA, 22 bp, Homo sapiens
tccaggcctaggccaagtgatt

SEQ ID NO: 8205865 - DNA, 22 bp, Homo sapiens
tccaggcctaggccaagtgatt

SEQ ID NO: 8205866 - DNA, 22 bp, Homo sapiens
tccaggcctaggccaagtgatt

SEQ ID NO: 8205867 - DNA, 21 bp, Homo sapiens
tccaggcctcaggaagggatg

SEQ ID NO: 8205868 - DNA, 21 bp, Homo sapiens
tccaggcctcaggaagggatg

SEQ ID NO: 8205869 - DNA, 22 bp, Homo sapiens
tccaggcctaggccaagtgatt

SEQ ID NO: 8205870 - DNA, 22 bp, Homo sapiens
tccaggccgcatagttactctg

SEQ ID NO: 8205871 - DNA, 22 bp, Homo sapiens
tccaggccgcatagttactctg

SEQ ID NO: 8205872 - DNA, 22 bp, Homo sapiens
tccaggccgcaggggcagcccc

SEQ ID NO: 8205873 - DNA, 22 bp, Homo sapiens
tccagggagagccgctgctcca

SEQ ID NO: 8205874 - DNA, 22 bp, Homo sapiens
tccagggagatactggctgcca

SEQ ID NO: 8205875 - DNA, 22 bp, Homo sapiens
tccagggagatggcagaggctg

SEQ ID NO: 8205876 - DNA, 22 bp, Homo sapiens
tccagggagatggcagaggctg

SEQ ID NO: 8205877 - DNA, 22 bp, Homo sapiens
tccagggagcaagtcaggccgg

SEQ ID NO: 8205878 - DNA, 22 bp, Homo sapiens
tccagggacctccctgagagct

SEQ ID NO: 8205879 - DNA, 22 bp, Homo sapiens
tccagggacagcgctggagcta

SEQ ID NO: 8205880 - DNA, 21 bp, Homo sapiens
tccaggcctcaggaagggatg

SEQ ID NO: 8205881 - DNA, 20 bp, Homo sapiens
tccagtggcctgaatctgga

SEQ ID NO: 8205882 - DNA, 22 bp, Homo sapiens
tccagtggcaggcggtgaggtc

SEQ ID NO: 8205883 - DNA, 22 bp, Homo sapiens
tccagtggcaggcggtgaggtc

SEQ ID NO: 8205884 - DNA, 22 bp, Homo sapiens
tccagtggcactggagactaga

SEQ ID NO: 8205885 - DNA, 22 bp, Homo sapiens
tccagtggcaccttggccctca

SEQ ID NO: 8205886 - DNA, 22 bp, Homo sapiens
tccagtggcactggagactaga

SEQ ID NO: 8205887 - DNA, 15 bp, Homo sapiens
tccagtggaggcact

SEQ ID NO: 8205888 - DNA, 22 bp, Homo sapiens
tccagtggagtgtgggggtgaa

SEQ ID NO: 8205889 - DNA, 22 bp, Homo sapiens
tccagtggaacagatgttgcct

SEQ ID NO: 8205890 - DNA, 22 bp, Homo sapiens
tccagtggaaattgtgttcatt

SEQ ID NO: 8205891 - DNA, 22 bp, Homo sapiens
tccagtgctggaccagagcacc

SEQ ID NO: 8205892 - DNA, 22 bp, Homo sapiens
tccagtgctggaccagagcacc

SEQ ID NO: 8205893 - DNA, 22 bp, Homo sapiens
tccagtgcctcactgaggattc

SEQ ID NO: 8205894 - DNA, 22 bp, Homo sapiens
tccagtgcctcactgaggattc

SEQ ID NO: 8205895 - DNA, 22 bp, Homo sapiens
tccagtggtggctcccggacct

SEQ ID NO: 8205896 - DNA, 22 bp, Homo sapiens
tccagtggtagtaaagaggtct

SEQ ID NO: 8205897 - DNA, 22 bp, Homo sapiens
tccagtggtacatggagacact

SEQ ID NO: 8205898 - DNA, 21 bp, Homo sapiens
tccagtggtgtctagaatgtg

SEQ ID NO: 8205899 - DNA, 21 bp, Homo sapiens
tccagtggtgtctagaatgtg

SEQ ID NO: 8205900 - DNA, 22 bp, Homo sapiens
tccagtggtggtttgaagggca

SEQ ID NO: 8205901 - DNA, 22 bp, Homo sapiens
tccagtggtggtttgaagggca

SEQ ID NO: 8205902 - DNA, 22 bp, Homo sapiens
tccagtggctttgctgctttaa

SEQ ID NO: 8205903 - DNA, 22 bp, Homo sapiens
tccagtggcttcctggaaaaaa

SEQ ID NO: 8205904 - DNA, 22 bp, Homo sapiens
tccagtggcaggcggtgaggtc

SEQ ID NO: 8205905 - DNA, 20 bp, Homo sapiens
tccagtggcctgaatctgga

SEQ ID NO: 8205906 - DNA, 20 bp, Homo sapiens
tccagtggcctgaatctgga

SEQ ID NO: 8205907 - DNA, 22 bp, Homo sapiens
tccagtgggtctggcaagacca

SEQ ID NO: 8205908 - DNA, 21 bp, Homo sapiens
tccagtggggatctctgatat

SEQ ID NO: 8205909 - DNA, 21 bp, Homo sapiens
tccagtggggatctctgatat

SEQ ID NO: 8205910 - DNA, 21 bp, Homo sapiens
tccagtggggatctctgatat

SEQ ID NO: 8205911 - DNA, 22 bp, Homo sapiens
tccagtgggttgctgagggagg

SEQ ID NO: 8205912 - DNA, 22 bp, Homo sapiens
tccagtgggttgctgagggagg

SEQ ID NO: 8205913 - DNA, 22 bp, Homo sapiens
tccagtctaatgagtcagagtg

SEQ ID NO: 8205914 - DNA, 22 bp, Homo sapiens
tccagtcctagaaactggagag

SEQ ID NO: 8205915 - DNA, 22 bp, Homo sapiens
tccagtctctactctgagataa

SEQ ID NO: 8205916 - DNA, 22 bp, Homo sapiens
tccagtctctggctgtttgtga

SEQ ID NO: 8205917 - DNA, 22 bp, Homo sapiens
tccagtctgtagtgcacagtga

SEQ ID NO: 8205918 - DNA, 22 bp, Homo sapiens
tccagtgcattcagacacttgg

SEQ ID NO: 8205919 - DNA, 22 bp, Homo sapiens
tccagtcttcttgcagctacat

SEQ ID NO: 8205920 - DNA, 22 bp, Homo sapiens
tccagggcagccgcgggtgcgc

SEQ ID NO: 8205921 - DNA, 22 bp, Homo sapiens
tccagggcagccgcgggtgcgc

SEQ ID NO: 8205922 - DNA, 20 bp, Homo sapiens
tccagggcaactagagtgtg

SEQ ID NO: 8205923 - DNA, 20 bp, Homo sapiens
tccagggcaactagagtgtg

SEQ ID NO: 8205924 - DNA, 22 bp, Homo sapiens
tccagggcaccagcgtccccct

SEQ ID NO: 8205925 - DNA, 20 bp, Homo sapiens
tccagggcaaactcatcacc

SEQ ID NO: 8205926 - DNA, 20 bp, Homo sapiens
tccagggcaactagagtgtg

SEQ ID NO: 8205927 - DNA, 20 bp, Homo sapiens
tccagggcaaactcatcacc

SEQ ID NO: 8205928 - DNA, 22 bp, Homo sapiens
tccagggatggtaatgagcagt

SEQ ID NO: 8205929 - DNA, 22 bp, Homo sapiens
tccagggatgtcctgtagcact

SEQ ID NO: 8205930 - DNA, 20 bp, Homo sapiens
tccagggcaaactcatcacc

SEQ ID NO: 8205931 - DNA, 22 bp, Homo sapiens
tccagggatgccagccatgttg

SEQ ID NO: 8205932 - DNA, 22 bp, Homo sapiens
tccagggatctttagagtcttt

SEQ ID NO: 8205933 - DNA, 22 bp, Homo sapiens
tccagggagttggctggatagt

SEQ ID NO: 8205934 - DNA, 22 bp, Homo sapiens
tacatacacaaatgctgaatgg

SEQ ID NO: 8205935 - DNA, 22 bp, Homo sapiens
tacatacacaaatatactgttt

SEQ ID NO: 8205936 - DNA, 22 bp, Homo sapiens
tacatacacaaatgctgaatgg

SEQ ID NO: 8205937 - DNA, 22 bp, Homo sapiens
tacatacagccaagtatgaagt

SEQ ID NO: 8205938 - DNA, 22 bp, Homo sapiens
tacatacagagatgctagttaa

SEQ ID NO: 8205939 - DNA, 22 bp, Homo sapiens
tacatacaagatgtgtttaaaa

SEQ ID NO: 8205940 - DNA, 22 bp, Homo sapiens
tacatacaagatgtgtttaaaa

SEQ ID NO: 8205941 - DNA, 22 bp, Homo sapiens
tacatacaagcattcaatttta

SEQ ID NO: 8205942 - DNA, 22 bp, Homo sapiens
tacatacacaaatatactgttt

SEQ ID NO: 8205943 - DNA, 22 bp, Homo sapiens
tacatacacaaatatactgttt

SEQ ID NO: 8205944 - DNA, 22 bp, Homo sapiens
tacatacacaaatatactgttt

SEQ ID NO: 8205945 - DNA, 22 bp, Homo sapiens
tacatacacaaatatactgttt

SEQ ID NO: 8205946 - DNA, 22 bp, Homo sapiens
tacatacagccaagtatgaagt

SEQ ID NO: 8205947 - DNA, 22 bp, Homo sapiens
tacatacagtggatgctttagg

SEQ ID NO: 8205948 - DNA, 22 bp, Homo sapiens
tacatacagtggatgctttagg

SEQ ID NO: 8205949 - DNA, 22 bp, Homo sapiens
tacatacatattcatacaggtg

SEQ ID NO: 8205950 - DNA, 22 bp, Homo sapiens
tacatacagtggatgctttagg

SEQ ID NO: 8205951 - DNA, 22 bp, Homo sapiens
tacatacatattcatacaggtg

SEQ ID NO: 8205952 - DNA, 22 bp, Homo sapiens
tacatacatattcatacaggtg

SEQ ID NO: 8205953 - DNA, 22 bp, Homo sapiens
tacatacatattcatacaggtg

SEQ ID NO: 8205954 - DNA, 22 bp, Homo sapiens
tacatacatggtggaatggtta

SEQ ID NO: 8205955 - DNA, 22 bp, Homo sapiens
tacatgtatgtttatcttgaga

SEQ ID NO: 8205956 - DNA, 22 bp, Homo sapiens
tacatgtattgatttctcttct

SEQ ID NO: 8205957 - DNA, 22 bp, Homo sapiens
tacatgtatgtttatcttgaga

SEQ ID NO: 8205958 - DNA, 22 bp, Homo sapiens
tacatgtattgatttctcttct

SEQ ID NO: 8205959 - DNA, 22 bp, Homo sapiens
tacatgtctacatgcatttttg

SEQ ID NO: 8205960 - DNA, 22 bp, Homo sapiens
tacatgtgataaattgattaaa

SEQ ID NO: 8205961 - DNA, 22 bp, Homo sapiens
tacatgtttggtaaatgatggc

SEQ ID NO: 8205962 - DNA, 22 bp, Homo sapiens
tacattaaggatatggacatga

SEQ ID NO: 8205963 - DNA, 22 bp, Homo sapiens
tacattaacttacgtccacatg

SEQ ID NO: 8205964 - DNA, 22 bp, Homo sapiens
tacattatcttgttatctttca

SEQ ID NO: 8205965 - DNA, 22 bp, Homo sapiens
tacattatcttgttatctttca

SEQ ID NO: 8205966 - DNA, 22 bp, Homo sapiens
tacattatttcatcagtcatct

SEQ ID NO: 8205967 - DNA, 22 bp, Homo sapiens
tacattatttcatcagtcatct

SEQ ID NO: 8205968 - DNA, 22 bp, Homo sapiens
tacattatcttgttatctttca

SEQ ID NO: 8205969 - DNA, 22 bp, Homo sapiens
tacattagctcatctatttatt

SEQ ID NO: 8205970 - DNA, 22 bp, Homo sapiens
tacattatcctgtctttgtcct

SEQ ID NO: 8205971 - DNA, 22 bp, Homo sapiens
tacattacaggaaagataaaga

SEQ ID NO: 8205972 - DNA, 22 bp, Homo sapiens
tacattaaggatatggacatga

SEQ ID NO: 8205973 - DNA, 22 bp, Homo sapiens
tacattaaggatatggacatga

SEQ ID NO: 8205974 - DNA, 22 bp, Homo sapiens
tacattagctcatctatttatt

SEQ ID NO: 8205975 - DNA, 22 bp, Homo sapiens
tacattcaaacgatttattgat

SEQ ID NO: 8205976 - DNA, 22 bp, Homo sapiens
tacattcatggtgacttgtatg

SEQ ID NO: 8205977 - DNA, 22 bp, Homo sapiens
tacattcagaagaatggacacg

SEQ ID NO: 8205978 - DNA, 22 bp, Homo sapiens
tacagcagagtgggatgcatct

SEQ ID NO: 8205979 - DNA, 22 bp, Homo sapiens
tacagcagcatcgcagtgacct

SEQ ID NO: 8205980 - DNA, 22 bp, Homo sapiens
tacagcagcccaccttcttctg

SEQ ID NO: 8205981 - DNA, 22 bp, Homo sapiens
tacagcttatccagcttgatag

SEQ ID NO: 8205982 - DNA, 22 bp, Homo sapiens
tacagcttaaaagatgcattta

SEQ ID NO: 8205983 - DNA, 22 bp, Homo sapiens
tacactatgggctttgtgtaat

SEQ ID NO: 8205984 - DNA, 22 bp, Homo sapiens
tacagcactgtgcatagtggtt

SEQ ID NO: 8205985 - DNA, 20 bp, Homo sapiens
tacagcagaaatgttttgct

SEQ ID NO: 8205986 - DNA, 22 bp, Homo sapiens
tacagcttcagtgtgccccagt

SEQ ID NO: 8205987 - DNA, 22 bp, Homo sapiens
tacagcttgacccataatgtct

SEQ ID NO: 8205988 - DNA, 22 bp, Homo sapiens
tacagcttcagtgtgccccagt

SEQ ID NO: 8205989 - DNA, 22 bp, Homo sapiens
tacagcttgatgagagcgcgag

SEQ ID NO: 8205990 - DNA, 18 bp, Homo sapiens
tacagcttgagttgactg

SEQ ID NO: 8205991 - DNA, 22 bp, Homo sapiens
tacagcttttcatatttgtgtt

SEQ ID NO: 8205992 - DNA, 22 bp, Homo sapiens
tacagctttgggaaggccccat

SEQ ID NO: 8205993 - DNA, 22 bp, Homo sapiens
tacagctttatacccatcaaaa

SEQ ID NO: 8205994 - DNA, 22 bp, Homo sapiens
tacagcttgatgtttgtgtgtt

SEQ ID NO: 8205995 - DNA, 22 bp, Homo sapiens
tacagctttagcaaattaccta

SEQ ID NO: 8205996 - DNA, 22 bp, Homo sapiens
tacaggaagcactcaagaaatg

SEQ ID NO: 8205997 - DNA, 22 bp, Homo sapiens
tacaggaaggagcacatcggga

SEQ ID NO: 8205998 - DNA, 18 bp, Homo sapiens
tacaggaaggggttctcg

SEQ ID NO: 8205999 - DNA, 22 bp, Homo sapiens
tacaggaaggctctggaggtgc

SEQ ID NO: 8206000 - DNA, 22 bp, Homo sapiens
tacaggaaggctctggaggtgc

SEQ ID NO: 8206001 - DNA, 22 bp, Homo sapiens
tacaggaagtctcagtacagta

SEQ ID NO: 8206002 - DNA, 22 bp, Homo sapiens
tacaggaagtaagtaatgaaat

SEQ ID NO: 8206003 - DNA, 22 bp, Homo sapiens
tacaggaaagaaatttgaactc

SEQ ID NO: 8206004 - DNA, 22 bp, Homo sapiens
tacagcttttgcagctgttttg

SEQ ID NO: 8206005 - DNA, 22 bp, Homo sapiens
tacagctttatacccatcaaaa

SEQ ID NO: 8206006 - DNA, 22 bp, Homo sapiens
tacaggaactgggcaggacatt

SEQ ID NO: 8206007 - DNA, 22 bp, Homo sapiens
tacaggaactgggcaggacatt

SEQ ID NO: 8206008 - DNA, 22 bp, Homo sapiens
tacagtttttattcatgacaag

SEQ ID NO: 8206009 - DNA, 22 bp, Homo sapiens
tacagtttttattcatgacaag

SEQ ID NO: 8206010 - DNA, 22 bp, Homo sapiens
tacagtttttattcatgacaag

SEQ ID NO: 8206011 - DNA, 22 bp, Homo sapiens
tacagtttttattcatgacaag

SEQ ID NO: 8206012 - DNA, 22 bp, Homo sapiens
tacataattgtctttgtcctca

SEQ ID NO: 8206013 - DNA, 22 bp, Homo sapiens
tacatacaagatgtgtttaaaa

SEQ ID NO: 8206014 - DNA, 22 bp, Homo sapiens
tacataattaatctttaagttc

SEQ ID NO: 8206015 - DNA, 22 bp, Homo sapiens
tacataatgagctagttaagtt

SEQ ID NO: 8206016 - DNA, 22 bp, Homo sapiens
tacataatgagctagttaagtt

SEQ ID NO: 8206017 - DNA, 22 bp, Homo sapiens
tacaggagagatttagtaatca

SEQ ID NO: 8206018 - DNA, 20 bp, Homo sapiens
tacaggaatcaagactgcat

SEQ ID NO: 8206019 - DNA, 20 bp, Homo sapiens
tacaggaatcaagactgcat

SEQ ID NO: 8206020 - DNA, 20 bp, Homo sapiens
tacaggaatcaagactgcat

SEQ ID NO: 8206021 - DNA, 22 bp, Homo sapiens
tacaggaagttacagactatga

SEQ ID NO: 8206022 - DNA, 22 bp, Homo sapiens
tacagttaccctggaaagaaat

SEQ ID NO: 8206023 - DNA, 22 bp, Homo sapiens
tacaggagagatttagtaatca

SEQ ID NO: 8206024 - DNA, 22 bp, Homo sapiens
tacaggagagatttagtaatca

SEQ ID NO: 8206025 - DNA, 22 bp, Homo sapiens
tacagttactgttatatgtgct

SEQ ID NO: 8206026 - DNA, 22 bp, Homo sapiens
tacagttaccctggaaagaaat

SEQ ID NO: 8206027 - DNA, 22 bp, Homo sapiens
tacagttacgctgagaaacgaa

SEQ ID NO: 8206028 - DNA, 22 bp, Homo sapiens
tacagttacgctgagaaacgaa

SEQ ID NO: 8206029 - DNA, 22 bp, Homo sapiens
tacagtttgttacattgttagt

SEQ ID NO: 8206030 - DNA, 22 bp, Homo sapiens
tacagtttgttacattgttagt

SEQ ID NO: 8206031 - DNA, 22 bp, Homo sapiens
tacagtttgttacattgttagt

SEQ ID NO: 8206032 - DNA, 22 bp, Homo sapiens
tacagttttggtgatgatgatg

SEQ ID NO: 8206033 - DNA, 22 bp, Homo sapiens
tacagtttgttacattgttagt

SEQ ID NO: 8206034 - DNA, 22 bp, Homo sapiens
tacagttactttgaaaattgat

SEQ ID NO: 8206035 - DNA, 22 bp, Homo sapiens
tactgcttcacccttgagtctt

SEQ ID NO: 8206036 - DNA, 22 bp, Homo sapiens
tactgcttcatatagggatgta

SEQ ID NO: 8206037 - DNA, 22 bp, Homo sapiens
tactgcttggtgttgttgtatc

SEQ ID NO: 8206038 - DNA, 22 bp, Homo sapiens
tactgcttcatatatgggagac

SEQ ID NO: 8206039 - DNA, 22 bp, Homo sapiens
tactgcttgatctagcatggct

SEQ ID NO: 8206040 - DNA, 22 bp, Homo sapiens
tactgctagatgaaaatgtagg

SEQ ID NO: 8206041 - DNA, 22 bp, Homo sapiens
tactgctagatgaaaatgtagg

SEQ ID NO: 8206042 - DNA, 22 bp, Homo sapiens
tactgcctagatattaaaagct

SEQ ID NO: 8206043 - DNA, 22 bp, Homo sapiens
tactggaagttagagatctttt

SEQ ID NO: 8206044 - DNA, 22 bp, Homo sapiens
tactggaatcccgggtggctgg

SEQ ID NO: 8206045 - DNA, 22 bp, Homo sapiens
tactggaatcccgggtggctgg

SEQ ID NO: 8206046 - DNA, 20 bp, Homo sapiens
tactggaaatttctccacct

SEQ ID NO: 8206047 - DNA, 22 bp, Homo sapiens
tactgcttttagctggatacac

SEQ ID NO: 8206048 - DNA, 22 bp, Homo sapiens
tactgcttgttagctgtatttg

SEQ ID NO: 8206049 - DNA, 22 bp, Homo sapiens
tactgctttgactgtatgggac

SEQ ID NO: 8206050 - DNA, 22 bp, Homo sapiens
tactggacacgtatatatagat

SEQ ID NO: 8206051 - DNA, 22 bp, Homo sapiens
tactggggtatgctcagatata

SEQ ID NO: 8206052 - DNA, 22 bp, Homo sapiens
tactggcatttagtgggcagaa

SEQ ID NO: 8206053 - DNA, 20 bp, Homo sapiens
tactgggcaagcccacagac

SEQ ID NO: 8206054 - DNA, 22 bp, Homo sapiens
tactgcaaaccatttacagtag

SEQ ID NO: 8206055 - DNA, 22 bp, Homo sapiens
tactgatatgatgtgctttaga

SEQ ID NO: 8206056 - DNA, 22 bp, Homo sapiens
tactgcacttgagaaagctgag

SEQ ID NO: 8206057 - DNA, 21 bp, Homo sapiens
tactgagacctcacagtgtgc

SEQ ID NO: 8206058 - DNA, 22 bp, Homo sapiens
tactgaggctgaattcttagca

SEQ ID NO: 8206059 - DNA, 22 bp, Homo sapiens
tactgaggctggcagccccttg

SEQ ID NO: 8206060 - DNA, 22 bp, Homo sapiens
tactgaggccatgagtctcata

SEQ ID NO: 8206061 - DNA, 22 bp, Homo sapiens
tactgaggccatgagtctcata

SEQ ID NO: 8206062 - DNA, 22 bp, Homo sapiens
tactgaggccatgagtctcata

SEQ ID NO: 8206063 - DNA, 22 bp, Homo sapiens
tactgaggcaatagataacggc

SEQ ID NO: 8206064 - DNA, 22 bp, Homo sapiens
tactgagggcaaagagtgaagc

SEQ ID NO: 8206065 - DNA, 22 bp, Homo sapiens
tactgaggctgggttaagcatc

SEQ ID NO: 8206066 - DNA, 22 bp, Homo sapiens
tactgagggctgtgtatgtatt

SEQ ID NO: 8206067 - DNA, 22 bp, Homo sapiens
tactgaggctgaattcttagca

SEQ ID NO: 8206068 - DNA, 22 bp, Homo sapiens
tactgagggcaaagagtgaagc

SEQ ID NO: 8206069 - DNA, 17 bp, Homo sapiens
tactgaggggtctggag

SEQ ID NO: 8206070 - DNA, 22 bp, Homo sapiens
tactgagggtatgaagccaagg

SEQ ID NO: 8206071 - DNA, 22 bp, Homo sapiens
tactgagggtgaaaaataaagt

SEQ ID NO: 8206072 - DNA, 22 bp, Homo sapiens
tactgaggtactttacttataa

SEQ ID NO: 8206073 - DNA, 22 bp, Homo sapiens
tactgaggttgagaagctgctc

SEQ ID NO: 8206074 - DNA, 22 bp, Homo sapiens
tactgaggttgagaagctgctc

SEQ ID NO: 8206075 - DNA, 20 bp, Homo sapiens
tactgaggttaggggatgga

SEQ ID NO: 8206076 - DNA, 22 bp, Homo sapiens
tacttataaggaggcacacaaa

SEQ ID NO: 8206077 - DNA, 22 bp, Homo sapiens
tacttattggttcagaagttta

SEQ ID NO: 8206078 - DNA, 19 bp, Homo sapiens
tacttattagaaatatggg

SEQ ID NO: 8206079 - DNA, 22 bp, Homo sapiens
tacttattgttgaactgaatca

SEQ ID NO: 8206080 - DNA, 22 bp, Homo sapiens
tacttcaaacaatggtacaaac

SEQ ID NO: 8206081 - DNA, 22 bp, Homo sapiens
tactggtggaaagagtgaatga

SEQ ID NO: 8206082 - DNA, 22 bp, Homo sapiens
tacttccagcaatctgcatatt

SEQ ID NO: 8206083 - DNA, 22 bp, Homo sapiens
tacttccaggcggacaaagccc

SEQ ID NO: 8206084 - DNA, 22 bp, Homo sapiens
tacttcattattctagttttga

SEQ ID NO: 8206085 - DNA, 22 bp, Homo sapiens
tacttctgccttagagaacact

SEQ ID NO: 8206086 - DNA, 22 bp, Homo sapiens
tacttctagcctgccccttgtg

SEQ ID NO: 8206087 - DNA, 22 bp, Homo sapiens
tacttctctccgcctcgtgctt

SEQ ID NO: 8206088 - DNA, 22 bp, Homo sapiens
tacttctctccgcctcgtgctt

SEQ ID NO: 8206089 - DNA, 22 bp, Homo sapiens
tacttctctgcgatcacttgat

SEQ ID NO: 8206090 - DNA, 22 bp, Homo sapiens
tactaaatagtttaattcctca

SEQ ID NO: 8206091 - DNA, 22 bp, Homo sapiens
tactaaatagtttaattcctca

SEQ ID NO: 8206092 - DNA, 22 bp, Homo sapiens
tactaaatgattaagcaggaat

SEQ ID NO: 8206093 - DNA, 22 bp, Homo sapiens
tacgttttaaacacggagccag

SEQ ID NO: 8206094 - DNA, 22 bp, Homo sapiens
tacgggcacgcaccacgatgcc

SEQ ID NO: 8206095 - DNA, 22 bp, Homo sapiens
tacctttaaggagatttgacaa

SEQ ID NO: 8206096 - DNA, 22 bp, Homo sapiens
tacctttgatctggaattttaa

SEQ ID NO: 8206097 - DNA, 22 bp, Homo sapiens
tacgcctgtaatcccagcactt

SEQ ID NO: 8206098 - DNA, 22 bp, Homo sapiens
tacgattagagatgaatgcatg

SEQ ID NO: 8206099 - DNA, 22 bp, Homo sapiens
tacgcctgtaatcccagcactt

SEQ ID NO: 8206100 - DNA, 22 bp, Homo sapiens
tactaagtggggcattgttata

SEQ ID NO: 8206101 - DNA, 22 bp, Homo sapiens
tactaagtgtttggcagtatca

SEQ ID NO: 8206102 - DNA, 22 bp, Homo sapiens
tactacaaggccgaagctctca

SEQ ID NO: 8206103 - DNA, 22 bp, Homo sapiens
tactaattgttcacacttgttt

SEQ ID NO: 8206104 - DNA, 22 bp, Homo sapiens
tactgaaagactgaatatttag

SEQ ID NO: 8206105 - DNA, 22 bp, Homo sapiens
tactgaaagactgaatatttag

SEQ ID NO: 8206106 - DNA, 22 bp, Homo sapiens
tactgaaatggcagatatataa

SEQ ID NO: 8206107 - DNA, 20 bp, Homo sapiens
tactgaagaagctgcccaga

SEQ ID NO: 8206108 - DNA, 22 bp, Homo sapiens
tactgaatggggcagtaagaaa

SEQ ID NO: 8206109 - DNA, 22 bp, Homo sapiens
tacctgtcaaaagacatggaga

SEQ ID NO: 8206110 - DNA, 22 bp, Homo sapiens
tacctggggctgggctttgatt

SEQ ID NO: 8206111 - DNA, 22 bp, Homo sapiens
tacctggaatagagtctctcca

SEQ ID NO: 8206112 - DNA, 22 bp, Homo sapiens
tacctggaatcacagaggctga

SEQ ID NO: 8206113 - DNA, 22 bp, Homo sapiens
tacctggatcctggtagacatc

SEQ ID NO: 8206114 - DNA, 22 bp, Homo sapiens
tacctggatatcattcattctc

SEQ ID NO: 8206115 - DNA, 22 bp, Homo sapiens
tacctggagcaggaggcagaat

SEQ ID NO: 8206116 - DNA, 22 bp, Homo sapiens
taccttgagccgttgctgatga

SEQ ID NO: 8206117 - DNA, 22 bp, Homo sapiens
taccttgattttgaatccatga

SEQ ID NO: 8206118 - DNA, 22 bp, Homo sapiens
taccttctctagatctttattc

SEQ ID NO: 8206119 - DNA, 22 bp, Homo sapiens
taccttgggctattatctttga

SEQ ID NO: 8206120 - DNA, 22 bp, Homo sapiens
taccttgggttgagttcattct

SEQ ID NO: 8206121 - DNA, 22 bp, Homo sapiens
taccttggggttttgttgctct

SEQ ID NO: 8206122 - DNA, 22 bp, Homo sapiens
taccttggaaatgctagagtaa

SEQ ID NO: 8206123 - DNA, 22 bp, Homo sapiens
taccttggaggccaagcagttt

SEQ ID NO: 8206124 - DNA, 22 bp, Homo sapiens
taccttgggagacgccaggccc

SEQ ID NO: 8206125 - DNA, 19 bp, Homo sapiens
tacattccacacaatctct

SEQ ID NO: 8206126 - DNA, 22 bp, Homo sapiens
tacattccacaagcattgcttt

SEQ ID NO: 8206127 - DNA, 22 bp, Homo sapiens
tacattccacaagcattgcttt

SEQ ID NO: 8206128 - DNA, 22 bp, Homo sapiens
tacattcccccaattaccaatg

SEQ ID NO: 8206129 - DNA, 22 bp, Homo sapiens
tacccaaggccctttcaatttc

SEQ ID NO: 8206130 - DNA, 22 bp, Homo sapiens
tacccagagggagagcaactat

SEQ ID NO: 8206131 - DNA, 22 bp, Homo sapiens
tacccagagggagagcaactat

SEQ ID NO: 8206132 - DNA, 22 bp, Homo sapiens
tacctgagcccagtgcagcata

SEQ ID NO: 8206133 - DNA, 22 bp, Homo sapiens
tacctgattttattaccagttt

SEQ ID NO: 8206134 - DNA, 22 bp, Homo sapiens
tacccagcccatgcctacctca

SEQ ID NO: 8206135 - DNA, 22 bp, Homo sapiens
tacccagcttcaagtcaggact

SEQ ID NO: 8206136 - DNA, 22 bp, Homo sapiens
tacccagctcctcagaagacca

SEQ ID NO: 8206137 - DNA, 22 bp, Homo sapiens
taatgcttttccttcaaataag

SEQ ID NO: 8206138 - DNA, 22 bp, Homo sapiens
taatgcttttccttcaaataag

SEQ ID NO: 8206139 - DNA, 22 bp, Homo sapiens
taatgcttaattttcacaagcc

SEQ ID NO: 8206140 - DNA, 22 bp, Homo sapiens
taatgcttaacagctggctttt

SEQ ID NO: 8206141 - DNA, 22 bp, Homo sapiens
taatgctgtggtctaatgggga

SEQ ID NO: 8206142 - DNA, 22 bp, Homo sapiens
taatgctgagtgatgttgaaag

SEQ ID NO: 8206143 - DNA, 22 bp, Homo sapiens
taatgccttatgtcaaatgtaa

SEQ ID NO: 8206144 - DNA, 22 bp, Homo sapiens
taatttcacagttcaacgcaca

SEQ ID NO: 8206145 - DNA, 22 bp, Homo sapiens
taatttcaatagcttgcataat

SEQ ID NO: 8206146 - DNA, 22 bp, Homo sapiens
taatttcaatagcttgcataat

SEQ ID NO: 8206147 - DNA, 22 bp, Homo sapiens
taatttcaatagcttgcataat

SEQ ID NO: 8206148 - DNA, 22 bp, Homo sapiens
taatttcaatagcttgcataat

SEQ ID NO: 8206149 - DNA, 22 bp, Homo sapiens
taatggaagttaaatatggtat

SEQ ID NO: 8206150 - DNA, 22 bp, Homo sapiens
taatttcagtgggctctgggct

SEQ ID NO: 8206151 - DNA, 22 bp, Homo sapiens
taatttcagtgcaagctcacgg

SEQ ID NO: 8206152 - DNA, 22 bp, Homo sapiens
taatttctaattcattttcagt

SEQ ID NO: 8206153 - DNA, 22 bp, Homo sapiens
taatttcaccgttgctagaaat

SEQ ID NO: 8206154 - DNA, 22 bp, Homo sapiens
taatttcaccgttgctagaaat

SEQ ID NO: 8206155 - DNA, 22 bp, Homo sapiens
taatttcactgatatgaagtca

SEQ ID NO: 8206156 - DNA, 22 bp, Homo sapiens
taatttcactgatatgaagtca

SEQ ID NO: 8206157 - DNA, 22 bp, Homo sapiens
taatttcactgatatgaagtca

SEQ ID NO: 8206158 - DNA, 22 bp, Homo sapiens
taatttcactgatatgaagtca

SEQ ID NO: 8206159 - DNA, 23 bp, Homo sapiens
taatgagaagctttgtttcctga

SEQ ID NO: 8206160 - DNA, 22 bp, Homo sapiens
taatgaggaaatagagggaatg

SEQ ID NO: 8206161 - DNA, 22 bp, Homo sapiens
taatgaatgagaatataacaga

SEQ ID NO: 8206162 - DNA, 22 bp, Homo sapiens
taatgaataaacttgagagtca

SEQ ID NO: 8206163 - DNA, 22 bp, Homo sapiens
taatgaataaacttgagagtca

SEQ ID NO: 8206164 - DNA, 22 bp, Homo sapiens
taataacaattgtaggacatga

SEQ ID NO: 8206165 - DNA, 19 bp, Homo sapiens
taataagcaatatggaagt

SEQ ID NO: 8206166 - DNA, 22 bp, Homo sapiens
taatgatatttcccatttctct

SEQ ID NO: 8206167 - DNA, 22 bp, Homo sapiens
taatgatatttcccatttctct

SEQ ID NO: 8206168 - DNA, 22 bp, Homo sapiens
taatgcaaggaattccaagtag

SEQ ID NO: 8206169 - DNA, 22 bp, Homo sapiens
taatgccacctacctgctttat

SEQ ID NO: 8206170 - DNA, 22 bp, Homo sapiens
taatgcacagaattgacatggg

SEQ ID NO: 8206171 - DNA, 22 bp, Homo sapiens
taagttttaagcaatctgataa

SEQ ID NO: 8206172 - DNA, 22 bp, Homo sapiens
taataaatgaaagtgctggcat

SEQ ID NO: 8206173 - DNA, 22 bp, Homo sapiens
taataaatgaaagtgctggcat

SEQ ID NO: 8206174 - DNA, 22 bp, Homo sapiens
taataacaattgtaggacatga

SEQ ID NO: 8206175 - DNA, 22 bp, Homo sapiens
taataacaattgtaggacatga

SEQ ID NO: 8206176 - DNA, 22 bp, Homo sapiens
taataacaattgtaggacatga

SEQ ID NO: 8206177 - DNA, 22 bp, Homo sapiens
taagtttaagtcatgtttgatg

SEQ ID NO: 8206178 - DNA, 22 bp, Homo sapiens
taagtttaagtcatgtttgatg

SEQ ID NO: 8206179 - DNA, 22 bp, Homo sapiens
taagtttaagtcatgtttgatg

SEQ ID NO: 8206180 - DNA, 22 bp, Homo sapiens
taagtttaccactttcagaatt

SEQ ID NO: 8206181 - DNA, 22 bp, Homo sapiens
taagttctgagtaaatactgtt

SEQ ID NO: 8206182 - DNA, 22 bp, Homo sapiens
taagttgattataaccactgga

SEQ ID NO: 8206183 - DNA, 22 bp, Homo sapiens
taagttctgagtaaatactgtt

SEQ ID NO: 8206184 - DNA, 22 bp, Homo sapiens
taagtttaaatgtacatgaagc

SEQ ID NO: 8206185 - DNA, 22 bp, Homo sapiens
taagtttaaatgtacatgaagc

SEQ ID NO: 8206186 - DNA, 22 bp, Homo sapiens
taagttggcaataatactgtaa

SEQ ID NO: 8206187 - DNA, 18 bp, Homo sapiens
taagcaatgacattgcaa

SEQ ID NO: 8206188 - DNA, 22 bp, Homo sapiens
taagcaatgagataatcatggg

SEQ ID NO: 8206189 - DNA, 20 bp, Homo sapiens
taagcacatgaacagtcctc

SEQ ID NO: 8206190 - DNA, 22 bp, Homo sapiens
taagcaatgagataatcatggg

SEQ ID NO: 8206191 - DNA, 22 bp, Homo sapiens
taagcagatgctgtctgcacaa

SEQ ID NO: 8206192 - DNA, 22 bp, Homo sapiens
taagcagtttttcttgtattaa

SEQ ID NO: 8206193 - DNA, 22 bp, Homo sapiens
taagcactttatatgctttatc

SEQ ID NO: 8206194 - DNA, 22 bp, Homo sapiens
taagcagaaaaagtgggagtta

SEQ ID NO: 8206195 - DNA, 22 bp, Homo sapiens
taagcagagccctctttattag

SEQ ID NO: 8206196 - DNA, 22 bp, Homo sapiens
taagcatacattctctcctttc

SEQ ID NO: 8206197 - DNA, 22 bp, Homo sapiens
taagcataagatacatgagaca

SEQ ID NO: 8206198 - DNA, 22 bp, Homo sapiens
taagcataagatacatgagaca

SEQ ID NO: 8206199 - DNA, 22 bp, Homo sapiens
taagcataactaaaaatgattt

SEQ ID NO: 8206200 - DNA, 22 bp, Homo sapiens
taagcataactaaaaatgattt

SEQ ID NO: 8206201 - DNA, 22 bp, Homo sapiens
taagcataagatacatgagaca

SEQ ID NO: 8206202 - DNA, 22 bp, Homo sapiens
taagttacctgttttgtcatca

SEQ ID NO: 8206203 - DNA, 22 bp, Homo sapiens
taagttagccctattaaattaa

SEQ ID NO: 8206204 - DNA, 22 bp, Homo sapiens
taagttagatcttaattaaagt

SEQ ID NO: 8206205 - DNA, 22 bp, Homo sapiens
taagttagagcacaattcttac

SEQ ID NO: 8206206 - DNA, 22 bp, Homo sapiens
taagcatagtaccgtagcagct

SEQ ID NO: 8206207 - DNA, 22 bp, Homo sapiens
taagttatcggagtgtgtttca

SEQ ID NO: 8206208 - DNA, 22 bp, Homo sapiens
tacacatgacagtggactgaga

SEQ ID NO: 8206209 - DNA, 22 bp, Homo sapiens
tacacatctggtgtgactgcca

SEQ ID NO: 8206210 - DNA, 22 bp, Homo sapiens
tacacatctggagaagccctgt

SEQ ID NO: 8206211 - DNA, 22 bp, Homo sapiens
tacacatccttctgaacaacct

SEQ ID NO: 8206212 - DNA, 22 bp, Homo sapiens
tacacatctctgtcagtagtga

SEQ ID NO: 8206213 - DNA, 22 bp, Homo sapiens
tacacatcactgtatctttcag

SEQ ID NO: 8206214 - DNA, 22 bp, Homo sapiens
tacacatcatacactgggatta

SEQ ID NO: 8206215 - DNA, 22 bp, Homo sapiens
tacacatccatgttttgacttt

SEQ ID NO: 8206216 - DNA, 22 bp, Homo sapiens
tacacatatgtgtgtatatgtg

SEQ ID NO: 8206217 - DNA, 22 bp, Homo sapiens
tacacatcaacctggctttggc

SEQ ID NO: 8206218 - DNA, 22 bp, Homo sapiens
tacacatatgtgtgtatatgtg

SEQ ID NO: 8206219 - DNA, 22 bp, Homo sapiens
tacacatatgtgtgtatatgtg

SEQ ID NO: 8206220 - DNA, 22 bp, Homo sapiens
tacacatatgtccattaatcag

SEQ ID NO: 8206221 - DNA, 22 bp, Homo sapiens
tacacatatgtccattaatcag

SEQ ID NO: 8206222 - DNA, 22 bp, Homo sapiens
tacacatatgtccattaatcag

SEQ ID NO: 8206223 - DNA, 22 bp, Homo sapiens
tacaatttagtggtgtgtggtt

SEQ ID NO: 8206224 - DNA, 22 bp, Homo sapiens
tacaatttagtggtgtgtggtt

SEQ ID NO: 8206225 - DNA, 22 bp, Homo sapiens
tacaatttagtggtgtgtggtt

SEQ ID NO: 8206226 - DNA, 19 bp, Homo sapiens
tacaattggctttccattg

SEQ ID NO: 8206227 - DNA, 22 bp, Homo sapiens
tacacaaaggcactctgttgtt

SEQ ID NO: 8206228 - DNA, 22 bp, Homo sapiens
tacacaaaggcactctgttgtt

SEQ ID NO: 8206229 - DNA, 22 bp, Homo sapiens
tacacaaaggcactctgttgtt

SEQ ID NO: 8206230 - DNA, 22 bp, Homo sapiens
tacacaaaggcactctgttgtt

SEQ ID NO: 8206231 - DNA, 22 bp, Homo sapiens
tacaattactcagctctgctgt

SEQ ID NO: 8206232 - DNA, 22 bp, Homo sapiens
tacaatgttcctagcaggaaag

SEQ ID NO: 8206233 - DNA, 22 bp, Homo sapiens
tacaatgttggtaaagtatcat

SEQ ID NO: 8206234 - DNA, 22 bp, Homo sapiens
tacaatgttaaggaaagagaga

SEQ ID NO: 8206235 - DNA, 17 bp, Homo sapiens
tacaatgtgattcaatc

SEQ ID NO: 8206236 - DNA, 22 bp, Homo sapiens
tacacatgtttggcaagtatgt

SEQ ID NO: 8206237 - DNA, 22 bp, Homo sapiens
tacacatgtccaaggtgtcacc

SEQ ID NO: 8206238 - DNA, 22 bp, Homo sapiens
tacacatgtatttatgtgtaca

SEQ ID NO: 8206239 - DNA, 22 bp, Homo sapiens
tacacattctagggcacagtta

SEQ ID NO: 8206240 - DNA, 22 bp, Homo sapiens
tacacattagtgaggtattttg

SEQ ID NO: 8206241 - DNA, 22 bp, Homo sapiens
tacacattacataatactatct

SEQ ID NO: 8206242 - DNA, 22 bp, Homo sapiens
tacacattacataatactatct

SEQ ID NO: 8206243 - DNA, 22 bp, Homo sapiens
tacacattacataatactatct

SEQ ID NO: 8206244 - DNA, 22 bp, Homo sapiens
tacacattacataatactatct

SEQ ID NO: 8206245 - DNA, 22 bp, Homo sapiens
tacaccttaatcatatgtgtct

SEQ ID NO: 8206246 - DNA, 22 bp, Homo sapiens
tacacgtgtgtgtatgtacata

SEQ ID NO: 8206247 - DNA, 22 bp, Homo sapiens
tacacccttctcctgagtgtgt

SEQ ID NO: 8206248 - DNA, 22 bp, Homo sapiens
tacacccacattgagcatggga

SEQ ID NO: 8206249 - DNA, 22 bp, Homo sapiens
tacacccaggtaccgtgatttc

SEQ ID NO: 8206250 - DNA, 22 bp, Homo sapiens
tacactaaatcttcatctttta

SEQ ID NO: 8206251 - DNA, 22 bp, Homo sapiens
tacaccagattatttataacat

SEQ ID NO: 8206252 - DNA, 22 bp, Homo sapiens
tacaccagtatcttaagcatga

SEQ ID NO: 8206253 - DNA, 22 bp, Homo sapiens
tacaccagcttgcctgggctct

SEQ ID NO: 8206254 - DNA, 22 bp, Homo sapiens
tacacccacattgagcatggga

SEQ ID NO: 8206255 - DNA, 22 bp, Homo sapiens
tacacccacatgcctaggaggg

SEQ ID NO: 8206256 - DNA, 22 bp, Homo sapiens
tacaccattcccaggtggattt

SEQ ID NO: 8206257 - DNA, 21 bp, Homo sapiens
tacaccagtttacacttcctc

SEQ ID NO: 8206258 - DNA, 22 bp, Homo sapiens
taatttcttcatctctgcagct

SEQ ID NO: 8206259 - DNA, 22 bp, Homo sapiens
taatttctaattcattttcagt

SEQ ID NO: 8206260 - DNA, 22 bp, Homo sapiens
taatttctggagggagaaagag

SEQ ID NO: 8206261 - DNA, 22 bp, Homo sapiens
taatttgaatctcgctatttta

SEQ ID NO: 8206262 - DNA, 22 bp, Homo sapiens
taatttcttcatctctgcagct

SEQ ID NO: 8206263 - DNA, 22 bp, Homo sapiens
taattttaactgtgctgtttgg

SEQ ID NO: 8206264 - DNA, 22 bp, Homo sapiens
taattttacttcctgagcacct

SEQ ID NO: 8206265 - DNA, 22 bp, Homo sapiens
taattttacttcctgagcacct

SEQ ID NO: 8206266 - DNA, 23 bp, Homo sapiens
taattttagccttacaggaccct

SEQ ID NO: 8206267 - DNA, 22 bp, Homo sapiens
taattttaatagtatgtggcat

SEQ ID NO: 8206268 - DNA, 22 bp, Homo sapiens
taattttgtcacagtgacatgc

SEQ ID NO: 8206269 - DNA, 22 bp, Homo sapiens
taattttgtccccctgcacata

SEQ ID NO: 8206270 - DNA, 22 bp, Homo sapiens
taattttgtattgccattgtag

SEQ ID NO: 8206271 - DNA, 22 bp, Homo sapiens
taattttgtcacagtgacatgc

SEQ ID NO: 8206272 - DNA, 22 bp, Homo sapiens
taattttgtattgccattgtag

SEQ ID NO: 8206273 - DNA, 22 bp, Homo sapiens
taattttgctgtgaccattgaa

SEQ ID NO: 8206274 - DNA, 22 bp, Homo sapiens
taattttgctgtgaccattgaa

SEQ ID NO: 8206275 - DNA, 22 bp, Homo sapiens
taattttccactctgtttatct

SEQ ID NO: 8206276 - DNA, 22 bp, Homo sapiens
taattttccactctgtttatct

SEQ ID NO: 8206277 - DNA, 22 bp, Homo sapiens
taattttatgacagtgtatttt

SEQ ID NO: 8206278 - DNA, 22 bp, Homo sapiens
taattttatgacagtgtatttt

SEQ ID NO: 8206279 - DNA, 22 bp, Homo sapiens
tacaatgaccatattatgtaag

SEQ ID NO: 8206280 - DNA, 22 bp, Homo sapiens
tacaatgaccatattatgtaag

SEQ ID NO: 8206281 - DNA, 22 bp, Homo sapiens
tacaatgactctcagtttggct

SEQ ID NO: 8206282 - DNA, 22 bp, Homo sapiens
tacaatcaggctctagcttctc

SEQ ID NO: 8206283 - DNA, 22 bp, Homo sapiens
tacaatcaggataataatagtg

SEQ ID NO: 8206284 - DNA, 22 bp, Homo sapiens
tacaatgagctgtacatctcca

SEQ ID NO: 8206285 - DNA, 22 bp, Homo sapiens
tacaatgagctgagccagaggc

SEQ ID NO: 8206286 - DNA, 19 bp, Homo sapiens
tacaatgatgttacctttg

SEQ ID NO: 8206287 - DNA, 19 bp, Homo sapiens
tacaatgatgttacctttg

SEQ ID NO: 8206288 - DNA, 22 bp, Homo sapiens
tacaatgattagctaacttgcc

SEQ ID NO: 8206289 - DNA, 22 bp, Homo sapiens
tacaatgatgatactttactgg

SEQ ID NO: 8206290 - DNA, 22 bp, Homo sapiens
tacaatgagctgtacatctcca

SEQ ID NO: 8206291 - DNA, 22 bp, Homo sapiens
tacaatgatgatactttactgg

SEQ ID NO: 8206292 - DNA, 22 bp, Homo sapiens
tacaatgtaattctgattatgt

SEQ ID NO: 8206293 - DNA, 22 bp, Homo sapiens
tacaatgtaattctgattatgt

SEQ ID NO: 8206294 - DNA, 22 bp, Homo sapiens
tacaatgcaaaatactgtctgc

SEQ ID NO: 8206295 - DNA, 23 bp, Homo sapiens
tacaatgcaaacttggcccatgg

SEQ ID NO: 8206296 - DNA, 22 bp, Homo sapiens
tacaatgcagtgacctccttta

SEQ ID NO: 8206297 - DNA, 22 bp, Homo sapiens
tacaatgcattcgttgtctcgg

SEQ ID NO: 8206298 - DNA, 22 bp, Homo sapiens
taatttttccacgtacactggg

SEQ ID NO: 8206299 - DNA, 22 bp, Homo sapiens
taatttttccacgtacactggg

SEQ ID NO: 8206300 - DNA, 19 bp, Homo sapiens
tacaagcttaaagtaatgt

SEQ ID NO: 8206301 - DNA, 19 bp, Homo sapiens
tacaagcttaaagtaatgt

SEQ ID NO: 8206302 - DNA, 19 bp, Homo sapiens
tacaagcttaaagtaatgt

SEQ ID NO: 8206303 - DNA, 22 bp, Homo sapiens
tacaagctggcgcagttaagat

SEQ ID NO: 8206304 - DNA, 19 bp, Homo sapiens
tacaagcttaaagtaatgt

SEQ ID NO: 8206305 - DNA, 22 bp, Homo sapiens
tacaagctgaccctgaagatga

SEQ ID NO: 8206306 - DNA, 22 bp, Homo sapiens
tacaagctggcgcagttaagat

SEQ ID NO: 8206307 - DNA, 22 bp, Homo sapiens
tacaagctcgggcagctcatta

SEQ ID NO: 8206308 - DNA, 22 bp, Homo sapiens
tacaagctgaccctgaagatga

SEQ ID NO: 8206309 - DNA, 22 bp, Homo sapiens
tacaagctgaccctgaagatga

SEQ ID NO: 8206310 - DNA, 22 bp, Homo sapiens
tacaagctcacaaatttttaag

SEQ ID NO: 8206311 - DNA, 22 bp, Homo sapiens
tacaagctcacaaatttttaag

SEQ ID NO: 8206312 - DNA, 22 bp, Homo sapiens
tacaatatgtggccttttgtga

SEQ ID NO: 8206313 - DNA, 22 bp, Homo sapiens
tacaagcttttgtgtataaatg

SEQ ID NO: 8206314 - DNA, 22 bp, Homo sapiens
tacaatatgtggccttttgtga

SEQ ID NO: 8206315 - DNA, 22 bp, Homo sapiens
tacaagcttttgtgtataaatg

SEQ ID NO: 8206316 - DNA, 22 bp, Homo sapiens
tacaatatgtggccttttgtga

SEQ ID NO: 8206317 - DNA, 20 bp, Homo sapiens
tacaatattcccactttgct

SEQ ID NO: 8206318 - DNA, 20 bp, Homo sapiens
tacaatattcccactttgct

SEQ ID NO: 8206319 - DNA, 20 bp, Homo sapiens
tacaatattcccactttgct

SEQ ID NO: 8206320 - DNA, 20 bp, Homo sapiens
tacaatattcccactttgct

SEQ ID NO: 8206321 - DNA, 22 bp, Homo sapiens
tacaatcacccaaagagccaga

SEQ ID NO: 8206322 - DNA, 22 bp, Homo sapiens
gtttctcagtttggtctgcaga

SEQ ID NO: 8206323 - DNA, 18 bp, Homo sapiens
gtttctcccaggcggggc

SEQ ID NO: 8206324 - DNA, 22 bp, Homo sapiens
gtttctcctctgtgtcttgttt

SEQ ID NO: 8206325 - DNA, 22 bp, Homo sapiens
gtttctcctctgtgtcttgttt

SEQ ID NO: 8206326 - DNA, 22 bp, Homo sapiens
gtttctgaagggattacttggt

SEQ ID NO: 8206327 - DNA, 22 bp, Homo sapiens
gtttctctttgaagcctggctg

SEQ ID NO: 8206328 - DNA, 22 bp, Homo sapiens
gtttctcttaacacataaagta

SEQ ID NO: 8206329 - DNA, 22 bp, Homo sapiens
gtttctcttaacacataaagta

SEQ ID NO: 8206330 - DNA, 22 bp, Homo sapiens
gtttctgattctagaggcaggc

SEQ ID NO: 8206331 - DNA, 22 bp, Homo sapiens
gtttctgtgttagatgagtctt

SEQ ID NO: 8206332 - DNA, 22 bp, Homo sapiens
gtttcttaaatgtagcaggacc

SEQ ID NO: 8206333 - DNA, 22 bp, Homo sapiens
gtttcttaaatgtagcaggacc

SEQ ID NO: 8206334 - DNA, 22 bp, Homo sapiens
gtttcttaagttacaaaatctt

SEQ ID NO: 8206335 - DNA, 23 bp, Homo sapiens
gttttacaggtgagaaaatggag

SEQ ID NO: 8206336 - DNA, 22 bp, Homo sapiens
gttttacacacctatgaaagac

SEQ ID NO: 8206337 - DNA, 22 bp, Homo sapiens
gttttacacacctatgaaagac

SEQ ID NO: 8206338 - DNA, 22 bp, Homo sapiens
gttttacacacctatgaaagac

SEQ ID NO: 8206339 - DNA, 22 bp, Homo sapiens
gttttacaaggttaatcagcag

SEQ ID NO: 8206340 - DNA, 22 bp, Homo sapiens
gttttacaaggttaatcagcag

SEQ ID NO: 8206341 - DNA, 22 bp, Homo sapiens
gtttcctacactgtagtattat

SEQ ID NO: 8206342 - DNA, 22 bp, Homo sapiens
gtttcctaggcttatacagctg

SEQ ID NO: 8206343 - DNA, 22 bp, Homo sapiens
gtttcctagatcagtgttctta

SEQ ID NO: 8206344 - DNA, 22 bp, Homo sapiens
gtttcctaccagtggttccaga

SEQ ID NO: 8206345 - DNA, 22 bp, Homo sapiens
gtttccttttggaattagagct

SEQ ID NO: 8206346 - DNA, 22 bp, Homo sapiens
gtttatatgtgtgccactctta

SEQ ID NO: 8206347 - DNA, 22 bp, Homo sapiens
gtttatatgaacttcataccca

SEQ ID NO: 8206348 - DNA, 22 bp, Homo sapiens
gtttatatgaacttcataccca

SEQ ID NO: 8206349 - DNA, 22 bp, Homo sapiens
gtttataaggtaaaggagagag

SEQ ID NO: 8206350 - DNA, 22 bp, Homo sapiens
gtttataaggtaaaggagagag

SEQ ID NO: 8206351 - DNA, 22 bp, Homo sapiens
gtttctacatgcctctttcacc

SEQ ID NO: 8206352 - DNA, 22 bp, Homo sapiens
gtttctaattggaactttgagg

SEQ ID NO: 8206353 - DNA, 22 bp, Homo sapiens
gtttctaagcacatgtgagtgt

SEQ ID NO: 8206354 - DNA, 22 bp, Homo sapiens
gtttcctttttctgccctcaat

SEQ ID NO: 8206355 - DNA, 22 bp, Homo sapiens
gtttctaaatgttctgagtttt

SEQ ID NO: 8206356 - DNA, 22 bp, Homo sapiens
gtttctaaatgttctgagtttt

SEQ ID NO: 8206357 - DNA, 22 bp, Homo sapiens
gtttctcagtttggtctgcaga

SEQ ID NO: 8206358 - DNA, 22 bp, Homo sapiens
gtttctatggtttatattactg

SEQ ID NO: 8206359 - DNA, 22 bp, Homo sapiens
gttccacaaaatgtacccagtt

SEQ ID NO: 8206360 - DNA, 22 bp, Homo sapiens
gttccagacttgccagtggaag

SEQ ID NO: 8206361 - DNA, 22 bp, Homo sapiens
gttccaggaccctggcctctga

SEQ ID NO: 8206362 - DNA, 22 bp, Homo sapiens
gttccaggaccctggcctctga

SEQ ID NO: 8206363 - DNA, 22 bp, Homo sapiens
gttccaggcaagtgggatagga

SEQ ID NO: 8206364 - DNA, 18 bp, Homo sapiens
gttcccagatggtgctga

SEQ ID NO: 8206365 - DNA, 18 bp, Homo sapiens
gttcccagatggtgctga

SEQ ID NO: 8206366 - DNA, 20 bp, Homo sapiens
gttcccaggaattgaagacc

SEQ ID NO: 8206367 - DNA, 20 bp, Homo sapiens
gttcccaggaattgaagacc

SEQ ID NO: 8206368 - DNA, 22 bp, Homo sapiens
gttccaggtggtcacagagctc

SEQ ID NO: 8206369 - DNA, 22 bp, Homo sapiens
gttccaggcagtggcaacagct

SEQ ID NO: 8206370 - DNA, 22 bp, Homo sapiens
gttccaggtggtcacagagctc

SEQ ID NO: 8206371 - DNA, 22 bp, Homo sapiens
gttccaggtggtcacagagctc

SEQ ID NO: 8206372 - DNA, 22 bp, Homo sapiens
gtttaattttaggttgtcaagc

SEQ ID NO: 8206373 - DNA, 22 bp, Homo sapiens
gttcgcatcttgatcatggact

SEQ ID NO: 8206374 - DNA, 22 bp, Homo sapiens
gtttaattttaggttgtcaagc

SEQ ID NO: 8206375 - DNA, 22 bp, Homo sapiens
gttccttgtaatttgttaagga

SEQ ID NO: 8206376 - DNA, 22 bp, Homo sapiens
gttccttgtatttcagacatga

SEQ ID NO: 8206377 - DNA, 22 bp, Homo sapiens
gttcctggtggtcatggcagct

SEQ ID NO: 8206378 - DNA, 22 bp, Homo sapiens
gttcctgggcctgcattcacca

SEQ ID NO: 8206379 - DNA, 22 bp, Homo sapiens
gttcctgggaggcatgggctgg

SEQ ID NO: 8206380 - DNA, 22 bp, Homo sapiens
gttcctggtggtcatggcagct

SEQ ID NO: 8206381 - DNA, 22 bp, Homo sapiens
gttcctggtggtcatggcagct

SEQ ID NO: 8206382 - DNA, 22 bp, Homo sapiens
gttccttgggaacaacgctgaa

SEQ ID NO: 8206383 - DNA, 22 bp, Homo sapiens
gttccttcctatcccgagagcc

SEQ ID NO: 8206384 - DNA, 23 bp, Homo sapiens
gttccttcatgtggtcattggtt

SEQ ID NO: 8206385 - DNA, 23 bp, Homo sapiens
gttccttcatgtggtcattggtt

SEQ ID NO: 8206386 - DNA, 16 bp, Homo sapiens
gttccttcccacacct

SEQ ID NO: 8206387 - DNA, 22 bp, Homo sapiens
gttccttggaagaacttgaggt

SEQ ID NO: 8206388 - DNA, 22 bp, Homo sapiens
gtttagcaataaaaacacatga

SEQ ID NO: 8206389 - DNA, 22 bp, Homo sapiens
gtttataaggcccaatatttct

SEQ ID NO: 8206390 - DNA, 22 bp, Homo sapiens
gtttagaatgaaacttttgagc

SEQ ID NO: 8206391 - DNA, 22 bp, Homo sapiens
gtttagaatggcaaaattaagt

SEQ ID NO: 8206392 - DNA, 22 bp, Homo sapiens
gtttagaatggcaaaattaagt

SEQ ID NO: 8206393 - DNA, 22 bp, Homo sapiens
gtttagaattctaactttaagg

SEQ ID NO: 8206394 - DNA, 22 bp, Homo sapiens
gtttagatttcatgaagacact

SEQ ID NO: 8206395 - DNA, 22 bp, Homo sapiens
gtttagatgagattttagaaca

SEQ ID NO: 8206396 - DNA, 22 bp, Homo sapiens
gtttacaaatattttaaatggt

SEQ ID NO: 8206397 - DNA, 22 bp, Homo sapiens
gtttacaaatattttaaatggt

SEQ ID NO: 8206398 - DNA, 22 bp, Homo sapiens
gtttacattgctgtttgtgtct

SEQ ID NO: 8206399 - DNA, 22 bp, Homo sapiens
gtttacaaatattttaaatggt

SEQ ID NO: 8206400 - DNA, 22 bp, Homo sapiens
gtttacttagatgctcatgcag

SEQ ID NO: 8206401 - DNA, 21 bp, Homo sapiens
gtttagaagtagtctggctca

SEQ ID NO: 8206402 - DNA, 22 bp, Homo sapiens
gtttagaagccaagatttgggt

SEQ ID NO: 8206403 - DNA, 22 bp, Homo sapiens
gtttagaacacggaaatactga

SEQ ID NO: 8206404 - DNA, 22 bp, Homo sapiens
gtttagaacacggaaatactga

SEQ ID NO: 8206405 - DNA, 22 bp, Homo sapiens
gtttagaaaatagtgaagcaag

SEQ ID NO: 8206406 - DNA, 22 bp, Homo sapiens
gtttacttgtgccttggcttaa

SEQ ID NO: 8206407 - DNA, 22 bp, Homo sapiens
gttactcttgagaggctgaggt

SEQ ID NO: 8206408 - DNA, 22 bp, Homo sapiens
gttagaaagtgtctgcttgggt

SEQ ID NO: 8206409 - DNA, 22 bp, Homo sapiens
gttactcttccccggggtctgg

SEQ ID NO: 8206410 - DNA, 22 bp, Homo sapiens
gttacaaatgccaaagctgaga

SEQ ID NO: 8206411 - DNA, 22 bp, Homo sapiens
gttacaaaggtcataaaagtgt

SEQ ID NO: 8206412 - DNA, 20 bp, Homo sapiens
gttaggaggttggacatgga

SEQ ID NO: 8206413 - DNA, 22 bp, Homo sapiens
gttagggagtcaggtggctctt

SEQ ID NO: 8206414 - DNA, 22 bp, Homo sapiens
gttaggtagaagtttactttga

SEQ ID NO: 8206415 - DNA, 22 bp, Homo sapiens
gttagcacaaccaagaaatgcg

SEQ ID NO: 8206416 - DNA, 22 bp, Homo sapiens
gttccaaacaagtcataaagta

SEQ ID NO: 8206417 - DNA, 22 bp, Homo sapiens
gttccaaagtctctgagctgag

SEQ ID NO: 8206418 - DNA, 22 bp, Homo sapiens
gttccaaatttggatctttagg

SEQ ID NO: 8206419 - DNA, 22 bp, Homo sapiens
gttcatttttactttgatctac

SEQ ID NO: 8206420 - DNA, 22 bp, Homo sapiens
gttcatttttactttgatctac

SEQ ID NO: 8206421 - DNA, 23 bp, Homo sapiens
gttcattttattgtctgattgct

SEQ ID NO: 8206422 - DNA, 23 bp, Homo sapiens
gttcattttattgtctgattgct

SEQ ID NO: 8206423 - DNA, 23 bp, Homo sapiens
gttcattttattgtctgattgct

SEQ ID NO: 8206424 - DNA, 22 bp, Homo sapiens
gttcatttttccctaatgagta

SEQ ID NO: 8206425 - DNA, 22 bp, Homo sapiens
gttcatttttccctaatgagta

SEQ ID NO: 8206426 - DNA, 22 bp, Homo sapiens
gttcatttttccctaatgagta

SEQ ID NO: 8206427 - DNA, 22 bp, Homo sapiens
gttcatttttccctaatgagta

SEQ ID NO: 8206428 - DNA, 22 bp, Homo sapiens
gttcatttttagaatgctagta

SEQ ID NO: 8206429 - DNA, 22 bp, Homo sapiens
gttataaatacctaataggatt

SEQ ID NO: 8206430 - DNA, 22 bp, Homo sapiens
gttataaatacctaataggatt

SEQ ID NO: 8206431 - DNA, 22 bp, Homo sapiens
gttcattttactgtaaatagca

SEQ ID NO: 8206432 - DNA, 22 bp, Homo sapiens
gttcattttactgtaaatagca

SEQ ID NO: 8206433 - DNA, 22 bp, Homo sapiens
gttcattttactgtaaatagca

SEQ ID NO: 8206434 - DNA, 22 bp, Homo sapiens
gttataaaggtgataatggtca

SEQ ID NO: 8206435 - DNA, 22 bp, Homo sapiens
gttataaaggtgataatggtca

SEQ ID NO: 8206436 - DNA, 22 bp, Homo sapiens
gttataaaggtgataatggtca

SEQ ID NO: 8206437 - DNA, 22 bp, Homo sapiens
gttataaaatgcacagttgttt

SEQ ID NO: 8206438 - DNA, 22 bp, Homo sapiens
gttataaaatgcacagttgttt

SEQ ID NO: 8206439 - DNA, 22 bp, Homo sapiens
gttataaaatgcacagttgttt

SEQ ID NO: 8206440 - DNA, 22 bp, Homo sapiens
gttagtgcttattaaatagtat

SEQ ID NO: 8206441 - DNA, 22 bp, Homo sapiens
gttagtgtgactgaggaatgca

SEQ ID NO: 8206442 - DNA, 22 bp, Homo sapiens
gttagtgtatattgccttcaaa

SEQ ID NO: 8206443 - DNA, 22 bp, Homo sapiens
gtgtgtgtgcatataacatata

SEQ ID NO: 8206444 - DNA, 22 bp, Homo sapiens
gtgtgtgtgcatataacatata

SEQ ID NO: 8206445 - DNA, 22 bp, Homo sapiens
gtgtgtgtctccgcggccgtag

SEQ ID NO: 8206446 - DNA, 22 bp, Homo sapiens
gtgtgtgtatctgcctatcaca

SEQ ID NO: 8206447 - DNA, 22 bp, Homo sapiens
gtgtgtgtctccgcggccgtag

SEQ ID NO: 8206448 - DNA, 22 bp, Homo sapiens
gtgtgtgtatctgcctatcaca

SEQ ID NO: 8206449 - DNA, 22 bp, Homo sapiens
gtgtgtccttgggcctctgcag

SEQ ID NO: 8206450 - DNA, 22 bp, Homo sapiens
gtgtgtcctcttaactattatg

SEQ ID NO: 8206451 - DNA, 22 bp, Homo sapiens
gtgtgtcctcataagatggagg

SEQ ID NO: 8206452 - DNA, 22 bp, Homo sapiens
gtgtgtcctgttttaaaatagt

SEQ ID NO: 8206453 - DNA, 19 bp, Homo sapiens
gtgctttttaagagctcag

SEQ ID NO: 8206454 - DNA, 22 bp, Homo sapiens
gtgctttaataagatttcactt

SEQ ID NO: 8206455 - DNA, 22 bp, Homo sapiens
gtgctttaaagacagttatgct

SEQ ID NO: 8206456 - DNA, 22 bp, Homo sapiens
gtgctttactggcagtgatgta

SEQ ID NO: 8206457 - DNA, 22 bp, Homo sapiens
gtgctttctgcatggttcctac

SEQ ID NO: 8206458 - DNA, 22 bp, Homo sapiens
gtgctttctgctgcattcctct

SEQ ID NO: 8206459 - DNA, 22 bp, Homo sapiens
gtgctttccatcctccctgctg

SEQ ID NO: 8206460 - DNA, 22 bp, Homo sapiens
gtgcttttaaaggcaattagta

SEQ ID NO: 8206461 - DNA, 21 bp, Homo sapiens
gtgcttttccttaatgttctt

SEQ ID NO: 8206462 - DNA, 22 bp, Homo sapiens
gtgtgtgttcaataaatttaag

SEQ ID NO: 8206463 - DNA, 22 bp, Homo sapiens
gtgtgtgttcaataaatttaag

SEQ ID NO: 8206464 - DNA, 22 bp, Homo sapiens
gtgtgtttcagaagccaggtgt

SEQ ID NO: 8206465 - DNA, 22 bp, Homo sapiens
gtgtgtttagcattagcagggg

SEQ ID NO: 8206466 - DNA, 22 bp, Homo sapiens
gtgtgttcgtatcaacagagga

SEQ ID NO: 8206467 - DNA, 22 bp, Homo sapiens
gtgtgtgtgtaaaaatccagag

SEQ ID NO: 8206468 - DNA, 22 bp, Homo sapiens
gtgtgtgtgtaaaaatccagag

SEQ ID NO: 8206469 - DNA, 22 bp, Homo sapiens
gtgtgtgtgcctgcacacacac

SEQ ID NO: 8206470 - DNA, 22 bp, Homo sapiens
gtgtgtgtgcctgcacacacac

SEQ ID NO: 8206471 - DNA, 22 bp, Homo sapiens
gtgtgtgtgcatctcttttatt

SEQ ID NO: 8206472 - DNA, 22 bp, Homo sapiens
gtgtgtgtgcatctcttttatt

SEQ ID NO: 8206473 - DNA, 22 bp, Homo sapiens
gtgttaaacatgttcacagcat

SEQ ID NO: 8206474 - DNA, 22 bp, Homo sapiens
gtgttaaatgcaatcacatgca

SEQ ID NO: 8206475 - DNA, 22 bp, Homo sapiens
gtgttaaatgcaatcacatgca

SEQ ID NO: 8206476 - DNA, 22 bp, Homo sapiens
gtgttaaatttctaatttgtga

SEQ ID NO: 8206477 - DNA, 22 bp, Homo sapiens
gtgttaaccagctaaactttgc

SEQ ID NO: 8206478 - DNA, 22 bp, Homo sapiens
gtgttaaatttctaatttgtga

SEQ ID NO: 8206479 - DNA, 22 bp, Homo sapiens
gtgttacagtaccttgtcacaa

SEQ ID NO: 8206480 - DNA, 22 bp, Homo sapiens
gtgttaaccagctaaactttgc

SEQ ID NO: 8206481 - DNA, 22 bp, Homo sapiens
gttttcagccaggagcacattt

SEQ ID NO: 8206482 - DNA, 22 bp, Homo sapiens
gttttcagccaggagcacattt

SEQ ID NO: 8206483 - DNA, 22 bp, Homo sapiens
gttttcagccaggagcacattt

SEQ ID NO: 8206484 - DNA, 21 bp, Homo sapiens
gttttcatgatagagtctgta

SEQ ID NO: 8206485 - DNA, 22 bp, Homo sapiens
gttttcaaggggatttaactga

SEQ ID NO: 8206486 - DNA, 22 bp, Homo sapiens
gttttcaattataagatggctt

SEQ ID NO: 8206487 - DNA, 16 bp, Homo sapiens
taaacagcagacagtt

SEQ ID NO: 8206488 - DNA, 22 bp, Homo sapiens
taaacagcctcccctttcactc

SEQ ID NO: 8206489 - DNA, 22 bp, Homo sapiens
taaacagcctcccctttcactc

SEQ ID NO: 8206490 - DNA, 22 bp, Homo sapiens
taaacagcctaaaactttcttt

SEQ ID NO: 8206491 - DNA, 22 bp, Homo sapiens
taaacagcctaaaactttcttt

SEQ ID NO: 8206492 - DNA, 22 bp, Homo sapiens
taaacagagtgctagttcacgg

SEQ ID NO: 8206493 - DNA, 21 bp, Homo sapiens
taaacataaccttgtatggct

SEQ ID NO: 8206494 - DNA, 22 bp, Homo sapiens
taaacagttaacatgccagaat

SEQ ID NO: 8206495 - DNA, 22 bp, Homo sapiens
taaacatcagtacaaagactaa

SEQ ID NO: 8206496 - DNA, 22 bp, Homo sapiens
taaacatcaccttctgcagttg

SEQ ID NO: 8206497 - DNA, 22 bp, Homo sapiens
taaacagctactgtgtcaaagg

SEQ ID NO: 8206498 - DNA, 20 bp, Homo sapiens
taaacagtatttactaggag

SEQ ID NO: 8206499 - DNA, 22 bp, Homo sapiens
taaacagtgatacgttccagct

SEQ ID NO: 8206500 - DNA, 22 bp, Homo sapiens
taaacagttaacatgccagaat

SEQ ID NO: 8206501 - DNA, 22 bp, Homo sapiens
taaacatctgtcatgtgtttat

SEQ ID NO: 8206502 - DNA, 22 bp, Homo sapiens
taaacatggattctgatcacag

SEQ ID NO: 8206503 - DNA, 22 bp, Homo sapiens
taaacatctgtcatgtgtttat

SEQ ID NO: 8206504 - DNA, 22 bp, Homo sapiens
taaacatgttgacatcttacct

SEQ ID NO: 8206505 - DNA, 22 bp, Homo sapiens
gttttatttccatgagagaccg

SEQ ID NO: 8206506 - DNA, 22 bp, Homo sapiens
gttttatttccatgagagaccg

SEQ ID NO: 8206507 - DNA, 22 bp, Homo sapiens
gttttatttccatgagagaccg

SEQ ID NO: 8206508 - DNA, 22 bp, Homo sapiens
gttttatttccatgagagaccg

SEQ ID NO: 8206509 - DNA, 22 bp, Homo sapiens
gttttatttccatgagagaccg

SEQ ID NO: 8206510 - DNA, 22 bp, Homo sapiens
gttttattggaacacagccatg

SEQ ID NO: 8206511 - DNA, 22 bp, Homo sapiens
gttttattggaacacagccatg

SEQ ID NO: 8206512 - DNA, 22 bp, Homo sapiens
gttttattggaacacagccatg

SEQ ID NO: 8206513 - DNA, 22 bp, Homo sapiens
gttttattggaacacagccatg

SEQ ID NO: 8206514 - DNA, 22 bp, Homo sapiens
gttttatttccatgagagaccg

SEQ ID NO: 8206515 - DNA, 22 bp, Homo sapiens
gttttatttccatgagagaccg

SEQ ID NO: 8206516 - DNA, 22 bp, Homo sapiens
gttttattggaacacagccatg

SEQ ID NO: 8206517 - DNA, 22 bp, Homo sapiens
gttttataggctgttgctatat

SEQ ID NO: 8206518 - DNA, 22 bp, Homo sapiens
gttttataattgcttcataaga

SEQ ID NO: 8206519 - DNA, 22 bp, Homo sapiens
gttttagtgggtggccactgat

SEQ ID NO: 8206520 - DNA, 22 bp, Homo sapiens
gttttatgagacctcaggaata

SEQ ID NO: 8206521 - DNA, 20 bp, Homo sapiens
gttttatgccagttctgtgt

SEQ ID NO: 8206522 - DNA, 22 bp, Homo sapiens
gttttattggaacacagccatg

SEQ ID NO: 8206523 - DNA, 22 bp, Homo sapiens
gttttattggaacacagccatg

SEQ ID NO: 8206524 - DNA, 22 bp, Homo sapiens
gttttataggtgaaatattact

SEQ ID NO: 8206525 - DNA, 17 bp, Homo sapiens
taaatacacaagggtat

SEQ ID NO: 8206526 - DNA, 17 bp, Homo sapiens
taaatacacaagggtat

SEQ ID NO: 8206527 - DNA, 21 bp, Homo sapiens
taaataataagttgctgagat

SEQ ID NO: 8206528 - DNA, 17 bp, Homo sapiens
taaatacacaagggtat

SEQ ID NO: 8206529 - DNA, 17 bp, Homo sapiens
taaatacacaagggtat

SEQ ID NO: 8206530 - DNA, 17 bp, Homo sapiens
taaatacacaagggtat

SEQ ID NO: 8206531 - DNA, 22 bp, Homo sapiens
taaataagttcttcattgtttg

SEQ ID NO: 8206532 - DNA, 22 bp, Homo sapiens
taaataagttcttcattgtttg

SEQ ID NO: 8206533 - DNA, 22 bp, Homo sapiens
taaataagttcttcattgtttg

SEQ ID NO: 8206534 - DNA, 21 bp, Homo sapiens
taaataataagttgctgagat

SEQ ID NO: 8206535 - DNA, 21 bp, Homo sapiens
taaataataagttgctgagat

SEQ ID NO: 8206536 - DNA, 22 bp, Homo sapiens
taaagtttggcagacaataaca

SEQ ID NO: 8206537 - DNA, 22 bp, Homo sapiens
taaagtttgtagcaattgatat

SEQ ID NO: 8206538 - DNA, 22 bp, Homo sapiens
taaataagtcactgaccattta

SEQ ID NO: 8206539 - DNA, 22 bp, Homo sapiens
taaataagttcttcattgtttg

SEQ ID NO: 8206540 - DNA, 22 bp, Homo sapiens
taaagtttattggcaccaccat

SEQ ID NO: 8206541 - DNA, 22 bp, Homo sapiens
taaagtttatttgaacatctct

SEQ ID NO: 8206542 - DNA, 22 bp, Homo sapiens
taaagtttatttgaacatctct

SEQ ID NO: 8206543 - DNA, 22 bp, Homo sapiens
taaagtgtgcatggtcaaatat

SEQ ID NO: 8206544 - DNA, 22 bp, Homo sapiens
taaagtgtgtatatacatatgg

SEQ ID NO: 8206545 - DNA, 22 bp, Homo sapiens
taaagaacacagggaatagcac

SEQ ID NO: 8206546 - DNA, 22 bp, Homo sapiens
taaacatgttgacatcttacct

SEQ ID NO: 8206547 - DNA, 22 bp, Homo sapiens
taacacattttcctcatacgga

SEQ ID NO: 8206548 - DNA, 22 bp, Homo sapiens
taacacatatttcaagagtagt

SEQ ID NO: 8206549 - DNA, 22 bp, Homo sapiens
taacacatatctacaacatgtg

SEQ ID NO: 8206550 - DNA, 22 bp, Homo sapiens
taacacatatttcaagagtagt

SEQ ID NO: 8206551 - DNA, 22 bp, Homo sapiens
taacacatagatattttaactt

SEQ ID NO: 8206552 - DNA, 22 bp, Homo sapiens
taacacataagctgagaccatg

SEQ ID NO: 8206553 - DNA, 22 bp, Homo sapiens
taacacagttctctgttgcaca

SEQ ID NO: 8206554 - DNA, 22 bp, Homo sapiens
taacacagttctctgttgcaca

SEQ ID NO: 8206555 - DNA, 22 bp, Homo sapiens
taacacagtgtcctcagaaaca

SEQ ID NO: 8206556 - DNA, 17 bp, Homo sapiens
taacacaggctcagaga

SEQ ID NO: 8206557 - DNA, 17 bp, Homo sapiens
taacacaggctcagaga

SEQ ID NO: 8206558 - DNA, 22 bp, Homo sapiens
taacacagagttttaaatgtgg

SEQ ID NO: 8206559 - DNA, 22 bp, Homo sapiens
taacacagagtaagtggtcaat

SEQ ID NO: 8206560 - DNA, 22 bp, Homo sapiens
taacacaaaagaatatgtgtgt

SEQ ID NO: 8206561 - DNA, 22 bp, Homo sapiens
taacaatgattagtgactacag

SEQ ID NO: 8206562 - DNA, 22 bp, Homo sapiens
taacaatgattagtgactacag

SEQ ID NO: 8206563 - DNA, 22 bp, Homo sapiens
taacaatggttttgctgataat

SEQ ID NO: 8206564 - DNA, 22 bp, Homo sapiens
taacaatggagttttgagaaag

SEQ ID NO: 8206565 - DNA, 22 bp, Homo sapiens
taacaatgggaaggactgatga

SEQ ID NO: 8206566 - DNA, 22 bp, Homo sapiens
taaatacttagttttgtgtcta

SEQ ID NO: 8206567 - DNA, 22 bp, Homo sapiens
taaatttttgttaacagcctct

SEQ ID NO: 8206568 - DNA, 22 bp, Homo sapiens
taaatactttacaggatgtctc

SEQ ID NO: 8206569 - DNA, 22 bp, Homo sapiens
taaatacagtcatttgagccat

SEQ ID NO: 8206570 - DNA, 22 bp, Homo sapiens
taaatactgagttggagttggc

SEQ ID NO: 8206571 - DNA, 22 bp, Homo sapiens
taacaatagtgtttgctagtca

SEQ ID NO: 8206572 - DNA, 22 bp, Homo sapiens
taacttctgcacagaaaatttg

SEQ ID NO: 8206573 - DNA, 22 bp, Homo sapiens
taacttctggaaatgcatctgc

SEQ ID NO: 8206574 - DNA, 22 bp, Homo sapiens
taacttctggaaatgcatctgc

SEQ ID NO: 8206575 - DNA, 22 bp, Homo sapiens
taagaaactaatgcaataagag

SEQ ID NO: 8206576 - DNA, 22 bp, Homo sapiens
taagaaatttagttatagaatg

SEQ ID NO: 8206577 - DNA, 22 bp, Homo sapiens
taagaaatttagttatagaatg

SEQ ID NO: 8206578 - DNA, 22 bp, Homo sapiens
taagaaatttagttatagaatg

SEQ ID NO: 8206579 - DNA, 22 bp, Homo sapiens
taacttctgaatagcaatagta

SEQ ID NO: 8206580 - DNA, 22 bp, Homo sapiens
taacttctctgctatcatagga

SEQ ID NO: 8206581 - DNA, 22 bp, Homo sapiens
taacttctctgctatcatagga

SEQ ID NO: 8206582 - DNA, 22 bp, Homo sapiens
taacttcagcgagttctcttaa

SEQ ID NO: 8206583 - DNA, 22 bp, Homo sapiens
taactgtcacttctgcacatct

SEQ ID NO: 8206584 - DNA, 22 bp, Homo sapiens
taactgtgtgaacgtgatcatt

SEQ ID NO: 8206585 - DNA, 22 bp, Homo sapiens
taacttagaagtttaattgtat

SEQ ID NO: 8206586 - DNA, 22 bp, Homo sapiens
taacttagaagtttaattgtat

SEQ ID NO: 8206587 - DNA, 22 bp, Homo sapiens
taactgtatagcttggactaaa

SEQ ID NO: 8206588 - DNA, 22 bp, Homo sapiens
taactgtatagcttggactaaa

SEQ ID NO: 8206589 - DNA, 22 bp, Homo sapiens
taactgtatagcttggactaaa

SEQ ID NO: 8206590 - DNA, 22 bp, Homo sapiens
taactgtacctagataacgaac

SEQ ID NO: 8206591 - DNA, 22 bp, Homo sapiens
taagatggcagatgagcttgtt

SEQ ID NO: 8206592 - DNA, 22 bp, Homo sapiens
taagcaacaagtggctggagga

SEQ ID NO: 8206593 - DNA, 22 bp, Homo sapiens
taagatagaactctgaggctac

SEQ ID NO: 8206594 - DNA, 22 bp, Homo sapiens
taagataatccattataatgtt

SEQ ID NO: 8206595 - DNA, 22 bp, Homo sapiens
taagatcagttcaaacatgtgt

SEQ ID NO: 8206596 - DNA, 22 bp, Homo sapiens
taagataataagtatgtctatg

SEQ ID NO: 8206597 - DNA, 22 bp, Homo sapiens
taagataataagtatgtctatg

SEQ ID NO: 8206598 - DNA, 22 bp, Homo sapiens
taagataaggaacattctgtga

SEQ ID NO: 8206599 - DNA, 22 bp, Homo sapiens
taagataagtgggttgagatgg

SEQ ID NO: 8206600 - DNA, 22 bp, Homo sapiens
taagagttactggtttagaacc

SEQ ID NO: 8206601 - DNA, 22 bp, Homo sapiens
taagagttactggtttagaacc

SEQ ID NO: 8206602 - DNA, 23 bp, Homo sapiens
taagagtgaggtcataaattttc

SEQ ID NO: 8206603 - DNA, 22 bp, Homo sapiens
taagagttgaaggagattttca

SEQ ID NO: 8206604 - DNA, 22 bp, Homo sapiens
taagagttagggctagcaatat

SEQ ID NO: 8206605 - DNA, 22 bp, Homo sapiens
taagaggcattagagacatagc

SEQ ID NO: 8206606 - DNA, 22 bp, Homo sapiens
taagaggcattagagacatagc

SEQ ID NO: 8206607 - DNA, 22 bp, Homo sapiens
taagaggcagcattcctcgcct

SEQ ID NO: 8206608 - DNA, 22 bp, Homo sapiens
taagaaatttagttatagaatg

SEQ ID NO: 8206609 - DNA, 22 bp, Homo sapiens
taagaaatttagttatagaatg

SEQ ID NO: 8206610 - DNA, 22 bp, Homo sapiens
tagtcacttttttaccatgtgc

SEQ ID NO: 8206611 - DNA, 22 bp, Homo sapiens
tagtcacctttggcacctgcaa

SEQ ID NO: 8206612 - DNA, 22 bp, Homo sapiens
tagtcaccagctacaggacagc

SEQ ID NO: 8206613 - DNA, 22 bp, Homo sapiens
tagtcacatgatcacaggatcg

SEQ ID NO: 8206614 - DNA, 22 bp, Homo sapiens
tagtcacaggaagtttcaatgt

SEQ ID NO: 8206615 - DNA, 22 bp, Homo sapiens
tagtcacagtacaggataaaga

SEQ ID NO: 8206616 - DNA, 22 bp, Homo sapiens
tagtcacagtacaggataaaga

SEQ ID NO: 8206617 - DNA, 22 bp, Homo sapiens
tagtcattctccttacaaagcc

SEQ ID NO: 8206618 - DNA, 22 bp, Homo sapiens
tagtcagagtcttctctgttgt

SEQ ID NO: 8206619 - DNA, 22 bp, Homo sapiens
tagtatgtcttactctaataca

SEQ ID NO: 8206620 - DNA, 22 bp, Homo sapiens
tagtatgttgtctgatgttacc

SEQ ID NO: 8206621 - DNA, 22 bp, Homo sapiens
tagtatttaatcacttttgtct

SEQ ID NO: 8206622 - DNA, 22 bp, Homo sapiens
tagtatttataatcatgcttaa

SEQ ID NO: 8206623 - DNA, 22 bp, Homo sapiens
tagtatttataatcatgcttaa

SEQ ID NO: 8206624 - DNA, 22 bp, Homo sapiens
tagtatttcctgtaagctatag

SEQ ID NO: 8206625 - DNA, 22 bp, Homo sapiens
tagtatttgcagatttgtgtca

SEQ ID NO: 8206626 - DNA, 20 bp, Homo sapiens
tagtatttgcataaggatag

SEQ ID NO: 8206627 - DNA, 20 bp, Homo sapiens
tagtatttgcataaggatag

SEQ ID NO: 8206628 - DNA, 20 bp, Homo sapiens
tagtatttgcataaggatag

SEQ ID NO: 8206629 - DNA, 22 bp, Homo sapiens
tagtattttagaaaaccatgaa

SEQ ID NO: 8206630 - DNA, 22 bp, Homo sapiens
tagtattttagaaaaccatgaa

SEQ ID NO: 8206631 - DNA, 22 bp, Homo sapiens
tagtcaaatggcagggatattt

SEQ ID NO: 8206632 - DNA, 22 bp, Homo sapiens
tagtcacaaccttcaagttgtc

SEQ ID NO: 8206633 - DNA, 22 bp, Homo sapiens
tagtcaactagtgagcatatgg

SEQ ID NO: 8206634 - DNA, 22 bp, Homo sapiens
tagtcaaaaggaaggatatgct

SEQ ID NO: 8206635 - DNA, 22 bp, Homo sapiens
tagtattttagaaaaccatgaa

SEQ ID NO: 8206636 - DNA, 22 bp, Homo sapiens
tagtgggtttatacaatttaaa

SEQ ID NO: 8206637 - DNA, 22 bp, Homo sapiens
tagtgggttaactagaagttaa

SEQ ID NO: 8206638 - DNA, 22 bp, Homo sapiens
tagtgtaatgacatttagacga

SEQ ID NO: 8206639 - DNA, 22 bp, Homo sapiens
tagtgtatgataaaaaattctt

SEQ ID NO: 8206640 - DNA, 22 bp, Homo sapiens
tagtgtatctgttcttttatct

SEQ ID NO: 8206641 - DNA, 23 bp, Homo sapiens
tagtgtatatcaacatttgtccc

SEQ ID NO: 8206642 - DNA, 23 bp, Homo sapiens
tagtgtatatcaacatttgtccc

SEQ ID NO: 8206643 - DNA, 22 bp, Homo sapiens
tagtgggtgatttgatgaggaa

SEQ ID NO: 8206644 - DNA, 22 bp, Homo sapiens
tagtgggtggaggccagggatg

SEQ ID NO: 8206645 - DNA, 22 bp, Homo sapiens
tagtgggtgatttgatgaggaa

SEQ ID NO: 8206646 - DNA, 22 bp, Homo sapiens
tagtgggtcttataattttagg

SEQ ID NO: 8206647 - DNA, 22 bp, Homo sapiens
tagtggggcctgggagggttcc

SEQ ID NO: 8206648 - DNA, 22 bp, Homo sapiens
tagtgggtagaggccagggacg

SEQ ID NO: 8206649 - DNA, 22 bp, Homo sapiens
tagtggatgttcagagatttga

SEQ ID NO: 8206650 - DNA, 19 bp, Homo sapiens
tagtggagtgacaagttct

SEQ ID NO: 8206651 - DNA, 22 bp, Homo sapiens
tagtctaagaaatctttacttt

SEQ ID NO: 8206652 - DNA, 19 bp, Homo sapiens
tagtggagtgacaagttct

SEQ ID NO: 8206653 - DNA, 22 bp, Homo sapiens
tagtggctgcttcattggtgag

SEQ ID NO: 8206654 - DNA, 22 bp, Homo sapiens
tagtggcattgttgtgaggatt

SEQ ID NO: 8206655 - DNA, 17 bp, Homo sapiens
tagtggcaggaaatgaa

SEQ ID NO: 8206656 - DNA, 22 bp, Homo sapiens
tagtggcaaaagcattttgggt

SEQ ID NO: 8206657 - DNA, 17 bp, Homo sapiens
tagtggcaggaaatgaa

SEQ ID NO: 8206658 - DNA, 22 bp, Homo sapiens
tagtggcaaaagcattttgggt

SEQ ID NO: 8206659 - DNA, 22 bp, Homo sapiens
tagtccatgttgatatcctcat

SEQ ID NO: 8206660 - DNA, 22 bp, Homo sapiens
tagtcccattttgaggtatttg

SEQ ID NO: 8206661 - DNA, 22 bp, Homo sapiens
tagtcccggaactccttcaggt

SEQ ID NO: 8206662 - DNA, 22 bp, Homo sapiens
tagtcctcagctgaactgctgc

SEQ ID NO: 8206663 - DNA, 22 bp, Homo sapiens
tagtcctcagctgaactgctgc

SEQ ID NO: 8206664 - DNA, 22 bp, Homo sapiens
tagtcccattttgaggtatttg

SEQ ID NO: 8206665 - DNA, 22 bp, Homo sapiens
tagtccagccttgggtgtagcc

SEQ ID NO: 8206666 - DNA, 22 bp, Homo sapiens
taggctgggaagaaagattctc

SEQ ID NO: 8206667 - DNA, 22 bp, Homo sapiens
taggctggaggaagcagtgcct

SEQ ID NO: 8206668 - DNA, 22 bp, Homo sapiens
taggctggaggaagcagtgcct

SEQ ID NO: 8206669 - DNA, 22 bp, Homo sapiens
taggctggaggaagcagtgcct

SEQ ID NO: 8206670 - DNA, 22 bp, Homo sapiens
taggctggaggaagcagtgcct

SEQ ID NO: 8206671 - DNA, 22 bp, Homo sapiens
taggctggaggaagcagtgcct

SEQ ID NO: 8206672 - DNA, 22 bp, Homo sapiens
taggctggaacttaggcagagg

SEQ ID NO: 8206673 - DNA, 22 bp, Homo sapiens
taggctggaacttaggcagagg

SEQ ID NO: 8206674 - DNA, 22 bp, Homo sapiens
taggctggaacttaggcagagg

SEQ ID NO: 8206675 - DNA, 22 bp, Homo sapiens
taggctggaacttaggcagagg

SEQ ID NO: 8206676 - DNA, 22 bp, Homo sapiens
taggctggaacttaggcagagg

SEQ ID NO: 8206677 - DNA, 22 bp, Homo sapiens
taggctggaacttaggcagagg

SEQ ID NO: 8206678 - DNA, 22 bp, Homo sapiens
taggctgctcaccaggctcaga

SEQ ID NO: 8206679 - DNA, 22 bp, Homo sapiens
taggctgaggttgatgccaggg

SEQ ID NO: 8206680 - DNA, 22 bp, Homo sapiens
taggctgagctaagagagctta

SEQ ID NO: 8206681 - DNA, 22 bp, Homo sapiens
taggctgagctaagagagctta

SEQ ID NO: 8206682 - DNA, 22 bp, Homo sapiens
taggctgagcttgtagatcgta

SEQ ID NO: 8206683 - DNA, 22 bp, Homo sapiens
taggctgagctaagagagctta

SEQ ID NO: 8206684 - DNA, 22 bp, Homo sapiens
taggctgacttgtttcataaag

SEQ ID NO: 8206685 - DNA, 22 bp, Homo sapiens
taggtgtgggctcaggaatgtg

SEQ ID NO: 8206686 - DNA, 22 bp, Homo sapiens
taggctgggagcctgaggctag

SEQ ID NO: 8206687 - DNA, 22 bp, Homo sapiens
taggctgggagcctgaggctag

SEQ ID NO: 8206688 - DNA, 18 bp, Homo sapiens
taggttacagccagccag

SEQ ID NO: 8206689 - DNA, 20 bp, Homo sapiens
taggtgtctttgccagcttt

SEQ ID NO: 8206690 - DNA, 22 bp, Homo sapiens
taggttcactgtcttgaggagc

SEQ ID NO: 8206691 - DNA, 22 bp, Homo sapiens
taggttcacacatcttccagat

SEQ ID NO: 8206692 - DNA, 20 bp, Homo sapiens
taggtgtctttgccagcttt

SEQ ID NO: 8206693 - DNA, 22 bp, Homo sapiens
taggctgggagcctgaggctag

SEQ ID NO: 8206694 - DNA, 22 bp, Homo sapiens
taggctgggagcctgaggctag

SEQ ID NO: 8206695 - DNA, 22 bp, Homo sapiens
taggctgggaagaaagattctc

SEQ ID NO: 8206696 - DNA, 22 bp, Homo sapiens
taggttcagtgtcttgttctgc

SEQ ID NO: 8206697 - DNA, 22 bp, Homo sapiens
taggttcatattctagaatcat

SEQ ID NO: 8206698 - DNA, 22 bp, Homo sapiens
taggttcatgaaattttcagga

SEQ ID NO: 8206699 - DNA, 22 bp, Homo sapiens
taggttcagagaactgaaaata

SEQ ID NO: 8206700 - DNA, 22 bp, Homo sapiens
taggttcacttagctgtgggaa

SEQ ID NO: 8206701 - DNA, 22 bp, Homo sapiens
taggtttactgaattagtggaa

SEQ ID NO: 8206702 - DNA, 22 bp, Homo sapiens
taggtttactgaattagtggaa

SEQ ID NO: 8206703 - DNA, 22 bp, Homo sapiens
tagtataattgttctggaatca

SEQ ID NO: 8206704 - DNA, 22 bp, Homo sapiens
tagtatagattgaagcagatca

SEQ ID NO: 8206705 - DNA, 22 bp, Homo sapiens
tagtatatctttagtacatagt

SEQ ID NO: 8206706 - DNA, 22 bp, Homo sapiens
tagtatatctttagtacatagt

SEQ ID NO: 8206707 - DNA, 22 bp, Homo sapiens
tagtatatctttagtacatagt

SEQ ID NO: 8206708 - DNA, 22 bp, Homo sapiens
tagtatatctttagtacatagt

SEQ ID NO: 8206709 - DNA, 22 bp, Homo sapiens
tagtatatgtctatggttgtag

SEQ ID NO: 8206710 - DNA, 22 bp, Homo sapiens
tagtagcaacaagaaacaaata

SEQ ID NO: 8206711 - DNA, 22 bp, Homo sapiens
tagtagaatccaaaccaacagt

SEQ ID NO: 8206712 - DNA, 22 bp, Homo sapiens
tagtacagttttggcacatgga

SEQ ID NO: 8206713 - DNA, 22 bp, Homo sapiens
tagtaaaaggtcttcctttgtt

SEQ ID NO: 8206714 - DNA, 22 bp, Homo sapiens
tagtaaaagtttagttgaaagt

SEQ ID NO: 8206715 - DNA, 22 bp, Homo sapiens
tagtaaacccatgaggcttaaa

SEQ ID NO: 8206716 - DNA, 22 bp, Homo sapiens
tagtaaacagctctgccacaat

SEQ ID NO: 8206717 - DNA, 22 bp, Homo sapiens
tagtaaacaggcaagggaccac

SEQ ID NO: 8206718 - DNA, 22 bp, Homo sapiens
tagtaaacatgcctcggctgct

SEQ ID NO: 8206719 - DNA, 22 bp, Homo sapiens
taggtttcagaggtgccgggaa

SEQ ID NO: 8206720 - DNA, 22 bp, Homo sapiens
taggttttcctaaaattctggt

SEQ ID NO: 8206721 - DNA, 22 bp, Homo sapiens
tagtaaaaggtcttcctttgtt

SEQ ID NO: 8206722 - DNA, 22 bp, Homo sapiens
tagtaaaaagcaatggtgagta

SEQ ID NO: 8206723 - DNA, 22 bp, Homo sapiens
tagtaaaaagcaatggtgagta

SEQ ID NO: 8206724 - DNA, 22 bp, Homo sapiens
taggtttaggagtgaaggtgaa

SEQ ID NO: 8206725 - DNA, 22 bp, Homo sapiens
taggtttcagaggtgccgggaa

SEQ ID NO: 8206726 - DNA, 22 bp, Homo sapiens
taggtttaggagtgaaggtgaa

SEQ ID NO: 8206727 - DNA, 22 bp, Homo sapiens
taggtttactgaattagtggaa

SEQ ID NO: 8206728 - DNA, 22 bp, Homo sapiens
taggaaagcagtagagccagga

SEQ ID NO: 8206729 - DNA, 22 bp, Homo sapiens
taggaaagcagtagagccagga

SEQ ID NO: 8206730 - DNA, 18 bp, Homo sapiens
taggaaatagggctgtga

SEQ ID NO: 8206731 - DNA, 22 bp, Homo sapiens
taggaaataattcactctggct

SEQ ID NO: 8206732 - DNA, 22 bp, Homo sapiens
taggaaatatttgaacatagga

SEQ ID NO: 8206733 - DNA, 20 bp, Homo sapiens
taggaaatcgaggcagggtg

SEQ ID NO: 8206734 - DNA, 22 bp, Homo sapiens
taggaaatcagagaaagaggtg

SEQ ID NO: 8206735 - DNA, 22 bp, Homo sapiens
taggaaatatttgaacatagga

SEQ ID NO: 8206736 - DNA, 22 bp, Homo sapiens
tagccattgacttaaagcttat

SEQ ID NO: 8206737 - DNA, 22 bp, Homo sapiens
tagccatttttattaatgctgg

SEQ ID NO: 8206738 - DNA, 22 bp, Homo sapiens
taggaaagaaatgagtagtgat

SEQ ID NO: 8206739 - DNA, 22 bp, Homo sapiens
taggaaagaaatgagtagtgat

SEQ ID NO: 8206740 - DNA, 22 bp, Homo sapiens
taggaaactcaaagggaagtgg

SEQ ID NO: 8206741 - DNA, 22 bp, Homo sapiens
taggaaactctcagctggtcat

SEQ ID NO: 8206742 - DNA, 22 bp, Homo sapiens
tagcccagagtcccaattccag

SEQ ID NO: 8206743 - DNA, 22 bp, Homo sapiens
tagcccagcatgagcagagctg

SEQ ID NO: 8206744 - DNA, 22 bp, Homo sapiens
taggaagctctttgttttgtga

SEQ ID NO: 8206745 - DNA, 18 bp, Homo sapiens
taggaagcttaatgtttt

SEQ ID NO: 8206746 - DNA, 22 bp, Homo sapiens
taggaaggaggccatcttggcg

SEQ ID NO: 8206747 - DNA, 22 bp, Homo sapiens
taggaaggaagagcctcagatt

SEQ ID NO: 8206748 - DNA, 22 bp, Homo sapiens
taggaagcctaaattaagtggt

SEQ ID NO: 8206749 - DNA, 22 bp, Homo sapiens
taggaaatgctgtcttattgta

SEQ ID NO: 8206750 - DNA, 22 bp, Homo sapiens
taggaaatgctgtcttattgta

SEQ ID NO: 8206751 - DNA, 22 bp, Homo sapiens
taggaaatgctccattgcataa

SEQ ID NO: 8206752 - DNA, 22 bp, Homo sapiens
taggaaatgctccattgcataa

SEQ ID NO: 8206753 - DNA, 22 bp, Homo sapiens
taggaaatgaatgcaggctccc

SEQ ID NO: 8206754 - DNA, 22 bp, Homo sapiens
taggaaatggctcagttactgc

SEQ ID NO: 8206755 - DNA, 22 bp, Homo sapiens
taggacaggtgaggggctgtgg

SEQ ID NO: 8206756 - DNA, 22 bp, Homo sapiens
taggacaggtgaggggctgtgg

SEQ ID NO: 8206757 - DNA, 22 bp, Homo sapiens
taggcccctagtgccacgtggc

SEQ ID NO: 8206758 - DNA, 22 bp, Homo sapiens
taggcccctagtgccacgtggc

SEQ ID NO: 8206759 - DNA, 19 bp, Homo sapiens
taggccctagctctgcagt

SEQ ID NO: 8206760 - DNA, 22 bp, Homo sapiens
taggcctggatctctgggagca

SEQ ID NO: 8206761 - DNA, 23 bp, Homo sapiens
taggcctccctggagcacccagc

SEQ ID NO: 8206762 - DNA, 22 bp, Homo sapiens
taggcctcaggaccccagggct

SEQ ID NO: 8206763 - DNA, 22 bp, Homo sapiens
taggctaggctgaaggttttgg

SEQ ID NO: 8206764 - DNA, 22 bp, Homo sapiens
taggctcagggctgggtgacgg

SEQ ID NO: 8206765 - DNA, 22 bp, Homo sapiens
taggctcagaaggcactgaaaa

SEQ ID NO: 8206766 - DNA, 22 bp, Homo sapiens
taggctccaagagcgaactcag

SEQ ID NO: 8206767 - DNA, 22 bp, Homo sapiens
taggctcattaagtccccaggg

SEQ ID NO: 8206768 - DNA, 22 bp, Homo sapiens
taggctcagtgagtagggagtt

SEQ ID NO: 8206769 - DNA, 22 bp, Homo sapiens
taggctcagtgagtagggagtt

SEQ ID NO: 8206770 - DNA, 22 bp, Homo sapiens
taggctccagtgtgtggcgagt

SEQ ID NO: 8206771 - DNA, 22 bp, Homo sapiens
taggctcccagatcgtttgctg

SEQ ID NO: 8206772 - DNA, 22 bp, Homo sapiens
taggctcctctcacattctatt

SEQ ID NO: 8206773 - DNA, 22 bp, Homo sapiens
taggctcctgaggactccatgc

SEQ ID NO: 8206774 - DNA, 22 bp, Homo sapiens
taggctcctgagtccacagcac

SEQ ID NO: 8206775 - DNA, 22 bp, Homo sapiens
taggctgaaaggagaggtgaag

SEQ ID NO: 8206776 - DNA, 23 bp, Homo sapiens
taggctctgtaggtagagatggg

SEQ ID NO: 8206777 - DNA, 22 bp, Homo sapiens
taggacagagttccctgatggc

SEQ ID NO: 8206778 - DNA, 22 bp, Homo sapiens
taggaatgtttttatcaactta

SEQ ID NO: 8206779 - DNA, 22 bp, Homo sapiens
taggaatgtttttatcaactta

SEQ ID NO: 8206780 - DNA, 22 bp, Homo sapiens
taggaatgtttttatcaactta

SEQ ID NO: 8206781 - DNA, 22 bp, Homo sapiens
taggaatgtggcaggcagaaca

SEQ ID NO: 8206782 - DNA, 22 bp, Homo sapiens
taggaatgtggcaggcagaaca

SEQ ID NO: 8206783 - DNA, 22 bp, Homo sapiens
taggaatgtggcaggcagaaca

SEQ ID NO: 8206784 - DNA, 22 bp, Homo sapiens
taggaatgtctatgcagtgagg

SEQ ID NO: 8206785 - DNA, 22 bp, Homo sapiens
taggaatgtctatgcagtgagg

SEQ ID NO: 8206786 - DNA, 22 bp, Homo sapiens
taggaattatgatgctatcaag

SEQ ID NO: 8206787 - DNA, 22 bp, Homo sapiens
taggaatggcagcagccggggg

SEQ ID NO: 8206788 - DNA, 22 bp, Homo sapiens
taggaatgggcaagacaaagaa

SEQ ID NO: 8206789 - DNA, 22 bp, Homo sapiens
taggaatgggcaagacaaagaa

SEQ ID NO: 8206790 - DNA, 22 bp, Homo sapiens
taggaatggcagcagccggggg

SEQ ID NO: 8206791 - DNA, 22 bp, Homo sapiens
taggaatggaacactttgattt

SEQ ID NO: 8206792 - DNA, 22 bp, Homo sapiens
taggaatgcatgggggattctg

SEQ ID NO: 8206793 - DNA, 22 bp, Homo sapiens
taggaatggaacactttgattt

SEQ ID NO: 8206794 - DNA, 22 bp, Homo sapiens
taggaatgcagatgcataataa

SEQ ID NO: 8206795 - DNA, 22 bp, Homo sapiens
taggaatgattggaattccagg

SEQ ID NO: 8206796 - DNA, 22 bp, Homo sapiens
taggaatgcagatgcataataa

SEQ ID NO: 8206797 - DNA, 22 bp, Homo sapiens
taggaatgcagtgagacacaga

SEQ ID NO: 8206798 - DNA, 22 bp, Homo sapiens
taggaatgcagtgagacacaga

SEQ ID NO: 8206799 - DNA, 22 bp, Homo sapiens
taggaatgcagatgcataataa

SEQ ID NO: 8206800 - DNA, 22 bp, Homo sapiens
taggaatgcagtgagacacaga

SEQ ID NO: 8206801 - DNA, 22 bp, Homo sapiens
taggaatgcatgggggattctg

SEQ ID NO: 8206802 - DNA, 22 bp, Homo sapiens
taggaatgtaatctctgttatg

SEQ ID NO: 8206803 - DNA, 22 bp, Homo sapiens
taggaatgtaatctctgttatg

SEQ ID NO: 8206804 - DNA, 19 bp, Homo sapiens
taggaatgtagaatcctag

SEQ ID NO: 8206805 - DNA, 19 bp, Homo sapiens
taggaatgtagaatcctag

SEQ ID NO: 8206806 - DNA, 22 bp, Homo sapiens
taggaatgtctatgcagtgagg

SEQ ID NO: 8206807 - DNA, 22 bp, Homo sapiens
taggaatgggctatcccaagct

SEQ ID NO: 8206808 - DNA, 22 bp, Homo sapiens
taggaatgggcaagacaaagaa

SEQ ID NO: 8206809 - DNA, 22 bp, Homo sapiens
taggaatggtgctcagcagaaa

SEQ ID NO: 8206810 - DNA, 22 bp, Homo sapiens
taggaatggtgctcagcagaaa

SEQ ID NO: 8206811 - DNA, 22 bp, Homo sapiens
taggaatgggctatcccaagct

SEQ ID NO: 8206812 - DNA, 22 bp, Homo sapiens
taggaatggtgctcagcagaaa

SEQ ID NO: 8206813 - DNA, 22 bp, Homo sapiens
taggaatgaagaagtatgatat

SEQ ID NO: 8206814 - DNA, 22 bp, Homo sapiens
taggaatgaagaagtatgatat

SEQ ID NO: 8206815 - DNA, 22 bp, Homo sapiens
taggaatgaaagtgttttgaaa

SEQ ID NO: 8206816 - DNA, 22 bp, Homo sapiens
taggaatgaaagtgttttgaaa

SEQ ID NO: 8206817 - DNA, 22 bp, Homo sapiens
taggaatgaaaatggccataga

SEQ ID NO: 8206818 - DNA, 22 bp, Homo sapiens
taggaatgaaaatggccataga

SEQ ID NO: 8206819 - DNA, 22 bp, Homo sapiens
taggaatgattggaattccagg

SEQ ID NO: 8206820 - DNA, 22 bp, Homo sapiens
taggaatgattggaattccagg

SEQ ID NO: 8206821 - DNA, 22 bp, Homo sapiens
taggaatgatgtatttttctct

SEQ ID NO: 8206822 - DNA, 22 bp, Homo sapiens
taggaatgatgtatttttctct

SEQ ID NO: 8206823 - DNA, 22 bp, Homo sapiens
taggaatgataatagtaaagag

SEQ ID NO: 8206824 - DNA, 22 bp, Homo sapiens
taggaatgataatagtaaagag

SEQ ID NO: 8206825 - DNA, 22 bp, Homo sapiens
taggaatgagagggtgaggatt

SEQ ID NO: 8206826 - DNA, 22 bp, Homo sapiens
taggaatgagagggtgaggatt

SEQ ID NO: 8206827 - DNA, 22 bp, Homo sapiens
taggaatgagaaagaattagat

SEQ ID NO: 8206828 - DNA, 22 bp, Homo sapiens
taggaatgaaggataaggtgtg

SEQ ID NO: 8206829 - DNA, 22 bp, Homo sapiens
taggaatgagaaagaattagat

SEQ ID NO: 8206830 - DNA, 22 bp, Homo sapiens
taggaatgaaggataaggtgtg

SEQ ID NO: 8206831 - DNA, 22 bp, Homo sapiens
taggaagggaaaggcttcaact

SEQ ID NO: 8206832 - DNA, 22 bp, Homo sapiens
taggaaggcctgtcactacttg

SEQ ID NO: 8206833 - DNA, 22 bp, Homo sapiens
taggaaggcctgtcactacttg

SEQ ID NO: 8206834 - DNA, 22 bp, Homo sapiens
taggaaggcctgtcactacttg

SEQ ID NO: 8206835 - DNA, 22 bp, Homo sapiens
taggaagggctcagggctcggt

SEQ ID NO: 8206836 - DNA, 22 bp, Homo sapiens
taggaaggtccatgtcttatct

SEQ ID NO: 8206837 - DNA, 22 bp, Homo sapiens
taggaaggtccatgtcttatct

SEQ ID NO: 8206838 - DNA, 22 bp, Homo sapiens
taggaaggtgtttttaaggagc

SEQ ID NO: 8206839 - DNA, 22 bp, Homo sapiens
tagcacaagaagtacacataga

SEQ ID NO: 8206840 - DNA, 22 bp, Homo sapiens
tagcacaagcaactactgaagt

SEQ ID NO: 8206841 - DNA, 22 bp, Homo sapiens
tagcacaagcaactactgaagt

SEQ ID NO: 8206842 - DNA, 22 bp, Homo sapiens
tagcacacactgcatctacaaa

SEQ ID NO: 8206843 - DNA, 22 bp, Homo sapiens
tagcaaaaactgcagttacttt

SEQ ID NO: 8206844 - DNA, 22 bp, Homo sapiens
tagcaaaaactgcagttacttt

SEQ ID NO: 8206845 - DNA, 21 bp, Homo sapiens
tagcacagctgtagacagttt

SEQ ID NO: 8206846 - DNA, 21 bp, Homo sapiens
tagcacagctgtagacagttt

SEQ ID NO: 8206847 - DNA, 22 bp, Homo sapiens
tagcacagacagaatggtcata

SEQ ID NO: 8206848 - DNA, 18 bp, Homo sapiens
tagcacagagcaggatgt

SEQ ID NO: 8206849 - DNA, 22 bp, Homo sapiens
tagcacacgcattagcaaatca

SEQ ID NO: 8206850 - DNA, 22 bp, Homo sapiens
tagcacaggtcttgttgccatt

SEQ ID NO: 8206851 - DNA, 22 bp, Homo sapiens
tagcacagggctcctcaaccca

SEQ ID NO: 8206852 - DNA, 22 bp, Homo sapiens
tagcacagtatttctcaactgg

SEQ ID NO: 8206853 - DNA, 22 bp, Homo sapiens
tagcacagtgttcacaacagtg

SEQ ID NO: 8206854 - DNA, 22 bp, Homo sapiens
tagcaaaaaaactggcatctcc

SEQ ID NO: 8206855 - DNA, 22 bp, Homo sapiens
tagattttgcatttctaacaag

SEQ ID NO: 8206856 - DNA, 22 bp, Homo sapiens
tagattttaggagattttactg

SEQ ID NO: 8206857 - DNA, 22 bp, Homo sapiens
tagattttaggagattttactg

SEQ ID NO: 8206858 - DNA, 22 bp, Homo sapiens
tagattttacttctgtcattac

SEQ ID NO: 8206859 - DNA, 22 bp, Homo sapiens
tagattatccctgatttgtcca

SEQ ID NO: 8206860 - DNA, 22 bp, Homo sapiens
tagattatccctgatttgtcca

SEQ ID NO: 8206861 - DNA, 22 bp, Homo sapiens
tagattaacagttttgttgaag

SEQ ID NO: 8206862 - DNA, 22 bp, Homo sapiens
tagattaagatgccagttttga

SEQ ID NO: 8206863 - DNA, 18 bp, Homo sapiens
tagattaaaattgaattc

SEQ ID NO: 8206864 - DNA, 22 bp, Homo sapiens
tagatgttgaagtcatatttgg

SEQ ID NO: 8206865 - DNA, 20 bp, Homo sapiens
tagatgtttcctgtcataaa

SEQ ID NO: 8206866 - DNA, 22 bp, Homo sapiens
tagatgttttgatatttgctga

SEQ ID NO: 8206867 - DNA, 22 bp, Homo sapiens
tagatgtgagcccaggctgctt

SEQ ID NO: 8206868 - DNA, 22 bp, Homo sapiens
tagatgtgttgcctggagttgt

SEQ ID NO: 8206869 - DNA, 22 bp, Homo sapiens
tagatgtgttgcctggagttgt

SEQ ID NO: 8206870 - DNA, 22 bp, Homo sapiens
tagatggctttctgaggtattt

SEQ ID NO: 8206871 - DNA, 22 bp, Homo sapiens
tagatggctggtgttctgagct

SEQ ID NO: 8206872 - DNA, 22 bp, Homo sapiens
tagatggcgtccatggccgcag

SEQ ID NO: 8206873 - DNA, 18 bp, Homo sapiens
tagatggcagtctgcaga

SEQ ID NO: 8206874 - DNA, 22 bp, Homo sapiens
tagatggcaccttctgtgtgtc

SEQ ID NO: 8206875 - DNA, 22 bp, Homo sapiens
tagccagtgggacggtgctgca

SEQ ID NO: 8206876 - DNA, 22 bp, Homo sapiens
tagccagtgccatgggactgat

SEQ ID NO: 8206877 - DNA, 22 bp, Homo sapiens
tagccagttgcccagagtagaa

SEQ ID NO: 8206878 - DNA, 22 bp, Homo sapiens
tagccaggctggaagcaaaagg

SEQ ID NO: 8206879 - DNA, 23 bp, Homo sapiens
tagccagtcattccagcaaggcc

SEQ ID NO: 8206880 - DNA, 22 bp, Homo sapiens
tagccaggcgaggtcagtgtcg

SEQ ID NO: 8206881 - DNA, 22 bp, Homo sapiens
tagccaggctgcagctgatccg

SEQ ID NO: 8206882 - DNA, 23 bp, Homo sapiens
tagccaggcccagcatggacacc

SEQ ID NO: 8206883 - DNA, 22 bp, Homo sapiens
tagccaggcaattatgggtgat

SEQ ID NO: 8206884 - DNA, 22 bp, Homo sapiens
tagccagctggataatgtgggg

SEQ ID NO: 8206885 - DNA, 22 bp, Homo sapiens
tagccagctgaatgcactacag

SEQ ID NO: 8206886 - DNA, 22 bp, Homo sapiens
tagcattttagctgttttctct

SEQ ID NO: 8206887 - DNA, 22 bp, Homo sapiens
tagccaccagaaaggttttcag

SEQ ID NO: 8206888 - DNA, 22 bp, Homo sapiens
tagcatttggacattgtcacct

SEQ ID NO: 8206889 - DNA, 22 bp, Homo sapiens
tagcatttcccaaatgcatttg

SEQ ID NO: 8206890 - DNA, 22 bp, Homo sapiens
tagcatttcactgatcttcact

SEQ ID NO: 8206891 - DNA, 22 bp, Homo sapiens
tagcagaaccagcagtcaattt

SEQ ID NO: 8206892 - DNA, 22 bp, Homo sapiens
tagcagggttttgaagagggtt

SEQ ID NO: 8206893 - DNA, 21 bp, Homo sapiens
tagcacttcgctgtaattggg

SEQ ID NO: 8206894 - DNA, 22 bp, Homo sapiens
tagcacttgtgttatgccttgt

SEQ ID NO: 8206895 - DNA, 22 bp, Homo sapiens
tagcacttgtgttatgccttgt

SEQ ID NO: 8206896 - DNA, 21 bp, Homo sapiens
tagcacttcgctgtaattggg

SEQ ID NO: 8206897 - DNA, 22 bp, Homo sapiens
tagcactgttctagcatgtttt

SEQ ID NO: 8206898 - DNA, 22 bp, Homo sapiens
tagcactccattatgatgtggc

SEQ ID NO: 8206899 - DNA, 22 bp, Homo sapiens
tagcactgagtctagctttgga

SEQ ID NO: 8206900 - DNA, 22 bp, Homo sapiens
tagcacatacataatagataga

SEQ ID NO: 8206901 - DNA, 22 bp, Homo sapiens
tagcacagttcctgactctttg

SEQ ID NO: 8206902 - DNA, 22 bp, Homo sapiens
tagcacatcttcttggcctgca

SEQ ID NO: 8206903 - DNA, 22 bp, Homo sapiens
tagcacatctggcgcttatagg

SEQ ID NO: 8206904 - DNA, 22 bp, Homo sapiens
tagcacattgttgaccagaagg

SEQ ID NO: 8206905 - DNA, 22 bp, Homo sapiens
tactttattgtaaatgctgatg

SEQ ID NO: 8206906 - DNA, 22 bp, Homo sapiens
tacttggtttagtttggaggga

SEQ ID NO: 8206907 - DNA, 22 bp, Homo sapiens
tacttggtctgggcagggggtt

SEQ ID NO: 8206908 - DNA, 22 bp, Homo sapiens
tactttctagctctccccagtt

SEQ ID NO: 8206909 - DNA, 22 bp, Homo sapiens
tactttctaagacatacaactt

SEQ ID NO: 8206910 - DNA, 22 bp, Homo sapiens
tactttcatgtctatacatatt

SEQ ID NO: 8206911 - DNA, 22 bp, Homo sapiens
tactttctaagacatacaactt

SEQ ID NO: 8206912 - DNA, 22 bp, Homo sapiens
tactttctaagacatacaactt

SEQ ID NO: 8206913 - DNA, 22 bp, Homo sapiens
tagaagcagtaatagaaatagg

SEQ ID NO: 8206914 - DNA, 19 bp, Homo sapiens
tagaagcagggaagctgag

SEQ ID NO: 8206915 - DNA, 22 bp, Homo sapiens
tagaagcagcaggagtaaaggc

SEQ ID NO: 8206916 - DNA, 22 bp, Homo sapiens
tagaagcagcaggagtaaaggc

SEQ ID NO: 8206917 - DNA, 22 bp, Homo sapiens
tagaagcagcaggactcatggt

SEQ ID NO: 8206918 - DNA, 22 bp, Homo sapiens
tagaagcagcaggactcatggt

SEQ ID NO: 8206919 - DNA, 19 bp, Homo sapiens
tagaagcactaggcaaact

SEQ ID NO: 8206920 - DNA, 19 bp, Homo sapiens
tagaagcactaggcaaact

SEQ ID NO: 8206921 - DNA, 19 bp, Homo sapiens
tagaagcactaggcaaact

SEQ ID NO: 8206922 - DNA, 22 bp, Homo sapiens
tagaagcagcaggactcatggt

SEQ ID NO: 8206923 - DNA, 22 bp, Homo sapiens
tagaagcagaaggaaggtggct

SEQ ID NO: 8206924 - DNA, 22 bp, Homo sapiens
tactttctgtccttctgttaaa

SEQ ID NO: 8206925 - DNA, 22 bp, Homo sapiens
tagaagcaccactcatcacgtg

SEQ ID NO: 8206926 - DNA, 22 bp, Homo sapiens
tagaaggaggactggcagtgtt

SEQ ID NO: 8206927 - DNA, 22 bp, Homo sapiens
tagaagcagtaatagaaatagg

SEQ ID NO: 8206928 - DNA, 22 bp, Homo sapiens
tagaagcagtaatagaaatagg

SEQ ID NO: 8206929 - DNA, 22 bp, Homo sapiens
tagaagctcaggaataggcata

SEQ ID NO: 8206930 - DNA, 22 bp, Homo sapiens
tagaagtactccttagccttta

SEQ ID NO: 8206931 - DNA, 22 bp, Homo sapiens
tagaagtggattgaagtttgga

SEQ ID NO: 8206932 - DNA, 22 bp, Homo sapiens
tagaaggcccattcatttgttc

SEQ ID NO: 8206933 - DNA, 22 bp, Homo sapiens
tagaagttaaaggaatacagaa

SEQ ID NO: 8206934 - DNA, 22 bp, Homo sapiens
tagaagttaggaaataggaata

SEQ ID NO: 8206935 - DNA, 22 bp, Homo sapiens
tagaagtgtctgtgaaatatac

SEQ ID NO: 8206936 - DNA, 22 bp, Homo sapiens
tagaagtggcaacactcagaaa

SEQ ID NO: 8206937 - DNA, 22 bp, Homo sapiens
tagaagtggcaacactcagaaa

SEQ ID NO: 8206938 - DNA, 22 bp, Homo sapiens
tagaagtgggaatataaaatat

SEQ ID NO: 8206939 - DNA, 22 bp, Homo sapiens
tagaagttatgataataatagt

SEQ ID NO: 8206940 - DNA, 22 bp, Homo sapiens
tagaagttcatgcgaattattt

SEQ ID NO: 8206941 - DNA, 22 bp, Homo sapiens
tagaagttatgataataatagt

SEQ ID NO: 8206942 - DNA, 22 bp, Homo sapiens
tagaagttgaactaaaaatatt

SEQ ID NO: 8206943 - DNA, 22 bp, Homo sapiens
tagaataagttgatgatatatg

SEQ ID NO: 8206944 - DNA, 22 bp, Homo sapiens
tagaatcagaagatttgactgt

SEQ ID NO: 8206945 - DNA, 22 bp, Homo sapiens
tagaatcagaagatttgactgt

SEQ ID NO: 8206946 - DNA, 22 bp, Homo sapiens
tagaataagttgatgatatatg

SEQ ID NO: 8206947 - DNA, 22 bp, Homo sapiens
tagaagttgctcaataaatgtt

SEQ ID NO: 8206948 - DNA, 22 bp, Homo sapiens
tagaatcattgagaataacagg

SEQ ID NO: 8206949 - DNA, 23 bp, Homo sapiens
tagaatcctctgagatggaatag

SEQ ID NO: 8206950 - DNA, 22 bp, Homo sapiens
tagaggagggctgttcttcagt

SEQ ID NO: 8206951 - DNA, 22 bp, Homo sapiens
tagaggagggctgttcttcagt

SEQ ID NO: 8206952 - DNA, 22 bp, Homo sapiens
tagaggcacagtctatgtagag

SEQ ID NO: 8206953 - DNA, 22 bp, Homo sapiens
tagaggagagttgctggatgga

SEQ ID NO: 8206954 - DNA, 22 bp, Homo sapiens
tagagctgctggactgtaacag

SEQ ID NO: 8206955 - DNA, 22 bp, Homo sapiens
tagaggagcggcgagctgagct

SEQ ID NO: 8206956 - DNA, 22 bp, Homo sapiens
tagaggagcggcgagctgagct

SEQ ID NO: 8206957 - DNA, 22 bp, Homo sapiens
tagaggagcggcgagctgagct

SEQ ID NO: 8206958 - DNA, 22 bp, Homo sapiens
tagaggagagttgctggatgga

SEQ ID NO: 8206959 - DNA, 22 bp, Homo sapiens
tagaggagcggcgagctgagct

SEQ ID NO: 8206960 - DNA, 22 bp, Homo sapiens
tagatgaccttgtgttaggcaa

SEQ ID NO: 8206961 - DNA, 22 bp, Homo sapiens
tagaggcagaagaaattgacaa

SEQ ID NO: 8206962 - DNA, 22 bp, Homo sapiens
tagaggcaccctggaggagact

SEQ ID NO: 8206963 - DNA, 22 bp, Homo sapiens
tagatgatggaaaaaagcaata

SEQ ID NO: 8206964 - DNA, 22 bp, Homo sapiens
tagatgatggtaaaaagaagtt

SEQ ID NO: 8206965 - DNA, 22 bp, Homo sapiens
tagagcagttggcagctgtatt

SEQ ID NO: 8206966 - DNA, 23 bp, Homo sapiens
tagagcagtagatcaccatggga

SEQ ID NO: 8206967 - DNA, 22 bp, Homo sapiens
tagagcagtgttgtccatcaga

SEQ ID NO: 8206968 - DNA, 22 bp, Homo sapiens
tagagcagtgggtaccatggca

SEQ ID NO: 8206969 - DNA, 21 bp, Homo sapiens
tagagccagtggtgttctgac

SEQ ID NO: 8206970 - DNA, 22 bp, Homo sapiens
tagagctactggcagcctcttc

SEQ ID NO: 8206971 - DNA, 22 bp, Homo sapiens
tagagctgataatgaggccaag

SEQ ID NO: 8206972 - DNA, 22 bp, Homo sapiens
tagagatgtgatatagcagagt

SEQ ID NO: 8206973 - DNA, 22 bp, Homo sapiens
tagagatggggtcttgctatga

SEQ ID NO: 8206974 - DNA, 23 bp, Homo sapiens
tagagcagggaaatctgtcagag

SEQ ID NO: 8206975 - DNA, 22 bp, Homo sapiens
tagagcagccttcagagcagtt

SEQ ID NO: 8206976 - DNA, 22 bp, Homo sapiens
tagagcagatagtgaaacagaa

SEQ ID NO: 8206977 - DNA, 22 bp, Homo sapiens
tagagcagccttcagagcagtt

SEQ ID NO: 8206978 - DNA, 22 bp, Homo sapiens
tagagatgccctagctgaagta

SEQ ID NO: 8206979 - DNA, 22 bp, Homo sapiens
tagagatgccctagctgaagta

SEQ ID NO: 8206980 - DNA, 21 bp, Homo sapiens
tagagatgacgagctctagca

SEQ ID NO: 8206981 - DNA, 21 bp, Homo sapiens
tagagatgacgagctctagca

SEQ ID NO: 8206982 - DNA, 22 bp, Homo sapiens
tagagaggtttgaattggctgc

SEQ ID NO: 8206983 - DNA, 22 bp, Homo sapiens
tagagatgaattctgcagtctt

SEQ ID NO: 8206984 - DNA, 22 bp, Homo sapiens
tattttcaccttctctggatat

SEQ ID NO: 8206985 - DNA, 22 bp, Homo sapiens
tattttcaccttctctggatat

SEQ ID NO: 8206986 - DNA, 22 bp, Homo sapiens
tatttgttgcgggaattgctat

SEQ ID NO: 8206987 - DNA, 22 bp, Homo sapiens
tattttcaccatgtatccctgt

SEQ ID NO: 8206988 - DNA, 22 bp, Homo sapiens
tatttgtttctagtggcagcaa

SEQ ID NO: 8206989 - DNA, 22 bp, Homo sapiens
tattttcaccatgtatccctgt

SEQ ID NO: 8206990 - DNA, 22 bp, Homo sapiens
tattttcattctgtgtgactgt

SEQ ID NO: 8206991 - DNA, 22 bp, Homo sapiens
tattttcattctgtgtgactgt

SEQ ID NO: 8206992 - DNA, 22 bp, Homo sapiens
tattttcattctgtgtgactgt

SEQ ID NO: 8206993 - DNA, 22 bp, Homo sapiens
tattttcatcttgtccttggat

SEQ ID NO: 8206994 - DNA, 22 bp, Homo sapiens
tattttcatcttgtccttggat

SEQ ID NO: 8206995 - DNA, 22 bp, Homo sapiens
tattttcatcttgtccttggat

SEQ ID NO: 8206996 - DNA, 22 bp, Homo sapiens
tatttgttccagagataaaaat

SEQ ID NO: 8206997 - DNA, 22 bp, Homo sapiens
tatttgttccagagataaaaat

SEQ ID NO: 8206998 - DNA, 22 bp, Homo sapiens
tatttgttccagagataaaaat

SEQ ID NO: 8206999 - DNA, 22 bp, Homo sapiens
tatttgttccagagataaaaat

SEQ ID NO: 8207000 - DNA, 22 bp, Homo sapiens
tatttgttgagttgttatgtct

SEQ ID NO: 8207001 - DNA, 22 bp, Homo sapiens
tatttgttgagttgttatgtct

SEQ ID NO: 8207002 - DNA, 22 bp, Homo sapiens
tatttgttgagttgttatgtct

SEQ ID NO: 8207003 - DNA, 22 bp, Homo sapiens
tatttgttgaatacccctgtct

SEQ ID NO: 8207004 - DNA, 22 bp, Homo sapiens
tatttgtatttcatgcagtaaa

SEQ ID NO: 8207005 - DNA, 22 bp, Homo sapiens
tatttgtatttcatgcagtaaa

SEQ ID NO: 8207006 - DNA, 22 bp, Homo sapiens
tatttgtatttcatgcagtaaa

SEQ ID NO: 8207007 - DNA, 22 bp, Homo sapiens
tatttctaagagatatctgtac

SEQ ID NO: 8207008 - DNA, 22 bp, Homo sapiens
tatttctaagctgtaagtctga

SEQ ID NO: 8207009 - DNA, 22 bp, Homo sapiens
tatttctaagagatatctgtac

SEQ ID NO: 8207010 - DNA, 22 bp, Homo sapiens
tatttctaagagatatctgtac

SEQ ID NO: 8207011 - DNA, 22 bp, Homo sapiens
tatttctaagagatatctgtac

SEQ ID NO: 8207012 - DNA, 22 bp, Homo sapiens
tatttctaagagatatctgtac

SEQ ID NO: 8207013 - DNA, 22 bp, Homo sapiens
tatttcctgcatggtgatgtaa

SEQ ID NO: 8207014 - DNA, 22 bp, Homo sapiens
tatttcccagggagcaacaagc

SEQ ID NO: 8207015 - DNA, 22 bp, Homo sapiens
tatttccttgagacggagtctc

SEQ ID NO: 8207016 - DNA, 22 bp, Homo sapiens
tatttcctgtggatacttttag

SEQ ID NO: 8207017 - DNA, 22 bp, Homo sapiens
tatttccagatgaggttacatt

SEQ ID NO: 8207018 - DNA, 22 bp, Homo sapiens
tatttcagggagaataaatttg

SEQ ID NO: 8207019 - DNA, 22 bp, Homo sapiens
tatttccagcagtaagaagaca

SEQ ID NO: 8207020 - DNA, 22 bp, Homo sapiens
tatttccatgttagaactaagt

SEQ ID NO: 8207021 - DNA, 22 bp, Homo sapiens
tatttccaggccccactctaga

SEQ ID NO: 8207022 - DNA, 22 bp, Homo sapiens
tatttccatgttagaactaagt

SEQ ID NO: 8207023 - DNA, 18 bp, Homo sapiens
tatttcccaatggaaaca

SEQ ID NO: 8207024 - DNA, 22 bp, Homo sapiens
tatttcccagggagcaacaagc

SEQ ID NO: 8207025 - DNA, 18 bp, Homo sapiens
tatttcccaatggaaaca

SEQ ID NO: 8207026 - DNA, 22 bp, Homo sapiens
tatttctaagctgtaagtctga

SEQ ID NO: 8207027 - DNA, 22 bp, Homo sapiens
tatttctaagctgtaagtctga

SEQ ID NO: 8207028 - DNA, 22 bp, Homo sapiens
tatttgtatgtgtgtacatata

SEQ ID NO: 8207029 - DNA, 22 bp, Homo sapiens
tatttgtatgtgtgtacatata

SEQ ID NO: 8207030 - DNA, 22 bp, Homo sapiens
tatttgtatgtgtgtacatata

SEQ ID NO: 8207031 - DNA, 22 bp, Homo sapiens
tatttgtatttcatgcagtaaa

SEQ ID NO: 8207032 - DNA, 22 bp, Homo sapiens
tatttgtatgtgtgtacatata

SEQ ID NO: 8207033 - DNA, 22 bp, Homo sapiens
tatttgtatgtgtgtacatata

SEQ ID NO: 8207034 - DNA, 22 bp, Homo sapiens
tattgcatctcttcatatctgt

SEQ ID NO: 8207035 - DNA, 22 bp, Homo sapiens
tattgcatccccattgtgcccc

SEQ ID NO: 8207036 - DNA, 22 bp, Homo sapiens
tattgcatattattctagtggc

SEQ ID NO: 8207037 - DNA, 22 bp, Homo sapiens
tattgcaagtggcataaaattt

SEQ ID NO: 8207038 - DNA, 22 bp, Homo sapiens
tattgcaatttggctaaagaat

SEQ ID NO: 8207039 - DNA, 21 bp, Homo sapiens
tattgattcaatttcttgagt

SEQ ID NO: 8207040 - DNA, 21 bp, Homo sapiens
tattgattcaatttcttgagt

SEQ ID NO: 8207041 - DNA, 22 bp, Homo sapiens
tattgattcctgctttctgctc

SEQ ID NO: 8207042 - DNA, 22 bp, Homo sapiens
tattgcagaagaaatgaatgaa

SEQ ID NO: 8207043 - DNA, 22 bp, Homo sapiens
tattgtacatttcaaagtagct

SEQ ID NO: 8207044 - DNA, 22 bp, Homo sapiens
tattgtacatttcaaagtagct

SEQ ID NO: 8207045 - DNA, 22 bp, Homo sapiens
tattgtacatttcaaagtagct

SEQ ID NO: 8207046 - DNA, 22 bp, Homo sapiens
tattgtacagagagagaggttt

SEQ ID NO: 8207047 - DNA, 22 bp, Homo sapiens
tattgtacatggttatgcagga

SEQ ID NO: 8207048 - DNA, 22 bp, Homo sapiens
tattgtacatggttatgcagga

SEQ ID NO: 8207049 - DNA, 22 bp, Homo sapiens
tattggtgggggcagagagaga

SEQ ID NO: 8207050 - DNA, 22 bp, Homo sapiens
tattggtgtacttatagcagag

SEQ ID NO: 8207051 - DNA, 22 bp, Homo sapiens
tattggtttattgtgtatgaga

SEQ ID NO: 8207052 - DNA, 22 bp, Homo sapiens
tattgggtaaagatccagtttt

SEQ ID NO: 8207053 - DNA, 22 bp, Homo sapiens
tattggtaggactcagctgaga

SEQ ID NO: 8207054 - DNA, 22 bp, Homo sapiens
tattggtagatggagagagaca

SEQ ID NO: 8207055 - DNA, 22 bp, Homo sapiens
tattgcatcttagtgtaagtca

SEQ ID NO: 8207056 - DNA, 22 bp, Homo sapiens
tattgcatcttagtgtaagtca

SEQ ID NO: 8207057 - DNA, 22 bp, Homo sapiens
tattggtatggtaagaattgaa

SEQ ID NO: 8207058 - DNA, 19 bp, Homo sapiens
tattggtatgtgtgaggca

SEQ ID NO: 8207059 - DNA, 22 bp, Homo sapiens
tattggtcaatttcaccttgat

SEQ ID NO: 8207060 - DNA, 22 bp, Homo sapiens
tattggtcaagttgaggaccct

SEQ ID NO: 8207061 - DNA, 22 bp, Homo sapiens
tattggtatctgagacagagtt

SEQ ID NO: 8207062 - DNA, 22 bp, Homo sapiens
tattggtgatgacttgaggcca

SEQ ID NO: 8207063 - DNA, 22 bp, Homo sapiens
tattggtgatgacttgaggcca

SEQ ID NO: 8207064 - DNA, 19 bp, Homo sapiens
tatttcaggctcagagtct

SEQ ID NO: 8207065 - DNA, 22 bp, Homo sapiens
tatttcagctctttggattatc

SEQ ID NO: 8207066 - DNA, 22 bp, Homo sapiens
tatttcaggctatatttcttgt

SEQ ID NO: 8207067 - DNA, 22 bp, Homo sapiens
tatttcagcaagaagaatgtgg

SEQ ID NO: 8207068 - DNA, 21 bp, Homo sapiens
tatttcagaagagtctcagag

SEQ ID NO: 8207069 - DNA, 22 bp, Homo sapiens
tatttcagacactgatcttgca

SEQ ID NO: 8207070 - DNA, 22 bp, Homo sapiens
tatttcagagttgttttctgtc

SEQ ID NO: 8207071 - DNA, 22 bp, Homo sapiens
tatttcagagttgttttctgtc

SEQ ID NO: 8207072 - DNA, 22 bp, Homo sapiens
tatttcactccgagactctatg

SEQ ID NO: 8207073 - DNA, 22 bp, Homo sapiens
tatttcactcagtataccatag

SEQ ID NO: 8207074 - DNA, 22 bp, Homo sapiens
tatttcaccttactaagctgtg

SEQ ID NO: 8207075 - DNA, 22 bp, Homo sapiens
tattgtatcttaccacatgtat

SEQ ID NO: 8207076 - DNA, 22 bp, Homo sapiens
tatttcaacgtatgaaaagctg

SEQ ID NO: 8207077 - DNA, 22 bp, Homo sapiens
tatttcaagaacttctatccat

SEQ ID NO: 8207078 - DNA, 22 bp, Homo sapiens
tatttcaagaacttctatccat

SEQ ID NO: 8207079 - DNA, 22 bp, Homo sapiens
tatttcaccttactaagctgtg

SEQ ID NO: 8207080 - DNA, 22 bp, Homo sapiens
tatttcacctaaaagtgtcaaa

SEQ ID NO: 8207081 - DNA, 22 bp, Homo sapiens
tatttcacctaaaagtgtcaaa

SEQ ID NO: 8207082 - DNA, 22 bp, Homo sapiens
tatttcacatctatgaagtgag

SEQ ID NO: 8207083 - DNA, 22 bp, Homo sapiens
tatttcacagcagctcatttaa

SEQ ID NO: 8207084 - DNA, 22 bp, Homo sapiens
tatttcacaagatgctgatgct

SEQ ID NO: 8207085 - DNA, 22 bp, Homo sapiens
tatttcacagcagctcatttaa

SEQ ID NO: 8207086 - DNA, 22 bp, Homo sapiens
tatttcacataccacagagtgt

SEQ ID NO: 8207087 - DNA, 22 bp, Homo sapiens
tatttcacagcagctcatttaa

SEQ ID NO: 8207088 - DNA, 22 bp, Homo sapiens
tatttcacataccacagagtgt

SEQ ID NO: 8207089 - DNA, 22 bp, Homo sapiens
tatgttactcacatgttcttgc

SEQ ID NO: 8207090 - DNA, 22 bp, Homo sapiens
tatgttatattttgtcaattgt

SEQ ID NO: 8207091 - DNA, 19 bp, Homo sapiens
tatgttatgttgtttactc

SEQ ID NO: 8207092 - DNA, 19 bp, Homo sapiens
tatgttatgttgtttactc

SEQ ID NO: 8207093 - DNA, 19 bp, Homo sapiens
tatgttatgttgtttactc

SEQ ID NO: 8207094 - DNA, 22 bp, Homo sapiens
tatgttattttcatacaacaga

SEQ ID NO: 8207095 - DNA, 22 bp, Homo sapiens
tatgttaagtgggataatcaaa

SEQ ID NO: 8207096 - DNA, 22 bp, Homo sapiens
tatgttaagtgggataatcaaa

SEQ ID NO: 8207097 - DNA, 22 bp, Homo sapiens
tatgttacaaagtttttctaaa

SEQ ID NO: 8207098 - DNA, 22 bp, Homo sapiens
tatgttacaaagtttttctaaa

SEQ ID NO: 8207099 - DNA, 22 bp, Homo sapiens
tatgttaagtgggataatcaaa

SEQ ID NO: 8207100 - DNA, 22 bp, Homo sapiens
tatgttcatctggtgcatcagt

SEQ ID NO: 8207101 - DNA, 22 bp, Homo sapiens
tatgttattttcatacaacaga

SEQ ID NO: 8207102 - DNA, 22 bp, Homo sapiens
tatgttattttcatacaacaga

SEQ ID NO: 8207103 - DNA, 22 bp, Homo sapiens
tatgttattttcatacaacaga

SEQ ID NO: 8207104 - DNA, 22 bp, Homo sapiens
tatgttgaatagatgaatggca

SEQ ID NO: 8207105 - DNA, 22 bp, Homo sapiens
tatgttgaaattctgaccttca

SEQ ID NO: 8207106 - DNA, 22 bp, Homo sapiens
tatgttgagcattcagtgatct

SEQ ID NO: 8207107 - DNA, 22 bp, Homo sapiens
tatgttgagcattcagtgatct

SEQ ID NO: 8207108 - DNA, 22 bp, Homo sapiens
tatgttctgtctgtacagattt

SEQ ID NO: 8207109 - DNA, 22 bp, Homo sapiens
tatgttctgactctacatggga

SEQ ID NO: 8207110 - DNA, 22 bp, Homo sapiens
tatgtttaaatgtatgtgtatg

SEQ ID NO: 8207111 - DNA, 22 bp, Homo sapiens
tatgtttaaatgtatgtgtatg

SEQ ID NO: 8207112 - DNA, 22 bp, Homo sapiens
tatgtttacgctggtagaatta

SEQ ID NO: 8207113 - DNA, 22 bp, Homo sapiens
tatgtttaaatgtatgtgtatg

SEQ ID NO: 8207114 - DNA, 22 bp, Homo sapiens
tatgtttaaatgtatgtgtatg

SEQ ID NO: 8207115 - DNA, 22 bp, Homo sapiens
tatgcctacctccaaaatatat

SEQ ID NO: 8207116 - DNA, 22 bp, Homo sapiens
tatgcctgataactgtgtctct

SEQ ID NO: 8207117 - DNA, 22 bp, Homo sapiens
tatgcccttacaatgagcacaa

SEQ ID NO: 8207118 - DNA, 22 bp, Homo sapiens
tatgctccaaagacatgttgcc

SEQ ID NO: 8207119 - DNA, 22 bp, Homo sapiens
tatgctctcctcccagtcccag

SEQ ID NO: 8207120 - DNA, 22 bp, Homo sapiens
tatgctaagataaacagagtta

SEQ ID NO: 8207121 - DNA, 22 bp, Homo sapiens
tatgtgtttgacaccctgcaag

SEQ ID NO: 8207122 - DNA, 22 bp, Homo sapiens
tatgtgtttgacaccctgcaag

SEQ ID NO: 8207123 - DNA, 22 bp, Homo sapiens
tatgttaagtgggataatcaaa

SEQ ID NO: 8207124 - DNA, 22 bp, Homo sapiens
tatgttaaatgtttgatgttta

SEQ ID NO: 8207125 - DNA, 17 bp, Homo sapiens
tatgtgtgtttgcagca

SEQ ID NO: 8207126 - DNA, 22 bp, Homo sapiens
tatgtgttatttggtatacatt

SEQ ID NO: 8207127 - DNA, 22 bp, Homo sapiens
tatgtgtgtttcagtggaaatg

SEQ ID NO: 8207128 - DNA, 22 bp, Homo sapiens
tatgtgttatttggtatacatt

SEQ ID NO: 8207129 - DNA, 22 bp, Homo sapiens
tatgtgttatttggtatacatt

SEQ ID NO: 8207130 - DNA, 22 bp, Homo sapiens
tatgtgttgtatatgtgcagag

SEQ ID NO: 8207131 - DNA, 22 bp, Homo sapiens
tatgctttaacattaaacaaca

SEQ ID NO: 8207132 - DNA, 22 bp, Homo sapiens
tatgctgtgctagatacaatat

SEQ ID NO: 8207133 - DNA, 22 bp, Homo sapiens
tatgctgtggaaaatacaaaga

SEQ ID NO: 8207134 - DNA, 17 bp, Homo sapiens
tatgtgtgtgtttatac

SEQ ID NO: 8207135 - DNA, 17 bp, Homo sapiens
tatgtgtgtgtttatac

SEQ ID NO: 8207136 - DNA, 16 bp, Homo sapiens
tatgtgtgtgggagtg

SEQ ID NO: 8207137 - DNA, 19 bp, Homo sapiens
tatgtgtgtgtatttacat

SEQ ID NO: 8207138 - DNA, 19 bp, Homo sapiens
tatgtgtgtgtatttacat

SEQ ID NO: 8207139 - DNA, 22 bp, Homo sapiens
tattcacaggcacgaaatattg

SEQ ID NO: 8207140 - DNA, 22 bp, Homo sapiens
tattcacaggcacgaaatattg

SEQ ID NO: 8207141 - DNA, 22 bp, Homo sapiens
tattcaagattgaactggcaga

SEQ ID NO: 8207142 - DNA, 22 bp, Homo sapiens
tattcaaagtgcgaggtcaggg

SEQ ID NO: 8207143 - DNA, 22 bp, Homo sapiens
tattcaaagtgcgaggtcaggg

SEQ ID NO: 8207144 - DNA, 22 bp, Homo sapiens
tatgtttatactttgatgtact

SEQ ID NO: 8207145 - DNA, 22 bp, Homo sapiens
tatgtttagtatccattttcag

SEQ ID NO: 8207146 - DNA, 22 bp, Homo sapiens
tatgtttatactttgatgtact

SEQ ID NO: 8207147 - DNA, 22 bp, Homo sapiens
tatgtttatactttgatgtact

SEQ ID NO: 8207148 - DNA, 22 bp, Homo sapiens
tatgtttatactttgatgtact

SEQ ID NO: 8207149 - DNA, 22 bp, Homo sapiens
tatgtttatactttgatgtact

SEQ ID NO: 8207150 - DNA, 22 bp, Homo sapiens
tattcacaggctggagtgatgt

SEQ ID NO: 8207151 - DNA, 22 bp, Homo sapiens
tattcacaggctggagtgatgt

SEQ ID NO: 8207152 - DNA, 22 bp, Homo sapiens
tattcacagttgatttacagtt

SEQ ID NO: 8207153 - DNA, 22 bp, Homo sapiens
tattcacagttgatttacagtt

SEQ ID NO: 8207154 - DNA, 22 bp, Homo sapiens
tattgagttacagaaaatactt

SEQ ID NO: 8207155 - DNA, 22 bp, Homo sapiens
tattgatgaaagggattttgga

SEQ ID NO: 8207156 - DNA, 22 bp, Homo sapiens
tattgatcaggatccttttcca

SEQ ID NO: 8207157 - DNA, 22 bp, Homo sapiens
tattgatgcagagccaaattgc

SEQ ID NO: 8207158 - DNA, 22 bp, Homo sapiens
tattgatgcttggattgggcca

SEQ ID NO: 8207159 - DNA, 22 bp, Homo sapiens
tattgatgtatttctaggtgct

SEQ ID NO: 8207160 - DNA, 22 bp, Homo sapiens
tattgagacttccagtatatga

SEQ ID NO: 8207161 - DNA, 22 bp, Homo sapiens
tattgagaccagtgcttgctta

SEQ ID NO: 8207162 - DNA, 22 bp, Homo sapiens
tattgagacttccagtatatga

SEQ ID NO: 8207163 - DNA, 22 bp, Homo sapiens
tattgacttgggcattgagaga

SEQ ID NO: 8207164 - DNA, 22 bp, Homo sapiens
tattgagaaccctcaggaggca

SEQ ID NO: 8207165 - DNA, 22 bp, Homo sapiens
tattgacttttaaagtgatata

SEQ ID NO: 8207166 - DNA, 22 bp, Homo sapiens
tattcagaataaagactacatt

SEQ ID NO: 8207167 - DNA, 17 bp, Homo sapiens
tattcagaggagtattt

SEQ ID NO: 8207168 - DNA, 22 bp, Homo sapiens
tattcatagtaaacaaaagtgg

SEQ ID NO: 8207169 - DNA, 22 bp, Homo sapiens
tattcatagtaaacaaaagtgg

SEQ ID NO: 8207170 - DNA, 22 bp, Homo sapiens
tattcagagggttgaattttta

SEQ ID NO: 8207171 - DNA, 22 bp, Homo sapiens
tattcagagtattccatgaggt

SEQ ID NO: 8207172 - DNA, 22 bp, Homo sapiens
tatgcatagtggaattagcaaa

SEQ ID NO: 8207173 - DNA, 22 bp, Homo sapiens
tatgcatatagatgcacacaca

SEQ ID NO: 8207174 - DNA, 22 bp, Homo sapiens
tatgcatagatattatcagcca

SEQ ID NO: 8207175 - DNA, 22 bp, Homo sapiens
tatgcataggtatctatactca

SEQ ID NO: 8207176 - DNA, 22 bp, Homo sapiens
tatgcataattggataagtaga

SEQ ID NO: 8207177 - DNA, 22 bp, Homo sapiens
tatgcatacaatgagatattcc

SEQ ID NO: 8207178 - DNA, 22 bp, Homo sapiens
tatgcatgtggtatatgcttat

SEQ ID NO: 8207179 - DNA, 22 bp, Homo sapiens
tatgcatgtggtatatgcttat

SEQ ID NO: 8207180 - DNA, 22 bp, Homo sapiens
tatgccactgctctccatccta

SEQ ID NO: 8207181 - DNA, 22 bp, Homo sapiens
tatgcattatacattaatttct

SEQ ID NO: 8207182 - DNA, 22 bp, Homo sapiens
tatgcattcagaggttgggtgt

SEQ ID NO: 8207183 - DNA, 22 bp, Homo sapiens
tatgcacatataacctgcactg

SEQ ID NO: 8207184 - DNA, 22 bp, Homo sapiens
tatgcagcaccactcactgcag

SEQ ID NO: 8207185 - DNA, 20 bp, Homo sapiens
tatgataattacaaaatagt

SEQ ID NO: 8207186 - DNA, 20 bp, Homo sapiens
tatgataattacaaaatagt

SEQ ID NO: 8207187 - DNA, 22 bp, Homo sapiens
tatgagtttaaggctaaaatag

SEQ ID NO: 8207188 - DNA, 22 bp, Homo sapiens
tatcttgagagacaacacagca

SEQ ID NO: 8207189 - DNA, 22 bp, Homo sapiens
tatcttgtaataggtccacttg

SEQ ID NO: 8207190 - DNA, 22 bp, Homo sapiens
tatctttaacttgcagtattta

SEQ ID NO: 8207191 - DNA, 22 bp, Homo sapiens
tatctttaacttgcagtattta

SEQ ID NO: 8207192 - DNA, 22 bp, Homo sapiens
tatctttaacttgcagtattta

SEQ ID NO: 8207193 - DNA, 22 bp, Homo sapiens
tatctttaacttgcagtattta

SEQ ID NO: 8207194 - DNA, 22 bp, Homo sapiens
tatctttattatgtctatctgc

SEQ ID NO: 8207195 - DNA, 19 bp, Homo sapiens
tatctttatgcagtggtgg

SEQ ID NO: 8207196 - DNA, 22 bp, Homo sapiens
tatctttagaggaagagaatct

SEQ ID NO: 8207197 - DNA, 22 bp, Homo sapiens
tatctttagaggaagagaatct

SEQ ID NO: 8207198 - DNA, 22 bp, Homo sapiens
tatcttcaactaggattcattt

SEQ ID NO: 8207199 - DNA, 22 bp, Homo sapiens
tatcttcaatttattcaaggag

SEQ ID NO: 8207200 - DNA, 23 bp, Homo sapiens
tatcttacctcccttctttcctg

SEQ ID NO: 8207201 - DNA, 22 bp, Homo sapiens
tatcttacagactgaatgttgg

SEQ ID NO: 8207202 - DNA, 22 bp, Homo sapiens
tatcttacttatgctgatgtcc

SEQ ID NO: 8207203 - DNA, 20 bp, Homo sapiens
tatcttactttagtcatttg

SEQ ID NO: 8207204 - DNA, 22 bp, Homo sapiens
tatcttaaatgcatgatagaca

SEQ ID NO: 8207205 - DNA, 22 bp, Homo sapiens
tatcttaaaaatcgaagcagat

SEQ ID NO: 8207206 - DNA, 22 bp, Homo sapiens
tatctgtttgctcacaggtgtt

SEQ ID NO: 8207207 - DNA, 19 bp, Homo sapiens
tatctgtttcctgcttgtc

SEQ ID NO: 8207208 - DNA, 22 bp, Homo sapiens
tatctgttgtcttttacatgta

SEQ ID NO: 8207209 - DNA, 22 bp, Homo sapiens
tatctgttgtccatgcagaaag

SEQ ID NO: 8207210 - DNA, 22 bp, Homo sapiens
tatctgttgtagtacagatgat

SEQ ID NO: 8207211 - DNA, 22 bp, Homo sapiens
tatcaagagtctctacattaat

SEQ ID NO: 8207212 - DNA, 22 bp, Homo sapiens
tatcaagtgactatcacagaac

SEQ ID NO: 8207213 - DNA, 22 bp, Homo sapiens
tatcaatacatgttatcagtgt

SEQ ID NO: 8207214 - DNA, 22 bp, Homo sapiens
tatcaatacatgttatcagtgt

SEQ ID NO: 8207215 - DNA, 22 bp, Homo sapiens
tatcaatacatgttatcagtgt

SEQ ID NO: 8207216 - DNA, 22 bp, Homo sapiens
tatcacactagcctatagtgga

SEQ ID NO: 8207217 - DNA, 22 bp, Homo sapiens
tatcacaattcctatagtttgt

SEQ ID NO: 8207218 - DNA, 22 bp, Homo sapiens
tatctataatgttttacttcct

SEQ ID NO: 8207219 - DNA, 22 bp, Homo sapiens
tatctgtcacctgtagggtagg

SEQ ID NO: 8207220 - DNA, 22 bp, Homo sapiens
tatctgtcgcatacatacttgg

SEQ ID NO: 8207221 - DNA, 22 bp, Homo sapiens
tatctagatttctttctctgtg

SEQ ID NO: 8207222 - DNA, 22 bp, Homo sapiens
tatctataagtactaacatggt

SEQ ID NO: 8207223 - DNA, 22 bp, Homo sapiens
tatctataagtactaacatggt

SEQ ID NO: 8207224 - DNA, 22 bp, Homo sapiens
tatctgttaggatcagagctgg

SEQ ID NO: 8207225 - DNA, 22 bp, Homo sapiens
tatctgttatgggctgaattgc

SEQ ID NO: 8207226 - DNA, 22 bp, Homo sapiens
tatctgttcaatggaagatgac

SEQ ID NO: 8207227 - DNA, 22 bp, Homo sapiens
tatctgttcatgtttatatgtc

SEQ ID NO: 8207228 - DNA, 22 bp, Homo sapiens
tatctgttccaggcactcagct

SEQ ID NO: 8207229 - DNA, 22 bp, Homo sapiens
tatctgttcttagctatagatg

SEQ ID NO: 8207230 - DNA, 22 bp, Homo sapiens
tatctgttggctcctagttgta

SEQ ID NO: 8207231 - DNA, 18 bp, Homo sapiens
tatatttcacacatattc

SEQ ID NO: 8207232 - DNA, 18 bp, Homo sapiens
tatatttcacacatattc

SEQ ID NO: 8207233 - DNA, 18 bp, Homo sapiens
tatatttcacacatattc

SEQ ID NO: 8207234 - DNA, 18 bp, Homo sapiens
tatatttcacacatattc

SEQ ID NO: 8207235 - DNA, 19 bp, Homo sapiens
tatatttgagtgtgcatgc

SEQ ID NO: 8207236 - DNA, 22 bp, Homo sapiens
tatatttgctaaatgtgtgcaa

SEQ ID NO: 8207237 - DNA, 19 bp, Homo sapiens
tatatttgagtgtgcatgc

SEQ ID NO: 8207238 - DNA, 22 bp, Homo sapiens
tatatttgctaaatgtgtgcaa

SEQ ID NO: 8207239 - DNA, 22 bp, Homo sapiens
tatatttgtgtgtgatttatga

SEQ ID NO: 8207240 - DNA, 22 bp, Homo sapiens
tatatttaatcctagagccatt

SEQ ID NO: 8207241 - DNA, 22 bp, Homo sapiens
tatatttaatcctagagccatt

SEQ ID NO: 8207242 - DNA, 22 bp, Homo sapiens
tatatttaatcctagagccatt

SEQ ID NO: 8207243 - DNA, 22 bp, Homo sapiens
tatatttaattagttgctggat

SEQ ID NO: 8207244 - DNA, 22 bp, Homo sapiens
tatatttaaatccaggttgaaa

SEQ ID NO: 8207245 - DNA, 22 bp, Homo sapiens
tatatttaaatccaggttgaaa

SEQ ID NO: 8207246 - DNA, 22 bp, Homo sapiens
tatattttagacaccctcacgc

SEQ ID NO: 8207247 - DNA, 20 bp, Homo sapiens
tatattttctctttggcctt

SEQ ID NO: 8207248 - DNA, 20 bp, Homo sapiens
tatattttctctttggcctt

SEQ ID NO: 8207249 - DNA, 22 bp, Homo sapiens
tatattttagacaccctcacgc

SEQ ID NO: 8207250 - DNA, 22 bp, Homo sapiens
tatattttagacaccctcacgc

SEQ ID NO: 8207251 - DNA, 22 bp, Homo sapiens
tatattttagacaccctcacgc

SEQ ID NO: 8207252 - DNA, 19 bp, Homo sapiens
tatatttgttgaataaaaa

SEQ ID NO: 8207253 - DNA, 22 bp, Homo sapiens
tatatttgtgtgtgatttatga

SEQ ID NO: 8207254 - DNA, 22 bp, Homo sapiens
tatattttagacaccctcacgc

SEQ ID NO: 8207255 - DNA, 22 bp, Homo sapiens
tatattttagacaccctcacgc

SEQ ID NO: 8207256 - DNA, 19 bp, Homo sapiens
tatatttgttgaataaaaa

SEQ ID NO: 8207257 - DNA, 20 bp, Homo sapiens
tatattttctctttggcctt

SEQ ID NO: 8207258 - DNA, 20 bp, Homo sapiens
tatattttctctttggcctt

SEQ ID NO: 8207259 - DNA, 20 bp, Homo sapiens
tatattttctctttggcctt

SEQ ID NO: 8207260 - DNA, 22 bp, Homo sapiens
tatcaaaaggagttgaaagggg

SEQ ID NO: 8207261 - DNA, 23 bp, Homo sapiens
tagtgtcaagagggagtgtaatt

SEQ ID NO: 8207262 - DNA, 22 bp, Homo sapiens
tagtgtatgttcagcttatatg

SEQ ID NO: 8207263 - DNA, 22 bp, Homo sapiens
tagtgtatgtctaacatacact

SEQ ID NO: 8207264 - DNA, 22 bp, Homo sapiens
tagtgtttagtacatatgcata

SEQ ID NO: 8207265 - DNA, 22 bp, Homo sapiens
tagttaaaataatggagatgtt

SEQ ID NO: 8207266 - DNA, 22 bp, Homo sapiens
tagttaaaataatggagatgtt

SEQ ID NO: 8207267 - DNA, 22 bp, Homo sapiens
tagtgtttgggaattgtagaga

SEQ ID NO: 8207268 - DNA, 22 bp, Homo sapiens
tagttaaagccctaaattgata

SEQ ID NO: 8207269 - DNA, 22 bp, Homo sapiens
tagttaaagccctaaattgata

SEQ ID NO: 8207270 - DNA, 22 bp, Homo sapiens
tagttaaagccctaaattgata

SEQ ID NO: 8207271 - DNA, 22 bp, Homo sapiens
tagttaaagattctgttaagag

SEQ ID NO: 8207272 - DNA, 22 bp, Homo sapiens
tagttaattctttaagaacaag

SEQ ID NO: 8207273 - DNA, 22 bp, Homo sapiens
tagttaagaggccagtgtaata

SEQ ID NO: 8207274 - DNA, 22 bp, Homo sapiens
tagttaatgctaattaacaaat

SEQ ID NO: 8207275 - DNA, 22 bp, Homo sapiens
tagttaatgctaattaacaaat

SEQ ID NO: 8207276 - DNA, 22 bp, Homo sapiens
tatacagaaccgcctgaagtct

SEQ ID NO: 8207277 - DNA, 22 bp, Homo sapiens
tatacagaactgcacgtgcacg

SEQ ID NO: 8207278 - DNA, 22 bp, Homo sapiens
tatacagaactgcacgtgcacg

SEQ ID NO: 8207279 - DNA, 22 bp, Homo sapiens
tatactgagagcaaatacattc

SEQ ID NO: 8207280 - DNA, 22 bp, Homo sapiens
tatacttatgctaaaaaatgtt

SEQ ID NO: 8207281 - DNA, 22 bp, Homo sapiens
tatacttatgctaaaaaatgtt

SEQ ID NO: 8207282 - DNA, 22 bp, Homo sapiens
tatacttatgctaaaaaatgtt

SEQ ID NO: 8207283 - DNA, 22 bp, Homo sapiens
tatactttcctgcaactttgat

SEQ ID NO: 8207284 - DNA, 22 bp, Homo sapiens
tatactttcctgcaactttgat

SEQ ID NO: 8207285 - DNA, 22 bp, Homo sapiens
tatagaagagacatgtgcatag

SEQ ID NO: 8207286 - DNA, 22 bp, Homo sapiens
tatacagataatgaagaccaag

SEQ ID NO: 8207287 - DNA, 22 bp, Homo sapiens
tatacatgttttacataagtga

SEQ ID NO: 8207288 - DNA, 22 bp, Homo sapiens
tataccaaaatatcagaaaggg

SEQ ID NO: 8207289 - DNA, 22 bp, Homo sapiens
tatacgtgcaggtcacagggga

SEQ ID NO: 8207290 - DNA, 22 bp, Homo sapiens
tataccttccacaaaacagctt

SEQ ID NO: 8207291 - DNA, 20 bp, Homo sapiens
tatactaacatatatctgtt

SEQ ID NO: 8207292 - DNA, 20 bp, Homo sapiens
tatactaacatatatctgtt

SEQ ID NO: 8207293 - DNA, 22 bp, Homo sapiens
tatactctgagaaacgtgtcac

SEQ ID NO: 8207294 - DNA, 22 bp, Homo sapiens
tatactctgagaaacgtgtcac

SEQ ID NO: 8207295 - DNA, 22 bp, Homo sapiens
tatactctgaaaacaatagtag

SEQ ID NO: 8207296 - DNA, 22 bp, Homo sapiens
tatactatgcttctgatccaat

SEQ ID NO: 8207297 - DNA, 22 bp, Homo sapiens
tatactacgcaccaaacaaagg

SEQ ID NO: 8207298 - DNA, 22 bp, Homo sapiens
tatactatgcttctgatccaat

SEQ ID NO: 8207299 - DNA, 20 bp, Homo sapiens
tatactaacatatatctgtt

SEQ ID NO: 8207300 - DNA, 22 bp, Homo sapiens
tatattatcataaaaccattca

SEQ ID NO: 8207301 - DNA, 22 bp, Homo sapiens
tatattacctgcctgatctata

SEQ ID NO: 8207302 - DNA, 22 bp, Homo sapiens
tatattacctgcctgatctata

SEQ ID NO: 8207303 - DNA, 22 bp, Homo sapiens
tatattagtgagatttatccat

SEQ ID NO: 8207304 - DNA, 22 bp, Homo sapiens
tatattaacacccacttgcctc

SEQ ID NO: 8207305 - DNA, 22 bp, Homo sapiens
tatattaacacccacttgcctc

SEQ ID NO: 8207306 - DNA, 22 bp, Homo sapiens
tatattaaccatagggttctag

SEQ ID NO: 8207307 - DNA, 22 bp, Homo sapiens
tatattaacttgtgatcctgga

SEQ ID NO: 8207308 - DNA, 22 bp, Homo sapiens
tatattacctgcctgatctata

SEQ ID NO: 8207309 - DNA, 22 bp, Homo sapiens
tatattacatagtgtttgagat

SEQ ID NO: 8207310 - DNA, 20 bp, Homo sapiens
tatatgtgtacatacacaca

SEQ ID NO: 8207311 - DNA, 22 bp, Homo sapiens
tatatgtttcttacaaaatatt

SEQ ID NO: 8207312 - DNA, 22 bp, Homo sapiens
tatatgtttcttacaaaatatt

SEQ ID NO: 8207313 - DNA, 22 bp, Homo sapiens
tatatgttgatactaattctgg

SEQ ID NO: 8207314 - DNA, 22 bp, Homo sapiens
tatatgtgtggattcttgtaga

SEQ ID NO: 8207315 - DNA, 22 bp, Homo sapiens
tatatgtttttctaattaggga

SEQ ID NO: 8207316 - DNA, 22 bp, Homo sapiens
tatattaaaccctctctgtagg

SEQ ID NO: 8207317 - DNA, 22 bp, Homo sapiens
tatattaaagtgctttgcagtg

SEQ ID NO: 8207318 - DNA, 22 bp, Homo sapiens
tatattaaagtgctttgcagtg

SEQ ID NO: 8207319 - DNA, 22 bp, Homo sapiens
tatattaaatgaccagttttaa

SEQ ID NO: 8207320 - DNA, 22 bp, Homo sapiens
tatattaaatgaccagttttaa

SEQ ID NO: 8207321 - DNA, 18 bp, Homo sapiens
tatagacacatatgccag

SEQ ID NO: 8207322 - DNA, 22 bp, Homo sapiens
tatagacttgatggtattaagt

SEQ ID NO: 8207323 - DNA, 22 bp, Homo sapiens
tatagatagactgacgatacag

SEQ ID NO: 8207324 - DNA, 22 bp, Homo sapiens
tatagatagactgacgatacag

SEQ ID NO: 8207325 - DNA, 22 bp, Homo sapiens
tatagatagtcacttgttgcta

SEQ ID NO: 8207326 - DNA, 22 bp, Homo sapiens
tatagatagtcacttgttgcta

SEQ ID NO: 8207327 - DNA, 22 bp, Homo sapiens
tatagatagtcacttgttgcta

SEQ ID NO: 8207328 - DNA, 22 bp, Homo sapiens
tatagcaagcaggacagtctca

SEQ ID NO: 8207329 - DNA, 22 bp, Homo sapiens
tatatgcaatgaggtgggagta

SEQ ID NO: 8207330 - DNA, 22 bp, Homo sapiens
tatatgatgccaaataacctgt

SEQ ID NO: 8207331 - DNA, 22 bp, Homo sapiens
tatatgcagattttcatcatcg

SEQ ID NO: 8207332 - DNA, 22 bp, Homo sapiens
tatatgtagattgtaccaatgt

SEQ ID NO: 8207333 - DNA, 22 bp, Homo sapiens
tatatgtagattgtaccaatgt

SEQ ID NO: 8207334 - DNA, 22 bp, Homo sapiens
tatatgtagattgtaccaatgt

SEQ ID NO: 8207335 - DNA, 17 bp, Homo sapiens
tatatgtatgcctctcc

SEQ ID NO: 8207336 - DNA, 22 bp, Homo sapiens
tatatgtctgctactgtataaa

SEQ ID NO: 8207337 - DNA, 22 bp, Homo sapiens
tatatgtctgctactgtataaa

SEQ ID NO: 8207338 - DNA, 22 bp, Homo sapiens
tatatgtgcagcatttttaatt

SEQ ID NO: 8207339 - DNA, 22 bp, Homo sapiens
tatatgtagtcagtcagagtaa

SEQ ID NO: 8207340 - DNA, 22 bp, Homo sapiens
tatatgtaaataagtctaatgt

SEQ ID NO: 8207341 - DNA, 22 bp, Homo sapiens
tatatgtaaataagtctaatgt

SEQ ID NO: 8207342 - DNA, 22 bp, Homo sapiens
tatatgtaaataagtctaatgt

SEQ ID NO: 8207343 - DNA, 22 bp, Homo sapiens
tatatgtaagctatgtaagagt

SEQ ID NO: 8207344 - DNA, 22 bp, Homo sapiens
tatatgtaagctatgtaagagt

SEQ ID NO: 8207345 - DNA, 22 bp, Homo sapiens
tatatggatagtgatcataaga

SEQ ID NO: 8207346 - DNA, 22 bp, Homo sapiens
tatatgcatgcccatgtataca

SEQ ID NO: 8207347 - DNA, 22 bp, Homo sapiens
tatatgctctgggatcctgaaa

SEQ ID NO: 8207348 - DNA, 22 bp, Homo sapiens
tatatgcatgcccatgtataca

SEQ ID NO: 8207349 - DNA, 22 bp, Homo sapiens
tatatgcatgcccatgtataca

SEQ ID NO: 8207350 - DNA, 22 bp, Homo sapiens
ggagagctggtagctggctcca

SEQ ID NO: 8207351 - DNA, 22 bp, Homo sapiens
ggagagaggagcccactgctgt

SEQ ID NO: 8207352 - DNA, 22 bp, Homo sapiens
ggagagagatgccgccttgctc

SEQ ID NO: 8207353 - DNA, 22 bp, Homo sapiens
ggagagagatgccgccttgctc

SEQ ID NO: 8207354 - DNA, 22 bp, Homo sapiens
ggactgaggcccacttgaggga

SEQ ID NO: 8207355 - DNA, 22 bp, Homo sapiens
ggagagagagctcattagctgc

SEQ ID NO: 8207356 - DNA, 22 bp, Homo sapiens
ggactctgttttcctgatcact

SEQ ID NO: 8207357 - DNA, 22 bp, Homo sapiens
ggactgaggacatgtgaggcat

SEQ ID NO: 8207358 - DNA, 22 bp, Homo sapiens
ggactgaggacatgtgaggcat

SEQ ID NO: 8207359 - DNA, 22 bp, Homo sapiens
ggactgaggacatgtgaggcat

SEQ ID NO: 8207360 - DNA, 22 bp, Homo sapiens
ggacctgctctcccagttctct

SEQ ID NO: 8207361 - DNA, 22 bp, Homo sapiens
ggacctggaagtttggtgatcc

SEQ ID NO: 8207362 - DNA, 22 bp, Homo sapiens
ggactctggctcagtgttgctt

SEQ ID NO: 8207363 - DNA, 22 bp, Homo sapiens
ggactctggctcagtgttgctt

SEQ ID NO: 8207364 - DNA, 22 bp, Homo sapiens
ggactctgtagaggttctcatt

SEQ ID NO: 8207365 - DNA, 21 bp, Homo sapiens
ggactctacacaggccatctt

SEQ ID NO: 8207366 - DNA, 22 bp, Homo sapiens
ggactcctctagaagttgaggc

SEQ ID NO: 8207367 - DNA, 22 bp, Homo sapiens
ggactcagcagccaggagtggc

SEQ ID NO: 8207368 - DNA, 20 bp, Homo sapiens
ggactacaatttgcagtgtg

SEQ ID NO: 8207369 - DNA, 22 bp, Homo sapiens
ggacggggagctggaaagggga

SEQ ID NO: 8207370 - DNA, 22 bp, Homo sapiens
ggacggggagctggaaagggga

SEQ ID NO: 8207371 - DNA, 22 bp, Homo sapiens
ggagaggcttccagagtcgtgc

SEQ ID NO: 8207372 - DNA, 22 bp, Homo sapiens
ggagaggcttccagagtcgtgc

SEQ ID NO: 8207373 - DNA, 22 bp, Homo sapiens
ggagaggcttccagagtcgtgc

SEQ ID NO: 8207374 - DNA, 22 bp, Homo sapiens
ggagaggcttccagagtcgtgc

SEQ ID NO: 8207375 - DNA, 19 bp, Homo sapiens
ggagaggctggagggatgc

SEQ ID NO: 8207376 - DNA, 19 bp, Homo sapiens
ggagaggctggagggatgc

SEQ ID NO: 8207377 - DNA, 19 bp, Homo sapiens
ggagaggctggagggatgc

SEQ ID NO: 8207378 - DNA, 19 bp, Homo sapiens
ggagaggctggagggatgc

SEQ ID NO: 8207379 - DNA, 19 bp, Homo sapiens
ggagaggctggagggatgc

SEQ ID NO: 8207380 - DNA, 22 bp, Homo sapiens
ggagaggagctattgggggctc

SEQ ID NO: 8207381 - DNA, 22 bp, Homo sapiens
ggagaggatgttttagtaactt

SEQ ID NO: 8207382 - DNA, 22 bp, Homo sapiens
ggagaggcgatgagtcacagcc

SEQ ID NO: 8207383 - DNA, 22 bp, Homo sapiens
ggagaggcgatgagtcacagcc

SEQ ID NO: 8207384 - DNA, 22 bp, Homo sapiens
ggagaggcgatgagtcacagcc

SEQ ID NO: 8207385 - DNA, 22 bp, Homo sapiens
ggagaggacatggctcccacag

SEQ ID NO: 8207386 - DNA, 22 bp, Homo sapiens
ggagaggacatggctcccacag

SEQ ID NO: 8207387 - DNA, 22 bp, Homo sapiens
ggagaggaaatgccagcacttc

SEQ ID NO: 8207388 - DNA, 22 bp, Homo sapiens
ggagaggaaatgccagcacttc

SEQ ID NO: 8207389 - DNA, 22 bp, Homo sapiens
ggagaggaaatgccagcacttc

SEQ ID NO: 8207390 - DNA, 22 bp, Homo sapiens
ggagaggagattgtggcatttt

SEQ ID NO: 8207391 - DNA, 22 bp, Homo sapiens
ggagaggagattgtggcatttt

SEQ ID NO: 8207392 - DNA, 22 bp, Homo sapiens
ggagaggagattgtggcatttt

SEQ ID NO: 8207393 - DNA, 22 bp, Homo sapiens
ggagaggaaatgccagcacttc

SEQ ID NO: 8207394 - DNA, 22 bp, Homo sapiens
ggagaggaaatgccagcacttc

SEQ ID NO: 8207395 - DNA, 22 bp, Homo sapiens
ggagaggaaatgccagcacttc

SEQ ID NO: 8207396 - DNA, 22 bp, Homo sapiens
ggagaggaaatgccagcacttc

SEQ ID NO: 8207397 - DNA, 22 bp, Homo sapiens
ggagaggaaatgccagcacttc

SEQ ID NO: 8207398 - DNA, 22 bp, Homo sapiens
ggagagcttggagtgcgatttt

SEQ ID NO: 8207399 - DNA, 22 bp, Homo sapiens
ggacagactttacagccccggg

SEQ ID NO: 8207400 - DNA, 22 bp, Homo sapiens
ggacagacagtgtgagtgaggc

SEQ ID NO: 8207401 - DNA, 22 bp, Homo sapiens
ggacagacaaaaatagtaagca

SEQ ID NO: 8207402 - DNA, 19 bp, Homo sapiens
ggacagacgcagagatctg

SEQ ID NO: 8207403 - DNA, 22 bp, Homo sapiens
ggacagagcagacgagcagcgg

SEQ ID NO: 8207404 - DNA, 22 bp, Homo sapiens
ggacagagcagacgagcagcgg

SEQ ID NO: 8207405 - DNA, 22 bp, Homo sapiens
ggacagagcagacgagcagcgg

SEQ ID NO: 8207406 - DNA, 22 bp, Homo sapiens
ggacagagccctggtggcctaa

SEQ ID NO: 8207407 - DNA, 22 bp, Homo sapiens
ggacagagccctggtggcctaa

SEQ ID NO: 8207408 - DNA, 22 bp, Homo sapiens
ggacagagccctggtggcctaa

SEQ ID NO: 8207409 - DNA, 22 bp, Homo sapiens
ggacagagccctggtggcctaa

SEQ ID NO: 8207410 - DNA, 22 bp, Homo sapiens
ggacagagccctggtggcctaa

SEQ ID NO: 8207411 - DNA, 22 bp, Homo sapiens
ggacactgaagaatctcagatg

SEQ ID NO: 8207412 - DNA, 21 bp, Homo sapiens
ggacactgataatcttgttgc

SEQ ID NO: 8207413 - DNA, 21 bp, Homo sapiens
ggacactgataatcttgttgc

SEQ ID NO: 8207414 - DNA, 23 bp, Homo sapiens
ggacactgctataaaggatctgc

SEQ ID NO: 8207415 - DNA, 17 bp, Homo sapiens
ggacacctggagtctcc

SEQ ID NO: 8207416 - DNA, 22 bp, Homo sapiens
ggacagaaaccatatgagtgta

SEQ ID NO: 8207417 - DNA, 22 bp, Homo sapiens
ggacacttgtttggttaggcct

SEQ ID NO: 8207418 - DNA, 22 bp, Homo sapiens
ggacactgttcatggggagggg

SEQ ID NO: 8207419 - DNA, 22 bp, Homo sapiens
ggacactgttcatggggagggg

SEQ ID NO: 8207420 - DNA, 23 bp, Homo sapiens
ggacactgtgcagatgctagtgc

SEQ ID NO: 8207421 - DNA, 23 bp, Homo sapiens
ggacactgtgcagatgctagtgc

SEQ ID NO: 8207422 - DNA, 22 bp, Homo sapiens
ggacactgttcatggggagggg

SEQ ID NO: 8207423 - DNA, 22 bp, Homo sapiens
ggacactgtataagttagagta

SEQ ID NO: 8207424 - DNA, 20 bp, Homo sapiens
ggacactgtagatttcaaac

SEQ ID NO: 8207425 - DNA, 22 bp, Homo sapiens
ggacactggccacatttcaaaa

SEQ ID NO: 8207426 - DNA, 21 bp, Homo sapiens
ggacagaggagaaggcaccct

SEQ ID NO: 8207427 - DNA, 22 bp, Homo sapiens
ggacagagggcaggagcccaga

SEQ ID NO: 8207428 - DNA, 21 bp, Homo sapiens
ggacagaggagaaggcaccct

SEQ ID NO: 8207429 - DNA, 22 bp, Homo sapiens
ggacccagaggggagtctggca

SEQ ID NO: 8207430 - DNA, 22 bp, Homo sapiens
ggacccagctctgagaccctgc

SEQ ID NO: 8207431 - DNA, 22 bp, Homo sapiens
ggacccagaggggagtctggca

SEQ ID NO: 8207432 - DNA, 22 bp, Homo sapiens
ggacccagctctgagaccctgc

SEQ ID NO: 8207433 - DNA, 18 bp, Homo sapiens
ggacccagggcctcaccc

SEQ ID NO: 8207434 - DNA, 18 bp, Homo sapiens
ggacccagggcctcaccc

SEQ ID NO: 8207435 - DNA, 22 bp, Homo sapiens
ggaccctgggctctgggcctat

SEQ ID NO: 8207436 - DNA, 22 bp, Homo sapiens
ggaccctgggcagctggctgct

SEQ ID NO: 8207437 - DNA, 22 bp, Homo sapiens
ggaccctgggcagctggctgct

SEQ ID NO: 8207438 - DNA, 23 bp, Homo sapiens
ggaccctgtggagggtgagagtc

SEQ ID NO: 8207439 - DNA, 22 bp, Homo sapiens
ggacctgaacataaaacgaggc

SEQ ID NO: 8207440 - DNA, 22 bp, Homo sapiens
ggacctgaacataaaacgaggc

SEQ ID NO: 8207441 - DNA, 22 bp, Homo sapiens
ggacctgccagaactcaggcta

SEQ ID NO: 8207442 - DNA, 22 bp, Homo sapiens
ggacctgccagaactcaggcta

SEQ ID NO: 8207443 - DNA, 22 bp, Homo sapiens
ggacctgagaacgccttggctt

SEQ ID NO: 8207444 - DNA, 22 bp, Homo sapiens
ggaaagctcagatcttgttgga

SEQ ID NO: 8207445 - DNA, 22 bp, Homo sapiens
ggaaagctttgtacttgaaaac

SEQ ID NO: 8207446 - DNA, 22 bp, Homo sapiens
gcttcctgatattcatactgtt

SEQ ID NO: 8207447 - DNA, 22 bp, Homo sapiens
ggaaaggagatattggagagtg

SEQ ID NO: 8207448 - DNA, 22 bp, Homo sapiens
ggaaaggagatgaataggatta

SEQ ID NO: 8207449 - DNA, 22 bp, Homo sapiens
ggaaaggagatattggagagtg

SEQ ID NO: 8207450 - DNA, 22 bp, Homo sapiens
ggaaagggagttttgcttatga

SEQ ID NO: 8207451 - DNA, 22 bp, Homo sapiens
ggaaagggagttttgcttatga

SEQ ID NO: 8207452 - DNA, 22 bp, Homo sapiens
ggaaagggagttttgcttatga

SEQ ID NO: 8207453 - DNA, 22 bp, Homo sapiens
ggaaagggcagaggccttggag

SEQ ID NO: 8207454 - DNA, 22 bp, Homo sapiens
ggaaaggctaacagtcatggaa

SEQ ID NO: 8207455 - DNA, 22 bp, Homo sapiens
ggaaaggctaacagtcatggaa

SEQ ID NO: 8207456 - DNA, 22 bp, Homo sapiens
ggaaatcaaggggacaaattgt

SEQ ID NO: 8207457 - DNA, 22 bp, Homo sapiens
ggaaatccttctaaaaagtcag

SEQ ID NO: 8207458 - DNA, 22 bp, Homo sapiens
ggaaagggcagaggccttggag

SEQ ID NO: 8207459 - DNA, 22 bp, Homo sapiens
ggaaagggcagaggccttggag

SEQ ID NO: 8207460 - DNA, 22 bp, Homo sapiens
ggaaaggggcctggatcttttg

SEQ ID NO: 8207461 - DNA, 22 bp, Homo sapiens
ggaaagggcatggccttttcac

SEQ ID NO: 8207462 - DNA, 22 bp, Homo sapiens
ggaaaggggcctggatcttttg

SEQ ID NO: 8207463 - DNA, 22 bp, Homo sapiens
ggaaagggcatggccttttcac

SEQ ID NO: 8207464 - DNA, 22 bp, Homo sapiens
ggaaagggcagaggccttggag

SEQ ID NO: 8207465 - DNA, 22 bp, Homo sapiens
ggaaagggcagaggccttggag

SEQ ID NO: 8207466 - DNA, 22 bp, Homo sapiens
ggaaagggcagaggccttggag

SEQ ID NO: 8207467 - DNA, 22 bp, Homo sapiens
ggaaagtggtggtggaaagagg

SEQ ID NO: 8207468 - DNA, 17 bp, Homo sapiens
ggaaaggtagagtaatc

SEQ ID NO: 8207469 - DNA, 22 bp, Homo sapiens
ggaaaggggcctggatcttttg

SEQ ID NO: 8207470 - DNA, 22 bp, Homo sapiens
ggaaaggggcctggatcttttg

SEQ ID NO: 8207471 - DNA, 22 bp, Homo sapiens
ggaaaggggcctggatcttttg

SEQ ID NO: 8207472 - DNA, 17 bp, Homo sapiens
ggaaaggtagagtaatc

SEQ ID NO: 8207473 - DNA, 22 bp, Homo sapiens
gcttcctcctggaggtcactca

SEQ ID NO: 8207474 - DNA, 22 bp, Homo sapiens
gcttcctcctggaggtcactca

SEQ ID NO: 8207475 - DNA, 22 bp, Homo sapiens
gcttcctccatctggggcttgc

SEQ ID NO: 8207476 - DNA, 22 bp, Homo sapiens
gcttcctccctgctgctcacta

SEQ ID NO: 8207477 - DNA, 22 bp, Homo sapiens
gcttcctccctgctgctcacta

SEQ ID NO: 8207478 - DNA, 18 bp, Homo sapiens
gcttcctgaaagctgccc

SEQ ID NO: 8207479 - DNA, 22 bp, Homo sapiens
gcttcctgagaaacaatctgat

SEQ ID NO: 8207480 - DNA, 18 bp, Homo sapiens
gcttcctgaaagctgccc

SEQ ID NO: 8207481 - DNA, 22 bp, Homo sapiens
gcttcctgagacaacattgagt

SEQ ID NO: 8207482 - DNA, 22 bp, Homo sapiens
gcttcctgagagagacagttcc

SEQ ID NO: 8207483 - DNA, 22 bp, Homo sapiens
gcttcctgagagagacagttcc

SEQ ID NO: 8207484 - DNA, 22 bp, Homo sapiens
gcttcctgagtacaccctcatc

SEQ ID NO: 8207485 - DNA, 22 bp, Homo sapiens
gcttcctagcattagccattgc

SEQ ID NO: 8207486 - DNA, 17 bp, Homo sapiens
gcttcccctgccctctc

SEQ ID NO: 8207487 - DNA, 22 bp, Homo sapiens
gcttccgcgatgtcctaggtgg

SEQ ID NO: 8207488 - DNA, 22 bp, Homo sapiens
gcttcccaggcgcctgaccttt

SEQ ID NO: 8207489 - DNA, 23 bp, Homo sapiens
gcttcccagacaatactgcttcc

SEQ ID NO: 8207490 - DNA, 22 bp, Homo sapiens
ggaacagttgagatgatgtacc

SEQ ID NO: 8207491 - DNA, 22 bp, Homo sapiens
ggaacagttgcgtcatgggcct

SEQ ID NO: 8207492 - DNA, 22 bp, Homo sapiens
ggaacagggatttggcctggtt

SEQ ID NO: 8207493 - DNA, 22 bp, Homo sapiens
ggaacagggatttggcctggtt

SEQ ID NO: 8207494 - DNA, 22 bp, Homo sapiens
ggaacagggatttggcctggtt

SEQ ID NO: 8207495 - DNA, 20 bp, Homo sapiens
ggaacatgaatgtgagtggc

SEQ ID NO: 8207496 - DNA, 21 bp, Homo sapiens
ggaacattgttaatagtctct

SEQ ID NO: 8207497 - DNA, 22 bp, Homo sapiens
ggaacattggcattttaaggct

SEQ ID NO: 8207498 - DNA, 22 bp, Homo sapiens
ggaacattctagagtgttgtga

SEQ ID NO: 8207499 - DNA, 22 bp, Homo sapiens
ggaacatttcctggcagagagg

SEQ ID NO: 8207500 - DNA, 15 bp, Homo sapiens
ggaacatttctgttt

SEQ ID NO: 8207501 - DNA, 22 bp, Homo sapiens
ggaacatttaaattcttatttg

SEQ ID NO: 8207502 - DNA, 21 bp, Homo sapiens
ggaacattgttaatagtctct

SEQ ID NO: 8207503 - DNA, 22 bp, Homo sapiens
ggaacattttttaaggcagaaa

SEQ ID NO: 8207504 - DNA, 22 bp, Homo sapiens
ggaagccagagtgctgggcagg

SEQ ID NO: 8207505 - DNA, 22 bp, Homo sapiens
ggaagccacccagctttgatag

SEQ ID NO: 8207506 - DNA, 22 bp, Homo sapiens
ggaagccagaaagtgagaatat

SEQ ID NO: 8207507 - DNA, 22 bp, Homo sapiens
ggaagccagaaagtgagaatat

SEQ ID NO: 8207508 - DNA, 22 bp, Homo sapiens
ggaagccaaggtggcctctatt

SEQ ID NO: 8207509 - DNA, 22 bp, Homo sapiens
ggaagccacccagctttgatag

SEQ ID NO: 8207510 - DNA, 22 bp, Homo sapiens
ggaagccaaggtggcctctatt

SEQ ID NO: 8207511 - DNA, 22 bp, Homo sapiens
ggaagcaggaggctggggtaaa

SEQ ID NO: 8207512 - DNA, 22 bp, Homo sapiens
ggaagcaggaggctggggtaaa

SEQ ID NO: 8207513 - DNA, 21 bp, Homo sapiens
ggaagcagtggcggcaactcc

SEQ ID NO: 8207514 - DNA, 20 bp, Homo sapiens
ggaagccagcatccttgagg

SEQ ID NO: 8207515 - DNA, 22 bp, Homo sapiens
ggaagccaggccaatgagaaca

SEQ ID NO: 8207516 - DNA, 22 bp, Homo sapiens
ggaagccaggccaatgagaaca

SEQ ID NO: 8207517 - DNA, 22 bp, Homo sapiens
ggaagccaggccaatgagaaca

SEQ ID NO: 8207518 - DNA, 22 bp, Homo sapiens
ggaagccaggctgggggatctg

SEQ ID NO: 8207519 - DNA, 22 bp, Homo sapiens
ggaagccaggcccagagatgct

SEQ ID NO: 8207520 - DNA, 20 bp, Homo sapiens
ggaagccagggtgcagggga

SEQ ID NO: 8207521 - DNA, 22 bp, Homo sapiens
ggaagccaggctgggggatctg

SEQ ID NO: 8207522 - DNA, 21 bp, Homo sapiens
ggacaccagtcacactggatt

SEQ ID NO: 8207523 - DNA, 21 bp, Homo sapiens
ggacaccagtcacactggatt

SEQ ID NO: 8207524 - DNA, 22 bp, Homo sapiens
ggaaggaagtgaccaggatatc

SEQ ID NO: 8207525 - DNA, 22 bp, Homo sapiens
ggaaggaaattggggcagttgt

SEQ ID NO: 8207526 - DNA, 22 bp, Homo sapiens
ggaagctttctctgtttcctta

SEQ ID NO: 8207527 - DNA, 22 bp, Homo sapiens
ggaagctgttgtgagtgcagca

SEQ ID NO: 8207528 - DNA, 22 bp, Homo sapiens
ggaagctgttgtgagtgcagca

SEQ ID NO: 8207529 - DNA, 22 bp, Homo sapiens
ggaagcttaatgcctaatttcc

SEQ ID NO: 8207530 - DNA, 22 bp, Homo sapiens
ggaagctgttgtgagtgcagca

SEQ ID NO: 8207531 - DNA, 22 bp, Homo sapiens
ggaagctgttgtgagtgcagca

SEQ ID NO: 8207532 - DNA, 22 bp, Homo sapiens
ggaagcttcatacctttattta

SEQ ID NO: 8207533 - DNA, 22 bp, Homo sapiens
ggaagcttaatgcctaatttcc

SEQ ID NO: 8207534 - DNA, 21 bp, Homo sapiens
ggaagcttccttggtgatcac

SEQ ID NO: 8207535 - DNA, 22 bp, Homo sapiens
ggaagcttcatacctttattta

SEQ ID NO: 8207536 - DNA, 21 bp, Homo sapiens
ggaagctgtgtccatgctcct

SEQ ID NO: 8207537 - DNA, 22 bp, Homo sapiens
ggaagctgttatcatctgtatc

SEQ ID NO: 8207538 - DNA, 22 bp, Homo sapiens
ggaagctgttatcatctgtatc

SEQ ID NO: 8207539 - DNA, 22 bp, Homo sapiens
ggaagctgttcctgtgtggcca

SEQ ID NO: 8207540 - DNA, 22 bp, Homo sapiens
ggaagctgttcctgtgtggcca

SEQ ID NO: 8207541 - DNA, 22 bp, Homo sapiens
ggaagccatgagggacagttct

SEQ ID NO: 8207542 - DNA, 22 bp, Homo sapiens
ggaagccatgagggacagttct

SEQ ID NO: 8207543 - DNA, 22 bp, Homo sapiens
ggaagccagttgcttggtgtgg

SEQ ID NO: 8207544 - DNA, 22 bp, Homo sapiens
ggaagccaggttactgttcaga

SEQ ID NO: 8207545 - DNA, 19 bp, Homo sapiens
ggaagccaggtcagcccac

SEQ ID NO: 8207546 - DNA, 19 bp, Homo sapiens
ggaagccaggtcagcccac

SEQ ID NO: 8207547 - DNA, 22 bp, Homo sapiens
ggaagccccagcatggccttgg

SEQ ID NO: 8207548 - DNA, 19 bp, Homo sapiens
ggaagccctgggtcagagc

SEQ ID NO: 8207549 - DNA, 19 bp, Homo sapiens
ggaagccctaaaggaccta

SEQ ID NO: 8207550 - DNA, 22 bp, Homo sapiens
gctgggttttcttccgggccta

SEQ ID NO: 8207551 - DNA, 22 bp, Homo sapiens
gctggtagacctcactgcactc

SEQ ID NO: 8207552 - DNA, 22 bp, Homo sapiens
gctgggttttcttccgggccta

SEQ ID NO: 8207553 - DNA, 22 bp, Homo sapiens
gctgggtttccagcaggcagga

SEQ ID NO: 8207554 - DNA, 22 bp, Homo sapiens
gctgggtttccagcaggcagga

SEQ ID NO: 8207555 - DNA, 22 bp, Homo sapiens
gctgggttttcttccgggccta

SEQ ID NO: 8207556 - DNA, 22 bp, Homo sapiens
gctggtagacctcactgcactc

SEQ ID NO: 8207557 - DNA, 22 bp, Homo sapiens
gctggtagacctcactgcactc

SEQ ID NO: 8207558 - DNA, 22 bp, Homo sapiens
gctggtcactctgggagctgct

SEQ ID NO: 8207559 - DNA, 22 bp, Homo sapiens
gctggtatttgcagcctgtcat

SEQ ID NO: 8207560 - DNA, 22 bp, Homo sapiens
gctgtcttcacttcctggtttc

SEQ ID NO: 8207561 - DNA, 19 bp, Homo sapiens
gctgggtggggtccacagc

SEQ ID NO: 8207562 - DNA, 22 bp, Homo sapiens
gctgggtgtcacggggctcgtg

SEQ ID NO: 8207563 - DNA, 22 bp, Homo sapiens
gctgggtgtcacggggctcgtg

SEQ ID NO: 8207564 - DNA, 22 bp, Homo sapiens
gctgggtggatcggaggctctg

SEQ ID NO: 8207565 - DNA, 22 bp, Homo sapiens
gctgggtggatcggaggctctg

SEQ ID NO: 8207566 - DNA, 22 bp, Homo sapiens
gctgggtgattcatttccataa

SEQ ID NO: 8207567 - DNA, 22 bp, Homo sapiens
gctgggtggatcggaggctctg

SEQ ID NO: 8207568 - DNA, 22 bp, Homo sapiens
gctgggtggatcggaggctctg

SEQ ID NO: 8207569 - DNA, 22 bp, Homo sapiens
gctgggtggatcggaggctctg

SEQ ID NO: 8207570 - DNA, 22 bp, Homo sapiens
gctgggtctctccctggtcctg

SEQ ID NO: 8207571 - DNA, 22 bp, Homo sapiens
gctgggtcctatgctggtagag

SEQ ID NO: 8207572 - DNA, 19 bp, Homo sapiens
gctgggtgaggtcgttgga

SEQ ID NO: 8207573 - DNA, 19 bp, Homo sapiens
gctgggtgaggtcgttgga

SEQ ID NO: 8207574 - DNA, 22 bp, Homo sapiens
gctgggtgattcatttccataa

SEQ ID NO: 8207575 - DNA, 22 bp, Homo sapiens
gctggggtctgtgaggagggct

SEQ ID NO: 8207576 - DNA, 22 bp, Homo sapiens
gctggggtctgtgaggagggct

SEQ ID NO: 8207577 - DNA, 22 bp, Homo sapiens
gctggggtctgtgaggagggct

SEQ ID NO: 8207578 - DNA, 18 bp, Homo sapiens
gctggggttgagctctcc

SEQ ID NO: 8207579 - DNA, 22 bp, Homo sapiens
gctggggtgtggtggataagct

SEQ ID NO: 8207580 - DNA, 22 bp, Homo sapiens
gctggggtgtggtggataagct

SEQ ID NO: 8207581 - DNA, 22 bp, Homo sapiens
gctggggtgtggtggataagct

SEQ ID NO: 8207582 - DNA, 22 bp, Homo sapiens
gctggggtgtggtggataagct

SEQ ID NO: 8207583 - DNA, 22 bp, Homo sapiens
gctgggtcctatgctggtagag

SEQ ID NO: 8207584 - DNA, 22 bp, Homo sapiens
gctgggtccatggtcctcgggt

SEQ ID NO: 8207585 - DNA, 22 bp, Homo sapiens
gctgggaggcagcacctttagc

SEQ ID NO: 8207586 - DNA, 22 bp, Homo sapiens
gctgggaggcagcacctttagc

SEQ ID NO: 8207587 - DNA, 16 bp, Homo sapiens
gctgggagggagaggt

SEQ ID NO: 8207588 - DNA, 16 bp, Homo sapiens
gctgggagggagaggt

SEQ ID NO: 8207589 - DNA, 16 bp, Homo sapiens
gctgggagggagaggt

SEQ ID NO: 8207590 - DNA, 16 bp, Homo sapiens
gctgggagggagaggt

SEQ ID NO: 8207591 - DNA, 16 bp, Homo sapiens
gctgggagggagaggt

SEQ ID NO: 8207592 - DNA, 22 bp, Homo sapiens
gctgggagggaggctataccct

SEQ ID NO: 8207593 - DNA, 22 bp, Homo sapiens
gctgggagtcgcgtctgtggcc

SEQ ID NO: 8207594 - DNA, 20 bp, Homo sapiens
gctgggggtgtgctgagtga

SEQ ID NO: 8207595 - DNA, 20 bp, Homo sapiens
gctgggggtgtgctgagtga

SEQ ID NO: 8207596 - DNA, 20 bp, Homo sapiens
gctgggggtgtgctgagtga

SEQ ID NO: 8207597 - DNA, 20 bp, Homo sapiens
gctgggggtgtgctgagtga

SEQ ID NO: 8207598 - DNA, 22 bp, Homo sapiens
gctgggagtgggcaagatgaga

SEQ ID NO: 8207599 - DNA, 22 bp, Homo sapiens
gctgggagtcgcgtctgtggcc

SEQ ID NO: 8207600 - DNA, 22 bp, Homo sapiens
gctgggagtcgcgtctgtggcc

SEQ ID NO: 8207601 - DNA, 22 bp, Homo sapiens
gctgggagtcgcgtctgtggcc

SEQ ID NO: 8207602 - DNA, 22 bp, Homo sapiens
gctgggagtcgcgtctgtggcc

SEQ ID NO: 8207603 - DNA, 22 bp, Homo sapiens
gcttcattttgccctctggtgg

SEQ ID NO: 8207604 - DNA, 20 bp, Homo sapiens
gcttcatttgcaagtctagt

SEQ ID NO: 8207605 - DNA, 22 bp, Homo sapiens
gctgtgcccatattctgctgac

SEQ ID NO: 8207606 - DNA, 21 bp, Homo sapiens
gcttccaagatggcaccttga

SEQ ID NO: 8207607 - DNA, 22 bp, Homo sapiens
gcttccaagcggtagatagcat

SEQ ID NO: 8207608 - DNA, 22 bp, Homo sapiens
gcttccacctactaaatgccac

SEQ ID NO: 8207609 - DNA, 22 bp, Homo sapiens
gcttccagtaactcttgaaagg

SEQ ID NO: 8207610 - DNA, 22 bp, Homo sapiens
gcttccagtaagttgctgccat

SEQ ID NO: 8207611 - DNA, 22 bp, Homo sapiens
gcttccatgtatgctcttgaca

SEQ ID NO: 8207612 - DNA, 22 bp, Homo sapiens
gcttccatgtatgctcttgaca

SEQ ID NO: 8207613 - DNA, 22 bp, Homo sapiens
gcttccatgttgctgctggtca

SEQ ID NO: 8207614 - DNA, 22 bp, Homo sapiens
gcttccatgttgctgctggtca

SEQ ID NO: 8207615 - DNA, 22 bp, Homo sapiens
gcttccatttgctaggggattt

SEQ ID NO: 8207616 - DNA, 23 bp, Homo sapiens
gcttccattctagtttgctgtgc

SEQ ID NO: 8207617 - DNA, 22 bp, Homo sapiens
gcttccagtaagttgctgccat

SEQ ID NO: 8207618 - DNA, 22 bp, Homo sapiens
gcttccagtaagttgctgccat

SEQ ID NO: 8207619 - DNA, 22 bp, Homo sapiens
gctgtgcagccaagtgcctctg

SEQ ID NO: 8207620 - DNA, 22 bp, Homo sapiens
gctgtgcagccaagtgcctctg

SEQ ID NO: 8207621 - DNA, 22 bp, Homo sapiens
gctgtgcagatgtagggagtgg

SEQ ID NO: 8207622 - DNA, 22 bp, Homo sapiens
gctgtgcagccaagtgcctctg

SEQ ID NO: 8207623 - DNA, 21 bp, Homo sapiens
gctgtgcaggattgaaagcag

SEQ ID NO: 8207624 - DNA, 22 bp, Homo sapiens
gctgtgcagccaagtgcctctg

SEQ ID NO: 8207625 - DNA, 22 bp, Homo sapiens
gctgtgcagtagtaggtacagt

SEQ ID NO: 8207626 - DNA, 22 bp, Homo sapiens
gctgtgcagtagtaggtacagt

SEQ ID NO: 8207627 - DNA, 22 bp, Homo sapiens
gctgtgcagtctttggtgtgcc

SEQ ID NO: 8207628 - DNA, 22 bp, Homo sapiens
gctgtgcagtctttggtgtgcc

SEQ ID NO: 8207629 - DNA, 22 bp, Homo sapiens
gctgtgcccagctccagctctg

SEQ ID NO: 8207630 - DNA, 22 bp, Homo sapiens
gctgtgcccagccattctagat

SEQ ID NO: 8207631 - DNA, 20 bp, Homo sapiens
gctgtgccatgaccctcgag

SEQ ID NO: 8207632 - DNA, 22 bp, Homo sapiens
gctgtgcccatattctgctgac

SEQ ID NO: 8207633 - DNA, 22 bp, Homo sapiens
gctgtgcccagctccagctctg

SEQ ID NO: 8207634 - DNA, 22 bp, Homo sapiens
gctgtgagtggaggaggctgag

SEQ ID NO: 8207635 - DNA, 22 bp, Homo sapiens
gctgtgagtgagctgcctaggc

SEQ ID NO: 8207636 - DNA, 22 bp, Homo sapiens
gctgtgagctgcctgtgtcaca

SEQ ID NO: 8207637 - DNA, 22 bp, Homo sapiens
gctgtgagggcttctgaggcat

SEQ ID NO: 8207638 - DNA, 22 bp, Homo sapiens
gctgtgagggcttctgaggcat

SEQ ID NO: 8207639 - DNA, 22 bp, Homo sapiens
gctgtgagggtctagtgaggtg

SEQ ID NO: 8207640 - DNA, 22 bp, Homo sapiens
gctgtgcagagcacagggtccc

SEQ ID NO: 8207641 - DNA, 22 bp, Homo sapiens
gctgtgagccgctgctgagcat

SEQ ID NO: 8207642 - DNA, 22 bp, Homo sapiens
gctgtgagccgctgctgagcat

SEQ ID NO: 8207643 - DNA, 22 bp, Homo sapiens
gctgtgagctgcctgtgtcaca

SEQ ID NO: 8207644 - DNA, 22 bp, Homo sapiens
gctgtgagcactgctgggtgga

SEQ ID NO: 8207645 - DNA, 22 bp, Homo sapiens
gctgtgagcactgctgggtgga

SEQ ID NO: 8207646 - DNA, 22 bp, Homo sapiens
gctgtgagaaacagggagtgtc

SEQ ID NO: 8207647 - DNA, 22 bp, Homo sapiens
gctgtcttgctcactcttgcag

SEQ ID NO: 8207648 - DNA, 22 bp, Homo sapiens
gctgtcttgctcactcttgcag

SEQ ID NO: 8207649 - DNA, 22 bp, Homo sapiens
gctgtcttgggtagaaagaggt

SEQ ID NO: 8207650 - DNA, 22 bp, Homo sapiens
gctggcagaagagctggttcaa

SEQ ID NO: 8207651 - DNA, 22 bp, Homo sapiens
gctggcagaagagctggttcaa

SEQ ID NO: 8207652 - DNA, 22 bp, Homo sapiens
gctggcagaagagctggttcaa

SEQ ID NO: 8207653 - DNA, 22 bp, Homo sapiens
gctggcagaatttcttcttgct

SEQ ID NO: 8207654 - DNA, 22 bp, Homo sapiens
gctggcagaagagctggttcaa

SEQ ID NO: 8207655 - DNA, 19 bp, Homo sapiens
gctggcagaattttgaacc

SEQ ID NO: 8207656 - DNA, 22 bp, Homo sapiens
gctggcagaatttcttcttgct

SEQ ID NO: 8207657 - DNA, 22 bp, Homo sapiens
gctggcagaatttcttcttgct

SEQ ID NO: 8207658 - DNA, 22 bp, Homo sapiens
gctggcagactgggggcagaac

SEQ ID NO: 8207659 - DNA, 19 bp, Homo sapiens
gctggcagaattttgaacc

SEQ ID NO: 8207660 - DNA, 22 bp, Homo sapiens
gctggcagacttcctctggaac

SEQ ID NO: 8207661 - DNA, 22 bp, Homo sapiens
gctggcagacttcctctggaac

SEQ ID NO: 8207662 - DNA, 22 bp, Homo sapiens
gctggcagacttcctctggaac

SEQ ID NO: 8207663 - DNA, 22 bp, Homo sapiens
gctggcagactgggggcagaac

SEQ ID NO: 8207664 - DNA, 22 bp, Homo sapiens
gctggcagactgggggcagaac

SEQ ID NO: 8207665 - DNA, 22 bp, Homo sapiens
gctggcagactgggggcagaac

SEQ ID NO: 8207666 - DNA, 22 bp, Homo sapiens
gctggcagactgggggcagaac

SEQ ID NO: 8207667 - DNA, 22 bp, Homo sapiens
gctggcagacttcctctggaac

SEQ ID NO: 8207668 - DNA, 22 bp, Homo sapiens
gctggcacaggtggatgctggc

SEQ ID NO: 8207669 - DNA, 22 bp, Homo sapiens
gctggcacatggctcagggcct

SEQ ID NO: 8207670 - DNA, 22 bp, Homo sapiens
gctggcacacagtacacgcctt

SEQ ID NO: 8207671 - DNA, 22 bp, Homo sapiens
gctggcacagaataagcaggca

SEQ ID NO: 8207672 - DNA, 22 bp, Homo sapiens
gctggcacctatttggacctgg

SEQ ID NO: 8207673 - DNA, 22 bp, Homo sapiens
gctggcacatggctcagggcct

SEQ ID NO: 8207674 - DNA, 22 bp, Homo sapiens
gctggcacctgcaccaagcagg

SEQ ID NO: 8207675 - DNA, 22 bp, Homo sapiens
gctggcacctatttggacctgg

SEQ ID NO: 8207676 - DNA, 22 bp, Homo sapiens
gctggcacctgcaccaagcagg

SEQ ID NO: 8207677 - DNA, 22 bp, Homo sapiens
gctggcacctgcaccaagcagg

SEQ ID NO: 8207678 - DNA, 22 bp, Homo sapiens
gctggcactgggaaggactgag

SEQ ID NO: 8207679 - DNA, 19 bp, Homo sapiens
gctggcacttcaagggagc

SEQ ID NO: 8207680 - DNA, 22 bp, Homo sapiens
gctggcactgggaaggactgag

SEQ ID NO: 8207681 - DNA, 22 bp, Homo sapiens
gctggcaatggtgtggtctggt

SEQ ID NO: 8207682 - DNA, 22 bp, Homo sapiens
gctggcaagtaggttttggctg

SEQ ID NO: 8207683 - DNA, 22 bp, Homo sapiens
gctggattggagcaatagagtc

SEQ ID NO: 8207684 - DNA, 22 bp, Homo sapiens
gctgcccaatggtagtgtcttt

SEQ ID NO: 8207685 - DNA, 22 bp, Homo sapiens
gctgccatgccacagcactcac

SEQ ID NO: 8207686 - DNA, 22 bp, Homo sapiens
gctgccatggtccaggctccag

SEQ ID NO: 8207687 - DNA, 22 bp, Homo sapiens
gctggctcagggggattagcaa

SEQ ID NO: 8207688 - DNA, 22 bp, Homo sapiens
gctggctcagggggattagcaa

SEQ ID NO: 8207689 - DNA, 22 bp, Homo sapiens
gctggctcagggactagagttt

SEQ ID NO: 8207690 - DNA, 22 bp, Homo sapiens
gctggctccaaaagcaggggct

SEQ ID NO: 8207691 - DNA, 22 bp, Homo sapiens
gctggctccaaaagcaggggct

SEQ ID NO: 8207692 - DNA, 22 bp, Homo sapiens
gctggctccaaaagcaggggct

SEQ ID NO: 8207693 - DNA, 22 bp, Homo sapiens
gctggctcccagaggccccagc

SEQ ID NO: 8207694 - DNA, 22 bp, Homo sapiens
gctggctcccagaggccccagc

SEQ ID NO: 8207695 - DNA, 22 bp, Homo sapiens
gctggcagggacagctgcgtgt

SEQ ID NO: 8207696 - DNA, 21 bp, Homo sapiens
gctggctcaaatgcttgtgtc

SEQ ID NO: 8207697 - DNA, 21 bp, Homo sapiens
gctggctcaaatgcttgtgtc

SEQ ID NO: 8207698 - DNA, 22 bp, Homo sapiens
gctggctcaagtgtgcttccca

SEQ ID NO: 8207699 - DNA, 22 bp, Homo sapiens
gctggctcaagtgtgcttccca

SEQ ID NO: 8207700 - DNA, 22 bp, Homo sapiens
gctggctcaagtgtgcttccca

SEQ ID NO: 8207701 - DNA, 22 bp, Homo sapiens
gctggcagggacagctgcgtgt

SEQ ID NO: 8207702 - DNA, 22 bp, Homo sapiens
gctggcagggacagctgcgtgt

SEQ ID NO: 8207703 - DNA, 22 bp, Homo sapiens
gctggcagggacagctgcgtgt

SEQ ID NO: 8207704 - DNA, 22 bp, Homo sapiens
gctggcagggacagctgcgtgt

SEQ ID NO: 8207705 - DNA, 22 bp, Homo sapiens
gctggcagggacagctgcgtgt

SEQ ID NO: 8207706 - DNA, 22 bp, Homo sapiens
gctggcagagacaagaagacta

SEQ ID NO: 8207707 - DNA, 22 bp, Homo sapiens
gctggcagagacaagaagacta

SEQ ID NO: 8207708 - DNA, 22 bp, Homo sapiens
gctggcagagagctggtgagga

SEQ ID NO: 8207709 - DNA, 22 bp, Homo sapiens
gctggcagctggaagttgggct

SEQ ID NO: 8207710 - DNA, 22 bp, Homo sapiens
gctggcaggagaaacggggtgc

SEQ ID NO: 8207711 - DNA, 22 bp, Homo sapiens
gctggcagctggaagttgggct

SEQ ID NO: 8207712 - DNA, 22 bp, Homo sapiens
gctggcagctggaagttgggct

SEQ ID NO: 8207713 - DNA, 22 bp, Homo sapiens
gctggcagctggaagttgggct

SEQ ID NO: 8207714 - DNA, 22 bp, Homo sapiens
gctggcaggagaccatacccta

SEQ ID NO: 8207715 - DNA, 22 bp, Homo sapiens
gctggcaggagaccatacccta

SEQ ID NO: 8207716 - DNA, 22 bp, Homo sapiens
gctggcaggagaccatacccta

SEQ ID NO: 8207717 - DNA, 22 bp, Homo sapiens
gctggcaggagcctttcccttt

SEQ ID NO: 8207718 - DNA, 22 bp, Homo sapiens
gctggcaggagcctttcccttt

SEQ ID NO: 8207719 - DNA, 22 bp, Homo sapiens
gctggcaggagaaacggggtgc

SEQ ID NO: 8207720 - DNA, 22 bp, Homo sapiens
gctggcaggagaaacggggtgc

SEQ ID NO: 8207721 - DNA, 22 bp, Homo sapiens
gctggcaggagaccatacccta

SEQ ID NO: 8207722 - DNA, 22 bp, Homo sapiens
gctggcaggagaaacggggtgc

SEQ ID NO: 8207723 - DNA, 22 bp, Homo sapiens
gctggcaggataacttctaagc

SEQ ID NO: 8207724 - DNA, 22 bp, Homo sapiens
gctggcaggataacttctaagc

SEQ ID NO: 8207725 - DNA, 22 bp, Homo sapiens
gctggcaggatagaagtctaat

SEQ ID NO: 8207726 - DNA, 22 bp, Homo sapiens
gctggcaggatagaagtctaat

SEQ ID NO: 8207727 - DNA, 22 bp, Homo sapiens
gctggcaggataacttctaagc

SEQ ID NO: 8207728 - DNA, 22 bp, Homo sapiens
gctggcaggagcctttcccttt

SEQ ID NO: 8207729 - DNA, 22 bp, Homo sapiens
gctgggacaggcttggccctgt

SEQ ID NO: 8207730 - DNA, 22 bp, Homo sapiens
gctgggacaggcttggccctgt

SEQ ID NO: 8207731 - DNA, 22 bp, Homo sapiens
gctgggaagtggcagagctgga

SEQ ID NO: 8207732 - DNA, 22 bp, Homo sapiens
gctgggaagtggcagagctgga

SEQ ID NO: 8207733 - DNA, 22 bp, Homo sapiens
gctgggagacagacttggaacc

SEQ ID NO: 8207734 - DNA, 22 bp, Homo sapiens
gctgggagacagacttggaacc

SEQ ID NO: 8207735 - DNA, 22 bp, Homo sapiens
gctgggagacagacttggaacc

SEQ ID NO: 8207736 - DNA, 22 bp, Homo sapiens
gctgggagacagacttggaacc

SEQ ID NO: 8207737 - DNA, 22 bp, Homo sapiens
gctgggactgagacagtgacct

SEQ ID NO: 8207738 - DNA, 22 bp, Homo sapiens
gctgggactgagacagtgacct

SEQ ID NO: 8207739 - DNA, 22 bp, Homo sapiens
gctgggactgagacagtgacct

SEQ ID NO: 8207740 - DNA, 22 bp, Homo sapiens
gctgggagaggcagctttcgga

SEQ ID NO: 8207741 - DNA, 22 bp, Homo sapiens
gctgggagaggccctgaagtga

SEQ ID NO: 8207742 - DNA, 22 bp, Homo sapiens
gctgggagaggcagctttcgga

SEQ ID NO: 8207743 - DNA, 22 bp, Homo sapiens
gctgggagaggccctgaagtga

SEQ ID NO: 8207744 - DNA, 22 bp, Homo sapiens
gctgggagaggcagctttcgga

SEQ ID NO: 8207745 - DNA, 22 bp, Homo sapiens
gctgggaggatctctccctgtc

SEQ ID NO: 8207746 - DNA, 22 bp, Homo sapiens
gctgggaggatctctccctgtc

SEQ ID NO: 8207747 - DNA, 22 bp, Homo sapiens
gctgggaggaatttggggaata

SEQ ID NO: 8207748 - DNA, 22 bp, Homo sapiens
gctgggaggaatttggggaata

SEQ ID NO: 8207749 - DNA, 22 bp, Homo sapiens
gctgggaggaatttggggaata

SEQ ID NO: 8207750 - DNA, 22 bp, Homo sapiens
gctgggaggatctctccctgtc

SEQ ID NO: 8207751 - DNA, 22 bp, Homo sapiens
gctgggagcaaagccatgcata

SEQ ID NO: 8207752 - DNA, 22 bp, Homo sapiens
gctgggagcaaagccatgcata

SEQ ID NO: 8207753 - DNA, 22 bp, Homo sapiens
gctgggagaggccctgaagtga

SEQ ID NO: 8207754 - DNA, 21 bp, Homo sapiens
gctggctctctgacgtgcttt

SEQ ID NO: 8207755 - DNA, 21 bp, Homo sapiens
gctggctctctgacgtgcttt

SEQ ID NO: 8207756 - DNA, 22 bp, Homo sapiens
gctggctcgggaagcaggggat

SEQ ID NO: 8207757 - DNA, 22 bp, Homo sapiens
gctggctcgggaagcaggggat

SEQ ID NO: 8207758 - DNA, 22 bp, Homo sapiens
gctggctcccattggtccttcc

SEQ ID NO: 8207759 - DNA, 22 bp, Homo sapiens
gctggctcctctgtcctcacgg

SEQ ID NO: 8207760 - DNA, 22 bp, Homo sapiens
gctggctcctctgtcctcacgg

SEQ ID NO: 8207761 - DNA, 22 bp, Homo sapiens
gctggctcgggaagcaggggat

SEQ ID NO: 8207762 - DNA, 22 bp, Homo sapiens
gctggctcggatttgaacagga

SEQ ID NO: 8207763 - DNA, 22 bp, Homo sapiens
gctggctctgcacccaggcctc

SEQ ID NO: 8207764 - DNA, 22 bp, Homo sapiens
gctggctctgatgggctccagg

SEQ ID NO: 8207765 - DNA, 22 bp, Homo sapiens
gctggctctgtggtagttggca

SEQ ID NO: 8207766 - DNA, 22 bp, Homo sapiens
gctggctctgccccacctgttc

SEQ ID NO: 8207767 - DNA, 22 bp, Homo sapiens
gctggctctgcacccaggcctc

SEQ ID NO: 8207768 - DNA, 22 bp, Homo sapiens
gctggctgcagattttagaggt

SEQ ID NO: 8207769 - DNA, 22 bp, Homo sapiens
gctggctgccaatttcagagct

SEQ ID NO: 8207770 - DNA, 22 bp, Homo sapiens
gctggctgccaatttcagagct

SEQ ID NO: 8207771 - DNA, 18 bp, Homo sapiens
gctggctgcacttctgct

SEQ ID NO: 8207772 - DNA, 22 bp, Homo sapiens
gctggctgcagattttagaggt

SEQ ID NO: 8207773 - DNA, 22 bp, Homo sapiens
gctggctgcagattttagaggt

SEQ ID NO: 8207774 - DNA, 22 bp, Homo sapiens
gctggctgccaatttcagagct

SEQ ID NO: 8207775 - DNA, 22 bp, Homo sapiens
gctggctgccaatttcagagct

SEQ ID NO: 8207776 - DNA, 22 bp, Homo sapiens
gctggctgcctggttatgcctt

SEQ ID NO: 8207777 - DNA, 22 bp, Homo sapiens
gctggctgccttactttgtgga

SEQ ID NO: 8207778 - DNA, 22 bp, Homo sapiens
gctggctgcctggttatgcctt

SEQ ID NO: 8207779 - DNA, 22 bp, Homo sapiens
gctggctgccttactttgtgga

SEQ ID NO: 8207780 - DNA, 18 bp, Homo sapiens
gctggctgcacttctgct

SEQ ID NO: 8207781 - DNA, 18 bp, Homo sapiens
gctggctgcacttctgct

SEQ ID NO: 8207782 - DNA, 22 bp, Homo sapiens
gctggctgcacaggggctcact

SEQ ID NO: 8207783 - DNA, 22 bp, Homo sapiens
gctggctgcacaggggctcact

SEQ ID NO: 8207784 - DNA, 22 bp, Homo sapiens
gctggctgcacaggggctcact

SEQ ID NO: 8207785 - DNA, 22 bp, Homo sapiens
gctggctgagttctgtcgtctg

SEQ ID NO: 8207786 - DNA, 22 bp, Homo sapiens
gctggctgagttctgtcgtctg

SEQ ID NO: 8207787 - DNA, 22 bp, Homo sapiens
gctggctgcacaggggctcact

SEQ ID NO: 8207788 - DNA, 22 bp, Homo sapiens
gctggctgcacaggggctcact

SEQ ID NO: 8207789 - DNA, 22 bp, Homo sapiens
gctggctcttcagtggagatag

SEQ ID NO: 8207790 - DNA, 22 bp, Homo sapiens
gctggctgcacaggggctcact

SEQ ID NO: 8207791 - DNA, 22 bp, Homo sapiens
gctggctgcacaggggctcact

SEQ ID NO: 8207792 - DNA, 22 bp, Homo sapiens
gctggctgcacaggggctcact

SEQ ID NO: 8207793 - DNA, 22 bp, Homo sapiens
gctgaagatttttgctagcccc

SEQ ID NO: 8207794 - DNA, 22 bp, Homo sapiens
gctgaagatttttgctagcccc

SEQ ID NO: 8207795 - DNA, 22 bp, Homo sapiens
gctgaagcccacgtggcttgta

SEQ ID NO: 8207796 - DNA, 22 bp, Homo sapiens
gctgaagcccacgtggcttgta

SEQ ID NO: 8207797 - DNA, 22 bp, Homo sapiens
gctgaagctgacacatagtgct

SEQ ID NO: 8207798 - DNA, 22 bp, Homo sapiens
gctgaagataagtgaagaggct

SEQ ID NO: 8207799 - DNA, 20 bp, Homo sapiens
gctgaagattcccatgcaag

SEQ ID NO: 8207800 - DNA, 22 bp, Homo sapiens
gctgaaggcccggaggacaggg

SEQ ID NO: 8207801 - DNA, 22 bp, Homo sapiens
gctgaaggcccggaggacaggg

SEQ ID NO: 8207802 - DNA, 22 bp, Homo sapiens
gctgaagggagtgctgagtctg

SEQ ID NO: 8207803 - DNA, 22 bp, Homo sapiens
gctgaagggagtgctgagtctg

SEQ ID NO: 8207804 - DNA, 22 bp, Homo sapiens
gctgaagctgcagcaggaggaa

SEQ ID NO: 8207805 - DNA, 22 bp, Homo sapiens
gctgaagctgcagcaggaggaa

SEQ ID NO: 8207806 - DNA, 19 bp, Homo sapiens
gctgaaggaggtgcctgca

SEQ ID NO: 8207807 - DNA, 19 bp, Homo sapiens
gctgaaggaggtgcctgca

SEQ ID NO: 8207808 - DNA, 22 bp, Homo sapiens
gctgaagtaactcacatcgtta

SEQ ID NO: 8207809 - DNA, 22 bp, Homo sapiens
gctgaagtaactcacatcgtta

SEQ ID NO: 8207810 - DNA, 22 bp, Homo sapiens
gctgaaggtgtgtggagagagg

SEQ ID NO: 8207811 - DNA, 22 bp, Homo sapiens
gctgaaggtctctggagaggtc

SEQ ID NO: 8207812 - DNA, 22 bp, Homo sapiens
gctgaagggagtgctgagtctg

SEQ ID NO: 8207813 - DNA, 22 bp, Homo sapiens
gctgaagtgtggagtgacagtt

SEQ ID NO: 8207814 - DNA, 22 bp, Homo sapiens
gctgaagtggcgtgatcagaat

SEQ ID NO: 8207815 - DNA, 22 bp, Homo sapiens
gctgaagtgtggagtgacagtt

SEQ ID NO: 8207816 - DNA, 22 bp, Homo sapiens
gctgaagtctgagaatttgcaa

SEQ ID NO: 8207817 - DNA, 22 bp, Homo sapiens
gctgaagtcctaatcccaagta

SEQ ID NO: 8207818 - DNA, 16 bp, Homo sapiens
gctgaagtgagtatag

SEQ ID NO: 8207819 - DNA, 22 bp, Homo sapiens
gctgaagtgcttttgaatttgg

SEQ ID NO: 8207820 - DNA, 22 bp, Homo sapiens
gctgaataagagtctactttgc

SEQ ID NO: 8207821 - DNA, 22 bp, Homo sapiens
gctgaagttttgcagagagtaa

SEQ ID NO: 8207822 - DNA, 22 bp, Homo sapiens
gctgaataatgtgtaatgtctc

SEQ ID NO: 8207823 - DNA, 22 bp, Homo sapiens
gctgaagttttgcagagagtaa

SEQ ID NO: 8207824 - DNA, 22 bp, Homo sapiens
gctgaagtttatgtcttctttt

SEQ ID NO: 8207825 - DNA, 22 bp, Homo sapiens
gctgaagttgaatattctggga

SEQ ID NO: 8207826 - DNA, 22 bp, Homo sapiens
gctgaagttgcctattttaata

SEQ ID NO: 8207827 - DNA, 22 bp, Homo sapiens
gctgatggaattgtaaaatagt

SEQ ID NO: 8207828 - DNA, 22 bp, Homo sapiens
gctgatggcttgctggctgaca

SEQ ID NO: 8207829 - DNA, 22 bp, Homo sapiens
gctgatggcttgctggctgaca

SEQ ID NO: 8207830 - DNA, 22 bp, Homo sapiens
gctgatggcttgctggctgaca

SEQ ID NO: 8207831 - DNA, 23 bp, Homo sapiens
gctgatggagacttgtggcctcc

SEQ ID NO: 8207832 - DNA, 23 bp, Homo sapiens
gctgatggagacttgtggcctcc

SEQ ID NO: 8207833 - DNA, 22 bp, Homo sapiens
gctgatgggagctggctcaccc

SEQ ID NO: 8207834 - DNA, 22 bp, Homo sapiens
gctgatgggagctggctcaccc

SEQ ID NO: 8207835 - DNA, 22 bp, Homo sapiens
gctgatgtaagacttttggttt

SEQ ID NO: 8207836 - DNA, 22 bp, Homo sapiens
gctgatgtttagttgatgttac

SEQ ID NO: 8207837 - DNA, 22 bp, Homo sapiens
gctgatcacatttccaaaaccc

SEQ ID NO: 8207838 - DNA, 22 bp, Homo sapiens
gctgatccttttatgtctagct

SEQ ID NO: 8207839 - DNA, 22 bp, Homo sapiens
gctgatagactgaatgttggga

SEQ ID NO: 8207840 - DNA, 22 bp, Homo sapiens
gctgaataggactgtcatctct

SEQ ID NO: 8207841 - DNA, 22 bp, Homo sapiens
gctgaatagaagtcttcaaagg

SEQ ID NO: 8207842 - DNA, 22 bp, Homo sapiens
gctgaatacagcatgccttatg

SEQ ID NO: 8207843 - DNA, 22 bp, Homo sapiens
gctgaataattctttgttgtgg

SEQ ID NO: 8207844 - DNA, 22 bp, Homo sapiens
gctgaataatgtgtaatgtctc

SEQ ID NO: 8207845 - DNA, 22 bp, Homo sapiens
gctgattattacatgtctgtgg

SEQ ID NO: 8207846 - DNA, 22 bp, Homo sapiens
gctgattaacttcattgtagtt

SEQ ID NO: 8207847 - DNA, 22 bp, Homo sapiens
gctgcaactgttgctctctgca

SEQ ID NO: 8207848 - DNA, 22 bp, Homo sapiens
gctgcaagatcttaaaagggag

SEQ ID NO: 8207849 - DNA, 22 bp, Homo sapiens
gctgcaagtccttccctctctt

SEQ ID NO: 8207850 - DNA, 22 bp, Homo sapiens
gctgcaagtgcatgttgcaact

SEQ ID NO: 8207851 - DNA, 22 bp, Homo sapiens
gctgcaagtcatggcttttgca

SEQ ID NO: 8207852 - DNA, 22 bp, Homo sapiens
gctgcaagtcacagaaacagtg

SEQ ID NO: 8207853 - DNA, 22 bp, Homo sapiens
gctgcaagtcacagaaacagtg

SEQ ID NO: 8207854 - DNA, 21 bp, Homo sapiens
gctgcaaggaagttttggtct

SEQ ID NO: 8207855 - DNA, 22 bp, Homo sapiens
gctgcaagcatgtcatcctcac

SEQ ID NO: 8207856 - DNA, 19 bp, Homo sapiens
gctgcacacccagcaactg

SEQ ID NO: 8207857 - DNA, 22 bp, Homo sapiens
gctgcaagttagtatacattct

SEQ ID NO: 8207858 - DNA, 22 bp, Homo sapiens
gctgcacatggcagaggccttt

SEQ ID NO: 8207859 - DNA, 22 bp, Homo sapiens
gctgcacatggcagaggccttt

SEQ ID NO: 8207860 - DNA, 22 bp, Homo sapiens
gctgcacttgagcctgggagaa

SEQ ID NO: 8207861 - DNA, 22 bp, Homo sapiens
gctgcacatggcagaggccttt

SEQ ID NO: 8207862 - DNA, 22 bp, Homo sapiens
gctgcaccagctccaccagggc

SEQ ID NO: 8207863 - DNA, 22 bp, Homo sapiens
gctgcagctcgccttccggcct

SEQ ID NO: 8207864 - DNA, 22 bp, Homo sapiens
gctgcagactgggaggcaggtg

SEQ ID NO: 8207865 - DNA, 22 bp, Homo sapiens
gctgcagactgggaggcaggtg

SEQ ID NO: 8207866 - DNA, 22 bp, Homo sapiens
gctgcagactgggaggcaggtg

SEQ ID NO: 8207867 - DNA, 22 bp, Homo sapiens
gctgcagacctcatgcaggtgg

SEQ ID NO: 8207868 - DNA, 22 bp, Homo sapiens
gctgcagacctcatgcaggtgg

SEQ ID NO: 8207869 - DNA, 23 bp, Homo sapiens
gctgcagctgtggatgttctcag

SEQ ID NO: 8207870 - DNA, 23 bp, Homo sapiens
gctgcagctgtggatgttctcag

SEQ ID NO: 8207871 - DNA, 22 bp, Homo sapiens
gctgcagctgtaggacacaatt

SEQ ID NO: 8207872 - DNA, 22 bp, Homo sapiens
gctgcagctgtaggacacaatt

SEQ ID NO: 8207873 - DNA, 22 bp, Homo sapiens
gctgcagctcgccttccggcct

SEQ ID NO: 8207874 - DNA, 22 bp, Homo sapiens
gctgcaggagctggagctgtgg

SEQ ID NO: 8207875 - DNA, 22 bp, Homo sapiens
gctgcaggagattttgagagtc

SEQ ID NO: 8207876 - DNA, 22 bp, Homo sapiens
gctgcaggagattttgagagtc

SEQ ID NO: 8207877 - DNA, 22 bp, Homo sapiens
gctgcagctttaggatccagtg

SEQ ID NO: 8207878 - DNA, 22 bp, Homo sapiens
gctgcagctttaggatccagtg

SEQ ID NO: 8207879 - DNA, 22 bp, Homo sapiens
gctgcaggagattttgagagtc

SEQ ID NO: 8207880 - DNA, 22 bp, Homo sapiens
gctgcaggagctggagctgtgg

SEQ ID NO: 8207881 - DNA, 22 bp, Homo sapiens
gctgcaggagctggagctgtgg

SEQ ID NO: 8207882 - DNA, 22 bp, Homo sapiens
gctgcaggagctggagctgtgg

SEQ ID NO: 8207883 - DNA, 22 bp, Homo sapiens
gctgcaggagctggagctgtgg

SEQ ID NO: 8207884 - DNA, 22 bp, Homo sapiens
gctgcaggatgaggctctgctc

SEQ ID NO: 8207885 - DNA, 22 bp, Homo sapiens
gctgcaggatgaggctctgctc

SEQ ID NO: 8207886 - DNA, 22 bp, Homo sapiens
gctgcaggatgaggctctgctc

SEQ ID NO: 8207887 - DNA, 22 bp, Homo sapiens
gctgcagggggtgggcgtctcc

SEQ ID NO: 8207888 - DNA, 22 bp, Homo sapiens
gctgcagggggtgggcgtctcc

SEQ ID NO: 8207889 - DNA, 22 bp, Homo sapiens
gctgcaggatgaggctctgctc

SEQ ID NO: 8207890 - DNA, 22 bp, Homo sapiens
gctgcaggttgggcaacagagt

SEQ ID NO: 8207891 - DNA, 22 bp, Homo sapiens
gctgcaggttgggcaacagagt

SEQ ID NO: 8207892 - DNA, 22 bp, Homo sapiens
gctgccacttggtcatgtcatg

SEQ ID NO: 8207893 - DNA, 22 bp, Homo sapiens
gctgcaggtttgtctagtctgg

SEQ ID NO: 8207894 - DNA, 22 bp, Homo sapiens
gctgccactctgagcttgcttc

SEQ ID NO: 8207895 - DNA, 22 bp, Homo sapiens
gctgccagaatgggaaatctga

SEQ ID NO: 8207896 - DNA, 22 bp, Homo sapiens
gctgccagccaacttgctgtgc

SEQ ID NO: 8207897 - DNA, 22 bp, Homo sapiens
gctgccagtgtggcatgatgca

SEQ ID NO: 8207898 - DNA, 22 bp, Homo sapiens
gctgccagtgtggcatgatgca

SEQ ID NO: 8207899 - DNA, 20 bp, Homo sapiens
gctgccagtgcctgatgctt

SEQ ID NO: 8207900 - DNA, 20 bp, Homo sapiens
gctgccagtgcctgatgctt

SEQ ID NO: 8207901 - DNA, 20 bp, Homo sapiens
gctgccagtgcctgatgctt

SEQ ID NO: 8207902 - DNA, 22 bp, Homo sapiens
gctgccagttccttcttactcc

SEQ ID NO: 8207903 - DNA, 20 bp, Homo sapiens
gctgccagtgcctgatgctt

SEQ ID NO: 8207904 - DNA, 22 bp, Homo sapiens
gctgccaggggcagctgtctca

SEQ ID NO: 8207905 - DNA, 22 bp, Homo sapiens
gctgccaggggcagctgtctca

SEQ ID NO: 8207906 - DNA, 22 bp, Homo sapiens
gctgccaggggcagctgtctca

SEQ ID NO: 8207907 - DNA, 20 bp, Homo sapiens
gctgccagggcggagacatc

SEQ ID NO: 8207908 - DNA, 22 bp, Homo sapiens
gctgccagggaggtggtggagg

SEQ ID NO: 8207909 - DNA, 22 bp, Homo sapiens
gctgccagtagttggagctcca

SEQ ID NO: 8207910 - DNA, 22 bp, Homo sapiens
gctgccagtagttggagctcca

SEQ ID NO: 8207911 - DNA, 22 bp, Homo sapiens
gctgccagtagttggagctcca

SEQ ID NO: 8207912 - DNA, 22 bp, Homo sapiens
gctgccagtagttggagctcca

SEQ ID NO: 8207913 - DNA, 22 bp, Homo sapiens
gctgccagcgtcagacctgggg

SEQ ID NO: 8207914 - DNA, 22 bp, Homo sapiens
gctgccagctgcggcccacgcg

SEQ ID NO: 8207915 - DNA, 22 bp, Homo sapiens
gctgccagccctcggggtctga

SEQ ID NO: 8207916 - DNA, 22 bp, Homo sapiens
gctgccagccctcggggtctga

SEQ ID NO: 8207917 - DNA, 22 bp, Homo sapiens
gctgccagcgtcagacctgggg

SEQ ID NO: 8207918 - DNA, 22 bp, Homo sapiens
gctgccagccctcggggtctga

SEQ ID NO: 8207919 - DNA, 22 bp, Homo sapiens
gctgccaggacggagaggagcg

SEQ ID NO: 8207920 - DNA, 22 bp, Homo sapiens
gctgccaggacggagaggagcg

SEQ ID NO: 8207921 - DNA, 22 bp, Homo sapiens
gctgccagctttccttggctga

SEQ ID NO: 8207922 - DNA, 22 bp, Homo sapiens
gctgccagctttccttggctga

SEQ ID NO: 8207923 - DNA, 22 bp, Homo sapiens
gctgccagctttccttggctga

SEQ ID NO: 8207924 - DNA, 22 bp, Homo sapiens
gctgccagggaggtggtggagg

SEQ ID NO: 8207925 - DNA, 22 bp, Homo sapiens
gctgccaggccctggggctatg

SEQ ID NO: 8207926 - DNA, 22 bp, Homo sapiens
gctgccagggaggtggtggagg

SEQ ID NO: 8207927 - DNA, 21 bp, Homo sapiens
gctgccaggattttgcaggaa

SEQ ID NO: 8207928 - DNA, 22 bp, Homo sapiens
gctcaggctctcccaggggaat

SEQ ID NO: 8207929 - DNA, 22 bp, Homo sapiens
gctcaggctctcccaggggaat

SEQ ID NO: 8207930 - DNA, 21 bp, Homo sapiens
gctcaggctcttgacagagca

SEQ ID NO: 8207931 - DNA, 21 bp, Homo sapiens
gctcaggctcttgacagagca

SEQ ID NO: 8207932 - DNA, 21 bp, Homo sapiens
gctcaggctcttgacagagca

SEQ ID NO: 8207933 - DNA, 22 bp, Homo sapiens
gctcaggcctggctatccattg

SEQ ID NO: 8207934 - DNA, 22 bp, Homo sapiens
gctcaggcctggctatccattg

SEQ ID NO: 8207935 - DNA, 21 bp, Homo sapiens
gctcaggctcaggttcaggtt

SEQ ID NO: 8207936 - DNA, 21 bp, Homo sapiens
gctcaggctcaggttcaggtt

SEQ ID NO: 8207937 - DNA, 21 bp, Homo sapiens
gctcaggctcaggttcaggtt

SEQ ID NO: 8207938 - DNA, 22 bp, Homo sapiens
gctcaggctctcccaggggaat

SEQ ID NO: 8207939 - DNA, 22 bp, Homo sapiens
gctcaggcctccagaggggcaa

SEQ ID NO: 8207940 - DNA, 22 bp, Homo sapiens
gctcaggcctccagaggggcaa

SEQ ID NO: 8207941 - DNA, 22 bp, Homo sapiens
gctcaggcctcactccatttgg

SEQ ID NO: 8207942 - DNA, 18 bp, Homo sapiens
gctcaggccctagtcagt

SEQ ID NO: 8207943 - DNA, 18 bp, Homo sapiens
gctcaggccctagtcagt

SEQ ID NO: 8207944 - DNA, 22 bp, Homo sapiens
gctcaggcctccagaggggcaa

SEQ ID NO: 8207945 - DNA, 22 bp, Homo sapiens
gctcaggcctcggacacacaat

SEQ ID NO: 8207946 - DNA, 22 bp, Homo sapiens
gctcaggcctggcccatgggac

SEQ ID NO: 8207947 - DNA, 22 bp, Homo sapiens
gctcaggcctcggacacacaat

SEQ ID NO: 8207948 - DNA, 22 bp, Homo sapiens
gctcaggcctggcccatgggac

SEQ ID NO: 8207949 - DNA, 22 bp, Homo sapiens
gctcaggcctggcccatgggac

SEQ ID NO: 8207950 - DNA, 22 bp, Homo sapiens
gctcagggaaagagctcctgtc

SEQ ID NO: 8207951 - DNA, 22 bp, Homo sapiens
gctcagggaactttttgcaggc

SEQ ID NO: 8207952 - DNA, 22 bp, Homo sapiens
gctcctggtctggagcttcaag

SEQ ID NO: 8207953 - DNA, 22 bp, Homo sapiens
gctcctggtctggagcttcaag

SEQ ID NO: 8207954 - DNA, 22 bp, Homo sapiens
gctcctggtgcaaagtttcttc

SEQ ID NO: 8207955 - DNA, 21 bp, Homo sapiens
gctcctggtgctgcgtggcgc

SEQ ID NO: 8207956 - DNA, 22 bp, Homo sapiens
gctcctggtgcaaagtttcttc

SEQ ID NO: 8207957 - DNA, 22 bp, Homo sapiens
gctcaggctggattgcagtggc

SEQ ID NO: 8207958 - DNA, 22 bp, Homo sapiens
gctcaggctggattgcagtggc

SEQ ID NO: 8207959 - DNA, 22 bp, Homo sapiens
gctcaggctggattgcagtggc

SEQ ID NO: 8207960 - DNA, 21 bp, Homo sapiens
gctcaggctcttgacagagca

SEQ ID NO: 8207961 - DNA, 19 bp, Homo sapiens
gctcaggctgtgtgtgggg

SEQ ID NO: 8207962 - DNA, 22 bp, Homo sapiens
gctcaggctggattgcagtggc

SEQ ID NO: 8207963 - DNA, 22 bp, Homo sapiens
gctcagggaaagagctcctgtc

SEQ ID NO: 8207964 - DNA, 22 bp, Homo sapiens
gctcaggcttcttctataaaga

SEQ ID NO: 8207965 - DNA, 19 bp, Homo sapiens
gctcaggctgtgtgtgggg

SEQ ID NO: 8207966 - DNA, 19 bp, Homo sapiens
gctcaggctgtgtgtgggg

SEQ ID NO: 8207967 - DNA, 17 bp, Homo sapiens
gctccttctaacttcca

SEQ ID NO: 8207968 - DNA, 22 bp, Homo sapiens
gctctatggctgctgggagtcc

SEQ ID NO: 8207969 - DNA, 22 bp, Homo sapiens
gctctatgggcacagccagtgt

SEQ ID NO: 8207970 - DNA, 22 bp, Homo sapiens
gctccttcaggtggtagctgtt

SEQ ID NO: 8207971 - DNA, 22 bp, Homo sapiens
gctctatgagtttctcagttta

SEQ ID NO: 8207972 - DNA, 22 bp, Homo sapiens
gctctatgttgaccttcagtgg

SEQ ID NO: 8207973 - DNA, 22 bp, Homo sapiens
gctctatgtcgaaagccagtta

SEQ ID NO: 8207974 - DNA, 22 bp, Homo sapiens
gctcctgtgcaggtctcggttg

SEQ ID NO: 8207975 - DNA, 22 bp, Homo sapiens
gctcctgtgcaggtctcggttg

SEQ ID NO: 8207976 - DNA, 22 bp, Homo sapiens
gctcctgtttgtttgttcctga

SEQ ID NO: 8207977 - DNA, 22 bp, Homo sapiens
gctcctgtttgtttgttcctga

SEQ ID NO: 8207978 - DNA, 22 bp, Homo sapiens
gctcctgtgcaggtctcggttg

SEQ ID NO: 8207979 - DNA, 22 bp, Homo sapiens
gctcctgtttgtttgttcctga

SEQ ID NO: 8207980 - DNA, 22 bp, Homo sapiens
gctcctgttttcttccagaaat

SEQ ID NO: 8207981 - DNA, 21 bp, Homo sapiens
gctctcagctgcctgctggtt

SEQ ID NO: 8207982 - DNA, 21 bp, Homo sapiens
gctctcagctgcctgctggtt

SEQ ID NO: 8207983 - DNA, 21 bp, Homo sapiens
gctctcagctgcctgctggtt

SEQ ID NO: 8207984 - DNA, 22 bp, Homo sapiens
gctctcagatgctccagcagcc

SEQ ID NO: 8207985 - DNA, 22 bp, Homo sapiens
gctctcagatgctccagcagcc

SEQ ID NO: 8207986 - DNA, 22 bp, Homo sapiens
gctctcagaagagccaggctac

SEQ ID NO: 8207987 - DNA, 22 bp, Homo sapiens
gctctcagaagagccaggctac

SEQ ID NO: 8207988 - DNA, 22 bp, Homo sapiens
gctctcagaagagccaggctac

SEQ ID NO: 8207989 - DNA, 21 bp, Homo sapiens
gctcctggtgctgcgtggcgc

SEQ ID NO: 8207990 - DNA, 21 bp, Homo sapiens
gctcctggtgctgcgtggcgc

SEQ ID NO: 8207991 - DNA, 22 bp, Homo sapiens
gctcctggtgctgtagagattt

SEQ ID NO: 8207992 - DNA, 18 bp, Homo sapiens
gctcctggttggaaagaa

SEQ ID NO: 8207993 - DNA, 22 bp, Homo sapiens
gctcctggtgctgtagagattt

SEQ ID NO: 8207994 - DNA, 20 bp, Homo sapiens
gctcctgtcctggtggaggg

SEQ ID NO: 8207995 - DNA, 20 bp, Homo sapiens
gctcctgtcctggtggaggg

SEQ ID NO: 8207996 - DNA, 22 bp, Homo sapiens
gctcctgtcagtcatcaggtgc

SEQ ID NO: 8207997 - DNA, 22 bp, Homo sapiens
gctcctgtcatcaaacaatcct

SEQ ID NO: 8207998 - DNA, 22 bp, Homo sapiens
gctcctgtcagtcatcaggtgc

SEQ ID NO: 8207999 - DNA, 22 bp, Homo sapiens
gctcctgtaatttttaaaagtc

SEQ ID NO: 8208000 - DNA, 22 bp, Homo sapiens
gctcctgtcttggggcactggc

SEQ ID NO: 8208001 - DNA, 22 bp, Homo sapiens
gctcctgtgaaggcattaggtg

SEQ ID NO: 8208002 - DNA, 22 bp, Homo sapiens
gctcctgtgaggacacagccgc

SEQ ID NO: 8208003 - DNA, 22 bp, Homo sapiens
gctcctgtccttagccccagag

SEQ ID NO: 8208004 - DNA, 20 bp, Homo sapiens
gctcctgtcctggtggaggg

SEQ ID NO: 8208005 - DNA, 22 bp, Homo sapiens
gctcctgtcttggggcactggc

SEQ ID NO: 8208006 - DNA, 22 bp, Homo sapiens
gctcctgtccttagccccagag

SEQ ID NO: 8208007 - DNA, 22 bp, Homo sapiens
gctgaagagcaaggctgggtct

SEQ ID NO: 8208008 - DNA, 22 bp, Homo sapiens
gctctggctactgtggctaccg

SEQ ID NO: 8208009 - DNA, 22 bp, Homo sapiens
gctctggctactccaccctgtt

SEQ ID NO: 8208010 - DNA, 22 bp, Homo sapiens
gctctggctactgtggctaccg

SEQ ID NO: 8208011 - DNA, 22 bp, Homo sapiens
gctctggctactccaccctgtt

SEQ ID NO: 8208012 - DNA, 22 bp, Homo sapiens
gctctggctactccaccctgtt

SEQ ID NO: 8208013 - DNA, 22 bp, Homo sapiens
gctctggctactccaccctgtt

SEQ ID NO: 8208014 - DNA, 22 bp, Homo sapiens
gctctggccagaccctcagtgg

SEQ ID NO: 8208015 - DNA, 22 bp, Homo sapiens
gctctggccagaccctcagtgg

SEQ ID NO: 8208016 - DNA, 21 bp, Homo sapiens
gctctggcctactgttccctc

SEQ ID NO: 8208017 - DNA, 22 bp, Homo sapiens
gctctgctgacagctgggacag

SEQ ID NO: 8208018 - DNA, 22 bp, Homo sapiens
gctctgctgaagccccttgcat

SEQ ID NO: 8208019 - DNA, 22 bp, Homo sapiens
gctctgctcttgacttaccagg

SEQ ID NO: 8208020 - DNA, 23 bp, Homo sapiens
gctctggcagcttgtgtcagcac

SEQ ID NO: 8208021 - DNA, 23 bp, Homo sapiens
gctctggcagcttgtgtcagcac

SEQ ID NO: 8208022 - DNA, 22 bp, Homo sapiens
gctctggccagaccctcagtgg

SEQ ID NO: 8208023 - DNA, 23 bp, Homo sapiens
gctctggcagcttgtgtcagcac

SEQ ID NO: 8208024 - DNA, 22 bp, Homo sapiens
gctctgctggaagttctctgga

SEQ ID NO: 8208025 - DNA, 22 bp, Homo sapiens
gctctggcactggcgcgggatg

SEQ ID NO: 8208026 - DNA, 17 bp, Homo sapiens
gctctgccccagcctct

SEQ ID NO: 8208027 - DNA, 17 bp, Homo sapiens
gctctgccccagcctct

SEQ ID NO: 8208028 - DNA, 17 bp, Homo sapiens
gctctgccccagcctct

SEQ ID NO: 8208029 - DNA, 17 bp, Homo sapiens
gctctgccccagcctct

SEQ ID NO: 8208030 - DNA, 18 bp, Homo sapiens
gctctgcccaggctgccc

SEQ ID NO: 8208031 - DNA, 18 bp, Homo sapiens
gctctgcccaggctgccc

SEQ ID NO: 8208032 - DNA, 22 bp, Homo sapiens
gctctccactgaccacggggca

SEQ ID NO: 8208033 - DNA, 21 bp, Homo sapiens
gctctccagggccagcccagg

SEQ ID NO: 8208034 - DNA, 22 bp, Homo sapiens
gctctccagattcaggagggat

SEQ ID NO: 8208035 - DNA, 21 bp, Homo sapiens
gctctccagggccagcccagg

SEQ ID NO: 8208036 - DNA, 22 bp, Homo sapiens
gctctcagggtgatggcatact

SEQ ID NO: 8208037 - DNA, 22 bp, Homo sapiens
gctctccaaaccctgtggcttt

SEQ ID NO: 8208038 - DNA, 22 bp, Homo sapiens
gctctcatgccctctgggcttg

SEQ ID NO: 8208039 - DNA, 17 bp, Homo sapiens
gctctgcctctcccacc

SEQ ID NO: 8208040 - DNA, 22 bp, Homo sapiens
gctctgccccaggaactcagcc

SEQ ID NO: 8208041 - DNA, 17 bp, Homo sapiens
gctctgccccagcctct

SEQ ID NO: 8208042 - DNA, 22 bp, Homo sapiens
gctctgccccaggaactcagcc

SEQ ID NO: 8208043 - DNA, 22 bp, Homo sapiens
gctctgccccaggaactcagcc

SEQ ID NO: 8208044 - DNA, 17 bp, Homo sapiens
gctctgcctctcccacc

SEQ ID NO: 8208045 - DNA, 17 bp, Homo sapiens
gctctgcctctcccacc

SEQ ID NO: 8208046 - DNA, 22 bp, Homo sapiens
gctctgctaatattgtagtacc

SEQ ID NO: 8208047 - DNA, 22 bp, Homo sapiens
gctctgcctggtcgcgtgctgg

SEQ ID NO: 8208048 - DNA, 22 bp, Homo sapiens
gctctgctctaacattcctgac

SEQ ID NO: 8208049 - DNA, 23 bp, Homo sapiens
gctctgctctgtttcatagacag

SEQ ID NO: 8208050 - DNA, 22 bp, Homo sapiens
gctcacagttctatttttcatg

SEQ ID NO: 8208051 - DNA, 22 bp, Homo sapiens
gctcaccaagcagagactctgg

SEQ ID NO: 8208052 - DNA, 22 bp, Homo sapiens
gctcaccaagcagagactctgg

SEQ ID NO: 8208053 - DNA, 22 bp, Homo sapiens
gctcaccttcgtccagcagccg

SEQ ID NO: 8208054 - DNA, 22 bp, Homo sapiens
gctcactgcaacctccacctcc

SEQ ID NO: 8208055 - DNA, 22 bp, Homo sapiens
gctcagctgcacctggagagcc

SEQ ID NO: 8208056 - DNA, 21 bp, Homo sapiens
gctcagctgcttggttcctgt

SEQ ID NO: 8208057 - DNA, 21 bp, Homo sapiens
gctcagctgcttggttcctgt

SEQ ID NO: 8208058 - DNA, 22 bp, Homo sapiens
gctcactgcaacctccacctcc

SEQ ID NO: 8208059 - DNA, 22 bp, Homo sapiens
gctcactaaataacaggaagaa

SEQ ID NO: 8208060 - DNA, 22 bp, Homo sapiens
gctcaccttcgtccagcagccg

SEQ ID NO: 8208061 - DNA, 22 bp, Homo sapiens
gctcaggcatgtatgtggttgc

SEQ ID NO: 8208062 - DNA, 22 bp, Homo sapiens
gctcaggcccagcggctggtgt

SEQ ID NO: 8208063 - DNA, 22 bp, Homo sapiens
gctcaggcccagcggctggtgt

SEQ ID NO: 8208064 - DNA, 22 bp, Homo sapiens
gctcaggcccagcggctggtgt

SEQ ID NO: 8208065 - DNA, 18 bp, Homo sapiens
gctcaggccctagtcagt

SEQ ID NO: 8208066 - DNA, 18 bp, Homo sapiens
gctcaggccctagtcagt

SEQ ID NO: 8208067 - DNA, 22 bp, Homo sapiens
gctcaggcccagcggctggtgt

SEQ ID NO: 8208068 - DNA, 22 bp, Homo sapiens
gctcagctggaccatcgtgttt

SEQ ID NO: 8208069 - DNA, 22 bp, Homo sapiens
gctcagctggagagggacgggt

SEQ ID NO: 8208070 - DNA, 22 bp, Homo sapiens
gctcagcttgggagcgcccggt

SEQ ID NO: 8208071 - DNA, 22 bp, Homo sapiens
gctcacagtacagtgctggctc

SEQ ID NO: 8208072 - DNA, 22 bp, Homo sapiens
gctcacagtctgctgagtgcag

SEQ ID NO: 8208073 - DNA, 22 bp, Homo sapiens
gctcacagtctgctgagtgcag

SEQ ID NO: 8208074 - DNA, 22 bp, Homo sapiens
gctcacagtacagtgctggctc

SEQ ID NO: 8208075 - DNA, 22 bp, Homo sapiens
gctcacagtctgctgagtgcag

SEQ ID NO: 8208076 - DNA, 22 bp, Homo sapiens
gctcacagtctgctgagtgcag

SEQ ID NO: 8208077 - DNA, 22 bp, Homo sapiens
gctcacagtctggcatagtctc

SEQ ID NO: 8208078 - DNA, 22 bp, Homo sapiens
gctcacagaacttctcttccca

SEQ ID NO: 8208079 - DNA, 22 bp, Homo sapiens
gctcacagcccaggccagcgtg

SEQ ID NO: 8208080 - DNA, 22 bp, Homo sapiens
gctcacagcccaggccagcgtg

SEQ ID NO: 8208081 - DNA, 22 bp, Homo sapiens
gctcacagccggctggcagggg

SEQ ID NO: 8208082 - DNA, 22 bp, Homo sapiens
gctcacaggcagtgttgggaga

SEQ ID NO: 8208083 - DNA, 22 bp, Homo sapiens
gctcacagccggctggcagggg

SEQ ID NO: 8208084 - DNA, 22 bp, Homo sapiens
gctcacagccggctggcagggg

SEQ ID NO: 8208085 - DNA, 22 bp, Homo sapiens
gctcacagccggctggcagggg

SEQ ID NO: 8208086 - DNA, 22 bp, Homo sapiens
gcggggggaggaacatcttgca

SEQ ID NO: 8208087 - DNA, 22 bp, Homo sapiens
gctatagaaagtaatcactatc

SEQ ID NO: 8208088 - DNA, 22 bp, Homo sapiens
gctatagaatttcatagagacc

SEQ ID NO: 8208089 - DNA, 22 bp, Homo sapiens
gctatattttgaaggagagcca

SEQ ID NO: 8208090 - DNA, 22 bp, Homo sapiens
gctcaagatgtggcctctgaag

SEQ ID NO: 8208091 - DNA, 22 bp, Homo sapiens
gctcaagccttctgcccacctc

SEQ ID NO: 8208092 - DNA, 22 bp, Homo sapiens
gctcaagactgttagcctggca

SEQ ID NO: 8208093 - DNA, 22 bp, Homo sapiens
gctcaaatttcagactcatgaa

SEQ ID NO: 8208094 - DNA, 21 bp, Homo sapiens
gctatgaatgtagaaaattat

SEQ ID NO: 8208095 - DNA, 22 bp, Homo sapiens
gctcaagacccctctgtgactg

SEQ ID NO: 8208096 - DNA, 22 bp, Homo sapiens
gctcaactgctaactgttttga

SEQ ID NO: 8208097 - DNA, 22 bp, Homo sapiens
gctcaaatttcagactcatgaa

SEQ ID NO: 8208098 - DNA, 22 bp, Homo sapiens
gctcacagaacttctcttccca

SEQ ID NO: 8208099 - DNA, 22 bp, Homo sapiens
gctcaaggcaggcagacatgag

SEQ ID NO: 8208100 - DNA, 22 bp, Homo sapiens
gctcaagggatgggagtgggtg

SEQ ID NO: 8208101 - DNA, 22 bp, Homo sapiens
gctcaaggcaggcagacatgag

SEQ ID NO: 8208102 - DNA, 22 bp, Homo sapiens
gccttgagaagtcctgcagtga

SEQ ID NO: 8208103 - DNA, 22 bp, Homo sapiens
gcgaatctcagctggtgctgcg

SEQ ID NO: 8208104 - DNA, 22 bp, Homo sapiens
gcgacctcctgcctgagagtct

SEQ ID NO: 8208105 - DNA, 22 bp, Homo sapiens
gcgcgctgagtgtccgttgggg

SEQ ID NO: 8208106 - DNA, 22 bp, Homo sapiens
gcgcctggcacacagcaagggc

SEQ ID NO: 8208107 - DNA, 22 bp, Homo sapiens
gcgcctggcacacagcaagggc

SEQ ID NO: 8208108 - DNA, 16 bp, Homo sapiens
gcgcctcctcggcctc

SEQ ID NO: 8208109 - DNA, 16 bp, Homo sapiens
gcgcctcctcggcctc

SEQ ID NO: 8208110 - DNA, 22 bp, Homo sapiens
gcgactgtacagaattgcccct

SEQ ID NO: 8208111 - DNA, 22 bp, Homo sapiens
gcgagaaactaagtgccctttg

SEQ ID NO: 8208112 - DNA, 22 bp, Homo sapiens
gcgagaaactaagtgccctttg

SEQ ID NO: 8208113 - DNA, 22 bp, Homo sapiens
gccttctgatatctcttggcat

SEQ ID NO: 8208114 - DNA, 17 bp, Homo sapiens
gccttctctgccctcac

SEQ ID NO: 8208115 - DNA, 22 bp, Homo sapiens
gccttctgatcgctggactgac

SEQ ID NO: 8208116 - DNA, 22 bp, Homo sapiens
gccttctgattgctggactgac

SEQ ID NO: 8208117 - DNA, 22 bp, Homo sapiens
gccttctgcgctcgtgtctccg

SEQ ID NO: 8208118 - DNA, 22 bp, Homo sapiens
gccttctgatcgctggactgac

SEQ ID NO: 8208119 - DNA, 22 bp, Homo sapiens
gccttctgattgctggactgac

SEQ ID NO: 8208120 - DNA, 22 bp, Homo sapiens
gccttgaactcatgtatattga

SEQ ID NO: 8208121 - DNA, 22 bp, Homo sapiens
gccttctgtgctcctggccttt

SEQ ID NO: 8208122 - DNA, 22 bp, Homo sapiens
gcggaaggctgcctggcttgag

SEQ ID NO: 8208123 - DNA, 22 bp, Homo sapiens
gcgcgtgggccgcggctggtta

SEQ ID NO: 8208124 - DNA, 22 bp, Homo sapiens
gcgctaggcaagtcctttcaac

SEQ ID NO: 8208125 - DNA, 22 bp, Homo sapiens
gcgctcaggtgccaggcctgcg

SEQ ID NO: 8208126 - DNA, 22 bp, Homo sapiens
gcgctaggcaagtcctttcaac

SEQ ID NO: 8208127 - DNA, 22 bp, Homo sapiens
gcgctgaggctggaggcgcacg

SEQ ID NO: 8208128 - DNA, 22 bp, Homo sapiens
gcgctggggctcaaacctcaca

SEQ ID NO: 8208129 - DNA, 18 bp, Homo sapiens
gcgctggctgtcctgtcc

SEQ ID NO: 8208130 - DNA, 22 bp, Homo sapiens
gcgctgcgcctcctcttccgca

SEQ ID NO: 8208131 - DNA, 22 bp, Homo sapiens
gcggcccgagcaggacgggtgg

SEQ ID NO: 8208132 - DNA, 22 bp, Homo sapiens
gcggcccgggtccccagcagca

SEQ ID NO: 8208133 - DNA, 22 bp, Homo sapiens
gcggcaggagtaaaggaggaag

SEQ ID NO: 8208134 - DNA, 22 bp, Homo sapiens
gcggcggagacagcaggaagcc

SEQ ID NO: 8208135 - DNA, 22 bp, Homo sapiens
gcggggcacagtgatggagcac

SEQ ID NO: 8208136 - DNA, 22 bp, Homo sapiens
gcgggccaccttggagagcgct

SEQ ID NO: 8208137 - DNA, 22 bp, Homo sapiens
gcgggccaccttggagagcgct

SEQ ID NO: 8208138 - DNA, 22 bp, Homo sapiens
gcctggggcatgcagctgatac

SEQ ID NO: 8208139 - DNA, 22 bp, Homo sapiens
gcctggggggcatgtcataata

SEQ ID NO: 8208140 - DNA, 22 bp, Homo sapiens
gcctggggtcccttgttggcac

SEQ ID NO: 8208141 - DNA, 22 bp, Homo sapiens
gcctgggtaggagacaaaaggt

SEQ ID NO: 8208142 - DNA, 22 bp, Homo sapiens
gcctggtgaaaggcagagagcg

SEQ ID NO: 8208143 - DNA, 22 bp, Homo sapiens
gcctggtgaaaggcagagagcg

SEQ ID NO: 8208144 - DNA, 22 bp, Homo sapiens
gcctggtctctttcatgtcagt

SEQ ID NO: 8208145 - DNA, 22 bp, Homo sapiens
gcctgggttcctgcttttgtga

SEQ ID NO: 8208146 - DNA, 23 bp, Homo sapiens
gcctgggttgtaactagtgcatc

SEQ ID NO: 8208147 - DNA, 23 bp, Homo sapiens
gcctgggttgtaactagtgcatc

SEQ ID NO: 8208148 - DNA, 22 bp, Homo sapiens
gcctggtgataagcagtgacct

SEQ ID NO: 8208149 - DNA, 22 bp, Homo sapiens
gcctggtgataagcagtgacct

SEQ ID NO: 8208150 - DNA, 22 bp, Homo sapiens
gcctggtgaaaggcagagagcg

SEQ ID NO: 8208151 - DNA, 22 bp, Homo sapiens
gcctggtgaaaggcagagagcg

SEQ ID NO: 8208152 - DNA, 22 bp, Homo sapiens
gcctggtgaaaggcagagagcg

SEQ ID NO: 8208153 - DNA, 22 bp, Homo sapiens
gcctgggtctcctccgcttccc

SEQ ID NO: 8208154 - DNA, 22 bp, Homo sapiens
gcctgggtgaatttgatcctaa

SEQ ID NO: 8208155 - DNA, 22 bp, Homo sapiens
gcctgggtgagggtctccttca

SEQ ID NO: 8208156 - DNA, 22 bp, Homo sapiens
gcctgggtgaatttgatcctaa

SEQ ID NO: 8208157 - DNA, 22 bp, Homo sapiens
gcctgggtccactgatcatgct

SEQ ID NO: 8208158 - DNA, 22 bp, Homo sapiens
gcctgggtccactgatcatgct

SEQ ID NO: 8208159 - DNA, 22 bp, Homo sapiens
gcctgggtccaccgctcgcgct

SEQ ID NO: 8208160 - DNA, 23 bp, Homo sapiens
gcctgggtctagagataagagcc

SEQ ID NO: 8208161 - DNA, 22 bp, Homo sapiens
gcctgggtccactgatcatgct

SEQ ID NO: 8208162 - DNA, 22 bp, Homo sapiens
gcctgggtgagggtctccttca

SEQ ID NO: 8208163 - DNA, 22 bp, Homo sapiens
gcctgggtgcccaatgatgaga

SEQ ID NO: 8208164 - DNA, 22 bp, Homo sapiens
gcctgggtgtcgatcactagtg

SEQ ID NO: 8208165 - DNA, 22 bp, Homo sapiens
gcctgggtggagaggggtgaca

SEQ ID NO: 8208166 - DNA, 22 bp, Homo sapiens
gcctgggtgctctgtgtaaggg

SEQ ID NO: 8208167 - DNA, 22 bp, Homo sapiens
gcctgggttccatgatctccag

SEQ ID NO: 8208168 - DNA, 22 bp, Homo sapiens
gcctgggtgtcgatcactagtg

SEQ ID NO: 8208169 - DNA, 22 bp, Homo sapiens
gcctgggttccatgatctccag

SEQ ID NO: 8208170 - DNA, 22 bp, Homo sapiens
gcctgggttccatgatctccag

SEQ ID NO: 8208171 - DNA, 23 bp, Homo sapiens
gccttcagctcgggaaggctccc

SEQ ID NO: 8208172 - DNA, 22 bp, Homo sapiens
gccttcagcggccgctcgctgc

SEQ ID NO: 8208173 - DNA, 22 bp, Homo sapiens
gccttcaggaaatcagtccttg

SEQ ID NO: 8208174 - DNA, 23 bp, Homo sapiens
gccttcagctcgggaaggctccc

SEQ ID NO: 8208175 - DNA, 22 bp, Homo sapiens
gccttcaggaaatcagtccttg

SEQ ID NO: 8208176 - DNA, 22 bp, Homo sapiens
gccttcaggtgctgccaggcta

SEQ ID NO: 8208177 - DNA, 22 bp, Homo sapiens
gccttcaggtgtccctgtgggc

SEQ ID NO: 8208178 - DNA, 22 bp, Homo sapiens
gccttcagtagtatcctcatga

SEQ ID NO: 8208179 - DNA, 22 bp, Homo sapiens
gccttcagtagtgtcagctgta

SEQ ID NO: 8208180 - DNA, 22 bp, Homo sapiens
gccttccacctaggcctctgct

SEQ ID NO: 8208181 - DNA, 22 bp, Homo sapiens
gccttcagtagtgtcagctgta

SEQ ID NO: 8208182 - DNA, 22 bp, Homo sapiens
gccttcagtagtgtcagctgta

SEQ ID NO: 8208183 - DNA, 22 bp, Homo sapiens
gccttcagtagtgtcagctgta

SEQ ID NO: 8208184 - DNA, 22 bp, Homo sapiens
gccttcagagtaccatgtcctc

SEQ ID NO: 8208185 - DNA, 18 bp, Homo sapiens
gccttcagactgcatgct

SEQ ID NO: 8208186 - DNA, 18 bp, Homo sapiens
gccttcagactgcatgct

SEQ ID NO: 8208187 - DNA, 18 bp, Homo sapiens
gccttcagactgcatgct

SEQ ID NO: 8208188 - DNA, 22 bp, Homo sapiens
gccttcagcggccgctcgctgc

SEQ ID NO: 8208189 - DNA, 22 bp, Homo sapiens
gccttaggggtcagacagagct

SEQ ID NO: 8208190 - DNA, 22 bp, Homo sapiens
gcctggtgtccagaggcgagtg

SEQ ID NO: 8208191 - DNA, 18 bp, Homo sapiens
gccttcagactgcatgct

SEQ ID NO: 8208192 - DNA, 21 bp, Homo sapiens
gccttcactcccagagtttgt

SEQ ID NO: 8208193 - DNA, 22 bp, Homo sapiens
gcctggtgctatgagggccagc

SEQ ID NO: 8208194 - DNA, 22 bp, Homo sapiens
gcctggtgctatgagggccagc

SEQ ID NO: 8208195 - DNA, 22 bp, Homo sapiens
gcctggtggacactgggcatca

SEQ ID NO: 8208196 - DNA, 22 bp, Homo sapiens
gcctggtggtatcctggcaaga

SEQ ID NO: 8208197 - DNA, 22 bp, Homo sapiens
gcctggtggacactgggcatca

SEQ ID NO: 8208198 - DNA, 22 bp, Homo sapiens
gcctggtggtgtgctcaagtgg

SEQ ID NO: 8208199 - DNA, 22 bp, Homo sapiens
gcctggtggtgtgctcaagtgg

SEQ ID NO: 8208200 - DNA, 22 bp, Homo sapiens
gcctggtggtatcctggcaaga

SEQ ID NO: 8208201 - DNA, 22 bp, Homo sapiens
gcctggtgtccagaggcgagtg

SEQ ID NO: 8208202 - DNA, 22 bp, Homo sapiens
gcctggtgtccagaggcgagtg

SEQ ID NO: 8208203 - DNA, 22 bp, Homo sapiens
gcctggtgtccagaggcgagtg

SEQ ID NO: 8208204 - DNA, 22 bp, Homo sapiens
gcctcagggggagaggccagct

SEQ ID NO: 8208205 - DNA, 22 bp, Homo sapiens
gcctcagggataggatgagcat

SEQ ID NO: 8208206 - DNA, 22 bp, Homo sapiens
gcctcagggataggatgagcat

SEQ ID NO: 8208207 - DNA, 22 bp, Homo sapiens
gcctcagggataggatgagcat

SEQ ID NO: 8208208 - DNA, 22 bp, Homo sapiens
gcctggctaagcagaaggaccc

SEQ ID NO: 8208209 - DNA, 22 bp, Homo sapiens
gcctcaggcctatagctgctgt

SEQ ID NO: 8208210 - DNA, 22 bp, Homo sapiens
gcctcagggataggatgagcat

SEQ ID NO: 8208211 - DNA, 22 bp, Homo sapiens
gcctcaggcctatagctgctgt

SEQ ID NO: 8208212 - DNA, 22 bp, Homo sapiens
gcctcaggcctatagctgctgt

SEQ ID NO: 8208213 - DNA, 22 bp, Homo sapiens
gcctcaggcctatagctgctgt

SEQ ID NO: 8208214 - DNA, 22 bp, Homo sapiens
gcctcaggcctatagctgctgt

SEQ ID NO: 8208215 - DNA, 22 bp, Homo sapiens
gcctcaggccgccctgctgctc

SEQ ID NO: 8208216 - DNA, 22 bp, Homo sapiens
gcctcaggccgccctgctgctc

SEQ ID NO: 8208217 - DNA, 22 bp, Homo sapiens
gcctggctgcttagcctacttc

SEQ ID NO: 8208218 - DNA, 22 bp, Homo sapiens
gcctggctgctcagccactcac

SEQ ID NO: 8208219 - DNA, 22 bp, Homo sapiens
gcctggctgctagccagaggca

SEQ ID NO: 8208220 - DNA, 22 bp, Homo sapiens
gcctggctgctagccagaggca

SEQ ID NO: 8208221 - DNA, 22 bp, Homo sapiens
gcctggctgctagccagaggca

SEQ ID NO: 8208222 - DNA, 22 bp, Homo sapiens
gcctggctgctcagccactcac

SEQ ID NO: 8208223 - DNA, 22 bp, Homo sapiens
gcctggctgccggccttggcaa

SEQ ID NO: 8208224 - DNA, 18 bp, Homo sapiens
gcctggctgccaacccag

SEQ ID NO: 8208225 - DNA, 22 bp, Homo sapiens
gcctggctgccggccttggcaa

SEQ ID NO: 8208226 - DNA, 18 bp, Homo sapiens
gcctggctgccaacccag

SEQ ID NO: 8208227 - DNA, 22 bp, Homo sapiens
gcctggctgaggtggggaggca

SEQ ID NO: 8208228 - DNA, 18 bp, Homo sapiens
gcctggcttcggagccgc

SEQ ID NO: 8208229 - DNA, 22 bp, Homo sapiens
gcctggcttcccttggagcatt

SEQ ID NO: 8208230 - DNA, 23 bp, Homo sapiens
gcctggcttccaaggtaggggag

SEQ ID NO: 8208231 - DNA, 21 bp, Homo sapiens
gcctggcttcacaggcactga

SEQ ID NO: 8208232 - DNA, 22 bp, Homo sapiens
gcctggcttcccttggagcatt

SEQ ID NO: 8208233 - DNA, 22 bp, Homo sapiens
gcctggcttggggctcagtggt

SEQ ID NO: 8208234 - DNA, 22 bp, Homo sapiens
gcctggggaacttgatcctgtc

SEQ ID NO: 8208235 - DNA, 22 bp, Homo sapiens
gcctggcttgccagccctggcg

SEQ ID NO: 8208236 - DNA, 18 bp, Homo sapiens
gcctggcttcggagccgc

SEQ ID NO: 8208237 - DNA, 22 bp, Homo sapiens
gcctggcttgccagccctggcg

SEQ ID NO: 8208238 - DNA, 22 bp, Homo sapiens
gcctggcttgccagccctggcg

SEQ ID NO: 8208239 - DNA, 22 bp, Homo sapiens
gcctggcttgccagccctggcg

SEQ ID NO: 8208240 - DNA, 22 bp, Homo sapiens
gcctggctggtagagggggctc

SEQ ID NO: 8208241 - DNA, 22 bp, Homo sapiens
gcctggctgggctgaatgctta

SEQ ID NO: 8208242 - DNA, 19 bp, Homo sapiens
gcctggctgggatgagccc

SEQ ID NO: 8208243 - DNA, 19 bp, Homo sapiens
gcctggctgggatgagccc

SEQ ID NO: 8208244 - DNA, 22 bp, Homo sapiens
gcctggctgcttagcctacttc

SEQ ID NO: 8208245 - DNA, 22 bp, Homo sapiens
gcctggctgtctggcaaggttc

SEQ ID NO: 8208246 - DNA, 22 bp, Homo sapiens
gcctggctgtcaaacccagaag

SEQ ID NO: 8208247 - DNA, 22 bp, Homo sapiens
gcctggctggtcactgcctggc

SEQ ID NO: 8208248 - DNA, 22 bp, Homo sapiens
gcctggctggtcactgcctggc

SEQ ID NO: 8208249 - DNA, 22 bp, Homo sapiens
gcctggctggtcactgcctggc

SEQ ID NO: 8208250 - DNA, 22 bp, Homo sapiens
gcctggctggtagagggggctc

SEQ ID NO: 8208251 - DNA, 22 bp, Homo sapiens
gcaaatgcactgcatttagatt

SEQ ID NO: 8208252 - DNA, 22 bp, Homo sapiens
gcaaatgaaggtggtgctacag

SEQ ID NO: 8208253 - DNA, 22 bp, Homo sapiens
gagggtccccatgcagagctca

SEQ ID NO: 8208254 - DNA, 22 bp, Homo sapiens
gagggtcccgagccctgtcaga

SEQ ID NO: 8208255 - DNA, 22 bp, Homo sapiens
gcaagacctatctagttgctgt

SEQ ID NO: 8208256 - DNA, 22 bp, Homo sapiens
gcaagacctatctagttgctgt

SEQ ID NO: 8208257 - DNA, 22 bp, Homo sapiens
gcaagagacttttatgtctgcc

SEQ ID NO: 8208258 - DNA, 22 bp, Homo sapiens
gcaagagacttttatgtctgcc

SEQ ID NO: 8208259 - DNA, 22 bp, Homo sapiens
gcaagagttttttctctcttga

SEQ ID NO: 8208260 - DNA, 22 bp, Homo sapiens
gcaagagtttctggagcagagt

SEQ ID NO: 8208261 - DNA, 19 bp, Homo sapiens
gcaagagcttaggaggggt

SEQ ID NO: 8208262 - DNA, 22 bp, Homo sapiens
gcaagcagacattcaggtaggt

SEQ ID NO: 8208263 - DNA, 22 bp, Homo sapiens
gaggggctgtggagctctctgg

SEQ ID NO: 8208264 - DNA, 22 bp, Homo sapiens
gaggggctgggtagggcaaccc

SEQ ID NO: 8208265 - DNA, 22 bp, Homo sapiens
gaggggctgggtagggcaaccc

SEQ ID NO: 8208266 - DNA, 22 bp, Homo sapiens
gagggggagatgtgcacacact

SEQ ID NO: 8208267 - DNA, 22 bp, Homo sapiens
gagggggaaagtccctggagtc

SEQ ID NO: 8208268 - DNA, 22 bp, Homo sapiens
gaggggcttgaggccctgatgg

SEQ ID NO: 8208269 - DNA, 22 bp, Homo sapiens
gaggggtccaggaggcacttac

SEQ ID NO: 8208270 - DNA, 22 bp, Homo sapiens
gaggggtcttttgttgtcaggg

SEQ ID NO: 8208271 - DNA, 22 bp, Homo sapiens
gaggggtcctgccttggctgga

SEQ ID NO: 8208272 - DNA, 22 bp, Homo sapiens
gaggggtcacatgggctggctt

SEQ ID NO: 8208273 - DNA, 22 bp, Homo sapiens
gaggggtcacatgggctggctt

SEQ ID NO: 8208274 - DNA, 22 bp, Homo sapiens
gaggggtgtggagccatcagtt

SEQ ID NO: 8208275 - DNA, 22 bp, Homo sapiens
gaggggtgtggagccatcagtt

SEQ ID NO: 8208276 - DNA, 22 bp, Homo sapiens
gaggggtgtggagccatcagtt

SEQ ID NO: 8208277 - DNA, 22 bp, Homo sapiens
gaggggtggcgttggcatttag

SEQ ID NO: 8208278 - DNA, 22 bp, Homo sapiens
gaggggtggccctggcgtgtac

SEQ ID NO: 8208279 - DNA, 22 bp, Homo sapiens
gaggggtggccctggcgtgtac

SEQ ID NO: 8208280 - DNA, 22 bp, Homo sapiens
gcacagccctggtcggggcccc

SEQ ID NO: 8208281 - DNA, 22 bp, Homo sapiens
gcacagccttgccctgtgccct

SEQ ID NO: 8208282 - DNA, 22 bp, Homo sapiens
gcacagcctgtccctgtcctgg

SEQ ID NO: 8208283 - DNA, 22 bp, Homo sapiens
gcacagccttgccctgtgccct

SEQ ID NO: 8208284 - DNA, 22 bp, Homo sapiens
gcacagctcgagctcaggaggg

SEQ ID NO: 8208285 - DNA, 22 bp, Homo sapiens
gcacagctcagcatgggaggac

SEQ ID NO: 8208286 - DNA, 18 bp, Homo sapiens
gcacagctaggagggtcc

SEQ ID NO: 8208287 - DNA, 18 bp, Homo sapiens
gcacagctaggagggtcc

SEQ ID NO: 8208288 - DNA, 22 bp, Homo sapiens
gcacaggcacagagggccactg

SEQ ID NO: 8208289 - DNA, 22 bp, Homo sapiens
gcacaggcacagagggccactg

SEQ ID NO: 8208290 - DNA, 22 bp, Homo sapiens
gcacaggcaatagatacagcta

SEQ ID NO: 8208291 - DNA, 22 bp, Homo sapiens
gcacaggcaatagatacagcta

SEQ ID NO: 8208292 - DNA, 22 bp, Homo sapiens
gcacaggaggccgatgctcatg

SEQ ID NO: 8208293 - DNA, 22 bp, Homo sapiens
gcacaggaggccgatgctcatg

SEQ ID NO: 8208294 - DNA, 22 bp, Homo sapiens
gcacaggagccaggtccttcac

SEQ ID NO: 8208295 - DNA, 19 bp, Homo sapiens
gcacaggacatctgatgga

SEQ ID NO: 8208296 - DNA, 22 bp, Homo sapiens
gcacagctggactctgcctggc

SEQ ID NO: 8208297 - DNA, 22 bp, Homo sapiens
gcacagctccgcttcctcacac

SEQ ID NO: 8208298 - DNA, 22 bp, Homo sapiens
gcacaggaaatgactcatgtta

SEQ ID NO: 8208299 - DNA, 22 bp, Homo sapiens
gcaagctgtgccttctcaggat

SEQ ID NO: 8208300 - DNA, 22 bp, Homo sapiens
gcaagctgtgatttatgtgaat

SEQ ID NO: 8208301 - DNA, 22 bp, Homo sapiens
gcaagctggctgttagaggatg

SEQ ID NO: 8208302 - DNA, 22 bp, Homo sapiens
gcaaggaacaaatgctctgctt

SEQ ID NO: 8208303 - DNA, 22 bp, Homo sapiens
gcaagcttcatatggcattttc

SEQ ID NO: 8208304 - DNA, 21 bp, Homo sapiens
gcacagcatgagtgttggcat

SEQ ID NO: 8208305 - DNA, 21 bp, Homo sapiens
gcacagcatgagtgttggcat

SEQ ID NO: 8208306 - DNA, 22 bp, Homo sapiens
gcacagccactgagtgagaacc

SEQ ID NO: 8208307 - DNA, 22 bp, Homo sapiens
gcacagccacgtaatgtggtca

SEQ ID NO: 8208308 - DNA, 22 bp, Homo sapiens
gcacagccagcatctgagggat

SEQ ID NO: 8208309 - DNA, 22 bp, Homo sapiens
gcaagctgctcttatgtggagg

SEQ ID NO: 8208310 - DNA, 22 bp, Homo sapiens
gcaagctgctcttatgtggagg

SEQ ID NO: 8208311 - DNA, 22 bp, Homo sapiens
gcaagctgcttaagctcattgt

SEQ ID NO: 8208312 - DNA, 22 bp, Homo sapiens
gcaagctggctgttagaggatg

SEQ ID NO: 8208313 - DNA, 22 bp, Homo sapiens
gcaagctggctgttagaggatg

SEQ ID NO: 8208314 - DNA, 22 bp, Homo sapiens
gcaagctgatgtgatagtgaaa

SEQ ID NO: 8208315 - DNA, 22 bp, Homo sapiens
gcaagctgatgtgatagtgaaa

SEQ ID NO: 8208316 - DNA, 20 bp, Homo sapiens
gcaagcatgaagagtagaga

SEQ ID NO: 8208317 - DNA, 22 bp, Homo sapiens
gcaagcagttgtggcttctgag

SEQ ID NO: 8208318 - DNA, 22 bp, Homo sapiens
gcaagcagatctccggagggaa

SEQ ID NO: 8208319 - DNA, 22 bp, Homo sapiens
gcaagcagttgtggcttctgag

SEQ ID NO: 8208320 - DNA, 22 bp, Homo sapiens
gcaagcagggttccttagggca

SEQ ID NO: 8208321 - DNA, 22 bp, Homo sapiens
gcaagcagcccagaacagctct

SEQ ID NO: 8208322 - DNA, 23 bp, Homo sapiens
gcactgccatgtgctctgcaggc

SEQ ID NO: 8208323 - DNA, 23 bp, Homo sapiens
gcactgccatgtgctctgcaggc

SEQ ID NO: 8208324 - DNA, 22 bp, Homo sapiens
gcactgccatcaatgcatgaca

SEQ ID NO: 8208325 - DNA, 22 bp, Homo sapiens
gcactgcctgtgttcagggtaa

SEQ ID NO: 8208326 - DNA, 22 bp, Homo sapiens
gcactgcctgtgagccctggtt

SEQ ID NO: 8208327 - DNA, 22 bp, Homo sapiens
gcactgctatttagctccatca

SEQ ID NO: 8208328 - DNA, 22 bp, Homo sapiens
gcactgagtctgtcatgctgca

SEQ ID NO: 8208329 - DNA, 22 bp, Homo sapiens
gcactgagtctgtcatgctgca

SEQ ID NO: 8208330 - DNA, 22 bp, Homo sapiens
gcactgagtctgtcatgctgca

SEQ ID NO: 8208331 - DNA, 22 bp, Homo sapiens
gcactgcagcctcagatggtgg

SEQ ID NO: 8208332 - DNA, 22 bp, Homo sapiens
gcactgccacataatctcagca

SEQ ID NO: 8208333 - DNA, 22 bp, Homo sapiens
gcactgcatctactggcaagta

SEQ ID NO: 8208334 - DNA, 22 bp, Homo sapiens
gcactgcaggtgggtggagagg

SEQ ID NO: 8208335 - DNA, 22 bp, Homo sapiens
gcactgggaagaatgagcctgt

SEQ ID NO: 8208336 - DNA, 22 bp, Homo sapiens
gcactggagggtgtagttgctg

SEQ ID NO: 8208337 - DNA, 22 bp, Homo sapiens
gcactggatcttgggagacgtg

SEQ ID NO: 8208338 - DNA, 22 bp, Homo sapiens
gcactgggaatgagggcagctt

SEQ ID NO: 8208339 - DNA, 22 bp, Homo sapiens
gcactgggaatgagggcagctt

SEQ ID NO: 8208340 - DNA, 22 bp, Homo sapiens
gcactggaaatacctagatgaa

SEQ ID NO: 8208341 - DNA, 22 bp, Homo sapiens
gcactggaaggagggaatctta

SEQ ID NO: 8208342 - DNA, 22 bp, Homo sapiens
gcactggacaggagtgaaatta

SEQ ID NO: 8208343 - DNA, 22 bp, Homo sapiens
gcactggagatacagagatgaa

SEQ ID NO: 8208344 - DNA, 22 bp, Homo sapiens
gcactggagatggggttgtcgg

SEQ ID NO: 8208345 - DNA, 22 bp, Homo sapiens
gcactggagatggggttgtcgg

SEQ ID NO: 8208346 - DNA, 22 bp, Homo sapiens
gcactggaccccaggatatgga

SEQ ID NO: 8208347 - DNA, 22 bp, Homo sapiens
gcactggagatacagagatgaa

SEQ ID NO: 8208348 - DNA, 22 bp, Homo sapiens
gcactggagaatggctgtattc

SEQ ID NO: 8208349 - DNA, 22 bp, Homo sapiens
gcactgaatgccaaagtgtagg

SEQ ID NO: 8208350 - DNA, 22 bp, Homo sapiens
gcactgagcaccagccacagat

SEQ ID NO: 8208351 - DNA, 23 bp, Homo sapiens
gcactgagctcactagtcccctg

SEQ ID NO: 8208352 - DNA, 22 bp, Homo sapiens
gcactgagtctgtcatgctgca

SEQ ID NO: 8208353 - DNA, 22 bp, Homo sapiens
gcactgagtctgtcatgctgca

SEQ ID NO: 8208354 - DNA, 22 bp, Homo sapiens
gcactgagctttggaggagcag

SEQ ID NO: 8208355 - DNA, 22 bp, Homo sapiens
gcactgaggaaggagggagtgg

SEQ ID NO: 8208356 - DNA, 22 bp, Homo sapiens
gcactgagcaccagccacagat

SEQ ID NO: 8208357 - DNA, 21 bp, Homo sapiens
gcactgagcatctcctctgcc

SEQ ID NO: 8208358 - DNA, 21 bp, Homo sapiens
gcactgagcatctcctctgcc

SEQ ID NO: 8208359 - DNA, 17 bp, Homo sapiens
gcactgagccacagttt

SEQ ID NO: 8208360 - DNA, 17 bp, Homo sapiens
gcactgagccacagttt

SEQ ID NO: 8208361 - DNA, 21 bp, Homo sapiens
gcactgagcatctcctctgcc

SEQ ID NO: 8208362 - DNA, 22 bp, Homo sapiens
gcacctgggcaaggattcagag

SEQ ID NO: 8208363 - DNA, 22 bp, Homo sapiens
gcacctgggcaaggattcagag

SEQ ID NO: 8208364 - DNA, 22 bp, Homo sapiens
gcacctgggacccagaggcacc

SEQ ID NO: 8208365 - DNA, 22 bp, Homo sapiens
gcacaggcacagagggccactg

SEQ ID NO: 8208366 - DNA, 22 bp, Homo sapiens
gcacaggccatgggaggacagc

SEQ ID NO: 8208367 - DNA, 18 bp, Homo sapiens
gcactctgactgcagagc

SEQ ID NO: 8208368 - DNA, 22 bp, Homo sapiens
gcactgaaaatgttggattcca

SEQ ID NO: 8208369 - DNA, 17 bp, Homo sapiens
gcactcccccacctcct

SEQ ID NO: 8208370 - DNA, 17 bp, Homo sapiens
gcactcccccacctcct

SEQ ID NO: 8208371 - DNA, 22 bp, Homo sapiens
gcactctcctggctgccacagt

SEQ ID NO: 8208372 - DNA, 22 bp, Homo sapiens
gcactctcctggctgccacagt

SEQ ID NO: 8208373 - DNA, 18 bp, Homo sapiens
gcactctgactgcagagc

SEQ ID NO: 8208374 - DNA, 22 bp, Homo sapiens
gcacttcacatgccttttcctg

SEQ ID NO: 8208375 - DNA, 22 bp, Homo sapiens
gcacttatggcatcttcctgtg

SEQ ID NO: 8208376 - DNA, 22 bp, Homo sapiens
gcacttatggcatcttcctgtg

SEQ ID NO: 8208377 - DNA, 22 bp, Homo sapiens
gcacttatgctcaccttgttct

SEQ ID NO: 8208378 - DNA, 22 bp, Homo sapiens
gcacttacatactctgcataca

SEQ ID NO: 8208379 - DNA, 22 bp, Homo sapiens
gcactgtgctagaagccagggg

SEQ ID NO: 8208380 - DNA, 22 bp, Homo sapiens
gcactgtgcttagttcactatt

SEQ ID NO: 8208381 - DNA, 22 bp, Homo sapiens
gcacttctatttttttcagtgg

SEQ ID NO: 8208382 - DNA, 22 bp, Homo sapiens
gcactgggaatgctgatgggct

SEQ ID NO: 8208383 - DNA, 22 bp, Homo sapiens
gcactgggaatgctgatgggct

SEQ ID NO: 8208384 - DNA, 22 bp, Homo sapiens
gcactgggaatgctgatgggct

SEQ ID NO: 8208385 - DNA, 22 bp, Homo sapiens
gcactgggaatgtgagcagctg

SEQ ID NO: 8208386 - DNA, 23 bp, Homo sapiens
gcactgggctctcagcaaggtgt

SEQ ID NO: 8208387 - DNA, 23 bp, Homo sapiens
gcactgggctctcagcaaggtgt

SEQ ID NO: 8208388 - DNA, 22 bp, Homo sapiens
gcactgggctccaggaaggagg

SEQ ID NO: 8208389 - DNA, 16 bp, Homo sapiens
gcactgggatgtcttc

SEQ ID NO: 8208390 - DNA, 22 bp, Homo sapiens
gcagaggactcaatcaaggtat

SEQ ID NO: 8208391 - DNA, 22 bp, Homo sapiens
gcagaggagatgaagatacttt

SEQ ID NO: 8208392 - DNA, 22 bp, Homo sapiens
gcagaggacagggatttagatt

SEQ ID NO: 8208393 - DNA, 22 bp, Homo sapiens
gcagaggactcaatcaaggtat

SEQ ID NO: 8208394 - DNA, 22 bp, Homo sapiens
gcagaggacacaggagggcaag

SEQ ID NO: 8208395 - DNA, 22 bp, Homo sapiens
gcagaggacagggatttagatt

SEQ ID NO: 8208396 - DNA, 22 bp, Homo sapiens
gcagaggagatgaagatacttt

SEQ ID NO: 8208397 - DNA, 22 bp, Homo sapiens
gcagaggagcaagctggacacc

SEQ ID NO: 8208398 - DNA, 22 bp, Homo sapiens
gcagaggagcaagctggacacc

SEQ ID NO: 8208399 - DNA, 22 bp, Homo sapiens
gcagaggagcaagctggacacc

SEQ ID NO: 8208400 - DNA, 22 bp, Homo sapiens
gcagaggagcaagctggacacc

SEQ ID NO: 8208401 - DNA, 23 bp, Homo sapiens
gcagaggagcaagctggacacca

SEQ ID NO: 8208402 - DNA, 22 bp, Homo sapiens
gcagagctctgttcttatctcc

SEQ ID NO: 8208403 - DNA, 22 bp, Homo sapiens
gcagagctctgttcttatctcc

SEQ ID NO: 8208404 - DNA, 22 bp, Homo sapiens
gcagagctgcagcgaggcctgg

SEQ ID NO: 8208405 - DNA, 22 bp, Homo sapiens
gcagagctgagcggctgcccgg

SEQ ID NO: 8208406 - DNA, 22 bp, Homo sapiens
gcagaggacacaggagggcaag

SEQ ID NO: 8208407 - DNA, 21 bp, Homo sapiens
gcagaggaatggtatacataa

SEQ ID NO: 8208408 - DNA, 21 bp, Homo sapiens
gcagaggaatggtatacataa

SEQ ID NO: 8208409 - DNA, 22 bp, Homo sapiens
gcagaggacacaggagggcaag

SEQ ID NO: 8208410 - DNA, 22 bp, Homo sapiens
gcagaggacacaggagggcaag

SEQ ID NO: 8208411 - DNA, 22 bp, Homo sapiens
gcaggaggagcattaactgagc

SEQ ID NO: 8208412 - DNA, 22 bp, Homo sapiens
gcaggaggatcacttgagccca

SEQ ID NO: 8208413 - DNA, 22 bp, Homo sapiens
gcaggaggagcattaactgagc

SEQ ID NO: 8208414 - DNA, 22 bp, Homo sapiens
gcaggaggatcacttgagccca

SEQ ID NO: 8208415 - DNA, 22 bp, Homo sapiens
gcaggaggccaggtatgcttta

SEQ ID NO: 8208416 - DNA, 22 bp, Homo sapiens
gcagctggccctgacacgcaga

SEQ ID NO: 8208417 - DNA, 22 bp, Homo sapiens
gcagctggcccctttccttgtt

SEQ ID NO: 8208418 - DNA, 22 bp, Homo sapiens
gcagctggcccctttccttgtt

SEQ ID NO: 8208419 - DNA, 22 bp, Homo sapiens
gcagctggatttcaagagggag

SEQ ID NO: 8208420 - DNA, 22 bp, Homo sapiens
gcaggagctggaaagtgatgtt

SEQ ID NO: 8208421 - DNA, 22 bp, Homo sapiens
gcaggagctggaaagtgatgtt

SEQ ID NO: 8208422 - DNA, 22 bp, Homo sapiens
gcagctggccctgacacgcaga

SEQ ID NO: 8208423 - DNA, 22 bp, Homo sapiens
gcaggagctgctctcctgacga

SEQ ID NO: 8208424 - DNA, 22 bp, Homo sapiens
gcagctggatttcaagagggag

SEQ ID NO: 8208425 - DNA, 22 bp, Homo sapiens
gcagctggagccagccagacac

SEQ ID NO: 8208426 - DNA, 22 bp, Homo sapiens
gcagctggagccagccagacac

SEQ ID NO: 8208427 - DNA, 22 bp, Homo sapiens
gcagctggagccagccagacac

SEQ ID NO: 8208428 - DNA, 22 bp, Homo sapiens
gcagctggagcatcttctcatc

SEQ ID NO: 8208429 - DNA, 22 bp, Homo sapiens
gcagctgcctattcagggcttg

SEQ ID NO: 8208430 - DNA, 22 bp, Homo sapiens
gcagctgcctaaagtgctaaga

SEQ ID NO: 8208431 - DNA, 22 bp, Homo sapiens
gcagctgcctattcagggcttg

SEQ ID NO: 8208432 - DNA, 22 bp, Homo sapiens
gcagctggacccacacggctta

SEQ ID NO: 8208433 - DNA, 22 bp, Homo sapiens
gcagctggacccacacggctta

SEQ ID NO: 8208434 - DNA, 22 bp, Homo sapiens
gcagctggacccacacggctta

SEQ ID NO: 8208435 - DNA, 22 bp, Homo sapiens
gcagctggagcatcttctcatc

SEQ ID NO: 8208436 - DNA, 22 bp, Homo sapiens
gcagctggagcatcttctcatc

SEQ ID NO: 8208437 - DNA, 22 bp, Homo sapiens
gcagctggagcatcttctcatc

SEQ ID NO: 8208438 - DNA, 22 bp, Homo sapiens
gcagctggagaaataccaccct

SEQ ID NO: 8208439 - DNA, 22 bp, Homo sapiens
gcagctggagcatcttctcatc

SEQ ID NO: 8208440 - DNA, 22 bp, Homo sapiens
gcagctggagaaataccaccct

SEQ ID NO: 8208441 - DNA, 22 bp, Homo sapiens
gcagctggagaaataccaccct

SEQ ID NO: 8208442 - DNA, 16 bp, Homo sapiens
gcaggagtaccacttg

SEQ ID NO: 8208443 - DNA, 22 bp, Homo sapiens
gcaggaggttgagccaggactg

SEQ ID NO: 8208444 - DNA, 22 bp, Homo sapiens
gcaggaggttgagccaggactg

SEQ ID NO: 8208445 - DNA, 22 bp, Homo sapiens
gcaggaggttgagccaggactg

SEQ ID NO: 8208446 - DNA, 22 bp, Homo sapiens
gcaggaggttgagccaggactg

SEQ ID NO: 8208447 - DNA, 22 bp, Homo sapiens
gcaggaggccaggtatgcttta

SEQ ID NO: 8208448 - DNA, 22 bp, Homo sapiens
gcaggaggccaggtatgcttta

SEQ ID NO: 8208449 - DNA, 22 bp, Homo sapiens
gcaggagtcccagaaggttttg

SEQ ID NO: 8208450 - DNA, 22 bp, Homo sapiens
gcaggagtcagccctaccttga

SEQ ID NO: 8208451 - DNA, 22 bp, Homo sapiens
gcaggagtcactgacttggtcc

SEQ ID NO: 8208452 - DNA, 22 bp, Homo sapiens
gcaggagtgacatggatgtgga

SEQ ID NO: 8208453 - DNA, 22 bp, Homo sapiens
gcaggagtgacatggatgtgga

SEQ ID NO: 8208454 - DNA, 22 bp, Homo sapiens
gcaggagtgacatggatgtgga

SEQ ID NO: 8208455 - DNA, 22 bp, Homo sapiens
gcaggagtcactgacttggtcc

SEQ ID NO: 8208456 - DNA, 22 bp, Homo sapiens
gcaggagtatgcagctatggtt

SEQ ID NO: 8208457 - DNA, 22 bp, Homo sapiens
gcaggagtatgcagctatggtt

SEQ ID NO: 8208458 - DNA, 22 bp, Homo sapiens
gcaggagtatctatacattaaa

SEQ ID NO: 8208459 - DNA, 22 bp, Homo sapiens
gcaggagtatgcagctatggtt

SEQ ID NO: 8208460 - DNA, 22 bp, Homo sapiens
gcaggagtatgcagctatggtt

SEQ ID NO: 8208461 - DNA, 22 bp, Homo sapiens
gcaggagtatctatacattaaa

SEQ ID NO: 8208462 - DNA, 22 bp, Homo sapiens
gcaggcctctgttgagggcctt

SEQ ID NO: 8208463 - DNA, 22 bp, Homo sapiens
gcaggcctctaattcaccgcag

SEQ ID NO: 8208464 - DNA, 22 bp, Homo sapiens
gcaggagttaggcgtcgtggat

SEQ ID NO: 8208465 - DNA, 22 bp, Homo sapiens
gcaggcctctgttgagggcctt

SEQ ID NO: 8208466 - DNA, 22 bp, Homo sapiens
gcaggcctctgttgagggcctt

SEQ ID NO: 8208467 - DNA, 19 bp, Homo sapiens
gcaggcctcttgggaatta

SEQ ID NO: 8208468 - DNA, 22 bp, Homo sapiens
gcaggagttaggcgtcgtggat

SEQ ID NO: 8208469 - DNA, 22 bp, Homo sapiens
gcaggagttaggcgtcgtggat

SEQ ID NO: 8208470 - DNA, 22 bp, Homo sapiens
gcaggagttagaggtttaatct

SEQ ID NO: 8208471 - DNA, 22 bp, Homo sapiens
gcaggagttaggcgtcgtggat

SEQ ID NO: 8208472 - DNA, 22 bp, Homo sapiens
gcaggagtgtgtctaatactca

SEQ ID NO: 8208473 - DNA, 22 bp, Homo sapiens
gcaggagttaaaatatgtaatg

SEQ ID NO: 8208474 - DNA, 22 bp, Homo sapiens
gcaggagttagaggtttaatct

SEQ ID NO: 8208475 - DNA, 22 bp, Homo sapiens
gcaggagttaaaatatgtaatg

SEQ ID NO: 8208476 - DNA, 22 bp, Homo sapiens
gcaggagtggagaccatgggga

SEQ ID NO: 8208477 - DNA, 22 bp, Homo sapiens
gcaggagtggagaccatgggga

SEQ ID NO: 8208478 - DNA, 22 bp, Homo sapiens
gcaggagtggagaccatgggga

SEQ ID NO: 8208479 - DNA, 22 bp, Homo sapiens
gcaggagtgacatggatgtgga

SEQ ID NO: 8208480 - DNA, 22 bp, Homo sapiens
gcaggagtgacatggatgtgga

SEQ ID NO: 8208481 - DNA, 22 bp, Homo sapiens
gcaggagtgacatggatgtgga

SEQ ID NO: 8208482 - DNA, 22 bp, Homo sapiens
gcaggagtgtatttgcatgtaa

SEQ ID NO: 8208483 - DNA, 22 bp, Homo sapiens
gcaggagtgtatttgcatgtaa

SEQ ID NO: 8208484 - DNA, 22 bp, Homo sapiens
gcaggagtgtggtgggacatcc

SEQ ID NO: 8208485 - DNA, 22 bp, Homo sapiens
gcaggagtgtggtgggacatcc

SEQ ID NO: 8208486 - DNA, 22 bp, Homo sapiens
gcaggagtgtggtgggacatcc

SEQ ID NO: 8208487 - DNA, 22 bp, Homo sapiens
gcaggagtgtatttgcatgtaa

SEQ ID NO: 8208488 - DNA, 22 bp, Homo sapiens
gcaggagtgtggtgggacatcc

SEQ ID NO: 8208489 - DNA, 22 bp, Homo sapiens
gcagggctagatatttgcaagt

SEQ ID NO: 8208490 - DNA, 22 bp, Homo sapiens
gcagggctagatatttgcaagt

SEQ ID NO: 8208491 - DNA, 22 bp, Homo sapiens
gcagggctaggtcttctagggc

SEQ ID NO: 8208492 - DNA, 22 bp, Homo sapiens
gcagggctaggtcttctagggc

SEQ ID NO: 8208493 - DNA, 22 bp, Homo sapiens
gcagggctaggtcttctagggc

SEQ ID NO: 8208494 - DNA, 22 bp, Homo sapiens
gcagggctattggaaggagatg

SEQ ID NO: 8208495 - DNA, 22 bp, Homo sapiens
gcagggctattggaaggagatg

SEQ ID NO: 8208496 - DNA, 22 bp, Homo sapiens
gcagggctattggaaggagatg

SEQ ID NO: 8208497 - DNA, 22 bp, Homo sapiens
gcagggctcaacaggacacccc

SEQ ID NO: 8208498 - DNA, 22 bp, Homo sapiens
gcagggctattggaaggagatg

SEQ ID NO: 8208499 - DNA, 22 bp, Homo sapiens
gcagggctattggaaggagatg

SEQ ID NO: 8208500 - DNA, 22 bp, Homo sapiens
gcagggctaatggggcaagtag

SEQ ID NO: 8208501 - DNA, 22 bp, Homo sapiens
gcagggctaatggggcaagtag

SEQ ID NO: 8208502 - DNA, 22 bp, Homo sapiens
gcagggctaatggggcaagtag

SEQ ID NO: 8208503 - DNA, 22 bp, Homo sapiens
gcagggctaatggggcaagtag

SEQ ID NO: 8208504 - DNA, 22 bp, Homo sapiens
gcagggctaatggggcaagtag

SEQ ID NO: 8208505 - DNA, 22 bp, Homo sapiens
gcagggcggcccagagcaggcc

SEQ ID NO: 8208506 - DNA, 22 bp, Homo sapiens
gcagggctaatggggcaagtag

SEQ ID NO: 8208507 - DNA, 22 bp, Homo sapiens
gcagggcgcgtttgagcgggct

SEQ ID NO: 8208508 - DNA, 22 bp, Homo sapiens
gcaggctgccaccttctgagtt

SEQ ID NO: 8208509 - DNA, 22 bp, Homo sapiens
gcaggctgccaccttctgagtt

SEQ ID NO: 8208510 - DNA, 22 bp, Homo sapiens
gcaggctgccaccttctgagtt

SEQ ID NO: 8208511 - DNA, 22 bp, Homo sapiens
gcaggctgccaccttctgagtt

SEQ ID NO: 8208512 - DNA, 22 bp, Homo sapiens
gcaggctgatgactggagttgg

SEQ ID NO: 8208513 - DNA, 22 bp, Homo sapiens
gcaggctgatgactggagttgg

SEQ ID NO: 8208514 - DNA, 22 bp, Homo sapiens
gcaggctgatgactggagttgg

SEQ ID NO: 8208515 - DNA, 22 bp, Homo sapiens
gcaggctgatagaggattccat

SEQ ID NO: 8208516 - DNA, 22 bp, Homo sapiens
gcaggctgatagaggattccat

SEQ ID NO: 8208517 - DNA, 22 bp, Homo sapiens
gcaggctgatagaggattccat

SEQ ID NO: 8208518 - DNA, 22 bp, Homo sapiens
gcaggctgatagaggattccat

SEQ ID NO: 8208519 - DNA, 22 bp, Homo sapiens
gcaggctgatgactggagttgg

SEQ ID NO: 8208520 - DNA, 22 bp, Homo sapiens
gcaggctatgtcagggccgctc

SEQ ID NO: 8208521 - DNA, 19 bp, Homo sapiens
gcaggcctcttgggaatta

SEQ ID NO: 8208522 - DNA, 22 bp, Homo sapiens
gcaggctcaaaagctggtagga

SEQ ID NO: 8208523 - DNA, 22 bp, Homo sapiens
gcaggctcaaaagctggtagga

SEQ ID NO: 8208524 - DNA, 22 bp, Homo sapiens
gcaggctcactctgtttggctc

SEQ ID NO: 8208525 - DNA, 22 bp, Homo sapiens
gcaggctcagagcagattagca

SEQ ID NO: 8208526 - DNA, 22 bp, Homo sapiens
gcaggctccaactggaggagtt

SEQ ID NO: 8208527 - DNA, 22 bp, Homo sapiens
gcaggctccaactggaggagtt

SEQ ID NO: 8208528 - DNA, 22 bp, Homo sapiens
gcaggctcccttgcagagcagg

SEQ ID NO: 8208529 - DNA, 22 bp, Homo sapiens
gcaggctcccttgcagagcagg

SEQ ID NO: 8208530 - DNA, 20 bp, Homo sapiens
gcaggctccgggcttgggag

SEQ ID NO: 8208531 - DNA, 22 bp, Homo sapiens
gcaggctccaaggcctgggaga

SEQ ID NO: 8208532 - DNA, 22 bp, Homo sapiens
gcaggctccaaggcctgggaga

SEQ ID NO: 8208533 - DNA, 22 bp, Homo sapiens
gcaggctccaggccggcccctt

SEQ ID NO: 8208534 - DNA, 22 bp, Homo sapiens
gcaggctgagagtccaagaagg

SEQ ID NO: 8208535 - DNA, 22 bp, Homo sapiens
gcaggctgaaactcggggtcta

SEQ ID NO: 8208536 - DNA, 22 bp, Homo sapiens
gcaggctgaaactcggggtcta

SEQ ID NO: 8208537 - DNA, 22 bp, Homo sapiens
gcaggctgaaactcggggtcta

SEQ ID NO: 8208538 - DNA, 22 bp, Homo sapiens
gcaggctgaaactcggggtcta

SEQ ID NO: 8208539 - DNA, 22 bp, Homo sapiens
gcaggctcttctttctgcccag

SEQ ID NO: 8208540 - DNA, 22 bp, Homo sapiens
gcaggctcgttggaagtcccct

SEQ ID NO: 8208541 - DNA, 22 bp, Homo sapiens
gcaggctgagagtccaagaagg

SEQ ID NO: 8208542 - DNA, 22 bp, Homo sapiens
gcaggctgagtattaccctagt

SEQ ID NO: 8208543 - DNA, 22 bp, Homo sapiens
gcaggctgatagaggattccat

SEQ ID NO: 8208544 - DNA, 22 bp, Homo sapiens
gcaggctgagttgggaaaccaa

SEQ ID NO: 8208545 - DNA, 22 bp, Homo sapiens
gcaggctgagttgggaaaccaa

SEQ ID NO: 8208546 - DNA, 22 bp, Homo sapiens
gcaggctgagttgggaaaccaa

SEQ ID NO: 8208547 - DNA, 22 bp, Homo sapiens
gcaggctgagtattaccctagt

SEQ ID NO: 8208548 - DNA, 22 bp, Homo sapiens
gcagaggaggacccaggaatta

SEQ ID NO: 8208549 - DNA, 22 bp, Homo sapiens
gcagaggaggacccaggaatta

SEQ ID NO: 8208550 - DNA, 22 bp, Homo sapiens
gcagaggagcaagttgctacag

SEQ ID NO: 8208551 - DNA, 22 bp, Homo sapiens
gcagaggagcaagttgctacag

SEQ ID NO: 8208552 - DNA, 22 bp, Homo sapiens
gcagaggagcaagttgctacag

SEQ ID NO: 8208553 - DNA, 23 bp, Homo sapiens
gcagaggagcaagctggacacca

SEQ ID NO: 8208554 - DNA, 23 bp, Homo sapiens
gcagaggagcaagctggacacca

SEQ ID NO: 8208555 - DNA, 22 bp, Homo sapiens
gcagaggaggacccaggaatta

SEQ ID NO: 8208556 - DNA, 22 bp, Homo sapiens
gcagcagccgacatggattgca

SEQ ID NO: 8208557 - DNA, 22 bp, Homo sapiens
gcagaggaggacccaggaatta

SEQ ID NO: 8208558 - DNA, 22 bp, Homo sapiens
gcagaggaggacccaggaatta

SEQ ID NO: 8208559 - DNA, 22 bp, Homo sapiens
gcagaggaggacccaggaatta

SEQ ID NO: 8208560 - DNA, 22 bp, Homo sapiens
gcagaggaggacccaggaatta

SEQ ID NO: 8208561 - DNA, 22 bp, Homo sapiens
gcagcagcggggcccctgcgcg

SEQ ID NO: 8208562 - DNA, 22 bp, Homo sapiens
gcagcagcggggcccctgcgcg

SEQ ID NO: 8208563 - DNA, 22 bp, Homo sapiens
gcagcagcggggcccctgcgcg

SEQ ID NO: 8208564 - DNA, 22 bp, Homo sapiens
gcagcagctcagccgggcactg

SEQ ID NO: 8208565 - DNA, 22 bp, Homo sapiens
gcagcagctcagttctgggagg

SEQ ID NO: 8208566 - DNA, 22 bp, Homo sapiens
gcagcagctcagccgggcactg

SEQ ID NO: 8208567 - DNA, 22 bp, Homo sapiens
gcagcagctccctatccaggct

SEQ ID NO: 8208568 - DNA, 22 bp, Homo sapiens
gcagcagctccctatccaggct

SEQ ID NO: 8208569 - DNA, 22 bp, Homo sapiens
gcagcagctccctatccaggct

SEQ ID NO: 8208570 - DNA, 22 bp, Homo sapiens
gcagcagctccctatccaggct

SEQ ID NO: 8208571 - DNA, 22 bp, Homo sapiens
gcagcagctctgaatgggcccc

SEQ ID NO: 8208572 - DNA, 22 bp, Homo sapiens
gcagcagctgacagtgggtgcc

SEQ ID NO: 8208573 - DNA, 22 bp, Homo sapiens
gcagcagctctgaatgggcccc

SEQ ID NO: 8208574 - DNA, 22 bp, Homo sapiens
gcagcagctctcaaagtggtct

SEQ ID NO: 8208575 - DNA, 22 bp, Homo sapiens
gcagcagctctcaaagtggtct

SEQ ID NO: 8208576 - DNA, 22 bp, Homo sapiens
gcagcagctctgaatgggcccc

SEQ ID NO: 8208577 - DNA, 22 bp, Homo sapiens
gcagcaggtctgtcaatgtcat

SEQ ID NO: 8208578 - DNA, 22 bp, Homo sapiens
gcagcaggtctgtcaatgtcat

SEQ ID NO: 8208579 - DNA, 22 bp, Homo sapiens
gcagcaggcacttaccgttgct

SEQ ID NO: 8208580 - DNA, 22 bp, Homo sapiens
gcagcaggtctgtcaatgtcat

SEQ ID NO: 8208581 - DNA, 22 bp, Homo sapiens
gcagcaggtctgtcaatgtcat

SEQ ID NO: 8208582 - DNA, 22 bp, Homo sapiens
gcagcaggcacttaccgttgct

SEQ ID NO: 8208583 - DNA, 22 bp, Homo sapiens
gcagcaggcacggtctcgacat

SEQ ID NO: 8208584 - DNA, 22 bp, Homo sapiens
gcagcaggcacttaccgttgct

SEQ ID NO: 8208585 - DNA, 22 bp, Homo sapiens
gcagcaggatggccaattgcca

SEQ ID NO: 8208586 - DNA, 22 bp, Homo sapiens
gcagcaggagagtttgtcctgc

SEQ ID NO: 8208587 - DNA, 22 bp, Homo sapiens
gcagcaggatggccaattgcca

SEQ ID NO: 8208588 - DNA, 22 bp, Homo sapiens
gcagcaggatggccaattgcca

SEQ ID NO: 8208589 - DNA, 22 bp, Homo sapiens
gcagcaggcacggtctcgacat

SEQ ID NO: 8208590 - DNA, 22 bp, Homo sapiens
gcagcaggcacggtctcgacat

SEQ ID NO: 8208591 - DNA, 22 bp, Homo sapiens
gcagcaggcacggtctcgacat

SEQ ID NO: 8208592 - DNA, 22 bp, Homo sapiens
gcagcaggcacggtctcgacat

SEQ ID NO: 8208593 - DNA, 22 bp, Homo sapiens
gcagcaggaataggataagcaa

SEQ ID NO: 8208594 - DNA, 22 bp, Homo sapiens
gcagcaggaatttaaatttata

SEQ ID NO: 8208595 - DNA, 22 bp, Homo sapiens
gcagcaggaatttaaatttata

SEQ ID NO: 8208596 - DNA, 22 bp, Homo sapiens
gcagcaggaataggataagcaa

SEQ ID NO: 8208597 - DNA, 22 bp, Homo sapiens
gcagcaggaataggataagcaa

SEQ ID NO: 8208598 - DNA, 22 bp, Homo sapiens
gcagcaggagagtaatagcggt

SEQ ID NO: 8208599 - DNA, 22 bp, Homo sapiens
gcagcaggagagtttgtcctgc

SEQ ID NO: 8208600 - DNA, 22 bp, Homo sapiens
gcagcaggagagtttgtcctgc

SEQ ID NO: 8208601 - DNA, 22 bp, Homo sapiens
gcagcaggagagtttgtcctgc

SEQ ID NO: 8208602 - DNA, 22 bp, Homo sapiens
gcagcaggagagtttgtcctgc

SEQ ID NO: 8208603 - DNA, 22 bp, Homo sapiens
gcagcaggagagtaatagcggt

SEQ ID NO: 8208604 - DNA, 22 bp, Homo sapiens
gcagcaggactgccgttaaagt

SEQ ID NO: 8208605 - DNA, 22 bp, Homo sapiens
gcagcaggactgccgttaaagt

SEQ ID NO: 8208606 - DNA, 22 bp, Homo sapiens
gcagctgcaggtggtcccatgc

SEQ ID NO: 8208607 - DNA, 22 bp, Homo sapiens
gcagctgcaggtggtcccatgc

SEQ ID NO: 8208608 - DNA, 22 bp, Homo sapiens
gcagctgcaggcaggcttgctg

SEQ ID NO: 8208609 - DNA, 22 bp, Homo sapiens
gcagctgcaggcaggcttgctg

SEQ ID NO: 8208610 - DNA, 18 bp, Homo sapiens
gcagctgcagttgtagct

SEQ ID NO: 8208611 - DNA, 22 bp, Homo sapiens
gcagctgccagtccccttccag

SEQ ID NO: 8208612 - DNA, 22 bp, Homo sapiens
gcagctgccagtccccttccag

SEQ ID NO: 8208613 - DNA, 20 bp, Homo sapiens
gcagctgcccccagtccctg

SEQ ID NO: 8208614 - DNA, 20 bp, Homo sapiens
gcagctgcccccagtccctg

SEQ ID NO: 8208615 - DNA, 22 bp, Homo sapiens
gcagctgccgtgagctcacgcc

SEQ ID NO: 8208616 - DNA, 22 bp, Homo sapiens
gcagctgccgtgagctcacgcc

SEQ ID NO: 8208617 - DNA, 22 bp, Homo sapiens
gcagctgccgtgagctcacgcc

SEQ ID NO: 8208618 - DNA, 22 bp, Homo sapiens
gcagctgccccgactgtgagtc

SEQ ID NO: 8208619 - DNA, 22 bp, Homo sapiens
gcagctgccccgactgtgagtc

SEQ ID NO: 8208620 - DNA, 20 bp, Homo sapiens
gcagctgcccccagtccctg

SEQ ID NO: 8208621 - DNA, 22 bp, Homo sapiens
gcagccacagaggagggatgca

SEQ ID NO: 8208622 - DNA, 22 bp, Homo sapiens
gcagctgatggaagtcctattg

SEQ ID NO: 8208623 - DNA, 22 bp, Homo sapiens
gcagctgcaagcacttctggca

SEQ ID NO: 8208624 - DNA, 22 bp, Homo sapiens
gcagctgcaagcacttctggca

SEQ ID NO: 8208625 - DNA, 23 bp, Homo sapiens
gcagccaagagaccagggcaggc

SEQ ID NO: 8208626 - DNA, 22 bp, Homo sapiens
gcagctgcaataggcatcaagc

SEQ ID NO: 8208627 - DNA, 22 bp, Homo sapiens
gcagctgcagaccctcagtgct

SEQ ID NO: 8208628 - DNA, 22 bp, Homo sapiens
gcagctgcacttctacctaatt

SEQ ID NO: 8208629 - DNA, 22 bp, Homo sapiens
gcagctgcagagaccgggtggg

SEQ ID NO: 8208630 - DNA, 22 bp, Homo sapiens
gcagctgcagaccctcagtgct

SEQ ID NO: 8208631 - DNA, 22 bp, Homo sapiens
gcagcatgttgaaagggccaca

SEQ ID NO: 8208632 - DNA, 22 bp, Homo sapiens
gcagcatgtgccttaaatcatt

SEQ ID NO: 8208633 - DNA, 22 bp, Homo sapiens
gcagcatgttgaaagggccaca

SEQ ID NO: 8208634 - DNA, 22 bp, Homo sapiens
gcagcatgttgaaagggccaca

SEQ ID NO: 8208635 - DNA, 22 bp, Homo sapiens
gcagcattaccaagacatggca

SEQ ID NO: 8208636 - DNA, 22 bp, Homo sapiens
gcagcatggagttgtggaatga

SEQ ID NO: 8208637 - DNA, 22 bp, Homo sapiens
gcagcatggagttgtggaatga

SEQ ID NO: 8208638 - DNA, 22 bp, Homo sapiens
gcagcatggagttgtggaatga

SEQ ID NO: 8208639 - DNA, 22 bp, Homo sapiens
gcagcatgagctatacaaagta

SEQ ID NO: 8208640 - DNA, 22 bp, Homo sapiens
gcagcatctagggcactggcct

SEQ ID NO: 8208641 - DNA, 22 bp, Homo sapiens
gcagcagtggctgcaggtccca

SEQ ID NO: 8208642 - DNA, 22 bp, Homo sapiens
gcagcagtggctgcaggtccca

SEQ ID NO: 8208643 - DNA, 22 bp, Homo sapiens
gcagcagtgtctcccatcttgc

SEQ ID NO: 8208644 - DNA, 22 bp, Homo sapiens
gcagcagtggttttatcatttt

SEQ ID NO: 8208645 - DNA, 22 bp, Homo sapiens
gcagcagtgcgggcagctacag

SEQ ID NO: 8208646 - DNA, 22 bp, Homo sapiens
gcagcagtgcgggcagctacag

SEQ ID NO: 8208647 - DNA, 20 bp, Homo sapiens
gcagcagtgcaagtcctctt

SEQ ID NO: 8208648 - DNA, 22 bp, Homo sapiens
gcagcaggtgtgcttttaatga

SEQ ID NO: 8208649 - DNA, 22 bp, Homo sapiens
gcagcaggtgtgcttttaatga

SEQ ID NO: 8208650 - DNA, 22 bp, Homo sapiens
gcccacagtacgaggctcaggc

SEQ ID NO: 8208651 - DNA, 22 bp, Homo sapiens
gcccacagtacgaggctcaggc

SEQ ID NO: 8208652 - DNA, 22 bp, Homo sapiens
gcccacagtacgaggctcaggc

SEQ ID NO: 8208653 - DNA, 22 bp, Homo sapiens
gcccacagtacgaggctcaggc

SEQ ID NO: 8208654 - DNA, 22 bp, Homo sapiens
gccagtggcttgccaggcagga

SEQ ID NO: 8208655 - DNA, 22 bp, Homo sapiens
gccagtggcttgccaggcagga

SEQ ID NO: 8208656 - DNA, 22 bp, Homo sapiens
gcccacaggggacctggtggct

SEQ ID NO: 8208657 - DNA, 22 bp, Homo sapiens
gcccacagtacgaggctcaggc

SEQ ID NO: 8208658 - DNA, 22 bp, Homo sapiens
gccagtggccctctggagaagg

SEQ ID NO: 8208659 - DNA, 22 bp, Homo sapiens
gccagtggcttgccaggcagga

SEQ ID NO: 8208660 - DNA, 22 bp, Homo sapiens
gccagtggccctctggagaagg

SEQ ID NO: 8208661 - DNA, 22 bp, Homo sapiens
gccagtggccctctggagaagg

SEQ ID NO: 8208662 - DNA, 22 bp, Homo sapiens
gccagtggcatgcggcagggac

SEQ ID NO: 8208663 - DNA, 22 bp, Homo sapiens
gccagtggcatgcggcagggac

SEQ ID NO: 8208664 - DNA, 22 bp, Homo sapiens
gccagtggcatgcggcagggac

SEQ ID NO: 8208665 - DNA, 22 bp, Homo sapiens
gccagtggcatgcggcagggac

SEQ ID NO: 8208666 - DNA, 22 bp, Homo sapiens
gccagtggaggacccatggaga

SEQ ID NO: 8208667 - DNA, 22 bp, Homo sapiens
gccagtggatgaggacttaact

SEQ ID NO: 8208668 - DNA, 22 bp, Homo sapiens
gccagtggaggacccatggaga

SEQ ID NO: 8208669 - DNA, 22 bp, Homo sapiens
gccagtggaggacccatggaga

SEQ ID NO: 8208670 - DNA, 22 bp, Homo sapiens
gccagtctgctcccacaagttc

SEQ ID NO: 8208671 - DNA, 22 bp, Homo sapiens
gccagtcagctggccaggctgg

SEQ ID NO: 8208672 - DNA, 22 bp, Homo sapiens
gccagtcagctggccaggctgg

SEQ ID NO: 8208673 - DNA, 22 bp, Homo sapiens
gccagtctccctcagtcctctg

SEQ ID NO: 8208674 - DNA, 22 bp, Homo sapiens
gccaggttgctgacgacgatct

SEQ ID NO: 8208675 - DNA, 22 bp, Homo sapiens
gccaggttgctgacgacgatct

SEQ ID NO: 8208676 - DNA, 22 bp, Homo sapiens
gccaggttctggggaggtacaa

SEQ ID NO: 8208677 - DNA, 22 bp, Homo sapiens
gccaggttgctgacgacgatct

SEQ ID NO: 8208678 - DNA, 22 bp, Homo sapiens
gccaggttgctgacgacgatct

SEQ ID NO: 8208679 - DNA, 22 bp, Homo sapiens
gccagtaaaacaaaggccatgt

SEQ ID NO: 8208680 - DNA, 22 bp, Homo sapiens
gccaggttgctgacgacgatct

SEQ ID NO: 8208681 - DNA, 22 bp, Homo sapiens
gccagtgcttgtggagctggca

SEQ ID NO: 8208682 - DNA, 22 bp, Homo sapiens
gccagtggagcacatggtgaag

SEQ ID NO: 8208683 - DNA, 22 bp, Homo sapiens
gccagtggagcacatggtgaag

SEQ ID NO: 8208684 - DNA, 22 bp, Homo sapiens
gccagtggagactgaaacccat

SEQ ID NO: 8208685 - DNA, 22 bp, Homo sapiens
gccagtggagactgaaacccat

SEQ ID NO: 8208686 - DNA, 22 bp, Homo sapiens
gccagtgcctgctgctcagggc

SEQ ID NO: 8208687 - DNA, 22 bp, Homo sapiens
gccagtgcctgctgctcagggc

SEQ ID NO: 8208688 - DNA, 18 bp, Homo sapiens
gccagtgccctggctcac

SEQ ID NO: 8208689 - DNA, 18 bp, Homo sapiens
gccagtgccctggctcac

SEQ ID NO: 8208690 - DNA, 18 bp, Homo sapiens
gcccagaggtctgggccc

SEQ ID NO: 8208691 - DNA, 18 bp, Homo sapiens
gcccagaggtctgggccc

SEQ ID NO: 8208692 - DNA, 22 bp, Homo sapiens
gcccagagtgagtcctgggccc

SEQ ID NO: 8208693 - DNA, 22 bp, Homo sapiens
gcccagagtgagtcctgggccc

SEQ ID NO: 8208694 - DNA, 22 bp, Homo sapiens
gcccagagtgagtcctgggccc

SEQ ID NO: 8208695 - DNA, 22 bp, Homo sapiens
gcccagagtgagtcctgggccc

SEQ ID NO: 8208696 - DNA, 22 bp, Homo sapiens
gcccagagggaagaggtgtcat

SEQ ID NO: 8208697 - DNA, 18 bp, Homo sapiens
gcccagaggtctgggccc

SEQ ID NO: 8208698 - DNA, 23 bp, Homo sapiens
gcccagagaggctcaccaggaat

SEQ ID NO: 8208699 - DNA, 22 bp, Homo sapiens
gcccagagggaagaggtgtcat

SEQ ID NO: 8208700 - DNA, 22 bp, Homo sapiens
gcccactggctggagtgctggt

SEQ ID NO: 8208701 - DNA, 22 bp, Homo sapiens
gcccactgagtgactccctcag

SEQ ID NO: 8208702 - DNA, 22 bp, Homo sapiens
gcccagagagatgaagtgatgg

SEQ ID NO: 8208703 - DNA, 22 bp, Homo sapiens
gcccagagagatgaagtgatgg

SEQ ID NO: 8208704 - DNA, 22 bp, Homo sapiens
gcccagaagttgaggctgcagt

SEQ ID NO: 8208705 - DNA, 21 bp, Homo sapiens
gcccagaagactggctctgcc

SEQ ID NO: 8208706 - DNA, 22 bp, Homo sapiens
gccaggacggtgaatgggctac

SEQ ID NO: 8208707 - DNA, 22 bp, Homo sapiens
gccaggactgagaatgggagca

SEQ ID NO: 8208708 - DNA, 22 bp, Homo sapiens
gccaggagaaaaggcgaatgat

SEQ ID NO: 8208709 - DNA, 22 bp, Homo sapiens
gccaggagaaaaggcgaatgat

SEQ ID NO: 8208710 - DNA, 22 bp, Homo sapiens
gccaggagaaaaggcgaatgat

SEQ ID NO: 8208711 - DNA, 22 bp, Homo sapiens
gccaggaatggagaggtggcct

SEQ ID NO: 8208712 - DNA, 19 bp, Homo sapiens
gccaggacatcctcctgct

SEQ ID NO: 8208713 - DNA, 21 bp, Homo sapiens
gccaggaccagcagaccactt

SEQ ID NO: 8208714 - DNA, 22 bp, Homo sapiens
gccaggacctcagatgcagggc

SEQ ID NO: 8208715 - DNA, 22 bp, Homo sapiens
gccaggacctcagatgcagggc

SEQ ID NO: 8208716 - DNA, 22 bp, Homo sapiens
gccaggagtgtgtggctatgtt

SEQ ID NO: 8208717 - DNA, 22 bp, Homo sapiens
gccaggaggctgctgtgtaggc

SEQ ID NO: 8208718 - DNA, 22 bp, Homo sapiens
gccaggaggctgctgtgtaggc

SEQ ID NO: 8208719 - DNA, 22 bp, Homo sapiens
gccaggagccctgggcaagttc

SEQ ID NO: 8208720 - DNA, 22 bp, Homo sapiens
gccaggagccctgggcaagttc

SEQ ID NO: 8208721 - DNA, 22 bp, Homo sapiens
gccaggagccctgggcaagttc

SEQ ID NO: 8208722 - DNA, 22 bp, Homo sapiens
gccaggagccctgggcaagttc

SEQ ID NO: 8208723 - DNA, 22 bp, Homo sapiens
gccaggagccagcttcttagca

SEQ ID NO: 8208724 - DNA, 22 bp, Homo sapiens
gccaggagaatgctagcagagg

SEQ ID NO: 8208725 - DNA, 22 bp, Homo sapiens
gccaggagaatgctagcagagg

SEQ ID NO: 8208726 - DNA, 22 bp, Homo sapiens
gccaggagagctccttcaggtt

SEQ ID NO: 8208727 - DNA, 22 bp, Homo sapiens
gccaggagagctccttcaggtt

SEQ ID NO: 8208728 - DNA, 22 bp, Homo sapiens
gccaggagagctccttcaggtt

SEQ ID NO: 8208729 - DNA, 22 bp, Homo sapiens
gccaggtctaagcatcagccac

SEQ ID NO: 8208730 - DNA, 22 bp, Homo sapiens
gccaggtcgtctccatgtccaa

SEQ ID NO: 8208731 - DNA, 22 bp, Homo sapiens
gccaggtctgcaggcatcctga

SEQ ID NO: 8208732 - DNA, 18 bp, Homo sapiens
gccaggtctctctgcttc

SEQ ID NO: 8208733 - DNA, 22 bp, Homo sapiens
gccaggtctcataaatgcagct

SEQ ID NO: 8208734 - DNA, 22 bp, Homo sapiens
gccaggtctcataaatgcagct

SEQ ID NO: 8208735 - DNA, 22 bp, Homo sapiens
gccaggtgggagacagacagca

SEQ ID NO: 8208736 - DNA, 22 bp, Homo sapiens
gccaggtgggagacagacagca

SEQ ID NO: 8208737 - DNA, 22 bp, Homo sapiens
gccaggtgggagacagacagca

SEQ ID NO: 8208738 - DNA, 22 bp, Homo sapiens
gccaggtggctgagtgactgag

SEQ ID NO: 8208739 - DNA, 22 bp, Homo sapiens
gccaggtctgggtagcagagga

SEQ ID NO: 8208740 - DNA, 22 bp, Homo sapiens
gccaggtctgggtagcagagga

SEQ ID NO: 8208741 - DNA, 22 bp, Homo sapiens
gccaggtgtagtggccacacct

SEQ ID NO: 8208742 - DNA, 22 bp, Homo sapiens
gccaggtggtctggctccagag

SEQ ID NO: 8208743 - DNA, 22 bp, Homo sapiens
gccaggtggtctggctccagag

SEQ ID NO: 8208744 - DNA, 22 bp, Homo sapiens
gccaggtggtctggctccagag

SEQ ID NO: 8208745 - DNA, 22 bp, Homo sapiens
gccaggtggtctggctccagag

SEQ ID NO: 8208746 - DNA, 22 bp, Homo sapiens
gccaggtggtctggctccagag

SEQ ID NO: 8208747 - DNA, 22 bp, Homo sapiens
gccaggtggctgagtgactgag

SEQ ID NO: 8208748 - DNA, 22 bp, Homo sapiens
gccaggtgtcctcacagtgagg

SEQ ID NO: 8208749 - DNA, 22 bp, Homo sapiens
gccaggtgtcctcacagtgagg

SEQ ID NO: 8208750 - DNA, 22 bp, Homo sapiens
gccaggtgtagtggccacacct

SEQ ID NO: 8208751 - DNA, 22 bp, Homo sapiens
gccaggcacagttctaggtgct

SEQ ID NO: 8208752 - DNA, 22 bp, Homo sapiens
gccaggcacagttctaggtgct

SEQ ID NO: 8208753 - DNA, 22 bp, Homo sapiens
gccaggcacagttctaggtgct

SEQ ID NO: 8208754 - DNA, 22 bp, Homo sapiens
gccaggcaatgtgttagaagcg

SEQ ID NO: 8208755 - DNA, 23 bp, Homo sapiens
gccaggcacatggtggacacgca

SEQ ID NO: 8208756 - DNA, 23 bp, Homo sapiens
gccaggcacatggtggacacgca

SEQ ID NO: 8208757 - DNA, 23 bp, Homo sapiens
gccaggcacatggtggacacgca

SEQ ID NO: 8208758 - DNA, 22 bp, Homo sapiens
gccaggtcccctcatggctcct

SEQ ID NO: 8208759 - DNA, 22 bp, Homo sapiens
gccaggtccagggtggagcgct

SEQ ID NO: 8208760 - DNA, 22 bp, Homo sapiens
gccaggcaaattaaggaatgca

SEQ ID NO: 8208761 - DNA, 22 bp, Homo sapiens
gccaggcaaattaaggaatgca

SEQ ID NO: 8208762 - DNA, 22 bp, Homo sapiens
gccaggcaatgtgttagaagcg

SEQ ID NO: 8208763 - DNA, 22 bp, Homo sapiens
gccaggcaaattaaggaatgca

SEQ ID NO: 8208764 - DNA, 22 bp, Homo sapiens
gccaggagttcagatgcatgtt

SEQ ID NO: 8208765 - DNA, 22 bp, Homo sapiens
gccaggagttcagatgcatgtt

SEQ ID NO: 8208766 - DNA, 22 bp, Homo sapiens
gccaggagttcagatgcatgtt

SEQ ID NO: 8208767 - DNA, 22 bp, Homo sapiens
gccaggagttcagatgcatgtt

SEQ ID NO: 8208768 - DNA, 22 bp, Homo sapiens
gccaggagttcagatgcatgtt

SEQ ID NO: 8208769 - DNA, 22 bp, Homo sapiens
gccctgagaatgtgtgtgtcta

SEQ ID NO: 8208770 - DNA, 22 bp, Homo sapiens
gccctgagaatgtgtgtgtcta

SEQ ID NO: 8208771 - DNA, 22 bp, Homo sapiens
gccctgagactgagcatgggtt

SEQ ID NO: 8208772 - DNA, 22 bp, Homo sapiens
gccctgaaggcagaggtggagc

SEQ ID NO: 8208773 - DNA, 22 bp, Homo sapiens
gccctgagcactgctgctgggg

SEQ ID NO: 8208774 - DNA, 22 bp, Homo sapiens
gccctgagaggcaatgactctt

SEQ ID NO: 8208775 - DNA, 22 bp, Homo sapiens
gccctgagcctatgagcctctc

SEQ ID NO: 8208776 - DNA, 22 bp, Homo sapiens
gccctgagcctatgagcctctc

SEQ ID NO: 8208777 - DNA, 22 bp, Homo sapiens
gccctgaggatttgcatttcct

SEQ ID NO: 8208778 - DNA, 22 bp, Homo sapiens
gccctgaggcaaaagaacagtc

SEQ ID NO: 8208779 - DNA, 22 bp, Homo sapiens
gccctgaggatttgcatttcct

SEQ ID NO: 8208780 - DNA, 22 bp, Homo sapiens
gcctcagccggcggacgccagg

SEQ ID NO: 8208781 - DNA, 20 bp, Homo sapiens
gcctcagagggtttgagttt

SEQ ID NO: 8208782 - DNA, 22 bp, Homo sapiens
gcctcagagggccctagggaca

SEQ ID NO: 8208783 - DNA, 22 bp, Homo sapiens
gcctcagagggccctagggaca

SEQ ID NO: 8208784 - DNA, 22 bp, Homo sapiens
gcctcagagggccctagggaca

SEQ ID NO: 8208785 - DNA, 22 bp, Homo sapiens
gcctcaggccgccctgctgctc

SEQ ID NO: 8208786 - DNA, 22 bp, Homo sapiens
gcctcagctgttgcaggggccc

SEQ ID NO: 8208787 - DNA, 22 bp, Homo sapiens
gcctcagctcccagcccaggct

SEQ ID NO: 8208788 - DNA, 17 bp, Homo sapiens
gcctactcctatactcc

SEQ ID NO: 8208789 - DNA, 22 bp, Homo sapiens
gcctacagttggctgagggcct

SEQ ID NO: 8208790 - DNA, 22 bp, Homo sapiens
gcctagcattgatcagcctgct

SEQ ID NO: 8208791 - DNA, 22 bp, Homo sapiens
gcctcagaaagcttttattcat

SEQ ID NO: 8208792 - DNA, 22 bp, Homo sapiens
gcctcagaaagtggcaggtagg

SEQ ID NO: 8208793 - DNA, 22 bp, Homo sapiens
gcctcagaaagtggcaggtagg

SEQ ID NO: 8208794 - DNA, 22 bp, Homo sapiens
gcctcagaatcatttatcatct

SEQ ID NO: 8208795 - DNA, 22 bp, Homo sapiens
gcctcagacactgcctgggtgt

SEQ ID NO: 8208796 - DNA, 23 bp, Homo sapiens
gcctcagagaaacagctgcacac

SEQ ID NO: 8208797 - DNA, 22 bp, Homo sapiens
gcctcagagctacacacacgca

SEQ ID NO: 8208798 - DNA, 22 bp, Homo sapiens
gcctcagagctacacacacgca

SEQ ID NO: 8208799 - DNA, 22 bp, Homo sapiens
gcctcagagggcagggtggtga

SEQ ID NO: 8208800 - DNA, 19 bp, Homo sapiens
gccctgagtaagctaggag

SEQ ID NO: 8208801 - DNA, 22 bp, Homo sapiens
gccctgaggggtggtgtctgta

SEQ ID NO: 8208802 - DNA, 22 bp, Homo sapiens
gccctgaggggtggtgtctgta

SEQ ID NO: 8208803 - DNA, 22 bp, Homo sapiens
gcccaggctggagtgcagtggt

SEQ ID NO: 8208804 - DNA, 22 bp, Homo sapiens
gcccaggctggagtgcagtggt

SEQ ID NO: 8208805 - DNA, 22 bp, Homo sapiens
gcccaggctggagtgcagtggt

SEQ ID NO: 8208806 - DNA, 22 bp, Homo sapiens
gcccaggctggagtgcagtggt

SEQ ID NO: 8208807 - DNA, 22 bp, Homo sapiens
gcccaggctggagtgcagtggt

SEQ ID NO: 8208808 - DNA, 22 bp, Homo sapiens
gcccaggctggagtgcagtggt

SEQ ID NO: 8208809 - DNA, 22 bp, Homo sapiens
gcccaggctggagtgcagtggt

SEQ ID NO: 8208810 - DNA, 22 bp, Homo sapiens
gcccagcaaggaccaagggccg

SEQ ID NO: 8208811 - DNA, 22 bp, Homo sapiens
gcccagcaaggaccaagggccg

SEQ ID NO: 8208812 - DNA, 22 bp, Homo sapiens
gcccagcaactgcacccttctt

SEQ ID NO: 8208813 - DNA, 22 bp, Homo sapiens
gcccagagttcaaggctgcagt

SEQ ID NO: 8208814 - DNA, 22 bp, Homo sapiens
gcccagagttcaaggctgcagt

SEQ ID NO: 8208815 - DNA, 22 bp, Homo sapiens
gcccagagttcaaggctgcagt

SEQ ID NO: 8208816 - DNA, 22 bp, Homo sapiens
gcccagagttcaaggctgcagt

SEQ ID NO: 8208817 - DNA, 22 bp, Homo sapiens
gcccagagttcaaggctgcagt

SEQ ID NO: 8208818 - DNA, 21 bp, Homo sapiens
gcccagagttaagcccaccca

SEQ ID NO: 8208819 - DNA, 22 bp, Homo sapiens
gcccagagtggccacttggctc

SEQ ID NO: 8208820 - DNA, 22 bp, Homo sapiens
gcccagagtggccacttggctc

SEQ ID NO: 8208821 - DNA, 22 bp, Homo sapiens
gcccagggctgcaagtggacgc

SEQ ID NO: 8208822 - DNA, 22 bp, Homo sapiens
gcccagggctgcaagtggacgc

SEQ ID NO: 8208823 - DNA, 22 bp, Homo sapiens
gcccagggcgatggtcggggcc

SEQ ID NO: 8208824 - DNA, 22 bp, Homo sapiens
gcccagggcgatggtcggggcc

SEQ ID NO: 8208825 - DNA, 22 bp, Homo sapiens
gcccagggcagggcaagagtga

SEQ ID NO: 8208826 - DNA, 22 bp, Homo sapiens
gcccagggcagggcaagagtga

SEQ ID NO: 8208827 - DNA, 23 bp, Homo sapiens
gcccagggactgggaatcagtgg

SEQ ID NO: 8208828 - DNA, 22 bp, Homo sapiens
gcccaggctggagttcagtggt

SEQ ID NO: 8208829 - DNA, 22 bp, Homo sapiens
gcccaggctggagttcagtggt

SEQ ID NO: 8208830 - DNA, 23 bp, Homo sapiens
gcccagggactgggaatcagtgg

SEQ ID NO: 8208831 - DNA, 22 bp, Homo sapiens
gcccatggaaaacctgtcctct

SEQ ID NO: 8208832 - DNA, 22 bp, Homo sapiens
gcccatggacacccaagtgcca

SEQ ID NO: 8208833 - DNA, 22 bp, Homo sapiens
gcccatggacacccaagtgcca

SEQ ID NO: 8208834 - DNA, 22 bp, Homo sapiens
gcccatgcccctccttctggca

SEQ ID NO: 8208835 - DNA, 22 bp, Homo sapiens
gcccatgcactttctgtgatgg

SEQ ID NO: 8208836 - DNA, 22 bp, Homo sapiens
gcccatgaggtggaggctgcag

SEQ ID NO: 8208837 - DNA, 20 bp, Homo sapiens
gcccatgaggactgcagctg

SEQ ID NO: 8208838 - DNA, 22 bp, Homo sapiens
gccctctggtgggtgagccccg

SEQ ID NO: 8208839 - DNA, 22 bp, Homo sapiens
gccctctggggcacacagagga

SEQ ID NO: 8208840 - DNA, 18 bp, Homo sapiens
gccctctggctgctgatg

SEQ ID NO: 8208841 - DNA, 23 bp, Homo sapiens
gcccatggagtctggatctggcc

SEQ ID NO: 8208842 - DNA, 22 bp, Homo sapiens
gcccaggggcagcgcatagtgg

SEQ ID NO: 8208843 - DNA, 22 bp, Homo sapiens
gcccaggggcagcgcatagtgg

SEQ ID NO: 8208844 - DNA, 22 bp, Homo sapiens
gcccaggggagtagtcaattta

SEQ ID NO: 8208845 - DNA, 22 bp, Homo sapiens
gcccagggcttcaaagagagaa

SEQ ID NO: 8208846 - DNA, 22 bp, Homo sapiens
gcccagggcttcaaagagagaa

SEQ ID NO: 8208847 - DNA, 22 bp, Homo sapiens
gcccatcttctagcagctgtta

SEQ ID NO: 8208848 - DNA, 22 bp, Homo sapiens
gcccatcttctagcagctgtta

SEQ ID NO: 8208849 - DNA, 22 bp, Homo sapiens
gcccatctaatatgtactgtgt

SEQ ID NO: 8208850 - DNA, 22 bp, Homo sapiens
gcccatccctgaaccaactggg

SEQ ID NO: 8208851 - DNA, 22 bp, Homo sapiens
gcccataattcaaatataacac

SEQ ID NO: 8208852 - DNA, 22 bp, Homo sapiens
gcccagtggtaaaagcaggcct

SEQ ID NO: 8208853 - DNA, 22 bp, Homo sapiens
gcatttttgatcccactaggat

SEQ ID NO: 8208854 - DNA, 22 bp, Homo sapiens
gcatttttctctcctataggag

SEQ ID NO: 8208855 - DNA, 22 bp, Homo sapiens
gccaaggaaggcttcctggaag

SEQ ID NO: 8208856 - DNA, 22 bp, Homo sapiens
gccaagctttgcaggagtgttg

SEQ ID NO: 8208857 - DNA, 22 bp, Homo sapiens
gccaaggcctctgcaggatgag

SEQ ID NO: 8208858 - DNA, 22 bp, Homo sapiens
gccaaggataccagctgtgaga

SEQ ID NO: 8208859 - DNA, 22 bp, Homo sapiens
gccaaggcctgcagcacctcat

SEQ ID NO: 8208860 - DNA, 22 bp, Homo sapiens
gccaaggcctgcagcacctcat

SEQ ID NO: 8208861 - DNA, 22 bp, Homo sapiens
gccaaggcctgcagcacctcat

SEQ ID NO: 8208862 - DNA, 22 bp, Homo sapiens
gccaaggcctctgcaggatgag

SEQ ID NO: 8208863 - DNA, 22 bp, Homo sapiens
gcatttgtgtggcggaaggatt

SEQ ID NO: 8208864 - DNA, 22 bp, Homo sapiens
gcattttaatgaggtttatgag

SEQ ID NO: 8208865 - DNA, 18 bp, Homo sapiens
gcattttaatctgaggca

SEQ ID NO: 8208866 - DNA, 18 bp, Homo sapiens
gcattttaatctgaggca

SEQ ID NO: 8208867 - DNA, 22 bp, Homo sapiens
gcattttaatgaggtttatgag

SEQ ID NO: 8208868 - DNA, 22 bp, Homo sapiens
gcattttaatgaggtttatgag

SEQ ID NO: 8208869 - DNA, 22 bp, Homo sapiens
gcattttagaatattggagcaa

SEQ ID NO: 8208870 - DNA, 22 bp, Homo sapiens
gcattttagaatattggagcaa

SEQ ID NO: 8208871 - DNA, 22 bp, Homo sapiens
gcattttataaagagttatttg

SEQ ID NO: 8208872 - DNA, 22 bp, Homo sapiens
gcattttgaggctgggggagca

SEQ ID NO: 8208873 - DNA, 22 bp, Homo sapiens
gcattttataaagagttatttg

SEQ ID NO: 8208874 - DNA, 22 bp, Homo sapiens
gcatttttctaatcattggcat

SEQ ID NO: 8208875 - DNA, 22 bp, Homo sapiens
gcatttttctaatcattggcat

SEQ ID NO: 8208876 - DNA, 22 bp, Homo sapiens
gcatttttcatccctcttgggt

SEQ ID NO: 8208877 - DNA, 22 bp, Homo sapiens
gcatttttcatccctcttgggt

SEQ ID NO: 8208878 - DNA, 22 bp, Homo sapiens
gccagagcacaggctggtagta

SEQ ID NO: 8208879 - DNA, 22 bp, Homo sapiens
gccagagcacaggctggtagta

SEQ ID NO: 8208880 - DNA, 22 bp, Homo sapiens
gccaagggaactgagccggagg

SEQ ID NO: 8208881 - DNA, 22 bp, Homo sapiens
gccaagggaactgagccggagg

SEQ ID NO: 8208882 - DNA, 22 bp, Homo sapiens
gccaataaaatctgtgcatatt

SEQ ID NO: 8208883 - DNA, 22 bp, Homo sapiens
gccaagggtagtggaggcccct

SEQ ID NO: 8208884 - DNA, 21 bp, Homo sapiens
gccagagcagtacaatgaggt

SEQ ID NO: 8208885 - DNA, 21 bp, Homo sapiens
gccagagcagtacaatgaggt

SEQ ID NO: 8208886 - DNA, 22 bp, Homo sapiens
gccagagcagaatagagtggcc

SEQ ID NO: 8208887 - DNA, 22 bp, Homo sapiens
gccagagcagaatagagtggcc

SEQ ID NO: 8208888 - DNA, 22 bp, Homo sapiens
gccagagcagaatagagtggcc

SEQ ID NO: 8208889 - DNA, 22 bp, Homo sapiens
gccagagcagaatagagtggcc

SEQ ID NO: 8208890 - DNA, 22 bp, Homo sapiens
gccagagcatgcactgcctgca

SEQ ID NO: 8208891 - DNA, 18 bp, Homo sapiens
gccagagcatatctccag

SEQ ID NO: 8208892 - DNA, 22 bp, Homo sapiens
gccagagcatcgcaccctccat

SEQ ID NO: 8208893 - DNA, 21 bp, Homo sapiens
gccagagcagtacaatgaggt

SEQ ID NO: 8208894 - DNA, 22 bp, Homo sapiens
gccagagcatgcactgcctgca

SEQ ID NO: 8208895 - DNA, 22 bp, Homo sapiens
gccagagcatgcactgcctgca

SEQ ID NO: 8208896 - DNA, 22 bp, Homo sapiens
gccagagcatgcactgcctgca

SEQ ID NO: 8208897 - DNA, 22 bp, Homo sapiens
gccagagcatgcactgcctgca

SEQ ID NO: 8208898 - DNA, 22 bp, Homo sapiens
gccagagccacttttgggtgat

SEQ ID NO: 8208899 - DNA, 22 bp, Homo sapiens
gccagagccacttttgggtgat

SEQ ID NO: 8208900 - DNA, 22 bp, Homo sapiens
gccagagccggcttcacaggat

SEQ ID NO: 8208901 - DNA, 22 bp, Homo sapiens
gccagagccggcttcacaggat

SEQ ID NO: 8208902 - DNA, 22 bp, Homo sapiens
gccagagccggcttcacaggat

SEQ ID NO: 8208903 - DNA, 22 bp, Homo sapiens
gccagagctgagacacgagtcc

SEQ ID NO: 8208904 - DNA, 22 bp, Homo sapiens
gccagagcctgtggatttaacc

SEQ ID NO: 8208905 - DNA, 22 bp, Homo sapiens
gccagagccggcttcacaggat

SEQ ID NO: 8208906 - DNA, 22 bp, Homo sapiens
gccagagccggcttcacaggat

SEQ ID NO: 8208907 - DNA, 22 bp, Homo sapiens
gccagcagtggccaccaccagg

SEQ ID NO: 8208908 - DNA, 22 bp, Homo sapiens
gccagccaagattgagaaggta

SEQ ID NO: 8208909 - DNA, 22 bp, Homo sapiens
gccagcattccttggctcctgg

SEQ ID NO: 8208910 - DNA, 22 bp, Homo sapiens
gccagcagtcctgctgtgtgcc

SEQ ID NO: 8208911 - DNA, 22 bp, Homo sapiens
gccagcagtcctgctgtgtgcc

SEQ ID NO: 8208912 - DNA, 22 bp, Homo sapiens
gccagcagtcctgctgtgtgcc

SEQ ID NO: 8208913 - DNA, 22 bp, Homo sapiens
gccagcagtatgtcctggcagt

SEQ ID NO: 8208914 - DNA, 22 bp, Homo sapiens
gccagcagtatgtcctggcagt

SEQ ID NO: 8208915 - DNA, 22 bp, Homo sapiens
gccagccccttagggctctccc

SEQ ID NO: 8208916 - DNA, 22 bp, Homo sapiens
gccagcccctccatcctgttca

SEQ ID NO: 8208917 - DNA, 22 bp, Homo sapiens
gccagccccttagggctctccc

SEQ ID NO: 8208918 - DNA, 22 bp, Homo sapiens
gccagcccctccatcctgttca

SEQ ID NO: 8208919 - DNA, 22 bp, Homo sapiens
gccagcccctccatcctgttca

SEQ ID NO: 8208920 - DNA, 22 bp, Homo sapiens
gccagccccagacatcctatcg

SEQ ID NO: 8208921 - DNA, 22 bp, Homo sapiens
gccagcccattaacccctgtcc

SEQ ID NO: 8208922 - DNA, 22 bp, Homo sapiens
gccagcccattaacccctgtcc

SEQ ID NO: 8208923 - DNA, 22 bp, Homo sapiens
gccagcccattaacccctgtcc

SEQ ID NO: 8208924 - DNA, 22 bp, Homo sapiens
gccagcccattaacccctgtcc

SEQ ID NO: 8208925 - DNA, 22 bp, Homo sapiens
gccagcccagctccaggggaaa

SEQ ID NO: 8208926 - DNA, 22 bp, Homo sapiens
gccagcccagctccaggggaaa

SEQ ID NO: 8208927 - DNA, 21 bp, Homo sapiens
gccagccatgcttgcctaggc

SEQ ID NO: 8208928 - DNA, 21 bp, Homo sapiens
gccagccatgcttgcctaggc

SEQ ID NO: 8208929 - DNA, 22 bp, Homo sapiens
gccagaggcccaaggacagctg

SEQ ID NO: 8208930 - DNA, 22 bp, Homo sapiens
gccagaggcccaaggacagctg

SEQ ID NO: 8208931 - DNA, 22 bp, Homo sapiens
gccagaggaacgctgcgcgccc

SEQ ID NO: 8208932 - DNA, 23 bp, Homo sapiens
gccagaggaacgcagagctttct

SEQ ID NO: 8208933 - DNA, 22 bp, Homo sapiens
gccagagctgagacacgagtcc

SEQ ID NO: 8208934 - DNA, 22 bp, Homo sapiens
gccagagctgagacacgagtcc

SEQ ID NO: 8208935 - DNA, 22 bp, Homo sapiens
gccagagctgagacacgagtcc

SEQ ID NO: 8208936 - DNA, 22 bp, Homo sapiens
gccagagctgagtgaggttctt

SEQ ID NO: 8208937 - DNA, 22 bp, Homo sapiens
gccagagctgagtgaggttctt

SEQ ID NO: 8208938 - DNA, 22 bp, Homo sapiens
gccagagctgagtgaggttctt

SEQ ID NO: 8208939 - DNA, 22 bp, Homo sapiens
gccagagcttcccccgagtgtg

SEQ ID NO: 8208940 - DNA, 23 bp, Homo sapiens
gccagagctgcctgcccttgctg

SEQ ID NO: 8208941 - DNA, 22 bp, Homo sapiens
gccagagcttcccccgagtgtg

SEQ ID NO: 8208942 - DNA, 23 bp, Homo sapiens
gccagagctgcctgcccttgctg

SEQ ID NO: 8208943 - DNA, 23 bp, Homo sapiens
gccagaggaacgcagagctttct

SEQ ID NO: 8208944 - DNA, 22 bp, Homo sapiens
gccagagcttggtttttattta

SEQ ID NO: 8208945 - DNA, 22 bp, Homo sapiens
gccagagcttcccccgagtgtg

SEQ ID NO: 8208946 - DNA, 22 bp, Homo sapiens
gccagaggcccaaggacagctg

SEQ ID NO: 8208947 - DNA, 22 bp, Homo sapiens
gccagcagggcggagccatcta

SEQ ID NO: 8208948 - DNA, 22 bp, Homo sapiens
gccagcaggtggagagatcaag

SEQ ID NO: 8208949 - DNA, 22 bp, Homo sapiens
gccagcaggtggagagatcaag

SEQ ID NO: 8208950 - DNA, 22 bp, Homo sapiens
gccagcagggcggagccatcta

SEQ ID NO: 8208951 - DNA, 22 bp, Homo sapiens
gccagcagggcggagccatcta

SEQ ID NO: 8208952 - DNA, 22 bp, Homo sapiens
gccagcaggttgtcaaggagct

SEQ ID NO: 8208953 - DNA, 22 bp, Homo sapiens
gccagcaggttgtcaaggagct

SEQ ID NO: 8208954 - DNA, 22 bp, Homo sapiens
gccagcagtatgtcctggcagt

SEQ ID NO: 8208955 - DNA, 22 bp, Homo sapiens
gccagcagtatgtcctggcagt

SEQ ID NO: 8208956 - DNA, 22 bp, Homo sapiens
gccagcaggttgtcaaggagct

SEQ ID NO: 8208957 - DNA, 22 bp, Homo sapiens
gccagcaggttgtcaaggagct

SEQ ID NO: 8208958 - DNA, 22 bp, Homo sapiens
gccagcaggttgtcaaggagct

SEQ ID NO: 8208959 - DNA, 22 bp, Homo sapiens
gcagggctcattgccaggcatt

SEQ ID NO: 8208960 - DNA, 22 bp, Homo sapiens
gcagggctcattgccaggcatt

SEQ ID NO: 8208961 - DNA, 22 bp, Homo sapiens
gcagggctcattgccaggcatt

SEQ ID NO: 8208962 - DNA, 22 bp, Homo sapiens
gcagggctcattgccaggcatt

SEQ ID NO: 8208963 - DNA, 22 bp, Homo sapiens
gcagggctcattgccaggcatt

SEQ ID NO: 8208964 - DNA, 22 bp, Homo sapiens
gcagggctcattgccaggcatt

SEQ ID NO: 8208965 - DNA, 22 bp, Homo sapiens
gcagggctcattctagtacaat

SEQ ID NO: 8208966 - DNA, 22 bp, Homo sapiens
gcagggctcattgccaggcatt

SEQ ID NO: 8208967 - DNA, 22 bp, Homo sapiens
gcagggctccactgtggccaag

SEQ ID NO: 8208968 - DNA, 22 bp, Homo sapiens
gcagggctccactgtggccaag

SEQ ID NO: 8208969 - DNA, 22 bp, Homo sapiens
gcagggctccactgtggccaag

SEQ ID NO: 8208970 - DNA, 22 bp, Homo sapiens
gcagggctccccaggcccgagg

SEQ ID NO: 8208971 - DNA, 22 bp, Homo sapiens
gcagggctcaacaggacacccc

SEQ ID NO: 8208972 - DNA, 22 bp, Homo sapiens
gcagggctcaacaggacacccc

SEQ ID NO: 8208973 - DNA, 22 bp, Homo sapiens
gcagggctcaacaggacacccc

SEQ ID NO: 8208974 - DNA, 22 bp, Homo sapiens
gcagggctcaacaggacacccc

SEQ ID NO: 8208975 - DNA, 22 bp, Homo sapiens
gcagggctcagccgctcccacc

SEQ ID NO: 8208976 - DNA, 22 bp, Homo sapiens
gcagggctcagccgctcccacc

SEQ ID NO: 8208977 - DNA, 22 bp, Homo sapiens
gcagggctcattgccaggcatt

SEQ ID NO: 8208978 - DNA, 22 bp, Homo sapiens
gcagggctcattctagtacaat

SEQ ID NO: 8208979 - DNA, 22 bp, Homo sapiens
gcagggctcattctagtacaat

SEQ ID NO: 8208980 - DNA, 22 bp, Homo sapiens
gcagggctcagccgctcccacc

SEQ ID NO: 8208981 - DNA, 22 bp, Homo sapiens
gcagggctcagccgctcccacc

SEQ ID NO: 8208982 - DNA, 22 bp, Homo sapiens
gcagggctcagccgctcccacc

SEQ ID NO: 8208983 - DNA, 22 bp, Homo sapiens
gcagtcagtaaggcagccagaa

SEQ ID NO: 8208984 - DNA, 22 bp, Homo sapiens
gcagtcagacaggaggagctcc

SEQ ID NO: 8208985 - DNA, 22 bp, Homo sapiens
gcagtcaggttaaggccttccc

SEQ ID NO: 8208986 - DNA, 22 bp, Homo sapiens
gcagtcagtaaggcagccagaa

SEQ ID NO: 8208987 - DNA, 22 bp, Homo sapiens
gcagtcagtctcttgccttgag

SEQ ID NO: 8208988 - DNA, 22 bp, Homo sapiens
gcagtcagtgttgactacatgc

SEQ ID NO: 8208989 - DNA, 22 bp, Homo sapiens
gcagtcagtctcttgccttgag

SEQ ID NO: 8208990 - DNA, 22 bp, Homo sapiens
gcagtcagacaggaggagctcc

SEQ ID NO: 8208991 - DNA, 21 bp, Homo sapiens
gcagtcactcggttggctacc

SEQ ID NO: 8208992 - DNA, 22 bp, Homo sapiens
gcagtcacagggagatggtgac

SEQ ID NO: 8208993 - DNA, 22 bp, Homo sapiens
gcagggctccccaggcccgagg

SEQ ID NO: 8208994 - DNA, 19 bp, Homo sapiens
gcagggctctcccagatgc

SEQ ID NO: 8208995 - DNA, 22 bp, Homo sapiens
gcagggctctgctgtagtccta

SEQ ID NO: 8208996 - DNA, 22 bp, Homo sapiens
gcagggctctgctgtagtccta

SEQ ID NO: 8208997 - DNA, 22 bp, Homo sapiens
gcagggctctgctgtagtccta

SEQ ID NO: 8208998 - DNA, 22 bp, Homo sapiens
gcagggctctgctgtagtccta

SEQ ID NO: 8208999 - DNA, 19 bp, Homo sapiens
gcagggctctcccagatgc

SEQ ID NO: 8209000 - DNA, 19 bp, Homo sapiens
gcagggctctcccagatgc

SEQ ID NO: 8209001 - DNA, 22 bp, Homo sapiens
gcagtatctatgtgatgggttg

SEQ ID NO: 8209002 - DNA, 22 bp, Homo sapiens
gcagtcacagggagatggtgac

SEQ ID NO: 8209003 - DNA, 22 bp, Homo sapiens
gcagtatctatgtgatgggttg

SEQ ID NO: 8209004 - DNA, 22 bp, Homo sapiens
gcagtatatggattttaaacat

SEQ ID NO: 8209005 - DNA, 22 bp, Homo sapiens
gcagtctttgagtatcttcaaa

SEQ ID NO: 8209006 - DNA, 20 bp, Homo sapiens
gcagtctgtcacagagcatg

SEQ ID NO: 8209007 - DNA, 22 bp, Homo sapiens
gcagtctataaatcagctttgc

SEQ ID NO: 8209008 - DNA, 22 bp, Homo sapiens
gcagtctatcttgtgatttaac

SEQ ID NO: 8209009 - DNA, 18 bp, Homo sapiens
gcagtgaagaaagagctt

SEQ ID NO: 8209010 - DNA, 22 bp, Homo sapiens
gcagtgaacataacacagaagg

SEQ ID NO: 8209011 - DNA, 22 bp, Homo sapiens
gcagtgaaaaagtgcaccctgt

SEQ ID NO: 8209012 - DNA, 22 bp, Homo sapiens
gcagtctttttcttctagctaa

SEQ ID NO: 8209013 - DNA, 22 bp, Homo sapiens
gcagtctttgagtatcttcaaa

SEQ ID NO: 8209014 - DNA, 22 bp, Homo sapiens
gcagtctttttcttctagctaa

SEQ ID NO: 8209015 - DNA, 22 bp, Homo sapiens
gcagtccccgtcgtggcaggga

SEQ ID NO: 8209016 - DNA, 22 bp, Homo sapiens
gcagtccccgtcgtggcaggga

SEQ ID NO: 8209017 - DNA, 20 bp, Homo sapiens
gcagtcccatttctgagcct

SEQ ID NO: 8209018 - DNA, 22 bp, Homo sapiens
gcagtccccgtcgtggcaggga

SEQ ID NO: 8209019 - DNA, 22 bp, Homo sapiens
gcagtcctagggtgctctgcag

SEQ ID NO: 8209020 - DNA, 22 bp, Homo sapiens
gcagtccattgacagaggtctt

SEQ ID NO: 8209021 - DNA, 22 bp, Homo sapiens
gcagtccattgacagaggtctt

SEQ ID NO: 8209022 - DNA, 22 bp, Homo sapiens
gcagtcctctcattggcctcct

SEQ ID NO: 8209023 - DNA, 22 bp, Homo sapiens
gcagtccttaggagaggaagta

SEQ ID NO: 8209024 - DNA, 22 bp, Homo sapiens
gcatttggtgatgcaccgttta

SEQ ID NO: 8209025 - DNA, 22 bp, Homo sapiens
gcatttcttcctggtgtgagcc

SEQ ID NO: 8209026 - DNA, 22 bp, Homo sapiens
gcatttgaaatcctctgtgacg

SEQ ID NO: 8209027 - DNA, 22 bp, Homo sapiens
gcatttgaaatgcaagaaagtg

SEQ ID NO: 8209028 - DNA, 22 bp, Homo sapiens
gcatttgagcacattttaaaga

SEQ ID NO: 8209029 - DNA, 22 bp, Homo sapiens
gcatttcatgtagattgagaac

SEQ ID NO: 8209030 - DNA, 22 bp, Homo sapiens
gcatttcctgtgcttggcatat

SEQ ID NO: 8209031 - DNA, 22 bp, Homo sapiens
gcatgatagctaactcccctca

SEQ ID NO: 8209032 - DNA, 19 bp, Homo sapiens
gcatttctctttacagcca

SEQ ID NO: 8209033 - DNA, 22 bp, Homo sapiens
gcatttctgtgcatacacatga

SEQ ID NO: 8209034 - DNA, 22 bp, Homo sapiens
gcatttctgtgcatacacatga

SEQ ID NO: 8209035 - DNA, 22 bp, Homo sapiens
gcatttctgtgcatacacatga

SEQ ID NO: 8209036 - DNA, 22 bp, Homo sapiens
gcatgaggggggttaggaagtt

SEQ ID NO: 8209037 - DNA, 22 bp, Homo sapiens
gcatgaggttcttggccagcat

SEQ ID NO: 8209038 - DNA, 22 bp, Homo sapiens
gcatgaggtttgggctctgtga

SEQ ID NO: 8209039 - DNA, 22 bp, Homo sapiens
gcatgaggttcttggccagcat

SEQ ID NO: 8209040 - DNA, 22 bp, Homo sapiens
gcatgataccataggttttgcc

SEQ ID NO: 8209041 - DNA, 22 bp, Homo sapiens
gcatgacattcctaatcacagt

SEQ ID NO: 8209042 - DNA, 22 bp, Homo sapiens
gcatgaggggggttaggaagtt

SEQ ID NO: 8209043 - DNA, 21 bp, Homo sapiens
gcatgaaaacagcctgtgctc

SEQ ID NO: 8209044 - DNA, 22 bp, Homo sapiens
gcatctgttagagtgtgcatgc

SEQ ID NO: 8209045 - DNA, 22 bp, Homo sapiens
gcatctgtgtttctagctagga

SEQ ID NO: 8209046 - DNA, 22 bp, Homo sapiens
gcatctgtgaatttgatataca

SEQ ID NO: 8209047 - DNA, 22 bp, Homo sapiens
gcatctgatccaatagatatat

SEQ ID NO: 8209048 - DNA, 22 bp, Homo sapiens
gcatctaaataaacgtgggagt

SEQ ID NO: 8209049 - DNA, 22 bp, Homo sapiens
gcatccctctgaggggccaggc

SEQ ID NO: 8209050 - DNA, 20 bp, Homo sapiens
gcatcctcccagcagagctg

SEQ ID NO: 8209051 - DNA, 22 bp, Homo sapiens
gcatccctctgaggggccaggc

SEQ ID NO: 8209052 - DNA, 22 bp, Homo sapiens
gcatccatgcatgcagggtgtg

SEQ ID NO: 8209053 - DNA, 22 bp, Homo sapiens
gcatccatcagcagattgactg

SEQ ID NO: 8209054 - DNA, 20 bp, Homo sapiens
gcatccatatatgcatgtgt

SEQ ID NO: 8209055 - DNA, 22 bp, Homo sapiens
gcatccatggagagcactctga

SEQ ID NO: 8209056 - DNA, 19 bp, Homo sapiens
gcatccatggaggccgctt

SEQ ID NO: 8209057 - DNA, 22 bp, Homo sapiens
gcatccattcactcaacttaga

SEQ ID NO: 8209058 - DNA, 22 bp, Homo sapiens
gcatccattgtttatgtgtttc

SEQ ID NO: 8209059 - DNA, 19 bp, Homo sapiens
gcataaatacactattgtc

SEQ ID NO: 8209060 - DNA, 19 bp, Homo sapiens
gcataaatacactattgtc

SEQ ID NO: 8209061 - DNA, 22 bp, Homo sapiens
gcatccagtcttggctcctgga

SEQ ID NO: 8209062 - DNA, 22 bp, Homo sapiens
gcatccagtcttggctcctgga

SEQ ID NO: 8209063 - DNA, 22 bp, Homo sapiens
gcatccagaggtagccactgtg

SEQ ID NO: 8209064 - DNA, 22 bp, Homo sapiens
gcatccagaggtagccactgtg

SEQ ID NO: 8209065 - DNA, 22 bp, Homo sapiens
ggtgggcaacatttggcctgag

SEQ ID NO: 8209066 - DNA, 22 bp, Homo sapiens
ggtgggcaacatttggcctgag

SEQ ID NO: 8209067 - DNA, 22 bp, Homo sapiens
ggtgggcaacatttggcctgag

SEQ ID NO: 8209068 - DNA, 21 bp, Homo sapiens
ggtgggcacaggagagcagag

SEQ ID NO: 8209069 - DNA, 21 bp, Homo sapiens
ggtgggcacaggagagcagag

SEQ ID NO: 8209070 - DNA, 22 bp, Homo sapiens
ggtgggagtggaacgtggaaga

SEQ ID NO: 8209071 - DNA, 22 bp, Homo sapiens
ggtgggagtgggcacagttacg

SEQ ID NO: 8209072 - DNA, 22 bp, Homo sapiens
ggtgggagtggaacgtggaaga

SEQ ID NO: 8209073 - DNA, 16 bp, Homo sapiens
ggtgggaggtgaggtg

SEQ ID NO: 8209074 - DNA, 16 bp, Homo sapiens
ggtgggaggtgaggtg

SEQ ID NO: 8209075 - DNA, 16 bp, Homo sapiens
ggtgggaggtgaggtg

SEQ ID NO: 8209076 - DNA, 16 bp, Homo sapiens
ggtgggaggtgaggtg

SEQ ID NO: 8209077 - DNA, 22 bp, Homo sapiens
ggtgggaggcaggctgctccca

SEQ ID NO: 8209078 - DNA, 22 bp, Homo sapiens
ggtgggaggcaggctgctccca

SEQ ID NO: 8209079 - DNA, 23 bp, Homo sapiens
ggtgggagattatccagaattat

SEQ ID NO: 8209080 - DNA, 22 bp, Homo sapiens
ggtgggagagcttgctttgatg

SEQ ID NO: 8209081 - DNA, 22 bp, Homo sapiens
ggtggctgcaccctggctaact

SEQ ID NO: 8209082 - DNA, 22 bp, Homo sapiens
ggtggctgcaatggctaacttc

SEQ ID NO: 8209083 - DNA, 22 bp, Homo sapiens
ggtgctcaagagggcatcctct

SEQ ID NO: 8209084 - DNA, 22 bp, Homo sapiens
ggtggctctgttgtcaactgat

SEQ ID NO: 8209085 - DNA, 22 bp, Homo sapiens
ggtgctcaaggtgacaggacat

SEQ ID NO: 8209086 - DNA, 22 bp, Homo sapiens
ggtggctgaagcagtcttcggg

SEQ ID NO: 8209087 - DNA, 22 bp, Homo sapiens
ggtgcctttggcccctggctag

SEQ ID NO: 8209088 - DNA, 22 bp, Homo sapiens
ggtgccttcctgccagccgcaa

SEQ ID NO: 8209089 - DNA, 22 bp, Homo sapiens
ggtgccttcctgccagccgcaa

SEQ ID NO: 8209090 - DNA, 22 bp, Homo sapiens
ggtgcctgtatttggggcacag

SEQ ID NO: 8209091 - DNA, 22 bp, Homo sapiens
ggtgccttttccgtgtggccca

SEQ ID NO: 8209092 - DNA, 20 bp, Homo sapiens
ggtgcgaggccagagcagac

SEQ ID NO: 8209093 - DNA, 22 bp, Homo sapiens
ggtgcctgatggtgatgaggtc

SEQ ID NO: 8209094 - DNA, 22 bp, Homo sapiens
ggtgccgttgaggaagtaactg

SEQ ID NO: 8209095 - DNA, 22 bp, Homo sapiens
ggtgcctgatggtgatgaggtc

SEQ ID NO: 8209096 - DNA, 22 bp, Homo sapiens
ggtgcctgtatttggggcacag

SEQ ID NO: 8209097 - DNA, 22 bp, Homo sapiens
ggtgcccagcgaagtggctgtg

SEQ ID NO: 8209098 - DNA, 22 bp, Homo sapiens
ggtgccaggctcccagctcagg

SEQ ID NO: 8209099 - DNA, 22 bp, Homo sapiens
ggtgccaggctcccagctcagg

SEQ ID NO: 8209100 - DNA, 22 bp, Homo sapiens
ggtgccaggctcccagctcagg

SEQ ID NO: 8209101 - DNA, 22 bp, Homo sapiens
ggtgccaggctgtagtcagggt

SEQ ID NO: 8209102 - DNA, 22 bp, Homo sapiens
ggtgccagtgggtctcaggata

SEQ ID NO: 8209103 - DNA, 22 bp, Homo sapiens
ggtgccagtgggtctcaggata

SEQ ID NO: 8209104 - DNA, 22 bp, Homo sapiens
ggtgccagtgggtctcaggata

SEQ ID NO: 8209105 - DNA, 22 bp, Homo sapiens
ggtgccaggctgtagtcagggt

SEQ ID NO: 8209106 - DNA, 22 bp, Homo sapiens
ggtgccaggctgtagtcagggt

SEQ ID NO: 8209107 - DNA, 22 bp, Homo sapiens
ggtgccagtgggtctcaggata

SEQ ID NO: 8209108 - DNA, 22 bp, Homo sapiens
ggtgccaggctgtagtcagggt

SEQ ID NO: 8209109 - DNA, 22 bp, Homo sapiens
ggtgccagatgaggcccgcgat

SEQ ID NO: 8209110 - DNA, 22 bp, Homo sapiens
ggtgccagatgaggcccgcgat

SEQ ID NO: 8209111 - DNA, 22 bp, Homo sapiens
ggtgccagcctagtgcagtggt

SEQ ID NO: 8209112 - DNA, 22 bp, Homo sapiens
ggtgccagcctagtgcagtggt

SEQ ID NO: 8209113 - DNA, 22 bp, Homo sapiens
ggtgccagcctagtgcagtggt

SEQ ID NO: 8209114 - DNA, 22 bp, Homo sapiens
ggtgccagcctagtgcagtggt

SEQ ID NO: 8209115 - DNA, 22 bp, Homo sapiens
ggtgccagagtggcccaggggc

SEQ ID NO: 8209116 - DNA, 22 bp, Homo sapiens
ggtgccacataaatggagagag

SEQ ID NO: 8209117 - DNA, 20 bp, Homo sapiens
ggtgcaggtaacgctgtgct

SEQ ID NO: 8209118 - DNA, 20 bp, Homo sapiens
ggtgcaggtaacgctgtgct

SEQ ID NO: 8209119 - DNA, 20 bp, Homo sapiens
ggtgcaggtaacgctgtgct

SEQ ID NO: 8209120 - DNA, 20 bp, Homo sapiens
ggtgcaggtaacgctgtgct

SEQ ID NO: 8209121 - DNA, 21 bp, Homo sapiens
ggtgcaggtaatgatgatata

SEQ ID NO: 8209122 - DNA, 22 bp, Homo sapiens
ggtgcatggaaagagtaagtaa

SEQ ID NO: 8209123 - DNA, 22 bp, Homo sapiens
ggtgcatggtggaggtgaccct

SEQ ID NO: 8209124 - DNA, 22 bp, Homo sapiens
ggtgcatgtagccatcaagata

SEQ ID NO: 8209125 - DNA, 22 bp, Homo sapiens
ggtgcagggagaggcaggcccc

SEQ ID NO: 8209126 - DNA, 22 bp, Homo sapiens
ggtgaataagctgaacacttgg

SEQ ID NO: 8209127 - DNA, 22 bp, Homo sapiens
ggtgcagggagaggcaggcccc

SEQ ID NO: 8209128 - DNA, 22 bp, Homo sapiens
ggtgcagggagaggcaggcccc

SEQ ID NO: 8209129 - DNA, 20 bp, Homo sapiens
ggtgcaggtaacgctgtgct

SEQ ID NO: 8209130 - DNA, 22 bp, Homo sapiens
ggtgcagggagaggcaggcccc

SEQ ID NO: 8209131 - DNA, 22 bp, Homo sapiens
ggtgaaggtggaacgcagagca

SEQ ID NO: 8209132 - DNA, 22 bp, Homo sapiens
ggtgaaggtctactgtgtgcca

SEQ ID NO: 8209133 - DNA, 22 bp, Homo sapiens
ggtgaaggtctactgtgtgcca

SEQ ID NO: 8209134 - DNA, 22 bp, Homo sapiens
ggtgaaggtcagagcaggaaaa

SEQ ID NO: 8209135 - DNA, 22 bp, Homo sapiens
ggtgaaggtggaacgcagagca

SEQ ID NO: 8209136 - DNA, 22 bp, Homo sapiens
ggtgaagtaataccaggtgtac

SEQ ID NO: 8209137 - DNA, 22 bp, Homo sapiens
ggtgaaggtggaacgcagagca

SEQ ID NO: 8209138 - DNA, 22 bp, Homo sapiens
ggtgaaggtcagagcaggaaaa

SEQ ID NO: 8209139 - DNA, 22 bp, Homo sapiens
ggtgaaggtcagagcaggaaaa

SEQ ID NO: 8209140 - DNA, 22 bp, Homo sapiens
ggtgaagggtgtcatggcattt

SEQ ID NO: 8209141 - DNA, 22 bp, Homo sapiens
ggtgaagggtgtcatggcattt

SEQ ID NO: 8209142 - DNA, 22 bp, Homo sapiens
ggtgaagggccttaggagacag

SEQ ID NO: 8209143 - DNA, 22 bp, Homo sapiens
ggtgaagggccttaggagacag

SEQ ID NO: 8209144 - DNA, 22 bp, Homo sapiens
ggtgaaggcacaagagggcaag

SEQ ID NO: 8209145 - DNA, 22 bp, Homo sapiens
ggtgaaggcacaagagggcaag

SEQ ID NO: 8209146 - DNA, 22 bp, Homo sapiens
ggtgaaggaggaagctgatgga

SEQ ID NO: 8209147 - DNA, 22 bp, Homo sapiens
ggtgaagcgtatttgtggagct

SEQ ID NO: 8209148 - DNA, 22 bp, Homo sapiens
ggtgaagcgtatttgtggagct

SEQ ID NO: 8209149 - DNA, 22 bp, Homo sapiens
ggtgaaggcacaagagggcaag

SEQ ID NO: 8209150 - DNA, 22 bp, Homo sapiens
ggtgaagggccttaggagacag

SEQ ID NO: 8209151 - DNA, 22 bp, Homo sapiens
ggtgaaggcacaagagggcaag

SEQ ID NO: 8209152 - DNA, 22 bp, Homo sapiens
ggtgaagggccttaggagacag

SEQ ID NO: 8209153 - DNA, 22 bp, Homo sapiens
ggtgaagggccttaggagacag

SEQ ID NO: 8209154 - DNA, 22 bp, Homo sapiens
ggtcttctctatgagctggtct

SEQ ID NO: 8209155 - DNA, 22 bp, Homo sapiens
ggtcttctggaaagcagactgt

SEQ ID NO: 8209156 - DNA, 21 bp, Homo sapiens
ggtcttccaaataaggagaaa

SEQ ID NO: 8209157 - DNA, 21 bp, Homo sapiens
ggtcttcccactgtctggtga

SEQ ID NO: 8209158 - DNA, 22 bp, Homo sapiens
ggtcttccgagaggcctgtgct

SEQ ID NO: 8209159 - DNA, 22 bp, Homo sapiens
ggtcttcagctttgcatgtctt

SEQ ID NO: 8209160 - DNA, 22 bp, Homo sapiens
ggtctgtgtgctttgggaagtg

SEQ ID NO: 8209161 - DNA, 17 bp, Homo sapiens
ggtctgtgtctagggaa

SEQ ID NO: 8209162 - DNA, 22 bp, Homo sapiens
ggtcttcagctttgcatgtctt

SEQ ID NO: 8209163 - DNA, 18 bp, Homo sapiens
ggtctttaggtcagtgtc

SEQ ID NO: 8209164 - DNA, 22 bp, Homo sapiens
ggtctttcattacatgggttaa

SEQ ID NO: 8209165 - DNA, 22 bp, Homo sapiens
ggtgaaatatttttgatatgtt

SEQ ID NO: 8209166 - DNA, 22 bp, Homo sapiens
ggtgaacattgatgtggttaca

SEQ ID NO: 8209167 - DNA, 22 bp, Homo sapiens
ggtgaaattccttgtggaaagt

SEQ ID NO: 8209168 - DNA, 22 bp, Homo sapiens
ggtctgtgtcataggctgagtt

SEQ ID NO: 8209169 - DNA, 22 bp, Homo sapiens
ggtctggggcaggcatctgaca

SEQ ID NO: 8209170 - DNA, 17 bp, Homo sapiens
ggtctggggccattggc

SEQ ID NO: 8209171 - DNA, 22 bp, Homo sapiens
ggtctgtcacttactagctgta

SEQ ID NO: 8209172 - DNA, 22 bp, Homo sapiens
ggtctgtctttatatctggttc

SEQ ID NO: 8209173 - DNA, 22 bp, Homo sapiens
ggtcccaatctaatcacatgag

SEQ ID NO: 8209174 - DNA, 22 bp, Homo sapiens
ggtcccaaggaggatgaggcta

SEQ ID NO: 8209175 - DNA, 22 bp, Homo sapiens
ggtctggcctcgggcaccccca

SEQ ID NO: 8209176 - DNA, 22 bp, Homo sapiens
ggtcccagaattggttagcaca

SEQ ID NO: 8209177 - DNA, 22 bp, Homo sapiens
ggtaggcaaactacagttagct

SEQ ID NO: 8209178 - DNA, 22 bp, Homo sapiens
ggtaggagtattttgcagcagt

SEQ ID NO: 8209179 - DNA, 22 bp, Homo sapiens
ggtaggcactggtgggaagaga

SEQ ID NO: 8209180 - DNA, 22 bp, Homo sapiens
ggtaggcactggtgggaagaga

SEQ ID NO: 8209181 - DNA, 22 bp, Homo sapiens
ggtaggcagatcactgtctatg

SEQ ID NO: 8209182 - DNA, 22 bp, Homo sapiens
ggtaggcagatcactgtctatg

SEQ ID NO: 8209183 - DNA, 22 bp, Homo sapiens
ggtagctgcagcaggctggcaa

SEQ ID NO: 8209184 - DNA, 22 bp, Homo sapiens
ggtaggaagatagagcaaagtt

SEQ ID NO: 8209185 - DNA, 22 bp, Homo sapiens
ggtaggaagatagagcaaagtt

SEQ ID NO: 8209186 - DNA, 22 bp, Homo sapiens
ggtaggagtattttgcagcagt

SEQ ID NO: 8209187 - DNA, 22 bp, Homo sapiens
ggtaggagtattttgcagcagt

SEQ ID NO: 8209188 - DNA, 22 bp, Homo sapiens
ggtagccaggcatcccagatgc

SEQ ID NO: 8209189 - DNA, 22 bp, Homo sapiens
ggtagcgagaacagaccttaag

SEQ ID NO: 8209190 - DNA, 22 bp, Homo sapiens
ggtagccagcaactagcccagg

SEQ ID NO: 8209191 - DNA, 20 bp, Homo sapiens
ggtagctgctgcagttggta

SEQ ID NO: 8209192 - DNA, 22 bp, Homo sapiens
ggtagcaagcgcttgccctgcg

SEQ ID NO: 8209193 - DNA, 20 bp, Homo sapiens
ggtagcagctgctgtcatcc

SEQ ID NO: 8209194 - DNA, 22 bp, Homo sapiens
ggtagggaaggctctgcgggga

SEQ ID NO: 8209195 - DNA, 22 bp, Homo sapiens
ggtagggaaggctctgcgggga

SEQ ID NO: 8209196 - DNA, 22 bp, Homo sapiens
ggtagggaaggctctgcgggga

SEQ ID NO: 8209197 - DNA, 22 bp, Homo sapiens
ggtagggaaggtctcccacatt

SEQ ID NO: 8209198 - DNA, 21 bp, Homo sapiens
ggtagggaaggttcgctggtg

SEQ ID NO: 8209199 - DNA, 21 bp, Homo sapiens
ggtagggaaggttcgctggtg

SEQ ID NO: 8209200 - DNA, 22 bp, Homo sapiens
ggtcagcatctggttgagggca

SEQ ID NO: 8209201 - DNA, 22 bp, Homo sapiens
ggtagggatgggatttggaagt

SEQ ID NO: 8209202 - DNA, 22 bp, Homo sapiens
ggtcagcatctggttgagggca

SEQ ID NO: 8209203 - DNA, 22 bp, Homo sapiens
ggtagggcaaagtagggcacct

SEQ ID NO: 8209204 - DNA, 22 bp, Homo sapiens
ggtcagcagtttctttgaattt

SEQ ID NO: 8209205 - DNA, 22 bp, Homo sapiens
ggtcagccttggatttggtagc

SEQ ID NO: 8209206 - DNA, 22 bp, Homo sapiens
ggtcagctctttgggctggtgg

SEQ ID NO: 8209207 - DNA, 21 bp, Homo sapiens
ggtcagctctatccacgcctt

SEQ ID NO: 8209208 - DNA, 19 bp, Homo sapiens
ggtcagctgggctagaggc

SEQ ID NO: 8209209 - DNA, 22 bp, Homo sapiens
ggtcagccttggatttggtagc

SEQ ID NO: 8209210 - DNA, 22 bp, Homo sapiens
ggtcaggatccaagtctgtgct

SEQ ID NO: 8209211 - DNA, 22 bp, Homo sapiens
ggtcaggatccaagtctgtgct

SEQ ID NO: 8209212 - DNA, 21 bp, Homo sapiens
ggtcaggcatgtgccctgagc

SEQ ID NO: 8209213 - DNA, 21 bp, Homo sapiens
ggtcaggcatgtgccctgagc

SEQ ID NO: 8209214 - DNA, 21 bp, Homo sapiens
ggtcagggggtgcctccaggt

SEQ ID NO: 8209215 - DNA, 21 bp, Homo sapiens
ggtcagggggtgcctccaggt

SEQ ID NO: 8209216 - DNA, 22 bp, Homo sapiens
ggtcagggtataatcaagtgag

SEQ ID NO: 8209217 - DNA, 22 bp, Homo sapiens
ggtcagggtataatcaagtgag

SEQ ID NO: 8209218 - DNA, 22 bp, Homo sapiens
ggtcagggggatctgtgaggta

SEQ ID NO: 8209219 - DNA, 22 bp, Homo sapiens
ggtcagggggatctgtgaggta

SEQ ID NO: 8209220 - DNA, 22 bp, Homo sapiens
ggtcagggggatctgtgaggta

SEQ ID NO: 8209221 - DNA, 22 bp, Homo sapiens
ggtcagggggatctgtgaggta

SEQ ID NO: 8209222 - DNA, 22 bp, Homo sapiens
ggtcaggggctgctctacagag

SEQ ID NO: 8209223 - DNA, 22 bp, Homo sapiens
ggtcaggggctgctctacagag

SEQ ID NO: 8209224 - DNA, 22 bp, Homo sapiens
ggtcaggggctgctctacagag

SEQ ID NO: 8209225 - DNA, 22 bp, Homo sapiens
ggtcagggctcttccagtggct

SEQ ID NO: 8209226 - DNA, 22 bp, Homo sapiens
ggtcagggctgggtatgaagag

SEQ ID NO: 8209227 - DNA, 22 bp, Homo sapiens
ggtcagggctgggtatgaagag

SEQ ID NO: 8209228 - DNA, 18 bp, Homo sapiens
ggtcaggggcggagagaa

SEQ ID NO: 8209229 - DNA, 23 bp, Homo sapiens
ggtccaggaaaggcagcagcacc

SEQ ID NO: 8209230 - DNA, 23 bp, Homo sapiens
ggtccaggaaaggcagcagcacc

SEQ ID NO: 8209231 - DNA, 22 bp, Homo sapiens
ggtccagccaggtgctcatgcc

SEQ ID NO: 8209232 - DNA, 23 bp, Homo sapiens
ggtccaggaaaggcagcagcacc

SEQ ID NO: 8209233 - DNA, 23 bp, Homo sapiens
ggtccaggaaaggcagcagcacc

SEQ ID NO: 8209234 - DNA, 19 bp, Homo sapiens
ggtccagcacagttccagg

SEQ ID NO: 8209235 - DNA, 22 bp, Homo sapiens
ggtccagcacaacactggcatg

SEQ ID NO: 8209236 - DNA, 22 bp, Homo sapiens
ggtccagagctgatggtctttt

SEQ ID NO: 8209237 - DNA, 22 bp, Homo sapiens
ggtcagggttccaggtatcttc

SEQ ID NO: 8209238 - DNA, 22 bp, Homo sapiens
ggtcagggttccaggtatcttc

SEQ ID NO: 8209239 - DNA, 22 bp, Homo sapiens
ggtccaggatcaaggcatcacc

SEQ ID NO: 8209240 - DNA, 22 bp, Homo sapiens
ggtccaggatcaaggcatcacc

SEQ ID NO: 8209241 - DNA, 22 bp, Homo sapiens
ggtccaggatcaaggcatcacc

SEQ ID NO: 8209242 - DNA, 22 bp, Homo sapiens
ggtccaggtcctgtgacagcag

SEQ ID NO: 8209243 - DNA, 22 bp, Homo sapiens
ggtccaggtcctgtgacagcag

SEQ ID NO: 8209244 - DNA, 22 bp, Homo sapiens
ggtccaggtcctgtgacagcag

SEQ ID NO: 8209245 - DNA, 22 bp, Homo sapiens
ggtccaggtatgtggtgtgaat

SEQ ID NO: 8209246 - DNA, 22 bp, Homo sapiens
ggtccaggtatgtggtgtgaat

SEQ ID NO: 8209247 - DNA, 22 bp, Homo sapiens
gggtccagagttttcccgccct

SEQ ID NO: 8209248 - DNA, 23 bp, Homo sapiens
gggtccagagaagccattagggc

SEQ ID NO: 8209249 - DNA, 22 bp, Homo sapiens
gggtccacctgagcagcagcct

SEQ ID NO: 8209250 - DNA, 22 bp, Homo sapiens
gggtccacctgagcagcagcct

SEQ ID NO: 8209251 - DNA, 22 bp, Homo sapiens
gggtccagacactccagaggaa

SEQ ID NO: 8209252 - DNA, 22 bp, Homo sapiens
gggtccagactatgaagaactt

SEQ ID NO: 8209253 - DNA, 22 bp, Homo sapiens
gggtcaggctagcccagacttc

SEQ ID NO: 8209254 - DNA, 22 bp, Homo sapiens
gggtcaggctagcccagacttc

SEQ ID NO: 8209255 - DNA, 22 bp, Homo sapiens
gggtcaggctagcccagacttc

SEQ ID NO: 8209256 - DNA, 22 bp, Homo sapiens
gggtcaggcctcaaggtgggct

SEQ ID NO: 8209257 - DNA, 22 bp, Homo sapiens
gggtcaggcctcaaggtgggct

SEQ ID NO: 8209258 - DNA, 22 bp, Homo sapiens
gggtcaggcctcaaggtgggct

SEQ ID NO: 8209259 - DNA, 22 bp, Homo sapiens
gggtcaggaagaattctgccaa

SEQ ID NO: 8209260 - DNA, 22 bp, Homo sapiens
gggtcagggaggccccaccatg

SEQ ID NO: 8209261 - DNA, 22 bp, Homo sapiens
gggtcagggctgcctgggctca

SEQ ID NO: 8209262 - DNA, 22 bp, Homo sapiens
gggtcagggctgcctgggctca

SEQ ID NO: 8209263 - DNA, 22 bp, Homo sapiens
gggtcagggctgcctgggctca

SEQ ID NO: 8209264 - DNA, 22 bp, Homo sapiens
gggtcaggctcagcagggcagc

SEQ ID NO: 8209265 - DNA, 22 bp, Homo sapiens
gggtcaggctcagcagggcagc

SEQ ID NO: 8209266 - DNA, 22 bp, Homo sapiens
gggtcaggctcagcagggcagc

SEQ ID NO: 8209267 - DNA, 22 bp, Homo sapiens
gggtcaggctcagcagggcagc

SEQ ID NO: 8209268 - DNA, 22 bp, Homo sapiens
ggtacagggcttcctggacaag

SEQ ID NO: 8209269 - DNA, 22 bp, Homo sapiens
ggtacagaataaaaatcctaca

SEQ ID NO: 8209270 - DNA, 22 bp, Homo sapiens
ggtaagcacttcatgtacatga

SEQ ID NO: 8209271 - DNA, 22 bp, Homo sapiens
ggtacaaagttagatttaactt

SEQ ID NO: 8209272 - DNA, 19 bp, Homo sapiens
ggtagaagggaagtgtttt

SEQ ID NO: 8209273 - DNA, 22 bp, Homo sapiens
ggtagacaactttgtaatagcc

SEQ ID NO: 8209274 - DNA, 22 bp, Homo sapiens
ggtagaaagatggaacgttgaa

SEQ ID NO: 8209275 - DNA, 22 bp, Homo sapiens
ggtagaaataatcttcaggctg

SEQ ID NO: 8209276 - DNA, 22 bp, Homo sapiens
ggtacccagggttgcttcaagt

SEQ ID NO: 8209277 - DNA, 22 bp, Homo sapiens
ggtaccatggggaggcagaggt

SEQ ID NO: 8209278 - DNA, 22 bp, Homo sapiens
ggtaccaccaattcagctgcca

SEQ ID NO: 8209279 - DNA, 22 bp, Homo sapiens
ggtacagacagggctgcctggg

SEQ ID NO: 8209280 - DNA, 22 bp, Homo sapiens
ggtacagggcttcctggacaag

SEQ ID NO: 8209281 - DNA, 22 bp, Homo sapiens
ggtacagggcttcctggacaag

SEQ ID NO: 8209282 - DNA, 22 bp, Homo sapiens
ggtaacttagctcatggctgtg

SEQ ID NO: 8209283 - DNA, 22 bp, Homo sapiens
ggtaaggagctccggcttctgc

SEQ ID NO: 8209284 - DNA, 22 bp, Homo sapiens
gggtccagatggtgagagttaa

SEQ ID NO: 8209285 - DNA, 22 bp, Homo sapiens
gggtccagcgacagcaggctca

SEQ ID NO: 8209286 - DNA, 22 bp, Homo sapiens
gggcctgctccccatcgctgct

SEQ ID NO: 8209287 - DNA, 22 bp, Homo sapiens
gggcctgccattgctgccccag

SEQ ID NO: 8209288 - DNA, 22 bp, Homo sapiens
gggcctgctccccatcgctgct

SEQ ID NO: 8209289 - DNA, 22 bp, Homo sapiens
gggcctgctccccatcgctgct

SEQ ID NO: 8209290 - DNA, 22 bp, Homo sapiens
gggcctggcatgcagccccgtt

SEQ ID NO: 8209291 - DNA, 21 bp, Homo sapiens
gggcctggctgcgcaggacgg

SEQ ID NO: 8209292 - DNA, 22 bp, Homo sapiens
gggcctggcatgcagccccgtt

SEQ ID NO: 8209293 - DNA, 22 bp, Homo sapiens
gggcctggcatgcagccccgtt

SEQ ID NO: 8209294 - DNA, 22 bp, Homo sapiens
gggcctgctggtgcttccattg

SEQ ID NO: 8209295 - DNA, 22 bp, Homo sapiens
gggcctgcaggttctgagaggc

SEQ ID NO: 8209296 - DNA, 22 bp, Homo sapiens
gggcctgcaggttctgagaggc

SEQ ID NO: 8209297 - DNA, 22 bp, Homo sapiens
gggcctgcaggttctgagaggc

SEQ ID NO: 8209298 - DNA, 22 bp, Homo sapiens
gggcctgccattgctgccccag

SEQ ID NO: 8209299 - DNA, 22 bp, Homo sapiens
gggcctgccattgctgccccag

SEQ ID NO: 8209300 - DNA, 22 bp, Homo sapiens
gggcctgccaggctttcagcat

SEQ ID NO: 8209301 - DNA, 22 bp, Homo sapiens
gggcctgcaggttctgagaggc

SEQ ID NO: 8209302 - DNA, 22 bp, Homo sapiens
gggcctggtgcttctgactcct

SEQ ID NO: 8209303 - DNA, 22 bp, Homo sapiens
gggcctggtgcttctgactcct

SEQ ID NO: 8209304 - DNA, 22 bp, Homo sapiens
gggctccaaggaggccagcctg

SEQ ID NO: 8209305 - DNA, 22 bp, Homo sapiens
gggcctggtgcttctgactcct

SEQ ID NO: 8209306 - DNA, 22 bp, Homo sapiens
gggcctggtgcttctgactcct

SEQ ID NO: 8209307 - DNA, 22 bp, Homo sapiens
gggcctggggtgacgtacccct

SEQ ID NO: 8209308 - DNA, 22 bp, Homo sapiens
gggcctgggaacttgcatttag

SEQ ID NO: 8209309 - DNA, 22 bp, Homo sapiens
gggcctggggacaccaccatga

SEQ ID NO: 8209310 - DNA, 22 bp, Homo sapiens
gggcctggggacaccaccatga

SEQ ID NO: 8209311 - DNA, 21 bp, Homo sapiens
gggcctggctgcgcaggacgg

SEQ ID NO: 8209312 - DNA, 21 bp, Homo sapiens
gggcctggctgcgcaggacgg

SEQ ID NO: 8209313 - DNA, 21 bp, Homo sapiens
gggcctggctgcgcaggacgg

SEQ ID NO: 8209314 - DNA, 21 bp, Homo sapiens
gggcctggctgcgcaggacgg

SEQ ID NO: 8209315 - DNA, 22 bp, Homo sapiens
gggcctggggacaccaccatga

SEQ ID NO: 8209316 - DNA, 22 bp, Homo sapiens
gggcctgggaacttgcatttag

SEQ ID NO: 8209317 - DNA, 22 bp, Homo sapiens
gggcatgagaggcaggcaagtg

SEQ ID NO: 8209318 - DNA, 22 bp, Homo sapiens
gggcatgagaggcaggcaagtg

SEQ ID NO: 8209319 - DNA, 22 bp, Homo sapiens
gggcatgacttttggagtggga

SEQ ID NO: 8209320 - DNA, 22 bp, Homo sapiens
gggcatgacttttggagtggga

SEQ ID NO: 8209321 - DNA, 22 bp, Homo sapiens
gggcatgagagggcagctggca

SEQ ID NO: 8209322 - DNA, 22 bp, Homo sapiens
gggcatgagagggcagctggca

SEQ ID NO: 8209323 - DNA, 22 bp, Homo sapiens
gggcatgcctgagcctgccact

SEQ ID NO: 8209324 - DNA, 23 bp, Homo sapiens
gggcagttatgttgtccttggct

SEQ ID NO: 8209325 - DNA, 20 bp, Homo sapiens
gggcagttcaatgccactct

SEQ ID NO: 8209326 - DNA, 21 bp, Homo sapiens
gggcatcctttcccaccctgc

SEQ ID NO: 8209327 - DNA, 22 bp, Homo sapiens
gggcatctggtggagcctcagg

SEQ ID NO: 8209328 - DNA, 22 bp, Homo sapiens
gggcatcttgtagccttcactt

SEQ ID NO: 8209329 - DNA, 22 bp, Homo sapiens
gggcctccgtgtgctggtgctc

SEQ ID NO: 8209330 - DNA, 22 bp, Homo sapiens
gggcctccggggtgagctgtgg

SEQ ID NO: 8209331 - DNA, 22 bp, Homo sapiens
gggcctccggggtgagctgtgg

SEQ ID NO: 8209332 - DNA, 22 bp, Homo sapiens
gggcctccggggtgagctgtgg

SEQ ID NO: 8209333 - DNA, 22 bp, Homo sapiens
gggcctctccggcctttgcatc

SEQ ID NO: 8209334 - DNA, 22 bp, Homo sapiens
gggcctctcccttctcacgcat

SEQ ID NO: 8209335 - DNA, 22 bp, Homo sapiens
gggcctccgtgtgctggtgctc

SEQ ID NO: 8209336 - DNA, 22 bp, Homo sapiens
gggcctctgtgcagaggggcct

SEQ ID NO: 8209337 - DNA, 22 bp, Homo sapiens
gggcctgaaaccttcagggctt

SEQ ID NO: 8209338 - DNA, 22 bp, Homo sapiens
gggcatgcctgcgcagtgcatg

SEQ ID NO: 8209339 - DNA, 22 bp, Homo sapiens
gggcctcagctctgctctgcaa

SEQ ID NO: 8209340 - DNA, 22 bp, Homo sapiens
gggcctcagctctgctctgcaa

SEQ ID NO: 8209341 - DNA, 22 bp, Homo sapiens
gggcctcagctgccaacaggat

SEQ ID NO: 8209342 - DNA, 22 bp, Homo sapiens
gggcctcagctggagtctgcct

SEQ ID NO: 8209343 - DNA, 22 bp, Homo sapiens
gggcctcaggccttgctctgtg

SEQ ID NO: 8209344 - DNA, 22 bp, Homo sapiens
gggcctcaggccttgctctgtg

SEQ ID NO: 8209345 - DNA, 22 bp, Homo sapiens
gggcctcatgatggctcaggaa

SEQ ID NO: 8209346 - DNA, 22 bp, Homo sapiens
gggcctcatgatggctcaggaa

SEQ ID NO: 8209347 - DNA, 22 bp, Homo sapiens
gggcctcatgatggctcaggaa

SEQ ID NO: 8209348 - DNA, 22 bp, Homo sapiens
gggcctcatgatggctcaggaa

SEQ ID NO: 8209349 - DNA, 22 bp, Homo sapiens
gggctctcatgagtgtgtggta

SEQ ID NO: 8209350 - DNA, 22 bp, Homo sapiens
gggctctaggatggctccagcc

SEQ ID NO: 8209351 - DNA, 22 bp, Homo sapiens
gggctctagaggacagcctgct

SEQ ID NO: 8209352 - DNA, 19 bp, Homo sapiens
gggctctactctcagtctt

SEQ ID NO: 8209353 - DNA, 22 bp, Homo sapiens
gggctctcgattagaccctggg

SEQ ID NO: 8209354 - DNA, 22 bp, Homo sapiens
gggctctcgattagaccctggg

SEQ ID NO: 8209355 - DNA, 22 bp, Homo sapiens
gggctcggcatctgtggactct

SEQ ID NO: 8209356 - DNA, 22 bp, Homo sapiens
gggctcctgcctcctggcacct

SEQ ID NO: 8209357 - DNA, 22 bp, Homo sapiens
gggctcctcctctgactgtggc

SEQ ID NO: 8209358 - DNA, 22 bp, Homo sapiens
gggctcctcctctgactgtggc

SEQ ID NO: 8209359 - DNA, 22 bp, Homo sapiens
gggctcctgcctcctggcacct

SEQ ID NO: 8209360 - DNA, 22 bp, Homo sapiens
gggctcctgcctcctggcacct

SEQ ID NO: 8209361 - DNA, 22 bp, Homo sapiens
gggctctctttttggcctgccc

SEQ ID NO: 8209362 - DNA, 22 bp, Homo sapiens
gggctctgaatcccaggtctgc

SEQ ID NO: 8209363 - DNA, 20 bp, Homo sapiens
gggctggcgcatggggaaag

SEQ ID NO: 8209364 - DNA, 22 bp, Homo sapiens
gggctctgaatcccaggtctgc

SEQ ID NO: 8209365 - DNA, 22 bp, Homo sapiens
gggctggcatcggttgctgaga

SEQ ID NO: 8209366 - DNA, 22 bp, Homo sapiens
gggctctgaatcccaggtctgc

SEQ ID NO: 8209367 - DNA, 22 bp, Homo sapiens
gggctggcgggaaaggcaattc

SEQ ID NO: 8209368 - DNA, 20 bp, Homo sapiens
gggctggcgcatggggaaag

SEQ ID NO: 8209369 - DNA, 20 bp, Homo sapiens
gggctggcgcatggggaaag

SEQ ID NO: 8209370 - DNA, 20 bp, Homo sapiens
gggctggcgcatggggaaag

SEQ ID NO: 8209371 - DNA, 22 bp, Homo sapiens
gggctggctaagacttttctgt

SEQ ID NO: 8209372 - DNA, 22 bp, Homo sapiens
gggctggctaagacttttctgt

SEQ ID NO: 8209373 - DNA, 20 bp, Homo sapiens
gggctggctcaactggatcc

SEQ ID NO: 8209374 - DNA, 22 bp, Homo sapiens
gggctggcgggaaaggcaattc

SEQ ID NO: 8209375 - DNA, 22 bp, Homo sapiens
gggctggcgggaaaggcaattc

SEQ ID NO: 8209376 - DNA, 22 bp, Homo sapiens
gggctggctcccaggtgttgaa

SEQ ID NO: 8209377 - DNA, 22 bp, Homo sapiens
gggctggctcccaggtgttgaa

SEQ ID NO: 8209378 - DNA, 22 bp, Homo sapiens
gggctggctcccaggtgttgaa

SEQ ID NO: 8209379 - DNA, 22 bp, Homo sapiens
gggctggctcccaggtgttgaa

SEQ ID NO: 8209380 - DNA, 22 bp, Homo sapiens
gggctggctcccaggtgttgaa

SEQ ID NO: 8209381 - DNA, 22 bp, Homo sapiens
gggctggctcccaggtgttgaa

SEQ ID NO: 8209382 - DNA, 20 bp, Homo sapiens
gggctggctcaactggatcc

SEQ ID NO: 8209383 - DNA, 20 bp, Homo sapiens
gggctggctcaactggatcc

SEQ ID NO: 8209384 - DNA, 22 bp, Homo sapiens
gggctccagcagaggcagccgg

SEQ ID NO: 8209385 - DNA, 22 bp, Homo sapiens
gggctccagcccgggaccaggt

SEQ ID NO: 8209386 - DNA, 22 bp, Homo sapiens
gggctccacagcagtgagtgga

SEQ ID NO: 8209387 - DNA, 22 bp, Homo sapiens
gggctccacagcagtgagtgga

SEQ ID NO: 8209388 - DNA, 22 bp, Homo sapiens
gggctccacctagggacactgg

SEQ ID NO: 8209389 - DNA, 22 bp, Homo sapiens
gggctccacgcacgcgagaggt

SEQ ID NO: 8209390 - DNA, 22 bp, Homo sapiens
gggctccatcacaggctccatc

SEQ ID NO: 8209391 - DNA, 22 bp, Homo sapiens
gggctccatcacaggctccatc

SEQ ID NO: 8209392 - DNA, 17 bp, Homo sapiens
gggctcctcccctgggg

SEQ ID NO: 8209393 - DNA, 17 bp, Homo sapiens
gggctcctcccctgggg

SEQ ID NO: 8209394 - DNA, 22 bp, Homo sapiens
gggctccagtttggccaggaag

SEQ ID NO: 8209395 - DNA, 22 bp, Homo sapiens
gggctccagtttggccaggaag

SEQ ID NO: 8209396 - DNA, 23 bp, Homo sapiens
gggctccagtctctgctcagttg

SEQ ID NO: 8209397 - DNA, 22 bp, Homo sapiens
gggctccaggcaggcaggaaat

SEQ ID NO: 8209398 - DNA, 22 bp, Homo sapiens
gggctccaggcaggcaggaaat

SEQ ID NO: 8209399 - DNA, 22 bp, Homo sapiens
gggctgggcatggtgttccctc

SEQ ID NO: 8209400 - DNA, 22 bp, Homo sapiens
gggctgggcatggtgttccctc

SEQ ID NO: 8209401 - DNA, 22 bp, Homo sapiens
gggctgggcatggtgttccctc

SEQ ID NO: 8209402 - DNA, 22 bp, Homo sapiens
gggctggggctcaataatttgt

SEQ ID NO: 8209403 - DNA, 22 bp, Homo sapiens
gggctggggctcaataatttgt

SEQ ID NO: 8209404 - DNA, 16 bp, Homo sapiens
gggctgggggattctg

SEQ ID NO: 8209405 - DNA, 22 bp, Homo sapiens
gggctgggcatggtgttccctc

SEQ ID NO: 8209406 - DNA, 22 bp, Homo sapiens
gggctgggcatggtgttccctc

SEQ ID NO: 8209407 - DNA, 22 bp, Homo sapiens
gggctgggattgcttgctgtga

SEQ ID NO: 8209408 - DNA, 22 bp, Homo sapiens
gggctgggatggcttgaagatt

SEQ ID NO: 8209409 - DNA, 22 bp, Homo sapiens
gggctgggatggcttgaagatt

SEQ ID NO: 8209410 - DNA, 22 bp, Homo sapiens
gggctggctgattttcctctct

SEQ ID NO: 8209411 - DNA, 22 bp, Homo sapiens
gggctgggaatggctaagtatg

SEQ ID NO: 8209412 - DNA, 22 bp, Homo sapiens
gggctggctctgtctagaaagg

SEQ ID NO: 8209413 - DNA, 22 bp, Homo sapiens
gggctggctctgtctagaaagg

SEQ ID NO: 8209414 - DNA, 22 bp, Homo sapiens
gggctggctcccaggtgttgaa

SEQ ID NO: 8209415 - DNA, 22 bp, Homo sapiens
gggctggctctgtctagaaagg

SEQ ID NO: 8209416 - DNA, 22 bp, Homo sapiens
ggggatggtagaccggtgacgt

SEQ ID NO: 8209417 - DNA, 22 bp, Homo sapiens
ggggatggtagaccggtgacgt

SEQ ID NO: 8209418 - DNA, 22 bp, Homo sapiens
ggggatggaatgtagtagtgat

SEQ ID NO: 8209419 - DNA, 22 bp, Homo sapiens
ggggatggaggcgtgtggtcct

SEQ ID NO: 8209420 - DNA, 22 bp, Homo sapiens
ggggatggaggcgtgtggtcct

SEQ ID NO: 8209421 - DNA, 22 bp, Homo sapiens
ggggatggaggcgtgtggtcct

SEQ ID NO: 8209422 - DNA, 22 bp, Homo sapiens
ggggatggaatgtagtagtgat

SEQ ID NO: 8209423 - DNA, 22 bp, Homo sapiens
ggggatggaatgtagtagtgat

SEQ ID NO: 8209424 - DNA, 22 bp, Homo sapiens
ggggatggaatgtagtagtgat

SEQ ID NO: 8209425 - DNA, 22 bp, Homo sapiens
ggggcagaaagcccacagagtg

SEQ ID NO: 8209426 - DNA, 22 bp, Homo sapiens
ggggcactttactgcctcatct

SEQ ID NO: 8209427 - DNA, 22 bp, Homo sapiens
ggggcactttactgcctcatct

SEQ ID NO: 8209428 - DNA, 22 bp, Homo sapiens
ggggcagctcccgagggcagga

SEQ ID NO: 8209429 - DNA, 22 bp, Homo sapiens
ggggcagctaccggaagtaggg

SEQ ID NO: 8209430 - DNA, 22 bp, Homo sapiens
ggggcagctaccggaagtaggg

SEQ ID NO: 8209431 - DNA, 22 bp, Homo sapiens
ggggcagaagtagtgcccctga

SEQ ID NO: 8209432 - DNA, 22 bp, Homo sapiens
ggggcacttggcacctctgcag

SEQ ID NO: 8209433 - DNA, 22 bp, Homo sapiens
ggggatggtgggaaggcaatct

SEQ ID NO: 8209434 - DNA, 22 bp, Homo sapiens
ggggatggtgggaaggcaatct

SEQ ID NO: 8209435 - DNA, 22 bp, Homo sapiens
ggggatggtgggaaggcaatct

SEQ ID NO: 8209436 - DNA, 22 bp, Homo sapiens
ggggcaatgtccaagtcagttg

SEQ ID NO: 8209437 - DNA, 20 bp, Homo sapiens
gggggccagcagcagacgcc

SEQ ID NO: 8209438 - DNA, 22 bp, Homo sapiens
gggggcagtaaggatatggaaa

SEQ ID NO: 8209439 - DNA, 22 bp, Homo sapiens
gggggccagtgtctcttccttg

SEQ ID NO: 8209440 - DNA, 22 bp, Homo sapiens
gggggccagtcatctcccaaga

SEQ ID NO: 8209441 - DNA, 23 bp, Homo sapiens
gggggccgtcctggggattatag

SEQ ID NO: 8209442 - DNA, 22 bp, Homo sapiens
gggggccatcttcaaggatgtg

SEQ ID NO: 8209443 - DNA, 23 bp, Homo sapiens
gggggccgtcctggggattatag

SEQ ID NO: 8209444 - DNA, 23 bp, Homo sapiens
gggggcgtgtcatggagggccac

SEQ ID NO: 8209445 - DNA, 22 bp, Homo sapiens
gggggcggagcacgtgaccacg

SEQ ID NO: 8209446 - DNA, 22 bp, Homo sapiens
gggtatgatagggaggtgaaat

SEQ ID NO: 8209447 - DNA, 22 bp, Homo sapiens
gggtatgagatataggtgaata

SEQ ID NO: 8209448 - DNA, 22 bp, Homo sapiens
gggtagtttaattaggaagaaa

SEQ ID NO: 8209449 - DNA, 22 bp, Homo sapiens
gggtattaaaatgaaggagaaa

SEQ ID NO: 8209450 - DNA, 22 bp, Homo sapiens
gggtcaaggctacatggagacc

SEQ ID NO: 8209451 - DNA, 22 bp, Homo sapiens
gggtcaaggctacatggagacc

SEQ ID NO: 8209452 - DNA, 22 bp, Homo sapiens
gggtcacttttgctatgttggc

SEQ ID NO: 8209453 - DNA, 22 bp, Homo sapiens
gggtcagagcaagactggggtc

SEQ ID NO: 8209454 - DNA, 22 bp, Homo sapiens
gggtcaagccgttgcccaaggc

SEQ ID NO: 8209455 - DNA, 22 bp, Homo sapiens
gggtcacttttgctatgttggc

SEQ ID NO: 8209456 - DNA, 22 bp, Homo sapiens
gggtcagctccctccccagggc

SEQ ID NO: 8209457 - DNA, 22 bp, Homo sapiens
gggtcagagttcaggtcgaggg

SEQ ID NO: 8209458 - DNA, 22 bp, Homo sapiens
gggtcagagtaagcaaggacaa

SEQ ID NO: 8209459 - DNA, 22 bp, Homo sapiens
gggtcagagccgtaacaggact

SEQ ID NO: 8209460 - DNA, 22 bp, Homo sapiens
ggggcttctttctgccaccgac

SEQ ID NO: 8209461 - DNA, 22 bp, Homo sapiens
ggggcttctttctgccaccgac

SEQ ID NO: 8209462 - DNA, 22 bp, Homo sapiens
ggggcttccagcgcccgccggt

SEQ ID NO: 8209463 - DNA, 22 bp, Homo sapiens
ggggcttccagcgcccgccggt

SEQ ID NO: 8209464 - DNA, 22 bp, Homo sapiens
ggggcttttgcacgtgggaggc

SEQ ID NO: 8209465 - DNA, 22 bp, Homo sapiens
gggggaaagctcaggagcctgt

SEQ ID NO: 8209466 - DNA, 22 bp, Homo sapiens
ggggcaggaggtgttctctttt

SEQ ID NO: 8209467 - DNA, 22 bp, Homo sapiens
ggggcaggaggtgttctctttt

SEQ ID NO: 8209468 - DNA, 22 bp, Homo sapiens
ggggcaggaggtgttctctttt

SEQ ID NO: 8209469 - DNA, 22 bp, Homo sapiens
ggggcaggagcccttcttcagc

SEQ ID NO: 8209470 - DNA, 22 bp, Homo sapiens
ggggcaggagcccttcttcagc

SEQ ID NO: 8209471 - DNA, 22 bp, Homo sapiens
ggggcagctcccgagggcagga

SEQ ID NO: 8209472 - DNA, 22 bp, Homo sapiens
ggggcaggagcccttcttcagc

SEQ ID NO: 8209473 - DNA, 22 bp, Homo sapiens
gggggaagaaagaacatggcat

SEQ ID NO: 8209474 - DNA, 22 bp, Homo sapiens
gggggaaagtggaggttcgtga

SEQ ID NO: 8209475 - DNA, 22 bp, Homo sapiens
gggggaagaaagaacatggcat

SEQ ID NO: 8209476 - DNA, 22 bp, Homo sapiens
gggggaaatagaaatgcttaga

SEQ ID NO: 8209477 - DNA, 22 bp, Homo sapiens
gggggaagactgggctagtgat

SEQ ID NO: 8209478 - DNA, 22 bp, Homo sapiens
gggggaagactgggctagtgat

SEQ ID NO: 8209479 - DNA, 22 bp, Homo sapiens
gtagcagaatcagtgctacaga

SEQ ID NO: 8209480 - DNA, 22 bp, Homo sapiens
gtagcagctctccagggttcac

SEQ ID NO: 8209481 - DNA, 22 bp, Homo sapiens
gtagcagcagagcaggtcctcc

SEQ ID NO: 8209482 - DNA, 21 bp, Homo sapiens
gtagatttggcccaaagccat

SEQ ID NO: 8209483 - DNA, 22 bp, Homo sapiens
gtagcccacctggggagggcga

SEQ ID NO: 8209484 - DNA, 22 bp, Homo sapiens
gtagcccacctggggagggcga

SEQ ID NO: 8209485 - DNA, 22 bp, Homo sapiens
gtagcccacctggggagggcga

SEQ ID NO: 8209486 - DNA, 22 bp, Homo sapiens
gtagccagatctgctgtgtctg

SEQ ID NO: 8209487 - DNA, 22 bp, Homo sapiens
gtagcccacctggggagggcga

SEQ ID NO: 8209488 - DNA, 22 bp, Homo sapiens
gtagcccacctggggagggcga

SEQ ID NO: 8209489 - DNA, 22 bp, Homo sapiens
gtagcaggtattctggtgtgag

SEQ ID NO: 8209490 - DNA, 22 bp, Homo sapiens
gtagcaggtattctggtgtgag

SEQ ID NO: 8209491 - DNA, 22 bp, Homo sapiens
gtagccattggcaatgaagcct

SEQ ID NO: 8209492 - DNA, 22 bp, Homo sapiens
gtagcagctctgagcatgctgc

SEQ ID NO: 8209493 - DNA, 22 bp, Homo sapiens
gtagactgatgggactgaggta

SEQ ID NO: 8209494 - DNA, 22 bp, Homo sapiens
gtagaggacatttgacatgatg

SEQ ID NO: 8209495 - DNA, 22 bp, Homo sapiens
gtagaggctgaaatctgagggc

SEQ ID NO: 8209496 - DNA, 22 bp, Homo sapiens
gtagatattaaaaatggcagtg

SEQ ID NO: 8209497 - DNA, 22 bp, Homo sapiens
gtagatcatgagaatgtttttg

SEQ ID NO: 8209498 - DNA, 22 bp, Homo sapiens
gtagatgagctcacatgacctt

SEQ ID NO: 8209499 - DNA, 22 bp, Homo sapiens
gtagatggaggggctgcagggc

SEQ ID NO: 8209500 - DNA, 22 bp, Homo sapiens
gtcaacataggcctcagtgagg

SEQ ID NO: 8209501 - DNA, 17 bp, Homo sapiens
gtcaacaggatttcttt

SEQ ID NO: 8209502 - DNA, 21 bp, Homo sapiens
gtcaactggaagggcagggat

SEQ ID NO: 8209503 - DNA, 22 bp, Homo sapiens
gtcaagcagaagataatttaaa

SEQ ID NO: 8209504 - DNA, 22 bp, Homo sapiens
gtcaagcagaagataatttaaa

SEQ ID NO: 8209505 - DNA, 22 bp, Homo sapiens
gtcaaggcatctctagagcaat

SEQ ID NO: 8209506 - DNA, 22 bp, Homo sapiens
gtcaaggcattaaaaaggaata

SEQ ID NO: 8209507 - DNA, 22 bp, Homo sapiens
gtcaataattgatagatattgg

SEQ ID NO: 8209508 - DNA, 22 bp, Homo sapiens
gtcaataattttatggagagaa

SEQ ID NO: 8209509 - DNA, 22 bp, Homo sapiens
gtcaataattgatagatattgg

SEQ ID NO: 8209510 - DNA, 17 bp, Homo sapiens
gtcaacaggatttcttt

SEQ ID NO: 8209511 - DNA, 22 bp, Homo sapiens
gtaggaaatcaggggtttaagc

SEQ ID NO: 8209512 - DNA, 22 bp, Homo sapiens
gtaggaaagggagtgaagggaa

SEQ ID NO: 8209513 - DNA, 22 bp, Homo sapiens
gtagctttatagtgaataaacc

SEQ ID NO: 8209514 - DNA, 22 bp, Homo sapiens
gtagctttaaagactggctgat

SEQ ID NO: 8209515 - DNA, 22 bp, Homo sapiens
gtaggaaagggagtgaagggaa

SEQ ID NO: 8209516 - DNA, 22 bp, Homo sapiens
gtaggaaagtaaatgaaataca

SEQ ID NO: 8209517 - DNA, 22 bp, Homo sapiens
gtaggaaagggagtgaagggaa

SEQ ID NO: 8209518 - DNA, 22 bp, Homo sapiens
gtagctctgtttaaagttcttt

SEQ ID NO: 8209519 - DNA, 22 bp, Homo sapiens
gtagctgcctttctggcccagg

SEQ ID NO: 8209520 - DNA, 22 bp, Homo sapiens
gtagctctgtttaaagttcttt

SEQ ID NO: 8209521 - DNA, 22 bp, Homo sapiens
gtagctctgtttaaagttcttt

SEQ ID NO: 8209522 - DNA, 22 bp, Homo sapiens
gtagctctgtttaaagttcttt

SEQ ID NO: 8209523 - DNA, 22 bp, Homo sapiens
gtagctatttatgatactcatg

SEQ ID NO: 8209524 - DNA, 22 bp, Homo sapiens
gtaaatcataaaatttgagctc

SEQ ID NO: 8209525 - DNA, 22 bp, Homo sapiens
gtaaatgccacttaatgtaaag

SEQ ID NO: 8209526 - DNA, 22 bp, Homo sapiens
gtaaatgagtcaaatgggggaa

SEQ ID NO: 8209527 - DNA, 22 bp, Homo sapiens
gtaaatcatggtcagaataaat

SEQ ID NO: 8209528 - DNA, 22 bp, Homo sapiens
gtaaatgctagccctttaaagt

SEQ ID NO: 8209529 - DNA, 22 bp, Homo sapiens
gtaaatgcgattgactgatgga

SEQ ID NO: 8209530 - DNA, 22 bp, Homo sapiens
gtaaatttcccgggccatttaa

SEQ ID NO: 8209531 - DNA, 22 bp, Homo sapiens
gtaacaaaggataacttggttt

SEQ ID NO: 8209532 - DNA, 22 bp, Homo sapiens
gtaacaaaggataacttggttt

SEQ ID NO: 8209533 - DNA, 22 bp, Homo sapiens
gtaacaaaggataacttggttt

SEQ ID NO: 8209534 - DNA, 22 bp, Homo sapiens
ggtgggcagctcttggcaggca

SEQ ID NO: 8209535 - DNA, 22 bp, Homo sapiens
ggtgggcacccgagactggatc

SEQ ID NO: 8209536 - DNA, 22 bp, Homo sapiens
ggtgggcagctcttggcaggca

SEQ ID NO: 8209537 - DNA, 22 bp, Homo sapiens
ggtgggcacattcagtctctgt

SEQ ID NO: 8209538 - DNA, 22 bp, Homo sapiens
ggtgggcacccgagactggatc

SEQ ID NO: 8209539 - DNA, 22 bp, Homo sapiens
ggtgggcaggcgaggcccaggt

SEQ ID NO: 8209540 - DNA, 22 bp, Homo sapiens
ggtgggcagctcttggcaggca

SEQ ID NO: 8209541 - DNA, 22 bp, Homo sapiens
ggtgggcagctcttggcaggca

SEQ ID NO: 8209542 - DNA, 22 bp, Homo sapiens
gtaaatcagtgtcattttagaa

SEQ ID NO: 8209543 - DNA, 22 bp, Homo sapiens
gtaaatattccctcggttccta

SEQ ID NO: 8209544 - DNA, 22 bp, Homo sapiens
gtaaatattccctcggttccta

SEQ ID NO: 8209545 - DNA, 22 bp, Homo sapiens
gtaaatattccctcggttccta

SEQ ID NO: 8209546 - DNA, 22 bp, Homo sapiens
gtaatagtctcaaactcctgga

SEQ ID NO: 8209547 - DNA, 22 bp, Homo sapiens
gtaatagtctcaaactcctgga

SEQ ID NO: 8209548 - DNA, 17 bp, Homo sapiens
gtaatataataagcctt

SEQ ID NO: 8209549 - DNA, 22 bp, Homo sapiens
gtaataatggtccccaaacact

SEQ ID NO: 8209550 - DNA, 22 bp, Homo sapiens
gtaatctcagctacttgggagg

SEQ ID NO: 8209551 - DNA, 22 bp, Homo sapiens
gtaatctcagctacttgggagg

SEQ ID NO: 8209552 - DNA, 22 bp, Homo sapiens
gtaatccaaagtaacattaaac

SEQ ID NO: 8209553 - DNA, 22 bp, Homo sapiens
gtaacaaagtttctaggtgctg

SEQ ID NO: 8209554 - DNA, 22 bp, Homo sapiens
gtaacactagctctgtcacttt

SEQ ID NO: 8209555 - DNA, 22 bp, Homo sapiens
gtaacaggcaatacaactctct

SEQ ID NO: 8209556 - DNA, 22 bp, Homo sapiens
gtaacagaaagtcatgctcatt

SEQ ID NO: 8209557 - DNA, 22 bp, Homo sapiens
gtcacagtgctcccaaagtttg

SEQ ID NO: 8209558 - DNA, 22 bp, Homo sapiens
gtcacaggtgtggaggtgctgg

SEQ ID NO: 8209559 - DNA, 22 bp, Homo sapiens
gtcaatgaccctatgtggatgg

SEQ ID NO: 8209560 - DNA, 22 bp, Homo sapiens
gtcacagtgtatctcttcagct

SEQ ID NO: 8209561 - DNA, 22 bp, Homo sapiens
gtcacatgccagtgcacacagg

SEQ ID NO: 8209562 - DNA, 22 bp, Homo sapiens
gtcacagtgtatctcttcagct

SEQ ID NO: 8209563 - DNA, 22 bp, Homo sapiens
gtcacagtggggtcacagtgtg

SEQ ID NO: 8209564 - DNA, 22 bp, Homo sapiens
gtcacagtggggtcacagtgtg

SEQ ID NO: 8209565 - DNA, 23 bp, Homo sapiens
gtcacagtgggtggtgcctacat

SEQ ID NO: 8209566 - DNA, 22 bp, Homo sapiens
gtcacattcatgcagaatcaaa

SEQ ID NO: 8209567 - DNA, 22 bp, Homo sapiens
gtcaccagcaccaatgccacat

SEQ ID NO: 8209568 - DNA, 22 bp, Homo sapiens
gtcacatggaattgactagagt

SEQ ID NO: 8209569 - DNA, 23 bp, Homo sapiens
gtcagggcagctcccagcccaac

SEQ ID NO: 8209570 - DNA, 22 bp, Homo sapiens
gtcagggcacagtgacagctcc

SEQ ID NO: 8209571 - DNA, 22 bp, Homo sapiens
gtcagggctccactcaccctcc

SEQ ID NO: 8209572 - DNA, 21 bp, Homo sapiens
gtcagggattcaagtgctcac

SEQ ID NO: 8209573 - DNA, 22 bp, Homo sapiens
gtcagggatccactgctcttct

SEQ ID NO: 8209574 - DNA, 21 bp, Homo sapiens
gtcagggattcaagtgctcac

SEQ ID NO: 8209575 - DNA, 22 bp, Homo sapiens
gtcaccagtgctaagaggtgga

SEQ ID NO: 8209576 - DNA, 22 bp, Homo sapiens
gtcaccaggtctgatgcagcca

SEQ ID NO: 8209577 - DNA, 22 bp, Homo sapiens
gtcaccaggtctgatgcagcca

SEQ ID NO: 8209578 - DNA, 23 bp, Homo sapiens
gtcagtgctttagttcaggatgg

SEQ ID NO: 8209579 - DNA, 22 bp, Homo sapiens
gtcagtgtaggttcatcagtgg

SEQ ID NO: 8209580 - DNA, 22 bp, Homo sapiens
gtcagtgtcttaacagagatta

SEQ ID NO: 8209581 - DNA, 22 bp, Homo sapiens
gtcagtgtcttaacagagatta

SEQ ID NO: 8209582 - DNA, 20 bp, Homo sapiens
gtcagtgtcttcagtagtga

SEQ ID NO: 8209583 - DNA, 20 bp, Homo sapiens
gtcagtgtcttcagtagtga

SEQ ID NO: 8209584 - DNA, 21 bp, Homo sapiens
gtcagtgctgaaacaccttcc

SEQ ID NO: 8209585 - DNA, 22 bp, Homo sapiens
gtcagtctgcctgagcttgttt

SEQ ID NO: 8209586 - DNA, 22 bp, Homo sapiens
gtcagtgcttgaagggcagaga

SEQ ID NO: 8209587 - DNA, 22 bp, Homo sapiens
gtcagtgccaccagccactgcc

SEQ ID NO: 8209588 - DNA, 17 bp, Homo sapiens
gtcagtctcccactgcc

SEQ ID NO: 8209589 - DNA, 22 bp, Homo sapiens
gtcagtaggaacctagggtcaa

SEQ ID NO: 8209590 - DNA, 22 bp, Homo sapiens
gtcagtaggaacctagggtcaa

SEQ ID NO: 8209591 - DNA, 23 bp, Homo sapiens
gtcagggctggggtcagagtgac

SEQ ID NO: 8209592 - DNA, 23 bp, Homo sapiens
gtcagggctggggtcagagtgac

SEQ ID NO: 8209593 - DNA, 19 bp, Homo sapiens
gtcaggtcgttcctgccgg

SEQ ID NO: 8209594 - DNA, 23 bp, Homo sapiens
gtcaggtcattagaggtgacttc

SEQ ID NO: 8209595 - DNA, 22 bp, Homo sapiens
gtcaggtcttggaagataggct

SEQ ID NO: 8209596 - DNA, 22 bp, Homo sapiens
gtcaggtcttggaagataggct

SEQ ID NO: 8209597 - DNA, 22 bp, Homo sapiens
gtcagtaggaacctagggtcaa

SEQ ID NO: 8209598 - DNA, 22 bp, Homo sapiens
gtcaggtggctggtgattcaac

SEQ ID NO: 8209599 - DNA, 22 bp, Homo sapiens
gtcattcaaactgtatcacttg

SEQ ID NO: 8209600 - DNA, 22 bp, Homo sapiens
gtcattatttaatgtaggctaa

SEQ ID NO: 8209601 - DNA, 22 bp, Homo sapiens
gtcattcagagatgcaggtaga

SEQ ID NO: 8209602 - DNA, 22 bp, Homo sapiens
gtcattcaaactgtatcacttg

SEQ ID NO: 8209603 - DNA, 22 bp, Homo sapiens
gtcattccttatgttgattcag

SEQ ID NO: 8209604 - DNA, 17 bp, Homo sapiens
gtcattctcagaaaatg

SEQ ID NO: 8209605 - DNA, 22 bp, Homo sapiens
gtcattcctatccatttgatac

SEQ ID NO: 8209606 - DNA, 22 bp, Homo sapiens
gtcataaaatttgtggattaga

SEQ ID NO: 8209607 - DNA, 22 bp, Homo sapiens
gtcagtttgactcagtgttata

SEQ ID NO: 8209608 - DNA, 22 bp, Homo sapiens
gtcagtttgactcagtgttata

SEQ ID NO: 8209609 - DNA, 22 bp, Homo sapiens
gtcagttcattagcacttccaa

SEQ ID NO: 8209610 - DNA, 22 bp, Homo sapiens
gtcagtgttataagtttagcca

SEQ ID NO: 8209611 - DNA, 22 bp, Homo sapiens
gtcctctgcccaggtcaaggtt

SEQ ID NO: 8209612 - DNA, 19 bp, Homo sapiens
gtcctctcaacaacccggg

SEQ ID NO: 8209613 - DNA, 22 bp, Homo sapiens
gtcctctgactcagccttggga

SEQ ID NO: 8209614 - DNA, 22 bp, Homo sapiens
gtcctctgactcagccttggga

SEQ ID NO: 8209615 - DNA, 22 bp, Homo sapiens
gtcctctgagggggctgcacgc

SEQ ID NO: 8209616 - DNA, 22 bp, Homo sapiens
gtcctctgagggggctgcacgc

SEQ ID NO: 8209617 - DNA, 22 bp, Homo sapiens
gtcctctccaggaggctctgat

SEQ ID NO: 8209618 - DNA, 22 bp, Homo sapiens
gtcctccatggtcttgaagtaa

SEQ ID NO: 8209619 - DNA, 22 bp, Homo sapiens
gtcctcagtcagtttggtgggg

SEQ ID NO: 8209620 - DNA, 19 bp, Homo sapiens
gtcctcatgttgttctcca

SEQ ID NO: 8209621 - DNA, 22 bp, Homo sapiens
gtcctctccaggaggctctgat

SEQ ID NO: 8209622 - DNA, 22 bp, Homo sapiens
gtcctctgactcagccttggga

SEQ ID NO: 8209623 - DNA, 22 bp, Homo sapiens
gtcctctgaaagatgaaccatg

SEQ ID NO: 8209624 - DNA, 22 bp, Homo sapiens
gtctccccagggccctcttcat

SEQ ID NO: 8209625 - DNA, 22 bp, Homo sapiens
gtctccccagggccctcttcat

SEQ ID NO: 8209626 - DNA, 22 bp, Homo sapiens
gtctcctcttcatatacctgtt

SEQ ID NO: 8209627 - DNA, 22 bp, Homo sapiens
gtctcccagcctacatctttct

SEQ ID NO: 8209628 - DNA, 22 bp, Homo sapiens
gtctcccatcgtttgtgaggaa

SEQ ID NO: 8209629 - DNA, 22 bp, Homo sapiens
gtcctctgcttcatgccctgat

SEQ ID NO: 8209630 - DNA, 22 bp, Homo sapiens
gtcatttaaaagggaacacatg

SEQ ID NO: 8209631 - DNA, 22 bp, Homo sapiens
gtcatttaaagaccattgtggg

SEQ ID NO: 8209632 - DNA, 22 bp, Homo sapiens
gtcatttatcatcagaagtcat

SEQ ID NO: 8209633 - DNA, 22 bp, Homo sapiens
gtcatttatcatcagaagtcat

SEQ ID NO: 8209634 - DNA, 22 bp, Homo sapiens
gtcatttatcatcagaagtcat

SEQ ID NO: 8209635 - DNA, 22 bp, Homo sapiens
gtcatttaggtctgtcagaaat

SEQ ID NO: 8209636 - DNA, 22 bp, Homo sapiens
gtcatttaggtctgtcagaaat

SEQ ID NO: 8209637 - DNA, 22 bp, Homo sapiens
gtccctggagctgagcagtgct

SEQ ID NO: 8209638 - DNA, 22 bp, Homo sapiens
gtccctggatctgggacagctg

SEQ ID NO: 8209639 - DNA, 22 bp, Homo sapiens
gtcattttatgggaacagattt

SEQ ID NO: 8209640 - DNA, 22 bp, Homo sapiens
gtcattttatgggaacagattt

SEQ ID NO: 8209641 - DNA, 22 bp, Homo sapiens
gtccctggagctgagcagtgct

SEQ ID NO: 8209642 - DNA, 22 bp, Homo sapiens
gtcctcagcaccagaactaggg

SEQ ID NO: 8209643 - DNA, 22 bp, Homo sapiens
gtcctcagcaccagaactaggg

SEQ ID NO: 8209644 - DNA, 22 bp, Homo sapiens
gtcctcagaagcctgcttagct

SEQ ID NO: 8209645 - DNA, 22 bp, Homo sapiens
gtcctcagagtgggcaggtcct

SEQ ID NO: 8209646 - DNA, 21 bp, Homo sapiens
gtcctcacgctccggcctccc

SEQ ID NO: 8209647 - DNA, 22 bp, Homo sapiens
gtcctcaggcttgagtgtttat

SEQ ID NO: 8209648 - DNA, 22 bp, Homo sapiens
gtcctcaggaaagcagataaca

SEQ ID NO: 8209649 - DNA, 22 bp, Homo sapiens
gtcctcaggaaagcagataaca

SEQ ID NO: 8209650 - DNA, 22 bp, Homo sapiens
gtcctcagggaatgtggcgggt

SEQ ID NO: 8209651 - DNA, 22 bp, Homo sapiens
gtcctcagtaagagggcctctg

SEQ ID NO: 8209652 - DNA, 22 bp, Homo sapiens
gtgctgggccctgagaccaggg

SEQ ID NO: 8209653 - DNA, 22 bp, Homo sapiens
gtgctgggctccaccccagagg

SEQ ID NO: 8209654 - DNA, 22 bp, Homo sapiens
gtgctgggattacaggtgtgag

SEQ ID NO: 8209655 - DNA, 22 bp, Homo sapiens
gtgctgggattacaggtgtgag

SEQ ID NO: 8209656 - DNA, 22 bp, Homo sapiens
gtgctgggattacaggtgtgag

SEQ ID NO: 8209657 - DNA, 22 bp, Homo sapiens
gtgctgggattacaggtgtgag

SEQ ID NO: 8209658 - DNA, 22 bp, Homo sapiens
gtgctgggccctgagaccaggg

SEQ ID NO: 8209659 - DNA, 22 bp, Homo sapiens
gtgctgggggtttctgtaggtc

SEQ ID NO: 8209660 - DNA, 22 bp, Homo sapiens
gtgctgggggtttctgtaggtc

SEQ ID NO: 8209661 - DNA, 22 bp, Homo sapiens
gtgctgggggtttctgtaggtc

SEQ ID NO: 8209662 - DNA, 22 bp, Homo sapiens
gtgctgggggtttctgtaggtc

SEQ ID NO: 8209663 - DNA, 22 bp, Homo sapiens
gtgctgggggtttctgtaggtc

SEQ ID NO: 8209664 - DNA, 22 bp, Homo sapiens
gtgctggggagataggaagaga

SEQ ID NO: 8209665 - DNA, 22 bp, Homo sapiens
gtgctggggagataggaagaga

SEQ ID NO: 8209666 - DNA, 22 bp, Homo sapiens
gtgctggggagataggaagaga

SEQ ID NO: 8209667 - DNA, 22 bp, Homo sapiens
gtgctggggagataggaagaga

SEQ ID NO: 8209668 - DNA, 22 bp, Homo sapiens
gtgctgggtgctgcagacaggt

SEQ ID NO: 8209669 - DNA, 22 bp, Homo sapiens
gtgctgggtgctgcagacaggt

SEQ ID NO: 8209670 - DNA, 22 bp, Homo sapiens
gtgctgggggtttctgtaggtc

SEQ ID NO: 8209671 - DNA, 22 bp, Homo sapiens
gtgctggtatatgactgagttt

SEQ ID NO: 8209672 - DNA, 22 bp, Homo sapiens
gtgctgggtgctgcagacaggt

SEQ ID NO: 8209673 - DNA, 22 bp, Homo sapiens
gtgctgtaacaacagagtgtct

SEQ ID NO: 8209674 - DNA, 22 bp, Homo sapiens
gtgctgtattgagacaaggtcg

SEQ ID NO: 8209675 - DNA, 22 bp, Homo sapiens
gtgctgtatcagtacatattga

SEQ ID NO: 8209676 - DNA, 23 bp, Homo sapiens
gtgctgtgagccccttggcctcc

SEQ ID NO: 8209677 - DNA, 23 bp, Homo sapiens
gtgctgtgagccccttggcctcc

SEQ ID NO: 8209678 - DNA, 23 bp, Homo sapiens
gtgcttgaaagatgcagaattaa

SEQ ID NO: 8209679 - DNA, 22 bp, Homo sapiens
gtgcttggaccaggtcatcttc

SEQ ID NO: 8209680 - DNA, 22 bp, Homo sapiens
gtgcttgggggaagtaacagac

SEQ ID NO: 8209681 - DNA, 22 bp, Homo sapiens
gtgccctgttgcacacttgagg

SEQ ID NO: 8209682 - DNA, 23 bp, Homo sapiens
gtgccgacgctccagcaccatcc

SEQ ID NO: 8209683 - DNA, 22 bp, Homo sapiens
gtgccctgttcatttctctccc

SEQ ID NO: 8209684 - DNA, 22 bp, Homo sapiens
gtgccctgttcatttctctccc

SEQ ID NO: 8209685 - DNA, 22 bp, Homo sapiens
gtgccctgtgaactgtaaggaa

SEQ ID NO: 8209686 - DNA, 22 bp, Homo sapiens
gtgccctgtctcttgtctccag

SEQ ID NO: 8209687 - DNA, 22 bp, Homo sapiens
gtgccctgtctcttgtctccag

SEQ ID NO: 8209688 - DNA, 22 bp, Homo sapiens
gtgccctggctcacagtgtctc

SEQ ID NO: 8209689 - DNA, 22 bp, Homo sapiens
gtgccctggctcacagtgtctc

SEQ ID NO: 8209690 - DNA, 22 bp, Homo sapiens
gtgccctggctcacagtgtctc

SEQ ID NO: 8209691 - DNA, 22 bp, Homo sapiens
gtgccctggctcacagtgtctc

SEQ ID NO: 8209692 - DNA, 22 bp, Homo sapiens
gtgccctggatgactttggtct

SEQ ID NO: 8209693 - DNA, 22 bp, Homo sapiens
gtgccctggtccccagcatata

SEQ ID NO: 8209694 - DNA, 22 bp, Homo sapiens
gtgccctggtccccagcatata

SEQ ID NO: 8209695 - DNA, 22 bp, Homo sapiens
gtgccctggggtgaacccctgg

SEQ ID NO: 8209696 - DNA, 22 bp, Homo sapiens
gtgccctgggccttcagggcca

SEQ ID NO: 8209697 - DNA, 22 bp, Homo sapiens
gtgccctggtccccagcatata

SEQ ID NO: 8209698 - DNA, 22 bp, Homo sapiens
gtgccctggtccccagcatata

SEQ ID NO: 8209699 - DNA, 22 bp, Homo sapiens
gtgccctggtccccagcatata

SEQ ID NO: 8209700 - DNA, 22 bp, Homo sapiens
gtgccctggtccccagcatata

SEQ ID NO: 8209701 - DNA, 22 bp, Homo sapiens
gtgcctctcagctgttcacaat

SEQ ID NO: 8209702 - DNA, 22 bp, Homo sapiens
gtgcctctcattggctgagccc

SEQ ID NO: 8209703 - DNA, 22 bp, Homo sapiens
gtgcctgagccagctgcagctc

SEQ ID NO: 8209704 - DNA, 22 bp, Homo sapiens
gtgcctgaaagccatgctcact

SEQ ID NO: 8209705 - DNA, 22 bp, Homo sapiens
gtgctgggattacaggtgtgag

SEQ ID NO: 8209706 - DNA, 22 bp, Homo sapiens
gtgcctgaaagccatgctcact

SEQ ID NO: 8209707 - DNA, 22 bp, Homo sapiens
gtgcctctgaccggagaccagg

SEQ ID NO: 8209708 - DNA, 22 bp, Homo sapiens
gtgcctctgagctctgctacag

SEQ ID NO: 8209709 - DNA, 22 bp, Homo sapiens
gtgcctcagcaccgcctgcagc

SEQ ID NO: 8209710 - DNA, 22 bp, Homo sapiens
gtgcctcagcaccgcctgcagc

SEQ ID NO: 8209711 - DNA, 22 bp, Homo sapiens
gtgcctcagcaccgcctgcagc

SEQ ID NO: 8209712 - DNA, 22 bp, Homo sapiens
gtgcaatattgccatgttcttg

SEQ ID NO: 8209713 - DNA, 18 bp, Homo sapiens
gtgcaatgaatagcagag

SEQ ID NO: 8209714 - DNA, 22 bp, Homo sapiens
gtgcaattcactgttatgtctg

SEQ ID NO: 8209715 - DNA, 22 bp, Homo sapiens
gtgcacacaagcaatgcactta

SEQ ID NO: 8209716 - DNA, 22 bp, Homo sapiens
gtgcaattttgcatctgtatgc

SEQ ID NO: 8209717 - DNA, 22 bp, Homo sapiens
gtgcacactcttggggcacttt

SEQ ID NO: 8209718 - DNA, 22 bp, Homo sapiens
gtgcacactcttggggcacttt

SEQ ID NO: 8209719 - DNA, 22 bp, Homo sapiens
gtgcacacatacatgaacgctg

SEQ ID NO: 8209720 - DNA, 22 bp, Homo sapiens
gtgcaaatgtaattgtggtttt

SEQ ID NO: 8209721 - DNA, 22 bp, Homo sapiens
gtgcaaattccactggaaagct

SEQ ID NO: 8209722 - DNA, 17 bp, Homo sapiens
gtgcaactactggaaga

SEQ ID NO: 8209723 - DNA, 22 bp, Homo sapiens
gtgcaagaaggggagactgggt

SEQ ID NO: 8209724 - DNA, 22 bp, Homo sapiens
gtgcaactaaaaccattgatca

SEQ ID NO: 8209725 - DNA, 22 bp, Homo sapiens
gtgcaaattccactggaaagct

SEQ ID NO: 8209726 - DNA, 22 bp, Homo sapiens
gtgcaagaggacagtaagggtg

SEQ ID NO: 8209727 - DNA, 22 bp, Homo sapiens
gtgcaaggtacatccttgatgt

SEQ ID NO: 8209728 - DNA, 22 bp, Homo sapiens
gtgcaatagactgtggtattaa

SEQ ID NO: 8209729 - DNA, 22 bp, Homo sapiens
gtgcaataaataaatagattgt

SEQ ID NO: 8209730 - DNA, 22 bp, Homo sapiens
gtgcacagaaacatacaatgtg

SEQ ID NO: 8209731 - DNA, 22 bp, Homo sapiens
gtgcccaggggccagctgccgg

SEQ ID NO: 8209732 - DNA, 22 bp, Homo sapiens
gtgccctgagcttatgcattct

SEQ ID NO: 8209733 - DNA, 22 bp, Homo sapiens
gtgcccaggtgtccctgagaag

SEQ ID NO: 8209734 - DNA, 22 bp, Homo sapiens
gtgccctgcatgccccgggtat

SEQ ID NO: 8209735 - DNA, 22 bp, Homo sapiens
gtgccctgcatgccccgggtat

SEQ ID NO: 8209736 - DNA, 22 bp, Homo sapiens
gtgccctggaggggttgaaggg

SEQ ID NO: 8209737 - DNA, 22 bp, Homo sapiens
gtgccctgcatgccccgggtat

SEQ ID NO: 8209738 - DNA, 22 bp, Homo sapiens
gtgccctgagtgggtaggagag

SEQ ID NO: 8209739 - DNA, 22 bp, Homo sapiens
gtgccctgatcgctaggctccc

SEQ ID NO: 8209740 - DNA, 22 bp, Homo sapiens
gtgccctgatgcaattgtctca

SEQ ID NO: 8209741 - DNA, 22 bp, Homo sapiens
gtgccctgatcgctaggctccc

SEQ ID NO: 8209742 - DNA, 22 bp, Homo sapiens
gtgccctgatcgctaggctccc

SEQ ID NO: 8209743 - DNA, 22 bp, Homo sapiens
gtgattttgagacctatatagt

SEQ ID NO: 8209744 - DNA, 22 bp, Homo sapiens
gtgattttgagacctatatagt

SEQ ID NO: 8209745 - DNA, 22 bp, Homo sapiens
gtgattttcatgccctgctagg

SEQ ID NO: 8209746 - DNA, 22 bp, Homo sapiens
gtgattttctcctcctagaagt

SEQ ID NO: 8209747 - DNA, 22 bp, Homo sapiens
gtgattttgagacctatatagt

SEQ ID NO: 8209748 - DNA, 22 bp, Homo sapiens
gtgattttgagacctatatagt

SEQ ID NO: 8209749 - DNA, 22 bp, Homo sapiens
gtgattttgagacctatatagt

SEQ ID NO: 8209750 - DNA, 22 bp, Homo sapiens
gtgcaaaagcagttggattttt

SEQ ID NO: 8209751 - DNA, 22 bp, Homo sapiens
gtgcaaaagcaattgcagtttt

SEQ ID NO: 8209752 - DNA, 22 bp, Homo sapiens
gtgcaaaagcaattgcagtttt

SEQ ID NO: 8209753 - DNA, 22 bp, Homo sapiens
gtgcaaaaataattgtggtttt

SEQ ID NO: 8209754 - DNA, 22 bp, Homo sapiens
gtgcaaatgtaattgtgatttt

SEQ ID NO: 8209755 - DNA, 22 bp, Homo sapiens
gtgcaaatgtaattgccattga

SEQ ID NO: 8209756 - DNA, 22 bp, Homo sapiens
gtgcaaaagtaactgtggtttt

SEQ ID NO: 8209757 - DNA, 22 bp, Homo sapiens
gtgcaaaagtaaatgtggtttt

SEQ ID NO: 8209758 - DNA, 22 bp, Homo sapiens
gtgcaaaaggcattgtggtttt

SEQ ID NO: 8209759 - DNA, 22 bp, Homo sapiens
gtgcaaaagcagttgtggtttt

SEQ ID NO: 8209760 - DNA, 22 bp, Homo sapiens
gtgatttagtgagaggcagctg

SEQ ID NO: 8209761 - DNA, 22 bp, Homo sapiens
gtgatttagtgttaagtatgtt

SEQ ID NO: 8209762 - DNA, 22 bp, Homo sapiens
gtgatttagatgttgaaagtga

SEQ ID NO: 8209763 - DNA, 22 bp, Homo sapiens
gtgatttagatgttgaaagtga

SEQ ID NO: 8209764 - DNA, 22 bp, Homo sapiens
gtgattgtgaaaacattaagaa

SEQ ID NO: 8209765 - DNA, 22 bp, Homo sapiens
gtgattctgatatagctaaagt

SEQ ID NO: 8209766 - DNA, 22 bp, Homo sapiens
gtgattctttgatctatgaaag

SEQ ID NO: 8209767 - DNA, 22 bp, Homo sapiens
gtgattctgaaatattagaaaa

SEQ ID NO: 8209768 - DNA, 22 bp, Homo sapiens
gtgattcataaaacactagatg

SEQ ID NO: 8209769 - DNA, 22 bp, Homo sapiens
gtgattatatttctatgtgaat

SEQ ID NO: 8209770 - DNA, 22 bp, Homo sapiens
gtgattatagaatgctacaaag

SEQ ID NO: 8209771 - DNA, 22 bp, Homo sapiens
gtgattaagcatttcagaattt

SEQ ID NO: 8209772 - DNA, 22 bp, Homo sapiens
gtctctctcccaagattggcta

SEQ ID NO: 8209773 - DNA, 22 bp, Homo sapiens
gtctctctgactggtccacacc

SEQ ID NO: 8209774 - DNA, 22 bp, Homo sapiens
gtctctctgactggtccacacc

SEQ ID NO: 8209775 - DNA, 22 bp, Homo sapiens
gtctctctgctaggcctccagt

SEQ ID NO: 8209776 - DNA, 22 bp, Homo sapiens
gtctctgacctgcgtccctcct

SEQ ID NO: 8209777 - DNA, 22 bp, Homo sapiens
gtctctgacctgcgtccctcct

SEQ ID NO: 8209778 - DNA, 22 bp, Homo sapiens
gtctctctgctaggcctccagt

SEQ ID NO: 8209779 - DNA, 22 bp, Homo sapiens
gtctcctgtcctgcaggatgga

SEQ ID NO: 8209780 - DNA, 22 bp, Homo sapiens
gtctcctgtcctgcaggatgga

SEQ ID NO: 8209781 - DNA, 22 bp, Homo sapiens
gtctcctggcttttgtcccagt

SEQ ID NO: 8209782 - DNA, 23 bp, Homo sapiens
gtctctagagtgtggagcaaaga

SEQ ID NO: 8209783 - DNA, 22 bp, Homo sapiens
gtctcggttattcctcatttaa

SEQ ID NO: 8209784 - DNA, 22 bp, Homo sapiens
gtctcgttgctttataaataga

SEQ ID NO: 8209785 - DNA, 22 bp, Homo sapiens
gtctcgtcaatggcaggttccc

SEQ ID NO: 8209786 - DNA, 22 bp, Homo sapiens
gtctcctgagccttgactgcaa

SEQ ID NO: 8209787 - DNA, 22 bp, Homo sapiens
gtctcctgaggcatccattgaa

SEQ ID NO: 8209788 - DNA, 22 bp, Homo sapiens
gtctcctgagactgcagtcacc

SEQ ID NO: 8209789 - DNA, 22 bp, Homo sapiens
gtctcctgagactgcagtcacc

SEQ ID NO: 8209790 - DNA, 22 bp, Homo sapiens
gtctcctgagccttgactgcaa

SEQ ID NO: 8209791 - DNA, 22 bp, Homo sapiens
gtctcctgagactgcagtcacc

SEQ ID NO: 8209792 - DNA, 22 bp, Homo sapiens
gtctcctgagactgcagtcacc

SEQ ID NO: 8209793 - DNA, 20 bp, Homo sapiens
gtctcctctttgcattccta

SEQ ID NO: 8209794 - DNA, 22 bp, Homo sapiens
gtctcctgcccccggtgcttgg

SEQ ID NO: 8209795 - DNA, 22 bp, Homo sapiens
gtctcctgcccccggtgcttgg

SEQ ID NO: 8209796 - DNA, 22 bp, Homo sapiens
gtctcctgccacactcagtccc

SEQ ID NO: 8209797 - DNA, 22 bp, Homo sapiens
gtctcctgcccccggtgcttgg

SEQ ID NO: 8209798 - DNA, 22 bp, Homo sapiens
gtctcctggaaatatgcccata

SEQ ID NO: 8209799 - DNA, 22 bp, Homo sapiens
gtctcctggctgcagctaagac

SEQ ID NO: 8209800 - DNA, 22 bp, Homo sapiens
gtctcctggcctccagtttctc

SEQ ID NO: 8209801 - DNA, 22 bp, Homo sapiens
gtctgggtctccacagtcagca

SEQ ID NO: 8209802 - DNA, 22 bp, Homo sapiens
gtctggtgggattccaagtggc

SEQ ID NO: 8209803 - DNA, 22 bp, Homo sapiens
gtctgggtttcatgggcactgg

SEQ ID NO: 8209804 - DNA, 22 bp, Homo sapiens
gtcttattaaaaatctaatccc

SEQ ID NO: 8209805 - DNA, 22 bp, Homo sapiens
gtcttatagtacaatttgaagt

SEQ ID NO: 8209806 - DNA, 22 bp, Homo sapiens
gtcttattatgaggttagactt

SEQ ID NO: 8209807 - DNA, 22 bp, Homo sapiens
gtcttatttaaagagatcatac

SEQ ID NO: 8209808 - DNA, 22 bp, Homo sapiens
gtcttatttaaagagatcatac

SEQ ID NO: 8209809 - DNA, 22 bp, Homo sapiens
gtcttattaaaatgcagtttct

SEQ ID NO: 8209810 - DNA, 22 bp, Homo sapiens
gtcttctgatctggttagccat

SEQ ID NO: 8209811 - DNA, 19 bp, Homo sapiens
gtcttctgaatgtggctgc

SEQ ID NO: 8209812 - DNA, 22 bp, Homo sapiens
gtcttcatcgggggaatagaaa

SEQ ID NO: 8209813 - DNA, 22 bp, Homo sapiens
gtcttcattcaacaaatattca

SEQ ID NO: 8209814 - DNA, 22 bp, Homo sapiens
gtcttcagtggcaaatggatct

SEQ ID NO: 8209815 - DNA, 20 bp, Homo sapiens
gtcttcataatgaccttatt

SEQ ID NO: 8209816 - DNA, 22 bp, Homo sapiens
gtcttcaggacccggaattttg

SEQ ID NO: 8209817 - DNA, 22 bp, Homo sapiens
gtcttcaggacctggaattttg

SEQ ID NO: 8209818 - DNA, 22 bp, Homo sapiens
gtcttatttaaggacaagaaga

SEQ ID NO: 8209819 - DNA, 22 bp, Homo sapiens
gtcttatttaacctaaatttct

SEQ ID NO: 8209820 - DNA, 22 bp, Homo sapiens
gtcttcaactggactccaggga

SEQ ID NO: 8209821 - DNA, 22 bp, Homo sapiens
gtcttctgttctgtgaggcttc

SEQ ID NO: 8209822 - DNA, 20 bp, Homo sapiens
gtcttgaaggggtcatggag

SEQ ID NO: 8209823 - DNA, 22 bp, Homo sapiens
gtcttgaaattctgttaaagga

SEQ ID NO: 8209824 - DNA, 20 bp, Homo sapiens
gtcttgaaggggtcatggag

SEQ ID NO: 8209825 - DNA, 22 bp, Homo sapiens
gtcttctggaagagagccagct

SEQ ID NO: 8209826 - DNA, 22 bp, Homo sapiens
gtcttctgtctgtctggcatgt

SEQ ID NO: 8209827 - DNA, 22 bp, Homo sapiens
gtcttctgtaagatgaggtccc

SEQ ID NO: 8209828 - DNA, 22 bp, Homo sapiens
gtcttctgttctgtgaggcttc

SEQ ID NO: 8209829 - DNA, 22 bp, Homo sapiens
gtcttctgttctgtgaggcttc

SEQ ID NO: 8209830 - DNA, 22 bp, Homo sapiens
gtcttctgttctgtgaggcttc

SEQ ID NO: 8209831 - DNA, 22 bp, Homo sapiens
gtgaggccgcacgccccggagt

SEQ ID NO: 8209832 - DNA, 22 bp, Homo sapiens
gtgaggcattgaagaccggaat

SEQ ID NO: 8209833 - DNA, 22 bp, Homo sapiens
gtgaggcagggaaagaggataa

SEQ ID NO: 8209834 - DNA, 22 bp, Homo sapiens
gtgaggtcaccggccgttgcca

SEQ ID NO: 8209835 - DNA, 22 bp, Homo sapiens
gtgaggtcatatagcgaactcc

SEQ ID NO: 8209836 - DNA, 16 bp, Homo sapiens
gtgagggacatagctt

SEQ ID NO: 8209837 - DNA, 22 bp, Homo sapiens
gtgaggtcctaatagacatcga

SEQ ID NO: 8209838 - DNA, 22 bp, Homo sapiens
gtgaggtccagtaacttgtcca

SEQ ID NO: 8209839 - DNA, 22 bp, Homo sapiens
gtgaggtcatatagcgaactcc

SEQ ID NO: 8209840 - DNA, 22 bp, Homo sapiens
gtgaggtccatgttaatgggtt

SEQ ID NO: 8209841 - DNA, 22 bp, Homo sapiens
gtgaggtccagtaacttgtcca

SEQ ID NO: 8209842 - DNA, 22 bp, Homo sapiens
gtgaggtccatgttaatgggtt

SEQ ID NO: 8209843 - DNA, 22 bp, Homo sapiens
gtgaggtggtacaatattaact

SEQ ID NO: 8209844 - DNA, 22 bp, Homo sapiens
gtgaggtggtacaatattaact

SEQ ID NO: 8209845 - DNA, 22 bp, Homo sapiens
gtgaggtgagtagtgagaagcc

SEQ ID NO: 8209846 - DNA, 22 bp, Homo sapiens
gtgaggtgagtagtgagaagcc

SEQ ID NO: 8209847 - DNA, 22 bp, Homo sapiens
gtgaggtgggctggccagagac

SEQ ID NO: 8209848 - DNA, 22 bp, Homo sapiens
gtgaggtcctccctgctgggag

SEQ ID NO: 8209849 - DNA, 22 bp, Homo sapiens
gtgaggtcctaatagacatcga

SEQ ID NO: 8209850 - DNA, 22 bp, Homo sapiens
gtgaggtcctgagaggcttgtg

SEQ ID NO: 8209851 - DNA, 19 bp, Homo sapiens
gtgaggtctttccttttgt

SEQ ID NO: 8209852 - DNA, 22 bp, Homo sapiens
gtgaggtctttgggaggtgatt

SEQ ID NO: 8209853 - DNA, 22 bp, Homo sapiens
gtgaggtcctccctgctgggag

SEQ ID NO: 8209854 - DNA, 22 bp, Homo sapiens
gtgaggtcctgagaggcttgtg

SEQ ID NO: 8209855 - DNA, 19 bp, Homo sapiens
gtgaggtctttccttttgt

SEQ ID NO: 8209856 - DNA, 22 bp, Homo sapiens
gtgaggtctttgggaggtgatt

SEQ ID NO: 8209857 - DNA, 22 bp, Homo sapiens
gtgagttattatttatgtaaac

SEQ ID NO: 8209858 - DNA, 22 bp, Homo sapiens
gtgagttgggggattagaagct

SEQ ID NO: 8209859 - DNA, 22 bp, Homo sapiens
gtgataaaatagaaacagtggt

SEQ ID NO: 8209860 - DNA, 22 bp, Homo sapiens
gtgataaaatagaaacagtggt

SEQ ID NO: 8209861 - DNA, 22 bp, Homo sapiens
gtgataaaatagaaacagtggt

SEQ ID NO: 8209862 - DNA, 22 bp, Homo sapiens
gtgataaaattcaaatagctct

SEQ ID NO: 8209863 - DNA, 22 bp, Homo sapiens
gtgataaaattcaaatagctct

SEQ ID NO: 8209864 - DNA, 22 bp, Homo sapiens
gtgataaaattcaaatagctct

SEQ ID NO: 8209865 - DNA, 22 bp, Homo sapiens
gtgataaagacgtgtcataatt

SEQ ID NO: 8209866 - DNA, 22 bp, Homo sapiens
gtgataaaggggaggaagtgtg

SEQ ID NO: 8209867 - DNA, 22 bp, Homo sapiens
gtgataaaggggaggaagtgtg

SEQ ID NO: 8209868 - DNA, 22 bp, Homo sapiens
gtgaggtggtacaatattaact

SEQ ID NO: 8209869 - DNA, 22 bp, Homo sapiens
gtgagtaaaggttcattgaatt

SEQ ID NO: 8209870 - DNA, 22 bp, Homo sapiens
gtgagtaaaggttcattgaatt

SEQ ID NO: 8209871 - DNA, 22 bp, Homo sapiens
gtgagtaaaggttcattgaatt

SEQ ID NO: 8209872 - DNA, 23 bp, Homo sapiens
gtgagtcttgcctttgctgtgga

SEQ ID NO: 8209873 - DNA, 22 bp, Homo sapiens
gtgattaactgcagttagagct

SEQ ID NO: 8209874 - DNA, 22 bp, Homo sapiens
gtgatgtcttgtacatatgatt

SEQ ID NO: 8209875 - DNA, 22 bp, Homo sapiens
gtgatgtcagacatctggtatt

SEQ ID NO: 8209876 - DNA, 22 bp, Homo sapiens
gtgatgtcagcaagaataggaa

SEQ ID NO: 8209877 - DNA, 22 bp, Homo sapiens
gtgatgtacttggaaaagtcct

SEQ ID NO: 8209878 - DNA, 22 bp, Homo sapiens
gtgatgtcacacccttgataga

SEQ ID NO: 8209879 - DNA, 22 bp, Homo sapiens
gtgatgtagccctaattctgca

SEQ ID NO: 8209880 - DNA, 22 bp, Homo sapiens
gtgatgggtaactgtttaggga

SEQ ID NO: 8209881 - DNA, 23 bp, Homo sapiens
gtgatattaaggatagagacaag

SEQ ID NO: 8209882 - DNA, 22 bp, Homo sapiens
gtgatatttttaaagattaagg

SEQ ID NO: 8209883 - DNA, 22 bp, Homo sapiens
gtgatcactgcttcttccacca

SEQ ID NO: 8209884 - DNA, 22 bp, Homo sapiens
gtgatgaagtaaatgttattta

SEQ ID NO: 8209885 - DNA, 23 bp, Homo sapiens
gtgatattaaggatagagacaag

SEQ ID NO: 8209886 - DNA, 22 bp, Homo sapiens
gtgataattgcagagaaaggag

SEQ ID NO: 8209887 - DNA, 18 bp, Homo sapiens
gggaatcagaatctcatt

SEQ ID NO: 8209888 - DNA, 21 bp, Homo sapiens
gggaatgagattcttggagat

SEQ ID NO: 8209889 - DNA, 22 bp, Homo sapiens
gggaatgagagtcagcccagga

SEQ ID NO: 8209890 - DNA, 22 bp, Homo sapiens
gggaatgaccttaataagtagg

SEQ ID NO: 8209891 - DNA, 22 bp, Homo sapiens
gggaatgaccttaataagtagg

SEQ ID NO: 8209892 - DNA, 21 bp, Homo sapiens
gggagctgacagcagcacggc

SEQ ID NO: 8209893 - DNA, 22 bp, Homo sapiens
gggaatgtaagatatatactag

SEQ ID NO: 8209894 - DNA, 19 bp, Homo sapiens
gggaatgatggaagacttc

SEQ ID NO: 8209895 - DNA, 22 bp, Homo sapiens
gggaatgaggcagatagataaa

SEQ ID NO: 8209896 - DNA, 21 bp, Homo sapiens
gggaatgagattcttggagat

SEQ ID NO: 8209897 - DNA, 23 bp, Homo sapiens
gggaagtggggatttgaagtcat

SEQ ID NO: 8209898 - DNA, 22 bp, Homo sapiens
gggaagtgtgcagagttctctt

SEQ ID NO: 8209899 - DNA, 17 bp, Homo sapiens
gggaagtggagaaagct

SEQ ID NO: 8209900 - DNA, 17 bp, Homo sapiens
gggaagtggagaaagct

SEQ ID NO: 8209901 - DNA, 17 bp, Homo sapiens
gggaagtggagaaagct

SEQ ID NO: 8209902 - DNA, 22 bp, Homo sapiens
gggaaggtatttagctgctgaa

SEQ ID NO: 8209903 - DNA, 22 bp, Homo sapiens
gggaagggtgttgtcttatctt

SEQ ID NO: 8209904 - DNA, 22 bp, Homo sapiens
gggaagggtgttgtcttatctt

SEQ ID NO: 8209905 - DNA, 22 bp, Homo sapiens
gggaagggtgttgtcttatctt

SEQ ID NO: 8209906 - DNA, 22 bp, Homo sapiens
gggaagggctccttttattgca

SEQ ID NO: 8209907 - DNA, 22 bp, Homo sapiens
gggaagggctccttttattgca

SEQ ID NO: 8209908 - DNA, 22 bp, Homo sapiens
gggaagggagggcctccagtca

SEQ ID NO: 8209909 - DNA, 22 bp, Homo sapiens
gggaagggagggcctccagtca

SEQ ID NO: 8209910 - DNA, 23 bp, Homo sapiens
gggaagtgaggagcccctctgcc

SEQ ID NO: 8209911 - DNA, 22 bp, Homo sapiens
gggaagtgaggagcccctctgc

SEQ ID NO: 8209912 - DNA, 22 bp, Homo sapiens
gggaagtgatggagccaggatt

SEQ ID NO: 8209913 - DNA, 22 bp, Homo sapiens
gggaagtgatggagccaggatt

SEQ ID NO: 8209914 - DNA, 23 bp, Homo sapiens
gggaagtgaggagcccctcagcc

SEQ ID NO: 8209915 - DNA, 22 bp, Homo sapiens
gggagctgagggacctctgtgg

SEQ ID NO: 8209916 - DNA, 22 bp, Homo sapiens
gggagctgaggagccccgtcgg

SEQ ID NO: 8209917 - DNA, 22 bp, Homo sapiens
gggagctgagggacctctgtgg

SEQ ID NO: 8209918 - DNA, 22 bp, Homo sapiens
gggagctgagggacctctgtgg

SEQ ID NO: 8209919 - DNA, 22 bp, Homo sapiens
gggagctgagggacctctgtgg

SEQ ID NO: 8209920 - DNA, 22 bp, Homo sapiens
gggagctgagggacctctgtgg

SEQ ID NO: 8209921 - DNA, 22 bp, Homo sapiens
gggagctgagctggaagagaat

SEQ ID NO: 8209922 - DNA, 22 bp, Homo sapiens
gggagctgagctggaagagaat

SEQ ID NO: 8209923 - DNA, 19 bp, Homo sapiens
gggagctgaggtctttggt

SEQ ID NO: 8209924 - DNA, 22 bp, Homo sapiens
gggagctggagctggaagactc

SEQ ID NO: 8209925 - DNA, 22 bp, Homo sapiens
gggagctggagctggaagactc

SEQ ID NO: 8209926 - DNA, 19 bp, Homo sapiens
gggagctgaggtctttggt

SEQ ID NO: 8209927 - DNA, 19 bp, Homo sapiens
gggagctgaggtctttggt

SEQ ID NO: 8209928 - DNA, 22 bp, Homo sapiens
gggagctggagctggaagactc

SEQ ID NO: 8209929 - DNA, 22 bp, Homo sapiens
gggagctggagctggaagactc

SEQ ID NO: 8209930 - DNA, 22 bp, Homo sapiens
gggagctggagctggaagactc

SEQ ID NO: 8209931 - DNA, 22 bp, Homo sapiens
gggagctggagctggaagactc

SEQ ID NO: 8209932 - DNA, 22 bp, Homo sapiens
gggagctggagctggaagactc

SEQ ID NO: 8209933 - DNA, 22 bp, Homo sapiens
gggagctggagctggaagactc

SEQ ID NO: 8209934 - DNA, 22 bp, Homo sapiens
gggagctgagctggaagagaat

SEQ ID NO: 8209935 - DNA, 22 bp, Homo sapiens
gggagctgagctggaagagaat

SEQ ID NO: 8209936 - DNA, 22 bp, Homo sapiens
gggagctgagctctgagccacg

SEQ ID NO: 8209937 - DNA, 22 bp, Homo sapiens
gggagctgagctctgagccacg

SEQ ID NO: 8209938 - DNA, 22 bp, Homo sapiens
gggagctgagctggaagagaat

SEQ ID NO: 8209939 - DNA, 22 bp, Homo sapiens
gggagctgagctggaagagaat

SEQ ID NO: 8209940 - DNA, 22 bp, Homo sapiens
gggagctgagctggaagagaat

SEQ ID NO: 8209941 - DNA, 22 bp, Homo sapiens
gggagctgagctggaagagaat

SEQ ID NO: 8209942 - DNA, 22 bp, Homo sapiens
gggagctgagctggaagagaat

SEQ ID NO: 8209943 - DNA, 22 bp, Homo sapiens
gggagctgacctgcaggttccc

SEQ ID NO: 8209944 - DNA, 22 bp, Homo sapiens
gggagctgacctgcaggttccc

SEQ ID NO: 8209945 - DNA, 22 bp, Homo sapiens
gggagctgagaaacaacattct

SEQ ID NO: 8209946 - DNA, 22 bp, Homo sapiens
gggagctgagctctgagccacg

SEQ ID NO: 8209947 - DNA, 21 bp, Homo sapiens
gggagctgacagcagcacggc

SEQ ID NO: 8209948 - DNA, 21 bp, Homo sapiens
gggagctgacagcagcacggc

SEQ ID NO: 8209949 - DNA, 21 bp, Homo sapiens
gggagctgacagcagcacggc

SEQ ID NO: 8209950 - DNA, 22 bp, Homo sapiens
gggagctgacctgcaggttccc

SEQ ID NO: 8209951 - DNA, 22 bp, Homo sapiens
gggagctgacctgcaggttccc

SEQ ID NO: 8209952 - DNA, 22 bp, Homo sapiens
gggaaggccttgtcagcggatt

SEQ ID NO: 8209953 - DNA, 22 bp, Homo sapiens
gggaaggctgcctgagggatgg

SEQ ID NO: 8209954 - DNA, 22 bp, Homo sapiens
gggaaggctgcctgagggatgg

SEQ ID NO: 8209955 - DNA, 22 bp, Homo sapiens
gggaaggctgcctgagggatgg

SEQ ID NO: 8209956 - DNA, 22 bp, Homo sapiens
gggaagggacttgtttaaggtc

SEQ ID NO: 8209957 - DNA, 22 bp, Homo sapiens
gggaagggacttgtttaaggtc

SEQ ID NO: 8209958 - DNA, 22 bp, Homo sapiens
gggaagggagctgggtatttag

SEQ ID NO: 8209959 - DNA, 22 bp, Homo sapiens
gggaagggacttgtttaaggtc

SEQ ID NO: 8209960 - DNA, 22 bp, Homo sapiens
gggaagggacttgtttaaggtc

SEQ ID NO: 8209961 - DNA, 22 bp, Homo sapiens
gggaagggagggacctcagtct

SEQ ID NO: 8209962 - DNA, 22 bp, Homo sapiens
gggaagggagggacctcagtct

SEQ ID NO: 8209963 - DNA, 22 bp, Homo sapiens
gggaagggagggacctcagtct

SEQ ID NO: 8209964 - DNA, 22 bp, Homo sapiens
gggaagggagggcctccagtca

SEQ ID NO: 8209965 - DNA, 22 bp, Homo sapiens
gggaagggagggcctccagtca

SEQ ID NO: 8209966 - DNA, 22 bp, Homo sapiens
gggaagggagggcctccagtca

SEQ ID NO: 8209967 - DNA, 22 bp, Homo sapiens
gggaagggagggcctccagtca

SEQ ID NO: 8209968 - DNA, 22 bp, Homo sapiens
gggaagggagggacctcagtct

SEQ ID NO: 8209969 - DNA, 22 bp, Homo sapiens
gggaagggagctgggtatttag

SEQ ID NO: 8209970 - DNA, 22 bp, Homo sapiens
gggaagggagggacctcagtct

SEQ ID NO: 8209971 - DNA, 22 bp, Homo sapiens
gggaagggagggacctcagtct

SEQ ID NO: 8209972 - DNA, 22 bp, Homo sapiens
ggctttgcagtcatgttttgct

SEQ ID NO: 8209973 - DNA, 22 bp, Homo sapiens
ggctttgcctggaatttccttg

SEQ ID NO: 8209974 - DNA, 22 bp, Homo sapiens
ggctttgacatgctgaattaaa

SEQ ID NO: 8209975 - DNA, 22 bp, Homo sapiens
ggctttgacatgctgaattaaa

SEQ ID NO: 8209976 - DNA, 22 bp, Homo sapiens
ggctttgatgtggtgtcaattt

SEQ ID NO: 8209977 - DNA, 22 bp, Homo sapiens
ggctttgaggatacagaggaaa

SEQ ID NO: 8209978 - DNA, 22 bp, Homo sapiens
ggctttctcacagcatggcagc

SEQ ID NO: 8209979 - DNA, 22 bp, Homo sapiens
ggctttctcacagcatggcagc

SEQ ID NO: 8209980 - DNA, 22 bp, Homo sapiens
ggctttctagatctagctctgt

SEQ ID NO: 8209981 - DNA, 22 bp, Homo sapiens
ggctttattttgcatgaatgct

SEQ ID NO: 8209982 - DNA, 22 bp, Homo sapiens
ggctttcaacacaggctttcct

SEQ ID NO: 8209983 - DNA, 22 bp, Homo sapiens
ggctttattaagcagggtaagt

SEQ ID NO: 8209984 - DNA, 22 bp, Homo sapiens
ggctttattaactcatccgtaa

SEQ ID NO: 8209985 - DNA, 22 bp, Homo sapiens
ggctttatgtttttcatgtggt

SEQ ID NO: 8209986 - DNA, 21 bp, Homo sapiens
ggctttatgctcacccagcct

SEQ ID NO: 8209987 - DNA, 21 bp, Homo sapiens
ggctttatgctcacccagcct

SEQ ID NO: 8209988 - DNA, 21 bp, Homo sapiens
ggctttatgctcacccagcct

SEQ ID NO: 8209989 - DNA, 22 bp, Homo sapiens
ggctttatttgcagccattgtt

SEQ ID NO: 8209990 - DNA, 22 bp, Homo sapiens
ggctttatttgcagccattgtt

SEQ ID NO: 8209991 - DNA, 22 bp, Homo sapiens
ggctttattttgcatgaatgct

SEQ ID NO: 8209992 - DNA, 22 bp, Homo sapiens
ggctttatttcactgtaccata

SEQ ID NO: 8209993 - DNA, 22 bp, Homo sapiens
ggctttatttcactgtaccata

SEQ ID NO: 8209994 - DNA, 22 bp, Homo sapiens
ggctttattatgtggccatgtg

SEQ ID NO: 8209995 - DNA, 22 bp, Homo sapiens
ggctttattatgtggccatgtg

SEQ ID NO: 8209996 - DNA, 22 bp, Homo sapiens
ggctttattatgtggccatgtg

SEQ ID NO: 8209997 - DNA, 22 bp, Homo sapiens
ggctttatcaaatgagaccctg

SEQ ID NO: 8209998 - DNA, 22 bp, Homo sapiens
ggctttatgcacagcagatggt

SEQ ID NO: 8209999 - DNA, 22 bp, Homo sapiens
ggctttatcaaatgagaccctg

SEQ ID NO: 8210000 - DNA, 22 bp, Homo sapiens
ggctttatcaaatgagaccctg

SEQ ID NO: 8210001 - DNA, 22 bp, Homo sapiens
ggctttatgcacagcagatggt

SEQ ID NO: 8210002 - DNA, 22 bp, Homo sapiens
ggctttatgcagggatagaaat

SEQ ID NO: 8210003 - DNA, 22 bp, Homo sapiens
ggctgtgcgggcagccgtggga

SEQ ID NO: 8210004 - DNA, 22 bp, Homo sapiens
ggctgtgcctctggcagcacat

SEQ ID NO: 8210005 - DNA, 22 bp, Homo sapiens
ggctttatattgtttgagcaga

SEQ ID NO: 8210006 - DNA, 20 bp, Homo sapiens
ggctgtgcccttccgtggcc

SEQ ID NO: 8210007 - DNA, 20 bp, Homo sapiens
ggctgtgcccttccgtggcc

SEQ ID NO: 8210008 - DNA, 22 bp, Homo sapiens
ggctgtgcctcaaggctactca

SEQ ID NO: 8210009 - DNA, 22 bp, Homo sapiens
gggagctggagttgtgttgcct

SEQ ID NO: 8210010 - DNA, 22 bp, Homo sapiens
gggagctggagttgtgttgcct

SEQ ID NO: 8210011 - DNA, 22 bp, Homo sapiens
gggagctggagttgtgttgcct

SEQ ID NO: 8210012 - DNA, 22 bp, Homo sapiens
gggagctggatcgcgcgcccgg

SEQ ID NO: 8210013 - DNA, 22 bp, Homo sapiens
gggagctggatcgcgcgcccgg

SEQ ID NO: 8210014 - DNA, 22 bp, Homo sapiens
gggagctggagctggaagactc

SEQ ID NO: 8210015 - DNA, 22 bp, Homo sapiens
gggagctggagctggaagactc

SEQ ID NO: 8210016 - DNA, 22 bp, Homo sapiens
gggagctggagctggaagactc

SEQ ID NO: 8210017 - DNA, 22 bp, Homo sapiens
gggagctggatgattgaggcaa

SEQ ID NO: 8210018 - DNA, 22 bp, Homo sapiens
gggagctggatgattgaggcaa

SEQ ID NO: 8210019 - DNA, 22 bp, Homo sapiens
gggagctggcctactattagat

SEQ ID NO: 8210020 - DNA, 22 bp, Homo sapiens
gggagctggcctactattagat

SEQ ID NO: 8210021 - DNA, 22 bp, Homo sapiens
gggagggatctgctaggcaatg

SEQ ID NO: 8210022 - DNA, 22 bp, Homo sapiens
gggagggatctgctaggcaatg

SEQ ID NO: 8210023 - DNA, 22 bp, Homo sapiens
gggagggaggtgctggttcacg

SEQ ID NO: 8210024 - DNA, 16 bp, Homo sapiens
gggagggagttggtgg

SEQ ID NO: 8210025 - DNA, 22 bp, Homo sapiens
gggagggaggtgatgcttggct

SEQ ID NO: 8210026 - DNA, 22 bp, Homo sapiens
gggagggaggtgatgcttggct

SEQ ID NO: 8210027 - DNA, 22 bp, Homo sapiens
gggagggaggtgctggttcacg

SEQ ID NO: 8210028 - DNA, 22 bp, Homo sapiens
gggagggaggtgatgcttggct

SEQ ID NO: 8210029 - DNA, 22 bp, Homo sapiens
gggagggaggtgatgcttggct

SEQ ID NO: 8210030 - DNA, 22 bp, Homo sapiens
gggagggaggtgatgcttggct

SEQ ID NO: 8210031 - DNA, 22 bp, Homo sapiens
gggagggaggtgatgcttggct

SEQ ID NO: 8210032 - DNA, 22 bp, Homo sapiens
gggaggttctgttcgcacttga

SEQ ID NO: 8210033 - DNA, 22 bp, Homo sapiens
gggaggtgttctgccaacgcgg

SEQ ID NO: 8210034 - DNA, 22 bp, Homo sapiens
gggaggtgttctgccaacgcgg

SEQ ID NO: 8210035 - DNA, 22 bp, Homo sapiens
gggaggtgttccagtgttggta

SEQ ID NO: 8210036 - DNA, 22 bp, Homo sapiens
gggaggtgttccagtgttggta

SEQ ID NO: 8210037 - DNA, 22 bp, Homo sapiens
gggaggtgttccagtgttggta

SEQ ID NO: 8210038 - DNA, 22 bp, Homo sapiens
gggaggtgttccagtgttggta

SEQ ID NO: 8210039 - DNA, 22 bp, Homo sapiens
gggaggtgttccagtgttggta

SEQ ID NO: 8210040 - DNA, 22 bp, Homo sapiens
gggaggtgattaggaccatgta

SEQ ID NO: 8210041 - DNA, 22 bp, Homo sapiens
gggaggttgaggctgcagtgag

SEQ ID NO: 8210042 - DNA, 22 bp, Homo sapiens
gggcacaggagaaggatctggc

SEQ ID NO: 8210043 - DNA, 22 bp, Homo sapiens
gggcacagtactccaatcaact

SEQ ID NO: 8210044 - DNA, 22 bp, Homo sapiens
gggaggttgaggctgcagtgag

SEQ ID NO: 8210045 - DNA, 22 bp, Homo sapiens
gggaggttgaggctgcagtgag

SEQ ID NO: 8210046 - DNA, 22 bp, Homo sapiens
gggaggttgaggctgcagtgag

SEQ ID NO: 8210047 - DNA, 22 bp, Homo sapiens
gggaggttgaggctgcagtgag

SEQ ID NO: 8210048 - DNA, 22 bp, Homo sapiens
gggaggtgaaaggttgctgcag

SEQ ID NO: 8210049 - DNA, 22 bp, Homo sapiens
gggagggccaggctcacccagg

SEQ ID NO: 8210050 - DNA, 22 bp, Homo sapiens
gggaggtgatggcaagcagcgg

SEQ ID NO: 8210051 - DNA, 22 bp, Homo sapiens
gggaggtgatggcaagcagcgg

SEQ ID NO: 8210052 - DNA, 22 bp, Homo sapiens
gggaggtgatggcaagcagcgg

SEQ ID NO: 8210053 - DNA, 22 bp, Homo sapiens
gggaggtgatggcaagcagcgg

SEQ ID NO: 8210054 - DNA, 22 bp, Homo sapiens
gggaggtgattaggaccatgta

SEQ ID NO: 8210055 - DNA, 22 bp, Homo sapiens
gggaggtgattaggaccatgta

SEQ ID NO: 8210056 - DNA, 22 bp, Homo sapiens
gggaggtgattaggaccatgta

SEQ ID NO: 8210057 - DNA, 22 bp, Homo sapiens
gggaggtgattaggaccatgta

SEQ ID NO: 8210058 - DNA, 22 bp, Homo sapiens
gggaggtgattaggaccatgta

SEQ ID NO: 8210059 - DNA, 21 bp, Homo sapiens
gggagggatggaaatgatgtt

SEQ ID NO: 8210060 - DNA, 22 bp, Homo sapiens
gggagggattagttctgcctgg

SEQ ID NO: 8210061 - DNA, 21 bp, Homo sapiens
gggagggatggaaatgatgtt

SEQ ID NO: 8210062 - DNA, 22 bp, Homo sapiens
gggagggattagttctgcctgg

SEQ ID NO: 8210063 - DNA, 22 bp, Homo sapiens
gggcactggccgcccatccctg

SEQ ID NO: 8210064 - DNA, 18 bp, Homo sapiens
gggcactggggactggag

SEQ ID NO: 8210065 - DNA, 18 bp, Homo sapiens
gggcactggggactggag

SEQ ID NO: 8210066 - DNA, 18 bp, Homo sapiens
gggcactggggactggag

SEQ ID NO: 8210067 - DNA, 22 bp, Homo sapiens
gggcaggttattggagtaggga

SEQ ID NO: 8210068 - DNA, 22 bp, Homo sapiens
gggcactgggtcttctccacgc

SEQ ID NO: 8210069 - DNA, 22 bp, Homo sapiens
gggcaggttattggagtaggga

SEQ ID NO: 8210070 - DNA, 22 bp, Homo sapiens
gggcaggttattggagtaggga

SEQ ID NO: 8210071 - DNA, 22 bp, Homo sapiens
gggcaggttggcatcccgggca

SEQ ID NO: 8210072 - DNA, 23 bp, Homo sapiens
gggcaggtttttataggcttcag

SEQ ID NO: 8210073 - DNA, 22 bp, Homo sapiens
gggcaggttggcatcccgggca

SEQ ID NO: 8210074 - DNA, 23 bp, Homo sapiens
gggcaggtttttataggcttcag

SEQ ID NO: 8210075 - DNA, 23 bp, Homo sapiens
gggcaggtttttataggcttcag

SEQ ID NO: 8210076 - DNA, 22 bp, Homo sapiens
gggcagtgacaaaggggatgaa

SEQ ID NO: 8210077 - DNA, 19 bp, Homo sapiens
gggcagtggcactagggag

SEQ ID NO: 8210078 - DNA, 22 bp, Homo sapiens
gggcagtgaatattggtgggaa

SEQ ID NO: 8210079 - DNA, 22 bp, Homo sapiens
gggcagtcacagtgctggagca

SEQ ID NO: 8210080 - DNA, 22 bp, Homo sapiens
gggcagtgacaaaggggatgaa

SEQ ID NO: 8210081 - DNA, 22 bp, Homo sapiens
gggcacagtctaaagttgggcc

SEQ ID NO: 8210082 - DNA, 22 bp, Homo sapiens
gggcacatgcttagggaggaaa

SEQ ID NO: 8210083 - DNA, 22 bp, Homo sapiens
gggcacatgtaaagctggagaa

SEQ ID NO: 8210084 - DNA, 21 bp, Homo sapiens
gggcactgaaagggaatagca

SEQ ID NO: 8210085 - DNA, 22 bp, Homo sapiens
gggcactgaacaccctcttcgc

SEQ ID NO: 8210086 - DNA, 22 bp, Homo sapiens
gggcactcagctgtagagcagg

SEQ ID NO: 8210087 - DNA, 22 bp, Homo sapiens
gggcaccttgggtctcaggcaa

SEQ ID NO: 8210088 - DNA, 21 bp, Homo sapiens
gggcacccttagcctcctctg

SEQ ID NO: 8210089 - DNA, 22 bp, Homo sapiens
gggcacctggctagtgacagtg

SEQ ID NO: 8210090 - DNA, 22 bp, Homo sapiens
gggcacctggctagtgacagtg

SEQ ID NO: 8210091 - DNA, 22 bp, Homo sapiens
gggcacctggctagtgacagtg

SEQ ID NO: 8210092 - DNA, 22 bp, Homo sapiens
gggcactggaggccaaggagct

SEQ ID NO: 8210093 - DNA, 22 bp, Homo sapiens
gggcactggaggccaaggagct

SEQ ID NO: 8210094 - DNA, 22 bp, Homo sapiens
gggcactggcagtcggggacgc

SEQ ID NO: 8210095 - DNA, 22 bp, Homo sapiens
gggcactggaaggctctcaggc

SEQ ID NO: 8210096 - DNA, 22 bp, Homo sapiens
gggcactgctttgctctgtcac

SEQ ID NO: 8210097 - DNA, 22 bp, Homo sapiens
gggcactgctttgctctgtcac

SEQ ID NO: 8210098 - DNA, 22 bp, Homo sapiens
gggcactggaaggctctcaggc

SEQ ID NO: 8210099 - DNA, 22 bp, Homo sapiens
gggcactggaaggctctcaggc

SEQ ID NO: 8210100 - DNA, 22 bp, Homo sapiens
gggcactggaaggctctcaggc

SEQ ID NO: 8210101 - DNA, 22 bp, Homo sapiens
gggcactgctggaggctccctg

SEQ ID NO: 8210102 - DNA, 22 bp, Homo sapiens
gggcactgagtggatgatgcag

SEQ ID NO: 8210103 - DNA, 22 bp, Homo sapiens
gggcactgagtggatgatgcag

SEQ ID NO: 8210104 - DNA, 22 bp, Homo sapiens
gggcactgctggaggctccctg

SEQ ID NO: 8210105 - DNA, 22 bp, Homo sapiens
gggcactgacagggtcccaact

SEQ ID NO: 8210106 - DNA, 22 bp, Homo sapiens
gggcactgaatgccaagctagg

SEQ ID NO: 8210107 - DNA, 22 bp, Homo sapiens
gggcactgagggcccacaggat

SEQ ID NO: 8210108 - DNA, 22 bp, Homo sapiens
gggcactgagaattttccactt

SEQ ID NO: 8210109 - DNA, 22 bp, Homo sapiens
ggctccagtttgtgccttcagc

SEQ ID NO: 8210110 - DNA, 22 bp, Homo sapiens
ggctcccaggagggcctggagg

SEQ ID NO: 8210111 - DNA, 22 bp, Homo sapiens
ggctccaggctcctatttcact

SEQ ID NO: 8210112 - DNA, 22 bp, Homo sapiens
ggctccagggagtggagagaag

SEQ ID NO: 8210113 - DNA, 22 bp, Homo sapiens
ggctaggcgggcacatggtgga

SEQ ID NO: 8210114 - DNA, 22 bp, Homo sapiens
ggctaggcgggcacatggtgga

SEQ ID NO: 8210115 - DNA, 22 bp, Homo sapiens
ggctaggcgggcacatggtgga

SEQ ID NO: 8210116 - DNA, 22 bp, Homo sapiens
ggctaggcctcaggcctgcctg

SEQ ID NO: 8210117 - DNA, 22 bp, Homo sapiens
ggctaggctcacctggagagtt

SEQ ID NO: 8210118 - DNA, 22 bp, Homo sapiens
ggctaggctcacctggagagtt

SEQ ID NO: 8210119 - DNA, 22 bp, Homo sapiens
ggctaggctcacctggagagtt

SEQ ID NO: 8210120 - DNA, 22 bp, Homo sapiens
ggctaggctcacctggagagtt

SEQ ID NO: 8210121 - DNA, 22 bp, Homo sapiens
ggctaggcgggcacatggtgga

SEQ ID NO: 8210122 - DNA, 21 bp, Homo sapiens
ggctccctggcaggggtctgg

SEQ ID NO: 8210123 - DNA, 22 bp, Homo sapiens
ggctccctggccctggggacac

SEQ ID NO: 8210124 - DNA, 22 bp, Homo sapiens
ggctccctgggtgctcctgctc

SEQ ID NO: 8210125 - DNA, 22 bp, Homo sapiens
ggctccctgggtgctcctgctc

SEQ ID NO: 8210126 - DNA, 22 bp, Homo sapiens
ggctccctgggggtcggagagt

SEQ ID NO: 8210127 - DNA, 22 bp, Homo sapiens
ggctccctggaaatcccgaggc

SEQ ID NO: 8210128 - DNA, 22 bp, Homo sapiens
ggctccctgcctgtcctcagtc

SEQ ID NO: 8210129 - DNA, 22 bp, Homo sapiens
ggctccctgcctgtcctcagtc

SEQ ID NO: 8210130 - DNA, 22 bp, Homo sapiens
ggctccctgcctgtcctcagtc

SEQ ID NO: 8210131 - DNA, 22 bp, Homo sapiens
ggctccccaggtccaggagctg

SEQ ID NO: 8210132 - DNA, 22 bp, Homo sapiens
ggctccctagggagagtgggag

SEQ ID NO: 8210133 - DNA, 22 bp, Homo sapiens
ggctccctcaccaccatcacat

SEQ ID NO: 8210134 - DNA, 22 bp, Homo sapiens
ggctccctcaccaccatcacat

SEQ ID NO: 8210135 - DNA, 23 bp, Homo sapiens
ggctccctcctagctttcccaat

SEQ ID NO: 8210136 - DNA, 22 bp, Homo sapiens
ggctccctgcaacctccgcctc

SEQ ID NO: 8210137 - DNA, 22 bp, Homo sapiens
ggctccctgcaacctccgcctc

SEQ ID NO: 8210138 - DNA, 22 bp, Homo sapiens
ggctccctgcaacctccgcctc

SEQ ID NO: 8210139 - DNA, 17 bp, Homo sapiens
ggctccctgactatgga

SEQ ID NO: 8210140 - DNA, 17 bp, Homo sapiens
ggctccctgactatgga

SEQ ID NO: 8210141 - DNA, 23 bp, Homo sapiens
ggctccctcctagctttcccaat

SEQ ID NO: 8210142 - DNA, 22 bp, Homo sapiens
ggcgtttcaccatgttgaccag

SEQ ID NO: 8210143 - DNA, 22 bp, Homo sapiens
ggctaaggaacgcaggcttctc

SEQ ID NO: 8210144 - DNA, 22 bp, Homo sapiens
ggctacagaggccgtgagcctg

SEQ ID NO: 8210145 - DNA, 22 bp, Homo sapiens
ggctacagactgcataagggca

SEQ ID NO: 8210146 - DNA, 22 bp, Homo sapiens
ggctacagactgcataagggca

SEQ ID NO: 8210147 - DNA, 22 bp, Homo sapiens
ggcgtgggaagtggggcttctg

SEQ ID NO: 8210148 - DNA, 22 bp, Homo sapiens
ggcggtggttgagaggacggcg

SEQ ID NO: 8210149 - DNA, 23 bp, Homo sapiens
ggctagagtggaggggaactgca

SEQ ID NO: 8210150 - DNA, 22 bp, Homo sapiens
ggctagagtggaactggagcgg

SEQ ID NO: 8210151 - DNA, 22 bp, Homo sapiens
ggctagagtggaactggagcgg

SEQ ID NO: 8210152 - DNA, 22 bp, Homo sapiens
ggctagagtggaactggagcgg

SEQ ID NO: 8210153 - DNA, 23 bp, Homo sapiens
ggctagagtggaggggaactgca

SEQ ID NO: 8210154 - DNA, 23 bp, Homo sapiens
ggctagagtggaggggaactgca

SEQ ID NO: 8210155 - DNA, 23 bp, Homo sapiens
ggctagagtggaggggaactgca

SEQ ID NO: 8210156 - DNA, 23 bp, Homo sapiens
ggctagagtggaggggaactgca

SEQ ID NO: 8210157 - DNA, 21 bp, Homo sapiens
ggctaggatgctggggtttcc

SEQ ID NO: 8210158 - DNA, 22 bp, Homo sapiens
ggctagcttagagtcatgctag

SEQ ID NO: 8210159 - DNA, 22 bp, Homo sapiens
ggctaggcaggctcagagccta

SEQ ID NO: 8210160 - DNA, 22 bp, Homo sapiens
ggctaggcaggctcagagccta

SEQ ID NO: 8210161 - DNA, 22 bp, Homo sapiens
ggctagagtggaactggagcgg

SEQ ID NO: 8210162 - DNA, 22 bp, Homo sapiens
ggctagagtggaactggagcgg

SEQ ID NO: 8210163 - DNA, 22 bp, Homo sapiens
ggctacagggtacaccacatct

SEQ ID NO: 8210164 - DNA, 22 bp, Homo sapiens
ggctctgggcctccaaggtctg

SEQ ID NO: 8210165 - DNA, 22 bp, Homo sapiens
ggctctggggaagctctcttca

SEQ ID NO: 8210166 - DNA, 22 bp, Homo sapiens
ggctctgggcctccaaggtctg

SEQ ID NO: 8210167 - DNA, 22 bp, Homo sapiens
ggctctggggcctcctcccttg

SEQ ID NO: 8210168 - DNA, 22 bp, Homo sapiens
ggctctggggaagctctcttca

SEQ ID NO: 8210169 - DNA, 22 bp, Homo sapiens
ggctctggggaagctctcttca

SEQ ID NO: 8210170 - DNA, 22 bp, Homo sapiens
ggctctggggggaagtctgttg

SEQ ID NO: 8210171 - DNA, 22 bp, Homo sapiens
ggctctggggcctcctcccttg

SEQ ID NO: 8210172 - DNA, 22 bp, Homo sapiens
ggctctggggcctcctcccttg

SEQ ID NO: 8210173 - DNA, 22 bp, Homo sapiens
ggctctgggtctgtggggagcg

SEQ ID NO: 8210174 - DNA, 22 bp, Homo sapiens
ggctctgggtaaggcgtttgac

SEQ ID NO: 8210175 - DNA, 22 bp, Homo sapiens
ggctctgggtaaggcgtttgac

SEQ ID NO: 8210176 - DNA, 22 bp, Homo sapiens
ggctctggggggaagtctgttg

SEQ ID NO: 8210177 - DNA, 22 bp, Homo sapiens
ggctctggggggaagtctgttg

SEQ ID NO: 8210178 - DNA, 22 bp, Homo sapiens
ggctctggggggaagtctgttg

SEQ ID NO: 8210179 - DNA, 22 bp, Homo sapiens
ggctctggggttggcccatctc

SEQ ID NO: 8210180 - DNA, 22 bp, Homo sapiens
ggctctggggttggcccatctc

SEQ ID NO: 8210181 - DNA, 22 bp, Homo sapiens
ggctcctgaggaccaggcacag

SEQ ID NO: 8210182 - DNA, 22 bp, Homo sapiens
ggctcctgataggagaatgcgg

SEQ ID NO: 8210183 - DNA, 22 bp, Homo sapiens
ggctcctgataggagaatgcgg

SEQ ID NO: 8210184 - DNA, 22 bp, Homo sapiens
ggctcctgataggagaatgcgg

SEQ ID NO: 8210185 - DNA, 22 bp, Homo sapiens
ggctcctgaggaccaggcacag

SEQ ID NO: 8210186 - DNA, 22 bp, Homo sapiens
ggctcctgaggaccaggcacag

SEQ ID NO: 8210187 - DNA, 22 bp, Homo sapiens
ggctcctgaggaccaggcacag

SEQ ID NO: 8210188 - DNA, 22 bp, Homo sapiens
ggctcctgagaatgggccatca

SEQ ID NO: 8210189 - DNA, 22 bp, Homo sapiens
ggctcctccaagcaactctcag

SEQ ID NO: 8210190 - DNA, 22 bp, Homo sapiens
ggctcctccaagcaactctcag

SEQ ID NO: 8210191 - DNA, 22 bp, Homo sapiens
ggctccctgggtgctcctgctc

SEQ ID NO: 8210192 - DNA, 22 bp, Homo sapiens
ggctccctgttctattccctgg

SEQ ID NO: 8210193 - DNA, 22 bp, Homo sapiens
ggctcctgagaatgggccatca

SEQ ID NO: 8210194 - DNA, 22 bp, Homo sapiens
ggctcctgaaagactatgggaa

SEQ ID NO: 8210195 - DNA, 22 bp, Homo sapiens
ggctcctctctggccgctcccg

SEQ ID NO: 8210196 - DNA, 22 bp, Homo sapiens
ggctcctctctggccgctcccg

SEQ ID NO: 8210197 - DNA, 22 bp, Homo sapiens
ggctgagccatgggcactgcag

SEQ ID NO: 8210198 - DNA, 22 bp, Homo sapiens
ggctgagccactgcgcctggct

SEQ ID NO: 8210199 - DNA, 22 bp, Homo sapiens
ggctgagcactttaggcaggag

SEQ ID NO: 8210200 - DNA, 22 bp, Homo sapiens
ggctgagccactgcgcctggct

SEQ ID NO: 8210201 - DNA, 22 bp, Homo sapiens
ggctgagccatgggcactgcag

SEQ ID NO: 8210202 - DNA, 22 bp, Homo sapiens
ggctgagccatgggcactgcag

SEQ ID NO: 8210203 - DNA, 22 bp, Homo sapiens
ggctgagccatgggcactgcag

SEQ ID NO: 8210204 - DNA, 22 bp, Homo sapiens
ggctcttctacttcagatgggg

SEQ ID NO: 8210205 - DNA, 22 bp, Homo sapiens
ggctcttctacttcagatgggg

SEQ ID NO: 8210206 - DNA, 22 bp, Homo sapiens
ggctcttcacacagtgatgtca

SEQ ID NO: 8210207 - DNA, 22 bp, Homo sapiens
ggctcttccgccaccagccaca

SEQ ID NO: 8210208 - DNA, 22 bp, Homo sapiens
ggctcttcacacagtgatgtca

SEQ ID NO: 8210209 - DNA, 22 bp, Homo sapiens
ggctctgtaagtgttgcaggta

SEQ ID NO: 8210210 - DNA, 22 bp, Homo sapiens
ggctctgtaagtgttgcaggta

SEQ ID NO: 8210211 - DNA, 22 bp, Homo sapiens
ggctctgtaaagtgacacctgc

SEQ ID NO: 8210212 - DNA, 22 bp, Homo sapiens
ggctctggttgaccatgatggc

SEQ ID NO: 8210213 - DNA, 23 bp, Homo sapiens
ggctctgtgctgggcctgcagga

SEQ ID NO: 8210214 - DNA, 23 bp, Homo sapiens
ggctctgtgctgggcctgcagga

SEQ ID NO: 8210215 - DNA, 23 bp, Homo sapiens
ggctctgtgctgggcctgcagga

SEQ ID NO: 8210216 - DNA, 17 bp, Homo sapiens
ggctctgggtgtcacat

SEQ ID NO: 8210217 - DNA, 22 bp, Homo sapiens
ggctctgggtctgtggggagcg

SEQ ID NO: 8210218 - DNA, 22 bp, Homo sapiens
ggctctgggtctgtggggagcg

SEQ ID NO: 8210219 - DNA, 22 bp, Homo sapiens
ggctctgggtgtgaccttgggt

SEQ ID NO: 8210220 - DNA, 17 bp, Homo sapiens
ggctctgggtgtcacat

SEQ ID NO: 8210221 - DNA, 22 bp, Homo sapiens
ggctctgggtgtgaccttgggt

SEQ ID NO: 8210222 - DNA, 22 bp, Homo sapiens
ggctctgggtgtgaccttgggt

SEQ ID NO: 8210223 - DNA, 22 bp, Homo sapiens
ggctctggtgtgaagcagcctc

SEQ ID NO: 8210224 - DNA, 22 bp, Homo sapiens
ggctctggtgtgaagcagcctc

SEQ ID NO: 8210225 - DNA, 22 bp, Homo sapiens
ggctctggttgaccatgatggc

SEQ ID NO: 8210226 - DNA, 22 bp, Homo sapiens
ggctctggttgaccatgatggc

SEQ ID NO: 8210227 - DNA, 22 bp, Homo sapiens
ggctctggttgaccatgatggc

SEQ ID NO: 8210228 - DNA, 22 bp, Homo sapiens
ggctctgggttctgcaatgcgt

SEQ ID NO: 8210229 - DNA, 22 bp, Homo sapiens
ggctctgggttctgcaatgcgt

SEQ ID NO: 8210230 - DNA, 22 bp, Homo sapiens
ggctctgggttctgcaatgcgt

SEQ ID NO: 8210231 - DNA, 22 bp, Homo sapiens
ggctctgggttctgcaatgcgt

SEQ ID NO: 8210232 - DNA, 22 bp, Homo sapiens
ggctctgggttctgcaatgcgt

SEQ ID NO: 8210233 - DNA, 22 bp, Homo sapiens
ggctctggtgtgaagcagcctc

SEQ ID NO: 8210234 - DNA, 22 bp, Homo sapiens
ggctctggtgtgaagcagcctc

SEQ ID NO: 8210235 - DNA, 21 bp, Homo sapiens
ggctggacatcccaggagact

SEQ ID NO: 8210236 - DNA, 22 bp, Homo sapiens
ggctggactgcctcccagagtc

SEQ ID NO: 8210237 - DNA, 22 bp, Homo sapiens
ggctggactttctgctgggctc

SEQ ID NO: 8210238 - DNA, 22 bp, Homo sapiens
ggctggactttctgctgggctc

SEQ ID NO: 8210239 - DNA, 22 bp, Homo sapiens
ggctggactttttgcaggtcat

SEQ ID NO: 8210240 - DNA, 22 bp, Homo sapiens
ggctggactttctgctgggctc

SEQ ID NO: 8210241 - DNA, 22 bp, Homo sapiens
ggctggactttctgctgggctc

SEQ ID NO: 8210242 - DNA, 19 bp, Homo sapiens
ggctggagaaaggaatcag

SEQ ID NO: 8210243 - DNA, 22 bp, Homo sapiens
ggctggagaagggtggttgaca

SEQ ID NO: 8210244 - DNA, 22 bp, Homo sapiens
ggctggagaagggtggttgaca

SEQ ID NO: 8210245 - DNA, 22 bp, Homo sapiens
ggctggagaagggtggttgaca

SEQ ID NO: 8210246 - DNA, 19 bp, Homo sapiens
ggctggagaaaggaatcag

SEQ ID NO: 8210247 - DNA, 19 bp, Homo sapiens
ggctggagaaaggaatcag

SEQ ID NO: 8210248 - DNA, 19 bp, Homo sapiens
ggctggagaaaggaatcag

SEQ ID NO: 8210249 - DNA, 19 bp, Homo sapiens
ggctggagaaaggaatcag

SEQ ID NO: 8210250 - DNA, 22 bp, Homo sapiens
ggctgggtcccagctgggagga

SEQ ID NO: 8210251 - DNA, 22 bp, Homo sapiens
ggctgggtcccagctgggagga

SEQ ID NO: 8210252 - DNA, 22 bp, Homo sapiens
ggctgggtcccagctgggagga

SEQ ID NO: 8210253 - DNA, 19 bp, Homo sapiens
ggctgggtctggcaggttc

SEQ ID NO: 8210254 - DNA, 19 bp, Homo sapiens
ggctgggtctggcaggttc

SEQ ID NO: 8210255 - DNA, 21 bp, Homo sapiens
ggctgggtcatgcagctggcc

SEQ ID NO: 8210256 - DNA, 22 bp, Homo sapiens
ggctgggtacagggcagtgtgc

SEQ ID NO: 8210257 - DNA, 22 bp, Homo sapiens
ggctgggtacagggcagtgtgc

SEQ ID NO: 8210258 - DNA, 22 bp, Homo sapiens
ggctgggttctgagaaagagta

SEQ ID NO: 8210259 - DNA, 22 bp, Homo sapiens
ggctggtcacaccactgcaggg

SEQ ID NO: 8210260 - DNA, 21 bp, Homo sapiens
ggctggtcgcgtgcatgtctc

SEQ ID NO: 8210261 - DNA, 22 bp, Homo sapiens
ggctggtgagttcagagaaccc

SEQ ID NO: 8210262 - DNA, 23 bp, Homo sapiens
ggctggtgcccttggccagtcgg

SEQ ID NO: 8210263 - DNA, 23 bp, Homo sapiens
ggctggtgcccttggccagtcgg

SEQ ID NO: 8210264 - DNA, 23 bp, Homo sapiens
ggctggtgcccttggccagtcgg

SEQ ID NO: 8210265 - DNA, 22 bp, Homo sapiens
ggctggtggggaaagaggacca

SEQ ID NO: 8210266 - DNA, 23 bp, Homo sapiens
ggctggtgcccttggccagtcgg

SEQ ID NO: 8210267 - DNA, 23 bp, Homo sapiens
ggctggtgcccttggccagtcgg

SEQ ID NO: 8210268 - DNA, 22 bp, Homo sapiens
ggctgtgagcaggcagaatgct

SEQ ID NO: 8210269 - DNA, 22 bp, Homo sapiens
ggctgtgacccccacaggggtg

SEQ ID NO: 8210270 - DNA, 22 bp, Homo sapiens
ggctgtgattggtggatgtgaa

SEQ ID NO: 8210271 - DNA, 22 bp, Homo sapiens
ggctgtgattggtggatgtgaa

SEQ ID NO: 8210272 - DNA, 22 bp, Homo sapiens
ggctgtgacaaggctgcgggaa

SEQ ID NO: 8210273 - DNA, 22 bp, Homo sapiens
ggctggtggggaaagaggacca

SEQ ID NO: 8210274 - DNA, 17 bp, Homo sapiens
ggctgtgccaggtgaga

SEQ ID NO: 8210275 - DNA, 20 bp, Homo sapiens
ggctgtgcccttccgtggcc

SEQ ID NO: 8210276 - DNA, 22 bp, Homo sapiens
ggctgtgccctcacatggggca

SEQ ID NO: 8210277 - DNA, 21 bp, Homo sapiens
ggctggacatcccaggagact

SEQ ID NO: 8210278 - DNA, 21 bp, Homo sapiens
ggctggacatcccaggagact

SEQ ID NO: 8210279 - DNA, 21 bp, Homo sapiens
ggctggacatcccaggagact

SEQ ID NO: 8210280 - DNA, 22 bp, Homo sapiens
ggctggaatgtgtggatgtgat

SEQ ID NO: 8210281 - DNA, 22 bp, Homo sapiens
ggctggaatgtgtggatgtgat

SEQ ID NO: 8210282 - DNA, 20 bp, Homo sapiens
ggctggaagtgtgggtttgg

SEQ ID NO: 8210283 - DNA, 20 bp, Homo sapiens
ggctggaagtgtgggtttgg

SEQ ID NO: 8210284 - DNA, 22 bp, Homo sapiens
ggctgcttgtcagcagctggcc

SEQ ID NO: 8210285 - DNA, 22 bp, Homo sapiens
ggctgcttttcttgtatctact

SEQ ID NO: 8210286 - DNA, 22 bp, Homo sapiens
ggctggaaactcaggtagggtt

SEQ ID NO: 8210287 - DNA, 22 bp, Homo sapiens
ggctggaaactcaggtagggtt

SEQ ID NO: 8210288 - DNA, 22 bp, Homo sapiens
ggctggaagagactgaggacac

SEQ ID NO: 8210289 - DNA, 22 bp, Homo sapiens
ggctggaagagactgaggacac

SEQ ID NO: 8210290 - DNA, 22 bp, Homo sapiens
ggctggaaccagagtgaggcag

SEQ ID NO: 8210291 - DNA, 22 bp, Homo sapiens
ggctggaacttcttctggcatt

SEQ ID NO: 8210292 - DNA, 22 bp, Homo sapiens
ggctgctgtttcagagactgtt

SEQ ID NO: 8210293 - DNA, 22 bp, Homo sapiens
ggctgcttctcactcatttgca

SEQ ID NO: 8210294 - DNA, 22 bp, Homo sapiens
ggctgcttctgatttctaatgt

SEQ ID NO: 8210295 - DNA, 20 bp, Homo sapiens
ggctgctgtgggcagagagg

SEQ ID NO: 8210296 - DNA, 20 bp, Homo sapiens
ggctgctgtgggcagagagg

SEQ ID NO: 8210297 - DNA, 20 bp, Homo sapiens
ggctgctgtgggcagagagg

SEQ ID NO: 8210298 - DNA, 22 bp, Homo sapiens
ggctgctgtttcagagactgtt

SEQ ID NO: 8210299 - DNA, 22 bp, Homo sapiens
ggctgctggggacgtgggagag

SEQ ID NO: 8210300 - DNA, 21 bp, Homo sapiens
ggctgctgggggttggcacag

SEQ ID NO: 8210301 - DNA, 21 bp, Homo sapiens
ggctgctgggggttggcacag

SEQ ID NO: 8210302 - DNA, 22 bp, Homo sapiens
ggctgctggggacgtgggagag

SEQ ID NO: 8210303 - DNA, 22 bp, Homo sapiens
ggctgctggggacgtgggagag

SEQ ID NO: 8210304 - DNA, 22 bp, Homo sapiens
ggctgagttctcttgctgaatc

SEQ ID NO: 8210305 - DNA, 22 bp, Homo sapiens
ggctgagttctcttgctgaatc

SEQ ID NO: 8210306 - DNA, 22 bp, Homo sapiens
ggctgagttgagaggattactt

SEQ ID NO: 8210307 - DNA, 22 bp, Homo sapiens
ggctgaggggcccagaggaaca

SEQ ID NO: 8210308 - DNA, 22 bp, Homo sapiens
ggctgaggggcccagaggaaca

SEQ ID NO: 8210309 - DNA, 22 bp, Homo sapiens
ggctgaggggcccagaggaaca

SEQ ID NO: 8210310 - DNA, 22 bp, Homo sapiens
ggctgaggggcccagaggaaca

SEQ ID NO: 8210311 - DNA, 22 bp, Homo sapiens
ggctgagggccagggctagtct

SEQ ID NO: 8210312 - DNA, 22 bp, Homo sapiens
ggctgagggccagggctagtct

SEQ ID NO: 8210313 - DNA, 22 bp, Homo sapiens
ggctgagggccagggctagtct

SEQ ID NO: 8210314 - DNA, 22 bp, Homo sapiens
ggctgagggccagggctagtct

SEQ ID NO: 8210315 - DNA, 22 bp, Homo sapiens
ggctgagggccagggctagtct

SEQ ID NO: 8210316 - DNA, 22 bp, Homo sapiens
ggctgagggtatagctgtccca

SEQ ID NO: 8210317 - DNA, 22 bp, Homo sapiens
ggctgaggggcccagaggaaca

SEQ ID NO: 8210318 - DNA, 22 bp, Homo sapiens
ggctgagggtatagctgtccca

SEQ ID NO: 8210319 - DNA, 22 bp, Homo sapiens
ggctgagggtcccagaccctaa

SEQ ID NO: 8210320 - DNA, 22 bp, Homo sapiens
ggctgagggtatagctgtccca

SEQ ID NO: 8210321 - DNA, 22 bp, Homo sapiens
ggctgaggtgtggggaactata

SEQ ID NO: 8210322 - DNA, 22 bp, Homo sapiens
ggctgaggtgtggggaactata

SEQ ID NO: 8210323 - DNA, 22 bp, Homo sapiens
ggctgaggtgtggggaactata

SEQ ID NO: 8210324 - DNA, 18 bp, Homo sapiens
ggctgaggttgactagaa

SEQ ID NO: 8210325 - DNA, 22 bp, Homo sapiens
ggctgagggtcccagaccctaa

SEQ ID NO: 8210326 - DNA, 22 bp, Homo sapiens
ggctgagggttaagatcagaca

SEQ ID NO: 8210327 - DNA, 22 bp, Homo sapiens
ggctgagggtcccagaccctaa

SEQ ID NO: 8210328 - DNA, 22 bp, Homo sapiens
ggctgagggttaagatcagaca

SEQ ID NO: 8210329 - DNA, 18 bp, Homo sapiens
ggctgaggttgactagaa

SEQ ID NO: 8210330 - DNA, 18 bp, Homo sapiens
ggctgaggttgactagaa

SEQ ID NO: 8210331 - DNA, 18 bp, Homo sapiens
ggctgaggttgactagaa

SEQ ID NO: 8210332 - DNA, 18 bp, Homo sapiens
ggctgaggttgactagaa

SEQ ID NO: 8210333 - DNA, 18 bp, Homo sapiens
ggctgaggttgactagaa

SEQ ID NO: 8210334 - DNA, 18 bp, Homo sapiens
ggctgaggttgactagaa

SEQ ID NO: 8210335 - DNA, 22 bp, Homo sapiens
ggctgagtggctgggtctagtt

SEQ ID NO: 8210336 - DNA, 22 bp, Homo sapiens
ggctgagtggctgggtctagtt

SEQ ID NO: 8210337 - DNA, 22 bp, Homo sapiens
ggctgagtggctgggtctagtt

SEQ ID NO: 8210338 - DNA, 22 bp, Homo sapiens
ggctgagtgctgctgttcacga

SEQ ID NO: 8210339 - DNA, 22 bp, Homo sapiens
ggctgagtctgtgacccatgcg

SEQ ID NO: 8210340 - DNA, 22 bp, Homo sapiens
ggctgagtggaggtagccctgt

SEQ ID NO: 8210341 - DNA, 22 bp, Homo sapiens
ggctgagtctgtgacccatgcg

SEQ ID NO: 8210342 - DNA, 22 bp, Homo sapiens
ggcagggtgtggagttgggaca

SEQ ID NO: 8210343 - DNA, 22 bp, Homo sapiens
ggcaggtactggggagtgaaga

SEQ ID NO: 8210344 - DNA, 22 bp, Homo sapiens
ggcaggtacagcaagaggacaa

SEQ ID NO: 8210345 - DNA, 19 bp, Homo sapiens
ggcaggtagagggccagtc

SEQ ID NO: 8210346 - DNA, 19 bp, Homo sapiens
ggcaggtagagggccagtc

SEQ ID NO: 8210347 - DNA, 17 bp, Homo sapiens
ggcagggtgctgggtat

SEQ ID NO: 8210348 - DNA, 17 bp, Homo sapiens
ggcagggtgctgggtat

SEQ ID NO: 8210349 - DNA, 22 bp, Homo sapiens
ggcagggtggcagaggctcaga

SEQ ID NO: 8210350 - DNA, 22 bp, Homo sapiens
ggcagggtggcagaggctcaga

SEQ ID NO: 8210351 - DNA, 22 bp, Homo sapiens
ggcagggtggccctccagtgag

SEQ ID NO: 8210352 - DNA, 22 bp, Homo sapiens
ggcagggtggccctccagtgag

SEQ ID NO: 8210353 - DNA, 22 bp, Homo sapiens
ggcaggtgacggggatgagtat

SEQ ID NO: 8210354 - DNA, 22 bp, Homo sapiens
ggcaggtgacctggcctcccag

SEQ ID NO: 8210355 - DNA, 22 bp, Homo sapiens
ggcaggtgacctggcctcccag

SEQ ID NO: 8210356 - DNA, 22 bp, Homo sapiens
ggcaggtgacctggcctcccag

SEQ ID NO: 8210357 - DNA, 17 bp, Homo sapiens
ggcaggtgacagacacc

SEQ ID NO: 8210358 - DNA, 17 bp, Homo sapiens
ggcaggtgacagacacc

SEQ ID NO: 8210359 - DNA, 17 bp, Homo sapiens
ggcaggtgacagacacc

SEQ ID NO: 8210360 - DNA, 17 bp, Homo sapiens
ggcaggtgacagacacc

SEQ ID NO: 8210361 - DNA, 17 bp, Homo sapiens
ggcaggtgacagacacc

SEQ ID NO: 8210362 - DNA, 17 bp, Homo sapiens
ggcaggtgacagacacc

SEQ ID NO: 8210363 - DNA, 22 bp, Homo sapiens
ggcaggtaggccccctctccag

SEQ ID NO: 8210364 - DNA, 22 bp, Homo sapiens
ggcaggtaggccccctctccag

SEQ ID NO: 8210365 - DNA, 22 bp, Homo sapiens
ggcaggtcatcaactgtaattt

SEQ ID NO: 8210366 - DNA, 22 bp, Homo sapiens
ggcaggtagcctagaggaggtt

SEQ ID NO: 8210367 - DNA, 22 bp, Homo sapiens
ggcaggtgaggcatgtgcctgg

SEQ ID NO: 8210368 - DNA, 22 bp, Homo sapiens
ggcagtgggttccccaaggcac

SEQ ID NO: 8210369 - DNA, 22 bp, Homo sapiens
ggcagtgggttccccaaggcac

SEQ ID NO: 8210370 - DNA, 22 bp, Homo sapiens
ggcaggtgacggggatgagtat

SEQ ID NO: 8210371 - DNA, 22 bp, Homo sapiens
ggcaggtgagagctctttgaaa

SEQ ID NO: 8210372 - DNA, 22 bp, Homo sapiens
ggcaggtgagagctctttgaaa

SEQ ID NO: 8210373 - DNA, 22 bp, Homo sapiens
ggcaggtgacggggatgagtat

SEQ ID NO: 8210374 - DNA, 22 bp, Homo sapiens
ggcaggtgagagctctttgaaa

SEQ ID NO: 8210375 - DNA, 22 bp, Homo sapiens
ggcagggtgcctggctcctgtt

SEQ ID NO: 8210376 - DNA, 22 bp, Homo sapiens
ggcagggtgcctggctcctgtt

SEQ ID NO: 8210377 - DNA, 22 bp, Homo sapiens
ggcagggtgcctggctcctgtt

SEQ ID NO: 8210378 - DNA, 22 bp, Homo sapiens
ggcagggtccacacctgggaaa

SEQ ID NO: 8210379 - DNA, 22 bp, Homo sapiens
ggcagggtctggactgaaagct

SEQ ID NO: 8210380 - DNA, 22 bp, Homo sapiens
ggcagggtctggactgaaagct

SEQ ID NO: 8210381 - DNA, 22 bp, Homo sapiens
ggcagggtaaaccgaggtaagt

SEQ ID NO: 8210382 - DNA, 22 bp, Homo sapiens
ggcagggtatgattacctctga

SEQ ID NO: 8210383 - DNA, 22 bp, Homo sapiens
ggcaggggttcattttgtctta

SEQ ID NO: 8210384 - DNA, 18 bp, Homo sapiens
ggcaggggtgaaccacag

SEQ ID NO: 8210385 - DNA, 22 bp, Homo sapiens
ggcaggggtgaggccactctga

SEQ ID NO: 8210386 - DNA, 22 bp, Homo sapiens
ggcaggagctctccagtttgcc

SEQ ID NO: 8210387 - DNA, 22 bp, Homo sapiens
ggcaggagctctccagtttgcc

SEQ ID NO: 8210388 - DNA, 22 bp, Homo sapiens
ggcaggagctctccagtttgcc

SEQ ID NO: 8210389 - DNA, 22 bp, Homo sapiens
ggcaggagctctccagtttgcc

SEQ ID NO: 8210390 - DNA, 22 bp, Homo sapiens
ggcaggaggaagagttagcacc

SEQ ID NO: 8210391 - DNA, 22 bp, Homo sapiens
ggcaggaggaagagttagcacc

SEQ ID NO: 8210392 - DNA, 22 bp, Homo sapiens
ggcaggaggaagagttagcacc

SEQ ID NO: 8210393 - DNA, 22 bp, Homo sapiens
ggcaggagctcaggttggttcc

SEQ ID NO: 8210394 - DNA, 22 bp, Homo sapiens
ggcaggagctcaggttggttcc

SEQ ID NO: 8210395 - DNA, 22 bp, Homo sapiens
ggcaggagctcaggttggttcc

SEQ ID NO: 8210396 - DNA, 18 bp, Homo sapiens
ggcaggagcaagaatagg

SEQ ID NO: 8210397 - DNA, 22 bp, Homo sapiens
ggcaggagataaaatattagtt

SEQ ID NO: 8210398 - DNA, 22 bp, Homo sapiens
ggcaggagataaaatattagtt

SEQ ID NO: 8210399 - DNA, 22 bp, Homo sapiens
ggcaggagaatggcgtgaactc

SEQ ID NO: 8210400 - DNA, 22 bp, Homo sapiens
ggcaggagaatggcgtgaactc

SEQ ID NO: 8210401 - DNA, 22 bp, Homo sapiens
ggcagctttggattcgcggctg

SEQ ID NO: 8210402 - DNA, 22 bp, Homo sapiens
ggcagtggttagaaacatgagc

SEQ ID NO: 8210403 - DNA, 22 bp, Homo sapiens
ggcagtggtgggaggctcgctc

SEQ ID NO: 8210404 - DNA, 22 bp, Homo sapiens
ggcagtggtgggaggctcgctc

SEQ ID NO: 8210405 - DNA, 22 bp, Homo sapiens
ggcatcagggtaggaaggtatc

SEQ ID NO: 8210406 - DNA, 22 bp, Homo sapiens
ggcatcagtatggccatagggt

SEQ ID NO: 8210407 - DNA, 22 bp, Homo sapiens
ggcatcctctagaagctggaaa

SEQ ID NO: 8210408 - DNA, 20 bp, Homo sapiens
ggcatccttctgacccagag

SEQ ID NO: 8210409 - DNA, 22 bp, Homo sapiens
ggcatcgtcctgggcataggga

SEQ ID NO: 8210410 - DNA, 22 bp, Homo sapiens
ggcatcgtcctgggcataggga

SEQ ID NO: 8210411 - DNA, 22 bp, Homo sapiens
ggcatgagtaacgtgagtgagg

SEQ ID NO: 8210412 - DNA, 21 bp, Homo sapiens
ggcatgagggcagtgagcaga

SEQ ID NO: 8210413 - DNA, 21 bp, Homo sapiens
ggcatgagggcagtgagcaga

SEQ ID NO: 8210414 - DNA, 20 bp, Homo sapiens
ggcatgagatgtgagggagg

SEQ ID NO: 8210415 - DNA, 20 bp, Homo sapiens
ggcatgagatgtgagggagg

SEQ ID NO: 8210416 - DNA, 20 bp, Homo sapiens
ggcatgagatgtgagggagg

SEQ ID NO: 8210417 - DNA, 22 bp, Homo sapiens
ggcatgagaggtcctggggatt

SEQ ID NO: 8210418 - DNA, 20 bp, Homo sapiens
ggcatgagatgtgagggagg

SEQ ID NO: 8210419 - DNA, 22 bp, Homo sapiens
ggcatcttgttgctcaaatcta

SEQ ID NO: 8210420 - DNA, 22 bp, Homo sapiens
ggcatgagaggtcctggggatt

SEQ ID NO: 8210421 - DNA, 22 bp, Homo sapiens
ggcatgagaggtcctggggatt

SEQ ID NO: 8210422 - DNA, 22 bp, Homo sapiens
ggcatgagaggtcctggggatt

SEQ ID NO: 8210423 - DNA, 22 bp, Homo sapiens
ggcatgagaggtcctggggatt

SEQ ID NO: 8210424 - DNA, 22 bp, Homo sapiens
ggcatctgagctgtgtatggtt

SEQ ID NO: 8210425 - DNA, 18 bp, Homo sapiens
ggcatctgcacagcagcc

SEQ ID NO: 8210426 - DNA, 22 bp, Homo sapiens
ggcatctgtccatctctccagc

SEQ ID NO: 8210427 - DNA, 22 bp, Homo sapiens
ggccagctgtggggccgagcct

SEQ ID NO: 8210428 - DNA, 22 bp, Homo sapiens
ggccagctgtggggccgagcct

SEQ ID NO: 8210429 - DNA, 22 bp, Homo sapiens
ggccagctgtgggattttctgc

SEQ ID NO: 8210430 - DNA, 19 bp, Homo sapiens
ggccagctgtctcctgcta

SEQ ID NO: 8210431 - DNA, 19 bp, Homo sapiens
ggccagctgtctcctgcta

SEQ ID NO: 8210432 - DNA, 22 bp, Homo sapiens
ggccagcttctctgctgcctgt

SEQ ID NO: 8210433 - DNA, 22 bp, Homo sapiens
ggccagcttctctgctgcctgt

SEQ ID NO: 8210434 - DNA, 22 bp, Homo sapiens
ggccagcttattagctcagagg

SEQ ID NO: 8210435 - DNA, 22 bp, Homo sapiens
ggccagcttattagctcagagg

SEQ ID NO: 8210436 - DNA, 22 bp, Homo sapiens
ggccagcttctctgctgcctgt

SEQ ID NO: 8210437 - DNA, 22 bp, Homo sapiens
ggccagcttctctgctgcctgt

SEQ ID NO: 8210438 - DNA, 22 bp, Homo sapiens
ggccagctttgagctgcaggaa

SEQ ID NO: 8210439 - DNA, 22 bp, Homo sapiens
ggccagctttgagctgcaggaa

SEQ ID NO: 8210440 - DNA, 22 bp, Homo sapiens
ggccagctttgagctgcaggaa

SEQ ID NO: 8210441 - DNA, 22 bp, Homo sapiens
ggccagctttgagctgcaggaa

SEQ ID NO: 8210442 - DNA, 22 bp, Homo sapiens
ggccaggaacttttgggatggg

SEQ ID NO: 8210443 - DNA, 22 bp, Homo sapiens
ggccaggaacgatcctaccctt

SEQ ID NO: 8210444 - DNA, 22 bp, Homo sapiens
ggccaggaacttttgggatggg

SEQ ID NO: 8210445 - DNA, 22 bp, Homo sapiens
ggcatgagtggcagtgggcagt

SEQ ID NO: 8210446 - DNA, 22 bp, Homo sapiens
ggcatgagtggcagtgggcagt

SEQ ID NO: 8210447 - DNA, 22 bp, Homo sapiens
ggcatgagtggcagtgggcagt

SEQ ID NO: 8210448 - DNA, 22 bp, Homo sapiens
ggcatgagtggcagtgggcagt

SEQ ID NO: 8210449 - DNA, 23 bp, Homo sapiens
ggcatgcaatggacagagctgga

SEQ ID NO: 8210450 - DNA, 22 bp, Homo sapiens
ggcatgcatacgtagtgatttt

SEQ ID NO: 8210451 - DNA, 22 bp, Homo sapiens
ggcatgcaaatgtgggtgacct

SEQ ID NO: 8210452 - DNA, 23 bp, Homo sapiens
ggcatgcaatggacagagctgga

SEQ ID NO: 8210453 - DNA, 22 bp, Homo sapiens
ggcatgcaaatgtgggtgacct

SEQ ID NO: 8210454 - DNA, 22 bp, Homo sapiens
ggcatgcaaatgtgggtgacct

SEQ ID NO: 8210455 - DNA, 22 bp, Homo sapiens
ggccagctgtaagctgctgaat

SEQ ID NO: 8210456 - DNA, 22 bp, Homo sapiens
ggccagctgtaagctgctgaat

SEQ ID NO: 8210457 - DNA, 22 bp, Homo sapiens
ggccagctgtaagctgctgaat

SEQ ID NO: 8210458 - DNA, 22 bp, Homo sapiens
ggcatgcatgttgttttaggtg

SEQ ID NO: 8210459 - DNA, 22 bp, Homo sapiens
ggcatgcatgcaaggtggtgta

SEQ ID NO: 8210460 - DNA, 22 bp, Homo sapiens
ggcatgctctttgtccacagta

SEQ ID NO: 8210461 - DNA, 22 bp, Homo sapiens
ggcatgctctgggggtcctccg

SEQ ID NO: 8210462 - DNA, 22 bp, Homo sapiens
ggccctgggatgctcagcagtg

SEQ ID NO: 8210463 - DNA, 22 bp, Homo sapiens
ggccctgggcagaggagtgggc

SEQ ID NO: 8210464 - DNA, 22 bp, Homo sapiens
ggccctgggcagaggagtgggc

SEQ ID NO: 8210465 - DNA, 22 bp, Homo sapiens
ggccctgggatgctcagcagtg

SEQ ID NO: 8210466 - DNA, 22 bp, Homo sapiens
ggccctgggatgctcagcagtg

SEQ ID NO: 8210467 - DNA, 22 bp, Homo sapiens
ggccctgggatgctcagcagtg

SEQ ID NO: 8210468 - DNA, 22 bp, Homo sapiens
ggccctgggatgctcagcagtg

SEQ ID NO: 8210469 - DNA, 22 bp, Homo sapiens
ggccctgggatgctcagcagtg

SEQ ID NO: 8210470 - DNA, 22 bp, Homo sapiens
ggccctgggatgctcagcagtg

SEQ ID NO: 8210471 - DNA, 22 bp, Homo sapiens
ggccctgggacacaacaccgaa

SEQ ID NO: 8210472 - DNA, 22 bp, Homo sapiens
ggccctgggccctctagcttgt

SEQ ID NO: 8210473 - DNA, 22 bp, Homo sapiens
ggccctgggccctctagcttgt

SEQ ID NO: 8210474 - DNA, 22 bp, Homo sapiens
ggccctgggcagaggagtgggc

SEQ ID NO: 8210475 - DNA, 22 bp, Homo sapiens
ggccctgggcagaggagtgggc

SEQ ID NO: 8210476 - DNA, 22 bp, Homo sapiens
ggccctgggcagaggagtgggc

SEQ ID NO: 8210477 - DNA, 22 bp, Homo sapiens
ggccctggtcctaggggtggaa

SEQ ID NO: 8210478 - DNA, 22 bp, Homo sapiens
ggccctggtcctaggggtggaa

SEQ ID NO: 8210479 - DNA, 22 bp, Homo sapiens
ggccctggtcctaggggtggaa

SEQ ID NO: 8210480 - DNA, 22 bp, Homo sapiens
ggccctggtcctaggggtggaa

SEQ ID NO: 8210481 - DNA, 21 bp, Homo sapiens
ggccctggttacgcctcctct

SEQ ID NO: 8210482 - DNA, 21 bp, Homo sapiens
ggccctggttacgcctcctct

SEQ ID NO: 8210483 - DNA, 21 bp, Homo sapiens
ggccctggttacgcctcctct

SEQ ID NO: 8210484 - DNA, 21 bp, Homo sapiens
ggccctggttacgcctcctct

SEQ ID NO: 8210485 - DNA, 21 bp, Homo sapiens
ggccctggttacgcctcctct

SEQ ID NO: 8210486 - DNA, 21 bp, Homo sapiens
ggccctggttacgcctcctct

SEQ ID NO: 8210487 - DNA, 22 bp, Homo sapiens
ggcctaggattctgcatttcta

SEQ ID NO: 8210488 - DNA, 22 bp, Homo sapiens
ggcctagggagtggccatgcct

SEQ ID NO: 8210489 - DNA, 22 bp, Homo sapiens
ggcctagcctctcctgagagag

SEQ ID NO: 8210490 - DNA, 22 bp, Homo sapiens
ggcctaggaaggggatgtaact

SEQ ID NO: 8210491 - DNA, 22 bp, Homo sapiens
ggcctagttttttctggtaggt

SEQ ID NO: 8210492 - DNA, 22 bp, Homo sapiens
ggcctagggcttggtcatggca

SEQ ID NO: 8210493 - DNA, 22 bp, Homo sapiens
ggcctagggagtggccatgcct

SEQ ID NO: 8210494 - DNA, 22 bp, Homo sapiens
ggcctagggcttggtcatggca

SEQ ID NO: 8210495 - DNA, 22 bp, Homo sapiens
ggcctagggagtggccatgcct

SEQ ID NO: 8210496 - DNA, 21 bp, Homo sapiens
ggcctaggggcagatggtgct

SEQ ID NO: 8210497 - DNA, 22 bp, Homo sapiens
ggcctagggcttggtcatggca

SEQ ID NO: 8210498 - DNA, 21 bp, Homo sapiens
ggcctaggggcagatggtgct

SEQ ID NO: 8210499 - DNA, 21 bp, Homo sapiens
ggcctaggggcagatggtgct

SEQ ID NO: 8210500 - DNA, 22 bp, Homo sapiens
ggccctggcagccacgaaagcc

SEQ ID NO: 8210501 - DNA, 22 bp, Homo sapiens
ggccctgctgagtggagtggag

SEQ ID NO: 8210502 - DNA, 22 bp, Homo sapiens
ggccctggcagccacgaaagcc

SEQ ID NO: 8210503 - DNA, 22 bp, Homo sapiens
ggccctggcagccacgaaagcc

SEQ ID NO: 8210504 - DNA, 22 bp, Homo sapiens
ggccctggcagccacgaaagcc

SEQ ID NO: 8210505 - DNA, 22 bp, Homo sapiens
ggccctgctgaagccgggtcta

SEQ ID NO: 8210506 - DNA, 22 bp, Homo sapiens
ggccctgctcaggctgcgatga

SEQ ID NO: 8210507 - DNA, 19 bp, Homo sapiens
ggccaggctgactgtggtc

SEQ ID NO: 8210508 - DNA, 22 bp, Homo sapiens
ggccctgctcaggctgcgatga

SEQ ID NO: 8210509 - DNA, 22 bp, Homo sapiens
ggccaggccaagagggttggaa

SEQ ID NO: 8210510 - DNA, 22 bp, Homo sapiens
ggccaggcgatgacccctccac

SEQ ID NO: 8210511 - DNA, 22 bp, Homo sapiens
ggccaggcgatgacccctccac

SEQ ID NO: 8210512 - DNA, 22 bp, Homo sapiens
ggccaggccaagagggttggaa

SEQ ID NO: 8210513 - DNA, 22 bp, Homo sapiens
ggccaggcactgtgtgagatat

SEQ ID NO: 8210514 - DNA, 22 bp, Homo sapiens
ggccaggcactgtgtgagatat

SEQ ID NO: 8210515 - DNA, 22 bp, Homo sapiens
ggccaggcactgtgtgagatat

SEQ ID NO: 8210516 - DNA, 22 bp, Homo sapiens
ggccaggcactgtgtgagatat

SEQ ID NO: 8210517 - DNA, 22 bp, Homo sapiens
ggccaggcactgtgtgagatat

SEQ ID NO: 8210518 - DNA, 22 bp, Homo sapiens
ggccaggcactgtgtgagatat

SEQ ID NO: 8210519 - DNA, 22 bp, Homo sapiens
ggccaggcactgtgtgagatat

SEQ ID NO: 8210520 - DNA, 22 bp, Homo sapiens
ggccaggagcaagccaggctct

SEQ ID NO: 8210521 - DNA, 22 bp, Homo sapiens
ggccaggagatggacaccacat

SEQ ID NO: 8210522 - DNA, 22 bp, Homo sapiens
ggccaggagcaagccaggctct

SEQ ID NO: 8210523 - DNA, 22 bp, Homo sapiens
ggccaggagcaagccaggctct

SEQ ID NO: 8210524 - DNA, 22 bp, Homo sapiens
ggccaggaagggaagatcagca

SEQ ID NO: 8210525 - DNA, 22 bp, Homo sapiens
ggccaggaagggaagatcagca

SEQ ID NO: 8210526 - DNA, 22 bp, Homo sapiens
ggccaggaagggaagatcagca

SEQ ID NO: 8210527 - DNA, 22 bp, Homo sapiens
ggccaggagcaagccaggctct

SEQ ID NO: 8210528 - DNA, 22 bp, Homo sapiens
ggccaggagctgcacagggctc

SEQ ID NO: 8210529 - DNA, 22 bp, Homo sapiens
ggccaggagctgcacagggctc

SEQ ID NO: 8210530 - DNA, 22 bp, Homo sapiens
ggccaggagctgcacagggctc

SEQ ID NO: 8210531 - DNA, 22 bp, Homo sapiens
ggccaggaggcaggggctcaat

SEQ ID NO: 8210532 - DNA, 22 bp, Homo sapiens
ggccaggaggcaggggctcaat

SEQ ID NO: 8210533 - DNA, 19 bp, Homo sapiens
ggcctgcccaatgtctgct

SEQ ID NO: 8210534 - DNA, 22 bp, Homo sapiens
ggcctgcctcacagtcagcacc

SEQ ID NO: 8210535 - DNA, 22 bp, Homo sapiens
ggcctcagaccggagctggcca

SEQ ID NO: 8210536 - DNA, 22 bp, Homo sapiens
ggcctcagaccggagctggcca

SEQ ID NO: 8210537 - DNA, 22 bp, Homo sapiens
ggcctcagaccggagctggcca

SEQ ID NO: 8210538 - DNA, 22 bp, Homo sapiens
ggcctcagaaatagagtaaaat

SEQ ID NO: 8210539 - DNA, 22 bp, Homo sapiens
ggcctggacacctgaggtctta

SEQ ID NO: 8210540 - DNA, 22 bp, Homo sapiens
ggcctggacaaatgcaccaagg

SEQ ID NO: 8210541 - DNA, 22 bp, Homo sapiens
ggcctggacacctgaggtctta

SEQ ID NO: 8210542 - DNA, 22 bp, Homo sapiens
ggcctggaatgctttcctacca

SEQ ID NO: 8210543 - DNA, 22 bp, Homo sapiens
ggcctggaatgctttcctacca

SEQ ID NO: 8210544 - DNA, 22 bp, Homo sapiens
ggcctggacaaatgcaccaagg

SEQ ID NO: 8210545 - DNA, 22 bp, Homo sapiens
ggcctggaaggacagcgtgatg

SEQ ID NO: 8210546 - DNA, 22 bp, Homo sapiens
ggcctggaaggacagcgtgatg

SEQ ID NO: 8210547 - DNA, 22 bp, Homo sapiens
ggcctggaaggacagcgtgatg

SEQ ID NO: 8210548 - DNA, 22 bp, Homo sapiens
ggcctggaagaggacagagaaa

SEQ ID NO: 8210549 - DNA, 22 bp, Homo sapiens
ggcctggaagaggacagagaaa

SEQ ID NO: 8210550 - DNA, 22 bp, Homo sapiens
ggcctggaagaggacagagaaa

SEQ ID NO: 8210551 - DNA, 22 bp, Homo sapiens
ggcctggaagaggacagagaaa

SEQ ID NO: 8210552 - DNA, 22 bp, Homo sapiens
ggcctgctggggcctcagacac

SEQ ID NO: 8210553 - DNA, 22 bp, Homo sapiens
ggcctgctgggccccacagtcc

SEQ ID NO: 8210554 - DNA, 22 bp, Homo sapiens
ggcctgctttccgagcctgcag

SEQ ID NO: 8210555 - DNA, 22 bp, Homo sapiens
ggcctgcttctcagtgagcttg

SEQ ID NO: 8210556 - DNA, 22 bp, Homo sapiens
ggcctgcttactgattgttgtt

SEQ ID NO: 8210557 - DNA, 18 bp, Homo sapiens
ggcgggtgttttattcac

SEQ ID NO: 8210558 - DNA, 22 bp, Homo sapiens
ggcggtattttttgaggataga

SEQ ID NO: 8210559 - DNA, 22 bp, Homo sapiens
ggcggtggcgtgaaggtggctg

SEQ ID NO: 8210560 - DNA, 22 bp, Homo sapiens
ggcgggtgtaagtaggacagcg

SEQ ID NO: 8210561 - DNA, 22 bp, Homo sapiens
ggcgggtgcacagacccttccc

SEQ ID NO: 8210562 - DNA, 19 bp, Homo sapiens
ggcgggtggactggagccc

SEQ ID NO: 8210563 - DNA, 22 bp, Homo sapiens
ggcctggctggttcagtaccct

SEQ ID NO: 8210564 - DNA, 22 bp, Homo sapiens
ggcctggcctcccttcctagcg

SEQ ID NO: 8210565 - DNA, 22 bp, Homo sapiens
ggcctggagcagagactaggga

SEQ ID NO: 8210566 - DNA, 22 bp, Homo sapiens
ggcctggagcagagactaggga

SEQ ID NO: 8210567 - DNA, 22 bp, Homo sapiens
ggcctggagcagagactaggga

SEQ ID NO: 8210568 - DNA, 22 bp, Homo sapiens
ggcctggagaaggcccagggag

SEQ ID NO: 8210569 - DNA, 22 bp, Homo sapiens
ggcctggagaaggcccagggag

SEQ ID NO: 8210570 - DNA, 22 bp, Homo sapiens
ggcctggagaaggcccagggag

SEQ ID NO: 8210571 - DNA, 22 bp, Homo sapiens
ggcctggagtttggggaataga

SEQ ID NO: 8210572 - DNA, 22 bp, Homo sapiens
ggcctggagtcagggaaagcaa

SEQ ID NO: 8210573 - DNA, 19 bp, Homo sapiens
ggcctggatttagggctcc

SEQ ID NO: 8210574 - DNA, 19 bp, Homo sapiens
ggcctggatttagggctcc

SEQ ID NO: 8210575 - DNA, 19 bp, Homo sapiens
ggcctggatttagggctcc

SEQ ID NO: 8210576 - DNA, 22 bp, Homo sapiens
ggcctggcatggggactaaggg

SEQ ID NO: 8210577 - DNA, 22 bp, Homo sapiens
ggcctggcatggggactaaggg

SEQ ID NO: 8210578 - DNA, 22 bp, Homo sapiens
ggcctggcctccagatgtgggc

SEQ ID NO: 8210579 - DNA, 23 bp, Homo sapiens
ggcctggcccagggccctgatga

SEQ ID NO: 8210580 - DNA, 22 bp, Homo sapiens
ggcctggcctccagatgtgggc

SEQ ID NO: 8210581 - DNA, 22 bp, Homo sapiens
ggcctggcctccagatgtgggc

SEQ ID NO: 8210582 - DNA, 22 bp, Homo sapiens
ggcagcttacgttttgctagtg

SEQ ID NO: 8210583 - DNA, 22 bp, Homo sapiens
ggcagcttacgttttgctagtg

SEQ ID NO: 8210584 - DNA, 22 bp, Homo sapiens
ggcagcttcctgagccagcagc

SEQ ID NO: 8210585 - DNA, 22 bp, Homo sapiens
ggcagcttcggacggcttataa

SEQ ID NO: 8210586 - DNA, 22 bp, Homo sapiens
ggcagcttctcccaggctgttt

SEQ ID NO: 8210587 - DNA, 22 bp, Homo sapiens
ggcagcttgccctggtctcaac

SEQ ID NO: 8210588 - DNA, 22 bp, Homo sapiens
ggcagcttctcccaggctgttt

SEQ ID NO: 8210589 - DNA, 22 bp, Homo sapiens
ggcagctttccttatcctaggg

SEQ ID NO: 8210590 - DNA, 22 bp, Homo sapiens
ggcagctttcacctgtcttcct

SEQ ID NO: 8210591 - DNA, 22 bp, Homo sapiens
ggcagctttggattcgcggctg

SEQ ID NO: 8210592 - DNA, 22 bp, Homo sapiens
ggcaggagaatggcgtgaactc

SEQ ID NO: 8210593 - DNA, 22 bp, Homo sapiens
ggcagctttcaatagggttatg

SEQ ID NO: 8210594 - DNA, 23 bp, Homo sapiens
ggcagcttgttcctttgcttcca

SEQ ID NO: 8210595 - DNA, 20 bp, Homo sapiens
ggcagcttgggcagcagtta

SEQ ID NO: 8210596 - DNA, 22 bp, Homo sapiens
ggcagctgttggctctctagga

SEQ ID NO: 8210597 - DNA, 22 bp, Homo sapiens
ggcagctgttggctctctagga

SEQ ID NO: 8210598 - DNA, 22 bp, Homo sapiens
ggcagctgtttgtcctcctgtt

SEQ ID NO: 8210599 - DNA, 22 bp, Homo sapiens
ggcagctgtttgtcctcctgtt

SEQ ID NO: 8210600 - DNA, 22 bp, Homo sapiens
ggcagctgtttgtcctcctgtt

SEQ ID NO: 8210601 - DNA, 22 bp, Homo sapiens
ggcagctgtttgtcctcctgtt

SEQ ID NO: 8210602 - DNA, 22 bp, Homo sapiens
ggcagctgtttgtcctcctgtt

SEQ ID NO: 8210603 - DNA, 17 bp, Homo sapiens
ggcagctgtgtgcatgc

SEQ ID NO: 8210604 - DNA, 17 bp, Homo sapiens
ggcagctgtgtgcatgc

SEQ ID NO: 8210605 - DNA, 17 bp, Homo sapiens
ggcagctgtgtgcatgc

SEQ ID NO: 8210606 - DNA, 17 bp, Homo sapiens
ggcagctgtgtgcatgc

SEQ ID NO: 8210607 - DNA, 22 bp, Homo sapiens
ggcagccatactcagacctggg

SEQ ID NO: 8210608 - DNA, 22 bp, Homo sapiens
ggcagccatggacactggctag

SEQ ID NO: 8210609 - DNA, 21 bp, Homo sapiens
ggcagctgtggttaattgaac

SEQ ID NO: 8210610 - DNA, 22 bp, Homo sapiens
ggcagcagggtagccatttctc

SEQ ID NO: 8210611 - DNA, 22 bp, Homo sapiens
ggcagcagggctgtctccctac

SEQ ID NO: 8210612 - DNA, 22 bp, Homo sapiens
ggcagcaggcgacttccctatt

SEQ ID NO: 8210613 - DNA, 20 bp, Homo sapiens
ggcagcaggagtttcctctt

SEQ ID NO: 8210614 - DNA, 20 bp, Homo sapiens
ggcagcaggagtttcctctt

SEQ ID NO: 8210615 - DNA, 22 bp, Homo sapiens
ggcagcagggctgtctccctac

SEQ ID NO: 8210616 - DNA, 22 bp, Homo sapiens
ggcagcagtccatggcccaagg

SEQ ID NO: 8210617 - DNA, 22 bp, Homo sapiens
ggcagcagtaggagctaatctt

SEQ ID NO: 8210618 - DNA, 22 bp, Homo sapiens
ggcagcagggtctagattgatg

SEQ ID NO: 8210619 - DNA, 22 bp, Homo sapiens
ggcagccatgcacgctgcctgg

SEQ ID NO: 8210620 - DNA, 22 bp, Homo sapiens
ggcagccatgcacgctgcctgg

SEQ ID NO: 8210621 - DNA, 22 bp, Homo sapiens
ggcagccatgcacgctgcctgg

SEQ ID NO: 8210622 - DNA, 22 bp, Homo sapiens
ggcagccatactcagacctggg

SEQ ID NO: 8210623 - DNA, 22 bp, Homo sapiens
ggcagccatactcagacctggg

SEQ ID NO: 8210624 - DNA, 22 bp, Homo sapiens
ggcagccatggacactggctag

SEQ ID NO: 8210625 - DNA, 22 bp, Homo sapiens
ggcagccatggacactggctag

SEQ ID NO: 8210626 - DNA, 22 bp, Homo sapiens
ggcagccatggacactggctag

SEQ ID NO: 8210627 - DNA, 22 bp, Homo sapiens
ggcagccatgctccaggtgcag

SEQ ID NO: 8210628 - DNA, 22 bp, Homo sapiens
ggcagccagcaatgagaagttt

SEQ ID NO: 8210629 - DNA, 22 bp, Homo sapiens
ggcagccagcaatgagaagttt

SEQ ID NO: 8210630 - DNA, 22 bp, Homo sapiens
ggcagccagcaatgagaagttt

SEQ ID NO: 8210631 - DNA, 22 bp, Homo sapiens
ggcagcagtggctgctattgtc

SEQ ID NO: 8210632 - DNA, 22 bp, Homo sapiens
ggcagccagtagggccagcctg

SEQ ID NO: 8210633 - DNA, 22 bp, Homo sapiens
ggcagccagtagggccagcctg

SEQ ID NO: 8210634 - DNA, 22 bp, Homo sapiens
ggcagccaggagggtgtagttt

SEQ ID NO: 8210635 - DNA, 22 bp, Homo sapiens
ggcagccagcgggtggacgcgc

SEQ ID NO: 8210636 - DNA, 22 bp, Homo sapiens
ggcagcagcaaggttggagctg

SEQ ID NO: 8210637 - DNA, 22 bp, Homo sapiens
ggcagcaggagccatctggtag

SEQ ID NO: 8210638 - DNA, 22 bp, Homo sapiens
ggcagcaggagccatctggtag

SEQ ID NO: 8210639 - DNA, 22 bp, Homo sapiens
ggcagcaggagccatctggtag

SEQ ID NO: 8210640 - DNA, 22 bp, Homo sapiens
ggcagcaggagccatctggtag

SEQ ID NO: 8210641 - DNA, 22 bp, Homo sapiens
ggcagcaggagccatctggtag

SEQ ID NO: 8210642 - DNA, 22 bp, Homo sapiens
ggcagcagcaaggttggagctg

SEQ ID NO: 8210643 - DNA, 22 bp, Homo sapiens
ggcagcagcaaggttggagctg

SEQ ID NO: 8210644 - DNA, 21 bp, Homo sapiens
ggcagaagtagcatggacggg

SEQ ID NO: 8210645 - DNA, 22 bp, Homo sapiens
ggcagaagtgatgggatataac

SEQ ID NO: 8210646 - DNA, 22 bp, Homo sapiens
ggcagaaggttgaagtaatttg

SEQ ID NO: 8210647 - DNA, 21 bp, Homo sapiens
ggcagaagtagcatggacggg

SEQ ID NO: 8210648 - DNA, 21 bp, Homo sapiens
ggcagaagtagcatggacggg

SEQ ID NO: 8210649 - DNA, 19 bp, Homo sapiens
ggcagaaggtgtaggggga

SEQ ID NO: 8210650 - DNA, 19 bp, Homo sapiens
ggcagaaggtgtaggggga

SEQ ID NO: 8210651 - DNA, 19 bp, Homo sapiens
ggcagaaggtgtaggggga

SEQ ID NO: 8210652 - DNA, 22 bp, Homo sapiens
ggcagaaggcaattagagactg

SEQ ID NO: 8210653 - DNA, 22 bp, Homo sapiens
ggcagaaggcaattagagactg

SEQ ID NO: 8210654 - DNA, 22 bp, Homo sapiens
ggcagaaggcctcccagctcct

SEQ ID NO: 8210655 - DNA, 22 bp, Homo sapiens
ggcagaaggcctcccagctcct

SEQ ID NO: 8210656 - DNA, 22 bp, Homo sapiens
ggcagaaggcctcccagctcct

SEQ ID NO: 8210657 - DNA, 22 bp, Homo sapiens
ggcagaagaaaggctaagtctc

SEQ ID NO: 8210658 - DNA, 22 bp, Homo sapiens
ggcagaagaaaggctaagtctc

SEQ ID NO: 8210659 - DNA, 22 bp, Homo sapiens
ggcagaagacaggcaaatcatg

SEQ ID NO: 8210660 - DNA, 22 bp, Homo sapiens
ggcagaagataggacagggaat

SEQ ID NO: 8210661 - DNA, 22 bp, Homo sapiens
ggcagaaggcaattagagactg

SEQ ID NO: 8210662 - DNA, 22 bp, Homo sapiens
ggcagaagataggacagggaat

SEQ ID NO: 8210663 - DNA, 22 bp, Homo sapiens
ggcactgctgtaggcagtgagg

SEQ ID NO: 8210664 - DNA, 22 bp, Homo sapiens
ggcactgggcaccggctgaggg

SEQ ID NO: 8210665 - DNA, 19 bp, Homo sapiens
ggcactggggccaggacca

SEQ ID NO: 8210666 - DNA, 22 bp, Homo sapiens
ggcactgccccctgcccaggac

SEQ ID NO: 8210667 - DNA, 22 bp, Homo sapiens
ggcactgcaggtaagtgctgtc

SEQ ID NO: 8210668 - DNA, 22 bp, Homo sapiens
ggcactgcaggtaagtgctgtc

SEQ ID NO: 8210669 - DNA, 22 bp, Homo sapiens
ggattgcaacaagctagtttag

SEQ ID NO: 8210670 - DNA, 17 bp, Homo sapiens
ggattgcatatacagtg

SEQ ID NO: 8210671 - DNA, 17 bp, Homo sapiens
ggattgcatatacagtg

SEQ ID NO: 8210672 - DNA, 22 bp, Homo sapiens
ggatttacaagtttaactctca

SEQ ID NO: 8210673 - DNA, 22 bp, Homo sapiens
ggatttacacacctgcctgtca

SEQ ID NO: 8210674 - DNA, 22 bp, Homo sapiens
ggatttacccaatggatagatg

SEQ ID NO: 8210675 - DNA, 20 bp, Homo sapiens
ggatttacaggggaaaagtg

SEQ ID NO: 8210676 - DNA, 22 bp, Homo sapiens
ggattttagagtacctaagtgt

SEQ ID NO: 8210677 - DNA, 22 bp, Homo sapiens
ggatttactatcttgaaatata

SEQ ID NO: 8210678 - DNA, 22 bp, Homo sapiens
ggatttccagcttcattgtcta

SEQ ID NO: 8210679 - DNA, 22 bp, Homo sapiens
ggcactttccagtctatagagc

SEQ ID NO: 8210680 - DNA, 22 bp, Homo sapiens
ggcactttgattttgagatgca

SEQ ID NO: 8210681 - DNA, 22 bp, Homo sapiens
ggcactttgcctttatgcactg

SEQ ID NO: 8210682 - DNA, 22 bp, Homo sapiens
ggcacttggatcttagttgggg

SEQ ID NO: 8210683 - DNA, 20 bp, Homo sapiens
ggcacttgatcccctggttc

SEQ ID NO: 8210684 - DNA, 22 bp, Homo sapiens
ggcactgtttttgtattcagtt

SEQ ID NO: 8210685 - DNA, 18 bp, Homo sapiens
ggcactggtgatgcagag

SEQ ID NO: 8210686 - DNA, 18 bp, Homo sapiens
ggcactggtgatgcagag

SEQ ID NO: 8210687 - DNA, 22 bp, Homo sapiens
ggcactgggtgagggtcactgg

SEQ ID NO: 8210688 - DNA, 22 bp, Homo sapiens
ggcactgggtgagggtcactgg

SEQ ID NO: 8210689 - DNA, 22 bp, Homo sapiens
ggcactgggtgagggtcactgg

SEQ ID NO: 8210690 - DNA, 18 bp, Homo sapiens
ggcactggtgatgcagag

SEQ ID NO: 8210691 - DNA, 18 bp, Homo sapiens
ggcactggtgatgcagag

SEQ ID NO: 8210692 - DNA, 22 bp, Homo sapiens
ggatggagatgaccatggtgac

SEQ ID NO: 8210693 - DNA, 22 bp, Homo sapiens
ggatggagatgaccatggtgac

SEQ ID NO: 8210694 - DNA, 23 bp, Homo sapiens
ggatggacgtgatgccttagcca

SEQ ID NO: 8210695 - DNA, 22 bp, Homo sapiens
ggatgctgtctaagctgaggac

SEQ ID NO: 8210696 - DNA, 22 bp, Homo sapiens
ggatgctgtctaagctgaggac

SEQ ID NO: 8210697 - DNA, 22 bp, Homo sapiens
ggatgctggggaccaatctctg

SEQ ID NO: 8210698 - DNA, 22 bp, Homo sapiens
ggatgctggggaccaatctctg

SEQ ID NO: 8210699 - DNA, 22 bp, Homo sapiens
ggatgctgctatcaggcttcga

SEQ ID NO: 8210700 - DNA, 22 bp, Homo sapiens
ggatgctgactttggagcatgg

SEQ ID NO: 8210701 - DNA, 22 bp, Homo sapiens
ggatgctgactttggagcatgg

SEQ ID NO: 8210702 - DNA, 22 bp, Homo sapiens
ggatgctcagtgcctgtgtcca

SEQ ID NO: 8210703 - DNA, 22 bp, Homo sapiens
ggatgctctgtctcttgctgtt

SEQ ID NO: 8210704 - DNA, 22 bp, Homo sapiens
ggatgctgggagacagcaggca

SEQ ID NO: 8210705 - DNA, 22 bp, Homo sapiens
ggatgctgggagacagcaggca

SEQ ID NO: 8210706 - DNA, 22 bp, Homo sapiens
ggatgctgctgcacatcctgca

SEQ ID NO: 8210707 - DNA, 22 bp, Homo sapiens
ggatgcaggaacacagcgacct

SEQ ID NO: 8210708 - DNA, 22 bp, Homo sapiens
ggatgcaggacggcatggatgt

SEQ ID NO: 8210709 - DNA, 22 bp, Homo sapiens
ggatgcaggaacacagcgacct

SEQ ID NO: 8210710 - DNA, 21 bp, Homo sapiens
ggatgccacgaagcaccagga

SEQ ID NO: 8210711 - DNA, 18 bp, Homo sapiens
ggattctggggacctggg

SEQ ID NO: 8210712 - DNA, 22 bp, Homo sapiens
ggattgagagcactggtagctg

SEQ ID NO: 8210713 - DNA, 22 bp, Homo sapiens
ggattccatggtcaggaaatag

SEQ ID NO: 8210714 - DNA, 22 bp, Homo sapiens
ggattctactgatcagcaccac

SEQ ID NO: 8210715 - DNA, 22 bp, Homo sapiens
ggattcagcgaggcagcctgga

SEQ ID NO: 8210716 - DNA, 22 bp, Homo sapiens
ggattagcttttgttcttgact

SEQ ID NO: 8210717 - DNA, 22 bp, Homo sapiens
ggattaagacctgtcagtacac

SEQ ID NO: 8210718 - DNA, 22 bp, Homo sapiens
ggatgggaacttggtagggcat

SEQ ID NO: 8210719 - DNA, 22 bp, Homo sapiens
ggatgttgattgaatggccatt

SEQ ID NO: 8210720 - DNA, 22 bp, Homo sapiens
ggatgttgattgaatggccatt

SEQ ID NO: 8210721 - DNA, 22 bp, Homo sapiens
ggatgggaacttggtagggcat

SEQ ID NO: 8210722 - DNA, 22 bp, Homo sapiens
ggatggcttgcatttgaggact

SEQ ID NO: 8210723 - DNA, 22 bp, Homo sapiens
ggatggctgtaaaaggtgggaa

SEQ ID NO: 8210724 - DNA, 22 bp, Homo sapiens
ggatggctccagaaagcagggt

SEQ ID NO: 8210725 - DNA, 22 bp, Homo sapiens
ggatggctccagaaagcagggt

SEQ ID NO: 8210726 - DNA, 22 bp, Homo sapiens
ggatggctccacagtttctccc

SEQ ID NO: 8210727 - DNA, 20 bp, Homo sapiens
ggatggctccacatcatttt

SEQ ID NO: 8210728 - DNA, 20 bp, Homo sapiens
ggatggccggaccagagcct

SEQ ID NO: 8210729 - DNA, 20 bp, Homo sapiens
ggatggccggaccagagcct

SEQ ID NO: 8210730 - DNA, 22 bp, Homo sapiens
ggatggagatgaccatggtgac

SEQ ID NO: 8210731 - DNA, 22 bp, Homo sapiens
ggatggagatgaccatggtgac

SEQ ID NO: 8210732 - DNA, 23 bp, Homo sapiens
ggatggacgtgatgccttagcca

SEQ ID NO: 8210733 - DNA, 22 bp, Homo sapiens
ggatggagatgaccatggtgac

SEQ ID NO: 8210734 - DNA, 22 bp, Homo sapiens
ggatggagatgaccatggtgac

SEQ ID NO: 8210735 - DNA, 22 bp, Homo sapiens
ggatggagatgaccatggtgac

SEQ ID NO: 8210736 - DNA, 22 bp, Homo sapiens
ggatggaggttctcagatgctc

SEQ ID NO: 8210737 - DNA, 22 bp, Homo sapiens
ggatggcagtctgcatgagaaa

SEQ ID NO: 8210738 - DNA, 22 bp, Homo sapiens
ggatggcatgttgggctctgtt

SEQ ID NO: 8210739 - DNA, 22 bp, Homo sapiens
ggatggcatgttgggctctgtt

SEQ ID NO: 8210740 - DNA, 22 bp, Homo sapiens
ggatggcatgttgggctctgtt

SEQ ID NO: 8210741 - DNA, 22 bp, Homo sapiens
ggatggccgagaagacagcgta

SEQ ID NO: 8210742 - DNA, 22 bp, Homo sapiens
ggagttgccaaggcttgaaaat

SEQ ID NO: 8210743 - DNA, 22 bp, Homo sapiens
ggagttgctggatgtggtttaa

SEQ ID NO: 8210744 - DNA, 22 bp, Homo sapiens
ggagttgctgagacagaacaca

SEQ ID NO: 8210745 - DNA, 22 bp, Homo sapiens
ggagcagatgtcttcatggcct

SEQ ID NO: 8210746 - DNA, 23 bp, Homo sapiens
ggagttggattgtacttgctgct

SEQ ID NO: 8210747 - DNA, 22 bp, Homo sapiens
ggagcagagcatttcacagcct

SEQ ID NO: 8210748 - DNA, 22 bp, Homo sapiens
ggagcactttctaggagaagcc

SEQ ID NO: 8210749 - DNA, 22 bp, Homo sapiens
ggagcagagcatttcacagcct

SEQ ID NO: 8210750 - DNA, 22 bp, Homo sapiens
ggagcagagctcttcatctgca

SEQ ID NO: 8210751 - DNA, 22 bp, Homo sapiens
ggagcagagctcttcatctgca

SEQ ID NO: 8210752 - DNA, 22 bp, Homo sapiens
ggagcagagctgggcttggctg

SEQ ID NO: 8210753 - DNA, 22 bp, Homo sapiens
ggatgaggaagattactgagaa

SEQ ID NO: 8210754 - DNA, 22 bp, Homo sapiens
ggatgaggaagattactgagaa

SEQ ID NO: 8210755 - DNA, 19 bp, Homo sapiens
ggatgagggtcaggcatag

SEQ ID NO: 8210756 - DNA, 19 bp, Homo sapiens
ggatgagggtcaggcatag

SEQ ID NO: 8210757 - DNA, 19 bp, Homo sapiens
ggatgagggtcaggcatag

SEQ ID NO: 8210758 - DNA, 22 bp, Homo sapiens
ggatgaggaaaccacagtgtcc

SEQ ID NO: 8210759 - DNA, 22 bp, Homo sapiens
ggatgaggaaaccacagtgtcc

SEQ ID NO: 8210760 - DNA, 22 bp, Homo sapiens
ggatgaggaaaccacagtgtcc

SEQ ID NO: 8210761 - DNA, 22 bp, Homo sapiens
ggatgacagctcttccatgtgg

SEQ ID NO: 8210762 - DNA, 22 bp, Homo sapiens
ggatgacagcaagggggtgaag

SEQ ID NO: 8210763 - DNA, 22 bp, Homo sapiens
ggatgacacagttagaaagaga

SEQ ID NO: 8210764 - DNA, 22 bp, Homo sapiens
ggatgacagataacagtattaa

SEQ ID NO: 8210765 - DNA, 22 bp, Homo sapiens
ggatgacagatgcaggctttga

SEQ ID NO: 8210766 - DNA, 23 bp, Homo sapiens
ggagttggattgtacttgctgct

SEQ ID NO: 8210767 - DNA, 22 bp, Homo sapiens
ggagttgttctgcaggagagaa

SEQ ID NO: 8210768 - DNA, 19 bp, Homo sapiens
ggagtttccaatgggtaaa

SEQ ID NO: 8210769 - DNA, 22 bp, Homo sapiens
ggatctggggtagagcagtggg

SEQ ID NO: 8210770 - DNA, 22 bp, Homo sapiens
ggatgacaaggaaagcaaacca

SEQ ID NO: 8210771 - DNA, 22 bp, Homo sapiens
ggatctggggtagagcagtggg

SEQ ID NO: 8210772 - DNA, 22 bp, Homo sapiens
ggagcaccctgctcagccaagc

SEQ ID NO: 8210773 - DNA, 22 bp, Homo sapiens
ggagcaccctgctcagccaagc

SEQ ID NO: 8210774 - DNA, 22 bp, Homo sapiens
ggagcactataatagagatttt

SEQ ID NO: 8210775 - DNA, 22 bp, Homo sapiens
ggagcactataatagagatttt

SEQ ID NO: 8210776 - DNA, 22 bp, Homo sapiens
ggagcaccgttgggaggtgagg

SEQ ID NO: 8210777 - DNA, 22 bp, Homo sapiens
ggagcaagtcccaggcactagt

SEQ ID NO: 8210778 - DNA, 22 bp, Homo sapiens
ggagatgtagtgtcactggact

SEQ ID NO: 8210779 - DNA, 22 bp, Homo sapiens
ggagatgtagtgtcactggact

SEQ ID NO: 8210780 - DNA, 22 bp, Homo sapiens
ggagcaaatgccaagtgggagg

SEQ ID NO: 8210781 - DNA, 22 bp, Homo sapiens
ggagatggtggaagctggtgca

SEQ ID NO: 8210782 - DNA, 22 bp, Homo sapiens
ggagatggtggaagctggtgca

SEQ ID NO: 8210783 - DNA, 22 bp, Homo sapiens
ggagatggtggaagctggtgca

SEQ ID NO: 8210784 - DNA, 22 bp, Homo sapiens
ggagatggtggaagctggtgca

SEQ ID NO: 8210785 - DNA, 22 bp, Homo sapiens
ggagatggtggaagctggtgca

SEQ ID NO: 8210786 - DNA, 21 bp, Homo sapiens
ggagatgggtatcgcctgggc

SEQ ID NO: 8210787 - DNA, 21 bp, Homo sapiens
ggagatgggtatcgcctgggc

SEQ ID NO: 8210788 - DNA, 22 bp, Homo sapiens
ggagatggtctgttctcatatt

SEQ ID NO: 8210789 - DNA, 22 bp, Homo sapiens
ggagatggctggcaggtagatg

SEQ ID NO: 8210790 - DNA, 22 bp, Homo sapiens
ggagatggctggcaggtagatg

SEQ ID NO: 8210791 - DNA, 22 bp, Homo sapiens
ggagatggctggcaggtagatg

SEQ ID NO: 8210792 - DNA, 22 bp, Homo sapiens
ggagatggctctgcaaggtcta

SEQ ID NO: 8210793 - DNA, 22 bp, Homo sapiens
ggagatggctggcaggtagatg

SEQ ID NO: 8210794 - DNA, 22 bp, Homo sapiens
ggagatggctggcaggtagatg

SEQ ID NO: 8210795 - DNA, 22 bp, Homo sapiens
ggagatggcaagaagttattag

SEQ ID NO: 8210796 - DNA, 22 bp, Homo sapiens
ggagaggcttggcccagcctgg

SEQ ID NO: 8210797 - DNA, 22 bp, Homo sapiens
ttgcaccccttgattgagcctt

SEQ ID NO: 8210798 - DNA, 22 bp, Homo sapiens
ttgcacctcatttcatttgggc

SEQ ID NO: 8210799 - DNA, 22 bp, Homo sapiens
ttgcactagacacatttcaagt

SEQ ID NO: 8210800 - DNA, 22 bp, Homo sapiens
ttgcacatttcctagaatttca

SEQ ID NO: 8210801 - DNA, 22 bp, Homo sapiens
ttgcacatgctatttatgtttt

SEQ ID NO: 8210802 - DNA, 22 bp, Homo sapiens
ttgcacatgttggttcttgaaa

SEQ ID NO: 8210803 - DNA, 22 bp, Homo sapiens
ttgcactccagcccgagcaaca

SEQ ID NO: 8210804 - DNA, 22 bp, Homo sapiens
ttgctgagctttggcaaggaag

SEQ ID NO: 8210805 - DNA, 22 bp, Homo sapiens
ttgccgccgtctgctcgccccg

SEQ ID NO: 8210806 - DNA, 22 bp, Homo sapiens
ttgccgtccttactccagcgga

SEQ ID NO: 8210807 - DNA, 22 bp, Homo sapiens
ttgcacatgatagatgatttct

SEQ ID NO: 8210808 - DNA, 23 bp, Homo sapiens
ttgcacagtgtatacacatattt

SEQ ID NO: 8210809 - DNA, 20 bp, Homo sapiens
ttgcacagaggtttcaagtg

SEQ ID NO: 8210810 - DNA, 18 bp, Homo sapiens
ctcaggcctttccctgtg

SEQ ID NO: 8210811 - DNA, 18 bp, Homo sapiens
ctcaggcctttccctgtg

SEQ ID NO: 8210812 - DNA, 22 bp, Homo sapiens
ttgctgaggttgttttgaggag

SEQ ID NO: 8210813 - DNA, 22 bp, Homo sapiens
ttgctggtaaagtctttatcgg

SEQ ID NO: 8210814 - DNA, 22 bp, Homo sapiens
ttgctgggtgctattatgaaca

SEQ ID NO: 8210815 - DNA, 22 bp, Homo sapiens
ttgctgtagggggaaaatactt

SEQ ID NO: 8210816 - DNA, 22 bp, Homo sapiens
ctcaggctaagaaggccaagtg

SEQ ID NO: 8210817 - DNA, 22 bp, Homo sapiens
ctcaggctaagaaggccaagtg

SEQ ID NO: 8210818 - DNA, 22 bp, Homo sapiens
ctcaggctaagaaggccaagtg

SEQ ID NO: 8210819 - DNA, 22 bp, Homo sapiens
ctcaggctcatatcccatcagc

SEQ ID NO: 8210820 - DNA, 22 bp, Homo sapiens
ttgctgggtcagaagccaggag

SEQ ID NO: 8210821 - DNA, 22 bp, Homo sapiens
ttgctggggtgtgaaatctgat

SEQ ID NO: 8210822 - DNA, 22 bp, Homo sapiens
ttgctggcttgaagatagagga

SEQ ID NO: 8210823 - DNA, 20 bp, Homo sapiens
ttgctgggacctttttcaac

SEQ ID NO: 8210824 - DNA, 22 bp, Homo sapiens
ttgctgggctcttcaacacaca

SEQ ID NO: 8210825 - DNA, 22 bp, Homo sapiens
ttgctgggcatgtcttaattct

SEQ ID NO: 8210826 - DNA, 22 bp, Homo sapiens
ctcagaaagcaatctggtgagg

SEQ ID NO: 8210827 - DNA, 22 bp, Homo sapiens
ctcagaaacggagctgccattt

SEQ ID NO: 8210828 - DNA, 22 bp, Homo sapiens
ttgatcaaatcagctactgagg

SEQ ID NO: 8210829 - DNA, 22 bp, Homo sapiens
ttgatcaaatcagctactgagg

SEQ ID NO: 8210830 - DNA, 22 bp, Homo sapiens
ttgatttttttctactatgcgc

SEQ ID NO: 8210831 - DNA, 22 bp, Homo sapiens
ttgcaaaaccatcctaagtaaa

SEQ ID NO: 8210832 - DNA, 22 bp, Homo sapiens
ttgcaaaaccatcctaagtaaa

SEQ ID NO: 8210833 - DNA, 22 bp, Homo sapiens
ttgcaaaaccatcctaagtaaa

SEQ ID NO: 8210834 - DNA, 22 bp, Homo sapiens
ttgcaaaagcaattgcagtttt

SEQ ID NO: 8210835 - DNA, 22 bp, Homo sapiens
ctcagcagtgacaagagagtat

SEQ ID NO: 8210836 - DNA, 22 bp, Homo sapiens
ctcagcagtgacaagagagtat

SEQ ID NO: 8210837 - DNA, 22 bp, Homo sapiens
ttgcaaagaattttacattcta

SEQ ID NO: 8210838 - DNA, 23 bp, Homo sapiens
ttgcaaaatgcaattgagttaga

SEQ ID NO: 8210839 - DNA, 23 bp, Homo sapiens
ttgcaaaatgagtcttgagtgaa

SEQ ID NO: 8210840 - DNA, 23 bp, Homo sapiens
ttgcaaaatgcaattgagttaga

SEQ ID NO: 8210841 - DNA, 23 bp, Homo sapiens
ttgcaaaatgagtcttgagtgaa

SEQ ID NO: 8210842 - DNA, 22 bp, Homo sapiens
ctcagccagacatgacccagtc

SEQ ID NO: 8210843 - DNA, 22 bp, Homo sapiens
ctcagcatggagggagaacaag

SEQ ID NO: 8210844 - DNA, 22 bp, Homo sapiens
ctcagccagtgatctttccttt

SEQ ID NO: 8210845 - DNA, 22 bp, Homo sapiens
ctcagccatgcaacatgctggg

SEQ ID NO: 8210846 - DNA, 22 bp, Homo sapiens
ctcagccatgcaacatgctggg

SEQ ID NO: 8210847 - DNA, 22 bp, Homo sapiens
ctcagccagtgatctttccttt

SEQ ID NO: 8210848 - DNA, 22 bp, Homo sapiens
ctcagccagacatgacccagtc

SEQ ID NO: 8210849 - DNA, 22 bp, Homo sapiens
ctcagccccaatttgccctctt

SEQ ID NO: 8210850 - DNA, 22 bp, Homo sapiens
ctcaggagtagttcagcagctg

SEQ ID NO: 8210851 - DNA, 22 bp, Homo sapiens
ctcagcccagcccaggaccagg

SEQ ID NO: 8210852 - DNA, 22 bp, Homo sapiens
ctcagccccaattctccccatt

SEQ ID NO: 8210853 - DNA, 22 bp, Homo sapiens
ctcagcccagctcaggtctttc

SEQ ID NO: 8210854 - DNA, 22 bp, Homo sapiens
ctcagccatgtcatgcctacct

SEQ ID NO: 8210855 - DNA, 22 bp, Homo sapiens
ctcagccatgtcatgcctacct

SEQ ID NO: 8210856 - DNA, 22 bp, Homo sapiens
ctcagcccagcccaggaccagg

SEQ ID NO: 8210857 - DNA, 22 bp, Homo sapiens
ctcagccatgtcatgcctacct

SEQ ID NO: 8210858 - DNA, 22 bp, Homo sapiens
ctcagccatggggtggatcagc

SEQ ID NO: 8210859 - DNA, 22 bp, Homo sapiens
ctcaggccattcttccagctgc

SEQ ID NO: 8210860 - DNA, 22 bp, Homo sapiens
ctcaggccaggtttctcccaca

SEQ ID NO: 8210861 - DNA, 22 bp, Homo sapiens
ctcaggagttggaggctacagt

SEQ ID NO: 8210862 - DNA, 22 bp, Homo sapiens
ctcaggccaataagctccagcc

SEQ ID NO: 8210863 - DNA, 22 bp, Homo sapiens
ctcaggcccacagcagacccac

SEQ ID NO: 8210864 - DNA, 22 bp, Homo sapiens
ctcaggccattcttccagctgc

SEQ ID NO: 8210865 - DNA, 22 bp, Homo sapiens
ctcaggcccacagcagacccac

SEQ ID NO: 8210866 - DNA, 22 bp, Homo sapiens
ctcaggcctgagtggcagtccc

SEQ ID NO: 8210867 - DNA, 22 bp, Homo sapiens
ttgaagtagtatcttaaggaca

SEQ ID NO: 8210868 - DNA, 22 bp, Homo sapiens
ttgaaatatcaagttattagtg

SEQ ID NO: 8210869 - DNA, 22 bp, Homo sapiens
ttgaaatatcaagttattagtg

SEQ ID NO: 8210870 - DNA, 22 bp, Homo sapiens
ttgaagtcagttcatattttta

SEQ ID NO: 8210871 - DNA, 22 bp, Homo sapiens
ttgaagttctgcatttctaata

SEQ ID NO: 8210872 - DNA, 19 bp, Homo sapiens
ttgaagttacagtcatgcc

SEQ ID NO: 8210873 - DNA, 22 bp, Homo sapiens
ttgaagtctcatgatttaaaga

SEQ ID NO: 8210874 - DNA, 22 bp, Homo sapiens
ttcttcatgctgttgctgcttg

SEQ ID NO: 8210875 - DNA, 22 bp, Homo sapiens
ttcttcatgctgttgctgcttg

SEQ ID NO: 8210876 - DNA, 21 bp, Homo sapiens
ttcttcatgatgattaatggc

SEQ ID NO: 8210877 - DNA, 22 bp, Homo sapiens
ttcttcattcccttacttccga

SEQ ID NO: 8210878 - DNA, 22 bp, Homo sapiens
ttcttcattcccttacttccga

SEQ ID NO: 8210879 - DNA, 22 bp, Homo sapiens
ttcttcccagccagcacagccc

SEQ ID NO: 8210880 - DNA, 21 bp, Homo sapiens
ttcttcatgatgattaatggc

SEQ ID NO: 8210881 - DNA, 22 bp, Homo sapiens
ttcttcatctgtaagataagca

SEQ ID NO: 8210882 - DNA, 22 bp, Homo sapiens
ttcttcagtttggtaaatgtaa

SEQ ID NO: 8210883 - DNA, 22 bp, Homo sapiens
ttcttcagtgcccctctagtag

SEQ ID NO: 8210884 - DNA, 21 bp, Homo sapiens
ttcttcagtttaatataaaat

SEQ ID NO: 8210885 - DNA, 22 bp, Homo sapiens
ttgaatgaaattgctgtgttat

SEQ ID NO: 8210886 - DNA, 19 bp, Homo sapiens
ttgaatatgcaaactgaag

SEQ ID NO: 8210887 - DNA, 22 bp, Homo sapiens
ttgaatctataatttcagtatt

SEQ ID NO: 8210888 - DNA, 22 bp, Homo sapiens
ttgaatagtgttttcagtatac

SEQ ID NO: 8210889 - DNA, 22 bp, Homo sapiens
ttgaataatgtgtatgttgtta

SEQ ID NO: 8210890 - DNA, 22 bp, Homo sapiens
ttgaagttgtagttcagtgaag

SEQ ID NO: 8210891 - DNA, 22 bp, Homo sapiens
ttgaagttggtgtggaaagtag

SEQ ID NO: 8210892 - DNA, 22 bp, Homo sapiens
ttgaagtttaatggtagattcc

SEQ ID NO: 8210893 - DNA, 22 bp, Homo sapiens
ttgaagttgtagttcagtgaag

SEQ ID NO: 8210894 - DNA, 22 bp, Homo sapiens
ctcactgtgccttttcccaaac

SEQ ID NO: 8210895 - DNA, 22 bp, Homo sapiens
ctcactggcaagactacaggtg

SEQ ID NO: 8210896 - DNA, 22 bp, Homo sapiens
ctcactgtctgtactagctgat

SEQ ID NO: 8210897 - DNA, 22 bp, Homo sapiens
ctcagaaaacctctttcttgat

SEQ ID NO: 8210898 - DNA, 22 bp, Homo sapiens
ctcagaaacggagctgccattt

SEQ ID NO: 8210899 - DNA, 20 bp, Homo sapiens
ctcagaaaagctaaggagaa

SEQ ID NO: 8210900 - DNA, 22 bp, Homo sapiens
ctcactgcaagttccacctacc

SEQ ID NO: 8210901 - DNA, 22 bp, Homo sapiens
ctcactgcaagctctgcctccc

SEQ ID NO: 8210902 - DNA, 22 bp, Homo sapiens
ctcactggcaagactacaggtg

SEQ ID NO: 8210903 - DNA, 22 bp, Homo sapiens
ctcactggcaagactacaggtg

SEQ ID NO: 8210904 - DNA, 22 bp, Homo sapiens
ctcactggcaagactacaggtg

SEQ ID NO: 8210905 - DNA, 22 bp, Homo sapiens
ctcactgccctgaagttgggtt

SEQ ID NO: 8210906 - DNA, 22 bp, Homo sapiens
ctcactgcaagctctgcctcca

SEQ ID NO: 8210907 - DNA, 22 bp, Homo sapiens
ctcactgcaagctctgcctccc

SEQ ID NO: 8210908 - DNA, 22 bp, Homo sapiens
ctcactgcaagctctgcctccc

SEQ ID NO: 8210909 - DNA, 22 bp, Homo sapiens
ctcactgcaagctctgcctcca

SEQ ID NO: 8210910 - DNA, 22 bp, Homo sapiens
ctcactgcaagctccgcctccc

SEQ ID NO: 8210911 - DNA, 22 bp, Homo sapiens
ctcactgcaagctctgcctcca

SEQ ID NO: 8210912 - DNA, 22 bp, Homo sapiens
ttctctttttgcatctcaacct

SEQ ID NO: 8210913 - DNA, 22 bp, Homo sapiens
ttctctttttgcatctcaacct

SEQ ID NO: 8210914 - DNA, 22 bp, Homo sapiens
ctataaatctacccagcattgg

SEQ ID NO: 8210915 - DNA, 22 bp, Homo sapiens
ttctcttttgtgatgtgagatg

SEQ ID NO: 8210916 - DNA, 22 bp, Homo sapiens
ttctgaaaattgggtcatactt

SEQ ID NO: 8210917 - DNA, 22 bp, Homo sapiens
ttctgaaattcgactatccaat

SEQ ID NO: 8210918 - DNA, 22 bp, Homo sapiens
ttctgaaatgagatataaggta

SEQ ID NO: 8210919 - DNA, 22 bp, Homo sapiens
ttctgaaagccaattcattgaa

SEQ ID NO: 8210920 - DNA, 22 bp, Homo sapiens
ttctgtcctgttggatgaatca

SEQ ID NO: 8210921 - DNA, 22 bp, Homo sapiens
ttcttaaaattcaagctaggtt

SEQ ID NO: 8210922 - DNA, 22 bp, Homo sapiens
ttcttaaaattcaagctaggtt

SEQ ID NO: 8210923 - DNA, 22 bp, Homo sapiens
ttctgaaatttcaactttacta

SEQ ID NO: 8210924 - DNA, 22 bp, Homo sapiens
ttcttaagtttagcaacttgtg

SEQ ID NO: 8210925 - DNA, 22 bp, Homo sapiens
ttcttaatggcaaaggatttta

SEQ ID NO: 8210926 - DNA, 22 bp, Homo sapiens
ttcttaatggcaaaggatttta

SEQ ID NO: 8210927 - DNA, 19 bp, Homo sapiens
ttcttacaacaccctggga

SEQ ID NO: 8210928 - DNA, 22 bp, Homo sapiens
ttcttcaggtggttttggtaac

SEQ ID NO: 8210929 - DNA, 22 bp, Homo sapiens
ttcttcagtcccactagccaca

SEQ ID NO: 8210930 - DNA, 21 bp, Homo sapiens
ttcttcaggccaatgctcatt

SEQ ID NO: 8210931 - DNA, 22 bp, Homo sapiens
ttcttaactggaaaatgtcaga

SEQ ID NO: 8210932 - DNA, 20 bp, Homo sapiens
ttcttaaagacctcactttg

SEQ ID NO: 8210933 - DNA, 22 bp, Homo sapiens
ttcttaaagaggcaaaacacag

SEQ ID NO: 8210934 - DNA, 22 bp, Homo sapiens
ttcttaaagaggcaaaacacag

SEQ ID NO: 8210935 - DNA, 22 bp, Homo sapiens
ctacataatctggatttgtctg

SEQ ID NO: 8210936 - DNA, 22 bp, Homo sapiens
ctacataatctggatttgtctg

SEQ ID NO: 8210937 - DNA, 22 bp, Homo sapiens
ctacataaatttatcacagact

SEQ ID NO: 8210938 - DNA, 22 bp, Homo sapiens
ctacagtgtgacaggcttggtg

SEQ ID NO: 8210939 - DNA, 22 bp, Homo sapiens
ctacataaatatttatgtgtct

SEQ ID NO: 8210940 - DNA, 22 bp, Homo sapiens
ctacatctcaccttccaggaca

SEQ ID NO: 8210941 - DNA, 22 bp, Homo sapiens
ctacatgtaggtttccttaatt

SEQ ID NO: 8210942 - DNA, 22 bp, Homo sapiens
ctacattaaattggcttactta

SEQ ID NO: 8210943 - DNA, 22 bp, Homo sapiens
ttctacatcacttaacatgcta

SEQ ID NO: 8210944 - DNA, 22 bp, Homo sapiens
ttctacatcacttaacatgcta

SEQ ID NO: 8210945 - DNA, 22 bp, Homo sapiens
ttctacatgagaaaatgtattt

SEQ ID NO: 8210946 - DNA, 22 bp, Homo sapiens
ttctacattcatgtattacctc

SEQ ID NO: 8210947 - DNA, 22 bp, Homo sapiens
ttctacattgtgaagttcttta

SEQ ID NO: 8210948 - DNA, 22 bp, Homo sapiens
ttctacattgtgaagttcttta

SEQ ID NO: 8210949 - DNA, 22 bp, Homo sapiens
ttctacatggaagagccttctt

SEQ ID NO: 8210950 - DNA, 22 bp, Homo sapiens
ttctacatgagaaaatgtattt

SEQ ID NO: 8210951 - DNA, 22 bp, Homo sapiens
ttctacatgtgatgcgtgcctg

SEQ ID NO: 8210952 - DNA, 22 bp, Homo sapiens
ttctacatgtcaagtctccaag

SEQ ID NO: 8210953 - DNA, 22 bp, Homo sapiens
ttctacatggttgctcagaggg

SEQ ID NO: 8210954 - DNA, 22 bp, Homo sapiens
ttctacctcagtttcccactta

SEQ ID NO: 8210955 - DNA, 22 bp, Homo sapiens
ttctacccgttgagagaatgct

SEQ ID NO: 8210956 - DNA, 22 bp, Homo sapiens
ctacagtgaagactagctatag

SEQ ID NO: 8210957 - DNA, 22 bp, Homo sapiens
ttctaccagaccccagacttgt

SEQ ID NO: 8210958 - DNA, 22 bp, Homo sapiens
ttctacatttaaaaggaaaatc

SEQ ID NO: 8210959 - DNA, 22 bp, Homo sapiens
ttctacatttgaggagagtcag

SEQ ID NO: 8210960 - DNA, 22 bp, Homo sapiens
ctaaatgccccttctggcacag

SEQ ID NO: 8210961 - DNA, 22 bp, Homo sapiens
ctaaatgccctacaatgactgg

SEQ ID NO: 8210962 - DNA, 22 bp, Homo sapiens
ctaaatgcctttcctacctaac

SEQ ID NO: 8210963 - DNA, 22 bp, Homo sapiens
ctaactacaagcggggcatcct

SEQ ID NO: 8210964 - DNA, 22 bp, Homo sapiens
ctaaattatttgcacattagag

SEQ ID NO: 8210965 - DNA, 22 bp, Homo sapiens
ctaaattatttgcacattagag

SEQ ID NO: 8210966 - DNA, 22 bp, Homo sapiens
ctaaattatcatgagaattatg

SEQ ID NO: 8210967 - DNA, 22 bp, Homo sapiens
ctaaattatttgcacattagag

SEQ ID NO: 8210968 - DNA, 22 bp, Homo sapiens
ctaactttagcttagattatca

SEQ ID NO: 8210969 - DNA, 22 bp, Homo sapiens
ctaactttatttgctaagtaga

SEQ ID NO: 8210970 - DNA, 22 bp, Homo sapiens
ctaactgtcatgcacatgtgtt

SEQ ID NO: 8210971 - DNA, 22 bp, Homo sapiens
ttccttttgcaaggtcctctag

SEQ ID NO: 8210972 - DNA, 22 bp, Homo sapiens
ctaactttatttgctaagtaga

SEQ ID NO: 8210973 - DNA, 22 bp, Homo sapiens
ttctacaggtactgaagtacat

SEQ ID NO: 8210974 - DNA, 22 bp, Homo sapiens
ttctacaggtactgaagtacat

SEQ ID NO: 8210975 - DNA, 21 bp, Homo sapiens
ttctacaggatgaatgaaaac

SEQ ID NO: 8210976 - DNA, 22 bp, Homo sapiens
ttctacatatatttttctcact

SEQ ID NO: 8210977 - DNA, 22 bp, Homo sapiens
ttctacatagtctcttggagct

SEQ ID NO: 8210978 - DNA, 22 bp, Homo sapiens
ttctacagaataaatgtttaca

SEQ ID NO: 8210979 - DNA, 22 bp, Homo sapiens
ttctacagactataactgtgat

SEQ ID NO: 8210980 - DNA, 21 bp, Homo sapiens
ttctacaggatgaatgaaaac

SEQ ID NO: 8210981 - DNA, 22 bp, Homo sapiens
ttctcagtttcactgataacag

SEQ ID NO: 8210982 - DNA, 19 bp, Homo sapiens
ttctcagttcaggagaaga

SEQ ID NO: 8210983 - DNA, 22 bp, Homo sapiens
ttctcaggtgaggctgaggctg

SEQ ID NO: 8210984 - DNA, 22 bp, Homo sapiens
ctacatttacacagttaggctt

SEQ ID NO: 8210985 - DNA, 22 bp, Homo sapiens
ctacattgttatctgtaagtgt

SEQ ID NO: 8210986 - DNA, 22 bp, Homo sapiens
ttctcaggtgaggctgaggctg

SEQ ID NO: 8210987 - DNA, 22 bp, Homo sapiens
ttctcaggtcaccagggtgcca

SEQ ID NO: 8210988 - DNA, 22 bp, Homo sapiens
ttctatttttgtggaactgtag

SEQ ID NO: 8210989 - DNA, 22 bp, Homo sapiens
ttctatttttgtggaactgtag

SEQ ID NO: 8210990 - DNA, 22 bp, Homo sapiens
ttctcatagagacatgattata

SEQ ID NO: 8210991 - DNA, 22 bp, Homo sapiens
ttctcatagagacatgattata

SEQ ID NO: 8210992 - DNA, 22 bp, Homo sapiens
ttctcatgaaactcgcttcctc

SEQ ID NO: 8210993 - DNA, 22 bp, Homo sapiens
ttctcatgaaactcgcttcctc

SEQ ID NO: 8210994 - DNA, 22 bp, Homo sapiens
ttctcatgaaactcgcttcctc

SEQ ID NO: 8210995 - DNA, 22 bp, Homo sapiens
ttctcattctgactcagtgtag

SEQ ID NO: 8210996 - DNA, 21 bp, Homo sapiens
ttctcatgggataagtacatg

SEQ ID NO: 8210997 - DNA, 22 bp, Homo sapiens
ttctcatgaaactcgcttcctc

SEQ ID NO: 8210998 - DNA, 22 bp, Homo sapiens
ttctcctgcccttggacttcca

SEQ ID NO: 8210999 - DNA, 22 bp, Homo sapiens
ttctcctgcccttggacttcca

SEQ ID NO: 8211000 - DNA, 22 bp, Homo sapiens
ttctcattctgactcagtgtag

SEQ ID NO: 8211001 - DNA, 19 bp, Homo sapiens
ttctcattcctttccactt

SEQ ID NO: 8211002 - DNA, 22 bp, Homo sapiens
ttctcctgggaggggttgccca

SEQ ID NO: 8211003 - DNA, 22 bp, Homo sapiens
ttctcctggagtgcttgttggg

SEQ ID NO: 8211004 - DNA, 22 bp, Homo sapiens
ttctcctgcgcaggcccaggga

SEQ ID NO: 8211005 - DNA, 22 bp, Homo sapiens
ttctcctgcccttggacttcca

SEQ ID NO: 8211006 - DNA, 22 bp, Homo sapiens
ttctccttcctggttttcaggc

SEQ ID NO: 8211007 - DNA, 22 bp, Homo sapiens
ttctccttgaaaagctgcatct

SEQ ID NO: 8211008 - DNA, 22 bp, Homo sapiens
ttctccttgaaaagctgcatct

SEQ ID NO: 8211009 - DNA, 22 bp, Homo sapiens
ttctcctggggccgtgatgtga

SEQ ID NO: 8211010 - DNA, 21 bp, Homo sapiens
ttctcctgttttgcaccacag

SEQ ID NO: 8211011 - DNA, 22 bp, Homo sapiens
ttctccttggtttatgggacat

SEQ ID NO: 8211012 - DNA, 22 bp, Homo sapiens
ttctccttggtttatgggacat

SEQ ID NO: 8211013 - DNA, 19 bp, Homo sapiens
ctagggcttggcagcaggc

SEQ ID NO: 8211014 - DNA, 22 bp, Homo sapiens
ctagggcttccaagatgccttc

SEQ ID NO: 8211015 - DNA, 22 bp, Homo sapiens
ctataaatctacccagcattgg

SEQ ID NO: 8211016 - DNA, 22 bp, Homo sapiens
ctagtttagtcagagccttgct

SEQ ID NO: 8211017 - DNA, 22 bp, Homo sapiens
ctagtttggttagataagtctc

SEQ ID NO: 8211018 - DNA, 22 bp, Homo sapiens
ctagtttagagtatgcgtgtgt

SEQ ID NO: 8211019 - DNA, 22 bp, Homo sapiens
ctagtttaaagcagctgaaagg

SEQ ID NO: 8211020 - DNA, 22 bp, Homo sapiens
ctagttgtttaatattgattga

SEQ ID NO: 8211021 - DNA, 22 bp, Homo sapiens
ctagtttaaagcagctgaaagg

SEQ ID NO: 8211022 - DNA, 22 bp, Homo sapiens
ctagttgtttaatattgattga

SEQ ID NO: 8211023 - DNA, 22 bp, Homo sapiens
ctagtttaaagcagctgaaagg

SEQ ID NO: 8211024 - DNA, 22 bp, Homo sapiens
ctagttctcctgaaatgtttgg

SEQ ID NO: 8211025 - DNA, 22 bp, Homo sapiens
ctagttctagatccctgaggaa

SEQ ID NO: 8211026 - DNA, 22 bp, Homo sapiens
ctagttctgccattcagtgtca

SEQ ID NO: 8211027 - DNA, 22 bp, Homo sapiens
ctagttctaaatctgttgtcca

SEQ ID NO: 8211028 - DNA, 22 bp, Homo sapiens
ctagtggaaactaactggaatt

SEQ ID NO: 8211029 - DNA, 22 bp, Homo sapiens
ctagtgaacgtggtactatgga

SEQ ID NO: 8211030 - DNA, 22 bp, Homo sapiens
ctagggctcgcaagggctggag

SEQ ID NO: 8211031 - DNA, 22 bp, Homo sapiens
ctagttctagatccctgaggaa

SEQ ID NO: 8211032 - DNA, 22 bp, Homo sapiens
ctagtgtttattaatcatgagg

SEQ ID NO: 8211033 - DNA, 22 bp, Homo sapiens
ctagtgtttattaatcatgagg

SEQ ID NO: 8211034 - DNA, 22 bp, Homo sapiens
ttccactctccagtcaatttca

SEQ ID NO: 8211035 - DNA, 22 bp, Homo sapiens
ttccactctccagtcaatttca

SEQ ID NO: 8211036 - DNA, 19 bp, Homo sapiens
ttccacttgggttagaatt

SEQ ID NO: 8211037 - DNA, 22 bp, Homo sapiens
ttccacttagtggaagggcatg

SEQ ID NO: 8211038 - DNA, 19 bp, Homo sapiens
ttccacttgggttagaatt

SEQ ID NO: 8211039 - DNA, 22 bp, Homo sapiens
ttccactttgggtctgtgcagg

SEQ ID NO: 8211040 - DNA, 22 bp, Homo sapiens
ttccactttgggtctgtgcagg

SEQ ID NO: 8211041 - DNA, 22 bp, Homo sapiens
ttccacttttctctctcatgcc

SEQ ID NO: 8211042 - DNA, 22 bp, Homo sapiens
ttccacttttctctctcatgcc

SEQ ID NO: 8211043 - DNA, 22 bp, Homo sapiens
ttccacttttctctctcatgcc

SEQ ID NO: 8211044 - DNA, 22 bp, Homo sapiens
ttccacttttctctctcatgcc

SEQ ID NO: 8211045 - DNA, 22 bp, Homo sapiens
ttccagaaaacgctttatttag

SEQ ID NO: 8211046 - DNA, 22 bp, Homo sapiens
ttccagaaaaaaatgtatatct

SEQ ID NO: 8211047 - DNA, 22 bp, Homo sapiens
ttccagaaaacgctttatttag

SEQ ID NO: 8211048 - DNA, 21 bp, Homo sapiens
ttccagaaatctctttcttca

SEQ ID NO: 8211049 - DNA, 22 bp, Homo sapiens
ttccagaaatctttcagctcaa

SEQ ID NO: 8211050 - DNA, 22 bp, Homo sapiens
ttccagaaaactctgcctggta

SEQ ID NO: 8211051 - DNA, 22 bp, Homo sapiens
ttccagaaacctgaaagtttct

SEQ ID NO: 8211052 - DNA, 22 bp, Homo sapiens
ttccagaaagttctggaactgg

SEQ ID NO: 8211053 - DNA, 22 bp, Homo sapiens
cgtctaggccgtgccctgaggt

SEQ ID NO: 8211054 - DNA, 22 bp, Homo sapiens
cgtctctccgcaggggccttca

SEQ ID NO: 8211055 - DNA, 22 bp, Homo sapiens
cgtctggacgggaaggagaagt

SEQ ID NO: 8211056 - DNA, 22 bp, Homo sapiens
cgtccttgcaagatctgtacaa

SEQ ID NO: 8211057 - DNA, 22 bp, Homo sapiens
cgtcctgggtctgggaaggcat

SEQ ID NO: 8211058 - DNA, 22 bp, Homo sapiens
cgtcctgggtctgggaaggcat

SEQ ID NO: 8211059 - DNA, 22 bp, Homo sapiens
cgtcctgggtctgggaaggcat

SEQ ID NO: 8211060 - DNA, 22 bp, Homo sapiens
cgtcctcagaggccatccgaaa

SEQ ID NO: 8211061 - DNA, 22 bp, Homo sapiens
cgtcccgggttcacgccattct

SEQ ID NO: 8211062 - DNA, 22 bp, Homo sapiens
cgtcatcacggcaagcatctcc

SEQ ID NO: 8211063 - DNA, 22 bp, Homo sapiens
cgtcagtttactgttgccatgg

SEQ ID NO: 8211064 - DNA, 22 bp, Homo sapiens
cgtccaggaagatcggccgatg

SEQ ID NO: 8211065 - DNA, 22 bp, Homo sapiens
cgtcccagttccagccgcgctg

SEQ ID NO: 8211066 - DNA, 22 bp, Homo sapiens
cgtcccctcgttcccactttgg

SEQ ID NO: 8211067 - DNA, 20 bp, Homo sapiens
cgtccccttgagcaggtccc

SEQ ID NO: 8211068 - DNA, 22 bp, Homo sapiens
cgtccatattcatgagctgagt

SEQ ID NO: 8211069 - DNA, 22 bp, Homo sapiens
cgtccatattcctgagggctca

SEQ ID NO: 8211070 - DNA, 22 bp, Homo sapiens
cgtcccagttccagccgcgctg

SEQ ID NO: 8211071 - DNA, 22 bp, Homo sapiens
cgtgaaatgagttgaattattg

SEQ ID NO: 8211072 - DNA, 22 bp, Homo sapiens
ttcctaacaaacttcagtgaat

SEQ ID NO: 8211073 - DNA, 22 bp, Homo sapiens
ttcctaaaagctgagtagagaa

SEQ ID NO: 8211074 - DNA, 22 bp, Homo sapiens
ttcctccagcctggagcacttc

SEQ ID NO: 8211075 - DNA, 22 bp, Homo sapiens
ttcctccagcctggagcacttc

SEQ ID NO: 8211076 - DNA, 21 bp, Homo sapiens
ttcctcctctggagaagaaga

SEQ ID NO: 8211077 - DNA, 17 bp, Homo sapiens
ttcctcctcaccatgtt

SEQ ID NO: 8211078 - DNA, 17 bp, Homo sapiens
ttcctcctcaccatgtt

SEQ ID NO: 8211079 - DNA, 17 bp, Homo sapiens
ttcctcctcaccatgtt

SEQ ID NO: 8211080 - DNA, 22 bp, Homo sapiens
ttcctcctacgcttatcacttt

SEQ ID NO: 8211081 - DNA, 22 bp, Homo sapiens
ttcctccctgcccacattgtgc

SEQ ID NO: 8211082 - DNA, 22 bp, Homo sapiens
ttcctccatccttagggagagc

SEQ ID NO: 8211083 - DNA, 22 bp, Homo sapiens
ttcctccagtcagagctgtccc

SEQ ID NO: 8211084 - DNA, 22 bp, Homo sapiens
ttcctctcctcccaccaggtga

SEQ ID NO: 8211085 - DNA, 22 bp, Homo sapiens
ttcctccttgtcctagttactg

SEQ ID NO: 8211086 - DNA, 22 bp, Homo sapiens
ttcctctcaacatgcctgccgg

SEQ ID NO: 8211087 - DNA, 22 bp, Homo sapiens
ttcctctcaacatgcctgccgg

SEQ ID NO: 8211088 - DNA, 22 bp, Homo sapiens
ctaaatgatggatttaaacttt

SEQ ID NO: 8211089 - DNA, 22 bp, Homo sapiens
ttcctctctcttgccagaatgt

SEQ ID NO: 8211090 - DNA, 22 bp, Homo sapiens
ttcctctcgctctccggggccc

SEQ ID NO: 8211091 - DNA, 22 bp, Homo sapiens
ttcctctgaaatggcttggaaa

SEQ ID NO: 8211092 - DNA, 22 bp, Homo sapiens
ttcctctgaaatggcttggaaa

SEQ ID NO: 8211093 - DNA, 22 bp, Homo sapiens
cggctgggttcggctgcaggcc

SEQ ID NO: 8211094 - DNA, 22 bp, Homo sapiens
cggctggtgtcgggcacagcaa

SEQ ID NO: 8211095 - DNA, 22 bp, Homo sapiens
cggctggtgtcgggcacagcaa

SEQ ID NO: 8211096 - DNA, 22 bp, Homo sapiens
ttccactctatgatagaagggt

SEQ ID NO: 8211097 - DNA, 22 bp, Homo sapiens
ttccactactcgaatggtaaca

SEQ ID NO: 8211098 - DNA, 22 bp, Homo sapiens
ttccacggtggcaaaggctgga

SEQ ID NO: 8211099 - DNA, 22 bp, Homo sapiens
ttccacggggctccccgctctt

SEQ ID NO: 8211100 - DNA, 22 bp, Homo sapiens
ttccacggggctccccgctctt

SEQ ID NO: 8211101 - DNA, 22 bp, Homo sapiens
ttccaaattaaaatgtacaatg

SEQ ID NO: 8211102 - DNA, 22 bp, Homo sapiens
ttccaaattccaatcccctgaa

SEQ ID NO: 8211103 - DNA, 22 bp, Homo sapiens
cgggaaggtggaggttgcagtg

SEQ ID NO: 8211104 - DNA, 22 bp, Homo sapiens
cgggaaagttccacagatggat

SEQ ID NO: 8211105 - DNA, 22 bp, Homo sapiens
cgggaaggtggaggttgcagtg

SEQ ID NO: 8211106 - DNA, 22 bp, Homo sapiens
cgggaaggtggaggttgcagtg

SEQ ID NO: 8211107 - DNA, 22 bp, Homo sapiens
cgggaggaaaggcgaggctctg

SEQ ID NO: 8211108 - DNA, 22 bp, Homo sapiens
ttcagtttcgttatctatgaga

SEQ ID NO: 8211109 - DNA, 22 bp, Homo sapiens
ttcagtttcgttatctatgaga

SEQ ID NO: 8211110 - DNA, 22 bp, Homo sapiens
ttcagtttctaaagatgttcct

SEQ ID NO: 8211111 - DNA, 22 bp, Homo sapiens
ttcagtttcgttatctatgaga

SEQ ID NO: 8211112 - DNA, 22 bp, Homo sapiens
ttcagtttcttccctgtgaaat

SEQ ID NO: 8211113 - DNA, 18 bp, Homo sapiens
ttcagtttctagttcctt

SEQ ID NO: 8211114 - DNA, 22 bp, Homo sapiens
ttcagtttgaattctgtagaac

SEQ ID NO: 8211115 - DNA, 21 bp, Homo sapiens
ttcagtttcttcctcatctat

SEQ ID NO: 8211116 - DNA, 22 bp, Homo sapiens
ttcagtttcagtcttgcaaaaa

SEQ ID NO: 8211117 - DNA, 22 bp, Homo sapiens
ttcagggccctgagagggcagt

SEQ ID NO: 8211118 - DNA, 22 bp, Homo sapiens
ttcagggcttagggaaatagtg

SEQ ID NO: 8211119 - DNA, 22 bp, Homo sapiens
ttcagtttcaaatcctgtgaag

SEQ ID NO: 8211120 - DNA, 22 bp, Homo sapiens
cgcagcagccccgtggtaggtg

SEQ ID NO: 8211121 - DNA, 20 bp, Homo sapiens
cgcagcagtggaagtggaat

SEQ ID NO: 8211122 - DNA, 22 bp, Homo sapiens
cgcagccccaacaaatgggaca

SEQ ID NO: 8211123 - DNA, 22 bp, Homo sapiens
cgcagcgaactgtccctcggtc

SEQ ID NO: 8211124 - DNA, 21 bp, Homo sapiens
cgcagctgagaaatatacaga

SEQ ID NO: 8211125 - DNA, 22 bp, Homo sapiens
cgcagctgcaaaggaaacattt

SEQ ID NO: 8211126 - DNA, 22 bp, Homo sapiens
cgcagctgcacggggctgagcc

SEQ ID NO: 8211127 - DNA, 22 bp, Homo sapiens
cgcagctgcacggggctgagcc

SEQ ID NO: 8211128 - DNA, 22 bp, Homo sapiens
tgtttcttctcacacaaactca

SEQ ID NO: 8211129 - DNA, 19 bp, Homo sapiens
tgtttcttcctccatctga

SEQ ID NO: 8211130 - DNA, 22 bp, Homo sapiens
tgtttcttatccaagtggtctg

SEQ ID NO: 8211131 - DNA, 22 bp, Homo sapiens
tgtttcttctcacacaaactca

SEQ ID NO: 8211132 - DNA, 22 bp, Homo sapiens
tgtttcttctcacacaaactca

SEQ ID NO: 8211133 - DNA, 22 bp, Homo sapiens
tgtttcttacgtttttagaggc

SEQ ID NO: 8211134 - DNA, 22 bp, Homo sapiens
tgtttcttatccaagtggtctg

SEQ ID NO: 8211135 - DNA, 22 bp, Homo sapiens
tgtttcttatccaagtggtctg

SEQ ID NO: 8211136 - DNA, 22 bp, Homo sapiens
tgtttctgtatgatcaatattg

SEQ ID NO: 8211137 - DNA, 17 bp, Homo sapiens
tgttttcattcattgct

SEQ ID NO: 8211138 - DNA, 21 bp, Homo sapiens
tgttttccaccttgaggcaag

SEQ ID NO: 8211139 - DNA, 22 bp, Homo sapiens
tgttttcatttgatgtaacaaa

SEQ ID NO: 8211140 - DNA, 22 bp, Homo sapiens
tgttttctagaaacaatgccta

SEQ ID NO: 8211141 - DNA, 22 bp, Homo sapiens
tgttttctagaaacaatgccta

SEQ ID NO: 8211142 - DNA, 22 bp, Homo sapiens
tgttttcagtcatatagcaggt

SEQ ID NO: 8211143 - DNA, 22 bp, Homo sapiens
tgttttcatggttatgtgtcta

SEQ ID NO: 8211144 - DNA, 22 bp, Homo sapiens
tgttttcatcacagaatgtaac

SEQ ID NO: 8211145 - DNA, 22 bp, Homo sapiens
tgtttatacctgcaacctgtca

SEQ ID NO: 8211146 - DNA, 22 bp, Homo sapiens
tgtttataccttggtataacca

SEQ ID NO: 8211147 - DNA, 22 bp, Homo sapiens
tgtttctaggtcaataattttt

SEQ ID NO: 8211148 - DNA, 22 bp, Homo sapiens
cctggggccccgagccagaagc

SEQ ID NO: 8211149 - DNA, 22 bp, Homo sapiens
cctggggccccgagccagaagc

SEQ ID NO: 8211150 - DNA, 23 bp, Homo sapiens
cctggggcacttgagtcctcatc

SEQ ID NO: 8211151 - DNA, 22 bp, Homo sapiens
cctggggctcaagatggcgccg

SEQ ID NO: 8211152 - DNA, 22 bp, Homo sapiens
cctggggctcaagatggcgccg

SEQ ID NO: 8211153 - DNA, 22 bp, Homo sapiens
tgtttataatatgcagtgagca

SEQ ID NO: 8211154 - DNA, 23 bp, Homo sapiens
cctggggcacttgagtcctcatc

SEQ ID NO: 8211155 - DNA, 23 bp, Homo sapiens
cctggggcacttgagtcctcatc

SEQ ID NO: 8211156 - DNA, 22 bp, Homo sapiens
cctggggagagaaagcccagcc

SEQ ID NO: 8211157 - DNA, 22 bp, Homo sapiens
cctggggagccgcctgagcccc

SEQ ID NO: 8211158 - DNA, 22 bp, Homo sapiens
cctgctcccgggacgcgttcac

SEQ ID NO: 8211159 - DNA, 22 bp, Homo sapiens
cctgctcccgggacgcgttcac

SEQ ID NO: 8211160 - DNA, 22 bp, Homo sapiens
cctgctcctgctattcttctgg

SEQ ID NO: 8211161 - DNA, 22 bp, Homo sapiens
cctgctcctatctgggctcatt

SEQ ID NO: 8211162 - DNA, 22 bp, Homo sapiens
cctgctcctatctgggctcatt

SEQ ID NO: 8211163 - DNA, 22 bp, Homo sapiens
tgttcccacaccagcctcagcc

SEQ ID NO: 8211164 - DNA, 22 bp, Homo sapiens
cctgctcctgctattcttctgg

SEQ ID NO: 8211165 - DNA, 22 bp, Homo sapiens
tgttccatgtctttgtaggact

SEQ ID NO: 8211166 - DNA, 22 bp, Homo sapiens
tgttgattagtgtttagactta

SEQ ID NO: 8211167 - DNA, 20 bp, Homo sapiens
tgttgattggtgtcatctca

SEQ ID NO: 8211168 - DNA, 20 bp, Homo sapiens
tgttgattggtgtcatctca

SEQ ID NO: 8211169 - DNA, 20 bp, Homo sapiens
tgttgattggtgtcatctca

SEQ ID NO: 8211170 - DNA, 22 bp, Homo sapiens
tgttgcagaatctcaaaacagt

SEQ ID NO: 8211171 - DNA, 23 bp, Homo sapiens
tgttgctgcctttctaggatcag

SEQ ID NO: 8211172 - DNA, 22 bp, Homo sapiens
tgttggaataagtgcttgaagg

SEQ ID NO: 8211173 - DNA, 22 bp, Homo sapiens
tgttggaaggcaagcagcaatt

SEQ ID NO: 8211174 - DNA, 22 bp, Homo sapiens
tgttggaattaggatacagagg

SEQ ID NO: 8211175 - DNA, 22 bp, Homo sapiens
tgttggaattaggatacagagg

SEQ ID NO: 8211176 - DNA, 22 bp, Homo sapiens
tgttggatgaccttgtaattat

SEQ ID NO: 8211177 - DNA, 22 bp, Homo sapiens
tgttggcatctctgagagagtt

SEQ ID NO: 8211178 - DNA, 22 bp, Homo sapiens
tgttgcctgactttaaaatgtg

SEQ ID NO: 8211179 - DNA, 22 bp, Homo sapiens
tgttgcctggggaagctctgat

SEQ ID NO: 8211180 - DNA, 22 bp, Homo sapiens
tgttgcctggggaagctctgat

SEQ ID NO: 8211181 - DNA, 22 bp, Homo sapiens
tgttgcctaactgccctctgaa

SEQ ID NO: 8211182 - DNA, 22 bp, Homo sapiens
tgttgctcttttttaggtgagt

SEQ ID NO: 8211183 - DNA, 22 bp, Homo sapiens
tgttgcccaggttctctcctgc

SEQ ID NO: 8211184 - DNA, 22 bp, Homo sapiens
tgttgcccaggttctctcctgc

SEQ ID NO: 8211185 - DNA, 22 bp, Homo sapiens
tgttgcccaggttctctcctgc

SEQ ID NO: 8211186 - DNA, 19 bp, Homo sapiens
tgttgccaggtatcatgtt

SEQ ID NO: 8211187 - DNA, 22 bp, Homo sapiens
cctgcgggctgtgctgaagcct

SEQ ID NO: 8211188 - DNA, 22 bp, Homo sapiens
cctgctcacctgatgtggcaac

SEQ ID NO: 8211189 - DNA, 22 bp, Homo sapiens
cctgcgtcgtgtgggcagtgac

SEQ ID NO: 8211190 - DNA, 22 bp, Homo sapiens
cctgccttctaaagcgcccgcc

SEQ ID NO: 8211191 - DNA, 22 bp, Homo sapiens
cctgccttgacgtaacgcatga

SEQ ID NO: 8211192 - DNA, 22 bp, Homo sapiens
cctgccttctaaagcgcccgcc

SEQ ID NO: 8211193 - DNA, 22 bp, Homo sapiens
cctgcctttctcagtaatcttt

SEQ ID NO: 8211194 - DNA, 22 bp, Homo sapiens
cctgcgcgtctgggtctgtctc

SEQ ID NO: 8211195 - DNA, 22 bp, Homo sapiens
cctgctcagccccagctcaccc

SEQ ID NO: 8211196 - DNA, 22 bp, Homo sapiens
cctgctcagctgtcctcacgct

SEQ ID NO: 8211197 - DNA, 22 bp, Homo sapiens
cctgctcagagcgtcttgtgtg

SEQ ID NO: 8211198 - DNA, 22 bp, Homo sapiens
cctgctcagagcgtcttgtgtg

SEQ ID NO: 8211199 - DNA, 22 bp, Homo sapiens
cctgctcagctgtcctcacgct

SEQ ID NO: 8211200 - DNA, 23 bp, Homo sapiens
cctgctcaggcgtgtgccctgct

SEQ ID NO: 8211201 - DNA, 22 bp, Homo sapiens
cctgctccatgctcaccatcag

SEQ ID NO: 8211202 - DNA, 22 bp, Homo sapiens
cctgctccatgctcaccatcag

SEQ ID NO: 8211203 - DNA, 22 bp, Homo sapiens
cctgctcatgggtccctggcag

SEQ ID NO: 8211204 - DNA, 22 bp, Homo sapiens
tggttcctacgcacattgaatt

SEQ ID NO: 8211205 - DNA, 22 bp, Homo sapiens
tggttcccttaacagctgtata

SEQ ID NO: 8211206 - DNA, 22 bp, Homo sapiens
tggttcctacgcacattgaatt

SEQ ID NO: 8211207 - DNA, 22 bp, Homo sapiens
tggttcctcaagcgctggcggc

SEQ ID NO: 8211208 - DNA, 22 bp, Homo sapiens
tggttcctcaagcgctggcggc

SEQ ID NO: 8211209 - DNA, 22 bp, Homo sapiens
tggttcctcaagcgctggcggc

SEQ ID NO: 8211210 - DNA, 22 bp, Homo sapiens
tggttcctcaagcgctggcggc

SEQ ID NO: 8211211 - DNA, 22 bp, Homo sapiens
cctgccttcccagcttggcttt

SEQ ID NO: 8211212 - DNA, 23 bp, Homo sapiens
tggttcaagtgagaagtaatgtt

SEQ ID NO: 8211213 - DNA, 22 bp, Homo sapiens
ttaatgatacctatgttaattt

SEQ ID NO: 8211214 - DNA, 22 bp, Homo sapiens
ttaatgacctggaagaagtgat

SEQ ID NO: 8211215 - DNA, 22 bp, Homo sapiens
ttaatcttcagggactcttgct

SEQ ID NO: 8211216 - DNA, 22 bp, Homo sapiens
ttaatgaaaggcagtttggaac

SEQ ID NO: 8211217 - DNA, 22 bp, Homo sapiens
ttaatccatggcagttattaaa

SEQ ID NO: 8211218 - DNA, 22 bp, Homo sapiens
ttaatcttatatgtaaaggtaa

SEQ ID NO: 8211219 - DNA, 22 bp, Homo sapiens
ttaatcttatattgttgggacc

SEQ ID NO: 8211220 - DNA, 22 bp, Homo sapiens
ttaatcttatatgtaaaggtaa

SEQ ID NO: 8211221 - DNA, 22 bp, Homo sapiens
ttaatccaataacaaggttcaa

SEQ ID NO: 8211222 - DNA, 22 bp, Homo sapiens
ttaatccaatatcctggctatt

SEQ ID NO: 8211223 - DNA, 23 bp, Homo sapiens
cctgtggcaagtagatgagatga

SEQ ID NO: 8211224 - DNA, 22 bp, Homo sapiens
cctgtggcacatgcagggattc

SEQ ID NO: 8211225 - DNA, 22 bp, Homo sapiens
cctgtggccgcgtcgggcggcg

SEQ ID NO: 8211226 - DNA, 19 bp, Homo sapiens
cctgtggcagagtggaaac

SEQ ID NO: 8211227 - DNA, 21 bp, Homo sapiens
cctgtggattttaaaattgga

SEQ ID NO: 8211228 - DNA, 22 bp, Homo sapiens
cctgtggaccaggaggcagccc

SEQ ID NO: 8211229 - DNA, 22 bp, Homo sapiens
cctgtggaccaggaggcagccc

SEQ ID NO: 8211230 - DNA, 22 bp, Homo sapiens
ttaatgccaacaaagtgatttt

SEQ ID NO: 8211231 - DNA, 22 bp, Homo sapiens
cctgtggctgccacttgggtga

SEQ ID NO: 8211232 - DNA, 22 bp, Homo sapiens
cctgtggcgggggccagtgcct

SEQ ID NO: 8211233 - DNA, 21 bp, Homo sapiens
ttacaaagctacagatgttgc

SEQ ID NO: 8211234 - DNA, 22 bp, Homo sapiens
ttacaagtactgaatatgattt

SEQ ID NO: 8211235 - DNA, 22 bp, Homo sapiens
ttacaagtactgaatatgattt

SEQ ID NO: 8211236 - DNA, 22 bp, Homo sapiens
ttacaagtactgaatatgattt

SEQ ID NO: 8211237 - DNA, 22 bp, Homo sapiens
ttacaagtatttaagatgctgt

SEQ ID NO: 8211238 - DNA, 22 bp, Homo sapiens
ttacaagtgtcaggcgctggca

SEQ ID NO: 8211239 - DNA, 22 bp, Homo sapiens
ttacaagtatttaagatgctgt

SEQ ID NO: 8211240 - DNA, 22 bp, Homo sapiens
ttacaagtatttaagatgctgt

SEQ ID NO: 8211241 - DNA, 22 bp, Homo sapiens
cctgtggctggtcaggccagca

SEQ ID NO: 8211242 - DNA, 22 bp, Homo sapiens
cctgtggctggtcaggccagca

SEQ ID NO: 8211243 - DNA, 22 bp, Homo sapiens
ttacaagttttcatgaaattga

SEQ ID NO: 8211244 - DNA, 22 bp, Homo sapiens
ttacaataccacatcacctcat

SEQ ID NO: 8211245 - DNA, 22 bp, Homo sapiens
ttacaatagttccttcttttgt

SEQ ID NO: 8211246 - DNA, 22 bp, Homo sapiens
ttacaatagttccttcttttgt

SEQ ID NO: 8211247 - DNA, 22 bp, Homo sapiens
ttacaatgacaggtgtatcatt

SEQ ID NO: 8211248 - DNA, 22 bp, Homo sapiens
ttacaatagttccttcttttgt

SEQ ID NO: 8211249 - DNA, 22 bp, Homo sapiens
ttacaagtttctggcttcatcc

SEQ ID NO: 8211250 - DNA, 22 bp, Homo sapiens
ttacaagtttctggcttcatcc

SEQ ID NO: 8211251 - DNA, 22 bp, Homo sapiens
ttacaagttttcatgaaattga

SEQ ID NO: 8211252 - DNA, 22 bp, Homo sapiens
ttacaataccacatcacctcat

SEQ ID NO: 8211253 - DNA, 20 bp, Homo sapiens
ttacaagtttctaataacca

SEQ ID NO: 8211254 - DNA, 20 bp, Homo sapiens
ttacaagtttctaataacca

SEQ ID NO: 8211255 - DNA, 23 bp, Homo sapiens
ttacaagttctgaaatttccttc

SEQ ID NO: 8211256 - DNA, 23 bp, Homo sapiens
ttacaagttctgaaatttccttc

SEQ ID NO: 8211257 - DNA, 22 bp, Homo sapiens
ttacaagtgtcaggtactggca

SEQ ID NO: 8211258 - DNA, 22 bp, Homo sapiens
ttacaagtgtcaggtactggca

SEQ ID NO: 8211259 - DNA, 22 bp, Homo sapiens
ttacaagttcagattttctcat

SEQ ID NO: 8211260 - DNA, 22 bp, Homo sapiens
ttaataggcttctaacatagct

SEQ ID NO: 8211261 - DNA, 22 bp, Homo sapiens
ttaatatgttgaaatttattag

SEQ ID NO: 8211262 - DNA, 22 bp, Homo sapiens
ttaatatgttgaaatttattag

SEQ ID NO: 8211263 - DNA, 22 bp, Homo sapiens
cctgtcacgatgactgcactct

SEQ ID NO: 8211264 - DNA, 22 bp, Homo sapiens
cctgtcacgatgactgcactct

SEQ ID NO: 8211265 - DNA, 22 bp, Homo sapiens
cctgtcacctaggtactgagca

SEQ ID NO: 8211266 - DNA, 22 bp, Homo sapiens
cctgtacattagctgtgaattg

SEQ ID NO: 8211267 - DNA, 22 bp, Homo sapiens
cctgtacagtgaatgaatgtga

SEQ ID NO: 8211268 - DNA, 22 bp, Homo sapiens
cctgtacaagctcttggtgaca

SEQ ID NO: 8211269 - DNA, 22 bp, Homo sapiens
cctgtacaagagccatctggat

SEQ ID NO: 8211270 - DNA, 22 bp, Homo sapiens
cctgtattggaagcagtaggga

SEQ ID NO: 8211271 - DNA, 22 bp, Homo sapiens
cctgtaccgcgatctgctgcgc

SEQ ID NO: 8211272 - DNA, 21 bp, Homo sapiens
cctgtaccactgtaagatgcc

SEQ ID NO: 8211273 - DNA, 22 bp, Homo sapiens
cctgtaccattttccctagtct

SEQ ID NO: 8211274 - DNA, 22 bp, Homo sapiens
ttaaaatctaaagcagttgtct

SEQ ID NO: 8211275 - DNA, 22 bp, Homo sapiens
ttaaaatctaaagcagttgtct

SEQ ID NO: 8211276 - DNA, 22 bp, Homo sapiens
ttaaaatctaaagcagttgtct

SEQ ID NO: 8211277 - DNA, 22 bp, Homo sapiens
ttaaaatcgctgttgcttctgt

SEQ ID NO: 8211278 - DNA, 22 bp, Homo sapiens
ttaaaatcgctgttgcttctgt

SEQ ID NO: 8211279 - DNA, 22 bp, Homo sapiens
ttaaaatcgctgttgcttctgt

SEQ ID NO: 8211280 - DNA, 22 bp, Homo sapiens
ttaaaatagccagtgcccctct

SEQ ID NO: 8211281 - DNA, 22 bp, Homo sapiens
ttaaaatagccagtgcccctct

SEQ ID NO: 8211282 - DNA, 22 bp, Homo sapiens
ttaaaatcacagtcacccagta

SEQ ID NO: 8211283 - DNA, 22 bp, Homo sapiens
ttaaaatccagtgttggtggat

SEQ ID NO: 8211284 - DNA, 22 bp, Homo sapiens
cctggtttgggtgccagtgagt

SEQ ID NO: 8211285 - DNA, 22 bp, Homo sapiens
cctggtttgggtgccagtgagt

SEQ ID NO: 8211286 - DNA, 22 bp, Homo sapiens
ttaaaatgaatattgattagca

SEQ ID NO: 8211287 - DNA, 22 bp, Homo sapiens
ttaaaatgaatattgattagca

SEQ ID NO: 8211288 - DNA, 22 bp, Homo sapiens
ttaaaatgaatattgattagca

SEQ ID NO: 8211289 - DNA, 22 bp, Homo sapiens
tgttttctattacctgagattg

SEQ ID NO: 8211290 - DNA, 22 bp, Homo sapiens
tgttttctagaaacaatgccta

SEQ ID NO: 8211291 - DNA, 22 bp, Homo sapiens
tgttttctcttgaaaagcagtc

SEQ ID NO: 8211292 - DNA, 22 bp, Homo sapiens
tgttttctattacctgagattg

SEQ ID NO: 8211293 - DNA, 22 bp, Homo sapiens
tgttttctcttgaaaagcagtc

SEQ ID NO: 8211294 - DNA, 22 bp, Homo sapiens
ttaaaagtctgatgatttacat

SEQ ID NO: 8211295 - DNA, 22 bp, Homo sapiens
ttaaaagtctgatgatttacat

SEQ ID NO: 8211296 - DNA, 22 bp, Homo sapiens
ttaaaatagccagtgcccctct

SEQ ID NO: 8211297 - DNA, 22 bp, Homo sapiens
ttaaaatagccagtgcccctct

SEQ ID NO: 8211298 - DNA, 22 bp, Homo sapiens
ttaaaatagccagtgcccctct

SEQ ID NO: 8211299 - DNA, 22 bp, Homo sapiens
ttatgggagcaattggggaggt

SEQ ID NO: 8211300 - DNA, 22 bp, Homo sapiens
ttatgggagcaattggggaggt

SEQ ID NO: 8211301 - DNA, 22 bp, Homo sapiens
ttatgtacaatgttaatgtaaa

SEQ ID NO: 8211302 - DNA, 22 bp, Homo sapiens
ttatgtacaatgttaatgtaaa

SEQ ID NO: 8211303 - DNA, 22 bp, Homo sapiens
ttatgtacctgaattagtaaag

SEQ ID NO: 8211304 - DNA, 22 bp, Homo sapiens
ttatgtactctgcaatgtttga

SEQ ID NO: 8211305 - DNA, 22 bp, Homo sapiens
ttatgtacctgaattagtaaag

SEQ ID NO: 8211306 - DNA, 22 bp, Homo sapiens
ttatgtacctgaattagtaaag

SEQ ID NO: 8211307 - DNA, 22 bp, Homo sapiens
ttatgtactctgcaatgtttga

SEQ ID NO: 8211308 - DNA, 22 bp, Homo sapiens
ttatgtactctgcaatgtttga

SEQ ID NO: 8211309 - DNA, 22 bp, Homo sapiens
ttatgtactctgcaatgtttga

SEQ ID NO: 8211310 - DNA, 22 bp, Homo sapiens
ttatgtactctgcaatgtttga

SEQ ID NO: 8211311 - DNA, 22 bp, Homo sapiens
cctttcttttatccaccagcca

SEQ ID NO: 8211312 - DNA, 22 bp, Homo sapiens
cctttcttttatccaccagcca

SEQ ID NO: 8211313 - DNA, 21 bp, Homo sapiens
cctttgagtgtgtttgaagta

SEQ ID NO: 8211314 - DNA, 22 bp, Homo sapiens
cctttcttgctaagagtttatg

SEQ ID NO: 8211315 - DNA, 22 bp, Homo sapiens
cctttcttttatccaccagcca

SEQ ID NO: 8211316 - DNA, 22 bp, Homo sapiens
cctttgcattctagatgtttag

SEQ ID NO: 8211317 - DNA, 22 bp, Homo sapiens
cctttgcattatccttgattga

SEQ ID NO: 8211318 - DNA, 17 bp, Homo sapiens
cctttcttcccagaggg

SEQ ID NO: 8211319 - DNA, 22 bp, Homo sapiens
cctttcttgctaagagtttatg

SEQ ID NO: 8211320 - DNA, 17 bp, Homo sapiens
cctttcttcccagaggg

SEQ ID NO: 8211321 - DNA, 22 bp, Homo sapiens
cctttctgatggcctcccagcc

SEQ ID NO: 8211322 - DNA, 22 bp, Homo sapiens
cctttctgatggcctcccagcc

SEQ ID NO: 8211323 - DNA, 22 bp, Homo sapiens
ttatgtatggatggctgaaagt

SEQ ID NO: 8211324 - DNA, 22 bp, Homo sapiens
ttatgtatgaatatagtagaag

SEQ ID NO: 8211325 - DNA, 22 bp, Homo sapiens
ttatgtatgaatatagtagaag

SEQ ID NO: 8211326 - DNA, 22 bp, Homo sapiens
ttatgtatgaatatagtagaag

SEQ ID NO: 8211327 - DNA, 22 bp, Homo sapiens
cgattttgtggcaaattcttct

SEQ ID NO: 8211328 - DNA, 22 bp, Homo sapiens
cgcaacctgacagagccacgtc

SEQ ID NO: 8211329 - DNA, 22 bp, Homo sapiens
cgcaaggtcaggtcccggcggg

SEQ ID NO: 8211330 - DNA, 22 bp, Homo sapiens
cgcaccactgaattccagcctg

SEQ ID NO: 8211331 - DNA, 22 bp, Homo sapiens
cgcaccactgaattccagcctg

SEQ ID NO: 8211332 - DNA, 22 bp, Homo sapiens
cgcaccactgaattccagcctg

SEQ ID NO: 8211333 - DNA, 22 bp, Homo sapiens
cgagtccagggttaggagtccg

SEQ ID NO: 8211334 - DNA, 22 bp, Homo sapiens
cgaggtgatggcatttagactc

SEQ ID NO: 8211335 - DNA, 22 bp, Homo sapiens
cgatggaattggaaagaggaat

SEQ ID NO: 8211336 - DNA, 22 bp, Homo sapiens
cgatggagaggtcctgatagtt

SEQ ID NO: 8211337 - DNA, 21 bp, Homo sapiens
cgaggtgagctcttggctcag

SEQ ID NO: 8211338 - DNA, 22 bp, Homo sapiens
cgaggtgactttggtttagaca

SEQ ID NO: 8211339 - DNA, 17 bp, Homo sapiens
cgagggcttgctggctc

SEQ ID NO: 8211340 - DNA, 22 bp, Homo sapiens
cgagggctgtgttgctctcctt

SEQ ID NO: 8211341 - DNA, 17 bp, Homo sapiens
cgagggcttgctggctc

SEQ ID NO: 8211342 - DNA, 22 bp, Homo sapiens
cctttggagcaactgagagcta

SEQ ID NO: 8211343 - DNA, 22 bp, Homo sapiens
ttatttttaaaagttcacacag

SEQ ID NO: 8211344 - DNA, 22 bp, Homo sapiens
ttatttttaaaagttcacacag

SEQ ID NO: 8211345 - DNA, 22 bp, Homo sapiens
ttatttttaaaagttcacacag

SEQ ID NO: 8211346 - DNA, 22 bp, Homo sapiens
ttatttttaaaagttcacacag

SEQ ID NO: 8211347 - DNA, 22 bp, Homo sapiens
ttatttttaaaagttcacacag

SEQ ID NO: 8211348 - DNA, 22 bp, Homo sapiens
ttatttttaaaagttcacacag

SEQ ID NO: 8211349 - DNA, 22 bp, Homo sapiens
ttatttttaaaagttcacacag

SEQ ID NO: 8211350 - DNA, 22 bp, Homo sapiens
ttatttttaaaagttcacacag

SEQ ID NO: 8211351 - DNA, 22 bp, Homo sapiens
ttatttttaaaagttcacacag

SEQ ID NO: 8211352 - DNA, 17 bp, Homo sapiens
ttattttttgggctgag

SEQ ID NO: 8211353 - DNA, 17 bp, Homo sapiens
ttattttttgggctgag

SEQ ID NO: 8211354 - DNA, 17 bp, Homo sapiens
ttattttttgggctgag

SEQ ID NO: 8211355 - DNA, 17 bp, Homo sapiens
ttattttttgggctgag

SEQ ID NO: 8211356 - DNA, 17 bp, Homo sapiens
ttattttttgggctgag

SEQ ID NO: 8211357 - DNA, 17 bp, Homo sapiens
ttattttttgggctgag

SEQ ID NO: 8211358 - DNA, 22 bp, Homo sapiens
ttcaaaaaggtatgttcaagtc

SEQ ID NO: 8211359 - DNA, 22 bp, Homo sapiens
ttcaaaaaggtatgttcaagtc

SEQ ID NO: 8211360 - DNA, 22 bp, Homo sapiens
ttcaaaaaggtatgttcaagtc

SEQ ID NO: 8211361 - DNA, 22 bp, Homo sapiens
cgcagagggcaggcagtgctgg

SEQ ID NO: 8211362 - DNA, 22 bp, Homo sapiens
cgcagagggcaggcagtgctgg

SEQ ID NO: 8211363 - DNA, 22 bp, Homo sapiens
cgcagaagaggttgtctagtcc

SEQ ID NO: 8211364 - DNA, 22 bp, Homo sapiens
cgcagaagaggttgtctagtcc

SEQ ID NO: 8211365 - DNA, 21 bp, Homo sapiens
cgcagagcgaacttgcggcgc

SEQ ID NO: 8211366 - DNA, 21 bp, Homo sapiens
cgcagagcgaacttgcggcgc

SEQ ID NO: 8211367 - DNA, 21 bp, Homo sapiens
cgcagagcgaacttgcggcgc

SEQ ID NO: 8211368 - DNA, 21 bp, Homo sapiens
cgcagagcgaacttgcggcgc

SEQ ID NO: 8211369 - DNA, 22 bp, Homo sapiens
ttattattttgtgtacagcaaa

SEQ ID NO: 8211370 - DNA, 22 bp, Homo sapiens
ttattcaccagtgtaaaacact

SEQ ID NO: 8211371 - DNA, 22 bp, Homo sapiens
ttattcaccagtgtaaaacact

SEQ ID NO: 8211372 - DNA, 22 bp, Homo sapiens
ttattattttgtgtacagcaaa

SEQ ID NO: 8211373 - DNA, 22 bp, Homo sapiens
ttattattttgtgtacagcaaa

SEQ ID NO: 8211374 - DNA, 22 bp, Homo sapiens
ttattattttgtgtacagcaaa

SEQ ID NO: 8211375 - DNA, 22 bp, Homo sapiens
ttattattgtgacctgagaatg

SEQ ID NO: 8211376 - DNA, 22 bp, Homo sapiens
ttattattgtgacctgagaatg

SEQ ID NO: 8211377 - DNA, 22 bp, Homo sapiens
ttattattgtggttgcattatc

SEQ ID NO: 8211378 - DNA, 22 bp, Homo sapiens
ttattattgtggttgcattatc

SEQ ID NO: 8211379 - DNA, 22 bp, Homo sapiens
ttattattgtggttgcattatc

SEQ ID NO: 8211380 - DNA, 22 bp, Homo sapiens
ttattattgtgacctgagaatg

SEQ ID NO: 8211381 - DNA, 22 bp, Homo sapiens
cgcaccactgaattccagcctg

SEQ ID NO: 8211382 - DNA, 22 bp, Homo sapiens
cgcaccactgaattccagcctg

SEQ ID NO: 8211383 - DNA, 22 bp, Homo sapiens
ttattcacctctattagactca

SEQ ID NO: 8211384 - DNA, 22 bp, Homo sapiens
ttattcactcattaaagcagga

SEQ ID NO: 8211385 - DNA, 22 bp, Homo sapiens
ttattcaccgcaggtgcttccc

SEQ ID NO: 8211386 - DNA, 22 bp, Homo sapiens
ttattcacctctattagactca

SEQ ID NO: 8211387 - DNA, 22 bp, Homo sapiens
ttatttcatgtaaaatttatgt

SEQ ID NO: 8211388 - DNA, 22 bp, Homo sapiens
ttattcactcatttaacattat

SEQ ID NO: 8211389 - DNA, 22 bp, Homo sapiens
ttattcactcatttaacattat

SEQ ID NO: 8211390 - DNA, 22 bp, Homo sapiens
ttattcactcatttaacattat

SEQ ID NO: 8211391 - DNA, 22 bp, Homo sapiens
ttatttcatgtaaaatttatgt

SEQ ID NO: 8211392 - DNA, 22 bp, Homo sapiens
ttatttcattgatttctaagac

SEQ ID NO: 8211393 - DNA, 23 bp, Homo sapiens
ttattttgtcagaagggactttt

SEQ ID NO: 8211394 - DNA, 23 bp, Homo sapiens
ttattttgtcagaagggactttt

SEQ ID NO: 8211395 - DNA, 22 bp, Homo sapiens
ttatttttaaaagttcacacag

SEQ ID NO: 8211396 - DNA, 22 bp, Homo sapiens
ttacccagtgtggtttatagca

SEQ ID NO: 8211397 - DNA, 22 bp, Homo sapiens
ttacctctagctctttgcttgt

SEQ ID NO: 8211398 - DNA, 22 bp, Homo sapiens
ttaccaagctctgcatgttaag

SEQ ID NO: 8211399 - DNA, 22 bp, Homo sapiens
ttaccaagctctgcatgttaag

SEQ ID NO: 8211400 - DNA, 22 bp, Homo sapiens
ttaccagttttgccatttgcta

SEQ ID NO: 8211401 - DNA, 22 bp, Homo sapiens
ttaccagtggtacacatgacct

SEQ ID NO: 8211402 - DNA, 22 bp, Homo sapiens
ttaccaggaggcattctctgaa

SEQ ID NO: 8211403 - DNA, 22 bp, Homo sapiens
ttaccacctgtatcacattttt

SEQ ID NO: 8211404 - DNA, 22 bp, Homo sapiens
ttaccacagtgcctgtctaatg

SEQ ID NO: 8211405 - DNA, 22 bp, Homo sapiens
ccttctgagcttcaatttcagt

SEQ ID NO: 8211406 - DNA, 22 bp, Homo sapiens
ccttctgataactgtgaaattg

SEQ ID NO: 8211407 - DNA, 22 bp, Homo sapiens
ccttctggaagctctaagggag

SEQ ID NO: 8211408 - DNA, 22 bp, Homo sapiens
ccttctggatgtgctaaggaag

SEQ ID NO: 8211409 - DNA, 22 bp, Homo sapiens
ccttctggagggtgtacgagag

SEQ ID NO: 8211410 - DNA, 22 bp, Homo sapiens
ccttctgctggtcatcccagtg

SEQ ID NO: 8211411 - DNA, 22 bp, Homo sapiens
ccttctgctccctggccagggc

SEQ ID NO: 8211412 - DNA, 22 bp, Homo sapiens
ccttctgggccaacttccagga

SEQ ID NO: 8211413 - DNA, 22 bp, Homo sapiens
ccttctgtctccctcatattga

SEQ ID NO: 8211414 - DNA, 22 bp, Homo sapiens
ccttctgtgtgcccacgtttat

SEQ ID NO: 8211415 - DNA, 22 bp, Homo sapiens
ccttctgtctccctcatattga

SEQ ID NO: 8211416 - DNA, 22 bp, Homo sapiens
ccttctgtgtgcccacgtttat

SEQ ID NO: 8211417 - DNA, 23 bp, Homo sapiens
ccttctgttaaccatctgggggg

SEQ ID NO: 8211418 - DNA, 23 bp, Homo sapiens
ccttctgttaaccatctgggggg

SEQ ID NO: 8211419 - DNA, 22 bp, Homo sapiens
ccttctgtgtgcccacgtttat

SEQ ID NO: 8211420 - DNA, 22 bp, Homo sapiens
ccttcttcaccagtttacctga

SEQ ID NO: 8211421 - DNA, 22 bp, Homo sapiens
ttacagaactgccctagttggc

SEQ ID NO: 8211422 - DNA, 22 bp, Homo sapiens
ttacagaactgtcttgaaattt

SEQ ID NO: 8211423 - DNA, 22 bp, Homo sapiens
ttacagaactgccctagttggc

SEQ ID NO: 8211424 - DNA, 20 bp, Homo sapiens
ttacagaaatgatgttattt

SEQ ID NO: 8211425 - DNA, 22 bp, Homo sapiens
ttacaatgatgggattcagcca

SEQ ID NO: 8211426 - DNA, 22 bp, Homo sapiens
ttacaatgacaggtgtatcatt

SEQ ID NO: 8211427 - DNA, 22 bp, Homo sapiens
ttacaatgagaaatggttggca

SEQ ID NO: 8211428 - DNA, 22 bp, Homo sapiens
ttacaatgatgaataaatggca

SEQ ID NO: 8211429 - DNA, 22 bp, Homo sapiens
ttacagaaaggttgtgggatag

SEQ ID NO: 8211430 - DNA, 21 bp, Homo sapiens
ccttctcttgcttcagcttca

SEQ ID NO: 8211431 - DNA, 21 bp, Homo sapiens
ccttctcttgcttcagcttca

SEQ ID NO: 8211432 - DNA, 21 bp, Homo sapiens
ccttctcttgcttcagcttca

SEQ ID NO: 8211433 - DNA, 21 bp, Homo sapiens
ccttctccacagggtctccgg

SEQ ID NO: 8211434 - DNA, 20 bp, Homo sapiens
ccttctctggaattgcctcc

SEQ ID NO: 8211435 - DNA, 21 bp, Homo sapiens
ccttctccacagggtctccgg

SEQ ID NO: 8211436 - DNA, 21 bp, Homo sapiens
ccttctccacagggtctccgg

SEQ ID NO: 8211437 - DNA, 22 bp, Homo sapiens
ttacagaagagtaacttggcaa

SEQ ID NO: 8211438 - DNA, 22 bp, Homo sapiens
ttacagaagagaaagaattcag

SEQ ID NO: 8211439 - DNA, 22 bp, Homo sapiens
ccttgggaccctgctggaggtt

SEQ ID NO: 8211440 - DNA, 22 bp, Homo sapiens
ccttgggagaaattgcagagtc

SEQ ID NO: 8211441 - DNA, 22 bp, Homo sapiens
ccttgggaccctgctggaggtt

SEQ ID NO: 8211442 - DNA, 22 bp, Homo sapiens
ccttgggaccctgctggaggtt

SEQ ID NO: 8211443 - DNA, 22 bp, Homo sapiens
ccttgggaggcataattacttg

SEQ ID NO: 8211444 - DNA, 22 bp, Homo sapiens
ccttgggcttgggcatagcttt

SEQ ID NO: 8211445 - DNA, 22 bp, Homo sapiens
ccttgggcttgggcatagcttt

SEQ ID NO: 8211446 - DNA, 21 bp, Homo sapiens
ccttgggatgcaagtgagact

SEQ ID NO: 8211447 - DNA, 22 bp, Homo sapiens
ccttgggatgcataagagccca

SEQ ID NO: 8211448 - DNA, 22 bp, Homo sapiens
ccttggcttgtgggctgcagcc

SEQ ID NO: 8211449 - DNA, 19 bp, Homo sapiens
ccttgcctgtccctgcagc

SEQ ID NO: 8211450 - DNA, 19 bp, Homo sapiens
ccttgcctgtccctgcagc

SEQ ID NO: 8211451 - DNA, 22 bp, Homo sapiens
ttacgcagctgctccaggaagc

SEQ ID NO: 8211452 - DNA, 22 bp, Homo sapiens
ttacgagtttgcaattttaaat

SEQ ID NO: 8211453 - DNA, 22 bp, Homo sapiens
ttacctgtgtcagtatatgaga

SEQ ID NO: 8211454 - DNA, 22 bp, Homo sapiens
ttacctggtgtttatggtccat

SEQ ID NO: 8211455 - DNA, 22 bp, Homo sapiens
ttatctacgtatttaaactctt

SEQ ID NO: 8211456 - DNA, 21 bp, Homo sapiens
cctttacaattttgcattcct

SEQ ID NO: 8211457 - DNA, 22 bp, Homo sapiens
cctttacaaagttcttcatggg

SEQ ID NO: 8211458 - DNA, 22 bp, Homo sapiens
cctttacaaagttcttcatggg

SEQ ID NO: 8211459 - DNA, 22 bp, Homo sapiens
cctttaatttacaatgttaatt

SEQ ID NO: 8211460 - DNA, 22 bp, Homo sapiens
cctttacacgtaaggctgttga

SEQ ID NO: 8211461 - DNA, 22 bp, Homo sapiens
cctttacacatggaatgggtct

SEQ ID NO: 8211462 - DNA, 21 bp, Homo sapiens
cctttacaattttgcattcct

SEQ ID NO: 8211463 - DNA, 21 bp, Homo sapiens
cctttacaattttgcattcct

SEQ ID NO: 8211464 - DNA, 22 bp, Homo sapiens
cctttacagtagcccttttgaa

SEQ ID NO: 8211465 - DNA, 22 bp, Homo sapiens
ccttggggaatatccattcttc

SEQ ID NO: 8211466 - DNA, 22 bp, Homo sapiens
ccttggggtgttggaggcagcc

SEQ ID NO: 8211467 - DNA, 22 bp, Homo sapiens
ccttgggtgtttaatagatata

SEQ ID NO: 8211468 - DNA, 22 bp, Homo sapiens
ccttgggtctaggccagggagt

SEQ ID NO: 8211469 - DNA, 22 bp, Homo sapiens
ccttgggttccaagtcactgaa

SEQ ID NO: 8211470 - DNA, 22 bp, Homo sapiens
ccttgggttccaagtcactgaa

SEQ ID NO: 8211471 - DNA, 22 bp, Homo sapiens
ccttggtgatctgggctggaag

SEQ ID NO: 8211472 - DNA, 22 bp, Homo sapiens
ccttggtgctctgctgggatgg

SEQ ID NO: 8211473 - DNA, 22 bp, Homo sapiens
ccttggtccctccccagaccaa

SEQ ID NO: 8211474 - DNA, 22 bp, Homo sapiens
ccttggtgatctgggctggaag

SEQ ID NO: 8211475 - DNA, 19 bp, Homo sapiens
ccttgtctggtgaaggact

SEQ ID NO: 8211476 - DNA, 22 bp, Homo sapiens
cctttaaatggatgttcaactg

SEQ ID NO: 8211477 - DNA, 22 bp, Homo sapiens
ccttgttttggaaccaaaggat

SEQ ID NO: 8211478 - DNA, 22 bp, Homo sapiens
cctttaaagactgcataacttc

SEQ ID NO: 8211479 - DNA, 22 bp, Homo sapiens
tttcttcttgatttaaacaggg

SEQ ID NO: 8211480 - DNA, 22 bp, Homo sapiens
tttcttctgtttgtagttacac

SEQ ID NO: 8211481 - DNA, 22 bp, Homo sapiens
tttcttctgtttgtagttacac

SEQ ID NO: 8211482 - DNA, 22 bp, Homo sapiens
tttcttcttaatactggctgct

SEQ ID NO: 8211483 - DNA, 22 bp, Homo sapiens
tttcttcttgatttaaacaggg

SEQ ID NO: 8211484 - DNA, 22 bp, Homo sapiens
tttcttcttgatttaaacaggg

SEQ ID NO: 8211485 - DNA, 22 bp, Homo sapiens
tttcttcttgatttaaacaggg

SEQ ID NO: 8211486 - DNA, 22 bp, Homo sapiens
tttcttcttgatttaaacaggg

SEQ ID NO: 8211487 - DNA, 22 bp, Homo sapiens
tttcttgaccactatgttgata

SEQ ID NO: 8211488 - DNA, 22 bp, Homo sapiens
tttcttctttcccagtgatggg

SEQ ID NO: 8211489 - DNA, 22 bp, Homo sapiens
tttcttatactatattgtcatc

SEQ ID NO: 8211490 - DNA, 22 bp, Homo sapiens
tttcttatactatattgtcatc

SEQ ID NO: 8211491 - DNA, 22 bp, Homo sapiens
tttcttagtcctagagtgattt

SEQ ID NO: 8211492 - DNA, 22 bp, Homo sapiens
tttcttctgtttgtagttacac

SEQ ID NO: 8211493 - DNA, 22 bp, Homo sapiens
tttcttagcgatgcttgataaa

SEQ ID NO: 8211494 - DNA, 19 bp, Homo sapiens
tttcttaggcctttggcct

SEQ ID NO: 8211495 - DNA, 22 bp, Homo sapiens
tttcttaatttgagttccacta

SEQ ID NO: 8211496 - DNA, 22 bp, Homo sapiens
tttcttaaatatttgcaggaca

SEQ ID NO: 8211497 - DNA, 21 bp, Homo sapiens
tttcttaggctctaaaatgac

SEQ ID NO: 8211498 - DNA, 21 bp, Homo sapiens
tttcttaggctctaaaatgac

SEQ ID NO: 8211499 - DNA, 21 bp, Homo sapiens
tttcttaggctctaaaatgac

SEQ ID NO: 8211500 - DNA, 22 bp, Homo sapiens
tttcttagggactgtaaaatag

SEQ ID NO: 8211501 - DNA, 22 bp, Homo sapiens
tttcttagggactgtaaaatag

SEQ ID NO: 8211502 - DNA, 22 bp, Homo sapiens
ctctgcttctgagatggaagct

SEQ ID NO: 8211503 - DNA, 22 bp, Homo sapiens
ctctgctgtgccgccagggcct

SEQ ID NO: 8211504 - DNA, 22 bp, Homo sapiens
ctctgctgtctcagatgggcca

SEQ ID NO: 8211505 - DNA, 22 bp, Homo sapiens
ctctgctgtctccagggcagtc

SEQ ID NO: 8211506 - DNA, 22 bp, Homo sapiens
ctctgctggtgaccactgggcc

SEQ ID NO: 8211507 - DNA, 22 bp, Homo sapiens
tttcttgagcccaggaggtgga

SEQ ID NO: 8211508 - DNA, 22 bp, Homo sapiens
tttcttgaccactatgttgata

SEQ ID NO: 8211509 - DNA, 22 bp, Homo sapiens
tttcttgagtgatgcttagtgt

SEQ ID NO: 8211510 - DNA, 19 bp, Homo sapiens
ctctgcctctggctgtggc

SEQ ID NO: 8211511 - DNA, 19 bp, Homo sapiens
ctctgcctctggctgtggc

SEQ ID NO: 8211512 - DNA, 19 bp, Homo sapiens
ctctgcctctggctgtggc

SEQ ID NO: 8211513 - DNA, 22 bp, Homo sapiens
ctctgctgctttgccagtggaa

SEQ ID NO: 8211514 - DNA, 22 bp, Homo sapiens
tttgaagttggagatgggagat

SEQ ID NO: 8211515 - DNA, 22 bp, Homo sapiens
tttgaataaacggttaatgttc

SEQ ID NO: 8211516 - DNA, 22 bp, Homo sapiens
ctctggaattaaggaagcctgt

SEQ ID NO: 8211517 - DNA, 22 bp, Homo sapiens
tttgaataatcactgggcatta

SEQ ID NO: 8211518 - DNA, 22 bp, Homo sapiens
tttgaagtgtatgaaaatacag

SEQ ID NO: 8211519 - DNA, 22 bp, Homo sapiens
tttgaagtgtatgaaaatacag

SEQ ID NO: 8211520 - DNA, 22 bp, Homo sapiens
tttgaagtgttatttctatcac

SEQ ID NO: 8211521 - DNA, 22 bp, Homo sapiens
tttgaagttcccccatatcaga

SEQ ID NO: 8211522 - DNA, 23 bp, Homo sapiens
tttgaagttgactgccttccaga

SEQ ID NO: 8211523 - DNA, 22 bp, Homo sapiens
tttgaagtgttatttctatcac

SEQ ID NO: 8211524 - DNA, 22 bp, Homo sapiens
ctctggagcatttcacctacat

SEQ ID NO: 8211525 - DNA, 22 bp, Homo sapiens
ctctggaattgacctgggaggg

SEQ ID NO: 8211526 - DNA, 22 bp, Homo sapiens
ctctggaattgacctgggaggg

SEQ ID NO: 8211527 - DNA, 22 bp, Homo sapiens
ctctggaattgacctgggaggg

SEQ ID NO: 8211528 - DNA, 19 bp, Homo sapiens
ctctggagcagacactgga

SEQ ID NO: 8211529 - DNA, 23 bp, Homo sapiens
tttgaagcattttgtatcttagt

SEQ ID NO: 8211530 - DNA, 18 bp, Homo sapiens
tttgaaggatggcctgga

SEQ ID NO: 8211531 - DNA, 22 bp, Homo sapiens
tttgaagccatgtcaatagttt

SEQ ID NO: 8211532 - DNA, 22 bp, Homo sapiens
tttgaagggcacgacaatagtt

SEQ ID NO: 8211533 - DNA, 22 bp, Homo sapiens
tttgaagggcacgacaatagtt

SEQ ID NO: 8211534 - DNA, 22 bp, Homo sapiens
tttgaagtcagacactgctttg

SEQ ID NO: 8211535 - DNA, 22 bp, Homo sapiens
tttgaagtcaaagattgattcc

SEQ ID NO: 8211536 - DNA, 22 bp, Homo sapiens
tttgaagtcaaagattgattcc

SEQ ID NO: 8211537 - DNA, 22 bp, Homo sapiens
tttgaagtacctggttctgact

SEQ ID NO: 8211538 - DNA, 22 bp, Homo sapiens
tttgaagtggatcccttcagtg

SEQ ID NO: 8211539 - DNA, 22 bp, Homo sapiens
tttgaagtgggcattagaacct

SEQ ID NO: 8211540 - DNA, 22 bp, Homo sapiens
tttgaagtggaaaaggatttaa

SEQ ID NO: 8211541 - DNA, 22 bp, Homo sapiens
tttgaagtggaaaaggatttaa

SEQ ID NO: 8211542 - DNA, 22 bp, Homo sapiens
tttgaagtgcctcttgtggatt

SEQ ID NO: 8211543 - DNA, 22 bp, Homo sapiens
tttgaagtcaggctttctaccc

SEQ ID NO: 8211544 - DNA, 22 bp, Homo sapiens
tttgaagtccatctggcccagt

SEQ ID NO: 8211545 - DNA, 22 bp, Homo sapiens
tttgaagtcagacactgctttg

SEQ ID NO: 8211546 - DNA, 22 bp, Homo sapiens
tttgaagtcagatggtctgagt

SEQ ID NO: 8211547 - DNA, 21 bp, Homo sapiens
ctctggagtcaagagcttcca

SEQ ID NO: 8211548 - DNA, 22 bp, Homo sapiens
ctctggagtcaggcagccctgg

SEQ ID NO: 8211549 - DNA, 22 bp, Homo sapiens
ctctggagtcaggcagccctgg

SEQ ID NO: 8211550 - DNA, 22 bp, Homo sapiens
ctctggagtcaggcagccctgg

SEQ ID NO: 8211551 - DNA, 22 bp, Homo sapiens
ctctggaggtggaggttgcagt

SEQ ID NO: 8211552 - DNA, 22 bp, Homo sapiens
ctctggaggtggaggttgcagt

SEQ ID NO: 8211553 - DNA, 22 bp, Homo sapiens
ctctggaggtggaggttgcagt

SEQ ID NO: 8211554 - DNA, 22 bp, Homo sapiens
ctctggaggtcaggtgtggtgg

SEQ ID NO: 8211555 - DNA, 22 bp, Homo sapiens
ctctggaggtcaggtgtggtgg

SEQ ID NO: 8211556 - DNA, 22 bp, Homo sapiens
ctctggaggttgagcccagcaa

SEQ ID NO: 8211557 - DNA, 22 bp, Homo sapiens
ctctggagtaagagctatgaaa

SEQ ID NO: 8211558 - DNA, 22 bp, Homo sapiens
ctctggagtaagagctatgaaa

SEQ ID NO: 8211559 - DNA, 22 bp, Homo sapiens
ctctggagtaagagctatgaaa

SEQ ID NO: 8211560 - DNA, 22 bp, Homo sapiens
ctctggaggtggaggttgcagt

SEQ ID NO: 8211561 - DNA, 22 bp, Homo sapiens
ctctggaggttgagcccagcaa

SEQ ID NO: 8211562 - DNA, 22 bp, Homo sapiens
ctctggaggttgagcccagcaa

SEQ ID NO: 8211563 - DNA, 22 bp, Homo sapiens
ctctggagggaggctgagctgg

SEQ ID NO: 8211564 - DNA, 22 bp, Homo sapiens
ctctggagggaggctgagctgg

SEQ ID NO: 8211565 - DNA, 22 bp, Homo sapiens
ctctggagggaggctgagctgg

SEQ ID NO: 8211566 - DNA, 19 bp, Homo sapiens
ctctggagggaccgccgtt

SEQ ID NO: 8211567 - DNA, 19 bp, Homo sapiens
ctctggagggaccgccgtt

SEQ ID NO: 8211568 - DNA, 22 bp, Homo sapiens
ctctggaggcctaaggaagtgg

SEQ ID NO: 8211569 - DNA, 22 bp, Homo sapiens
ctctggaggcagcaccagccag

SEQ ID NO: 8211570 - DNA, 22 bp, Homo sapiens
ctctggaggccgttggccctta

SEQ ID NO: 8211571 - DNA, 22 bp, Homo sapiens
ctctggagcgctgcttcccgcg

SEQ ID NO: 8211572 - DNA, 21 bp, Homo sapiens
ctctggaggcaagggagagtg

SEQ ID NO: 8211573 - DNA, 21 bp, Homo sapiens
ctctggaggcaagggagagtg

SEQ ID NO: 8211574 - DNA, 21 bp, Homo sapiens
ctctggaggcaagggagagtg

SEQ ID NO: 8211575 - DNA, 22 bp, Homo sapiens
ctctggaggcagcaccagccag

SEQ ID NO: 8211576 - DNA, 22 bp, Homo sapiens
tttctgcatctctacagttgtt

SEQ ID NO: 8211577 - DNA, 22 bp, Homo sapiens
tttctgcatatgtatgtatgga

SEQ ID NO: 8211578 - DNA, 22 bp, Homo sapiens
tttctgttgtacttaaactagg

SEQ ID NO: 8211579 - DNA, 19 bp, Homo sapiens
tttctgcagcccagcagca

SEQ ID NO: 8211580 - DNA, 20 bp, Homo sapiens
tttctgcagatgtttacatg

SEQ ID NO: 8211581 - DNA, 20 bp, Homo sapiens
tttctgcagatgtttacatg

SEQ ID NO: 8211582 - DNA, 22 bp, Homo sapiens
tttctgttgtacttaaactagg

SEQ ID NO: 8211583 - DNA, 22 bp, Homo sapiens
tttctgttgtacttaaactagg

SEQ ID NO: 8211584 - DNA, 22 bp, Homo sapiens
tttctgttgtatggcttctgca

SEQ ID NO: 8211585 - DNA, 22 bp, Homo sapiens
tttctgttgttggtgtctggct

SEQ ID NO: 8211586 - DNA, 22 bp, Homo sapiens
tttctgttgttggtgtctggct

SEQ ID NO: 8211587 - DNA, 22 bp, Homo sapiens
tttctgttgttggtgtctggct

SEQ ID NO: 8211588 - DNA, 22 bp, Homo sapiens
tttctgtttagcataaagtggc

SEQ ID NO: 8211589 - DNA, 19 bp, Homo sapiens
tttctgtttgcttctggtt

SEQ ID NO: 8211590 - DNA, 19 bp, Homo sapiens
tttctgtttgcttctggtt

SEQ ID NO: 8211591 - DNA, 19 bp, Homo sapiens
tttctgtttgcttctggtt

SEQ ID NO: 8211592 - DNA, 22 bp, Homo sapiens
tttctgcaaacttccacgtctc

SEQ ID NO: 8211593 - DNA, 22 bp, Homo sapiens
tttctgcaacgagtctttgact

SEQ ID NO: 8211594 - DNA, 22 bp, Homo sapiens
tttctgcaaaatctaagttaga

SEQ ID NO: 8211595 - DNA, 22 bp, Homo sapiens
tttctgcaagtgtagataccca

SEQ ID NO: 8211596 - DNA, 22 bp, Homo sapiens
tttctgcaaaataaatagtgac

SEQ ID NO: 8211597 - DNA, 22 bp, Homo sapiens
tttctgatttgacttgaagtat

SEQ ID NO: 8211598 - DNA, 22 bp, Homo sapiens
tttctgcaaaatctaagttaga

SEQ ID NO: 8211599 - DNA, 22 bp, Homo sapiens
tttctgatattcatttagaaga

SEQ ID NO: 8211600 - DNA, 22 bp, Homo sapiens
tttctgattctcactttggcat

SEQ ID NO: 8211601 - DNA, 22 bp, Homo sapiens
tttctgatttgacttgaagtat

SEQ ID NO: 8211602 - DNA, 22 bp, Homo sapiens
tttctgataattttgtgaaatc

SEQ ID NO: 8211603 - DNA, 22 bp, Homo sapiens
tttctgataattttgtgaaatc

SEQ ID NO: 8211604 - DNA, 22 bp, Homo sapiens
tttctgatatactgtagaatcc

SEQ ID NO: 8211605 - DNA, 22 bp, Homo sapiens
tttctgatatactgtagaatcc

SEQ ID NO: 8211606 - DNA, 22 bp, Homo sapiens
tttctgatattcatttagaaga

SEQ ID NO: 8211607 - DNA, 22 bp, Homo sapiens
tttctgataattttgtgaaatc

SEQ ID NO: 8211608 - DNA, 22 bp, Homo sapiens
ctctgagctgaaacatgagcat

SEQ ID NO: 8211609 - DNA, 22 bp, Homo sapiens
ctctgagctgaaacatgagcat

SEQ ID NO: 8211610 - DNA, 22 bp, Homo sapiens
ctctgagctcgtgcagtacttc

SEQ ID NO: 8211611 - DNA, 22 bp, Homo sapiens
ctctgacagccttcattatgca

SEQ ID NO: 8211612 - DNA, 22 bp, Homo sapiens
ctctgacagccacatagaggct

SEQ ID NO: 8211613 - DNA, 22 bp, Homo sapiens
ctctctggatatttgtatgctg

SEQ ID NO: 8211614 - DNA, 22 bp, Homo sapiens
ctctctggcacttcattgctgt

SEQ ID NO: 8211615 - DNA, 22 bp, Homo sapiens
ctctctggcacttcattgctgt

SEQ ID NO: 8211616 - DNA, 22 bp, Homo sapiens
ctctctggcccatcctgttgcc

SEQ ID NO: 8211617 - DNA, 22 bp, Homo sapiens
ctctctggcccatcctgttgcc

SEQ ID NO: 8211618 - DNA, 22 bp, Homo sapiens
ctctctggcacttcattgctgt

SEQ ID NO: 8211619 - DNA, 22 bp, Homo sapiens
ctctctggcccatcctgttgcc

SEQ ID NO: 8211620 - DNA, 22 bp, Homo sapiens
ctctgagggctcgagggacgcg

SEQ ID NO: 8211621 - DNA, 22 bp, Homo sapiens
ctctgaggctccatgcaggctt

SEQ ID NO: 8211622 - DNA, 22 bp, Homo sapiens
ctctatgttatgcagaattaag

SEQ ID NO: 8211623 - DNA, 22 bp, Homo sapiens
ctctattagtctttgctaaata

SEQ ID NO: 8211624 - DNA, 22 bp, Homo sapiens
ctctatttatggcatctttatg

SEQ ID NO: 8211625 - DNA, 22 bp, Homo sapiens
ctctcaaagaaattgcctgtca

SEQ ID NO: 8211626 - DNA, 22 bp, Homo sapiens
ctctatttatggcatctttatg

SEQ ID NO: 8211627 - DNA, 22 bp, Homo sapiens
ctctagggtgcaggccccagga

SEQ ID NO: 8211628 - DNA, 22 bp, Homo sapiens
tttctcacccaagagttatttt

SEQ ID NO: 8211629 - DNA, 22 bp, Homo sapiens
tttctctcagcctgtagaaact

SEQ ID NO: 8211630 - DNA, 22 bp, Homo sapiens
tttctctattaggggctagctt

SEQ ID NO: 8211631 - DNA, 22 bp, Homo sapiens
ctctcaaatgtcattcctctat

SEQ ID NO: 8211632 - DNA, 22 bp, Homo sapiens
ctctcaaagtaaggtgtataca

SEQ ID NO: 8211633 - DNA, 20 bp, Homo sapiens
ctctcacagctccctcagcc

SEQ ID NO: 8211634 - DNA, 21 bp, Homo sapiens
tttctcaccatggtatggaaa

SEQ ID NO: 8211635 - DNA, 22 bp, Homo sapiens
ctctagctgaggtcactgctat

SEQ ID NO: 8211636 - DNA, 22 bp, Homo sapiens
ctctagcagcagcccttcctta

SEQ ID NO: 8211637 - DNA, 22 bp, Homo sapiens
ctctagctgaggtcactgctat

SEQ ID NO: 8211638 - DNA, 22 bp, Homo sapiens
ctctagagtacgggctggcatg

SEQ ID NO: 8211639 - DNA, 22 bp, Homo sapiens
ctctagaggcttgaatgggcga

SEQ ID NO: 8211640 - DNA, 22 bp, Homo sapiens
ctctagacaacttgctgtgggt

SEQ ID NO: 8211641 - DNA, 22 bp, Homo sapiens
ctctaggccatccagggccatt

SEQ ID NO: 8211642 - DNA, 22 bp, Homo sapiens
ctctaggccatccagggccatt

SEQ ID NO: 8211643 - DNA, 22 bp, Homo sapiens
ctctaggccatccagggccatt

SEQ ID NO: 8211644 - DNA, 22 bp, Homo sapiens
ctctaggctgcccaggagctga

SEQ ID NO: 8211645 - DNA, 22 bp, Homo sapiens
ctctagacaacttgctgtgggt

SEQ ID NO: 8211646 - DNA, 22 bp, Homo sapiens
ctctactcttaacacagctagg

SEQ ID NO: 8211647 - DNA, 22 bp, Homo sapiens
ctctagaatgaattagcgcagg

SEQ ID NO: 8211648 - DNA, 21 bp, Homo sapiens
ctctagaaatcgaataacctt

SEQ ID NO: 8211649 - DNA, 22 bp, Homo sapiens
ctctagaacagtgctgagcctt

SEQ ID NO: 8211650 - DNA, 21 bp, Homo sapiens
ctctacattcccagcaactct

SEQ ID NO: 8211651 - DNA, 22 bp, Homo sapiens
ctctacagctgctgcccctggt

SEQ ID NO: 8211652 - DNA, 22 bp, Homo sapiens
ctctctggaattaaagcccaat

SEQ ID NO: 8211653 - DNA, 22 bp, Homo sapiens
ctctctggaattaaagcccaat

SEQ ID NO: 8211654 - DNA, 22 bp, Homo sapiens
ctctctggacctcaactatttt

SEQ ID NO: 8211655 - DNA, 22 bp, Homo sapiens
ctctctggacttgagtatcagc

SEQ ID NO: 8211656 - DNA, 22 bp, Homo sapiens
ctctctggacttgagtatcagc

SEQ ID NO: 8211657 - DNA, 22 bp, Homo sapiens
ctctctggacttgagtatcagc

SEQ ID NO: 8211658 - DNA, 22 bp, Homo sapiens
tttctctggcattaggtataaa

SEQ ID NO: 8211659 - DNA, 22 bp, Homo sapiens
tttctctggcctcagtttaaca

SEQ ID NO: 8211660 - DNA, 22 bp, Homo sapiens
tttctctggcctcagtttaaca

SEQ ID NO: 8211661 - DNA, 20 bp, Homo sapiens
ctctctggaaggtgggagcc

SEQ ID NO: 8211662 - DNA, 22 bp, Homo sapiens
tttctctgctgcctgtgtcgat

SEQ ID NO: 8211663 - DNA, 22 bp, Homo sapiens
tttctctgagttgttacaaaac

SEQ ID NO: 8211664 - DNA, 22 bp, Homo sapiens
tttctctgagttgttacaaaac

SEQ ID NO: 8211665 - DNA, 19 bp, Homo sapiens
tttctctccctcatcccga

SEQ ID NO: 8211666 - DNA, 22 bp, Homo sapiens
tttctctctacagtactttcat

SEQ ID NO: 8211667 - DNA, 22 bp, Homo sapiens
tttctctctacagtactttcat

SEQ ID NO: 8211668 - DNA, 22 bp, Homo sapiens
tttctctcagcctgtagaaact

SEQ ID NO: 8211669 - DNA, 22 bp, Homo sapiens
tttctctccccaagtggaattg

SEQ ID NO: 8211670 - DNA, 19 bp, Homo sapiens
tttctctccctcatcccga

SEQ ID NO: 8211671 - DNA, 23 bp, Homo sapiens
tttctctgagaagcagttctcta

SEQ ID NO: 8211672 - DNA, 23 bp, Homo sapiens
tttctctgagaagcagttctcta

SEQ ID NO: 8211673 - DNA, 23 bp, Homo sapiens
tttctctgagaagcagttctcta

SEQ ID NO: 8211674 - DNA, 22 bp, Homo sapiens
tttctctcttaaggagtttaaa

SEQ ID NO: 8211675 - DNA, 22 bp, Homo sapiens
tttctctctggccctgattgtc

SEQ ID NO: 8211676 - DNA, 22 bp, Homo sapiens
tttctctctatttagacaggta

SEQ ID NO: 8211677 - DNA, 22 bp, Homo sapiens
tttctctctatttagacaggta

SEQ ID NO: 8211678 - DNA, 22 bp, Homo sapiens
tttctctctatttagacaggta

SEQ ID NO: 8211679 - DNA, 22 bp, Homo sapiens
tttctctctggccctgattgtc

SEQ ID NO: 8211680 - DNA, 22 bp, Homo sapiens
tttctctctggccctgattgtc

SEQ ID NO: 8211681 - DNA, 22 bp, Homo sapiens
tttacaattctggtgccagcta

SEQ ID NO: 8211682 - DNA, 22 bp, Homo sapiens
tttacaattggttttctctaat

SEQ ID NO: 8211683 - DNA, 22 bp, Homo sapiens
tttacaattggttttctctaat

SEQ ID NO: 8211684 - DNA, 22 bp, Homo sapiens
tttacaattggttttctctaat

SEQ ID NO: 8211685 - DNA, 22 bp, Homo sapiens
tttacacaaaagatagcacacc

SEQ ID NO: 8211686 - DNA, 22 bp, Homo sapiens
tttacacaaaagatagcacacc

SEQ ID NO: 8211687 - DNA, 22 bp, Homo sapiens
tttacacaaaagatagcacacc

SEQ ID NO: 8211688 - DNA, 22 bp, Homo sapiens
tttacacaaaagatagcacacc

SEQ ID NO: 8211689 - DNA, 22 bp, Homo sapiens
ctcctcagttgtcccatggaga

SEQ ID NO: 8211690 - DNA, 22 bp, Homo sapiens
tttacaattctctaccagtgtt

SEQ ID NO: 8211691 - DNA, 22 bp, Homo sapiens
tttacaattctctaccagtgtt

SEQ ID NO: 8211692 - DNA, 22 bp, Homo sapiens
tttacaatagggtctgaatgaa

SEQ ID NO: 8211693 - DNA, 22 bp, Homo sapiens
tttacaagtttacagaatgatg

SEQ ID NO: 8211694 - DNA, 22 bp, Homo sapiens
tttacaagtttacagaatgatg

SEQ ID NO: 8211695 - DNA, 22 bp, Homo sapiens
ctcctgcctgtgggactgagga

SEQ ID NO: 8211696 - DNA, 22 bp, Homo sapiens
ctcctgcgggagctccgcctag

SEQ ID NO: 8211697 - DNA, 22 bp, Homo sapiens
ctcctgagctgcagccttgtgt

SEQ ID NO: 8211698 - DNA, 22 bp, Homo sapiens
ctcctgagctgcagccttgtgt

SEQ ID NO: 8211699 - DNA, 22 bp, Homo sapiens
ctcctgcctgtgggactgagga

SEQ ID NO: 8211700 - DNA, 22 bp, Homo sapiens
ctcctgcctgtgggactgagga

SEQ ID NO: 8211701 - DNA, 22 bp, Homo sapiens
ctcctgagctctgaggaagctt

SEQ ID NO: 8211702 - DNA, 22 bp, Homo sapiens
ctcctgagctctgaggaagctt

SEQ ID NO: 8211703 - DNA, 22 bp, Homo sapiens
ctcctgagctgcagccttgtgt

SEQ ID NO: 8211704 - DNA, 22 bp, Homo sapiens
ctcctgagctgcagccttgtgt

SEQ ID NO: 8211705 - DNA, 22 bp, Homo sapiens
ctcctgcttcacgggcaccgcc

SEQ ID NO: 8211706 - DNA, 22 bp, Homo sapiens
ctcctgcttcacgggcaccgcc

SEQ ID NO: 8211707 - DNA, 22 bp, Homo sapiens
ctcctgctgaatggccaggagc

SEQ ID NO: 8211708 - DNA, 22 bp, Homo sapiens
ctcctgctgaatggccaggagc

SEQ ID NO: 8211709 - DNA, 22 bp, Homo sapiens
tttacacatacctctttaaagt

SEQ ID NO: 8211710 - DNA, 22 bp, Homo sapiens
tttacacataaatgtgtagaca

SEQ ID NO: 8211711 - DNA, 22 bp, Homo sapiens
tttacacagaggacactgggct

SEQ ID NO: 8211712 - DNA, 22 bp, Homo sapiens
tttacacaaaatgttagtagat

SEQ ID NO: 8211713 - DNA, 22 bp, Homo sapiens
tttacacaaaatgttagtagat

SEQ ID NO: 8211714 - DNA, 22 bp, Homo sapiens
tttacacaaaagatagcacacc

SEQ ID NO: 8211715 - DNA, 18 bp, Homo sapiens
tttatatggatagagacc

SEQ ID NO: 8211716 - DNA, 18 bp, Homo sapiens
tttatatggatagagacc

SEQ ID NO: 8211717 - DNA, 22 bp, Homo sapiens
tttatatccatctttgaagtaa

SEQ ID NO: 8211718 - DNA, 22 bp, Homo sapiens
tttatatgtttgtacaattaag

SEQ ID NO: 8211719 - DNA, 22 bp, Homo sapiens
tttatatgtttgtacaattaag

SEQ ID NO: 8211720 - DNA, 22 bp, Homo sapiens
tttatatggttgactatgagtt

SEQ ID NO: 8211721 - DNA, 22 bp, Homo sapiens
tttatatggttgactatgagtt

SEQ ID NO: 8211722 - DNA, 22 bp, Homo sapiens
tttatatgtgaaggtttgcaga

SEQ ID NO: 8211723 - DNA, 22 bp, Homo sapiens
tttatatgtgaaggtttgcaga

SEQ ID NO: 8211724 - DNA, 22 bp, Homo sapiens
ctcctggatgcaggctgtctgc

SEQ ID NO: 8211725 - DNA, 22 bp, Homo sapiens
ctcctggatcttagccagattc

SEQ ID NO: 8211726 - DNA, 23 bp, Homo sapiens
ctcctggagggtccggccctgcc

SEQ ID NO: 8211727 - DNA, 22 bp, Homo sapiens
ctcctggagtcctttcctattc

SEQ ID NO: 8211728 - DNA, 23 bp, Homo sapiens
ctcctggagggtccggccctgcc

SEQ ID NO: 8211729 - DNA, 23 bp, Homo sapiens
ctcctggagggtccggccctgcc

SEQ ID NO: 8211730 - DNA, 22 bp, Homo sapiens
ctcctggaggctccaagggaga

SEQ ID NO: 8211731 - DNA, 22 bp, Homo sapiens
ctcctggaggatagtgactggg

SEQ ID NO: 8211732 - DNA, 23 bp, Homo sapiens
ctcctggagggtccggccctgcc

SEQ ID NO: 8211733 - DNA, 22 bp, Homo sapiens
ctcctggagggccaaagaaata

SEQ ID NO: 8211734 - DNA, 22 bp, Homo sapiens
ctcctggacatggagcggagga

SEQ ID NO: 8211735 - DNA, 22 bp, Homo sapiens
ctcctggacatggagcggagga

SEQ ID NO: 8211736 - DNA, 22 bp, Homo sapiens
ctcctggacatggagcggagga

SEQ ID NO: 8211737 - DNA, 22 bp, Homo sapiens
ctcctggacatggagcggagga

SEQ ID NO: 8211738 - DNA, 22 bp, Homo sapiens
ctcctggaagcccgccctgctg

SEQ ID NO: 8211739 - DNA, 22 bp, Homo sapiens
ctcctggaagcccgccctgctg

SEQ ID NO: 8211740 - DNA, 22 bp, Homo sapiens
ctcctggagcagcaggcgcagg

SEQ ID NO: 8211741 - DNA, 22 bp, Homo sapiens
ctcctggaccagggctattggg

SEQ ID NO: 8211742 - DNA, 22 bp, Homo sapiens
ctcctggaccaccttgtggcca

SEQ ID NO: 8211743 - DNA, 22 bp, Homo sapiens
ctcctggaggatagtgactggg

SEQ ID NO: 8211744 - DNA, 22 bp, Homo sapiens
ctcctggagcagcaggcgcagg

SEQ ID NO: 8211745 - DNA, 22 bp, Homo sapiens
tttcaaagttgggaattgtaat

SEQ ID NO: 8211746 - DNA, 22 bp, Homo sapiens
tttcaaataccataaacctaat

SEQ ID NO: 8211747 - DNA, 22 bp, Homo sapiens
tttcaaataccataaacctaat

SEQ ID NO: 8211748 - DNA, 22 bp, Homo sapiens
tttcaaagtggagggatggtat

SEQ ID NO: 8211749 - DNA, 22 bp, Homo sapiens
tttcaaagtggagaattagaca

SEQ ID NO: 8211750 - DNA, 22 bp, Homo sapiens
tttcaaataccataaacctaat

SEQ ID NO: 8211751 - DNA, 22 bp, Homo sapiens
tttcaaataccataaacctaat

SEQ ID NO: 8211752 - DNA, 22 bp, Homo sapiens
tttcaaataccataaacctaat

SEQ ID NO: 8211753 - DNA, 22 bp, Homo sapiens
tttcaaataccataaacctaat

SEQ ID NO: 8211754 - DNA, 22 bp, Homo sapiens
ctcgttgctgaagccaaagtca

SEQ ID NO: 8211755 - DNA, 22 bp, Homo sapiens
ctcggtgaatttttctagcgta

SEQ ID NO: 8211756 - DNA, 22 bp, Homo sapiens
ctcggtgatggaaggtttctcg

SEQ ID NO: 8211757 - DNA, 22 bp, Homo sapiens
ctcgggcttgaggctgtttacc

SEQ ID NO: 8211758 - DNA, 22 bp, Homo sapiens
ctccttctcctcgggaggccag

SEQ ID NO: 8211759 - DNA, 22 bp, Homo sapiens
ctccttctcctcgggaggccag

SEQ ID NO: 8211760 - DNA, 22 bp, Homo sapiens
ctccttcctggttagcacctta

SEQ ID NO: 8211761 - DNA, 22 bp, Homo sapiens
ctctaaatccacggtatagttg

SEQ ID NO: 8211762 - DNA, 22 bp, Homo sapiens
ctctaaatccacggtatagttg

SEQ ID NO: 8211763 - DNA, 22 bp, Homo sapiens
ctctaaatccaaataagtgtcc

SEQ ID NO: 8211764 - DNA, 22 bp, Homo sapiens
ctctaaatccaaataagtgtcc

SEQ ID NO: 8211765 - DNA, 22 bp, Homo sapiens
ctctaaatccaaataagtgtcc

SEQ ID NO: 8211766 - DNA, 22 bp, Homo sapiens
ctctaacaccacagtgtggttt

SEQ ID NO: 8211767 - DNA, 22 bp, Homo sapiens
ctctaatactgaccaagtcacc

SEQ ID NO: 8211768 - DNA, 22 bp, Homo sapiens
ctctaatactgaccaagtcacc

SEQ ID NO: 8211769 - DNA, 22 bp, Homo sapiens
ctctaatactgaccaagtcacc

SEQ ID NO: 8211770 - DNA, 22 bp, Homo sapiens
ctctacagctgctgcccctggt

SEQ ID NO: 8211771 - DNA, 22 bp, Homo sapiens
ctcctgggcttcgaaggctccc

SEQ ID NO: 8211772 - DNA, 22 bp, Homo sapiens
ctcctgtatgttgggcttcaca

SEQ ID NO: 8211773 - DNA, 22 bp, Homo sapiens
ctcctgggcttcgaaggctccc

SEQ ID NO: 8211774 - DNA, 22 bp, Homo sapiens
ctcctgggcttcgaaggctccc

SEQ ID NO: 8211775 - DNA, 22 bp, Homo sapiens
tttatattacctggaatagctt

SEQ ID NO: 8211776 - DNA, 22 bp, Homo sapiens
tttatattacctggaatagctt

SEQ ID NO: 8211777 - DNA, 22 bp, Homo sapiens
tttatattacctggaatagctt

SEQ ID NO: 8211778 - DNA, 22 bp, Homo sapiens
tttatattacctggaatagctt

SEQ ID NO: 8211779 - DNA, 22 bp, Homo sapiens
ctcctgtcagaagcatcctgag

SEQ ID NO: 8211780 - DNA, 22 bp, Homo sapiens
ctcctgtcagaagcatcctgag

SEQ ID NO: 8211781 - DNA, 22 bp, Homo sapiens
ctcctgtcaataggctcctggc

SEQ ID NO: 8211782 - DNA, 22 bp, Homo sapiens
ctcctgtcaataggctcctggc

SEQ ID NO: 8211783 - DNA, 22 bp, Homo sapiens
ctcctgtcaataggctcctggc

SEQ ID NO: 8211784 - DNA, 22 bp, Homo sapiens
ctcctgtggtcaagggtgggac

SEQ ID NO: 8211785 - DNA, 22 bp, Homo sapiens
tttcaaagtaaggattttcatc

SEQ ID NO: 8211786 - DNA, 22 bp, Homo sapiens
ctcctgtggtactcccagggcc

SEQ ID NO: 8211787 - DNA, 22 bp, Homo sapiens
ctcctgtggtactcccagggcc

SEQ ID NO: 8211788 - DNA, 22 bp, Homo sapiens
tttcaaagtcaatatcattacc

SEQ ID NO: 8211789 - DNA, 22 bp, Homo sapiens
tttcaaagtcaagaaggatact

SEQ ID NO: 8211790 - DNA, 22 bp, Homo sapiens
ctcctgtcccggggaccgccga

SEQ ID NO: 8211791 - DNA, 22 bp, Homo sapiens
ctcctgtgaggcttaagcccag

SEQ ID NO: 8211792 - DNA, 22 bp, Homo sapiens
ctcctgtgcacctccagcggca

SEQ ID NO: 8211793 - DNA, 22 bp, Homo sapiens
ctcctgtgcatgcatctcccta

SEQ ID NO: 8211794 - DNA, 22 bp, Homo sapiens
ctcctgtggctttctgatttca

SEQ ID NO: 8211795 - DNA, 20 bp, Homo sapiens
ctcctgtgcctctctgggcc

SEQ ID NO: 8211796 - DNA, 22 bp, Homo sapiens
ctcctgtgggtcaccaataggc

SEQ ID NO: 8211797 - DNA, 20 bp, Homo sapiens
ctcctgtgcctctctgggcc

SEQ ID NO: 8211798 - DNA, 20 bp, Homo sapiens
ctcctgtgcctctctgggcc

SEQ ID NO: 8211799 - DNA, 22 bp, Homo sapiens
ctcctgtgcatgcatctcccta

SEQ ID NO: 8211800 - DNA, 22 bp, Homo sapiens
ttgtttaatgcctcatacatct

SEQ ID NO: 8211801 - DNA, 22 bp, Homo sapiens
ttgtttaatatcgtgaagtact

SEQ ID NO: 8211802 - DNA, 22 bp, Homo sapiens
ttgtttaatgcctcatacatct

SEQ ID NO: 8211803 - DNA, 22 bp, Homo sapiens
ttgtttaatgcctcatacatct

SEQ ID NO: 8211804 - DNA, 22 bp, Homo sapiens
ctccccaggttcaggaggtggg

SEQ ID NO: 8211805 - DNA, 22 bp, Homo sapiens
ctccccaggttcaggaggtggg

SEQ ID NO: 8211806 - DNA, 22 bp, Homo sapiens
ctccccagccctggtattctga

SEQ ID NO: 8211807 - DNA, 22 bp, Homo sapiens
ctccccagcattctgacttcct

SEQ ID NO: 8211808 - DNA, 22 bp, Homo sapiens
ctccccagcattctgacttcct

SEQ ID NO: 8211809 - DNA, 22 bp, Homo sapiens
ctccccagcattctgacttcct

SEQ ID NO: 8211810 - DNA, 22 bp, Homo sapiens
ctccccagctcgcgggtgacgg

SEQ ID NO: 8211811 - DNA, 22 bp, Homo sapiens
ctccccagctcgcgggtgacgg

SEQ ID NO: 8211812 - DNA, 22 bp, Homo sapiens
ctccccagctcgcgggtgacgg

SEQ ID NO: 8211813 - DNA, 18 bp, Homo sapiens
ctccccagctgcccccag

SEQ ID NO: 8211814 - DNA, 18 bp, Homo sapiens
ctccccagctgcccccag

SEQ ID NO: 8211815 - DNA, 18 bp, Homo sapiens
ctccccagctgcccccag

SEQ ID NO: 8211816 - DNA, 18 bp, Homo sapiens
ctccccagctgcccccag

SEQ ID NO: 8211817 - DNA, 20 bp, Homo sapiens
ttgtttattatgttctgatc

SEQ ID NO: 8211818 - DNA, 20 bp, Homo sapiens
ttgtttattatgttctgatc

SEQ ID NO: 8211819 - DNA, 22 bp, Homo sapiens
ttgtttcagctgtatgctatgt

SEQ ID NO: 8211820 - DNA, 22 bp, Homo sapiens
ttgtttcagcccagatctttac

SEQ ID NO: 8211821 - DNA, 22 bp, Homo sapiens
ttgtttaatgcctcatacatct

SEQ ID NO: 8211822 - DNA, 22 bp, Homo sapiens
ttgtttacaagttactcagtct

SEQ ID NO: 8211823 - DNA, 23 bp, Homo sapiens
ttgtttaccgtaggacttttaac

SEQ ID NO: 8211824 - DNA, 22 bp, Homo sapiens
ctcaggctgtgatgtgatggca

SEQ ID NO: 8211825 - DNA, 22 bp, Homo sapiens
ctcaggctgtgatgtgatggca

SEQ ID NO: 8211826 - DNA, 22 bp, Homo sapiens
ctcaggctggtccttagtgaca

SEQ ID NO: 8211827 - DNA, 22 bp, Homo sapiens
ctcaggctggtttgggttgttt

SEQ ID NO: 8211828 - DNA, 22 bp, Homo sapiens
ctcaggctggtccttagtgaca

SEQ ID NO: 8211829 - DNA, 22 bp, Homo sapiens
ctcaggctggtccttagtgaca

SEQ ID NO: 8211830 - DNA, 22 bp, Homo sapiens
ctcagggaagctatggtgaggg

SEQ ID NO: 8211831 - DNA, 22 bp, Homo sapiens
ctcaggcttgggaggaggccca

SEQ ID NO: 8211832 - DNA, 22 bp, Homo sapiens
ctcaggcttgggaggaggccca

SEQ ID NO: 8211833 - DNA, 22 bp, Homo sapiens
ctcaggctgtgccacctgtgtg

SEQ ID NO: 8211834 - DNA, 22 bp, Homo sapiens
ctcaggctctggccatccaagg

SEQ ID NO: 8211835 - DNA, 22 bp, Homo sapiens
ctcaggctgccctgacagcccc

SEQ ID NO: 8211836 - DNA, 22 bp, Homo sapiens
ctcaggctctggccatccaagg

SEQ ID NO: 8211837 - DNA, 22 bp, Homo sapiens
ctcaggctccagacttccgtcc

SEQ ID NO: 8211838 - DNA, 22 bp, Homo sapiens
ctcaggctgccctgacagcccc

SEQ ID NO: 8211839 - DNA, 22 bp, Homo sapiens
ctcaggctgccctgacagcccc

SEQ ID NO: 8211840 - DNA, 21 bp, Homo sapiens
ctcaggctggcagcaggctag

SEQ ID NO: 8211841 - DNA, 21 bp, Homo sapiens
ctcaggctggcagcaggctag

SEQ ID NO: 8211842 - DNA, 21 bp, Homo sapiens
ctcaggctggcagcaggctag

SEQ ID NO: 8211843 - DNA, 22 bp, Homo sapiens
ctccccacatttctccctgtct

SEQ ID NO: 8211844 - DNA, 22 bp, Homo sapiens
ctccccacatttctccctgtct

SEQ ID NO: 8211845 - DNA, 22 bp, Homo sapiens
ctccccaccttcgcggtccctg

SEQ ID NO: 8211846 - DNA, 22 bp, Homo sapiens
ctccccacgcctggactaagag

SEQ ID NO: 8211847 - DNA, 22 bp, Homo sapiens
ctcccatgctctctctgagaag

SEQ ID NO: 8211848 - DNA, 22 bp, Homo sapiens
ctcccatagcattttaaatagt

SEQ ID NO: 8211849 - DNA, 22 bp, Homo sapiens
ctcccagggccatcgagtcact

SEQ ID NO: 8211850 - DNA, 22 bp, Homo sapiens
ctcccagggccatcgagtcact

SEQ ID NO: 8211851 - DNA, 22 bp, Homo sapiens
ctccccaactcagccgaggctt

SEQ ID NO: 8211852 - DNA, 22 bp, Homo sapiens
ctccccacacactaggcctgat

SEQ ID NO: 8211853 - DNA, 22 bp, Homo sapiens
ctccccacacactaggcctgat

SEQ ID NO: 8211854 - DNA, 22 bp, Homo sapiens
ctccccaagtcatggagccagg

SEQ ID NO: 8211855 - DNA, 22 bp, Homo sapiens
ctccggagaggtcggaaaacag

SEQ ID NO: 8211856 - DNA, 22 bp, Homo sapiens
ctccgagactcgagtgtcctca

SEQ ID NO: 8211857 - DNA, 22 bp, Homo sapiens
ctcccttcaggagaggctcaca

SEQ ID NO: 8211858 - DNA, 22 bp, Homo sapiens
ctcccttcaggagaggctcaca

SEQ ID NO: 8211859 - DNA, 22 bp, Homo sapiens
ctccctggtgtcccctccagga

SEQ ID NO: 8211860 - DNA, 22 bp, Homo sapiens
ctccctggtgtcccctccagga

SEQ ID NO: 8211861 - DNA, 22 bp, Homo sapiens
ctccctggtgtcccctccagga

SEQ ID NO: 8211862 - DNA, 22 bp, Homo sapiens
ctccctgtgctcagagccctgc

SEQ ID NO: 8211863 - DNA, 22 bp, Homo sapiens
ctccctggtgtcccctccagga

SEQ ID NO: 8211864 - DNA, 22 bp, Homo sapiens
ctccctggtctttcccatcatt

SEQ ID NO: 8211865 - DNA, 22 bp, Homo sapiens
ctccctggggctcctcctattt

SEQ ID NO: 8211866 - DNA, 22 bp, Homo sapiens
ctccctggggctcctcctattt

SEQ ID NO: 8211867 - DNA, 22 bp, Homo sapiens
ctccctggtgactcccaaagct

SEQ ID NO: 8211868 - DNA, 22 bp, Homo sapiens
ctccctggtctttcccatcatt

SEQ ID NO: 8211869 - DNA, 22 bp, Homo sapiens
ctccctggtgactcccaaagct

SEQ ID NO: 8211870 - DNA, 22 bp, Homo sapiens
ctcctcaggaagtagcatgtgt

SEQ ID NO: 8211871 - DNA, 21 bp, Homo sapiens
ctcctcaggaccagccacagg

SEQ ID NO: 8211872 - DNA, 21 bp, Homo sapiens
ctcctcaggaccagccacagg

SEQ ID NO: 8211873 - DNA, 21 bp, Homo sapiens
ctcctcaggaccagccacagg

SEQ ID NO: 8211874 - DNA, 22 bp, Homo sapiens
ctcctcagtcaggtctagggtc

SEQ ID NO: 8211875 - DNA, 19 bp, Homo sapiens
ctcctcagtcccagaggtc

SEQ ID NO: 8211876 - DNA, 19 bp, Homo sapiens
ctcctcagtcccagaggtc

SEQ ID NO: 8211877 - DNA, 19 bp, Homo sapiens
ctcctcagtcccagaggtc

SEQ ID NO: 8211878 - DNA, 20 bp, Homo sapiens
ctcctcagttccatgggagg

SEQ ID NO: 8211879 - DNA, 20 bp, Homo sapiens
ctcctcagttccatgggagg

SEQ ID NO: 8211880 - DNA, 22 bp, Homo sapiens
ctccctgcttgtttcccttcag

SEQ ID NO: 8211881 - DNA, 22 bp, Homo sapiens
ctccctgacaggccatgggctt

SEQ ID NO: 8211882 - DNA, 22 bp, Homo sapiens
ctccctgaaattcagatgcctc

SEQ ID NO: 8211883 - DNA, 22 bp, Homo sapiens
ctccctcacacccttgcccaga

SEQ ID NO: 8211884 - DNA, 22 bp, Homo sapiens
ctccctcacacccttgcccaga

SEQ ID NO: 8211885 - DNA, 22 bp, Homo sapiens
ctccctcacacccttgcccaga

SEQ ID NO: 8211886 - DNA, 22 bp, Homo sapiens
ctccctggaggcccagacctgg

SEQ ID NO: 8211887 - DNA, 22 bp, Homo sapiens
ctccctggaggcccagacctgg

SEQ ID NO: 8211888 - DNA, 22 bp, Homo sapiens
ctccctggaggtgagctggcac

SEQ ID NO: 8211889 - DNA, 22 bp, Homo sapiens
ctccctgcttgtttcccttcag

SEQ ID NO: 8211890 - DNA, 22 bp, Homo sapiens
ctccctggaggcccagacctgg

SEQ ID NO: 8211891 - DNA, 22 bp, Homo sapiens
ctccctggaggcccagacctgg

SEQ ID NO: 8211892 - DNA, 22 bp, Homo sapiens
ctccctggaggcccagacctgg

SEQ ID NO: 8211893 - DNA, 22 bp, Homo sapiens
ctccctggcagccgcactcctg

SEQ ID NO: 8211894 - DNA, 22 bp, Homo sapiens
ctccctggcagccgcactcctg

SEQ ID NO: 8211895 - DNA, 22 bp, Homo sapiens
ctccctggcacagcgagaggtt

SEQ ID NO: 8211896 - DNA, 22 bp, Homo sapiens
ctccctggcacagcgagaggtt

SEQ ID NO: 8211897 - DNA, 23 bp, Homo sapiens
ctccctggagtttctggaagatg

SEQ ID NO: 8211898 - DNA, 22 bp, Homo sapiens
ctccctggcacagcgagaggtt

SEQ ID NO: 8211899 - DNA, 23 bp, Homo sapiens
ctccctggagtttctggaagatg

SEQ ID NO: 8211900 - DNA, 22 bp, Homo sapiens
ctccctggctttgtcctgaggc

SEQ ID NO: 8211901 - DNA, 22 bp, Homo sapiens
ctccctggctttgtcctgaggc

SEQ ID NO: 8211902 - DNA, 23 bp, Homo sapiens
ctccctggcccttgggagacctg

SEQ ID NO: 8211903 - DNA, 22 bp, Homo sapiens
ctccctggctttgtcctgaggc

SEQ ID NO: 8211904 - DNA, 22 bp, Homo sapiens
ctccctggctttgtcctgaggc

SEQ ID NO: 8211905 - DNA, 22 bp, Homo sapiens
ctccctggctttgtcctgaggc

SEQ ID NO: 8211906 - DNA, 22 bp, Homo sapiens
ctccctgggcagatgtggctct

SEQ ID NO: 8211907 - DNA, 22 bp, Homo sapiens
ctccctggctttgtcctgaggc

SEQ ID NO: 8211908 - DNA, 22 bp, Homo sapiens
ctccctgggcagatgtggctct

SEQ ID NO: 8211909 - DNA, 22 bp, Homo sapiens
ctccctgggcagatgtggctct

SEQ ID NO: 8211910 - DNA, 22 bp, Homo sapiens
ctccctgggcagatgtggctct

SEQ ID NO: 8211911 - DNA, 22 bp, Homo sapiens
ctccctgggcctcagtttctct

SEQ ID NO: 8211912 - DNA, 22 bp, Homo sapiens
ctccctgggcctcagtttctct

SEQ ID NO: 8211913 - DNA, 22 bp, Homo sapiens
ctccctgggcctcagtttctct

SEQ ID NO: 8211914 - DNA, 22 bp, Homo sapiens
ttttcctgttaaatctgggcac

SEQ ID NO: 8211915 - DNA, 20 bp, Homo sapiens
ttttcctgtggtttgatatg

SEQ ID NO: 8211916 - DNA, 22 bp, Homo sapiens
ttttctcaggtgcttatctaag

SEQ ID NO: 8211917 - DNA, 22 bp, Homo sapiens
ttttctcaggtgcttatctaag

SEQ ID NO: 8211918 - DNA, 22 bp, Homo sapiens
ttttctccaactcaaaggaaag

SEQ ID NO: 8211919 - DNA, 22 bp, Homo sapiens
ttttctccaactcaaaggaaag

SEQ ID NO: 8211920 - DNA, 22 bp, Homo sapiens
ttttctccaactcaaaggaaag

SEQ ID NO: 8211921 - DNA, 21 bp, Homo sapiens
ttttctccagctgtgatttta

SEQ ID NO: 8211922 - DNA, 23 bp, Homo sapiens
ttttcctgtggagacatgactgg

SEQ ID NO: 8211923 - DNA, 22 bp, Homo sapiens
ttttcctgtccaggcaattatt

SEQ ID NO: 8211924 - DNA, 20 bp, Homo sapiens
ttttcctgtggtttgatatg

SEQ ID NO: 8211925 - DNA, 22 bp, Homo sapiens
ttttcctggggcttctggactc

SEQ ID NO: 8211926 - DNA, 22 bp, Homo sapiens
ttttcctggggcttctggactc

SEQ ID NO: 8211927 - DNA, 22 bp, Homo sapiens
ttttcctgggctttctgtgtaa

SEQ ID NO: 8211928 - DNA, 22 bp, Homo sapiens
ttttcctggagatggagttgtt

SEQ ID NO: 8211929 - DNA, 22 bp, Homo sapiens
ttttcctctgtatttgaaatgc

SEQ ID NO: 8211930 - DNA, 22 bp, Homo sapiens
ttttcctctgtatttgaaatgc

SEQ ID NO: 8211931 - DNA, 22 bp, Homo sapiens
ttttcctctgttattagtgtga

SEQ ID NO: 8211932 - DNA, 19 bp, Homo sapiens
ttttcctgcctcattgttt

SEQ ID NO: 8211933 - DNA, 22 bp, Homo sapiens
ttttcctgcctgtctctagagg

SEQ ID NO: 8211934 - DNA, 22 bp, Homo sapiens
ttttcctgcctgtctctagagg

SEQ ID NO: 8211935 - DNA, 19 bp, Homo sapiens
ttttcctgcctcattgttt

SEQ ID NO: 8211936 - DNA, 22 bp, Homo sapiens
ttttcctgcctttgctcaggga

SEQ ID NO: 8211937 - DNA, 22 bp, Homo sapiens
ctctggagtcctgtatcactcc

SEQ ID NO: 8211938 - DNA, 22 bp, Homo sapiens
ctctggagtgcagcctggtggc

SEQ ID NO: 8211939 - DNA, 22 bp, Homo sapiens
ctctggagtgcagcctggtggc

SEQ ID NO: 8211940 - DNA, 22 bp, Homo sapiens
ctctggagtgcagcctggtggc

SEQ ID NO: 8211941 - DNA, 22 bp, Homo sapiens
ttttcagttccatctctgctct

SEQ ID NO: 8211942 - DNA, 22 bp, Homo sapiens
ttttcagttccatctctgctct

SEQ ID NO: 8211943 - DNA, 22 bp, Homo sapiens
ttttcctctgtatttgaaatgc

SEQ ID NO: 8211944 - DNA, 22 bp, Homo sapiens
ttttcagttgtgctctctagtt

SEQ ID NO: 8211945 - DNA, 22 bp, Homo sapiens
ttttcagttgtgctctctagtt

SEQ ID NO: 8211946 - DNA, 22 bp, Homo sapiens
ttttcagtttgcactgcagtgc

SEQ ID NO: 8211947 - DNA, 19 bp, Homo sapiens
tttttaatgggctggagca

SEQ ID NO: 8211948 - DNA, 19 bp, Homo sapiens
tttttaatgggctggagca

SEQ ID NO: 8211949 - DNA, 19 bp, Homo sapiens
tttttacaagtaggtgtga

SEQ ID NO: 8211950 - DNA, 22 bp, Homo sapiens
tttttctagctcaaagattcta

SEQ ID NO: 8211951 - DNA, 22 bp, Homo sapiens
tttttctagctcaaagattcta

SEQ ID NO: 8211952 - DNA, 22 bp, Homo sapiens
tttttctgagaatatgagagga

SEQ ID NO: 8211953 - DNA, 22 bp, Homo sapiens
tttttctgagcggtaatcatca

SEQ ID NO: 8211954 - DNA, 22 bp, Homo sapiens
tttttctcttctgtaaagtggt

SEQ ID NO: 8211955 - DNA, 22 bp, Homo sapiens
tttttctcttctgtaaagtggt

SEQ ID NO: 8211956 - DNA, 22 bp, Homo sapiens
tttttctgccattcaaagagga

SEQ ID NO: 8211957 - DNA, 22 bp, Homo sapiens
tttttctgccattcaaagagga

SEQ ID NO: 8211958 - DNA, 18 bp, Homo sapiens
tttttctgataaaacaag

SEQ ID NO: 8211959 - DNA, 18 bp, Homo sapiens
tttttctgataaaacaag

SEQ ID NO: 8211960 - DNA, 22 bp, Homo sapiens
tttttctgagcggtaatcatca

SEQ ID NO: 8211961 - DNA, 17 bp, Homo sapiens
ttttctcctgcccattc

SEQ ID NO: 8211962 - DNA, 22 bp, Homo sapiens
ttttctcctaagacccttcacc

SEQ ID NO: 8211963 - DNA, 22 bp, Homo sapiens
ttttctcctaagacccttcacc

SEQ ID NO: 8211964 - DNA, 22 bp, Homo sapiens
ttttctcctttcaagatagcat

SEQ ID NO: 8211965 - DNA, 22 bp, Homo sapiens
ttttctcctttcaagatagcat

SEQ ID NO: 8211966 - DNA, 17 bp, Homo sapiens
ttttctcctgcccattc

SEQ ID NO: 8211967 - DNA, 22 bp, Homo sapiens
ttttctccagggaacaaggtga

SEQ ID NO: 8211968 - DNA, 22 bp, Homo sapiens
ttttctccagggaacaaggtga

SEQ ID NO: 8211969 - DNA, 22 bp, Homo sapiens
ttttctccccagagaccatcat

SEQ ID NO: 8211970 - DNA, 22 bp, Homo sapiens
ttttctcccgctggctgctctt

SEQ ID NO: 8211971 - DNA, 22 bp, Homo sapiens
ttttctcccgctggctgctctt

SEQ ID NO: 8211972 - DNA, 22 bp, Homo sapiens
ttttctctacaaaataaccagc

SEQ ID NO: 8211973 - DNA, 22 bp, Homo sapiens
ttttctcctttctaggtcacat

SEQ ID NO: 8211974 - DNA, 22 bp, Homo sapiens
ttttctcctttcaagatagcat

SEQ ID NO: 8211975 - DNA, 22 bp, Homo sapiens
ttttctctatattgtctgtgaa

SEQ ID NO: 8211976 - DNA, 22 bp, Homo sapiens
ttttctctatattgtctgtgaa

SEQ ID NO: 8211977 - DNA, 20 bp, Homo sapiens
ctgaaagacgtaacagtgca

SEQ ID NO: 8211978 - DNA, 22 bp, Homo sapiens
ctgaagatgtctgagatgctca

SEQ ID NO: 8211979 - DNA, 22 bp, Homo sapiens
ctgaaagcaaagtaattcttaa

SEQ ID NO: 8211980 - DNA, 22 bp, Homo sapiens
ctgaagatttttggtaatcatg

SEQ ID NO: 8211981 - DNA, 22 bp, Homo sapiens
ctgaaggatgtgtggtgggagt

SEQ ID NO: 8211982 - DNA, 22 bp, Homo sapiens
ctgaaggacttggtgatagttg

SEQ ID NO: 8211983 - DNA, 22 bp, Homo sapiens
ctgaaggagaaggccactgttc

SEQ ID NO: 8211984 - DNA, 22 bp, Homo sapiens
ctgaaggagaaggccactgttc

SEQ ID NO: 8211985 - DNA, 22 bp, Homo sapiens
ctgaaggaggtagagtgacata

SEQ ID NO: 8211986 - DNA, 22 bp, Homo sapiens
ctgaaggagcatagtcagtttt

SEQ ID NO: 8211987 - DNA, 22 bp, Homo sapiens
ctgaagtcagatggcacaaggt

SEQ ID NO: 8211988 - DNA, 22 bp, Homo sapiens
ctgaagttattgtacaaatttg

SEQ ID NO: 8211989 - DNA, 22 bp, Homo sapiens
ctgaagttcatacaatggccat

SEQ ID NO: 8211990 - DNA, 22 bp, Homo sapiens
ctgaagttattgtacaaatttg

SEQ ID NO: 8211991 - DNA, 22 bp, Homo sapiens
ctgaagttattcagtgggctga

SEQ ID NO: 8211992 - DNA, 22 bp, Homo sapiens
ctgaagttagttatgcctaaaa

SEQ ID NO: 8211993 - DNA, 22 bp, Homo sapiens
ctgaagttaatcagaggtacaa

SEQ ID NO: 8211994 - DNA, 19 bp, Homo sapiens
ctgaagtcttttcagctgg

SEQ ID NO: 8211995 - DNA, 22 bp, Homo sapiens
ctgaagtgccaaatcataatca

SEQ ID NO: 8211996 - DNA, 22 bp, Homo sapiens
ctgaagtggacaaatggagtgg

SEQ ID NO: 8211997 - DNA, 22 bp, Homo sapiens
ctgaagttaaagtagtttttat

SEQ ID NO: 8211998 - DNA, 22 bp, Homo sapiens
ctgaagtggacaaatggagtgg

SEQ ID NO: 8211999 - DNA, 22 bp, Homo sapiens
ctgaagttaacatcttgatgtc

SEQ ID NO: 8212000 - DNA, 22 bp, Homo sapiens
ctgaagttaatcagaggtacaa

SEQ ID NO: 8212001 - DNA, 22 bp, Homo sapiens
tttttcttaaatgtgggttggc

SEQ ID NO: 8212002 - DNA, 22 bp, Homo sapiens
tttttctgtctcttacattgca

SEQ ID NO: 8212003 - DNA, 22 bp, Homo sapiens
tttttcttaaatgtgggttggc

SEQ ID NO: 8212004 - DNA, 22 bp, Homo sapiens
tttttctgtctcttacattgca

SEQ ID NO: 8212005 - DNA, 20 bp, Homo sapiens
tttttctgggcttccatagc

SEQ ID NO: 8212006 - DNA, 22 bp, Homo sapiens
tttttctggataactgtatctc

SEQ ID NO: 8212007 - DNA, 20 bp, Homo sapiens
tttttctgggcttccatagc

SEQ ID NO: 8212008 - DNA, 22 bp, Homo sapiens
tttttctgtaaagggccagaga

SEQ ID NO: 8212009 - DNA, 22 bp, Homo sapiens
tttttcttgtgctggatctaat

SEQ ID NO: 8212010 - DNA, 22 bp, Homo sapiens
tttttcttaaatgtgggttggc

SEQ ID NO: 8212011 - DNA, 22 bp, Homo sapiens
tttttcttaaatgtgggttggc

SEQ ID NO: 8212012 - DNA, 22 bp, Homo sapiens
tttttcttaaatgtgggttggc

SEQ ID NO: 8212013 - DNA, 22 bp, Homo sapiens
ctgaaacattgcaataacaaag

SEQ ID NO: 8212014 - DNA, 22 bp, Homo sapiens
ctgaaacattgcaataacaaag

SEQ ID NO: 8212015 - DNA, 22 bp, Homo sapiens
ctgaaactccatgagaaattgc

SEQ ID NO: 8212016 - DNA, 20 bp, Homo sapiens
ctgaaagacgtaacagtgca

SEQ ID NO: 8212017 - DNA, 22 bp, Homo sapiens
ctgaaaaatatgttttggagaa

SEQ ID NO: 8212018 - DNA, 22 bp, Homo sapiens
ctgaaaaacgggatttggctgg

SEQ ID NO: 8212019 - DNA, 22 bp, Homo sapiens
ctgaaaaacgggatttggctgg

SEQ ID NO: 8212020 - DNA, 22 bp, Homo sapiens
ctgaaaaatatgttttggagaa

SEQ ID NO: 8212021 - DNA, 22 bp, Homo sapiens
ctgaaaatgttacacaggaaga

SEQ ID NO: 8212022 - DNA, 22 bp, Homo sapiens
ctgaaaatgttacacaggaaga

SEQ ID NO: 8212023 - DNA, 22 bp, Homo sapiens
ctgaaaatgttacacaggaaga

SEQ ID NO: 8212024 - DNA, 22 bp, Homo sapiens
ctgaagtttttcaatttatgtt

SEQ ID NO: 8212025 - DNA, 22 bp, Homo sapiens
ctgaataatattccattatgag

SEQ ID NO: 8212026 - DNA, 22 bp, Homo sapiens
ctgaataatgttctcttgtatg

SEQ ID NO: 8212027 - DNA, 22 bp, Homo sapiens
ctgaagttcatacaatggccat

SEQ ID NO: 8212028 - DNA, 22 bp, Homo sapiens
ctgaagttcgccagactcgggc

SEQ ID NO: 8212029 - DNA, 22 bp, Homo sapiens
ctgaagttctacaagcctcagg

SEQ ID NO: 8212030 - DNA, 22 bp, Homo sapiens
ctgaagttctacaagcctcagg

SEQ ID NO: 8212031 - DNA, 22 bp, Homo sapiens
ctgaagttttgacatctcattt

SEQ ID NO: 8212032 - DNA, 22 bp, Homo sapiens
ctgaagtttatgcttttcgggt

SEQ ID NO: 8212033 - DNA, 22 bp, Homo sapiens
ctgaagtttcgagatggatgtg

SEQ ID NO: 8212034 - DNA, 22 bp, Homo sapiens
ctgaatatcatttacatttgga

SEQ ID NO: 8212035 - DNA, 22 bp, Homo sapiens
ctgagagatcaagccacaggat

SEQ ID NO: 8212036 - DNA, 22 bp, Homo sapiens
ctgaataattttatagttgctg

SEQ ID NO: 8212037 - DNA, 22 bp, Homo sapiens
ctgagagatgatatagcttaat

SEQ ID NO: 8212038 - DNA, 22 bp, Homo sapiens
ctgagagatgatatagcttaat

SEQ ID NO: 8212039 - DNA, 22 bp, Homo sapiens
ctgagagatcaagccacaggat

SEQ ID NO: 8212040 - DNA, 19 bp, Homo sapiens
ctgagagatgcttcacaca

SEQ ID NO: 8212041 - DNA, 22 bp, Homo sapiens
ctgagaggtaagcagcgcagtg

SEQ ID NO: 8212042 - DNA, 22 bp, Homo sapiens
ctgagaggtaagcagcgcagtg

SEQ ID NO: 8212043 - DNA, 22 bp, Homo sapiens
ctgagaggtaagcagcgcagtg

SEQ ID NO: 8212044 - DNA, 22 bp, Homo sapiens
ctgagaggtaagcagcgcagtg

SEQ ID NO: 8212045 - DNA, 22 bp, Homo sapiens
ctgagagtattggcaggcttgg

SEQ ID NO: 8212046 - DNA, 22 bp, Homo sapiens
ctgagagtcagtggagtggtgt

SEQ ID NO: 8212047 - DNA, 22 bp, Homo sapiens
ctgagaggtgctggtggctgca

SEQ ID NO: 8212048 - DNA, 22 bp, Homo sapiens
ctgagaggtgctggtggctgca

SEQ ID NO: 8212049 - DNA, 22 bp, Homo sapiens
ctgagaggtgctggtggctgca

SEQ ID NO: 8212050 - DNA, 22 bp, Homo sapiens
ctgagaggtgacagcgtgctgg

SEQ ID NO: 8212051 - DNA, 22 bp, Homo sapiens
ctgagctgggagcctggcacca

SEQ ID NO: 8212052 - DNA, 22 bp, Homo sapiens
ctgagctgggagcctggcacca

SEQ ID NO: 8212053 - DNA, 22 bp, Homo sapiens
ctgagctgggagtagagactct

SEQ ID NO: 8212054 - DNA, 22 bp, Homo sapiens
ctgagctgggagtagagactct

SEQ ID NO: 8212055 - DNA, 22 bp, Homo sapiens
ctgagctgggagtggatagtgg

SEQ ID NO: 8212056 - DNA, 22 bp, Homo sapiens
ctgagctgggagtagagactct

SEQ ID NO: 8212057 - DNA, 22 bp, Homo sapiens
ctgagctgggagtagagactct

SEQ ID NO: 8212058 - DNA, 22 bp, Homo sapiens
ctgagctgggagtagagactct

SEQ ID NO: 8212059 - DNA, 22 bp, Homo sapiens
ctgagctgggcaactcttagat

SEQ ID NO: 8212060 - DNA, 22 bp, Homo sapiens
ctgagccttattcaccagccct

SEQ ID NO: 8212061 - DNA, 22 bp, Homo sapiens
ctgagccttattcaccagccct

SEQ ID NO: 8212062 - DNA, 22 bp, Homo sapiens
ctgagcgcgggacctgaggctg

SEQ ID NO: 8212063 - DNA, 20 bp, Homo sapiens
ctgagcgtctaagaggtgag

SEQ ID NO: 8212064 - DNA, 22 bp, Homo sapiens
ctgagcaatttcagctctcact

SEQ ID NO: 8212065 - DNA, 22 bp, Homo sapiens
ctgagcaccccaggacctgcgc

SEQ ID NO: 8212066 - DNA, 22 bp, Homo sapiens
ctgagcacctgctgtgtgccag

SEQ ID NO: 8212067 - DNA, 22 bp, Homo sapiens
ctgagatggagtttcgctcttc

SEQ ID NO: 8212068 - DNA, 22 bp, Homo sapiens
ctgagatctttatacgaggcac

SEQ ID NO: 8212069 - DNA, 22 bp, Homo sapiens
ctgagatctttatacgaggcac

SEQ ID NO: 8212070 - DNA, 22 bp, Homo sapiens
ctgagatctttatacgaggcac

SEQ ID NO: 8212071 - DNA, 22 bp, Homo sapiens
ctgagatcccaggcagggtggc

SEQ ID NO: 8212072 - DNA, 22 bp, Homo sapiens
ctgagatggagtttcgctcttc

SEQ ID NO: 8212073 - DNA, 22 bp, Homo sapiens
ctgagatggagttttgctcttg

SEQ ID NO: 8212074 - DNA, 22 bp, Homo sapiens
ctgagatggagtttcgctcttc

SEQ ID NO: 8212075 - DNA, 22 bp, Homo sapiens
ctgagatggagttttgctcttg

SEQ ID NO: 8212076 - DNA, 22 bp, Homo sapiens
ctgagatggagttttgctcttg

SEQ ID NO: 8212077 - DNA, 22 bp, Homo sapiens
ctgagatggccactgggtctca

SEQ ID NO: 8212078 - DNA, 22 bp, Homo sapiens
ctgagatggccactgggtctca

SEQ ID NO: 8212079 - DNA, 22 bp, Homo sapiens
ctgagatggtagatggatgtta

SEQ ID NO: 8212080 - DNA, 22 bp, Homo sapiens
ctgagagtgtggcttccaggcc

SEQ ID NO: 8212081 - DNA, 22 bp, Homo sapiens
ctgagagttaagagatggggct

SEQ ID NO: 8212082 - DNA, 22 bp, Homo sapiens
ctgagatactgtggcgaatgca

SEQ ID NO: 8212083 - DNA, 22 bp, Homo sapiens
ctgagagtctgcatttctaaca

SEQ ID NO: 8212084 - DNA, 20 bp, Homo sapiens
ctgagagtctgtgcttagtc

SEQ ID NO: 8212085 - DNA, 20 bp, Homo sapiens
ctgagagtctgtgcttagtc

SEQ ID NO: 8212086 - DNA, 22 bp, Homo sapiens
ctgagagtgctctttgatgtca

SEQ ID NO: 8212087 - DNA, 22 bp, Homo sapiens
ctgaggaaagctgcagcggtac

SEQ ID NO: 8212088 - DNA, 22 bp, Homo sapiens
ctgaggaaagtattgcctggtg

SEQ ID NO: 8212089 - DNA, 22 bp, Homo sapiens
ctgaggaatgagtgaggagcca

SEQ ID NO: 8212090 - DNA, 22 bp, Homo sapiens
ctgaggacattgatgaggcaat

SEQ ID NO: 8212091 - DNA, 22 bp, Homo sapiens
ctgaggaatgagtgaggagcca

SEQ ID NO: 8212092 - DNA, 22 bp, Homo sapiens
ctgaggaaggctgggggcatcc

SEQ ID NO: 8212093 - DNA, 22 bp, Homo sapiens
ctgaggaaggagttaggcagtt

SEQ ID NO: 8212094 - DNA, 22 bp, Homo sapiens
ctgagcttccagttcctccagg

SEQ ID NO: 8212095 - DNA, 22 bp, Homo sapiens
ctgagcttcagtgcactgggag

SEQ ID NO: 8212096 - DNA, 22 bp, Homo sapiens
ctgagcttcagtgcactgggag

SEQ ID NO: 8212097 - DNA, 22 bp, Homo sapiens
ctgagcttccagttcctccagg

SEQ ID NO: 8212098 - DNA, 22 bp, Homo sapiens
ctgagcttggccaggaatgaat

SEQ ID NO: 8212099 - DNA, 22 bp, Homo sapiens
ctgagcttggccaggaatgaat

SEQ ID NO: 8212100 - DNA, 22 bp, Homo sapiens
ctgagcttggcttatctccagc

SEQ ID NO: 8212101 - DNA, 22 bp, Homo sapiens
ctgagctgttactctgtcctcg

SEQ ID NO: 8212102 - DNA, 22 bp, Homo sapiens
ctgagctgtttaatcccagata

SEQ ID NO: 8212103 - DNA, 22 bp, Homo sapiens
ctgagctgttactctgtcctcg

SEQ ID NO: 8212104 - DNA, 22 bp, Homo sapiens
ctgagctgtttaatcccagata

SEQ ID NO: 8212105 - DNA, 22 bp, Homo sapiens
ctgagctgtttaatcccagata

SEQ ID NO: 8212106 - DNA, 22 bp, Homo sapiens
ctgagcttaaccctgttagcaa

SEQ ID NO: 8212107 - DNA, 21 bp, Homo sapiens
ctgagcttattgaaaggaaga

SEQ ID NO: 8212108 - DNA, 22 bp, Homo sapiens
ctgagctggtgtttcagggtca

SEQ ID NO: 8212109 - DNA, 22 bp, Homo sapiens
ctgagctggtggaagcatgcag

SEQ ID NO: 8212110 - DNA, 22 bp, Homo sapiens
ctgagctggtctatggacttgg

SEQ ID NO: 8212111 - DNA, 22 bp, Homo sapiens
ctgagctggtggaagcatgcag

SEQ ID NO: 8212112 - DNA, 22 bp, Homo sapiens
ctgagctggtggaagcatgcag

SEQ ID NO: 8212113 - DNA, 22 bp, Homo sapiens
ctgagctggtggaagcatgcag

SEQ ID NO: 8212114 - DNA, 22 bp, Homo sapiens
ctgagctgggctctcttgaggg

SEQ ID NO: 8212115 - DNA, 21 bp, Homo sapiens
ctgagctggggtgaaggttgc

SEQ ID NO: 8212116 - DNA, 22 bp, Homo sapiens
ctgagctggtctatggacttgg

SEQ ID NO: 8212117 - DNA, 21 bp, Homo sapiens
ctgagctggggtgaaggttgc

SEQ ID NO: 8212118 - DNA, 22 bp, Homo sapiens
ctgagctggtctatggacttgg

SEQ ID NO: 8212119 - DNA, 22 bp, Homo sapiens
ctgagctggtctatggacttgg

SEQ ID NO: 8212120 - DNA, 22 bp, Homo sapiens
ctgagctgggctctcttgaggg

SEQ ID NO: 8212121 - DNA, 22 bp, Homo sapiens
ctgagctgtcaggaatggaaag

SEQ ID NO: 8212122 - DNA, 22 bp, Homo sapiens
ctgagctgtgctaagtgaaatg

SEQ ID NO: 8212123 - DNA, 22 bp, Homo sapiens
ctgagctgttactctgtcctcg

SEQ ID NO: 8212124 - DNA, 22 bp, Homo sapiens
ctgagctgtgtggtcctgggca

SEQ ID NO: 8212125 - DNA, 22 bp, Homo sapiens
ctgagctgtggccaccaattta

SEQ ID NO: 8212126 - DNA, 18 bp, Homo sapiens
ctgagggcagcccctggg

SEQ ID NO: 8212127 - DNA, 22 bp, Homo sapiens
ctgagggcaccgacagagtgga

SEQ ID NO: 8212128 - DNA, 22 bp, Homo sapiens
ctgagggcaccgacagagtgga

SEQ ID NO: 8212129 - DNA, 22 bp, Homo sapiens
ctgagggcagtgatgaaggtga

SEQ ID NO: 8212130 - DNA, 22 bp, Homo sapiens
ctgagggcagtgatgaaggtga

SEQ ID NO: 8212131 - DNA, 22 bp, Homo sapiens
ctgagggcagtgatgaaggtga

SEQ ID NO: 8212132 - DNA, 22 bp, Homo sapiens
ctgagggcagtgatgaaggtga

SEQ ID NO: 8212133 - DNA, 22 bp, Homo sapiens
ctgagggcagtgatgaaggtga

SEQ ID NO: 8212134 - DNA, 22 bp, Homo sapiens
ctgagggccctgaagcttggca

SEQ ID NO: 8212135 - DNA, 22 bp, Homo sapiens
ctgagggccctgaagcttggca

SEQ ID NO: 8212136 - DNA, 22 bp, Homo sapiens
ctgagggagttcctgagcccac

SEQ ID NO: 8212137 - DNA, 22 bp, Homo sapiens
ctgagggatgggctgggccgcc

SEQ ID NO: 8212138 - DNA, 22 bp, Homo sapiens
ctgagggatgtggattttggtc

SEQ ID NO: 8212139 - DNA, 18 bp, Homo sapiens
ctgagggcaacagaggct

SEQ ID NO: 8212140 - DNA, 18 bp, Homo sapiens
ctgagggcaacagaggct

SEQ ID NO: 8212141 - DNA, 22 bp, Homo sapiens
ctgagggcaccgacagagtgga

SEQ ID NO: 8212142 - DNA, 22 bp, Homo sapiens
ctgagggcaccgacagagtgga

SEQ ID NO: 8212143 - DNA, 22 bp, Homo sapiens
ctgagggagacagtgcggacta

SEQ ID NO: 8212144 - DNA, 22 bp, Homo sapiens
ctgagggagaagtgatctctac

SEQ ID NO: 8212145 - DNA, 22 bp, Homo sapiens
ctgagggagaagtgatctctac

SEQ ID NO: 8212146 - DNA, 22 bp, Homo sapiens
ctgagggagaagtcacgggcag

SEQ ID NO: 8212147 - DNA, 22 bp, Homo sapiens
ctgagggagagaatggggcaaa

SEQ ID NO: 8212148 - DNA, 22 bp, Homo sapiens
ctgagggagctgctggccttgg

SEQ ID NO: 8212149 - DNA, 22 bp, Homo sapiens
ctgagggaggagaattgcttga

SEQ ID NO: 8212150 - DNA, 22 bp, Homo sapiens
ctgagggaccctgtgagtacct

SEQ ID NO: 8212151 - DNA, 22 bp, Homo sapiens
ctgagggaccctgtgagtacct

SEQ ID NO: 8212152 - DNA, 22 bp, Homo sapiens
ctgagggaaggcagtcagttgg

SEQ ID NO: 8212153 - DNA, 22 bp, Homo sapiens
ctgaggctgggcatggggtcca

SEQ ID NO: 8212154 - DNA, 18 bp, Homo sapiens
ctgaggctggcaggagcc

SEQ ID NO: 8212155 - DNA, 18 bp, Homo sapiens
ctgaggctggcaggagcc

SEQ ID NO: 8212156 - DNA, 18 bp, Homo sapiens
ctgaggctggcaggagcc

SEQ ID NO: 8212157 - DNA, 18 bp, Homo sapiens
ctgaggctggcaggagcc

SEQ ID NO: 8212158 - DNA, 22 bp, Homo sapiens
ctgaggctgggcatggggtcca

SEQ ID NO: 8212159 - DNA, 22 bp, Homo sapiens
ctgctccaggaacagagctgct

SEQ ID NO: 8212160 - DNA, 22 bp, Homo sapiens
ctgctccacctccgggtcaggc

SEQ ID NO: 8212161 - DNA, 22 bp, Homo sapiens
ctgctccagacacctgcagggg

SEQ ID NO: 8212162 - DNA, 22 bp, Homo sapiens
ctgctccagacacctgcagggg

SEQ ID NO: 8212163 - DNA, 20 bp, Homo sapiens
ctgctccacccggctctcag

SEQ ID NO: 8212164 - DNA, 22 bp, Homo sapiens
ctgctccacctccgggtcaggc

SEQ ID NO: 8212165 - DNA, 22 bp, Homo sapiens
ctgctccacaccgtccatactc

SEQ ID NO: 8212166 - DNA, 22 bp, Homo sapiens
ctgctccacacctccatttcct

SEQ ID NO: 8212167 - DNA, 20 bp, Homo sapiens
ctgctccacccggctctcag

SEQ ID NO: 8212168 - DNA, 22 bp, Homo sapiens
ctgctccacacctccatttcct

SEQ ID NO: 8212169 - DNA, 22 bp, Homo sapiens
ctgcgttctgcctggcggccta

SEQ ID NO: 8212170 - DNA, 22 bp, Homo sapiens
ctgctccacaccgtccatactc

SEQ ID NO: 8212171 - DNA, 22 bp, Homo sapiens
ctgctccccagcctgcgccttt

SEQ ID NO: 8212172 - DNA, 19 bp, Homo sapiens
ctgctccctccttctggca

SEQ ID NO: 8212173 - DNA, 22 bp, Homo sapiens
ctgctcctccccatcaggcagc

SEQ ID NO: 8212174 - DNA, 22 bp, Homo sapiens
ctgctcctccccatcaggcagc

SEQ ID NO: 8212175 - DNA, 22 bp, Homo sapiens
ctgctccaggatttcaggccag

SEQ ID NO: 8212176 - DNA, 22 bp, Homo sapiens
ctgctccagtagccccatgtgg

SEQ ID NO: 8212177 - DNA, 18 bp, Homo sapiens
ctgctccagtctggccag

SEQ ID NO: 8212178 - DNA, 22 bp, Homo sapiens
ctgctccaggatttcaggccag

SEQ ID NO: 8212179 - DNA, 22 bp, Homo sapiens
ctgctccccagcctgcgccttt

SEQ ID NO: 8212180 - DNA, 22 bp, Homo sapiens
ctgctccccagcctgcgccttt

SEQ ID NO: 8212181 - DNA, 22 bp, Homo sapiens
ctgctcctctgaggtagccaca

SEQ ID NO: 8212182 - DNA, 22 bp, Homo sapiens
ctgctcctctgaggtagccaca

SEQ ID NO: 8212183 - DNA, 22 bp, Homo sapiens
ctgctcctccccatcaggcagc

SEQ ID NO: 8212184 - DNA, 22 bp, Homo sapiens
ctgctcctggtcatcctccact

SEQ ID NO: 8212185 - DNA, 22 bp, Homo sapiens
ctgctcctggtcatcctccact

SEQ ID NO: 8212186 - DNA, 22 bp, Homo sapiens
ctgctcctggtcatcctccact

SEQ ID NO: 8212187 - DNA, 22 bp, Homo sapiens
ctgctcctggtcatcctccact

SEQ ID NO: 8212188 - DNA, 22 bp, Homo sapiens
ctgctcctggtcatcctccact

SEQ ID NO: 8212189 - DNA, 22 bp, Homo sapiens
ctgctcctgtccagcagggcca

SEQ ID NO: 8212190 - DNA, 22 bp, Homo sapiens
ctgcctgcctggagacagatgg

SEQ ID NO: 8212191 - DNA, 22 bp, Homo sapiens
ctgcctgccttggcctccagga

SEQ ID NO: 8212192 - DNA, 22 bp, Homo sapiens
ctgcctgccttggcctccagga

SEQ ID NO: 8212193 - DNA, 22 bp, Homo sapiens
ctgcctgccacgttcagctgta

SEQ ID NO: 8212194 - DNA, 22 bp, Homo sapiens
ctgcctgcatgctgccatagct

SEQ ID NO: 8212195 - DNA, 22 bp, Homo sapiens
ctgcctgcatcccacagtgggg

SEQ ID NO: 8212196 - DNA, 22 bp, Homo sapiens
ctgcctgccacgttcagctgta

SEQ ID NO: 8212197 - DNA, 22 bp, Homo sapiens
ctgcctgccacgttcagctgta

SEQ ID NO: 8212198 - DNA, 22 bp, Homo sapiens
ctgcgtgagcgtgcccgtcttg

SEQ ID NO: 8212199 - DNA, 22 bp, Homo sapiens
ctgcgggctgtcaggcgtgcca

SEQ ID NO: 8212200 - DNA, 22 bp, Homo sapiens
ctgcctgccttggcctccagga

SEQ ID NO: 8212201 - DNA, 22 bp, Homo sapiens
ctgcctcttaagtggatggagt

SEQ ID NO: 8212202 - DNA, 22 bp, Homo sapiens
ctgcctcttgacagatcgtggc

SEQ ID NO: 8212203 - DNA, 22 bp, Homo sapiens
ctgcctgaactgggtgagcaag

SEQ ID NO: 8212204 - DNA, 22 bp, Homo sapiens
ctgcctgaactgggtgagcaag

SEQ ID NO: 8212205 - DNA, 22 bp, Homo sapiens
ctgcctcttgacagatcgtggc

SEQ ID NO: 8212206 - DNA, 22 bp, Homo sapiens
ctgcctcttgacagatcgtggc

SEQ ID NO: 8212207 - DNA, 22 bp, Homo sapiens
ctgcctcttaagtggatggagt

SEQ ID NO: 8212208 - DNA, 22 bp, Homo sapiens
ctgcctctgttgggcatggtct

SEQ ID NO: 8212209 - DNA, 22 bp, Homo sapiens
ctgcctctgttgggcatggtct

SEQ ID NO: 8212210 - DNA, 22 bp, Homo sapiens
ctgcctctgttgggcatggtct

SEQ ID NO: 8212211 - DNA, 22 bp, Homo sapiens
ctgcctctgttgggcatggtct

SEQ ID NO: 8212212 - DNA, 22 bp, Homo sapiens
ctgcctgcaggacacctcgcta

SEQ ID NO: 8212213 - DNA, 22 bp, Homo sapiens
ctgcctgcactgcctggctcca

SEQ ID NO: 8212214 - DNA, 22 bp, Homo sapiens
ctgcctgcaggacacctcgcta

SEQ ID NO: 8212215 - DNA, 22 bp, Homo sapiens
ctgcctgagtggaggtcgaggg

SEQ ID NO: 8212216 - DNA, 22 bp, Homo sapiens
ctgcctgcactgcctggctcca

SEQ ID NO: 8212217 - DNA, 22 bp, Homo sapiens
ctgcctgagtggaggtcgaggg

SEQ ID NO: 8212218 - DNA, 22 bp, Homo sapiens
ctgctgcctgattgcagacctc

SEQ ID NO: 8212219 - DNA, 22 bp, Homo sapiens
ctgctgcctgattgcagacctc

SEQ ID NO: 8212220 - DNA, 22 bp, Homo sapiens
ctgctgctgagaatgcctcagg

SEQ ID NO: 8212221 - DNA, 22 bp, Homo sapiens
ctgctgctcttgtgcattagtg

SEQ ID NO: 8212222 - DNA, 22 bp, Homo sapiens
ctgctgctcagtgtcatcatgt

SEQ ID NO: 8212223 - DNA, 22 bp, Homo sapiens
ctgctgctcagtgtcatcatgt

SEQ ID NO: 8212224 - DNA, 22 bp, Homo sapiens
ctgctgctcgaccagtcccagg

SEQ ID NO: 8212225 - DNA, 22 bp, Homo sapiens
ctgctgctcagtgtcatcatgt

SEQ ID NO: 8212226 - DNA, 22 bp, Homo sapiens
ctgctgctgagaatgcctcagg

SEQ ID NO: 8212227 - DNA, 22 bp, Homo sapiens
ctgctgctgagagctcagcctg

SEQ ID NO: 8212228 - DNA, 22 bp, Homo sapiens
ctgctgctgctatctacccagg

SEQ ID NO: 8212229 - DNA, 22 bp, Homo sapiens
ctgctgctgagagctcagcctg

SEQ ID NO: 8212230 - DNA, 22 bp, Homo sapiens
ctgctgcttagcatagcagagg

SEQ ID NO: 8212231 - DNA, 22 bp, Homo sapiens
ctgctgctgtaaggcagaatta

SEQ ID NO: 8212232 - DNA, 22 bp, Homo sapiens
ctgctgcttagcatagcagagg

SEQ ID NO: 8212233 - DNA, 22 bp, Homo sapiens
ctgctggcctcggccatgcctg

SEQ ID NO: 8212234 - DNA, 22 bp, Homo sapiens
ctgctggcctcggccatgcctg

SEQ ID NO: 8212235 - DNA, 22 bp, Homo sapiens
ctgctggcctagcccatcctct

SEQ ID NO: 8212236 - DNA, 17 bp, Homo sapiens
ctgctggctggggcttg

SEQ ID NO: 8212237 - DNA, 22 bp, Homo sapiens
ctgctgggaaggtctgctcagt

SEQ ID NO: 8212238 - DNA, 17 bp, Homo sapiens
ctgctggctggggcttg

SEQ ID NO: 8212239 - DNA, 22 bp, Homo sapiens
ctgctggcttctagtcattcaa

SEQ ID NO: 8212240 - DNA, 22 bp, Homo sapiens
ctgctgtgagtttggaggtcta

SEQ ID NO: 8212241 - DNA, 22 bp, Homo sapiens
ctgctgtgagtttggaggtcta

SEQ ID NO: 8212242 - DNA, 20 bp, Homo sapiens
ctgctgtgattccctcctcc

SEQ ID NO: 8212243 - DNA, 22 bp, Homo sapiens
ctgctgggaaggtctgctcagt

SEQ ID NO: 8212244 - DNA, 22 bp, Homo sapiens
ctgctggaagtttgctgtggat

SEQ ID NO: 8212245 - DNA, 22 bp, Homo sapiens
ctgctggaagtttgctgtggat

SEQ ID NO: 8212246 - DNA, 22 bp, Homo sapiens
ctgctggaatctttaagctgga

SEQ ID NO: 8212247 - DNA, 22 bp, Homo sapiens
ctgctggactacaggaagagtt

SEQ ID NO: 8212248 - DNA, 22 bp, Homo sapiens
ctgctggaggttggagcatgca

SEQ ID NO: 8212249 - DNA, 22 bp, Homo sapiens
ctgctggaggttggagcatgca

SEQ ID NO: 8212250 - DNA, 22 bp, Homo sapiens
ctgctggcaagcccagttggag

SEQ ID NO: 8212251 - DNA, 22 bp, Homo sapiens
ctgctggcaagcccagttggag

SEQ ID NO: 8212252 - DNA, 22 bp, Homo sapiens
ctgctgagccctggcacaggtg

SEQ ID NO: 8212253 - DNA, 22 bp, Homo sapiens
ctgctgagccctggcacaggtg

SEQ ID NO: 8212254 - DNA, 22 bp, Homo sapiens
ctgctgagccctggcacaggtg

SEQ ID NO: 8212255 - DNA, 22 bp, Homo sapiens
ctgctgcccctgagctcagcct

SEQ ID NO: 8212256 - DNA, 22 bp, Homo sapiens
ctgctgcccctgagctcagcct

SEQ ID NO: 8212257 - DNA, 20 bp, Homo sapiens
ctgctgccctgtcagcctct

SEQ ID NO: 8212258 - DNA, 22 bp, Homo sapiens
ctgctgccctagacccagtcct

SEQ ID NO: 8212259 - DNA, 22 bp, Homo sapiens
ctgctgccggcgagcctccctt

SEQ ID NO: 8212260 - DNA, 22 bp, Homo sapiens
ctgctgccggcgagcctccctt

SEQ ID NO: 8212261 - DNA, 19 bp, Homo sapiens
ctgctgccggagactcgtc

SEQ ID NO: 8212262 - DNA, 20 bp, Homo sapiens
ctgctgccctgtcagcctct

SEQ ID NO: 8212263 - DNA, 20 bp, Homo sapiens
ctgctgccctgtcagcctct

SEQ ID NO: 8212264 - DNA, 20 bp, Homo sapiens
ctgctgccctgtcagcctct

SEQ ID NO: 8212265 - DNA, 22 bp, Homo sapiens
ctgctctccccaggccagtctg

SEQ ID NO: 8212266 - DNA, 22 bp, Homo sapiens
ctgctcctgtgggccagtggcc

SEQ ID NO: 8212267 - DNA, 22 bp, Homo sapiens
ctgctcctgtgggccagtggcc

SEQ ID NO: 8212268 - DNA, 19 bp, Homo sapiens
ctgctctccttgacttgga

SEQ ID NO: 8212269 - DNA, 19 bp, Homo sapiens
ctgctctccttgacttgga

SEQ ID NO: 8212270 - DNA, 22 bp, Homo sapiens
ctgctctctgttcccctggatc

SEQ ID NO: 8212271 - DNA, 22 bp, Homo sapiens
ctgctgagcatttgcagggaca

SEQ ID NO: 8212272 - DNA, 22 bp, Homo sapiens
ctgctctgaagccaggattctg

SEQ ID NO: 8212273 - DNA, 22 bp, Homo sapiens
ctgagggctggagctgaggcct

SEQ ID NO: 8212274 - DNA, 23 bp, Homo sapiens
ctgagggctggtctgaagtctgc

SEQ ID NO: 8212275 - DNA, 23 bp, Homo sapiens
ctgagggctggtctgaagtctgc

SEQ ID NO: 8212276 - DNA, 22 bp, Homo sapiens
ctgagggctggagctgaggcct

SEQ ID NO: 8212277 - DNA, 22 bp, Homo sapiens
ctgagggctggagctgaggcct

SEQ ID NO: 8212278 - DNA, 22 bp, Homo sapiens
ctgagggctggagctgaggcct

SEQ ID NO: 8212279 - DNA, 22 bp, Homo sapiens
ctgagggccttggctcctgccc

SEQ ID NO: 8212280 - DNA, 21 bp, Homo sapiens
ctgagggccgcagctgggctc

SEQ ID NO: 8212281 - DNA, 21 bp, Homo sapiens
ctgagggccgcagctgggctc

SEQ ID NO: 8212282 - DNA, 21 bp, Homo sapiens
ctgagggccgcagctgggctc

SEQ ID NO: 8212283 - DNA, 21 bp, Homo sapiens
ctgagggccgcagctgggctc

SEQ ID NO: 8212284 - DNA, 21 bp, Homo sapiens
ctgagggccgcagctgggctc

SEQ ID NO: 8212285 - DNA, 22 bp, Homo sapiens
ctgagggccttctatgctgagc

SEQ ID NO: 8212286 - DNA, 22 bp, Homo sapiens
ctgagggccttctatgctgagc

SEQ ID NO: 8212287 - DNA, 22 bp, Homo sapiens
ctgagggccttctatgctgagc

SEQ ID NO: 8212288 - DNA, 22 bp, Homo sapiens
ctgagggccttggctcctgccc

SEQ ID NO: 8212289 - DNA, 22 bp, Homo sapiens
ctgagggcctgaggacctagat

SEQ ID NO: 8212290 - DNA, 22 bp, Homo sapiens
ctgcagggtttttcaaggacaa

SEQ ID NO: 8212291 - DNA, 22 bp, Homo sapiens
ctgcaggtctctgtgtgcattc

SEQ ID NO: 8212292 - DNA, 21 bp, Homo sapiens
ctgcaggtgctgccatcaggg

SEQ ID NO: 8212293 - DNA, 22 bp, Homo sapiens
ctgcaggttgagcagccaggtt

SEQ ID NO: 8212294 - DNA, 22 bp, Homo sapiens
ctgcaggttgagcagccaggtt

SEQ ID NO: 8212295 - DNA, 22 bp, Homo sapiens
ctgcaggttgagcagccaggtt

SEQ ID NO: 8212296 - DNA, 22 bp, Homo sapiens
ctgcaggttaggagcactcctt

SEQ ID NO: 8212297 - DNA, 22 bp, Homo sapiens
ctgcaggggctggagttggctt

SEQ ID NO: 8212298 - DNA, 22 bp, Homo sapiens
ctgcaggggctggagttggctt

SEQ ID NO: 8212299 - DNA, 21 bp, Homo sapiens
ctgagggctttgaatccagac

SEQ ID NO: 8212300 - DNA, 22 bp, Homo sapiens
ctgagggcttccttgtcccggg

SEQ ID NO: 8212301 - DNA, 22 bp, Homo sapiens
ctgcaggggcctcgagcacagg

SEQ ID NO: 8212302 - DNA, 22 bp, Homo sapiens
ctgcaggggcctcgagcacagg

SEQ ID NO: 8212303 - DNA, 22 bp, Homo sapiens
ctgcaggggcctcgagcacagg

SEQ ID NO: 8212304 - DNA, 22 bp, Homo sapiens
ctgcatatgagaataggagaaa

SEQ ID NO: 8212305 - DNA, 22 bp, Homo sapiens
ctgcccctgctcatggctgtcc

SEQ ID NO: 8212306 - DNA, 22 bp, Homo sapiens
ctgcccctgctcatggctgtcc

SEQ ID NO: 8212307 - DNA, 22 bp, Homo sapiens
ctgcagtgttctggaatgcatt

SEQ ID NO: 8212308 - DNA, 22 bp, Homo sapiens
ctgcagtgttctggaatgcatt

SEQ ID NO: 8212309 - DNA, 22 bp, Homo sapiens
ctgcagtgttctggaatgcatt

SEQ ID NO: 8212310 - DNA, 22 bp, Homo sapiens
ctgcagtgcctgccactgagcc

SEQ ID NO: 8212311 - DNA, 22 bp, Homo sapiens
ctgcagtgcctgccactgagcc

SEQ ID NO: 8212312 - DNA, 22 bp, Homo sapiens
ctgcagtgcaagcccagatgga

SEQ ID NO: 8212313 - DNA, 22 bp, Homo sapiens
ctgcagtgcaagcccagatgga

SEQ ID NO: 8212314 - DNA, 22 bp, Homo sapiens
ctgcagtgaaatcaggaagcaa

SEQ ID NO: 8212315 - DNA, 22 bp, Homo sapiens
ctgcagtcttccttccttaggc

SEQ ID NO: 8212316 - DNA, 22 bp, Homo sapiens
ctgcagtctacctggattttta

SEQ ID NO: 8212317 - DNA, 23 bp, Homo sapiens
ctgcagtcgccggcctgggtgcc

SEQ ID NO: 8212318 - DNA, 23 bp, Homo sapiens
ctgcagtcgccggcctgggtgcc

SEQ ID NO: 8212319 - DNA, 22 bp, Homo sapiens
ctgccctgctaatgagttccaa

SEQ ID NO: 8212320 - DNA, 22 bp, Homo sapiens
ctgccctgctggagatcacagt

SEQ ID NO: 8212321 - DNA, 20 bp, Homo sapiens
ctgccctgccctgggtcctg

SEQ ID NO: 8212322 - DNA, 20 bp, Homo sapiens
ctgccctgccctgggtcctg

SEQ ID NO: 8212323 - DNA, 20 bp, Homo sapiens
ctgccctgccctgggtcctg

SEQ ID NO: 8212324 - DNA, 22 bp, Homo sapiens
ctgccctgcctggccagtgtgg

SEQ ID NO: 8212325 - DNA, 22 bp, Homo sapiens
ctgccctgcccaggccttgggc

SEQ ID NO: 8212326 - DNA, 22 bp, Homo sapiens
ctgccctgcccaggccttgggc

SEQ ID NO: 8212327 - DNA, 22 bp, Homo sapiens
ctgccctgcccaggccttgggc

SEQ ID NO: 8212328 - DNA, 23 bp, Homo sapiens
ctgccctgatcttgatctattgt

SEQ ID NO: 8212329 - DNA, 22 bp, Homo sapiens
ctgccctgcagctccacggact

SEQ ID NO: 8212330 - DNA, 22 bp, Homo sapiens
ctgccctgagtcatgccagatg

SEQ ID NO: 8212331 - DNA, 22 bp, Homo sapiens
ctgccctgagtcatgccagatg

SEQ ID NO: 8212332 - DNA, 22 bp, Homo sapiens
ctgccctgagggcctgtgtgtt

SEQ ID NO: 8212333 - DNA, 18 bp, Homo sapiens
ctgccccttctctgagat

SEQ ID NO: 8212334 - DNA, 22 bp, Homo sapiens
ctgcccctggctggtgaagcag

SEQ ID NO: 8212335 - DNA, 18 bp, Homo sapiens
ctgccccttctctgagat

SEQ ID NO: 8212336 - DNA, 22 bp, Homo sapiens
ctgcccctggtgatggacgcca

SEQ ID NO: 8212337 - DNA, 22 bp, Homo sapiens
ctgccctgcttgtttccagtgg

SEQ ID NO: 8212338 - DNA, 22 bp, Homo sapiens
ctgccctgcttgatgacagcga

SEQ ID NO: 8212339 - DNA, 22 bp, Homo sapiens
ctgccctgcttgatgacagcga

SEQ ID NO: 8212340 - DNA, 22 bp, Homo sapiens
ctgccctgcttgatgacagcga

SEQ ID NO: 8212341 - DNA, 22 bp, Homo sapiens
ctgccctgcttgatgacagcga

SEQ ID NO: 8212342 - DNA, 22 bp, Homo sapiens
ctgccctggaaaacgtatctta

SEQ ID NO: 8212343 - DNA, 22 bp, Homo sapiens
ctgccctggcagcctaccatgg

SEQ ID NO: 8212344 - DNA, 22 bp, Homo sapiens
ctgccctggcagcctaccatgg

SEQ ID NO: 8212345 - DNA, 22 bp, Homo sapiens
ctgccctggccactgtgcccag

SEQ ID NO: 8212346 - DNA, 22 bp, Homo sapiens
ctgccctgggatggtctgtgcg

SEQ ID NO: 8212347 - DNA, 22 bp, Homo sapiens
ctgccctgggatggtctgtgcg

SEQ ID NO: 8212348 - DNA, 22 bp, Homo sapiens
ctgccctgggatggtctgtgcg

SEQ ID NO: 8212349 - DNA, 22 bp, Homo sapiens
ctgccctgggagtacctgtcct

SEQ ID NO: 8212350 - DNA, 22 bp, Homo sapiens
ctgccctgggagtacctgtcct

SEQ ID NO: 8212351 - DNA, 22 bp, Homo sapiens
ctgcctctattcactgaggcag

SEQ ID NO: 8212352 - DNA, 22 bp, Homo sapiens
ctgcctctattcactgaggcag

SEQ ID NO: 8212353 - DNA, 22 bp, Homo sapiens
ctgcctctattcactgaggcag

SEQ ID NO: 8212354 - DNA, 22 bp, Homo sapiens
ctgcctctggcctcaggcccag

SEQ ID NO: 8212355 - DNA, 22 bp, Homo sapiens
ctgcctctggcctcaggcccag

SEQ ID NO: 8212356 - DNA, 22 bp, Homo sapiens
ctgcctctggcctcaggcccag

SEQ ID NO: 8212357 - DNA, 22 bp, Homo sapiens
ctgcctctggcctcaggcccag

SEQ ID NO: 8212358 - DNA, 22 bp, Homo sapiens
ctgcctctattcactgaggcag

SEQ ID NO: 8212359 - DNA, 22 bp, Homo sapiens
ctgcctctggttttggtccctg

SEQ ID NO: 8212360 - DNA, 22 bp, Homo sapiens
ctgcctctggttttggtccctg

SEQ ID NO: 8212361 - DNA, 22 bp, Homo sapiens
ctgcctctggttttggtccctg

SEQ ID NO: 8212362 - DNA, 22 bp, Homo sapiens
gagaaagaaagggaagtttgtt

SEQ ID NO: 8212363 - DNA, 22 bp, Homo sapiens
gagaaactgctctgattctgca

SEQ ID NO: 8212364 - DNA, 22 bp, Homo sapiens
gagaaacttggagttattctgg

SEQ ID NO: 8212365 - DNA, 22 bp, Homo sapiens
gagaaactgttggaattttaat

SEQ ID NO: 8212366 - DNA, 22 bp, Homo sapiens
gagaaactgaaacatagggcca

SEQ ID NO: 8212367 - DNA, 22 bp, Homo sapiens
gagaaactgaatatttaacggg

SEQ ID NO: 8212368 - DNA, 22 bp, Homo sapiens
gagaaactgaaacatagggcca

SEQ ID NO: 8212369 - DNA, 22 bp, Homo sapiens
gagaaactaacatctgaaggtg

SEQ ID NO: 8212370 - DNA, 22 bp, Homo sapiens
gagaaactaacatctgaaggtg

SEQ ID NO: 8212371 - DNA, 22 bp, Homo sapiens
gagaaacctgtaaggaaggaag

SEQ ID NO: 8212372 - DNA, 22 bp, Homo sapiens
gagaaagatggaatcttacagg

SEQ ID NO: 8212373 - DNA, 22 bp, Homo sapiens
gagaaagatgaagagtggcgtt

SEQ ID NO: 8212374 - DNA, 22 bp, Homo sapiens
gagaaagacgtaggctgggagg

SEQ ID NO: 8212375 - DNA, 22 bp, Homo sapiens
gagaaagacgtaggctgggagg

SEQ ID NO: 8212376 - DNA, 22 bp, Homo sapiens
gagaaagacgtaggctgggagg

SEQ ID NO: 8212377 - DNA, 22 bp, Homo sapiens
gagaaagacgtaggctgggagg

SEQ ID NO: 8212378 - DNA, 22 bp, Homo sapiens
gactgcagtaagcctcatgact

SEQ ID NO: 8212379 - DNA, 22 bp, Homo sapiens
gactgcataggaccaaatagta

SEQ ID NO: 8212380 - DNA, 22 bp, Homo sapiens
gactgaggtgcccagaggtgac

SEQ ID NO: 8212381 - DNA, 22 bp, Homo sapiens
gactgaggtgcccagaggtgac

SEQ ID NO: 8212382 - DNA, 22 bp, Homo sapiens
gactgaggtgcccagaggtgac

SEQ ID NO: 8212383 - DNA, 22 bp, Homo sapiens
gactgaggtgcccagaggtgac

SEQ ID NO: 8212384 - DNA, 22 bp, Homo sapiens
gactgaggtgacctaggactac

SEQ ID NO: 8212385 - DNA, 22 bp, Homo sapiens
gactgaggtgacctaggactac

SEQ ID NO: 8212386 - DNA, 22 bp, Homo sapiens
gactgaggtgacctaggactac

SEQ ID NO: 8212387 - DNA, 22 bp, Homo sapiens
gagaaacactgttagtttatta

SEQ ID NO: 8212388 - DNA, 22 bp, Homo sapiens
gagaaacaggaattgagtcgct

SEQ ID NO: 8212389 - DNA, 22 bp, Homo sapiens
gagaaacaggaattgagtcgct

SEQ ID NO: 8212390 - DNA, 22 bp, Homo sapiens
gagaaagatgtaggctgggagg

SEQ ID NO: 8212391 - DNA, 22 bp, Homo sapiens
gagaaagatgtaggctgggagg

SEQ ID NO: 8212392 - DNA, 22 bp, Homo sapiens
gagaaagatgtaggctgggagg

SEQ ID NO: 8212393 - DNA, 22 bp, Homo sapiens
gagaaagatgtaggctgggagg

SEQ ID NO: 8212394 - DNA, 22 bp, Homo sapiens
gagaaagctaataggaatccta

SEQ ID NO: 8212395 - DNA, 22 bp, Homo sapiens
gagaaagcttcagaaatggcct

SEQ ID NO: 8212396 - DNA, 18 bp, Homo sapiens
gagaaagcagggaatgtt

SEQ ID NO: 8212397 - DNA, 22 bp, Homo sapiens
gagacagatgctgctggagcat

SEQ ID NO: 8212398 - DNA, 22 bp, Homo sapiens
gagaaagcttctttcccacagg

SEQ ID NO: 8212399 - DNA, 22 bp, Homo sapiens
gagacagatgctgctggagcat

SEQ ID NO: 8212400 - DNA, 20 bp, Homo sapiens
gagacagcaaaagcctctcc

SEQ ID NO: 8212401 - DNA, 22 bp, Homo sapiens
gagaccaggaagtacagcagcc

SEQ ID NO: 8212402 - DNA, 22 bp, Homo sapiens
gagaccaggaagtacagcagcc

SEQ ID NO: 8212403 - DNA, 23 bp, Homo sapiens
gagaccagggccagctgtgtcat

SEQ ID NO: 8212404 - DNA, 22 bp, Homo sapiens
gagagaacacaaagggccagct

SEQ ID NO: 8212405 - DNA, 18 bp, Homo sapiens
gagagggatccctcagga

SEQ ID NO: 8212406 - DNA, 22 bp, Homo sapiens
gagagaaatgtgcagtttgggc

SEQ ID NO: 8212407 - DNA, 22 bp, Homo sapiens
gagagaaattagttggtttgct

SEQ ID NO: 8212408 - DNA, 22 bp, Homo sapiens
gagagaaaggcttgcaggctgt

SEQ ID NO: 8212409 - DNA, 22 bp, Homo sapiens
gagagggccagggtgagaacta

SEQ ID NO: 8212410 - DNA, 22 bp, Homo sapiens
gagagggccagggtgagaacta

SEQ ID NO: 8212411 - DNA, 21 bp, Homo sapiens
gagagggcattataggaagtg

SEQ ID NO: 8212412 - DNA, 21 bp, Homo sapiens
gagagggcattataggaagtg

SEQ ID NO: 8212413 - DNA, 21 bp, Homo sapiens
gagagggcattataggaagtg

SEQ ID NO: 8212414 - DNA, 22 bp, Homo sapiens
gagagggcaaacttgtagctaa

SEQ ID NO: 8212415 - DNA, 22 bp, Homo sapiens
gagagggctctgtgtgggtact

SEQ ID NO: 8212416 - DNA, 22 bp, Homo sapiens
gagagggccgggggccagctcc

SEQ ID NO: 8212417 - DNA, 22 bp, Homo sapiens
gagagggctgcctggtgtgagg

SEQ ID NO: 8212418 - DNA, 22 bp, Homo sapiens
gagagggccgggggccagctcc

SEQ ID NO: 8212419 - DNA, 22 bp, Homo sapiens
gagactttaaaaaacattaaga

SEQ ID NO: 8212420 - DNA, 22 bp, Homo sapiens
gagactggtgtttgctgggctg

SEQ ID NO: 8212421 - DNA, 22 bp, Homo sapiens
gagactggtgtttgctgggctg

SEQ ID NO: 8212422 - DNA, 22 bp, Homo sapiens
gagactggtgtttgctgggctg

SEQ ID NO: 8212423 - DNA, 22 bp, Homo sapiens
gagagaaaagggggaattgatt

SEQ ID NO: 8212424 - DNA, 22 bp, Homo sapiens
gagagaaagcccctgcatccct

SEQ ID NO: 8212425 - DNA, 22 bp, Homo sapiens
gagagaaaggataacagctcaa

SEQ ID NO: 8212426 - DNA, 22 bp, Homo sapiens
gagagaaaggcttgcaggctgt

SEQ ID NO: 8212427 - DNA, 22 bp, Homo sapiens
gagaccccagctcagcctccag

SEQ ID NO: 8212428 - DNA, 22 bp, Homo sapiens
gagacctgcagctgtagtctgc

SEQ ID NO: 8212429 - DNA, 22 bp, Homo sapiens
gagacctgagtcaccctgtctg

SEQ ID NO: 8212430 - DNA, 22 bp, Homo sapiens
gagacctggaggatgtggatgg

SEQ ID NO: 8212431 - DNA, 22 bp, Homo sapiens
gagacctgcagctgtagtctgc

SEQ ID NO: 8212432 - DNA, 20 bp, Homo sapiens
gagactggatctggagagac

SEQ ID NO: 8212433 - DNA, 20 bp, Homo sapiens
gagactggatctggagagac

SEQ ID NO: 8212434 - DNA, 20 bp, Homo sapiens
gagactggatctggagagac

SEQ ID NO: 8212435 - DNA, 22 bp, Homo sapiens
gagactgatggggctcccagaa

SEQ ID NO: 8212436 - DNA, 22 bp, Homo sapiens
gacatttaaattgcaggcagcc

SEQ ID NO: 8212437 - DNA, 22 bp, Homo sapiens
gacatttaaattgcaggcagcc

SEQ ID NO: 8212438 - DNA, 22 bp, Homo sapiens
gacatttaaattgcaggcagcc

SEQ ID NO: 8212439 - DNA, 22 bp, Homo sapiens
gacattctgtgactctgaacag

SEQ ID NO: 8212440 - DNA, 22 bp, Homo sapiens
gacattgaagtatttttgtcga

SEQ ID NO: 8212441 - DNA, 22 bp, Homo sapiens
gacattctgtcaatgttgactc

SEQ ID NO: 8212442 - DNA, 22 bp, Homo sapiens
gacatttaaggcagtcacttaa

SEQ ID NO: 8212443 - DNA, 22 bp, Homo sapiens
gacatttaaggcagtcacttaa

SEQ ID NO: 8212444 - DNA, 22 bp, Homo sapiens
gacatttaaggcagtcacttaa

SEQ ID NO: 8212445 - DNA, 22 bp, Homo sapiens
gacatttaaggcagtcacttaa

SEQ ID NO: 8212446 - DNA, 22 bp, Homo sapiens
gacatttaatagtattgtggga

SEQ ID NO: 8212447 - DNA, 22 bp, Homo sapiens
gacatttaatagtattgtggga

SEQ ID NO: 8212448 - DNA, 22 bp, Homo sapiens
gacatttaatagtattgtggga

SEQ ID NO: 8212449 - DNA, 22 bp, Homo sapiens
gacatttagaagtctaatggcc

SEQ ID NO: 8212450 - DNA, 22 bp, Homo sapiens
gacatttagaagtctaatggcc

SEQ ID NO: 8212451 - DNA, 22 bp, Homo sapiens
gacatttactgaatactgatta

SEQ ID NO: 8212452 - DNA, 22 bp, Homo sapiens
gacatttactgaatactgatta

SEQ ID NO: 8212453 - DNA, 22 bp, Homo sapiens
gacatttactgaatactgatta

SEQ ID NO: 8212454 - DNA, 22 bp, Homo sapiens
gacagcagatactttcattgaa

SEQ ID NO: 8212455 - DNA, 22 bp, Homo sapiens
gacagcagatgaagcctgcaga

SEQ ID NO: 8212456 - DNA, 22 bp, Homo sapiens
gacagcagatgaagcctgcaga

SEQ ID NO: 8212457 - DNA, 22 bp, Homo sapiens
gacagcagcataatacatgaac

SEQ ID NO: 8212458 - DNA, 22 bp, Homo sapiens
gacagcagatgaagcctgcaga

SEQ ID NO: 8212459 - DNA, 22 bp, Homo sapiens
gacattcacaggtaaacattcc

SEQ ID NO: 8212460 - DNA, 22 bp, Homo sapiens
gacagcagcatgtttacaggcc

SEQ ID NO: 8212461 - DNA, 22 bp, Homo sapiens
gacattcaactttgatgattat

SEQ ID NO: 8212462 - DNA, 22 bp, Homo sapiens
gacattctaaaaaatatggaag

SEQ ID NO: 8212463 - DNA, 22 bp, Homo sapiens
gacagagccagttggaggtagg

SEQ ID NO: 8212464 - DNA, 22 bp, Homo sapiens
gacagagccagttggaggtagg

SEQ ID NO: 8212465 - DNA, 22 bp, Homo sapiens
gacagaggagaagatgctgtgg

SEQ ID NO: 8212466 - DNA, 22 bp, Homo sapiens
gacagagattgaatcaggaaat

SEQ ID NO: 8212467 - DNA, 22 bp, Homo sapiens
gacagagattgaatcaggaaat

SEQ ID NO: 8212468 - DNA, 22 bp, Homo sapiens
gacagagaggctgagcagtaca

SEQ ID NO: 8212469 - DNA, 22 bp, Homo sapiens
gacagagaggctgagcagtaca

SEQ ID NO: 8212470 - DNA, 22 bp, Homo sapiens
gacagacatttcctgatccaat

SEQ ID NO: 8212471 - DNA, 22 bp, Homo sapiens
gacagacatttcctgatccaat

SEQ ID NO: 8212472 - DNA, 22 bp, Homo sapiens
gacagacatgggacttcatact

SEQ ID NO: 8212473 - DNA, 22 bp, Homo sapiens
gacagacatgggacttcatact

SEQ ID NO: 8212474 - DNA, 22 bp, Homo sapiens
gacagcaagagacagagcatcc

SEQ ID NO: 8212475 - DNA, 22 bp, Homo sapiens
gacagaggcaagaccagaagcc

SEQ ID NO: 8212476 - DNA, 22 bp, Homo sapiens
gacagaggcaagaccagaagcc

SEQ ID NO: 8212477 - DNA, 22 bp, Homo sapiens
gacagcagacagcctggcccct

SEQ ID NO: 8212478 - DNA, 22 bp, Homo sapiens
gacagcagacagcctggcccct

SEQ ID NO: 8212479 - DNA, 22 bp, Homo sapiens
gacagcagagcagactaatgga

SEQ ID NO: 8212480 - DNA, 22 bp, Homo sapiens
gacagcagacagaactacctgc

SEQ ID NO: 8212481 - DNA, 22 bp, Homo sapiens
gacagcagaatccattcccagt

SEQ ID NO: 8212482 - DNA, 22 bp, Homo sapiens
gacagcagacagaactacctgc

SEQ ID NO: 8212483 - DNA, 22 bp, Homo sapiens
gactccagggattggaagatgt

SEQ ID NO: 8212484 - DNA, 22 bp, Homo sapiens
gactccagcatatacttttagt

SEQ ID NO: 8212485 - DNA, 22 bp, Homo sapiens
gaccaggctagttcagagcttc

SEQ ID NO: 8212486 - DNA, 22 bp, Homo sapiens
gaccaggctagttcagagcttc

SEQ ID NO: 8212487 - DNA, 22 bp, Homo sapiens
gaccaggaaagagtgtgactaa

SEQ ID NO: 8212488 - DNA, 22 bp, Homo sapiens
gaccaggaaagagtgtgactaa

SEQ ID NO: 8212489 - DNA, 22 bp, Homo sapiens
gaccagctggtcctgtcctggg

SEQ ID NO: 8212490 - DNA, 22 bp, Homo sapiens
gaccagctctctgaagaaagag

SEQ ID NO: 8212491 - DNA, 22 bp, Homo sapiens
gaccagagaaaggcactggaag

SEQ ID NO: 8212492 - DNA, 22 bp, Homo sapiens
gaccagagaaaggcactggaag

SEQ ID NO: 8212493 - DNA, 22 bp, Homo sapiens
gaccagaaatcaacacagaatg

SEQ ID NO: 8212494 - DNA, 22 bp, Homo sapiens
gaccacagcagtgcaagaggag

SEQ ID NO: 8212495 - DNA, 22 bp, Homo sapiens
gacatttaggtagcttccagtt

SEQ ID NO: 8212496 - DNA, 22 bp, Homo sapiens
gacatttaggtagcttccagtt

SEQ ID NO: 8212497 - DNA, 22 bp, Homo sapiens
gacatttaggtagcttccagtt

SEQ ID NO: 8212498 - DNA, 22 bp, Homo sapiens
gacatttagctgttttgcattt

SEQ ID NO: 8212499 - DNA, 22 bp, Homo sapiens
gacatttagctgttttgcattt

SEQ ID NO: 8212500 - DNA, 22 bp, Homo sapiens
gacatttagctgttttgcattt

SEQ ID NO: 8212501 - DNA, 22 bp, Homo sapiens
gacatttagaagttagattcaa

SEQ ID NO: 8212502 - DNA, 22 bp, Homo sapiens
gacatttagaagttagattcaa

SEQ ID NO: 8212503 - DNA, 22 bp, Homo sapiens
gacatttagaagttagattcaa

SEQ ID NO: 8212504 - DNA, 22 bp, Homo sapiens
gacatttagaagttagattcaa

SEQ ID NO: 8212505 - DNA, 22 bp, Homo sapiens
gactgaggtattaagatggctt

SEQ ID NO: 8212506 - DNA, 22 bp, Homo sapiens
gactgaggtgacctaggactac

SEQ ID NO: 8212507 - DNA, 17 bp, Homo sapiens
gactgaggtaaggtgag

SEQ ID NO: 8212508 - DNA, 17 bp, Homo sapiens
gactgaggtaaggtgag

SEQ ID NO: 8212509 - DNA, 22 bp, Homo sapiens
gactgaggtattaagatggctt

SEQ ID NO: 8212510 - DNA, 22 bp, Homo sapiens
gactgaggtaagtgaaataagc

SEQ ID NO: 8212511 - DNA, 22 bp, Homo sapiens
gactgaggtaagtgaaataagc

SEQ ID NO: 8212512 - DNA, 17 bp, Homo sapiens
gactgaggtaaggtgag

SEQ ID NO: 8212513 - DNA, 17 bp, Homo sapiens
gactgaggtaaggtgag

SEQ ID NO: 8212514 - DNA, 22 bp, Homo sapiens
gactgagggatagaggtgcttc

SEQ ID NO: 8212515 - DNA, 22 bp, Homo sapiens
gactgaggctcccctaggctca

SEQ ID NO: 8212516 - DNA, 22 bp, Homo sapiens
gactgagggacagggcagtgga

SEQ ID NO: 8212517 - DNA, 22 bp, Homo sapiens
gactgagggacagggcagtgga

SEQ ID NO: 8212518 - DNA, 22 bp, Homo sapiens
gactgagggacagggcagtgga

SEQ ID NO: 8212519 - DNA, 22 bp, Homo sapiens
gactgaggctcccctaggctca

SEQ ID NO: 8212520 - DNA, 22 bp, Homo sapiens
gactgagggatagaggtgcttc

SEQ ID NO: 8212521 - DNA, 22 bp, Homo sapiens
gactgagggatagaggtgcttc

SEQ ID NO: 8212522 - DNA, 22 bp, Homo sapiens
gactgagggatagaggtgcttc

SEQ ID NO: 8212523 - DNA, 22 bp, Homo sapiens
gactgagggatagaggtgcttc

SEQ ID NO: 8212524 - DNA, 22 bp, Homo sapiens
gactctttccctgtgacagagt

SEQ ID NO: 8212525 - DNA, 22 bp, Homo sapiens
gactctttcaaacagaaagcca

SEQ ID NO: 8212526 - DNA, 22 bp, Homo sapiens
gactctttcaaacagaaagcca

SEQ ID NO: 8212527 - DNA, 22 bp, Homo sapiens
gactgaggaggtaaggtttgaa

SEQ ID NO: 8212528 - DNA, 22 bp, Homo sapiens
gactgagaatcatagaaggcaa

SEQ ID NO: 8212529 - DNA, 22 bp, Homo sapiens
gactgaggctcccctaggctca

SEQ ID NO: 8212530 - DNA, 16 bp, Homo sapiens
gactgaggctcagaga

SEQ ID NO: 8212531 - DNA, 22 bp, Homo sapiens
gactgaggcctttattgagaca

SEQ ID NO: 8212532 - DNA, 22 bp, Homo sapiens
gactgaggcctttattgagaca

SEQ ID NO: 8212533 - DNA, 22 bp, Homo sapiens
gactgaggaggtaaggtttgaa

SEQ ID NO: 8212534 - DNA, 22 bp, Homo sapiens
gactgaggaggtaaggtttgaa

SEQ ID NO: 8212535 - DNA, 22 bp, Homo sapiens
gactgaggaggtaaggtttgaa

SEQ ID NO: 8212536 - DNA, 22 bp, Homo sapiens
gactgaggcctttattgagaca

SEQ ID NO: 8212537 - DNA, 22 bp, Homo sapiens
gactctgggctgagccagggcc

SEQ ID NO: 8212538 - DNA, 22 bp, Homo sapiens
gactctgggctgagccagggcc

SEQ ID NO: 8212539 - DNA, 22 bp, Homo sapiens
gactctggtgacttgacctgta

SEQ ID NO: 8212540 - DNA, 21 bp, Homo sapiens
gactctggggtcagctcaacc

SEQ ID NO: 8212541 - DNA, 22 bp, Homo sapiens
gactctggtgacttgacctgta

SEQ ID NO: 8212542 - DNA, 22 bp, Homo sapiens
gactctggtgtcagaagtgccc

SEQ ID NO: 8212543 - DNA, 22 bp, Homo sapiens
gactctggtgtcagaagtgccc

SEQ ID NO: 8212544 - DNA, 22 bp, Homo sapiens
gactctggttgcgggttctgct

SEQ ID NO: 8212545 - DNA, 22 bp, Homo sapiens
gactctggttgcgggttctgct

SEQ ID NO: 8212546 - DNA, 22 bp, Homo sapiens
gactctggtgtcagaagtgccc

SEQ ID NO: 8212547 - DNA, 22 bp, Homo sapiens
gactctgggaggtggactgagg

SEQ ID NO: 8212548 - DNA, 22 bp, Homo sapiens
gactctggcctcatccctgagg

SEQ ID NO: 8212549 - DNA, 22 bp, Homo sapiens
gactctggcagcactagggggc

SEQ ID NO: 8212550 - DNA, 22 bp, Homo sapiens
gactctggatgatggctttttt

SEQ ID NO: 8212551 - DNA, 22 bp, Homo sapiens
gactctgggctgagccagggcc

SEQ ID NO: 8212552 - DNA, 22 bp, Homo sapiens
gactctgggcctttggtgactc

SEQ ID NO: 8212553 - DNA, 22 bp, Homo sapiens
gactctgggcctttggtgactc

SEQ ID NO: 8212554 - DNA, 22 bp, Homo sapiens
gactctgggagtttatgtgatt

SEQ ID NO: 8212555 - DNA, 22 bp, Homo sapiens
gactctgggaggtggactgagg

SEQ ID NO: 8212556 - DNA, 22 bp, Homo sapiens
gactcctcccgctcccatgccg

SEQ ID NO: 8212557 - DNA, 22 bp, Homo sapiens
gactcctgggcctctgagaggc

SEQ ID NO: 8212558 - DNA, 22 bp, Homo sapiens
gactctagattcatggtggagt

SEQ ID NO: 8212559 - DNA, 21 bp, Homo sapiens
gactctctagtgctgtccagt

SEQ ID NO: 8212560 - DNA, 22 bp, Homo sapiens
gactctggaccatatatttggc

SEQ ID NO: 8212561 - DNA, 22 bp, Homo sapiens
gactctggaactcttggtaaga

SEQ ID NO: 8212562 - DNA, 22 bp, Homo sapiens
gacactgtcccacagaattcga

SEQ ID NO: 8212563 - DNA, 22 bp, Homo sapiens
gacactgtgctagctgggctta

SEQ ID NO: 8212564 - DNA, 22 bp, Homo sapiens
gacactgtgctagctgggctta

SEQ ID NO: 8212565 - DNA, 22 bp, Homo sapiens
gacactttaggccaccatgcaa

SEQ ID NO: 8212566 - DNA, 22 bp, Homo sapiens
gacactttaggatttaaaagtc

SEQ ID NO: 8212567 - DNA, 22 bp, Homo sapiens
gacactgttatggtgaggtaag

SEQ ID NO: 8212568 - DNA, 22 bp, Homo sapiens
gacactgttatggtgaggtaag

SEQ ID NO: 8212569 - DNA, 19 bp, Homo sapiens
gacacagttggttcctttg

SEQ ID NO: 8212570 - DNA, 22 bp, Homo sapiens
gacacagttctgttctagtagg

SEQ ID NO: 8212571 - DNA, 22 bp, Homo sapiens
gacacagttctgttctagtagg

SEQ ID NO: 8212572 - DNA, 22 bp, Homo sapiens
gacacagttacttattttgcct

SEQ ID NO: 8212573 - DNA, 22 bp, Homo sapiens
gacacagtcaagagtggaggaa

SEQ ID NO: 8212574 - DNA, 22 bp, Homo sapiens
gacacagtaatgtgtttcatct

SEQ ID NO: 8212575 - DNA, 22 bp, Homo sapiens
gaatgatttggttgtttagatt

SEQ ID NO: 8212576 - DNA, 22 bp, Homo sapiens
gaatgaatctgtaagtgacaag

SEQ ID NO: 8212577 - DNA, 22 bp, Homo sapiens
gaatgaagcaggtcacacagtt

SEQ ID NO: 8212578 - DNA, 22 bp, Homo sapiens
gaatgaataggtgtccagatgg

SEQ ID NO: 8212579 - DNA, 22 bp, Homo sapiens
gaatgaaagatttgcattctat

SEQ ID NO: 8212580 - DNA, 22 bp, Homo sapiens
gaatgaaagatttgcattctat

SEQ ID NO: 8212581 - DNA, 22 bp, Homo sapiens
gaatgaaaaccttggctcaaat

SEQ ID NO: 8212582 - DNA, 22 bp, Homo sapiens
gaatgagactatgcgagtgtga

SEQ ID NO: 8212583 - DNA, 22 bp, Homo sapiens
gaatgaattttggatggtgaag

SEQ ID NO: 8212584 - DNA, 22 bp, Homo sapiens
gaatgaattcagcacatggaat

SEQ ID NO: 8212585 - DNA, 22 bp, Homo sapiens
gacagaaggcatctagggcacg

SEQ ID NO: 8212586 - DNA, 22 bp, Homo sapiens
gacagaagaggaacttggacag

SEQ ID NO: 8212587 - DNA, 22 bp, Homo sapiens
gacagaagaggaacttggacag

SEQ ID NO: 8212588 - DNA, 22 bp, Homo sapiens
gacagaaggcatctagggcacg

SEQ ID NO: 8212589 - DNA, 22 bp, Homo sapiens
gacagaaggcatctagggcacg

SEQ ID NO: 8212590 - DNA, 22 bp, Homo sapiens
gacactttggtgctttgtggtt

SEQ ID NO: 8212591 - DNA, 22 bp, Homo sapiens
gacagaactcaaacatgagaag

SEQ ID NO: 8212592 - DNA, 22 bp, Homo sapiens
gacactttctcaggtaaagcat

SEQ ID NO: 8212593 - DNA, 22 bp, Homo sapiens
gacactttattaagctgttgtt

SEQ ID NO: 8212594 - DNA, 22 bp, Homo sapiens
gacagacacaattgatccatga

SEQ ID NO: 8212595 - DNA, 22 bp, Homo sapiens
gacagacaaatgtttttaactt

SEQ ID NO: 8212596 - DNA, 22 bp, Homo sapiens
gacagacacaattgatccatga

SEQ ID NO: 8212597 - DNA, 22 bp, Homo sapiens
gacagacacagggccatgattg

SEQ ID NO: 8212598 - DNA, 22 bp, Homo sapiens
gacagacacctggggggttgct

SEQ ID NO: 8212599 - DNA, 22 bp, Homo sapiens
gacagacacagggccatgattg

SEQ ID NO: 8212600 - DNA, 22 bp, Homo sapiens
gacagacactattggtatgcct

SEQ ID NO: 8212601 - DNA, 22 bp, Homo sapiens
gacagacaggaggcattcaggg

SEQ ID NO: 8212602 - DNA, 22 bp, Homo sapiens
gacagacaggaggcattcaggg

SEQ ID NO: 8212603 - DNA, 22 bp, Homo sapiens
gacagacaggagctcacaggca

SEQ ID NO: 8212604 - DNA, 22 bp, Homo sapiens
gacagacaggagctcacaggca

SEQ ID NO: 8212605 - DNA, 22 bp, Homo sapiens
gacagacagagaatgggcttga

SEQ ID NO: 8212606 - DNA, 22 bp, Homo sapiens
gacagacactgtgtcctcactt

SEQ ID NO: 8212607 - DNA, 22 bp, Homo sapiens
gacagacaggaggcattcaggg

SEQ ID NO: 8212608 - DNA, 22 bp, Homo sapiens
gacagacaggaggccacctgct

SEQ ID NO: 8212609 - DNA, 22 bp, Homo sapiens
gacagacaggaggccacctgct

SEQ ID NO: 8212610 - DNA, 22 bp, Homo sapiens
gacagacaggggttctcctgga

SEQ ID NO: 8212611 - DNA, 22 bp, Homo sapiens
gacagacaggtgtggtaggcac

SEQ ID NO: 8212612 - DNA, 22 bp, Homo sapiens
gacagacatgggacttcatact

SEQ ID NO: 8212613 - DNA, 22 bp, Homo sapiens
gacagacaggtgtggtaggcac

SEQ ID NO: 8212614 - DNA, 22 bp, Homo sapiens
gacagacaggggttctcctgga

SEQ ID NO: 8212615 - DNA, 22 bp, Homo sapiens
gaatcattcattgctcaattaa

SEQ ID NO: 8212616 - DNA, 22 bp, Homo sapiens
gaatcattggaaccacatccaa

SEQ ID NO: 8212617 - DNA, 22 bp, Homo sapiens
gaatcattcattgctcaattaa

SEQ ID NO: 8212618 - DNA, 22 bp, Homo sapiens
gaatcatttcttctgaaaggta

SEQ ID NO: 8212619 - DNA, 22 bp, Homo sapiens
gaatcatttatttttgacagca

SEQ ID NO: 8212620 - DNA, 22 bp, Homo sapiens
gaatcatttagctctgcatgga

SEQ ID NO: 8212621 - DNA, 22 bp, Homo sapiens
gaaggtttactgaagatttaaa

SEQ ID NO: 8212622 - DNA, 22 bp, Homo sapiens
gaaggttatgggggttggatta

SEQ ID NO: 8212623 - DNA, 22 bp, Homo sapiens
gaaggtttgaaataggtataga

SEQ ID NO: 8212624 - DNA, 17 bp, Homo sapiens
gaaggtttctcttaggt

SEQ ID NO: 8212625 - DNA, 22 bp, Homo sapiens
gaaggtttgaaataggtataga

SEQ ID NO: 8212626 - DNA, 17 bp, Homo sapiens
gaaggtttctcttaggt

SEQ ID NO: 8212627 - DNA, 22 bp, Homo sapiens
gaaggtttactgaagatttaaa

SEQ ID NO: 8212628 - DNA, 22 bp, Homo sapiens
gaaggttatgggggttggatta

SEQ ID NO: 8212629 - DNA, 22 bp, Homo sapiens
gaaggtttgatccttatttata

SEQ ID NO: 8212630 - DNA, 22 bp, Homo sapiens
gaaggtttgatccttatttata

SEQ ID NO: 8212631 - DNA, 22 bp, Homo sapiens
gaatatttgtaattactgttga

SEQ ID NO: 8212632 - DNA, 22 bp, Homo sapiens
gaatatttgtaattactgttga

SEQ ID NO: 8212633 - DNA, 22 bp, Homo sapiens
gaatctcaggaagatctctgca

SEQ ID NO: 8212634 - DNA, 22 bp, Homo sapiens
gaatctcaaattaagaatttta

SEQ ID NO: 8212635 - DNA, 22 bp, Homo sapiens
gaatctatgcctcatatagacc

SEQ ID NO: 8212636 - DNA, 22 bp, Homo sapiens
gaatctgcattttaacaagatc

SEQ ID NO: 8212637 - DNA, 22 bp, Homo sapiens
gaagggctttctgggagaagag

SEQ ID NO: 8212638 - DNA, 22 bp, Homo sapiens
gaagggctttctgggagaagag

SEQ ID NO: 8212639 - DNA, 22 bp, Homo sapiens
gaagggctttctgggagaagag

SEQ ID NO: 8212640 - DNA, 22 bp, Homo sapiens
gaagggcttggctgggaggcca

SEQ ID NO: 8212641 - DNA, 18 bp, Homo sapiens
gaagggagctggaatgca

SEQ ID NO: 8212642 - DNA, 22 bp, Homo sapiens
gaagggctgcaggtctgggccc

SEQ ID NO: 8212643 - DNA, 22 bp, Homo sapiens
gaagggctcatcaggtggccgc

SEQ ID NO: 8212644 - DNA, 20 bp, Homo sapiens
gaagggatcactgcatactt

SEQ ID NO: 8212645 - DNA, 22 bp, Homo sapiens
gaaggggaaagttgagcaaata

SEQ ID NO: 8212646 - DNA, 22 bp, Homo sapiens
gaaggggagtggctagtgtgtg

SEQ ID NO: 8212647 - DNA, 22 bp, Homo sapiens
gaaggggactggcagctgcaga

SEQ ID NO: 8212648 - DNA, 22 bp, Homo sapiens
gaaggggactggcagctgcaga

SEQ ID NO: 8212649 - DNA, 22 bp, Homo sapiens
gaaggtagctgctgagatgaca

SEQ ID NO: 8212650 - DNA, 22 bp, Homo sapiens
gaaggtccagcgtggccaagtc

SEQ ID NO: 8212651 - DNA, 22 bp, Homo sapiens
gaagggtgtgtgtgagggacac

SEQ ID NO: 8212652 - DNA, 22 bp, Homo sapiens
gaaggtgcaggcaaggttggtt

SEQ ID NO: 8212653 - DNA, 22 bp, Homo sapiens
gaaggtggcgagcggattgctg

SEQ ID NO: 8212654 - DNA, 22 bp, Homo sapiens
gaaggtgtccacttctcacctc

SEQ ID NO: 8212655 - DNA, 22 bp, Homo sapiens
gaaggtgtccatcaccaactgt

SEQ ID NO: 8212656 - DNA, 22 bp, Homo sapiens
gaagggtgcatggagggaagtc

SEQ ID NO: 8212657 - DNA, 22 bp, Homo sapiens
gaagggtgtgtgtgagggacac

SEQ ID NO: 8212658 - DNA, 22 bp, Homo sapiens
gaagggtgtgatttgcctgaga

SEQ ID NO: 8212659 - DNA, 22 bp, Homo sapiens
gaagggtgtgatttgcctgaga

SEQ ID NO: 8212660 - DNA, 16 bp, Homo sapiens
gaaggagattcagaaa

SEQ ID NO: 8212661 - DNA, 22 bp, Homo sapiens
gaaggagctaaagggagccctg

SEQ ID NO: 8212662 - DNA, 20 bp, Homo sapiens
gaagccagaggggaaaggag

SEQ ID NO: 8212663 - DNA, 22 bp, Homo sapiens
gaagccactatagatattctaa

SEQ ID NO: 8212664 - DNA, 22 bp, Homo sapiens
gaagccactatagatattctaa

SEQ ID NO: 8212665 - DNA, 22 bp, Homo sapiens
gaagccactatagatattctaa

SEQ ID NO: 8212666 - DNA, 22 bp, Homo sapiens
gaagccacgttaaattggctgt

SEQ ID NO: 8212667 - DNA, 22 bp, Homo sapiens
gaagccaccctccttccagccc

SEQ ID NO: 8212668 - DNA, 20 bp, Homo sapiens
gaagccaccctcagattcca

SEQ ID NO: 8212669 - DNA, 20 bp, Homo sapiens
gaagccaccctcagattcca

SEQ ID NO: 8212670 - DNA, 22 bp, Homo sapiens
gaagccaccctccttccagccc

SEQ ID NO: 8212671 - DNA, 22 bp, Homo sapiens
gaagccaccctccttccagccc

SEQ ID NO: 8212672 - DNA, 22 bp, Homo sapiens
gaagccacagggaaggagaaca

SEQ ID NO: 8212673 - DNA, 22 bp, Homo sapiens
gaagccacagggaaggagaaca

SEQ ID NO: 8212674 - DNA, 22 bp, Homo sapiens
gaagccacagagattgtggggg

SEQ ID NO: 8212675 - DNA, 22 bp, Homo sapiens
gaagccacaactttttcttagc

SEQ ID NO: 8212676 - DNA, 23 bp, Homo sapiens
gaagccacacaaaggtcgccaag

SEQ ID NO: 8212677 - DNA, 22 bp, Homo sapiens
gaaggcactgaactccttctgg

SEQ ID NO: 8212678 - DNA, 22 bp, Homo sapiens
gaaggcacccggcgtgcggcgg

SEQ ID NO: 8212679 - DNA, 22 bp, Homo sapiens
gaaggcacagatggcagtccac

SEQ ID NO: 8212680 - DNA, 22 bp, Homo sapiens
gaaggcaagtgagccaagagaa

SEQ ID NO: 8212681 - DNA, 22 bp, Homo sapiens
gaaggcaaggagggaagccacc

SEQ ID NO: 8212682 - DNA, 22 bp, Homo sapiens
gaaggagctaccaagactgaat

SEQ ID NO: 8212683 - DNA, 22 bp, Homo sapiens
gaaggcagggaatgtggtgcta

SEQ ID NO: 8212684 - DNA, 22 bp, Homo sapiens
gaaggcagggaatgtggtgcta

SEQ ID NO: 8212685 - DNA, 22 bp, Homo sapiens
gaaggcaggcttctgattaggt

SEQ ID NO: 8212686 - DNA, 22 bp, Homo sapiens
gaagggagaaggttgggtgacg

SEQ ID NO: 8212687 - DNA, 22 bp, Homo sapiens
gaagggagaaggttgggtgacg

SEQ ID NO: 8212688 - DNA, 22 bp, Homo sapiens
gaagggaatttggagggtttca

SEQ ID NO: 8212689 - DNA, 22 bp, Homo sapiens
gaagggagaaggttgggtgacg

SEQ ID NO: 8212690 - DNA, 22 bp, Homo sapiens
gaagggaatttggagggtttca

SEQ ID NO: 8212691 - DNA, 22 bp, Homo sapiens
gaaggcccagcttgaatgctgc

SEQ ID NO: 8212692 - DNA, 22 bp, Homo sapiens
gaaggccatttttaggtagaat

SEQ ID NO: 8212693 - DNA, 22 bp, Homo sapiens
gaaggccatttttaggtagaat

SEQ ID NO: 8212694 - DNA, 22 bp, Homo sapiens
gaaggccatttttaggtagaat

SEQ ID NO: 8212695 - DNA, 22 bp, Homo sapiens
gaaggccatttttaggtagaat

SEQ ID NO: 8212696 - DNA, 22 bp, Homo sapiens
gaaggccattagagcctgtgcc

SEQ ID NO: 8212697 - DNA, 22 bp, Homo sapiens
gaaggccattagagcctgtgcc

SEQ ID NO: 8212698 - DNA, 22 bp, Homo sapiens
gaaggccagttttgagataggt

SEQ ID NO: 8212699 - DNA, 22 bp, Homo sapiens
gaaggccattgcgtcctgggat

SEQ ID NO: 8212700 - DNA, 22 bp, Homo sapiens
gaaggccattagagcctgtgcc

SEQ ID NO: 8212701 - DNA, 22 bp, Homo sapiens
gaaggccattagagcctgtgcc

SEQ ID NO: 8212702 - DNA, 22 bp, Homo sapiens
gaaggccattgcgtcctgggat

SEQ ID NO: 8212703 - DNA, 22 bp, Homo sapiens
gaaggccattgcgtcctgggat

SEQ ID NO: 8212704 - DNA, 22 bp, Homo sapiens
gaaggccattgcgtcctgggat

SEQ ID NO: 8212705 - DNA, 22 bp, Homo sapiens
gaaggcaggtttttcaaaactg

SEQ ID NO: 8212706 - DNA, 22 bp, Homo sapiens
gaaggcagtaaatggctgtttt

SEQ ID NO: 8212707 - DNA, 22 bp, Homo sapiens
gaaggcagtaaatggctgtttt

SEQ ID NO: 8212708 - DNA, 22 bp, Homo sapiens
gaaggcagtaaatggctgtttt

SEQ ID NO: 8212709 - DNA, 22 bp, Homo sapiens
gaaggcatcagcaggcaccgat

SEQ ID NO: 8212710 - DNA, 22 bp, Homo sapiens
gaaggcatcacagaggctgtgg

SEQ ID NO: 8212711 - DNA, 22 bp, Homo sapiens
gaaggcatcacagaggctgtga

SEQ ID NO: 8212712 - DNA, 18 bp, Homo sapiens
gaaggcattcagtggctt

SEQ ID NO: 8212713 - DNA, 22 bp, Homo sapiens
gaaggccaagaggctccaagat

SEQ ID NO: 8212714 - DNA, 22 bp, Homo sapiens
gaaggccaagaggctccaagat

SEQ ID NO: 8212715 - DNA, 22 bp, Homo sapiens
gaaggccacaaaaaatgtcata

SEQ ID NO: 8212716 - DNA, 22 bp, Homo sapiens
gaaggccacaaaaaatgtcata

SEQ ID NO: 8212717 - DNA, 22 bp, Homo sapiens
gaaggccagttttgagataggt

SEQ ID NO: 8212718 - DNA, 22 bp, Homo sapiens
gaaggccagttttgagataggt

SEQ ID NO: 8212719 - DNA, 22 bp, Homo sapiens
gaaggccactttgtgttgagaa

SEQ ID NO: 8212720 - DNA, 22 bp, Homo sapiens
gaaggccactttgtgttgagaa

SEQ ID NO: 8212721 - DNA, 22 bp, Homo sapiens
gaaggccacggaatggagctgg

SEQ ID NO: 8212722 - DNA, 22 bp, Homo sapiens
gaaggccacggaatggagctgg

SEQ ID NO: 8212723 - DNA, 22 bp, Homo sapiens
gaaggccacggaatggagctgg

SEQ ID NO: 8212724 - DNA, 22 bp, Homo sapiens
gaaggccacaagagaagttaag

SEQ ID NO: 8212725 - DNA, 22 bp, Homo sapiens
gaaggccacaagagaagttaag

SEQ ID NO: 8212726 - DNA, 20 bp, Homo sapiens
gaagcagcttcatgtagaca

SEQ ID NO: 8212727 - DNA, 22 bp, Homo sapiens
gaagcagctggtgagatggagc

SEQ ID NO: 8212728 - DNA, 22 bp, Homo sapiens
gaagcagctttctggtgaggag

SEQ ID NO: 8212729 - DNA, 22 bp, Homo sapiens
gaagcagctttctggtgaggag

SEQ ID NO: 8212730 - DNA, 22 bp, Homo sapiens
gaagcagtgtgaacccatgtaa

SEQ ID NO: 8212731 - DNA, 22 bp, Homo sapiens
gaagcagctttctggtgaggag

SEQ ID NO: 8212732 - DNA, 22 bp, Homo sapiens
gaagcagtatcctgacagcacc

SEQ ID NO: 8212733 - DNA, 22 bp, Homo sapiens
gaagccaagtcctcgagtttca

SEQ ID NO: 8212734 - DNA, 22 bp, Homo sapiens
gaagcatcagcaatggctggaa

SEQ ID NO: 8212735 - DNA, 22 bp, Homo sapiens
gaagcagttcgaaagcagttgg

SEQ ID NO: 8212736 - DNA, 22 bp, Homo sapiens
gaagcatgctaaggattctcag

SEQ ID NO: 8212737 - DNA, 22 bp, Homo sapiens
gaagcagcagctggggacagtt

SEQ ID NO: 8212738 - DNA, 22 bp, Homo sapiens
gaagcagcgaagtggaagggac

SEQ ID NO: 8212739 - DNA, 22 bp, Homo sapiens
gaagcagcgaagtggaagggac

SEQ ID NO: 8212740 - DNA, 22 bp, Homo sapiens
gaagcagctcagattgactgaa

SEQ ID NO: 8212741 - DNA, 22 bp, Homo sapiens
gaagcagctggtgagatggagc

SEQ ID NO: 8212742 - DNA, 22 bp, Homo sapiens
gaagcagctaggatcttcattt

SEQ ID NO: 8212743 - DNA, 22 bp, Homo sapiens
gaagcagctaggatcttcattt

SEQ ID NO: 8212744 - DNA, 22 bp, Homo sapiens
gaagcagctagcccactagtca

SEQ ID NO: 8212745 - DNA, 22 bp, Homo sapiens
gaagcaaaatgtctgcacatat

SEQ ID NO: 8212746 - DNA, 20 bp, Homo sapiens
gaaaggagtgtccctgtgag

SEQ ID NO: 8212747 - DNA, 22 bp, Homo sapiens
gaagcaatctggctcccagcca

SEQ ID NO: 8212748 - DNA, 22 bp, Homo sapiens
gaaaggagtcagtcttactgaa

SEQ ID NO: 8212749 - DNA, 20 bp, Homo sapiens
gaaaggagtgtccctgtgag

SEQ ID NO: 8212750 - DNA, 22 bp, Homo sapiens
gaaaggagtgaatatttgtgac

SEQ ID NO: 8212751 - DNA, 22 bp, Homo sapiens
gaaaggagggaaacagagcggt

SEQ ID NO: 8212752 - DNA, 22 bp, Homo sapiens
gaaaggagagggttaaggagct

SEQ ID NO: 8212753 - DNA, 18 bp, Homo sapiens
gaaaggagagacagtagg

SEQ ID NO: 8212754 - DNA, 17 bp, Homo sapiens
gaaaggaggcaacactg

SEQ ID NO: 8212755 - DNA, 18 bp, Homo sapiens
gaaaggagagacagtagg

SEQ ID NO: 8212756 - DNA, 18 bp, Homo sapiens
gaaaggagagacagtagg

SEQ ID NO: 8212757 - DNA, 22 bp, Homo sapiens
gaaaggaaatattctaagcact

SEQ ID NO: 8212758 - DNA, 22 bp, Homo sapiens
gaaagctgtgaaatagtgctct

SEQ ID NO: 8212759 - DNA, 22 bp, Homo sapiens
gaaagctgaaccaggaaccatg

SEQ ID NO: 8212760 - DNA, 22 bp, Homo sapiens
gagctgcctgtgtgccatgatg

SEQ ID NO: 8212761 - DNA, 22 bp, Homo sapiens
gagctgcctgttgcatagcaac

SEQ ID NO: 8212762 - DNA, 19 bp, Homo sapiens
gagctgccttttgaagacc

SEQ ID NO: 8212763 - DNA, 22 bp, Homo sapiens
gagctgctggatatgtggcctg

SEQ ID NO: 8212764 - DNA, 22 bp, Homo sapiens
gagctgctggctcctcaggtta

SEQ ID NO: 8212765 - DNA, 22 bp, Homo sapiens
gagctgctggaagtggagccct

SEQ ID NO: 8212766 - DNA, 22 bp, Homo sapiens
gagctgctggttgctggtgcct

SEQ ID NO: 8212767 - DNA, 22 bp, Homo sapiens
gagctgcttctgtgtgccgggt

SEQ ID NO: 8212768 - DNA, 22 bp, Homo sapiens
gagctgcttccagagttgagtg

SEQ ID NO: 8212769 - DNA, 22 bp, Homo sapiens
gagctgctgtgaggggagcttc

SEQ ID NO: 8212770 - DNA, 22 bp, Homo sapiens
gagctgctgtgaggggagcttc

SEQ ID NO: 8212771 - DNA, 22 bp, Homo sapiens
gaggaaagctggtttaaagtat

SEQ ID NO: 8212772 - DNA, 22 bp, Homo sapiens
gaggaaagctggtttaaagtat

SEQ ID NO: 8212773 - DNA, 22 bp, Homo sapiens
gaggaaagagtcaaatctgaag

SEQ ID NO: 8212774 - DNA, 23 bp, Homo sapiens
gaggaaagaatatagatgcaatc

SEQ ID NO: 8212775 - DNA, 23 bp, Homo sapiens
gaggaaagaatatagatgcaatc

SEQ ID NO: 8212776 - DNA, 22 bp, Homo sapiens
gaggaaagagtcaaatctgaag

SEQ ID NO: 8212777 - DNA, 18 bp, Homo sapiens
gaggaaacaaggcagagg

SEQ ID NO: 8212778 - DNA, 22 bp, Homo sapiens
gaggaaacattgtagaagcagt

SEQ ID NO: 8212779 - DNA, 18 bp, Homo sapiens
gaggaaacaggctctgtg

SEQ ID NO: 8212780 - DNA, 18 bp, Homo sapiens
gaggaaacaggctctgtg

SEQ ID NO: 8212781 - DNA, 22 bp, Homo sapiens
gaggaaagaaccccagtcaata

SEQ ID NO: 8212782 - DNA, 23 bp, Homo sapiens
gaggaaagaatatagatgcaatc

SEQ ID NO: 8212783 - DNA, 22 bp, Homo sapiens
gaggaaagaaccccagtcaata

SEQ ID NO: 8212784 - DNA, 22 bp, Homo sapiens
gaggaaagaaccccagtcaata

SEQ ID NO: 8212785 - DNA, 22 bp, Homo sapiens
gaggaaagaaccccagtcaata

SEQ ID NO: 8212786 - DNA, 22 bp, Homo sapiens
gaggaagaatcagggtggtgag

SEQ ID NO: 8212787 - DNA, 22 bp, Homo sapiens
gaggagagagggactgtctgca

SEQ ID NO: 8212788 - DNA, 22 bp, Homo sapiens
gaggagagagggactgtctgca

SEQ ID NO: 8212789 - DNA, 22 bp, Homo sapiens
gaggagagagggactgtctgca

SEQ ID NO: 8212790 - DNA, 22 bp, Homo sapiens
gaggagagagggactgtctgca

SEQ ID NO: 8212791 - DNA, 22 bp, Homo sapiens
gaggaagaaagcataggtgggg

SEQ ID NO: 8212792 - DNA, 22 bp, Homo sapiens
gaggaagaagcaaaccagctaa

SEQ ID NO: 8212793 - DNA, 22 bp, Homo sapiens
gaggaagaagggattagaactc

SEQ ID NO: 8212794 - DNA, 22 bp, Homo sapiens
gaggaacatgaggtgacctggg

SEQ ID NO: 8212795 - DNA, 22 bp, Homo sapiens
gaggaacagcagccacatgtcc

SEQ ID NO: 8212796 - DNA, 22 bp, Homo sapiens
gaggaacagagacgggatcgct

SEQ ID NO: 8212797 - DNA, 22 bp, Homo sapiens
gaggaacagagacgggatcgct

SEQ ID NO: 8212798 - DNA, 22 bp, Homo sapiens
gaggaacctgggcttccatcct

SEQ ID NO: 8212799 - DNA, 19 bp, Homo sapiens
gaggaactggcttggttcc

SEQ ID NO: 8212800 - DNA, 22 bp, Homo sapiens
gaggaacttatgatattctact

SEQ ID NO: 8212801 - DNA, 22 bp, Homo sapiens
gaggaagaaagcataggtgggg

SEQ ID NO: 8212802 - DNA, 22 bp, Homo sapiens
gaggaagaaagcataggtgggg

SEQ ID NO: 8212803 - DNA, 22 bp, Homo sapiens
gagctgaggtgatgtggtcgtt

SEQ ID NO: 8212804 - DNA, 22 bp, Homo sapiens
gagctgaggtgatgtggtcgtt

SEQ ID NO: 8212805 - DNA, 22 bp, Homo sapiens
gagctgagtagaggctgctccc

SEQ ID NO: 8212806 - DNA, 22 bp, Homo sapiens
gagctgagggtctaggagggtt

SEQ ID NO: 8212807 - DNA, 22 bp, Homo sapiens
gagctgagggtctaggagggtt

SEQ ID NO: 8212808 - DNA, 22 bp, Homo sapiens
gagctgagggtctaggagggtt

SEQ ID NO: 8212809 - DNA, 22 bp, Homo sapiens
gagctgagtatcccactgaagt

SEQ ID NO: 8212810 - DNA, 22 bp, Homo sapiens
gagctgagtatcccactgaagt

SEQ ID NO: 8212811 - DNA, 22 bp, Homo sapiens
gagctgagtatcccactgaagt

SEQ ID NO: 8212812 - DNA, 22 bp, Homo sapiens
gagctgagtatcccactgaagt

SEQ ID NO: 8212813 - DNA, 22 bp, Homo sapiens
gagctgagtatgaaggatgtga

SEQ ID NO: 8212814 - DNA, 22 bp, Homo sapiens
gagctgcctgaacaagcagcag

SEQ ID NO: 8212815 - DNA, 23 bp, Homo sapiens
gagctgagtgtagggagactagg

SEQ ID NO: 8212816 - DNA, 23 bp, Homo sapiens
gagctgagtgtagggagactagg

SEQ ID NO: 8212817 - DNA, 22 bp, Homo sapiens
gagctgcctacattgccaagag

SEQ ID NO: 8212818 - DNA, 22 bp, Homo sapiens
gagctgagtatgaaggatgtga

SEQ ID NO: 8212819 - DNA, 22 bp, Homo sapiens
gagctgagtctgcagtcgccat

SEQ ID NO: 8212820 - DNA, 22 bp, Homo sapiens
gagctgaggctcaggctggcgt

SEQ ID NO: 8212821 - DNA, 22 bp, Homo sapiens
gagctgaggctcaggctggcgt

SEQ ID NO: 8212822 - DNA, 22 bp, Homo sapiens
gagctgaggctcaggctggcgt

SEQ ID NO: 8212823 - DNA, 22 bp, Homo sapiens
gagctgagcttaactccttgaa

SEQ ID NO: 8212824 - DNA, 22 bp, Homo sapiens
gagctgaggccagagtcttctg

SEQ ID NO: 8212825 - DNA, 22 bp, Homo sapiens
gagctgaggccagagtcttctg

SEQ ID NO: 8212826 - DNA, 22 bp, Homo sapiens
gagctgaggctgaggcctcact

SEQ ID NO: 8212827 - DNA, 22 bp, Homo sapiens
gagctgaggctgaggcctcact

SEQ ID NO: 8212828 - DNA, 22 bp, Homo sapiens
gagctgaggctgaggcctcact

SEQ ID NO: 8212829 - DNA, 22 bp, Homo sapiens
gagctgaggctcaggctggcgt

SEQ ID NO: 8212830 - DNA, 22 bp, Homo sapiens
gagctgagggtctaggagggtt

SEQ ID NO: 8212831 - DNA, 22 bp, Homo sapiens
gagctgaggctgaggcctcact

SEQ ID NO: 8212832 - DNA, 22 bp, Homo sapiens
gagctgagggtctaggagggtt

SEQ ID NO: 8212833 - DNA, 22 bp, Homo sapiens
gagctgagcctgggtggaccgc

SEQ ID NO: 8212834 - DNA, 22 bp, Homo sapiens
gagctgagcctgggtggaccgc

SEQ ID NO: 8212835 - DNA, 22 bp, Homo sapiens
gagctgagcagggagcctcact

SEQ ID NO: 8212836 - DNA, 22 bp, Homo sapiens
gagctgagcctgggtggaccgc

SEQ ID NO: 8212837 - DNA, 22 bp, Homo sapiens
gagctgagatttgaagcaagtt

SEQ ID NO: 8212838 - DNA, 22 bp, Homo sapiens
gagctgagcagggagcctcact

SEQ ID NO: 8212839 - DNA, 22 bp, Homo sapiens
gagctgagcttaactccttgaa

SEQ ID NO: 8212840 - DNA, 22 bp, Homo sapiens
gagctgagcttaactccttgaa

SEQ ID NO: 8212841 - DNA, 22 bp, Homo sapiens
gagctgaggatacatcagtgaa

SEQ ID NO: 8212842 - DNA, 22 bp, Homo sapiens
gagctgaggatacatcagtgaa

SEQ ID NO: 8212843 - DNA, 22 bp, Homo sapiens
gagctgaggatacatcagtgaa

SEQ ID NO: 8212844 - DNA, 22 bp, Homo sapiens
gagccctgcttccaagggggca

SEQ ID NO: 8212845 - DNA, 22 bp, Homo sapiens
gagccctggcagtctgggatgg

SEQ ID NO: 8212846 - DNA, 22 bp, Homo sapiens
gagccctgctgggccttgtctc

SEQ ID NO: 8212847 - DNA, 22 bp, Homo sapiens
gagccctgctgggccttgtctc

SEQ ID NO: 8212848 - DNA, 22 bp, Homo sapiens
gagccctgcccacttgtctgag

SEQ ID NO: 8212849 - DNA, 18 bp, Homo sapiens
gagccctgagtctgcaca

SEQ ID NO: 8212850 - DNA, 18 bp, Homo sapiens
gagccctgagtctgcaca

SEQ ID NO: 8212851 - DNA, 18 bp, Homo sapiens
gagccctgagtctgcaca

SEQ ID NO: 8212852 - DNA, 18 bp, Homo sapiens
gagccctgagtctgcaca

SEQ ID NO: 8212853 - DNA, 18 bp, Homo sapiens
gagccctgagtctgcaca

SEQ ID NO: 8212854 - DNA, 22 bp, Homo sapiens
gagccctgtagcaagtcatgtc

SEQ ID NO: 8212855 - DNA, 22 bp, Homo sapiens
gagccctgtagcaagtcatgtc

SEQ ID NO: 8212856 - DNA, 22 bp, Homo sapiens
gagccctgtagcaagtcatgtc

SEQ ID NO: 8212857 - DNA, 22 bp, Homo sapiens
gagccctggcagtctgggatgg

SEQ ID NO: 8212858 - DNA, 22 bp, Homo sapiens
gagccctgtagcaagtcatgtc

SEQ ID NO: 8212859 - DNA, 22 bp, Homo sapiens
gagctgagatttgaagcaagtt

SEQ ID NO: 8212860 - DNA, 22 bp, Homo sapiens
gagctgagatcgtgccattgca

SEQ ID NO: 8212861 - DNA, 22 bp, Homo sapiens
gagctgagatcgtgccattgca

SEQ ID NO: 8212862 - DNA, 22 bp, Homo sapiens
gagccctgttcaggcctcctca

SEQ ID NO: 8212863 - DNA, 22 bp, Homo sapiens
gagccctgttcaggcctcctca

SEQ ID NO: 8212864 - DNA, 22 bp, Homo sapiens
gagctgagatcatgtacactag

SEQ ID NO: 8212865 - DNA, 22 bp, Homo sapiens
gagccctgtaggaatctctcaa

SEQ ID NO: 8212866 - DNA, 22 bp, Homo sapiens
gagccctgtaggaatctctcaa

SEQ ID NO: 8212867 - DNA, 22 bp, Homo sapiens
gagccctgtgattctgttgtgt

SEQ ID NO: 8212868 - DNA, 22 bp, Homo sapiens
gagccctgtgattctgttgtgt

SEQ ID NO: 8212869 - DNA, 22 bp, Homo sapiens
gagccattgtccaagcctgttt

SEQ ID NO: 8212870 - DNA, 22 bp, Homo sapiens
gagccaggtttgaatctcagtc

SEQ ID NO: 8212871 - DNA, 22 bp, Homo sapiens
gagcatttttgtctgcatttta

SEQ ID NO: 8212872 - DNA, 22 bp, Homo sapiens
gagccaggtttgaatctcagtc

SEQ ID NO: 8212873 - DNA, 16 bp, Homo sapiens
gagcatggtggcgggc

SEQ ID NO: 8212874 - DNA, 22 bp, Homo sapiens
gagcatggttccataggttggt

SEQ ID NO: 8212875 - DNA, 22 bp, Homo sapiens
gagcatttttgtctgcatttta

SEQ ID NO: 8212876 - DNA, 22 bp, Homo sapiens
gagcatggttccataggttggt

SEQ ID NO: 8212877 - DNA, 22 bp, Homo sapiens
gagcccagctgcggccctcagc

SEQ ID NO: 8212878 - DNA, 22 bp, Homo sapiens
gagcccagctctacctcagact

SEQ ID NO: 8212879 - DNA, 22 bp, Homo sapiens
gagcccagctctacctcagact

SEQ ID NO: 8212880 - DNA, 22 bp, Homo sapiens
gagcccaggagtttgatgctgc

SEQ ID NO: 8212881 - DNA, 22 bp, Homo sapiens
gagcccaggagtttgatgctgc

SEQ ID NO: 8212882 - DNA, 22 bp, Homo sapiens
gagcccaggaagtggaggctga

SEQ ID NO: 8212883 - DNA, 22 bp, Homo sapiens
gagcccaggaagtggaggctga

SEQ ID NO: 8212884 - DNA, 22 bp, Homo sapiens
gagcccagctgtccttggcaaa

SEQ ID NO: 8212885 - DNA, 22 bp, Homo sapiens
gagcccagctgtccttggcaaa

SEQ ID NO: 8212886 - DNA, 22 bp, Homo sapiens
gagcccagcttgcacatggagc

SEQ ID NO: 8212887 - DNA, 22 bp, Homo sapiens
gagcccaggaagtggaggctga

SEQ ID NO: 8212888 - DNA, 22 bp, Homo sapiens
gagccctgacactgagggagtt

SEQ ID NO: 8212889 - DNA, 22 bp, Homo sapiens
gagccctgacactgagggagtt

SEQ ID NO: 8212890 - DNA, 22 bp, Homo sapiens
gagccctgaacaacagcaggaa

SEQ ID NO: 8212891 - DNA, 22 bp, Homo sapiens
gagccctgaacaacagcaggaa

SEQ ID NO: 8212892 - DNA, 22 bp, Homo sapiens
gagcccaggttctgcttccagc

SEQ ID NO: 8212893 - DNA, 22 bp, Homo sapiens
gagcccaggttctgcttccagc

SEQ ID NO: 8212894 - DNA, 22 bp, Homo sapiens
gagcccaggttctgcttccagc

SEQ ID NO: 8212895 - DNA, 22 bp, Homo sapiens
gagcccaggttctgcttccagc

SEQ ID NO: 8212896 - DNA, 22 bp, Homo sapiens
gagcccagtctgctcctgcgcc

SEQ ID NO: 8212897 - DNA, 22 bp, Homo sapiens
gagcccagtctgctcctgcgcc

SEQ ID NO: 8212898 - DNA, 22 bp, Homo sapiens
gagcccagtctgctcctgcgcc

SEQ ID NO: 8212899 - DNA, 22 bp, Homo sapiens
gagcccagtaggcaaagctgca

SEQ ID NO: 8212900 - DNA, 22 bp, Homo sapiens
gagcccaggatggtgtatggct

SEQ ID NO: 8212901 - DNA, 22 bp, Homo sapiens
gagcccaggcagaggttgcagt

SEQ ID NO: 8212902 - DNA, 22 bp, Homo sapiens
gagcccaggctggggttcagag

SEQ ID NO: 8212903 - DNA, 22 bp, Homo sapiens
gagcccaggctggggttcagag

SEQ ID NO: 8212904 - DNA, 22 bp, Homo sapiens
gagcccagggcaggcaaggcag

SEQ ID NO: 8212905 - DNA, 22 bp, Homo sapiens
gagcccagggtgaaatagcagc

SEQ ID NO: 8212906 - DNA, 22 bp, Homo sapiens
gagcccagggtgaaatagcagc

SEQ ID NO: 8212907 - DNA, 22 bp, Homo sapiens
gagcagggagacaactctggtg

SEQ ID NO: 8212908 - DNA, 20 bp, Homo sapiens
gagcagtgagccagggaaag

SEQ ID NO: 8212909 - DNA, 19 bp, Homo sapiens
gagcagtgaggaccaccag

SEQ ID NO: 8212910 - DNA, 22 bp, Homo sapiens
gagcagtgagtgaatgttgcct

SEQ ID NO: 8212911 - DNA, 22 bp, Homo sapiens
gagcagtgatgggaggacgtca

SEQ ID NO: 8212912 - DNA, 22 bp, Homo sapiens
gagcagtgggaaggaacagggt

SEQ ID NO: 8212913 - DNA, 22 bp, Homo sapiens
gagcagtgccaaagaatttgcg

SEQ ID NO: 8212914 - DNA, 20 bp, Homo sapiens
gagcagtggagtttccaggg

SEQ ID NO: 8212915 - DNA, 20 bp, Homo sapiens
gagcagtggagtttccaggg

SEQ ID NO: 8212916 - DNA, 22 bp, Homo sapiens
gagaggtaatttgaagtgcaaa

SEQ ID NO: 8212917 - DNA, 22 bp, Homo sapiens
gagcaggcttgcagagaagggg

SEQ ID NO: 8212918 - DNA, 22 bp, Homo sapiens
gagcaggcttgcagagaagggg

SEQ ID NO: 8212919 - DNA, 22 bp, Homo sapiens
gagcaggcttgcagagaagggg

SEQ ID NO: 8212920 - DNA, 22 bp, Homo sapiens
gagagggtgcctggaagccagg

SEQ ID NO: 8212921 - DNA, 22 bp, Homo sapiens
gagagggtgcctggaagccagg

SEQ ID NO: 8212922 - DNA, 22 bp, Homo sapiens
gagagggctggaaacttcctgg

SEQ ID NO: 8212923 - DNA, 22 bp, Homo sapiens
gagagggctggaaacttcctgg

SEQ ID NO: 8212924 - DNA, 22 bp, Homo sapiens
gagagggctgcctggtgtgagg

SEQ ID NO: 8212925 - DNA, 22 bp, Homo sapiens
gagagggctgcctggtgtgagg

SEQ ID NO: 8212926 - DNA, 22 bp, Homo sapiens
gagaggggacctgtgtgtctag

SEQ ID NO: 8212927 - DNA, 22 bp, Homo sapiens
gagaggggacctgtgtgtctag

SEQ ID NO: 8212928 - DNA, 22 bp, Homo sapiens
gagaggggcgcgcagctcgcga

SEQ ID NO: 8212929 - DNA, 22 bp, Homo sapiens
gagaggggcgcgcagctcgcga

SEQ ID NO: 8212930 - DNA, 22 bp, Homo sapiens
gagaggggcccaagccacatag

SEQ ID NO: 8212931 - DNA, 22 bp, Homo sapiens
gagaggggcgcgcagctcgcga

SEQ ID NO: 8212932 - DNA, 22 bp, Homo sapiens
gagaggggcgcgcagctcgcga

SEQ ID NO: 8212933 - DNA, 22 bp, Homo sapiens
gagcatctggctagaggagtga

SEQ ID NO: 8212934 - DNA, 22 bp, Homo sapiens
gagcatggatcatgtgctgggt

SEQ ID NO: 8212935 - DNA, 22 bp, Homo sapiens
gagcatggatcatgtgctgggt

SEQ ID NO: 8212936 - DNA, 22 bp, Homo sapiens
gagcatggatagaaggtgggat

SEQ ID NO: 8212937 - DNA, 22 bp, Homo sapiens
gagcatggatagaaggtgggat

SEQ ID NO: 8212938 - DNA, 21 bp, Homo sapiens
gagcatggcttacatcagcag

SEQ ID NO: 8212939 - DNA, 18 bp, Homo sapiens
gagcatgggcagtgggga

SEQ ID NO: 8212940 - DNA, 22 bp, Homo sapiens
gagcatggtgcttcagtgaagg

SEQ ID NO: 8212941 - DNA, 22 bp, Homo sapiens
gagcatggtgcttcagtgaagg

SEQ ID NO: 8212942 - DNA, 18 bp, Homo sapiens
gagcatgggcagtgggga

SEQ ID NO: 8212943 - DNA, 18 bp, Homo sapiens
gagcatgggcagtgggga

SEQ ID NO: 8212944 - DNA, 22 bp, Homo sapiens
gagcatggcagctgagggcagg

SEQ ID NO: 8212945 - DNA, 22 bp, Homo sapiens
gagcatggatcatgtgctgggt

SEQ ID NO: 8212946 - DNA, 22 bp, Homo sapiens
gagcatggcagctgagggcagg

SEQ ID NO: 8212947 - DNA, 21 bp, Homo sapiens
gagcatggcttacatcagcag

SEQ ID NO: 8212948 - DNA, 22 bp, Homo sapiens
gagcagtgggaaggaacagggt

SEQ ID NO: 8212949 - DNA, 22 bp, Homo sapiens
gagcagtggtcacagggaggga

SEQ ID NO: 8212950 - DNA, 22 bp, Homo sapiens
gagcagtgtttgtggacctgga

SEQ ID NO: 8212951 - DNA, 22 bp, Homo sapiens
gagcagtgtttgtggacctgga

SEQ ID NO: 8212952 - DNA, 22 bp, Homo sapiens
gagcagtggttgaacagaggca

SEQ ID NO: 8212953 - DNA, 22 bp, Homo sapiens
gagcagtggttgaacagaggca

SEQ ID NO: 8212954 - DNA, 22 bp, Homo sapiens
gagcagtggtggtgtgttagag

SEQ ID NO: 8212955 - DNA, 22 bp, Homo sapiens
gagcagtggtctgatcttctaa

SEQ ID NO: 8212956 - DNA, 22 bp, Homo sapiens
gagcagtggtggtgtgttagag

SEQ ID NO: 8212957 - DNA, 22 bp, Homo sapiens
gagcagttttatttcatgagac

SEQ ID NO: 8212958 - DNA, 22 bp, Homo sapiens
gagcagttatttttagacatga

SEQ ID NO: 8212959 - DNA, 22 bp, Homo sapiens
gagcatcgctgagatcccagac

SEQ ID NO: 8212960 - DNA, 22 bp, Homo sapiens
gagcatctatgtgctgggtact

SEQ ID NO: 8212961 - DNA, 22 bp, Homo sapiens
gagcatctctatagtgactgtg

SEQ ID NO: 8212962 - DNA, 22 bp, Homo sapiens
gagcatctgatgagattggatt

SEQ ID NO: 8212963 - DNA, 22 bp, Homo sapiens
gaggcaggaggattgcttgagc

SEQ ID NO: 8212964 - DNA, 22 bp, Homo sapiens
gaggcaggaggattgcttgagc

SEQ ID NO: 8212965 - DNA, 22 bp, Homo sapiens
gaggcaggaggattgcttgagc

SEQ ID NO: 8212966 - DNA, 22 bp, Homo sapiens
gaggcagcttggggctgtgggt

SEQ ID NO: 8212967 - DNA, 22 bp, Homo sapiens
gaggcagcttggggctgtgggt

SEQ ID NO: 8212968 - DNA, 22 bp, Homo sapiens
gaggcagcttggggctgtgggt

SEQ ID NO: 8212969 - DNA, 22 bp, Homo sapiens
gaggcagcttggggctgtgggt

SEQ ID NO: 8212970 - DNA, 22 bp, Homo sapiens
gaggcagcttagggtactgact

SEQ ID NO: 8212971 - DNA, 22 bp, Homo sapiens
gaggagcccagcaccatcactt

SEQ ID NO: 8212972 - DNA, 22 bp, Homo sapiens
gaggagcccagcaccatcactt

SEQ ID NO: 8212973 - DNA, 22 bp, Homo sapiens
gaggagcccccactgggctcac

SEQ ID NO: 8212974 - DNA, 22 bp, Homo sapiens
gaggagccaggaggtctccctg

SEQ ID NO: 8212975 - DNA, 22 bp, Homo sapiens
gaggagccatagatagtgctgc

SEQ ID NO: 8212976 - DNA, 22 bp, Homo sapiens
gaggagcccccactgggctcac

SEQ ID NO: 8212977 - DNA, 22 bp, Homo sapiens
gaggagcccccactgggctcac

SEQ ID NO: 8212978 - DNA, 22 bp, Homo sapiens
gaggagcccccactgggctcac

SEQ ID NO: 8212979 - DNA, 22 bp, Homo sapiens
gaggcaggcagattgcttgagg

SEQ ID NO: 8212980 - DNA, 22 bp, Homo sapiens
gaggcaggcagattgcttgagg

SEQ ID NO: 8212981 - DNA, 22 bp, Homo sapiens
gaggcaggcagattgcttgagg

SEQ ID NO: 8212982 - DNA, 22 bp, Homo sapiens
gaggcaggcagattgcttgagg

SEQ ID NO: 8212983 - DNA, 22 bp, Homo sapiens
gaggcaggcagattgcttgagg

SEQ ID NO: 8212984 - DNA, 22 bp, Homo sapiens
gaggcaggccctgaatgagtca

SEQ ID NO: 8212985 - DNA, 22 bp, Homo sapiens
gaggcaggcagattgcttgagg

SEQ ID NO: 8212986 - DNA, 22 bp, Homo sapiens
gaggcaggccctgaatgagtca

SEQ ID NO: 8212987 - DNA, 22 bp, Homo sapiens
gaggcaggccctgaatgagtca

SEQ ID NO: 8212988 - DNA, 22 bp, Homo sapiens
gaggcaggccctgaatgagtca

SEQ ID NO: 8212989 - DNA, 22 bp, Homo sapiens
gaggcaggccctgaatgagtca

SEQ ID NO: 8212990 - DNA, 22 bp, Homo sapiens
gaggcaggaggattgcttgagc

SEQ ID NO: 8212991 - DNA, 22 bp, Homo sapiens
gaggcaggaggattgcttgagc

SEQ ID NO: 8212992 - DNA, 22 bp, Homo sapiens
gaggcaggaggattgcttgagc

SEQ ID NO: 8212993 - DNA, 22 bp, Homo sapiens
gaggcaggcactgttatcagca

SEQ ID NO: 8212994 - DNA, 22 bp, Homo sapiens
gaggcaggcactgttatcagca

SEQ ID NO: 8212995 - DNA, 22 bp, Homo sapiens
gaggcaggcactgttatcagca

SEQ ID NO: 8212996 - DNA, 22 bp, Homo sapiens
gaggcaggcactgttatcagca

SEQ ID NO: 8212997 - DNA, 22 bp, Homo sapiens
gaggcaggcactgttatcagca

SEQ ID NO: 8212998 - DNA, 22 bp, Homo sapiens
gaggagaggggctcccaagagc

SEQ ID NO: 8212999 - DNA, 22 bp, Homo sapiens
gaggagaggggctcccaagagc

SEQ ID NO: 8213000 - DNA, 22 bp, Homo sapiens
gaggagaggctggacgcggtga

SEQ ID NO: 8213001 - DNA, 22 bp, Homo sapiens
gaggagaggctggacgcggtga

SEQ ID NO: 8213002 - DNA, 22 bp, Homo sapiens
gaggagagggctgcgggcccac

SEQ ID NO: 8213003 - DNA, 22 bp, Homo sapiens
gaggagagggctgcgggcccac

SEQ ID NO: 8213004 - DNA, 22 bp, Homo sapiens
gaggagagatggtagattgggt

SEQ ID NO: 8213005 - DNA, 22 bp, Homo sapiens
gaggagagcctgcactttgacc

SEQ ID NO: 8213006 - DNA, 22 bp, Homo sapiens
gaggagagcctgcactttgacc

SEQ ID NO: 8213007 - DNA, 22 bp, Homo sapiens
gaggagaggccatcgttgttat

SEQ ID NO: 8213008 - DNA, 22 bp, Homo sapiens
gaggagagcctgcactttgacc

SEQ ID NO: 8213009 - DNA, 22 bp, Homo sapiens
gaggagcatgggaaggctctgg

SEQ ID NO: 8213010 - DNA, 22 bp, Homo sapiens
gaggagcacatgaggctgaggg

SEQ ID NO: 8213011 - DNA, 22 bp, Homo sapiens
gaggagcacatgaggctgaggg

SEQ ID NO: 8213012 - DNA, 22 bp, Homo sapiens
gaggagcatgggaaggctctgg

SEQ ID NO: 8213013 - DNA, 22 bp, Homo sapiens
gaggagcatgggaaggctctgg

SEQ ID NO: 8213014 - DNA, 22 bp, Homo sapiens
gaggagccaggaggtctccctg

SEQ ID NO: 8213015 - DNA, 22 bp, Homo sapiens
gaggagccaaggtatgtgtgtt

SEQ ID NO: 8213016 - DNA, 22 bp, Homo sapiens
gaggagccaaggtatgtgtgtt

SEQ ID NO: 8213017 - DNA, 20 bp, Homo sapiens
gaggagccaccttgagctgg

SEQ ID NO: 8213018 - DNA, 22 bp, Homo sapiens
gaggagcatgggaaggctctgg

SEQ ID NO: 8213019 - DNA, 22 bp, Homo sapiens
gaggagaggggctcccaagagc

SEQ ID NO: 8213020 - DNA, 22 bp, Homo sapiens
gaggagcacatgaggctgaggg

SEQ ID NO: 8213021 - DNA, 22 bp, Homo sapiens
gaggagcacatgaggctgaggg

SEQ ID NO: 8213022 - DNA, 22 bp, Homo sapiens
gaggagcaagaaatagtgccca

SEQ ID NO: 8213023 - DNA, 22 bp, Homo sapiens
gaggagcacatgaggctgaggg

SEQ ID NO: 8213024 - DNA, 22 bp, Homo sapiens
gaggctcacgacgggacgaact

SEQ ID NO: 8213025 - DNA, 22 bp, Homo sapiens
gaggctcactaggcatcctggg

SEQ ID NO: 8213026 - DNA, 22 bp, Homo sapiens
gaggctcactgggcaaagactc

SEQ ID NO: 8213027 - DNA, 22 bp, Homo sapiens
gaggctcacgacgggacgaact

SEQ ID NO: 8213028 - DNA, 22 bp, Homo sapiens
gaggctcacctagggagcactg

SEQ ID NO: 8213029 - DNA, 22 bp, Homo sapiens
gaggctcagagaagtcatggta

SEQ ID NO: 8213030 - DNA, 22 bp, Homo sapiens
gaggctcagagaagtcatggta

SEQ ID NO: 8213031 - DNA, 22 bp, Homo sapiens
gaggcatctgggcacagaagtg

SEQ ID NO: 8213032 - DNA, 22 bp, Homo sapiens
gaggctcaacccacaggggttg

SEQ ID NO: 8213033 - DNA, 22 bp, Homo sapiens
gaggctcaacccacaggggttg

SEQ ID NO: 8213034 - DNA, 22 bp, Homo sapiens
gaggctcacctagggagcactg

SEQ ID NO: 8213035 - DNA, 22 bp, Homo sapiens
gaggctcacctagggagcactg

SEQ ID NO: 8213036 - DNA, 22 bp, Homo sapiens
gaggcagtttgccatgccagga

SEQ ID NO: 8213037 - DNA, 22 bp, Homo sapiens
gaggcagtttgccatgccagga

SEQ ID NO: 8213038 - DNA, 22 bp, Homo sapiens
gaggcagtgtttactgccctgt

SEQ ID NO: 8213039 - DNA, 22 bp, Homo sapiens
gaggcagggtgttgattacaga

SEQ ID NO: 8213040 - DNA, 22 bp, Homo sapiens
gaggcagggtgttgattacaga

SEQ ID NO: 8213041 - DNA, 22 bp, Homo sapiens
gaggcagtaattgtgggcaata

SEQ ID NO: 8213042 - DNA, 22 bp, Homo sapiens
gaggcagggtgttgattacaga

SEQ ID NO: 8213043 - DNA, 22 bp, Homo sapiens
gaggcagggtgttgattacaga

SEQ ID NO: 8213044 - DNA, 22 bp, Homo sapiens
gaggcagggtgttgattacaga

SEQ ID NO: 8213045 - DNA, 22 bp, Homo sapiens
gaggcagggtgttgattacaga

SEQ ID NO: 8213046 - DNA, 22 bp, Homo sapiens
gaggcagggtgttgattacaga

SEQ ID NO: 8213047 - DNA, 22 bp, Homo sapiens
gaggcaggccctgaatgagtca

SEQ ID NO: 8213048 - DNA, 22 bp, Homo sapiens
gaggcaggccctgaatgagtca

SEQ ID NO: 8213049 - DNA, 22 bp, Homo sapiens
gaggcagtaattgtgggcaata

SEQ ID NO: 8213050 - DNA, 22 bp, Homo sapiens
gaggcagtgcattgtctagggg

SEQ ID NO: 8213051 - DNA, 22 bp, Homo sapiens
gaggctgaatggccagaagcca

SEQ ID NO: 8213052 - DNA, 20 bp, Homo sapiens
gaggctgaagtgtttttgct

SEQ ID NO: 8213053 - DNA, 22 bp, Homo sapiens
gaggctgaatggccagaagcca

SEQ ID NO: 8213054 - DNA, 22 bp, Homo sapiens
gaggctgaatggccagaagcca

SEQ ID NO: 8213055 - DNA, 22 bp, Homo sapiens
gaggctgaatggccagaagcca

SEQ ID NO: 8213056 - DNA, 22 bp, Homo sapiens
gaggctgaatggccagaagcca

SEQ ID NO: 8213057 - DNA, 22 bp, Homo sapiens
gaggctgaatggccagaagcca

SEQ ID NO: 8213058 - DNA, 22 bp, Homo sapiens
gaggctgaagtgtacatgggtg

SEQ ID NO: 8213059 - DNA, 22 bp, Homo sapiens
gaggctgaagtgtacatgggtg

SEQ ID NO: 8213060 - DNA, 22 bp, Homo sapiens
gaggctgaagtgtacatgggtg

SEQ ID NO: 8213061 - DNA, 22 bp, Homo sapiens
gaggctgaagtgtacatgggtg

SEQ ID NO: 8213062 - DNA, 20 bp, Homo sapiens
gaggctgaagtgtttttgct

SEQ ID NO: 8213063 - DNA, 20 bp, Homo sapiens
gaggctgaagtgtttttgct

SEQ ID NO: 8213064 - DNA, 22 bp, Homo sapiens
gaggctgagactctgaattttt

SEQ ID NO: 8213065 - DNA, 22 bp, Homo sapiens
gaggctgagactctgaattttt

SEQ ID NO: 8213066 - DNA, 22 bp, Homo sapiens
gaggctgacggcaccatcttct

SEQ ID NO: 8213067 - DNA, 22 bp, Homo sapiens
gaggctgacggcaccatcttct

SEQ ID NO: 8213068 - DNA, 22 bp, Homo sapiens
gaggctgagagtttgttctact

SEQ ID NO: 8213069 - DNA, 22 bp, Homo sapiens
gaggctgagagtttgttctact

SEQ ID NO: 8213070 - DNA, 22 bp, Homo sapiens
gaggctgagagtttgttctact

SEQ ID NO: 8213071 - DNA, 22 bp, Homo sapiens
gaggctgagagtttgttctact

SEQ ID NO: 8213072 - DNA, 22 bp, Homo sapiens
gaggctgaggcaggaggatcac

SEQ ID NO: 8213073 - DNA, 22 bp, Homo sapiens
gaggctgaggcaggaggatcac

SEQ ID NO: 8213074 - DNA, 22 bp, Homo sapiens
gaggctgaggcaggaggatcac

SEQ ID NO: 8213075 - DNA, 22 bp, Homo sapiens
gaggctgagagtttgttctact

SEQ ID NO: 8213076 - DNA, 22 bp, Homo sapiens
gaggctccagcgacacctaggc

SEQ ID NO: 8213077 - DNA, 22 bp, Homo sapiens
gaggctcattgcattgtgcatt

SEQ ID NO: 8213078 - DNA, 22 bp, Homo sapiens
gaggctgaacaggttctcatga

SEQ ID NO: 8213079 - DNA, 22 bp, Homo sapiens
gaggctgaacaggttctcatga

SEQ ID NO: 8213080 - DNA, 22 bp, Homo sapiens
gaggctcagttatgtcatcagg

SEQ ID NO: 8213081 - DNA, 22 bp, Homo sapiens
gaggctcagttatgtcatcagg

SEQ ID NO: 8213082 - DNA, 22 bp, Homo sapiens
gaggctcagggagtatatgaat

SEQ ID NO: 8213083 - DNA, 22 bp, Homo sapiens
gaggctcagttatgtcatcagg

SEQ ID NO: 8213084 - DNA, 22 bp, Homo sapiens
gaggctcagagggagcatggtc

SEQ ID NO: 8213085 - DNA, 22 bp, Homo sapiens
gaggctcagagggagcatggtc

SEQ ID NO: 8213086 - DNA, 22 bp, Homo sapiens
gaggctcagagggagcatggtc

SEQ ID NO: 8213087 - DNA, 22 bp, Homo sapiens
gaggctcagggaaacagcgcag

SEQ ID NO: 8213088 - DNA, 22 bp, Homo sapiens
gaggctcagagggagcatggtc

SEQ ID NO: 8213089 - DNA, 22 bp, Homo sapiens
gaggctcagagggagcatggtc

SEQ ID NO: 8213090 - DNA, 22 bp, Homo sapiens
gaggctcagagaagtcatggta

SEQ ID NO: 8213091 - DNA, 22 bp, Homo sapiens
gaggctcagagaggtccacata

SEQ ID NO: 8213092 - DNA, 22 bp, Homo sapiens
gagggagggactagcattctct

SEQ ID NO: 8213093 - DNA, 22 bp, Homo sapiens
gagggagggaaagtttaacact

SEQ ID NO: 8213094 - DNA, 22 bp, Homo sapiens
gagggaggggagctccaccctc

SEQ ID NO: 8213095 - DNA, 22 bp, Homo sapiens
gagggaggggagctccaccctc

SEQ ID NO: 8213096 - DNA, 22 bp, Homo sapiens
gagggagggccaggtcccaacc

SEQ ID NO: 8213097 - DNA, 22 bp, Homo sapiens
gagggagggccaggtcccaacc

SEQ ID NO: 8213098 - DNA, 22 bp, Homo sapiens
gagggagggccaggtcccaacc

SEQ ID NO: 8213099 - DNA, 22 bp, Homo sapiens
gagggaggcatcatgaatccag

SEQ ID NO: 8213100 - DNA, 22 bp, Homo sapiens
gagggaggcatcatgaatccag

SEQ ID NO: 8213101 - DNA, 22 bp, Homo sapiens
gagggaggcatcatgaatccag

SEQ ID NO: 8213102 - DNA, 22 bp, Homo sapiens
gagggagctggagcagacgccg

SEQ ID NO: 8213103 - DNA, 22 bp, Homo sapiens
gagggagctggagcagacgccg

SEQ ID NO: 8213104 - DNA, 22 bp, Homo sapiens
gagggagctggagcagacgccg

SEQ ID NO: 8213105 - DNA, 22 bp, Homo sapiens
gagggagagtgatggaccattg

SEQ ID NO: 8213106 - DNA, 22 bp, Homo sapiens
gagggagagtgatggaccattg

SEQ ID NO: 8213107 - DNA, 22 bp, Homo sapiens
gagggagccgccacagactggg

SEQ ID NO: 8213108 - DNA, 22 bp, Homo sapiens
gagggagccgccacagactggg

SEQ ID NO: 8213109 - DNA, 22 bp, Homo sapiens
gaggctgcattcttcccactgc

SEQ ID NO: 8213110 - DNA, 22 bp, Homo sapiens
gaggctgcattcttcccactgc

SEQ ID NO: 8213111 - DNA, 22 bp, Homo sapiens
gaggctgccaatgtgtgcatgt

SEQ ID NO: 8213112 - DNA, 22 bp, Homo sapiens
gagggagaattgcagccagcgt

SEQ ID NO: 8213113 - DNA, 22 bp, Homo sapiens
gaggctgcattcttcccactgc

SEQ ID NO: 8213114 - DNA, 22 bp, Homo sapiens
gaggctgcaggcaatgctgccc

SEQ ID NO: 8213115 - DNA, 22 bp, Homo sapiens
gaggctgcaggcaatgctgccc

SEQ ID NO: 8213116 - DNA, 22 bp, Homo sapiens
gaggctgcaggcaatgctgccc

SEQ ID NO: 8213117 - DNA, 22 bp, Homo sapiens
gaggctgcagctatcagacatt

SEQ ID NO: 8213118 - DNA, 22 bp, Homo sapiens
gaggctgcactggctaaaggct

SEQ ID NO: 8213119 - DNA, 22 bp, Homo sapiens
gaggctgcactggctaaaggct

SEQ ID NO: 8213120 - DNA, 22 bp, Homo sapiens
gaggctgcactggctaaaggct

SEQ ID NO: 8213121 - DNA, 22 bp, Homo sapiens
gaggctgattcggggaacagca

SEQ ID NO: 8213122 - DNA, 22 bp, Homo sapiens
gaggctgattcggggaacagca

SEQ ID NO: 8213123 - DNA, 22 bp, Homo sapiens
gaggctgagtagctttgtgctc

SEQ ID NO: 8213124 - DNA, 22 bp, Homo sapiens
gaggctgatgctgcctcacaga

SEQ ID NO: 8213125 - DNA, 22 bp, Homo sapiens
gaggctgagtagctttgtgctc

SEQ ID NO: 8213126 - DNA, 22 bp, Homo sapiens
gaggctgagtagctttgtgctc

SEQ ID NO: 8213127 - DNA, 22 bp, Homo sapiens
gaggctgatgctgcctcacaga

SEQ ID NO: 8213128 - DNA, 22 bp, Homo sapiens
gaggctgattcggggaacagca

SEQ ID NO: 8213129 - DNA, 22 bp, Homo sapiens
gaggctgaggttgcagtgagcc

SEQ ID NO: 8213130 - DNA, 22 bp, Homo sapiens
gaggctgaggttgcagtgagcc

SEQ ID NO: 8213131 - DNA, 22 bp, Homo sapiens
gaggctgaggttgcagtgagcc

SEQ ID NO: 8213132 - DNA, 22 bp, Homo sapiens
gaggctgaggttgcagtgagct

SEQ ID NO: 8213133 - DNA, 22 bp, Homo sapiens
gaggctgaggttgcagtgagcc

SEQ ID NO: 8213134 - DNA, 22 bp, Homo sapiens
gaggctgaggttgcagtgagcc

SEQ ID NO: 8213135 - DNA, 22 bp, Homo sapiens
gaggctgaggttgcagtgagct

SEQ ID NO: 8213136 - DNA, 22 bp, Homo sapiens
gaggctgaggttgcagtgagct

SEQ ID NO: 8213137 - DNA, 22 bp, Homo sapiens
gaggctgaggttgcagtgagct

SEQ ID NO: 8213138 - DNA, 22 bp, Homo sapiens
gaggctgaggttgcagtgagct

SEQ ID NO: 8213139 - DNA, 22 bp, Homo sapiens
gaggctgaggcaggaggatcac

SEQ ID NO: 8213140 - DNA, 22 bp, Homo sapiens
gaggctgaggcaggaggatcac

SEQ ID NO: 8213141 - DNA, 22 bp, Homo sapiens
gaggctgaggcaggaggatcac

SEQ ID NO: 8213142 - DNA, 22 bp, Homo sapiens
gaggctgaggcggatggatcac

SEQ ID NO: 8213143 - DNA, 22 bp, Homo sapiens
gaggctgaggcggatggatcac

SEQ ID NO: 8213144 - DNA, 22 bp, Homo sapiens
gaggctgaggcggatggatcac

SEQ ID NO: 8213145 - DNA, 22 bp, Homo sapiens
gaggctgagggttagagagtca

SEQ ID NO: 8213146 - DNA, 22 bp, Homo sapiens
gaggctgagggttagagagtca

SEQ ID NO: 8213147 - DNA, 22 bp, Homo sapiens
gaggctgagggttagagagtca

SEQ ID NO: 8213148 - DNA, 22 bp, Homo sapiens
gaggggctggcacgatggctgc

SEQ ID NO: 8213149 - DNA, 22 bp, Homo sapiens
gaggggctggcacgatggctgc

SEQ ID NO: 8213150 - DNA, 22 bp, Homo sapiens
gaggggctggcacgatggctgc

SEQ ID NO: 8213151 - DNA, 22 bp, Homo sapiens
gaggggctggctgtggtcccat

SEQ ID NO: 8213152 - DNA, 22 bp, Homo sapiens
gaggggctgggcagtccctgga

SEQ ID NO: 8213153 - DNA, 22 bp, Homo sapiens
gaggggctctttaatagtaaca

SEQ ID NO: 8213154 - DNA, 22 bp, Homo sapiens
gaggggaaagtgtgaggctgcg

SEQ ID NO: 8213155 - DNA, 22 bp, Homo sapiens
gaggggctgccctggtgtcagg

SEQ ID NO: 8213156 - DNA, 22 bp, Homo sapiens
gaggggctgccctggtgtcagg

SEQ ID NO: 8213157 - DNA, 22 bp, Homo sapiens
gaggggctgccctggtgtcagg

SEQ ID NO: 8213158 - DNA, 22 bp, Homo sapiens
gaggggctggcacgatggctgc

SEQ ID NO: 8213159 - DNA, 22 bp, Homo sapiens
gaggggctgccctggtgtcagg

SEQ ID NO: 8213160 - DNA, 22 bp, Homo sapiens
gaggggctgccctggtgtcagg

SEQ ID NO: 8213161 - DNA, 22 bp, Homo sapiens
gagggctgtggggcatgaccag

SEQ ID NO: 8213162 - DNA, 22 bp, Homo sapiens
gagggctgtggggcatgaccag

SEQ ID NO: 8213163 - DNA, 22 bp, Homo sapiens
gagggctgtgaaggagcgggtt

SEQ ID NO: 8213164 - DNA, 22 bp, Homo sapiens
gagggctgtgaaggagcgggtt

SEQ ID NO: 8213165 - DNA, 22 bp, Homo sapiens
gagggctgtgaaggagcgggtt

SEQ ID NO: 8213166 - DNA, 22 bp, Homo sapiens
gagggctgtggggcatgaccag

SEQ ID NO: 8213167 - DNA, 22 bp, Homo sapiens
gagggctgtggggcatgaccag

SEQ ID NO: 8213168 - DNA, 22 bp, Homo sapiens
gagggctgtggggcatgaccag

SEQ ID NO: 8213169 - DNA, 22 bp, Homo sapiens
gagggctgtgaaggagcgggtt

SEQ ID NO: 8213170 - DNA, 22 bp, Homo sapiens
gagggctgtgaaggagcgggtt

SEQ ID NO: 8213171 - DNA, 22 bp, Homo sapiens
gagggctgtgaaggagcgggtt

SEQ ID NO: 8213172 - DNA, 22 bp, Homo sapiens
gagggctggggcttaggcttag

SEQ ID NO: 8213173 - DNA, 22 bp, Homo sapiens
gagggctggggcttaggcttag

SEQ ID NO: 8213174 - DNA, 22 bp, Homo sapiens
gagggctggggcttaggcttag

SEQ ID NO: 8213175 - DNA, 22 bp, Homo sapiens
gagggctggggcttaggcttag

SEQ ID NO: 8213176 - DNA, 22 bp, Homo sapiens
gagggctgctggaaaaatgcag

SEQ ID NO: 8213177 - DNA, 22 bp, Homo sapiens
gagggctgctggaaaaatgcag

SEQ ID NO: 8213178 - DNA, 22 bp, Homo sapiens
gagggctgctggaaaaatgcag

SEQ ID NO: 8213179 - DNA, 22 bp, Homo sapiens
gagggctgctggaaaaatgcag

SEQ ID NO: 8213180 - DNA, 22 bp, Homo sapiens
gagggctgcaatgagacagaga

SEQ ID NO: 8213181 - DNA, 22 bp, Homo sapiens
gagggctgcaatgagacagaga

SEQ ID NO: 8213182 - DNA, 22 bp, Homo sapiens
gagggctgcaatgagacagaga

SEQ ID NO: 8213183 - DNA, 22 bp, Homo sapiens
gagggctgatgttgccacctca

SEQ ID NO: 8213184 - DNA, 22 bp, Homo sapiens
gagggctgatgttgccacctca

SEQ ID NO: 8213185 - DNA, 22 bp, Homo sapiens
gagggctgcaatgagacagaga

SEQ ID NO: 8213186 - DNA, 22 bp, Homo sapiens
gagggctgcaatgagacagaga

SEQ ID NO: 8213187 - DNA, 22 bp, Homo sapiens
gagggctgcaatgagacagaga

SEQ ID NO: 8213188 - DNA, 22 bp, Homo sapiens
gagggctgctggaaaaatgcag

SEQ ID NO: 8213189 - DNA, 22 bp, Homo sapiens
gagggctgctgccagatatgcc

SEQ ID NO: 8213190 - DNA, 22 bp, Homo sapiens
gagggctgctgccagatatgcc

SEQ ID NO: 8213191 - DNA, 22 bp, Homo sapiens
gagggctgctgccagatatgcc

SEQ ID NO: 8213192 - DNA, 22 bp, Homo sapiens
gagggctgctgccagatatgcc

SEQ ID NO: 8213193 - DNA, 22 bp, Homo sapiens
gagggctgctgccagatatgcc

SEQ ID NO: 8213194 - DNA, 22 bp, Homo sapiens
gagggctgctgccagatatgcc

SEQ ID NO: 8213195 - DNA, 22 bp, Homo sapiens
gagggctgccacgttgggcgag

SEQ ID NO: 8213196 - DNA, 22 bp, Homo sapiens
gagggctgccacgttgggcgag

SEQ ID NO: 8213197 - DNA, 22 bp, Homo sapiens
gagggctgccacgttgggcgag

SEQ ID NO: 8213198 - DNA, 18 bp, Homo sapiens
gagggagtagctgaggtt

SEQ ID NO: 8213199 - DNA, 22 bp, Homo sapiens
gagggagtctgtgcaaagaatt

SEQ ID NO: 8213200 - DNA, 22 bp, Homo sapiens
gagggagtgagacacaaaagaa

SEQ ID NO: 8213201 - DNA, 22 bp, Homo sapiens
gagggagtgccagagggccagc

SEQ ID NO: 8213202 - DNA, 22 bp, Homo sapiens
gagggctgatgttgccacctca

SEQ ID NO: 8213203 - DNA, 22 bp, Homo sapiens
gagggagtgctttctgatagtt

SEQ ID NO: 8213204 - DNA, 22 bp, Homo sapiens
gagggctgatgttgccacctca

SEQ ID NO: 8213205 - DNA, 22 bp, Homo sapiens
gagggatctttaggcagcctca

SEQ ID NO: 8213206 - DNA, 22 bp, Homo sapiens
gagggaggtgatactgaacgta

SEQ ID NO: 8213207 - DNA, 22 bp, Homo sapiens
gagggaggtgatactgaacgta

SEQ ID NO: 8213208 - DNA, 22 bp, Homo sapiens
gagggaggtgatactgaacgta

SEQ ID NO: 8213209 - DNA, 22 bp, Homo sapiens
gagggagtaacgtactacagtg

SEQ ID NO: 8213210 - DNA, 18 bp, Homo sapiens
gagggagtagctgaggtt

SEQ ID NO: 8213211 - DNA, 22 bp, Homo sapiens
ctgtcaaagactaaggttctta

SEQ ID NO: 8213212 - DNA, 22 bp, Homo sapiens
ctgtattttttaagtgatctgg

SEQ ID NO: 8213213 - DNA, 22 bp, Homo sapiens
ctgtcaaattcataacacttat

SEQ ID NO: 8213214 - DNA, 22 bp, Homo sapiens
ctgtattttttaagaatatctc

SEQ ID NO: 8213215 - DNA, 22 bp, Homo sapiens
ctgtattttttaagaatatctc

SEQ ID NO: 8213216 - DNA, 22 bp, Homo sapiens
ctgtattttcatgcctacgtac

SEQ ID NO: 8213217 - DNA, 22 bp, Homo sapiens
ctgtcacactaaaacaagaagt

SEQ ID NO: 8213218 - DNA, 17 bp, Homo sapiens
ctgtcacaatacctcgc

SEQ ID NO: 8213219 - DNA, 22 bp, Homo sapiens
ctgtcacactgatatcaggctt

SEQ ID NO: 8213220 - DNA, 22 bp, Homo sapiens
ctgtcacactgatatcaggctt

SEQ ID NO: 8213221 - DNA, 20 bp, Homo sapiens
ctgtcacaaaggatgtgtca

SEQ ID NO: 8213222 - DNA, 22 bp, Homo sapiens
ctgtcacccacccagcctgtca

SEQ ID NO: 8213223 - DNA, 22 bp, Homo sapiens
ctgtcaccatttgagccctgga

SEQ ID NO: 8213224 - DNA, 22 bp, Homo sapiens
ctgtcacaggttcaaactcccc

SEQ ID NO: 8213225 - DNA, 22 bp, Homo sapiens
ctgtcacagcccgcgtctcctc

SEQ ID NO: 8213226 - DNA, 22 bp, Homo sapiens
ctgtcaccatttgagccctgga

SEQ ID NO: 8213227 - DNA, 22 bp, Homo sapiens
ctgtatttgtcctctatttatt

SEQ ID NO: 8213228 - DNA, 22 bp, Homo sapiens
ctgtatttgaaagaaaagattt

SEQ ID NO: 8213229 - DNA, 23 bp, Homo sapiens
ctgtatttgacttgagcggaaat

SEQ ID NO: 8213230 - DNA, 23 bp, Homo sapiens
ctgtatttgacttgagcggaaat

SEQ ID NO: 8213231 - DNA, 22 bp, Homo sapiens
ctgtatatggcttactttatat

SEQ ID NO: 8213232 - DNA, 22 bp, Homo sapiens
ctgtatttgaaagaaaagattt

SEQ ID NO: 8213233 - DNA, 22 bp, Homo sapiens
ctgtatttgaaagaaaagattt

SEQ ID NO: 8213234 - DNA, 22 bp, Homo sapiens
ctgtatatggcttactttatat

SEQ ID NO: 8213235 - DNA, 22 bp, Homo sapiens
ctgtatatcatggttttgcagt

SEQ ID NO: 8213236 - DNA, 22 bp, Homo sapiens
ctgtatataatgtatgcatggg

SEQ ID NO: 8213237 - DNA, 22 bp, Homo sapiens
ctgtataattcatgctcttatt

SEQ ID NO: 8213238 - DNA, 22 bp, Homo sapiens
ctgtataagataccacactgaa

SEQ ID NO: 8213239 - DNA, 22 bp, Homo sapiens
ctgtataaccccatgcgactgt

SEQ ID NO: 8213240 - DNA, 22 bp, Homo sapiens
ctgtataacatcttttgtttcc

SEQ ID NO: 8213241 - DNA, 22 bp, Homo sapiens
ctgtataaacatattttcaagt

SEQ ID NO: 8213242 - DNA, 22 bp, Homo sapiens
ctgtagttgggcattataatag

SEQ ID NO: 8213243 - DNA, 22 bp, Homo sapiens
ctgtagttgatgatttctgata

SEQ ID NO: 8213244 - DNA, 20 bp, Homo sapiens
ctgtagggtgcagcaggctc

SEQ ID NO: 8213245 - DNA, 20 bp, Homo sapiens
ctgtagggtgcagcaggctc

SEQ ID NO: 8213246 - DNA, 22 bp, Homo sapiens
ctgtcaggaagctgggcatcca

SEQ ID NO: 8213247 - DNA, 22 bp, Homo sapiens
ctgtcaggaagctgggcatcca

SEQ ID NO: 8213248 - DNA, 22 bp, Homo sapiens
ctgtcaggaagctgggcatcca

SEQ ID NO: 8213249 - DNA, 22 bp, Homo sapiens
ctgtcagcttctcctggccaga

SEQ ID NO: 8213250 - DNA, 22 bp, Homo sapiens
ctgtcagcttctcctggccaga

SEQ ID NO: 8213251 - DNA, 18 bp, Homo sapiens
ctgtcagcagcttcacga

SEQ ID NO: 8213252 - DNA, 19 bp, Homo sapiens
ctgtcaggggctggatgtt

SEQ ID NO: 8213253 - DNA, 22 bp, Homo sapiens
ctgtcagggggcctggccatca

SEQ ID NO: 8213254 - DNA, 19 bp, Homo sapiens
ctgtcaggggctggatgtt

SEQ ID NO: 8213255 - DNA, 19 bp, Homo sapiens
ctgtcaggggctggatgtt

SEQ ID NO: 8213256 - DNA, 19 bp, Homo sapiens
ctgtcaggggctggatgtt

SEQ ID NO: 8213257 - DNA, 22 bp, Homo sapiens
ctgtcaggggcgggtggagcgg

SEQ ID NO: 8213258 - DNA, 22 bp, Homo sapiens
ctgtcaggggcgggtggagcgg

SEQ ID NO: 8213259 - DNA, 22 bp, Homo sapiens
ctgtcacctgttcactgcagca

SEQ ID NO: 8213260 - DNA, 22 bp, Homo sapiens
ctgtcacctgttcactgcagca

SEQ ID NO: 8213261 - DNA, 22 bp, Homo sapiens
ctgtcacctgttcactgcagca

SEQ ID NO: 8213262 - DNA, 22 bp, Homo sapiens
ctgtcagcactctactacagat

SEQ ID NO: 8213263 - DNA, 22 bp, Homo sapiens
ctgtcacttaaattcaggctga

SEQ ID NO: 8213264 - DNA, 22 bp, Homo sapiens
ctgtcactgatgggctcaccag

SEQ ID NO: 8213265 - DNA, 19 bp, Homo sapiens
ctgtccttggctgcactgt

SEQ ID NO: 8213266 - DNA, 22 bp, Homo sapiens
ctgtctctgttgcctgtaggtg

SEQ ID NO: 8213267 - DNA, 19 bp, Homo sapiens
ctgtccttggctgcactgt

SEQ ID NO: 8213268 - DNA, 22 bp, Homo sapiens
ctgtctgccaataatctatggc

SEQ ID NO: 8213269 - DNA, 22 bp, Homo sapiens
ctgtctgccctggccagagccc

SEQ ID NO: 8213270 - DNA, 22 bp, Homo sapiens
ctgtcctgtggacctgaggacg

SEQ ID NO: 8213271 - DNA, 22 bp, Homo sapiens
ctgtcagtaggctcccatcatt

SEQ ID NO: 8213272 - DNA, 22 bp, Homo sapiens
ctgtcaggtttcccggctcacg

SEQ ID NO: 8213273 - DNA, 22 bp, Homo sapiens
ctgtcaggtttcccatctgcaa

SEQ ID NO: 8213274 - DNA, 22 bp, Homo sapiens
ctgtcaggtttcccatctgcaa

SEQ ID NO: 8213275 - DNA, 22 bp, Homo sapiens
ctgtcaggtttcccatctgcaa

SEQ ID NO: 8213276 - DNA, 22 bp, Homo sapiens
ctgtcaggtttcccatctgcaa

SEQ ID NO: 8213277 - DNA, 22 bp, Homo sapiens
ctgtcctgtggtgacaggtaca

SEQ ID NO: 8213278 - DNA, 22 bp, Homo sapiens
ctgtcctgtgtcagcctgaaat

SEQ ID NO: 8213279 - DNA, 22 bp, Homo sapiens
ctgtccttactgcttctggctt

SEQ ID NO: 8213280 - DNA, 22 bp, Homo sapiens
ctgtgctggtccagggagctgg

SEQ ID NO: 8213281 - DNA, 22 bp, Homo sapiens
ctgtgctgggtgtgcttatgat

SEQ ID NO: 8213282 - DNA, 22 bp, Homo sapiens
ctgtgctggcagcaatcaagga

SEQ ID NO: 8213283 - DNA, 22 bp, Homo sapiens
ctgtgctgtcttgggagcctta

SEQ ID NO: 8213284 - DNA, 22 bp, Homo sapiens
ctgtgctggtccagggagctgg

SEQ ID NO: 8213285 - DNA, 22 bp, Homo sapiens
ctgtgctggtgaaacccacaga

SEQ ID NO: 8213286 - DNA, 22 bp, Homo sapiens
ctgtgctggagatgggccagag

SEQ ID NO: 8213287 - DNA, 22 bp, Homo sapiens
ctgtgctggcagacctggagtt

SEQ ID NO: 8213288 - DNA, 22 bp, Homo sapiens
ctgtgctggattctgaggctac

SEQ ID NO: 8213289 - DNA, 22 bp, Homo sapiens
ctgtgctggagatgggccagag

SEQ ID NO: 8213290 - DNA, 22 bp, Homo sapiens
ctgtgctgctagacctggattc

SEQ ID NO: 8213291 - DNA, 22 bp, Homo sapiens
ctgtgctctggcatcgctgcaa

SEQ ID NO: 8213292 - DNA, 17 bp, Homo sapiens
ctgtgctcgagtgatgg

SEQ ID NO: 8213293 - DNA, 22 bp, Homo sapiens
ctgtgctgaacaattctgcatt

SEQ ID NO: 8213294 - DNA, 22 bp, Homo sapiens
ctgtgctgaggatgcagtttct

SEQ ID NO: 8213295 - DNA, 22 bp, Homo sapiens
ctgtgctgattcagcacaggcc

SEQ ID NO: 8213296 - DNA, 22 bp, Homo sapiens
ctgtgctgattcagcacaggcc

SEQ ID NO: 8213297 - DNA, 22 bp, Homo sapiens
ctgtgctgattcagcacaggcc

SEQ ID NO: 8213298 - DNA, 17 bp, Homo sapiens
ctgtgctcgagtgatgg

SEQ ID NO: 8213299 - DNA, 22 bp, Homo sapiens
ctgtgccctgtggctggcacct

SEQ ID NO: 8213300 - DNA, 22 bp, Homo sapiens
ctgtgccctgtggctggcacct

SEQ ID NO: 8213301 - DNA, 22 bp, Homo sapiens
ctgtgccctggccaggcctctc

SEQ ID NO: 8213302 - DNA, 22 bp, Homo sapiens
ctgtgccctggccaggcctctc

SEQ ID NO: 8213303 - DNA, 18 bp, Homo sapiens
ctgtgccctgctcctact

SEQ ID NO: 8213304 - DNA, 22 bp, Homo sapiens
ctgtgccctggccaggcctctc

SEQ ID NO: 8213305 - DNA, 19 bp, Homo sapiens
ctgtctggttcatgtgttc

SEQ ID NO: 8213306 - DNA, 22 bp, Homo sapiens
ctgtctgtactgagagttctgt

SEQ ID NO: 8213307 - DNA, 22 bp, Homo sapiens
ctgtctgtgacctctgcatgtc

SEQ ID NO: 8213308 - DNA, 19 bp, Homo sapiens
ctgtctgtgcagagatgtg

SEQ ID NO: 8213309 - DNA, 19 bp, Homo sapiens
ctgtctgtgcagagatgtg

SEQ ID NO: 8213310 - DNA, 22 bp, Homo sapiens
ctgtctgggtctacatcctctg

SEQ ID NO: 8213311 - DNA, 22 bp, Homo sapiens
ctgtctggatataccttggcca

SEQ ID NO: 8213312 - DNA, 22 bp, Homo sapiens
ctgtctggatgtgagtcaccta

SEQ ID NO: 8213313 - DNA, 21 bp, Homo sapiens
ctgtctggccgcgggctccgc

SEQ ID NO: 8213314 - DNA, 22 bp, Homo sapiens
ctgtctggaatgcagtacatag

SEQ ID NO: 8213315 - DNA, 22 bp, Homo sapiens
ctgtctgctcataatggagggc

SEQ ID NO: 8213316 - DNA, 19 bp, Homo sapiens
ctgtctgcggggcctgttc

SEQ ID NO: 8213317 - DNA, 22 bp, Homo sapiens
ctgtacatctctgaggacagta

SEQ ID NO: 8213318 - DNA, 22 bp, Homo sapiens
ctgtacatcccgagagccagta

SEQ ID NO: 8213319 - DNA, 22 bp, Homo sapiens
ctgtacatcttaaatggaaaaa

SEQ ID NO: 8213320 - DNA, 22 bp, Homo sapiens
ctgtacatcccgagagccagta

SEQ ID NO: 8213321 - DNA, 22 bp, Homo sapiens
ctgtacatcccaagatatttct

SEQ ID NO: 8213322 - DNA, 22 bp, Homo sapiens
ctgtacatatgtctccagagtg

SEQ ID NO: 8213323 - DNA, 22 bp, Homo sapiens
ctgtacatatacatttttttcc

SEQ ID NO: 8213324 - DNA, 20 bp, Homo sapiens
ctgtacatcaccaaggtgac

SEQ ID NO: 8213325 - DNA, 22 bp, Homo sapiens
ctgtagaacgatccaggcattt

SEQ ID NO: 8213326 - DNA, 22 bp, Homo sapiens
ctgtagagaaagcatggaagct

SEQ ID NO: 8213327 - DNA, 22 bp, Homo sapiens
ctgtagagaaagcatggaagct

SEQ ID NO: 8213328 - DNA, 22 bp, Homo sapiens
ctgtagccagaagcagaaggcc

SEQ ID NO: 8213329 - DNA, 22 bp, Homo sapiens
ctgtagccagaagcagaaggcc

SEQ ID NO: 8213330 - DNA, 22 bp, Homo sapiens
ctgtagccagtttggcctcacc

SEQ ID NO: 8213331 - DNA, 19 bp, Homo sapiens
ctgtacaggttgcttctgg

SEQ ID NO: 8213332 - DNA, 19 bp, Homo sapiens
ctgtacaggttgcttctgg

SEQ ID NO: 8213333 - DNA, 22 bp, Homo sapiens
ctgtacagagttctgagtgtac

SEQ ID NO: 8213334 - DNA, 22 bp, Homo sapiens
ctgtacaggagacgtctgtgca

SEQ ID NO: 8213335 - DNA, 22 bp, Homo sapiens
ctgtacagaagctagagcaaat

SEQ ID NO: 8213336 - DNA, 22 bp, Homo sapiens
ctgtacaatgttacctatttat

SEQ ID NO: 8213337 - DNA, 22 bp, Homo sapiens
ctgtacaatgttacctatttat

SEQ ID NO: 8213338 - DNA, 22 bp, Homo sapiens
ctgtacaagtccttcatcaggg

SEQ ID NO: 8213339 - DNA, 22 bp, Homo sapiens
ctgtaaaacactgtagtatctg

SEQ ID NO: 8213340 - DNA, 22 bp, Homo sapiens
ctggtgccattctgtggcctag

SEQ ID NO: 8213341 - DNA, 22 bp, Homo sapiens
ctggtgccctgtgtggcaggag

SEQ ID NO: 8213342 - DNA, 22 bp, Homo sapiens
ctggtgccattctgtggcctag

SEQ ID NO: 8213343 - DNA, 22 bp, Homo sapiens
ctggtgccattctgtggcctag

SEQ ID NO: 8213344 - DNA, 22 bp, Homo sapiens
ctggtgccctgtgtggcaggag

SEQ ID NO: 8213345 - DNA, 22 bp, Homo sapiens
ctggtgccctgtgtggcaggag

SEQ ID NO: 8213346 - DNA, 22 bp, Homo sapiens
ctggtttttagtgcttaggagt

SEQ ID NO: 8213347 - DNA, 22 bp, Homo sapiens
ctgtacaaaagaaagttcctat

SEQ ID NO: 8213348 - DNA, 22 bp, Homo sapiens
ctgtacaaagtagctgctggga

SEQ ID NO: 8213349 - DNA, 22 bp, Homo sapiens
ctgtacaaatggcagttgagtt

SEQ ID NO: 8213350 - DNA, 20 bp, Homo sapiens
ctgtaaaccaggcttcttgg

SEQ ID NO: 8213351 - DNA, 22 bp, Homo sapiens
ctggtgagactcagggatgctt

SEQ ID NO: 8213352 - DNA, 22 bp, Homo sapiens
ctggtgagacggttgacaggag

SEQ ID NO: 8213353 - DNA, 22 bp, Homo sapiens
ctggtgaccttgccccaggtca

SEQ ID NO: 8213354 - DNA, 22 bp, Homo sapiens
ctggtgaccggacctcagtttt

SEQ ID NO: 8213355 - DNA, 22 bp, Homo sapiens
ctggtgagactcagggatgctt

SEQ ID NO: 8213356 - DNA, 22 bp, Homo sapiens
ctggtgcaaggctttggaatcc

SEQ ID NO: 8213357 - DNA, 22 bp, Homo sapiens
ctggtgcaggaaggagctggca

SEQ ID NO: 8213358 - DNA, 22 bp, Homo sapiens
ctggtgcaggaaggagctggca

SEQ ID NO: 8213359 - DNA, 22 bp, Homo sapiens
ctggtgcacatgaaagagaagg

SEQ ID NO: 8213360 - DNA, 22 bp, Homo sapiens
ctggtgcacattcgctctcata

SEQ ID NO: 8213361 - DNA, 22 bp, Homo sapiens
ctggggagacgatcgatgttct

SEQ ID NO: 8213362 - DNA, 22 bp, Homo sapiens
ctggggactttggttctccatg

SEQ ID NO: 8213363 - DNA, 22 bp, Homo sapiens
ctggggagaagcgactcggctg

SEQ ID NO: 8213364 - DNA, 22 bp, Homo sapiens
ctggggagaagcgactcggctg

SEQ ID NO: 8213365 - DNA, 22 bp, Homo sapiens
ctggggaatagagctggagacc

SEQ ID NO: 8213366 - DNA, 22 bp, Homo sapiens
ctggggaatagagctggagacc

SEQ ID NO: 8213367 - DNA, 22 bp, Homo sapiens
ctggggaaggcggtgactgcgc

SEQ ID NO: 8213368 - DNA, 22 bp, Homo sapiens
ctggggaatagagctggagacc

SEQ ID NO: 8213369 - DNA, 20 bp, Homo sapiens
ctggggacagcaatggctgt

SEQ ID NO: 8213370 - DNA, 22 bp, Homo sapiens
ctggggacgtcgggcagtgttc

SEQ ID NO: 8213371 - DNA, 22 bp, Homo sapiens
ctggggacgtcgggcagtgttc

SEQ ID NO: 8213372 - DNA, 22 bp, Homo sapiens
ctggggactcattcagagcata

SEQ ID NO: 8213373 - DNA, 22 bp, Homo sapiens
ctggggactcattcagagcata

SEQ ID NO: 8213374 - DNA, 22 bp, Homo sapiens
ctgggctttggtactgtgatta

SEQ ID NO: 8213375 - DNA, 22 bp, Homo sapiens
ctgggctttgaagccaggctgc

SEQ ID NO: 8213376 - DNA, 22 bp, Homo sapiens
ctgggctttggtactgtgatta

SEQ ID NO: 8213377 - DNA, 22 bp, Homo sapiens
ctgggcttttgagtcacaaggg

SEQ ID NO: 8213378 - DNA, 22 bp, Homo sapiens
ctgggctttgaagccaggctgc

SEQ ID NO: 8213379 - DNA, 21 bp, Homo sapiens
ctgggctttctctcaaagaca

SEQ ID NO: 8213380 - DNA, 22 bp, Homo sapiens
ctggggaacaatttgccacact

SEQ ID NO: 8213381 - DNA, 22 bp, Homo sapiens
ctgggcttttgagtcacaaggg

SEQ ID NO: 8213382 - DNA, 22 bp, Homo sapiens
ctggggaacgcagcgagcagcg

SEQ ID NO: 8213383 - DNA, 22 bp, Homo sapiens
ctggggaacgcagcgagcagcg

SEQ ID NO: 8213384 - DNA, 22 bp, Homo sapiens
ctggggaacgcagcgagcagcg

SEQ ID NO: 8213385 - DNA, 22 bp, Homo sapiens
ctgggctttcaggccctaaggc

SEQ ID NO: 8213386 - DNA, 22 bp, Homo sapiens
ctgggctttcaggccctaaggc

SEQ ID NO: 8213387 - DNA, 22 bp, Homo sapiens
ctgggcttgtgttagctgacaa

SEQ ID NO: 8213388 - DNA, 19 bp, Homo sapiens
ctgggcttgatgttgagtt

SEQ ID NO: 8213389 - DNA, 22 bp, Homo sapiens
ctgggcttgcactgcagcgaga

SEQ ID NO: 8213390 - DNA, 22 bp, Homo sapiens
ctgggcttgcactgcagcgaga

SEQ ID NO: 8213391 - DNA, 22 bp, Homo sapiens
ctgggcttgagttcctgctcgt

SEQ ID NO: 8213392 - DNA, 22 bp, Homo sapiens
ctgggcttgagttcctgctcgt

SEQ ID NO: 8213393 - DNA, 22 bp, Homo sapiens
ctgggcttctccccctggcaga

SEQ ID NO: 8213394 - DNA, 22 bp, Homo sapiens
ctgggcttctccccctggcaga

SEQ ID NO: 8213395 - DNA, 22 bp, Homo sapiens
ctgggcttaggacctggtgcgg

SEQ ID NO: 8213396 - DNA, 22 bp, Homo sapiens
ctgggcttaggacctggtgcgg

SEQ ID NO: 8213397 - DNA, 22 bp, Homo sapiens
ctgggcttaggacctggtgcgg

SEQ ID NO: 8213398 - DNA, 22 bp, Homo sapiens
ctggtctggtttgtttagacag

SEQ ID NO: 8213399 - DNA, 22 bp, Homo sapiens
ctggtctgggatgagggatgta

SEQ ID NO: 8213400 - DNA, 22 bp, Homo sapiens
ctggtctgggatgagggatgta

SEQ ID NO: 8213401 - DNA, 22 bp, Homo sapiens
ctggtctggctagtttaggcca

SEQ ID NO: 8213402 - DNA, 21 bp, Homo sapiens
ctggtctggccaataaggtcc

SEQ ID NO: 8213403 - DNA, 22 bp, Homo sapiens
ctggtctggctacccagcgaat

SEQ ID NO: 8213404 - DNA, 21 bp, Homo sapiens
ctggtctggccaataaggtcc

SEQ ID NO: 8213405 - DNA, 22 bp, Homo sapiens
ctggtctggctacccagcgaat

SEQ ID NO: 8213406 - DNA, 19 bp, Homo sapiens
ctggtctgtcatgctcccc

SEQ ID NO: 8213407 - DNA, 22 bp, Homo sapiens
ctggtctgtccgcaggtcacct

SEQ ID NO: 8213408 - DNA, 16 bp, Homo sapiens
ctggtcttgctgccga

SEQ ID NO: 8213409 - DNA, 22 bp, Homo sapiens
ctggtctgtccgcaggtcacct

SEQ ID NO: 8213410 - DNA, 22 bp, Homo sapiens
ctggtctgtggtattttattat

SEQ ID NO: 8213411 - DNA, 16 bp, Homo sapiens
ctggtcttgctgccga

SEQ ID NO: 8213412 - DNA, 22 bp, Homo sapiens
ctggtctgaaaaggaggcatgc

SEQ ID NO: 8213413 - DNA, 22 bp, Homo sapiens
ctggtctgagggctcttgaggc

SEQ ID NO: 8213414 - DNA, 22 bp, Homo sapiens
ctggtctgaggttgcccttgaa

SEQ ID NO: 8213415 - DNA, 22 bp, Homo sapiens
ctggtctgagggctcttgaggc

SEQ ID NO: 8213416 - DNA, 22 bp, Homo sapiens
ctggtctgccacccacacccct

SEQ ID NO: 8213417 - DNA, 22 bp, Homo sapiens
ctggtctgaggttgcccttgaa

SEQ ID NO: 8213418 - DNA, 22 bp, Homo sapiens
ctggtctgcaaggccatataga

SEQ ID NO: 8213419 - DNA, 20 bp, Homo sapiens
ctggtctgccactcacagtt

SEQ ID NO: 8213420 - DNA, 20 bp, Homo sapiens
ctggtctgccactcacagtt

SEQ ID NO: 8213421 - DNA, 20 bp, Homo sapiens
ctggtctgccactcacagtt

SEQ ID NO: 8213422 - DNA, 22 bp, Homo sapiens
ctggtctgcgggaaggcgtggg

SEQ ID NO: 8213423 - DNA, 22 bp, Homo sapiens
ctggtctgctagaaagatgcat

SEQ ID NO: 8213424 - DNA, 22 bp, Homo sapiens
ctggtctgcgggaaggcgtggg

SEQ ID NO: 8213425 - DNA, 22 bp, Homo sapiens
ctggtctgctagaaagatgcat

SEQ ID NO: 8213426 - DNA, 19 bp, Homo sapiens
ctggtctgctgcttccagg

SEQ ID NO: 8213427 - DNA, 19 bp, Homo sapiens
ctggtctgctgcttccagg

SEQ ID NO: 8213428 - DNA, 20 bp, Homo sapiens
ctggggagcctcgcggtggc

SEQ ID NO: 8213429 - DNA, 20 bp, Homo sapiens
ctggggagcctcgcggtggc

SEQ ID NO: 8213430 - DNA, 20 bp, Homo sapiens
ctggggagctgctcccacga

SEQ ID NO: 8213431 - DNA, 20 bp, Homo sapiens
ctggggagctgctcccacga

SEQ ID NO: 8213432 - DNA, 22 bp, Homo sapiens
ctggtcactcctccacctgctt

SEQ ID NO: 8213433 - DNA, 22 bp, Homo sapiens
ctggtctgaaaaggaggcatgc

SEQ ID NO: 8213434 - DNA, 18 bp, Homo sapiens
ctggtctcccttcgcttt

SEQ ID NO: 8213435 - DNA, 18 bp, Homo sapiens
ctggtctcccttcgcttt

SEQ ID NO: 8213436 - DNA, 22 bp, Homo sapiens
ctggtcagctgaagccccacac

SEQ ID NO: 8213437 - DNA, 23 bp, Homo sapiens
ctggtcagaggctgctggaaggg

SEQ ID NO: 8213438 - DNA, 23 bp, Homo sapiens
ctggtcagaggctgctggaaggg

SEQ ID NO: 8213439 - DNA, 22 bp, Homo sapiens
ctggtcagagcaactgctcaca

SEQ ID NO: 8213440 - DNA, 22 bp, Homo sapiens
ctgggcgcgtcccctgaggcgg

SEQ ID NO: 8213441 - DNA, 22 bp, Homo sapiens
ctgggcgtgtcttccagctggc

SEQ ID NO: 8213442 - DNA, 22 bp, Homo sapiens
ctgggctaattaagcacagctg

SEQ ID NO: 8213443 - DNA, 22 bp, Homo sapiens
ctgggctacgtgttgacagcat

SEQ ID NO: 8213444 - DNA, 22 bp, Homo sapiens
ctgggcctttgggagttcggtg

SEQ ID NO: 8213445 - DNA, 22 bp, Homo sapiens
ctgggccttggattgacactgt

SEQ ID NO: 8213446 - DNA, 22 bp, Homo sapiens
ctgggccttggattgacactgt

SEQ ID NO: 8213447 - DNA, 22 bp, Homo sapiens
ctgggccttggattgacactgt

SEQ ID NO: 8213448 - DNA, 22 bp, Homo sapiens
ctgggccttggattgacactgt

SEQ ID NO: 8213449 - DNA, 22 bp, Homo sapiens
ctgggccttggattgacactgt

SEQ ID NO: 8213450 - DNA, 22 bp, Homo sapiens
ctgggctggagtgcaatggcgc

SEQ ID NO: 8213451 - DNA, 22 bp, Homo sapiens
ctgggctcaaatcctatctcca

SEQ ID NO: 8213452 - DNA, 22 bp, Homo sapiens
ctgggctggagtgcaatggcgc

SEQ ID NO: 8213453 - DNA, 22 bp, Homo sapiens
ctgggctggagtgcaatggcgc

SEQ ID NO: 8213454 - DNA, 22 bp, Homo sapiens
ctgggctggagtgcaatggcgc

SEQ ID NO: 8213455 - DNA, 22 bp, Homo sapiens
ctgggctggataattctttgct

SEQ ID NO: 8213456 - DNA, 21 bp, Homo sapiens
ctgggctggcaggcattacct

SEQ ID NO: 8213457 - DNA, 22 bp, Homo sapiens
ctgggcttagcagctcctggtc

SEQ ID NO: 8213458 - DNA, 22 bp, Homo sapiens
ctgggcttagcagctcctggtc

SEQ ID NO: 8213459 - DNA, 22 bp, Homo sapiens
ctgggctgtttgtttagaatgg

SEQ ID NO: 8213460 - DNA, 22 bp, Homo sapiens
ctgggcttaggacctggtgcgg

SEQ ID NO: 8213461 - DNA, 22 bp, Homo sapiens
ctgggcttagcagctcctggtc

SEQ ID NO: 8213462 - DNA, 22 bp, Homo sapiens
ctgggcttagcagctcctggtc

SEQ ID NO: 8213463 - DNA, 22 bp, Homo sapiens
ctgggcttagcagctcctggtc

SEQ ID NO: 8213464 - DNA, 22 bp, Homo sapiens
ctgggctggcgcatccgacacg

SEQ ID NO: 8213465 - DNA, 22 bp, Homo sapiens
ctgggctggcgcatccgacacg

SEQ ID NO: 8213466 - DNA, 22 bp, Homo sapiens
ctgggctgtttgttctggtctc

SEQ ID NO: 8213467 - DNA, 22 bp, Homo sapiens
ctgggctgtttgttctggtctc

SEQ ID NO: 8213468 - DNA, 22 bp, Homo sapiens
ctgggccttagggcactccctt

SEQ ID NO: 8213469 - DNA, 22 bp, Homo sapiens
ctgggccttatgagtacctgga

SEQ ID NO: 8213470 - DNA, 22 bp, Homo sapiens
ctgggccttcattgctctccca

SEQ ID NO: 8213471 - DNA, 22 bp, Homo sapiens
ctgggccttcattgctctccca

SEQ ID NO: 8213472 - DNA, 22 bp, Homo sapiens
ctgggccttgcatcccagagcc

SEQ ID NO: 8213473 - DNA, 22 bp, Homo sapiens
ctgggccttgatcacacaggtg

SEQ ID NO: 8213474 - DNA, 22 bp, Homo sapiens
ctgggccttagggcactccctt

SEQ ID NO: 8213475 - DNA, 22 bp, Homo sapiens
ctgggcctgtgggcacacggac

SEQ ID NO: 8213476 - DNA, 17 bp, Homo sapiens
ctgggcctcccctgtcc

SEQ ID NO: 8213477 - DNA, 22 bp, Homo sapiens
ctgggcctggtgtggcacctgc

SEQ ID NO: 8213478 - DNA, 22 bp, Homo sapiens
ctgggcagagctaacacctgag

SEQ ID NO: 8213479 - DNA, 22 bp, Homo sapiens
ctgggcagagtccggaagatgg

SEQ ID NO: 8213480 - DNA, 22 bp, Homo sapiens
ctgggcagcctcacacaatgtt

SEQ ID NO: 8213481 - DNA, 22 bp, Homo sapiens
ctgggcagcacatcatcgtatc

SEQ ID NO: 8213482 - DNA, 22 bp, Homo sapiens
ctgggcagaattttaggatggc

SEQ ID NO: 8213483 - DNA, 22 bp, Homo sapiens
ctgggcagaattttaggatggc

SEQ ID NO: 8213484 - DNA, 22 bp, Homo sapiens
ctgggcactttggggagcctac

SEQ ID NO: 8213485 - DNA, 22 bp, Homo sapiens
ctgggcacttgctcacagctct

SEQ ID NO: 8213486 - DNA, 22 bp, Homo sapiens
ctgggcactttggggagcctac

SEQ ID NO: 8213487 - DNA, 22 bp, Homo sapiens
ctgggcagaattttaggatggc

SEQ ID NO: 8213488 - DNA, 22 bp, Homo sapiens
ctgggcagctaccaccactgct

SEQ ID NO: 8213489 - DNA, 22 bp, Homo sapiens
ctgggcagctccataccaccca

SEQ ID NO: 8213490 - DNA, 22 bp, Homo sapiens
ctgggcagctaccaccactgct

SEQ ID NO: 8213491 - DNA, 22 bp, Homo sapiens
ctgggcagctaccaccactgct

SEQ ID NO: 8213492 - DNA, 22 bp, Homo sapiens
ctgggcagctgtgcaaacaata

SEQ ID NO: 8213493 - DNA, 22 bp, Homo sapiens
ctgggcagctgtatcagggagt

SEQ ID NO: 8213494 - DNA, 22 bp, Homo sapiens
ctgggcagctgtatcagggagt

SEQ ID NO: 8213495 - DNA, 22 bp, Homo sapiens
ctgggcagctgtatcagggagt

SEQ ID NO: 8213496 - DNA, 22 bp, Homo sapiens
ctgggcagctgtatcagggagt

SEQ ID NO: 8213497 - DNA, 22 bp, Homo sapiens
ctgggcagctgtatcagggagt

SEQ ID NO: 8213498 - DNA, 22 bp, Homo sapiens
ctgggcagctgtatcagggagt

SEQ ID NO: 8213499 - DNA, 22 bp, Homo sapiens
ctgggagcggctgtcactggtt

SEQ ID NO: 8213500 - DNA, 22 bp, Homo sapiens
ctgggatgtgaggagcgcctct

SEQ ID NO: 8213501 - DNA, 22 bp, Homo sapiens
ctgggatgtgaggagcgcctct

SEQ ID NO: 8213502 - DNA, 22 bp, Homo sapiens
ctgggcaatatgctgggcctgg

SEQ ID NO: 8213503 - DNA, 22 bp, Homo sapiens
ctgggatgtgaggagcgcctct

SEQ ID NO: 8213504 - DNA, 17 bp, Homo sapiens
ctgggatgtggactctt

SEQ ID NO: 8213505 - DNA, 22 bp, Homo sapiens
ctgggcacttgctcacagctct

SEQ ID NO: 8213506 - DNA, 22 bp, Homo sapiens
ctgggcacttgctcacagctct

SEQ ID NO: 8213507 - DNA, 22 bp, Homo sapiens
ctgggcacttgctcacagctct

SEQ ID NO: 8213508 - DNA, 22 bp, Homo sapiens
ctgggcactgcagcaggcatca

SEQ ID NO: 8213509 - DNA, 22 bp, Homo sapiens
ctgggagcgcagcaggcacaac

SEQ ID NO: 8213510 - DNA, 22 bp, Homo sapiens
ctgggagcccgcgtcctggtgg

SEQ ID NO: 8213511 - DNA, 22 bp, Homo sapiens
ctgggagccctgactagcctgg

SEQ ID NO: 8213512 - DNA, 22 bp, Homo sapiens
ctgggagcaccatacttgtttc

SEQ ID NO: 8213513 - DNA, 22 bp, Homo sapiens
ctgggagcaagaggctgcaaat

SEQ ID NO: 8213514 - DNA, 22 bp, Homo sapiens
ctgggagatctgttgggactgg

SEQ ID NO: 8213515 - DNA, 22 bp, Homo sapiens
ctgggagatgactcagagcagg

SEQ ID NO: 8213516 - DNA, 22 bp, Homo sapiens
ctgggagatgactcagagcagg

SEQ ID NO: 8213517 - DNA, 22 bp, Homo sapiens
ctgggagatctgttgggactgg

SEQ ID NO: 8213518 - DNA, 22 bp, Homo sapiens
ctgggagatctgttgggactgg

SEQ ID NO: 8213519 - DNA, 22 bp, Homo sapiens
ctgggagatctcctgagggcag

SEQ ID NO: 8213520 - DNA, 22 bp, Homo sapiens
ctgggagatctcctgagggcag

SEQ ID NO: 8213521 - DNA, 22 bp, Homo sapiens
ctgggagattgaggccatggtg

SEQ ID NO: 8213522 - DNA, 22 bp, Homo sapiens
ctgggagattgaggccatggtg

SEQ ID NO: 8213523 - DNA, 22 bp, Homo sapiens
ctgggagattgctagagatgca

SEQ ID NO: 8213524 - DNA, 22 bp, Homo sapiens
ctgggagattgctagagatgca

SEQ ID NO: 8213525 - DNA, 22 bp, Homo sapiens
ctgggagattgaggccatggtg

SEQ ID NO: 8213526 - DNA, 22 bp, Homo sapiens
ctgggagattgaggccatggtg

SEQ ID NO: 8213527 - DNA, 22 bp, Homo sapiens
ctgggagatatgaggatctgga

SEQ ID NO: 8213528 - DNA, 22 bp, Homo sapiens
ctgggagaggtggtgggaagta

SEQ ID NO: 8213529 - DNA, 22 bp, Homo sapiens
ctgggagaggtggtgggaagta

SEQ ID NO: 8213530 - DNA, 22 bp, Homo sapiens
ctgggagatctcctgagggcag

SEQ ID NO: 8213531 - DNA, 22 bp, Homo sapiens
ctgggacttgcagagcaggagg

SEQ ID NO: 8213532 - DNA, 22 bp, Homo sapiens
ctgggacttgatgaaatgactg

SEQ ID NO: 8213533 - DNA, 22 bp, Homo sapiens
ctgggactggacctctgcctgg

SEQ ID NO: 8213534 - DNA, 22 bp, Homo sapiens
ctgggactgggtcctcaggaca

SEQ ID NO: 8213535 - DNA, 22 bp, Homo sapiens
ctgggactgggtcctcaggaca

SEQ ID NO: 8213536 - DNA, 22 bp, Homo sapiens
ctgggagaggctgctccgctct

SEQ ID NO: 8213537 - DNA, 22 bp, Homo sapiens
ctgggacttgtagtctcggcgc

SEQ ID NO: 8213538 - DNA, 22 bp, Homo sapiens
ctgggacttgggctatgctctg

SEQ ID NO: 8213539 - DNA, 22 bp, Homo sapiens
ctgggacttgcagagcaggagg

SEQ ID NO: 8213540 - DNA, 22 bp, Homo sapiens
ctgggaccatctgtgtctactt

SEQ ID NO: 8213541 - DNA, 22 bp, Homo sapiens
ctgggaccctgccctgtggcct

SEQ ID NO: 8213542 - DNA, 22 bp, Homo sapiens
ctgggactgccattcacagcca

SEQ ID NO: 8213543 - DNA, 22 bp, Homo sapiens
ctgggactggacctctgcctgg

SEQ ID NO: 8213544 - DNA, 22 bp, Homo sapiens
ctgggactggacctctgcctgg

SEQ ID NO: 8213545 - DNA, 19 bp, Homo sapiens
ctgggactcctgatacctt

SEQ ID NO: 8213546 - DNA, 22 bp, Homo sapiens
ctgggactgccattcacagcca

SEQ ID NO: 8213547 - DNA, 22 bp, Homo sapiens
ctgggactcagaccagttctgt

SEQ ID NO: 8213548 - DNA, 22 bp, Homo sapiens
ctgggactcagaccagttctgt

SEQ ID NO: 8213549 - DNA, 18 bp, Homo sapiens
ctgggactcaatgctact

SEQ ID NO: 8213550 - DNA, 22 bp, Homo sapiens
ctgggacatattgctagtgttg

SEQ ID NO: 8213551 - DNA, 22 bp, Homo sapiens
ctgggacatagatcagcctttt

SEQ ID NO: 8213552 - DNA, 22 bp, Homo sapiens
ctgggacatattgctagtgttg

SEQ ID NO: 8213553 - DNA, 22 bp, Homo sapiens
ctgggacagctgagacaggaga

SEQ ID NO: 8213554 - DNA, 23 bp, Homo sapiens
ctgggacatggtaggggcacaac

SEQ ID NO: 8213555 - DNA, 22 bp, Homo sapiens
ctgggacatggtgctgtcttta

SEQ ID NO: 8213556 - DNA, 23 bp, Homo sapiens
ctgggacatggtaggggcacaac

SEQ ID NO: 8213557 - DNA, 22 bp, Homo sapiens
ctgggacatggtgctgtcttta

SEQ ID NO: 8213558 - DNA, 22 bp, Homo sapiens
ctgcttcctgctgggatactga

SEQ ID NO: 8213559 - DNA, 22 bp, Homo sapiens
ctgcttcctgctgggatactga

SEQ ID NO: 8213560 - DNA, 22 bp, Homo sapiens
ctgggaagaatccaagggccct

SEQ ID NO: 8213561 - DNA, 22 bp, Homo sapiens
ctgggaagatggtgacagaatt

SEQ ID NO: 8213562 - DNA, 22 bp, Homo sapiens
ctgggacacccaaggaaagagc

SEQ ID NO: 8213563 - DNA, 22 bp, Homo sapiens
ctgggacagagcagcagtgggg

SEQ ID NO: 8213564 - DNA, 22 bp, Homo sapiens
ctgggacacccagagctgcaga

SEQ ID NO: 8213565 - DNA, 22 bp, Homo sapiens
ctgcttccaagaaagagatagg

SEQ ID NO: 8213566 - DNA, 22 bp, Homo sapiens
ctgcttcatgtcctgggacctg

SEQ ID NO: 8213567 - DNA, 22 bp, Homo sapiens
ctgcttcatatttcatagtgat

SEQ ID NO: 8213568 - DNA, 22 bp, Homo sapiens
ctgcttcatatttcatagtgat

SEQ ID NO: 8213569 - DNA, 22 bp, Homo sapiens
ctgcttcatatttcatagtgat

SEQ ID NO: 8213570 - DNA, 19 bp, Homo sapiens
ctgcttcaggcgccttgcc

SEQ ID NO: 8213571 - DNA, 22 bp, Homo sapiens
ctgcttcatagccctggtctct

SEQ ID NO: 8213572 - DNA, 22 bp, Homo sapiens
ctgcttcatagccctggtctct

SEQ ID NO: 8213573 - DNA, 22 bp, Homo sapiens
ctgcttcacgttgtgccttgtt

SEQ ID NO: 8213574 - DNA, 22 bp, Homo sapiens
ctgcttcacttcggttgcatag

SEQ ID NO: 8213575 - DNA, 22 bp, Homo sapiens
ctgcttcacttcggttgcatag

SEQ ID NO: 8213576 - DNA, 22 bp, Homo sapiens
ctgcttcagcaaagctatttgc

SEQ ID NO: 8213577 - DNA, 19 bp, Homo sapiens
ctgcttcaggcgccttgcc

SEQ ID NO: 8213578 - DNA, 22 bp, Homo sapiens
ctgcttcacgttgtgccttgtt

SEQ ID NO: 8213579 - DNA, 22 bp, Homo sapiens
ctgcttcacgttgtgccttgtt

SEQ ID NO: 8213580 - DNA, 22 bp, Homo sapiens
ctgcttcaccctgcctgagaac

SEQ ID NO: 8213581 - DNA, 22 bp, Homo sapiens
ctgcttcaccctgcctgagaac

SEQ ID NO: 8213582 - DNA, 22 bp, Homo sapiens
ctgcttcaccctgcctgagaac

SEQ ID NO: 8213583 - DNA, 20 bp, Homo sapiens
ctgcttccaggctcaccccc

SEQ ID NO: 8213584 - DNA, 20 bp, Homo sapiens
ctgcttccaggctcaccccc

SEQ ID NO: 8213585 - DNA, 20 bp, Homo sapiens
ctgcttccaggctcaccccc

SEQ ID NO: 8213586 - DNA, 22 bp, Homo sapiens
ctgcttccataaataatgtgct

SEQ ID NO: 8213587 - DNA, 22 bp, Homo sapiens
ctgcttccatgcaatggcagtc

SEQ ID NO: 8213588 - DNA, 22 bp, Homo sapiens
ctgcttccatgcaatggcagtc

SEQ ID NO: 8213589 - DNA, 22 bp, Homo sapiens
ctgcttcctccctgtaaaggca

SEQ ID NO: 8213590 - DNA, 21 bp, Homo sapiens
ctgcttcctctcttcatggca

SEQ ID NO: 8213591 - DNA, 22 bp, Homo sapiens
ctgcttcctccctgtaaaggca

SEQ ID NO: 8213592 - DNA, 22 bp, Homo sapiens
ctgcttccatggtctggagact

SEQ ID NO: 8213593 - DNA, 22 bp, Homo sapiens
ctgctgttgccacctgcatgga

SEQ ID NO: 8213594 - DNA, 22 bp, Homo sapiens
ctgctgtgtttcacacctctgg

SEQ ID NO: 8213595 - DNA, 22 bp, Homo sapiens
ctgctgtgtttctgctagaaaa

SEQ ID NO: 8213596 - DNA, 23 bp, Homo sapiens
ctgctgtgttggtctcgatggga

SEQ ID NO: 8213597 - DNA, 22 bp, Homo sapiens
ctgctgtgttggcattggatag

SEQ ID NO: 8213598 - DNA, 22 bp, Homo sapiens
ctgctgtgttgccagtgtcacc

SEQ ID NO: 8213599 - DNA, 22 bp, Homo sapiens
ctgcttcacccaactttgggat

SEQ ID NO: 8213600 - DNA, 22 bp, Homo sapiens
ctgcttcacccaactttgggat

SEQ ID NO: 8213601 - DNA, 22 bp, Homo sapiens
ctgcttcacccaactttgggat

SEQ ID NO: 8213602 - DNA, 23 bp, Homo sapiens
ctgctgttttctgtacctgaagc

SEQ ID NO: 8213603 - DNA, 22 bp, Homo sapiens
ctgctgtttctcaaaattaagt

SEQ ID NO: 8213604 - DNA, 22 bp, Homo sapiens
ctgctgtgattgggagaaaccg

SEQ ID NO: 8213605 - DNA, 22 bp, Homo sapiens
ctgctgtgcaacattgcaccta

SEQ ID NO: 8213606 - DNA, 22 bp, Homo sapiens
ctgctgtgcacccaggaaggct

SEQ ID NO: 8213607 - DNA, 22 bp, Homo sapiens
ctgctgtgtggattcaatggct

SEQ ID NO: 8213608 - DNA, 22 bp, Homo sapiens
ctgctgtgtggtgaaactcagt

SEQ ID NO: 8213609 - DNA, 22 bp, Homo sapiens
ctgctgtgtggtgaaactcagt

SEQ ID NO: 8213610 - DNA, 22 bp, Homo sapiens
ctgctgtgttcctcctgcatct

SEQ ID NO: 8213611 - DNA, 22 bp, Homo sapiens
ctgctgtgttgccagtgtcacc

SEQ ID NO: 8213612 - DNA, 22 bp, Homo sapiens
ctgctgtgttgccagtgtcacc

SEQ ID NO: 8213613 - DNA, 22 bp, Homo sapiens
ctgctgtgttcctcctgcatct

SEQ ID NO: 8213614 - DNA, 22 bp, Homo sapiens
ctgctgtgttcctcctgcatct

SEQ ID NO: 8213615 - DNA, 22 bp, Homo sapiens
ctgctgtgttcctcctgcatct

SEQ ID NO: 8213616 - DNA, 20 bp, Homo sapiens
ctgctgtgtgtgcctcagcc

SEQ ID NO: 8213617 - DNA, 20 bp, Homo sapiens
ctgctgtgtgtgcctcagcc

SEQ ID NO: 8213618 - DNA, 20 bp, Homo sapiens
ctgctgtgtgtgcctcagcc

SEQ ID NO: 8213619 - DNA, 20 bp, Homo sapiens
ctgctgtgttattgtagaac

SEQ ID NO: 8213620 - DNA, 22 bp, Homo sapiens
ctgctgtgttagcaggtttagt

SEQ ID NO: 8213621 - DNA, 22 bp, Homo sapiens
ctgctgtgttagcaggtttagt

SEQ ID NO: 8213622 - DNA, 22 bp, Homo sapiens
ctgtttctttgctgtcagagag

SEQ ID NO: 8213623 - DNA, 22 bp, Homo sapiens
ctgtttctttgctgtcagagag

SEQ ID NO: 8213624 - DNA, 22 bp, Homo sapiens
ctgtttgtgatttctacgattt

SEQ ID NO: 8213625 - DNA, 22 bp, Homo sapiens
ctgtttgtgattagcagtgggt

SEQ ID NO: 8213626 - DNA, 22 bp, Homo sapiens
cttaaaatctggcagttagcta

SEQ ID NO: 8213627 - DNA, 22 bp, Homo sapiens
cttaaaatctggcagttagcta

SEQ ID NO: 8213628 - DNA, 22 bp, Homo sapiens
cttaaaatctggcagttagcta

SEQ ID NO: 8213629 - DNA, 22 bp, Homo sapiens
cttaaaatctggcagttagcta

SEQ ID NO: 8213630 - DNA, 22 bp, Homo sapiens
cttaaaatctggcagttagcta

SEQ ID NO: 8213631 - DNA, 22 bp, Homo sapiens
ctgtttttcagaaggtaaggga

SEQ ID NO: 8213632 - DNA, 22 bp, Homo sapiens
cttaaagaaattgaggagagga

SEQ ID NO: 8213633 - DNA, 22 bp, Homo sapiens
cttaaagaaattgaggagagga

SEQ ID NO: 8213634 - DNA, 22 bp, Homo sapiens
cttaaagaaattgaggagagga

SEQ ID NO: 8213635 - DNA, 20 bp, Homo sapiens
cttaaacacagagatagatt

SEQ ID NO: 8213636 - DNA, 20 bp, Homo sapiens
cttaaacacagagatagatt

SEQ ID NO: 8213637 - DNA, 22 bp, Homo sapiens
ctgtgcttcgcaactccaaggt

SEQ ID NO: 8213638 - DNA, 22 bp, Homo sapiens
ctgtgcttgcgggtgtggagcc

SEQ ID NO: 8213639 - DNA, 22 bp, Homo sapiens
ctgtgcttgtgttcattgttaa

SEQ ID NO: 8213640 - DNA, 22 bp, Homo sapiens
ctgtggaaataaacaatgctaa

SEQ ID NO: 8213641 - DNA, 22 bp, Homo sapiens
ctgtggaaaatgctttacatat

SEQ ID NO: 8213642 - DNA, 22 bp, Homo sapiens
ctgtggaaagagcctttggagg

SEQ ID NO: 8213643 - DNA, 22 bp, Homo sapiens
ctgtggaaaatttgtatgtaat

SEQ ID NO: 8213644 - DNA, 21 bp, Homo sapiens
ctgtgctttttaagtgtgatg

SEQ ID NO: 8213645 - DNA, 22 bp, Homo sapiens
ctgtgctttcaggccgctgtgt

SEQ ID NO: 8213646 - DNA, 22 bp, Homo sapiens
ctgtgctttcgagatgtgatct

SEQ ID NO: 8213647 - DNA, 22 bp, Homo sapiens
ctgtttaatgaggtgtaacaac

SEQ ID NO: 8213648 - DNA, 21 bp, Homo sapiens
ctgtggaagggaactagaggg

SEQ ID NO: 8213649 - DNA, 21 bp, Homo sapiens
ctgtggaagggaactagaggg

SEQ ID NO: 8213650 - DNA, 22 bp, Homo sapiens
ctgtggaagctgacacggtggt

SEQ ID NO: 8213651 - DNA, 22 bp, Homo sapiens
ctgtggaagagggtcaccagta

SEQ ID NO: 8213652 - DNA, 22 bp, Homo sapiens
ctgtggaagagggtcaccagta

SEQ ID NO: 8213653 - DNA, 19 bp, Homo sapiens
ctgtttctgagcttgcttt

SEQ ID NO: 8213654 - DNA, 21 bp, Homo sapiens
ctgtttcttgtgaagtgacac

SEQ ID NO: 8213655 - DNA, 22 bp, Homo sapiens
cttacattgtctcttgctgagc

SEQ ID NO: 8213656 - DNA, 22 bp, Homo sapiens
cttacagtgttgagggaattaa

SEQ ID NO: 8213657 - DNA, 22 bp, Homo sapiens
cttacagtgttgagggaattaa

SEQ ID NO: 8213658 - DNA, 22 bp, Homo sapiens
cttacagtgatcaacacaaaga

SEQ ID NO: 8213659 - DNA, 22 bp, Homo sapiens
cttacagtgatcaacacaaaga

SEQ ID NO: 8213660 - DNA, 22 bp, Homo sapiens
cttacagtgaccctgcagattt

SEQ ID NO: 8213661 - DNA, 22 bp, Homo sapiens
cttacagtgaccctgcagattt

SEQ ID NO: 8213662 - DNA, 22 bp, Homo sapiens
cttacagtgaccctgcagattt

SEQ ID NO: 8213663 - DNA, 22 bp, Homo sapiens
cttacagtgatcaacacaaaga

SEQ ID NO: 8213664 - DNA, 22 bp, Homo sapiens
cttacagtacttctaatatgat

SEQ ID NO: 8213665 - DNA, 22 bp, Homo sapiens
cttacagtacttctaatatgat

SEQ ID NO: 8213666 - DNA, 22 bp, Homo sapiens
cttacaggaaagaagaaagcat

SEQ ID NO: 8213667 - DNA, 22 bp, Homo sapiens
cttacagtacttctaatatgat

SEQ ID NO: 8213668 - DNA, 22 bp, Homo sapiens
cttacaagcaaaacaactgtag

SEQ ID NO: 8213669 - DNA, 22 bp, Homo sapiens
cttacaagaccaaagaaaggat

SEQ ID NO: 8213670 - DNA, 22 bp, Homo sapiens
cttacacactagatggtaggtg

SEQ ID NO: 8213671 - DNA, 22 bp, Homo sapiens
cttagaaatcgaactcaggtta

SEQ ID NO: 8213672 - DNA, 22 bp, Homo sapiens
cttaaagttgacacagtccctg

SEQ ID NO: 8213673 - DNA, 22 bp, Homo sapiens
cttaaattttcatctacaagaa

SEQ ID NO: 8213674 - DNA, 22 bp, Homo sapiens
cttaaattttcatctacaagaa

SEQ ID NO: 8213675 - DNA, 22 bp, Homo sapiens
cttaattacccaatgtggtagg

SEQ ID NO: 8213676 - DNA, 22 bp, Homo sapiens
cttacaaatacacttaggagag

SEQ ID NO: 8213677 - DNA, 22 bp, Homo sapiens
cttacaaatacacttaggagag

SEQ ID NO: 8213678 - DNA, 22 bp, Homo sapiens
cttacaaatacacttaggagag

SEQ ID NO: 8213679 - DNA, 22 bp, Homo sapiens
cttacaaaggagaggagatagg

SEQ ID NO: 8213680 - DNA, 22 bp, Homo sapiens
cttacaaaggagaggagatagg

SEQ ID NO: 8213681 - DNA, 22 bp, Homo sapiens
cttacaaatacacttaggagag

SEQ ID NO: 8213682 - DNA, 22 bp, Homo sapiens
cttaatttcaaactgctagtga

SEQ ID NO: 8213683 - DNA, 22 bp, Homo sapiens
cttaatttaagcctagaatgca

SEQ ID NO: 8213684 - DNA, 22 bp, Homo sapiens
cttaatttaaaatagttcaggc

SEQ ID NO: 8213685 - DNA, 22 bp, Homo sapiens
cttaatttttgtagtagatgga

SEQ ID NO: 8213686 - DNA, 22 bp, Homo sapiens
cttacaaaggagaggagatagg

SEQ ID NO: 8213687 - DNA, 22 bp, Homo sapiens
cttacaaaggagaggagatagg

SEQ ID NO: 8213688 - DNA, 22 bp, Homo sapiens
cttccaagtggggcacgtgcca

SEQ ID NO: 8213689 - DNA, 22 bp, Homo sapiens
cttccaagttgctctgctgacc

SEQ ID NO: 8213690 - DNA, 22 bp, Homo sapiens
cttccaagatgaacagcaagcg

SEQ ID NO: 8213691 - DNA, 22 bp, Homo sapiens
cttccaagatgaacagcaagcg

SEQ ID NO: 8213692 - DNA, 22 bp, Homo sapiens
cttccaagcccaggagccattt

SEQ ID NO: 8213693 - DNA, 20 bp, Homo sapiens
cttccaccagggccgctgat

SEQ ID NO: 8213694 - DNA, 22 bp, Homo sapiens
cttccacattatttaggaatcc

SEQ ID NO: 8213695 - DNA, 22 bp, Homo sapiens
cttccaatagcaacaaagatta

SEQ ID NO: 8213696 - DNA, 20 bp, Homo sapiens
cttccacacaagaagcacag

SEQ ID NO: 8213697 - DNA, 20 bp, Homo sapiens
cttccacacaagaagcacag

SEQ ID NO: 8213698 - DNA, 22 bp, Homo sapiens
cttccagctgattacaggctat

SEQ ID NO: 8213699 - DNA, 22 bp, Homo sapiens
cttccagagctgggctgacctt

SEQ ID NO: 8213700 - DNA, 22 bp, Homo sapiens
cttccagagctgggctgacctt

SEQ ID NO: 8213701 - DNA, 22 bp, Homo sapiens
cttccagaggaactctgcagtg

SEQ ID NO: 8213702 - DNA, 22 bp, Homo sapiens
cttccagaggaactctgcagtg

SEQ ID NO: 8213703 - DNA, 22 bp, Homo sapiens
cttccagaggaactctgcagtg

SEQ ID NO: 8213704 - DNA, 22 bp, Homo sapiens
cttccagagctgggctgacctt

SEQ ID NO: 8213705 - DNA, 22 bp, Homo sapiens
cttccagagatagggcctcaag

SEQ ID NO: 8213706 - DNA, 22 bp, Homo sapiens
cttccactactcttagatctgc

SEQ ID NO: 8213707 - DNA, 22 bp, Homo sapiens
cttccactctgagtccaccctg

SEQ ID NO: 8213708 - DNA, 20 bp, Homo sapiens
cttccttttccttcgtcaaa

SEQ ID NO: 8213709 - DNA, 22 bp, Homo sapiens
cttcctttggttggagcgccgt

SEQ ID NO: 8213710 - DNA, 22 bp, Homo sapiens
cttcctttgctgttcggaggtt

SEQ ID NO: 8213711 - DNA, 22 bp, Homo sapiens
cttcctttccccaatcatatcg

SEQ ID NO: 8213712 - DNA, 22 bp, Homo sapiens
cttccttccacaccttcagaat

SEQ ID NO: 8213713 - DNA, 22 bp, Homo sapiens
cttccttccacaccttcagaat

SEQ ID NO: 8213714 - DNA, 22 bp, Homo sapiens
cttccagcttgtggcgctttcc

SEQ ID NO: 8213715 - DNA, 22 bp, Homo sapiens
cttccagctgattggcatccag

SEQ ID NO: 8213716 - DNA, 22 bp, Homo sapiens
cttccagctgattacaggctat

SEQ ID NO: 8213717 - DNA, 22 bp, Homo sapiens
cttccaggacaccagggtagta

SEQ ID NO: 8213718 - DNA, 22 bp, Homo sapiens
cttccaggacaccagggtagta

SEQ ID NO: 8213719 - DNA, 22 bp, Homo sapiens
cttcctgggtctggagactgga

SEQ ID NO: 8213720 - DNA, 22 bp, Homo sapiens
cttcctgttgtcacagtctgcg

SEQ ID NO: 8213721 - DNA, 22 bp, Homo sapiens
cttcctgttgtatttgtgagcc

SEQ ID NO: 8213722 - DNA, 22 bp, Homo sapiens
cttccttcaatataatttttac

SEQ ID NO: 8213723 - DNA, 22 bp, Homo sapiens
cttcctgttgtcacagtctgcg

SEQ ID NO: 8213724 - DNA, 22 bp, Homo sapiens
cttccttcaatataatttttac

SEQ ID NO: 8213725 - DNA, 23 bp, Homo sapiens
cttctcagaagtctgtgccagga

SEQ ID NO: 8213726 - DNA, 23 bp, Homo sapiens
cttctcagaagtctgtgccagga

SEQ ID NO: 8213727 - DNA, 23 bp, Homo sapiens
cttctcagaagtctgtgccagga

SEQ ID NO: 8213728 - DNA, 23 bp, Homo sapiens
cttctcagaagtctgtgccagga

SEQ ID NO: 8213729 - DNA, 22 bp, Homo sapiens
cttctattcactggtcacagtt

SEQ ID NO: 8213730 - DNA, 22 bp, Homo sapiens
cttctcagatctcagctttgag

SEQ ID NO: 8213731 - DNA, 22 bp, Homo sapiens
cttctcagatctcagctttgag

SEQ ID NO: 8213732 - DNA, 22 bp, Homo sapiens
cttctcagcatggttactgtga

SEQ ID NO: 8213733 - DNA, 22 bp, Homo sapiens
cttctcagcatggttactgtga

SEQ ID NO: 8213734 - DNA, 22 bp, Homo sapiens
cttctcagaggccagaagctat

SEQ ID NO: 8213735 - DNA, 22 bp, Homo sapiens
cttctcagtcacctgtgagtct

SEQ ID NO: 8213736 - DNA, 22 bp, Homo sapiens
cttctcagcattttgtcagtct

SEQ ID NO: 8213737 - DNA, 22 bp, Homo sapiens
cttctcagcattttgtcagtct

SEQ ID NO: 8213738 - DNA, 22 bp, Homo sapiens
cttctcagcttaggtatggttt

SEQ ID NO: 8213739 - DNA, 22 bp, Homo sapiens
cttctcagcttaggtatggttt

SEQ ID NO: 8213740 - DNA, 22 bp, Homo sapiens
cttctagatttttgtaattgtt

SEQ ID NO: 8213741 - DNA, 22 bp, Homo sapiens
cttctagagctggagcaaatgt

SEQ ID NO: 8213742 - DNA, 23 bp, Homo sapiens
cttctagagtcagctccaagttt

SEQ ID NO: 8213743 - DNA, 17 bp, Homo sapiens
cttctagaaggcaaact

SEQ ID NO: 8213744 - DNA, 22 bp, Homo sapiens
cttctacacatccctcttgctt

SEQ ID NO: 8213745 - DNA, 22 bp, Homo sapiens
cttctacaggcccagcgagtgt

SEQ ID NO: 8213746 - DNA, 22 bp, Homo sapiens
cttctacacgtggctgtgccaa

SEQ ID NO: 8213747 - DNA, 22 bp, Homo sapiens
cttctacacatccctcttgctt

SEQ ID NO: 8213748 - DNA, 22 bp, Homo sapiens
cttctacaaggttgtcctctat

SEQ ID NO: 8213749 - DNA, 22 bp, Homo sapiens
cttagcatgtggtgtccttgta

SEQ ID NO: 8213750 - DNA, 22 bp, Homo sapiens
cttagcttctctgcatctgtgt

SEQ ID NO: 8213751 - DNA, 22 bp, Homo sapiens
cttaggaaatatatactaaact

SEQ ID NO: 8213752 - DNA, 22 bp, Homo sapiens
cttaggaaagtttctgcttatg

SEQ ID NO: 8213753 - DNA, 22 bp, Homo sapiens
cttaggaaagttggctgatttc

SEQ ID NO: 8213754 - DNA, 22 bp, Homo sapiens
cttatacaccctcttcccaggc

SEQ ID NO: 8213755 - DNA, 22 bp, Homo sapiens
cttataaagtccatctgaacaa

SEQ ID NO: 8213756 - DNA, 22 bp, Homo sapiens
cttataaagtccatctgaacaa

SEQ ID NO: 8213757 - DNA, 22 bp, Homo sapiens
cttataaagtccatctgaacaa

SEQ ID NO: 8213758 - DNA, 22 bp, Homo sapiens
cttagtttgcatgattatggag

SEQ ID NO: 8213759 - DNA, 22 bp, Homo sapiens
cttagtttctctgtatgtttac

SEQ ID NO: 8213760 - DNA, 22 bp, Homo sapiens
cttagtttctgtttctgattaa

SEQ ID NO: 8213761 - DNA, 22 bp, Homo sapiens
cttaggagttcacttgaatagt

SEQ ID NO: 8213762 - DNA, 22 bp, Homo sapiens
cttaggcaagcagagcccatcc

SEQ ID NO: 8213763 - DNA, 22 bp, Homo sapiens
cttaggcagtttaggaaagaga

SEQ ID NO: 8213764 - DNA, 22 bp, Homo sapiens
cttcagttagtttcatgtgagc

SEQ ID NO: 8213765 - DNA, 22 bp, Homo sapiens
cttcagtgttggttcattacga

SEQ ID NO: 8213766 - DNA, 19 bp, Homo sapiens
cttcattcttcagcttttg

SEQ ID NO: 8213767 - DNA, 19 bp, Homo sapiens
cttcattcttcagcttttg

SEQ ID NO: 8213768 - DNA, 19 bp, Homo sapiens
cttcattcttcagcttttg

SEQ ID NO: 8213769 - DNA, 22 bp, Homo sapiens
cttatatttgtcaactttacaa

SEQ ID NO: 8213770 - DNA, 22 bp, Homo sapiens
cttcagtgttgccagggcctag

SEQ ID NO: 8213771 - DNA, 22 bp, Homo sapiens
cttcagtgttgccagggcctag

SEQ ID NO: 8213772 - DNA, 22 bp, Homo sapiens
cttatatttgtcaactttacaa

SEQ ID NO: 8213773 - DNA, 22 bp, Homo sapiens
cttatagtatgatgttgagaat

SEQ ID NO: 8213774 - DNA, 22 bp, Homo sapiens
cttatagaatgtttttatatgt

SEQ ID NO: 8213775 - DNA, 22 bp, Homo sapiens
cttcatttcaggctgaagaata

SEQ ID NO: 8213776 - DNA, 22 bp, Homo sapiens
cttcatttcaggctgaagaata

SEQ ID NO: 8213777 - DNA, 22 bp, Homo sapiens
cttcatttcaggctgaagaata

SEQ ID NO: 8213778 - DNA, 22 bp, Homo sapiens
cttcatttcaggctgaagaata

SEQ ID NO: 8213779 - DNA, 22 bp, Homo sapiens
cttcatttccatccaactggga

SEQ ID NO: 8213780 - DNA, 22 bp, Homo sapiens
cttcatttggagaactgtgctt

SEQ ID NO: 8213781 - DNA, 22 bp, Homo sapiens
cttcatttggagaactgtgctt

SEQ ID NO: 8213782 - DNA, 18 bp, Homo sapiens
cttcatttgtagagttcc

SEQ ID NO: 8213783 - DNA, 18 bp, Homo sapiens
cttcatttgtagagttcc

SEQ ID NO: 8213784 - DNA, 22 bp, Homo sapiens
cttcatttggcaggctggcctc

SEQ ID NO: 8213785 - DNA, 22 bp, Homo sapiens
gaaaattattgaaaatggctct

SEQ ID NO: 8213786 - DNA, 22 bp, Homo sapiens
gaaaatttaattctcttctgtg

SEQ ID NO: 8213787 - DNA, 22 bp, Homo sapiens
gaaaatttagaactgaacttct

SEQ ID NO: 8213788 - DNA, 22 bp, Homo sapiens
gaaaatttagaactgaacttct

SEQ ID NO: 8213789 - DNA, 22 bp, Homo sapiens
gaaaatttctgccacatgtgtg

SEQ ID NO: 8213790 - DNA, 22 bp, Homo sapiens
gaaaatttctgccacatgtgtg

SEQ ID NO: 8213791 - DNA, 22 bp, Homo sapiens
cttttgcagccattattgctgc

SEQ ID NO: 8213792 - DNA, 22 bp, Homo sapiens
gaaaatacttcagtgttctggc

SEQ ID NO: 8213793 - DNA, 22 bp, Homo sapiens
cttttgcacccagagttatttg

SEQ ID NO: 8213794 - DNA, 22 bp, Homo sapiens
cttttgcaccttttaagtaatg

SEQ ID NO: 8213795 - DNA, 22 bp, Homo sapiens
gaaaatacttcagtgttctggc

SEQ ID NO: 8213796 - DNA, 22 bp, Homo sapiens
gaaaatgtttcctgttatttgc

SEQ ID NO: 8213797 - DNA, 22 bp, Homo sapiens
gaaaattattgaaaatggctct

SEQ ID NO: 8213798 - DNA, 22 bp, Homo sapiens
gaaaattattgaaaatggctct

SEQ ID NO: 8213799 - DNA, 22 bp, Homo sapiens
gaaaattattgaaaatggctct

SEQ ID NO: 8213800 - DNA, 22 bp, Homo sapiens
gaaagctctgcttcagcctgca

SEQ ID NO: 8213801 - DNA, 22 bp, Homo sapiens
gaaagctaaatgaggtcttaca

SEQ ID NO: 8213802 - DNA, 18 bp, Homo sapiens
gaaagccatgcagcagtg

SEQ ID NO: 8213803 - DNA, 18 bp, Homo sapiens
gaaagccatgcagcagtg

SEQ ID NO: 8213804 - DNA, 22 bp, Homo sapiens
gaaagccatctggctgctggga

SEQ ID NO: 8213805 - DNA, 22 bp, Homo sapiens
gaaagccatagcccagctttac

SEQ ID NO: 8213806 - DNA, 22 bp, Homo sapiens
gaaagccagagagaaagggctc

SEQ ID NO: 8213807 - DNA, 22 bp, Homo sapiens
gaaagccatagcccagctttac

SEQ ID NO: 8213808 - DNA, 22 bp, Homo sapiens
gaaagccatctggctgctggga

SEQ ID NO: 8213809 - DNA, 22 bp, Homo sapiens
gaaagccatctggctgctggga

SEQ ID NO: 8213810 - DNA, 22 bp, Homo sapiens
gaaagccatagcccagctttac

SEQ ID NO: 8213811 - DNA, 22 bp, Homo sapiens
gaaagaggaaggagatgtatta

SEQ ID NO: 8213812 - DNA, 22 bp, Homo sapiens
gaaagagaggggctgagatgca

SEQ ID NO: 8213813 - DNA, 22 bp, Homo sapiens
gaaagagaggggctgagatgca

SEQ ID NO: 8213814 - DNA, 22 bp, Homo sapiens
gaaacactggtaaagactgccg

SEQ ID NO: 8213815 - DNA, 22 bp, Homo sapiens
gaaacactcaatttagtaattc

SEQ ID NO: 8213816 - DNA, 22 bp, Homo sapiens
gaaacacatgcagctccataga

SEQ ID NO: 8213817 - DNA, 22 bp, Homo sapiens
gaaacactatgccaagacaggg

SEQ ID NO: 8213818 - DNA, 22 bp, Homo sapiens
gaaacagcacgtttggagagat

SEQ ID NO: 8213819 - DNA, 22 bp, Homo sapiens
gaaacagcacgtttggagagat

SEQ ID NO: 8213820 - DNA, 22 bp, Homo sapiens
gaaacacatatgaacagttgat

SEQ ID NO: 8213821 - DNA, 22 bp, Homo sapiens
gaaacacatgcagctccataga

SEQ ID NO: 8213822 - DNA, 22 bp, Homo sapiens
gaaacacatgcagctccataga

SEQ ID NO: 8213823 - DNA, 21 bp, Homo sapiens
cttttctctccgcaggacatt

SEQ ID NO: 8213824 - DNA, 21 bp, Homo sapiens
cttttctctccgcaggacatt

SEQ ID NO: 8213825 - DNA, 22 bp, Homo sapiens
cttttctctgcgggtctttcat

SEQ ID NO: 8213826 - DNA, 22 bp, Homo sapiens
cttttctctgcaccatgtgtga

SEQ ID NO: 8213827 - DNA, 22 bp, Homo sapiens
cttttctctgcgggtctttcat

SEQ ID NO: 8213828 - DNA, 22 bp, Homo sapiens
cttttctggccaggaacttgcc

SEQ ID NO: 8213829 - DNA, 22 bp, Homo sapiens
cttttctggaatcatctctaac

SEQ ID NO: 8213830 - DNA, 22 bp, Homo sapiens
cttttctgtatcaaaaggatta

SEQ ID NO: 8213831 - DNA, 22 bp, Homo sapiens
cttttctgggccccacgctgga

SEQ ID NO: 8213832 - DNA, 22 bp, Homo sapiens
cttttctgtgatgctgacagtc

SEQ ID NO: 8213833 - DNA, 22 bp, Homo sapiens
cttttctgtatcaaaaggatta

SEQ ID NO: 8213834 - DNA, 22 bp, Homo sapiens
cttttctggaatcatctctaac

SEQ ID NO: 8213835 - DNA, 22 bp, Homo sapiens
cttttctgagagggccaagatt

SEQ ID NO: 8213836 - DNA, 22 bp, Homo sapiens
cttttctctgtaccgtatatct

SEQ ID NO: 8213837 - DNA, 22 bp, Homo sapiens
cttttctcttacattccactgg

SEQ ID NO: 8213838 - DNA, 22 bp, Homo sapiens
cttttcttactcccgcaaggca

SEQ ID NO: 8213839 - DNA, 22 bp, Homo sapiens
cttttctgtcagtgcccaaatt

SEQ ID NO: 8213840 - DNA, 21 bp, Homo sapiens
cttttctgtgttcctccctgt

SEQ ID NO: 8213841 - DNA, 22 bp, Homo sapiens
cttttctgtgatgctgacagtc

SEQ ID NO: 8213842 - DNA, 21 bp, Homo sapiens
cttttctgtgttcctccctgt

SEQ ID NO: 8213843 - DNA, 22 bp, Homo sapiens
cttttcttatgtggacgtacct

SEQ ID NO: 8213844 - DNA, 22 bp, Homo sapiens
cttttcttgtattggatgcccc

SEQ ID NO: 8213845 - DNA, 22 bp, Homo sapiens
cttttgattgagcagtttcaaa

SEQ ID NO: 8213846 - DNA, 22 bp, Homo sapiens
cttttgatggagttcaagaagc

SEQ ID NO: 8213847 - DNA, 22 bp, Homo sapiens
cttttgatggagttcaagaagc

SEQ ID NO: 8213848 - DNA, 22 bp, Homo sapiens
cttttgatagttgctgagcagg

SEQ ID NO: 8213849 - DNA, 22 bp, Homo sapiens
cttttgatagttgctgagcagg

SEQ ID NO: 8213850 - DNA, 22 bp, Homo sapiens
ctttgattccaggcacatgttt

SEQ ID NO: 8213851 - DNA, 22 bp, Homo sapiens
ctttgattccaggcacatgttt

SEQ ID NO: 8213852 - DNA, 21 bp, Homo sapiens
ctttgcaagatgtctatgaaa

SEQ ID NO: 8213853 - DNA, 22 bp, Homo sapiens
cttttccactgagcctcacaaa

SEQ ID NO: 8213854 - DNA, 22 bp, Homo sapiens
cttttcctattgattctgttac

SEQ ID NO: 8213855 - DNA, 18 bp, Homo sapiens
cttttcccctttggactc

SEQ ID NO: 8213856 - DNA, 22 bp, Homo sapiens
cttttccactgagcctcacaaa

SEQ ID NO: 8213857 - DNA, 22 bp, Homo sapiens
cttttccaaagtccatctggtc

SEQ ID NO: 8213858 - DNA, 21 bp, Homo sapiens
cttttacattcagtcatgatg

SEQ ID NO: 8213859 - DNA, 22 bp, Homo sapiens
cttttacagtggacctgccatt

SEQ ID NO: 8213860 - DNA, 18 bp, Homo sapiens
ctttgcagttacagggca

SEQ ID NO: 8213861 - DNA, 22 bp, Homo sapiens
cttctgaagaggttatcataga

SEQ ID NO: 8213862 - DNA, 22 bp, Homo sapiens
cttctggaggacactggcccca

SEQ ID NO: 8213863 - DNA, 22 bp, Homo sapiens
cttctggaaacttttccaattt

SEQ ID NO: 8213864 - DNA, 22 bp, Homo sapiens
cttctggaaacttttccaattt

SEQ ID NO: 8213865 - DNA, 22 bp, Homo sapiens
cttctggagctcaccaacttcc

SEQ ID NO: 8213866 - DNA, 22 bp, Homo sapiens
cttctggatttattcattcctt

SEQ ID NO: 8213867 - DNA, 19 bp, Homo sapiens
cttctggatccgcagggcc

SEQ ID NO: 8213868 - DNA, 22 bp, Homo sapiens
cttctggatttattcattcctt

SEQ ID NO: 8213869 - DNA, 22 bp, Homo sapiens
cttctggataattgtgtgatta

SEQ ID NO: 8213870 - DNA, 22 bp, Homo sapiens
cttctggaggctccagggaggt

SEQ ID NO: 8213871 - DNA, 22 bp, Homo sapiens
cttctggaggctccagggaggt

SEQ ID NO: 8213872 - DNA, 22 bp, Homo sapiens
cttctggaggctccagggaggt

SEQ ID NO: 8213873 - DNA, 22 bp, Homo sapiens
cttctggcgttggaggtctgag

SEQ ID NO: 8213874 - DNA, 22 bp, Homo sapiens
cttctgggattaatttttcctg

SEQ ID NO: 8213875 - DNA, 22 bp, Homo sapiens
cttctgggagagcttttgcttc

SEQ ID NO: 8213876 - DNA, 20 bp, Homo sapiens
cttctggctggtcaaggact

SEQ ID NO: 8213877 - DNA, 22 bp, Homo sapiens
cttctggggatggagcccagaa

SEQ ID NO: 8213878 - DNA, 22 bp, Homo sapiens
cttctggggatggagcccagaa

SEQ ID NO: 8213879 - DNA, 22 bp, Homo sapiens
cttctggggatggagcccagaa

SEQ ID NO: 8213880 - DNA, 22 bp, Homo sapiens
cttctgggcatggcagagcctg

SEQ ID NO: 8213881 - DNA, 22 bp, Homo sapiens
cttctgggcatggcagagcctg

SEQ ID NO: 8213882 - DNA, 22 bp, Homo sapiens
cttctgggcattcagctgcaca

SEQ ID NO: 8213883 - DNA, 22 bp, Homo sapiens
cttctgggcattcagctgcaca

SEQ ID NO: 8213884 - DNA, 22 bp, Homo sapiens
cttgtttttaagagatgtttac

SEQ ID NO: 8213885 - DNA, 22 bp, Homo sapiens
ctttaaataatacaaggtccag

SEQ ID NO: 8213886 - DNA, 22 bp, Homo sapiens
cttgttttggctagtatgatgt

SEQ ID NO: 8213887 - DNA, 22 bp, Homo sapiens
cttgttttggctagtatgatgt

SEQ ID NO: 8213888 - DNA, 22 bp, Homo sapiens
cttgttttctaaaacatcattt

SEQ ID NO: 8213889 - DNA, 22 bp, Homo sapiens
cttgttttctaaaacatcattt

SEQ ID NO: 8213890 - DNA, 22 bp, Homo sapiens
cttgttttctaaaacatcattt

SEQ ID NO: 8213891 - DNA, 22 bp, Homo sapiens
cttgttttggaacagagtgaat

SEQ ID NO: 8213892 - DNA, 19 bp, Homo sapiens
cttgtgcagttcacgctca

SEQ ID NO: 8213893 - DNA, 19 bp, Homo sapiens
cttgtgcagttcacgctca

SEQ ID NO: 8213894 - DNA, 22 bp, Homo sapiens
cttgtgcatcatagtttgccaa

SEQ ID NO: 8213895 - DNA, 22 bp, Homo sapiens
cttgtgcataagaagacctgag

SEQ ID NO: 8213896 - DNA, 22 bp, Homo sapiens
cttgtgcaattgacattgaatc

SEQ ID NO: 8213897 - DNA, 19 bp, Homo sapiens
cttgtgcagttcacgctca

SEQ ID NO: 8213898 - DNA, 22 bp, Homo sapiens
cttgtgcagcctcctcttgcag

SEQ ID NO: 8213899 - DNA, 22 bp, Homo sapiens
cttgtgcatttcattcctcagg

SEQ ID NO: 8213900 - DNA, 22 bp, Homo sapiens
cttgtgcatctcttcatgacca

SEQ ID NO: 8213901 - DNA, 22 bp, Homo sapiens
cttgtgaaatgccagataatct

SEQ ID NO: 8213902 - DNA, 22 bp, Homo sapiens
cttctgggttgcaggtcttggc

SEQ ID NO: 8213903 - DNA, 22 bp, Homo sapiens
cttgtgcaaatcctcgagcaca

SEQ ID NO: 8213904 - DNA, 22 bp, Homo sapiens
cttgtgcaagaaacctggaatg

SEQ ID NO: 8213905 - DNA, 22 bp, Homo sapiens
cttctgggtaattcttcttcat

SEQ ID NO: 8213906 - DNA, 22 bp, Homo sapiens
cttctgggtgcctgtgagtgtt

SEQ ID NO: 8213907 - DNA, 22 bp, Homo sapiens
cttctgggttgcaggtcttggc

SEQ ID NO: 8213908 - DNA, 22 bp, Homo sapiens
cttctgggttgcaggtcttggc

SEQ ID NO: 8213909 - DNA, 22 bp, Homo sapiens
cttctgggtgtggagtgaggac

SEQ ID NO: 8213910 - DNA, 22 bp, Homo sapiens
cttctgggtgtggagtgaggac

SEQ ID NO: 8213911 - DNA, 22 bp, Homo sapiens
cttctgggtgtggagtgaggac

SEQ ID NO: 8213912 - DNA, 22 bp, Homo sapiens
ctttgatgagcatgcaatattt

SEQ ID NO: 8213913 - DNA, 22 bp, Homo sapiens
ctttgatataagtatacatagt

SEQ ID NO: 8213914 - DNA, 22 bp, Homo sapiens
ctttgagtaataattctgcctt

SEQ ID NO: 8213915 - DNA, 22 bp, Homo sapiens
ctttgaattgccgtttcatctg

SEQ ID NO: 8213916 - DNA, 22 bp, Homo sapiens
ctttgacctcatatgacacatt

SEQ ID NO: 8213917 - DNA, 22 bp, Homo sapiens
ctttgactccatctctctttgt

SEQ ID NO: 8213918 - DNA, 22 bp, Homo sapiens
ctttgaattgccgtttcatctg

SEQ ID NO: 8213919 - DNA, 22 bp, Homo sapiens
ctttgaaagctcccaggactta

SEQ ID NO: 8213920 - DNA, 22 bp, Homo sapiens
ctttgaaagctcccaggactta

SEQ ID NO: 8213921 - DNA, 22 bp, Homo sapiens
ctttgaagagattactgtgctc

SEQ ID NO: 8213922 - DNA, 22 bp, Homo sapiens
ctttgaaattcttcagctgaag

SEQ ID NO: 8213923 - DNA, 22 bp, Homo sapiens
ctttgaagatcacatgttgctc

SEQ ID NO: 8213924 - DNA, 22 bp, Homo sapiens
ctttctttgcagtgagccagag

SEQ ID NO: 8213925 - DNA, 22 bp, Homo sapiens
ctttctcttcagcacccagccc

SEQ ID NO: 8213926 - DNA, 22 bp, Homo sapiens
ctttctttgtccaccaacaatg

SEQ ID NO: 8213927 - DNA, 22 bp, Homo sapiens
ctttctttgtccaccaacaatg

SEQ ID NO: 8213928 - DNA, 22 bp, Homo sapiens
ctttctttgtccaccaacaatg

SEQ ID NO: 8213929 - DNA, 22 bp, Homo sapiens
ctttgaaaacttaaataacagc

SEQ ID NO: 8213930 - DNA, 22 bp, Homo sapiens
ctttgaaaacttaaataacagc

SEQ ID NO: 8213931 - DNA, 22 bp, Homo sapiens
ctttgaaaacttaaataacagc

SEQ ID NO: 8213932 - DNA, 22 bp, Homo sapiens
ctttgaaaacacacgaatagac

SEQ ID NO: 8213933 - DNA, 22 bp, Homo sapiens
ctttgaaaaatggtttcctaga

SEQ ID NO: 8213934 - DNA, 22 bp, Homo sapiens
ctttgaaaaatggtttcctaga

SEQ ID NO: 8213935 - DNA, 22 bp, Homo sapiens
ctttgaaaaatggtttcctaga

SEQ ID NO: 8213936 - DNA, 22 bp, Homo sapiens
ctttctcttcagcacccagccc

SEQ ID NO: 8213937 - DNA, 22 bp, Homo sapiens
ctttctcttcactgtcatgatc

SEQ ID NO: 8213938 - DNA, 22 bp, Homo sapiens
ctttctcttcactgtcatgatc

SEQ ID NO: 8213939 - DNA, 22 bp, Homo sapiens
ctttacaaagcaattttgtctc

SEQ ID NO: 8213940 - DNA, 22 bp, Homo sapiens
ctttacaaatagggagggagtg

SEQ ID NO: 8213941 - DNA, 22 bp, Homo sapiens
ctttaattgtagctcccataat

SEQ ID NO: 8213942 - DNA, 22 bp, Homo sapiens
ctttacaaactataaagtgcgg

SEQ ID NO: 8213943 - DNA, 22 bp, Homo sapiens
ctttacaaactataaagtgcgg

SEQ ID NO: 8213944 - DNA, 22 bp, Homo sapiens
ctttacaaactataaagtgcgg

SEQ ID NO: 8213945 - DNA, 22 bp, Homo sapiens
ctttaattctcaggtgcacata

SEQ ID NO: 8213946 - DNA, 22 bp, Homo sapiens
ctttaattcagatttgaaggga

SEQ ID NO: 8213947 - DNA, 22 bp, Homo sapiens
ctttaattaggaagtataatga

SEQ ID NO: 8213948 - DNA, 22 bp, Homo sapiens
ctttaattaggaagtataatga

SEQ ID NO: 8213949 - DNA, 22 bp, Homo sapiens
ctttaatgagtctttctgctgt

SEQ ID NO: 8213950 - DNA, 22 bp, Homo sapiens
ctttaatcaagataagtatact

SEQ ID NO: 8213951 - DNA, 23 bp, Homo sapiens
ctttaatgaaattctctgtgaag

SEQ ID NO: 8213952 - DNA, 22 bp, Homo sapiens
ctttaagactaaattagagttt

SEQ ID NO: 8213953 - DNA, 22 bp, Homo sapiens
ctttaaggtgatgagagatgct

SEQ ID NO: 8213954 - DNA, 22 bp, Homo sapiens
ctttaagactctgctcttggtg

SEQ ID NO: 8213955 - DNA, 22 bp, Homo sapiens
ctttaaataatacaaggtccag

SEQ ID NO: 8213956 - DNA, 22 bp, Homo sapiens
ctttaaataatacaaggtccag

SEQ ID NO: 8213957 - DNA, 22 bp, Homo sapiens
ctttaaataatacaaggtccag

SEQ ID NO: 8213958 - DNA, 22 bp, Homo sapiens
ccagtccagtgccatgcatggc

SEQ ID NO: 8213959 - DNA, 20 bp, Homo sapiens
ccagtccacctgagacatgt

SEQ ID NO: 8213960 - DNA, 22 bp, Homo sapiens
ccagtcagtcagttgctggcat

SEQ ID NO: 8213961 - DNA, 22 bp, Homo sapiens
ccagtcagggcaggagcctggt

SEQ ID NO: 8213962 - DNA, 22 bp, Homo sapiens
ccagtcagggcaggagcctggt

SEQ ID NO: 8213963 - DNA, 22 bp, Homo sapiens
ccagtcagccaagctgcagcgg

SEQ ID NO: 8213964 - DNA, 22 bp, Homo sapiens
ccagtcagccaagctgcagcgg

SEQ ID NO: 8213965 - DNA, 22 bp, Homo sapiens
ccagtcagagaaaatgtccact

SEQ ID NO: 8213966 - DNA, 22 bp, Homo sapiens
ccaggtgtgtcaccattgccca

SEQ ID NO: 8213967 - DNA, 22 bp, Homo sapiens
ccaggtgtgtcaccattgccca

SEQ ID NO: 8213968 - DNA, 22 bp, Homo sapiens
ccaggtgtgtcaccattgccca

SEQ ID NO: 8213969 - DNA, 22 bp, Homo sapiens
ccagtcactggaaaatgggaat

SEQ ID NO: 8213970 - DNA, 22 bp, Homo sapiens
ccaggtggccctgccctactct

SEQ ID NO: 8213971 - DNA, 22 bp, Homo sapiens
ccaggtggccctgccctactct

SEQ ID NO: 8213972 - DNA, 22 bp, Homo sapiens
ccaggtggataaggtttctgga

SEQ ID NO: 8213973 - DNA, 22 bp, Homo sapiens
ccaggtggataaggtttctgga

SEQ ID NO: 8213974 - DNA, 22 bp, Homo sapiens
ccaggtggaggtgtgaggtcct

SEQ ID NO: 8213975 - DNA, 22 bp, Homo sapiens
ccaggtggaggtgtgaggtcct

SEQ ID NO: 8213976 - DNA, 22 bp, Homo sapiens
ccaggtggacttgatttgaata

SEQ ID NO: 8213977 - DNA, 22 bp, Homo sapiens
ccaggtggaggtgtgaggtcct

SEQ ID NO: 8213978 - DNA, 22 bp, Homo sapiens
ccaggtggaggtgtgaggtcct

SEQ ID NO: 8213979 - DNA, 22 bp, Homo sapiens
ccaggtggacttgatttgaata

SEQ ID NO: 8213980 - DNA, 17 bp, Homo sapiens
ccaggtgggaggtgggg

SEQ ID NO: 8213981 - DNA, 17 bp, Homo sapiens
ccaggtgggaggtgggg

SEQ ID NO: 8213982 - DNA, 17 bp, Homo sapiens
ccaggtgggaggtgggg

SEQ ID NO: 8213983 - DNA, 22 bp, Homo sapiens
ccaggtgtgtcaccattgccca

SEQ ID NO: 8213984 - DNA, 22 bp, Homo sapiens
ccaggtgtgtcaccattgccca

SEQ ID NO: 8213985 - DNA, 17 bp, Homo sapiens
ccaggtgggaggtgggg

SEQ ID NO: 8213986 - DNA, 22 bp, Homo sapiens
ccaggtgggaggaaagcagaga

SEQ ID NO: 8213987 - DNA, 22 bp, Homo sapiens
ccaggtggcttctgcccgatgt

SEQ ID NO: 8213988 - DNA, 22 bp, Homo sapiens
ccaggtggcttctgcccgatgt

SEQ ID NO: 8213989 - DNA, 22 bp, Homo sapiens
ccaggtgggaggaaagcagaga

SEQ ID NO: 8213990 - DNA, 22 bp, Homo sapiens
ccaggtgggaggaaagcagaga

SEQ ID NO: 8213991 - DNA, 22 bp, Homo sapiens
ccaggtgggaggaaagcagaga

SEQ ID NO: 8213992 - DNA, 22 bp, Homo sapiens
ccaggtggcttctgcccgatgt

SEQ ID NO: 8213993 - DNA, 22 bp, Homo sapiens
ccaggtggcttctgcccgatgt

SEQ ID NO: 8213994 - DNA, 22 bp, Homo sapiens
ccaggtgggaggaaagcagaga

SEQ ID NO: 8213995 - DNA, 22 bp, Homo sapiens
ccagggctgctgggggagttga

SEQ ID NO: 8213996 - DNA, 22 bp, Homo sapiens
ccagggctgctgggggagttga

SEQ ID NO: 8213997 - DNA, 22 bp, Homo sapiens
ccagggctgctcattggctggt

SEQ ID NO: 8213998 - DNA, 22 bp, Homo sapiens
ccagggctgcctggccgtgtgt

SEQ ID NO: 8213999 - DNA, 22 bp, Homo sapiens
ccagggctgctcattggctggt

SEQ ID NO: 8214000 - DNA, 22 bp, Homo sapiens
ccagggctgctgtgggactcca

SEQ ID NO: 8214001 - DNA, 22 bp, Homo sapiens
ccagggctgctgtgggactcca

SEQ ID NO: 8214002 - DNA, 22 bp, Homo sapiens
ccagggctgctgtgggactcca

SEQ ID NO: 8214003 - DNA, 22 bp, Homo sapiens
ccagggctgctgtgggactcca

SEQ ID NO: 8214004 - DNA, 22 bp, Homo sapiens
tgagcagagacgggggcctcca

SEQ ID NO: 8214005 - DNA, 22 bp, Homo sapiens
tgagcagagacttcaagggcag

SEQ ID NO: 8214006 - DNA, 22 bp, Homo sapiens
tgagcaggggagagcgaatgtg

SEQ ID NO: 8214007 - DNA, 18 bp, Homo sapiens
tgagcaggggctgacctt

SEQ ID NO: 8214008 - DNA, 18 bp, Homo sapiens
tgagcaggggctgacctt

SEQ ID NO: 8214009 - DNA, 22 bp, Homo sapiens
tgagcaggtgagtctagggcag

SEQ ID NO: 8214010 - DNA, 21 bp, Homo sapiens
tgagcaggtgcagggaagtgg

SEQ ID NO: 8214011 - DNA, 22 bp, Homo sapiens
tgagcagtaggtctgaatagtg

SEQ ID NO: 8214012 - DNA, 17 bp, Homo sapiens
tgagcagtagaagatgc

SEQ ID NO: 8214013 - DNA, 22 bp, Homo sapiens
tgagcagtaacagctcacaggg

SEQ ID NO: 8214014 - DNA, 22 bp, Homo sapiens
ccagtgcaggtgagcaccaggt

SEQ ID NO: 8214015 - DNA, 22 bp, Homo sapiens
ccagtctgctgtggtaggaaga

SEQ ID NO: 8214016 - DNA, 22 bp, Homo sapiens
ccagtgcaggtgagcaccaggt

SEQ ID NO: 8214017 - DNA, 22 bp, Homo sapiens
tgagcccaggagttggagaccg

SEQ ID NO: 8214018 - DNA, 22 bp, Homo sapiens
tgagcccaggagtatgaggctg

SEQ ID NO: 8214019 - DNA, 22 bp, Homo sapiens
tgagcccaggagttggagaccg

SEQ ID NO: 8214020 - DNA, 22 bp, Homo sapiens
tgagcccagagatctgagctat

SEQ ID NO: 8214021 - DNA, 22 bp, Homo sapiens
tgagcccagagatctgagctat

SEQ ID NO: 8214022 - DNA, 22 bp, Homo sapiens
tgagcccagaagcccactcggc

SEQ ID NO: 8214023 - DNA, 22 bp, Homo sapiens
tgagcccagagcccttgtaggg

SEQ ID NO: 8214024 - DNA, 22 bp, Homo sapiens
tgagcccagagatctgagctat

SEQ ID NO: 8214025 - DNA, 22 bp, Homo sapiens
tgagcccagagcccttgtaggg

SEQ ID NO: 8214026 - DNA, 23 bp, Homo sapiens
tgagcccaggaggtcaaggctgc

SEQ ID NO: 8214027 - DNA, 23 bp, Homo sapiens
tgagcccaggaggtcaaggctgc

SEQ ID NO: 8214028 - DNA, 22 bp, Homo sapiens
tgagcccaggagtatgaggctg

SEQ ID NO: 8214029 - DNA, 22 bp, Homo sapiens
tgagcccaggaggcagaggttg

SEQ ID NO: 8214030 - DNA, 22 bp, Homo sapiens
tgagcccagcgtcccgttctgt

SEQ ID NO: 8214031 - DNA, 22 bp, Homo sapiens
tgagcccagcgtcccgttctgt

SEQ ID NO: 8214032 - DNA, 22 bp, Homo sapiens
ccagtcccagctctgccatgct

SEQ ID NO: 8214033 - DNA, 22 bp, Homo sapiens
ccagtcccagctctgccatgct

SEQ ID NO: 8214034 - DNA, 22 bp, Homo sapiens
tgagccagtggaagatggcagt

SEQ ID NO: 8214035 - DNA, 22 bp, Homo sapiens
tgagccagttcttcagatccat

SEQ ID NO: 8214036 - DNA, 22 bp, Homo sapiens
tgagccagtgtggtaaagctga

SEQ ID NO: 8214037 - DNA, 22 bp, Homo sapiens
tgagccagttcttcagatccat

SEQ ID NO: 8214038 - DNA, 22 bp, Homo sapiens
tgagccagtggaagatggcagt

SEQ ID NO: 8214039 - DNA, 22 bp, Homo sapiens
tgagccatgggactccaaggga

SEQ ID NO: 8214040 - DNA, 22 bp, Homo sapiens
tgagccatgggactccaaggga

SEQ ID NO: 8214041 - DNA, 22 bp, Homo sapiens
ccagtgcagtccccctgaactg

SEQ ID NO: 8214042 - DNA, 22 bp, Homo sapiens
ccagtgcccagctgcccaggca

SEQ ID NO: 8214043 - DNA, 22 bp, Homo sapiens
ccagtgcattgccgtgtctagg

SEQ ID NO: 8214044 - DNA, 22 bp, Homo sapiens
ccagtgcccagtctccctggtc

SEQ ID NO: 8214045 - DNA, 22 bp, Homo sapiens
ccagtgcccagtctccctggtc

SEQ ID NO: 8214046 - DNA, 22 bp, Homo sapiens
ccagtgcccagctgcccaggca

SEQ ID NO: 8214047 - DNA, 22 bp, Homo sapiens
ccagtgcccagctgcccaggca

SEQ ID NO: 8214048 - DNA, 22 bp, Homo sapiens
ccagtgcccagctgcccaggca

SEQ ID NO: 8214049 - DNA, 22 bp, Homo sapiens
ccagtgcctgtgggcatggtgc

SEQ ID NO: 8214050 - DNA, 22 bp, Homo sapiens
ccagtgcgagcctgtgctggcc

SEQ ID NO: 8214051 - DNA, 17 bp, Homo sapiens
ccagtgcctgtggcaac

SEQ ID NO: 8214052 - DNA, 17 bp, Homo sapiens
ccagtgcctgtggcaac

SEQ ID NO: 8214053 - DNA, 19 bp, Homo sapiens
ccagtgccggcgctgggga

SEQ ID NO: 8214054 - DNA, 22 bp, Homo sapiens
ccagtgcccagtctccctggtc

SEQ ID NO: 8214055 - DNA, 19 bp, Homo sapiens
ccagtgccggcgctgggga

SEQ ID NO: 8214056 - DNA, 22 bp, Homo sapiens
ccagtggacttctccctgtggt

SEQ ID NO: 8214057 - DNA, 22 bp, Homo sapiens
ccagtggacttctccctgtggt

SEQ ID NO: 8214058 - DNA, 22 bp, Homo sapiens
ccagtggaaatgtggtcaggat

SEQ ID NO: 8214059 - DNA, 22 bp, Homo sapiens
ccagtggacaatttctgaggaa

SEQ ID NO: 8214060 - DNA, 22 bp, Homo sapiens
ccagtggacaatttctgaggaa

SEQ ID NO: 8214061 - DNA, 22 bp, Homo sapiens
ccagtggaaatgtggtcaggat

SEQ ID NO: 8214062 - DNA, 22 bp, Homo sapiens
ccagtgcttctttgctagctgg

SEQ ID NO: 8214063 - DNA, 22 bp, Homo sapiens
ccagtggaattaaaaataagtg

SEQ ID NO: 8214064 - DNA, 22 bp, Homo sapiens
ccagtggacaatttctgaggaa

SEQ ID NO: 8214065 - DNA, 22 bp, Homo sapiens
ccagtggagtttttatacccag

SEQ ID NO: 8214066 - DNA, 22 bp, Homo sapiens
ccagtggccatgcacgagcagc

SEQ ID NO: 8214067 - DNA, 22 bp, Homo sapiens
ccagtgctaaggtagcctctgc

SEQ ID NO: 8214068 - DNA, 22 bp, Homo sapiens
ccagtgctaaggtagcctctgc

SEQ ID NO: 8214069 - DNA, 22 bp, Homo sapiens
ccagtgctaaggtagcctctgc

SEQ ID NO: 8214070 - DNA, 21 bp, Homo sapiens
ccagtgctacagctgcctgac

SEQ ID NO: 8214071 - DNA, 21 bp, Homo sapiens
ccagtgctacagctgcctgac

SEQ ID NO: 8214072 - DNA, 21 bp, Homo sapiens
ccagtgctacagctgcctgac

SEQ ID NO: 8214073 - DNA, 22 bp, Homo sapiens
ccagtgcttctttgctagctgg

SEQ ID NO: 8214074 - DNA, 22 bp, Homo sapiens
ccagtgcttccaggaatacggt

SEQ ID NO: 8214075 - DNA, 22 bp, Homo sapiens
ccagtgctgaatgaggaggtct

SEQ ID NO: 8214076 - DNA, 22 bp, Homo sapiens
ccagtgctcattcaagtcctta

SEQ ID NO: 8214077 - DNA, 22 bp, Homo sapiens
ccagtgctcattcaagtcctta

SEQ ID NO: 8214078 - DNA, 22 bp, Homo sapiens
ccagtgctcttaaaggtcataa

SEQ ID NO: 8214079 - DNA, 22 bp, Homo sapiens
ccagtgctcttaaaggtcataa

SEQ ID NO: 8214080 - DNA, 22 bp, Homo sapiens
ccatcatttgatacagctgtct

SEQ ID NO: 8214081 - DNA, 22 bp, Homo sapiens
ccatcattatcactgacaacct

SEQ ID NO: 8214082 - DNA, 22 bp, Homo sapiens
ccatccagaccagtccatgggt

SEQ ID NO: 8214083 - DNA, 22 bp, Homo sapiens
ccatccacagtcttgattattt

SEQ ID NO: 8214084 - DNA, 21 bp, Homo sapiens
ccatccactgagtggttccct

SEQ ID NO: 8214085 - DNA, 22 bp, Homo sapiens
ccatcagttctcagaccacact

SEQ ID NO: 8214086 - DNA, 22 bp, Homo sapiens
ccatcagctccagtatcttctg

SEQ ID NO: 8214087 - DNA, 22 bp, Homo sapiens
ccatcagcatgggagcatgggc

SEQ ID NO: 8214088 - DNA, 23 bp, Homo sapiens
ccatcaggcctccgtgtccagcc

SEQ ID NO: 8214089 - DNA, 23 bp, Homo sapiens
ccatcaggcctccgtgtccagcc

SEQ ID NO: 8214090 - DNA, 22 bp, Homo sapiens
ccatcagagggctgctctgcaa

SEQ ID NO: 8214091 - DNA, 22 bp, Homo sapiens
ccatcagcatgggagcatgggc

SEQ ID NO: 8214092 - DNA, 22 bp, Homo sapiens
ccatcagattagcaaaatccag

SEQ ID NO: 8214093 - DNA, 22 bp, Homo sapiens
tgaggctgagatatcagggagg

SEQ ID NO: 8214094 - DNA, 22 bp, Homo sapiens
tgaggctgagatatcagggagg

SEQ ID NO: 8214095 - DNA, 18 bp, Homo sapiens
tgaggctgagggtagagg

SEQ ID NO: 8214096 - DNA, 23 bp, Homo sapiens
tgaggctgattgatttttgctca

SEQ ID NO: 8214097 - DNA, 22 bp, Homo sapiens
ccagtgttttccagtttgccca

SEQ ID NO: 8214098 - DNA, 18 bp, Homo sapiens
tgaggctgagggtagagg

SEQ ID NO: 8214099 - DNA, 18 bp, Homo sapiens
tgaggctgagggtagagg

SEQ ID NO: 8214100 - DNA, 22 bp, Homo sapiens
ccatagtgaattgtctcagacg

SEQ ID NO: 8214101 - DNA, 22 bp, Homo sapiens
ccataggagccctggtccctga

SEQ ID NO: 8214102 - DNA, 22 bp, Homo sapiens
ccatagatgagacaaagtagag

SEQ ID NO: 8214103 - DNA, 22 bp, Homo sapiens
ccatagcaagaggagcagaaat

SEQ ID NO: 8214104 - DNA, 21 bp, Homo sapiens
ccatacctacctcacctggtt

SEQ ID NO: 8214105 - DNA, 17 bp, Homo sapiens
tgaggccatggcaccat

SEQ ID NO: 8214106 - DNA, 22 bp, Homo sapiens
tgaggccatggtcttcccagtc

SEQ ID NO: 8214107 - DNA, 22 bp, Homo sapiens
tgaggccatggtcttcccagtc

SEQ ID NO: 8214108 - DNA, 22 bp, Homo sapiens
tgaggccatggaactagcttgg

SEQ ID NO: 8214109 - DNA, 17 bp, Homo sapiens
tgaggccatggcaccat

SEQ ID NO: 8214110 - DNA, 17 bp, Homo sapiens
tgaggccatggcaccat

SEQ ID NO: 8214111 - DNA, 22 bp, Homo sapiens
tgaggccagtctcatcacaggc

SEQ ID NO: 8214112 - DNA, 22 bp, Homo sapiens
tgaggccagtctcatcacaggc

SEQ ID NO: 8214113 - DNA, 22 bp, Homo sapiens
tgaggccagggattccatcatt

SEQ ID NO: 8214114 - DNA, 22 bp, Homo sapiens
tgaggccagggattccatcatt

SEQ ID NO: 8214115 - DNA, 22 bp, Homo sapiens
tgaggccaggcaaaggcgatct

SEQ ID NO: 8214116 - DNA, 22 bp, Homo sapiens
tgaggctgagatatcagggagg

SEQ ID NO: 8214117 - DNA, 22 bp, Homo sapiens
tgaggctgagatatcagggagg

SEQ ID NO: 8214118 - DNA, 22 bp, Homo sapiens
tgaggctgacaaaagatgaggt

SEQ ID NO: 8214119 - DNA, 22 bp, Homo sapiens
tgaggctgacaaaagatgaggt

SEQ ID NO: 8214120 - DNA, 22 bp, Homo sapiens
tgaggctgacaaaagatgaggt

SEQ ID NO: 8214121 - DNA, 22 bp, Homo sapiens
tgaggctgacaaaagatgaggt

SEQ ID NO: 8214122 - DNA, 18 bp, Homo sapiens
tgaggctgaatatggggc

SEQ ID NO: 8214123 - DNA, 18 bp, Homo sapiens
tgaggctgaatatggggc

SEQ ID NO: 8214124 - DNA, 22 bp, Homo sapiens
tgaggctgacaaaagatgaggt

SEQ ID NO: 8214125 - DNA, 22 bp, Homo sapiens
tgaggctgacaaaagatgaggt

SEQ ID NO: 8214126 - DNA, 22 bp, Homo sapiens
tgaggcccagccgccctgagag

SEQ ID NO: 8214127 - DNA, 18 bp, Homo sapiens
tgaggcccatctctctga

SEQ ID NO: 8214128 - DNA, 22 bp, Homo sapiens
tgaggcccatctgagattttga

SEQ ID NO: 8214129 - DNA, 20 bp, Homo sapiens
tgaggcccagcagagtcggg

SEQ ID NO: 8214130 - DNA, 22 bp, Homo sapiens
tgaggctgaaactggcgataga

SEQ ID NO: 8214131 - DNA, 22 bp, Homo sapiens
tgaggctgaaactggcgataga

SEQ ID NO: 8214132 - DNA, 18 bp, Homo sapiens
tgaggctgaatatggggc

SEQ ID NO: 8214133 - DNA, 22 bp, Homo sapiens
tgaggctgaaactggcgataga

SEQ ID NO: 8214134 - DNA, 22 bp, Homo sapiens
tgagtctggcggagggaggagc

SEQ ID NO: 8214135 - DNA, 22 bp, Homo sapiens
tgagttgaaagactgacttctg

SEQ ID NO: 8214136 - DNA, 22 bp, Homo sapiens
tgagttgccctgccctgtgctt

SEQ ID NO: 8214137 - DNA, 22 bp, Homo sapiens
tgagttgccctgccctgtgctt

SEQ ID NO: 8214138 - DNA, 22 bp, Homo sapiens
tgagttgctatctagatccaga

SEQ ID NO: 8214139 - DNA, 22 bp, Homo sapiens
tgagtttagtgtgagacttatc

SEQ ID NO: 8214140 - DNA, 22 bp, Homo sapiens
tgagtttaatgatatttatatg

SEQ ID NO: 8214141 - DNA, 19 bp, Homo sapiens
tgagtttaatgcaaaactg

SEQ ID NO: 8214142 - DNA, 22 bp, Homo sapiens
tgagttttttcaacatatgaag

SEQ ID NO: 8214143 - DNA, 22 bp, Homo sapiens
tgagttttgtcttgctagaagt

SEQ ID NO: 8214144 - DNA, 22 bp, Homo sapiens
tgagtcctgctgagcagagagg

SEQ ID NO: 8214145 - DNA, 22 bp, Homo sapiens
tgagtcctggctttgggatgta

SEQ ID NO: 8214146 - DNA, 22 bp, Homo sapiens
tgagtcctgctctgggcagggt

SEQ ID NO: 8214147 - DNA, 22 bp, Homo sapiens
tgagtcctgctctgggcagggt

SEQ ID NO: 8214148 - DNA, 22 bp, Homo sapiens
tgagtcctaaagctgtgccctt

SEQ ID NO: 8214149 - DNA, 22 bp, Homo sapiens
tgagtccgaagttgcagtgagc

SEQ ID NO: 8214150 - DNA, 22 bp, Homo sapiens
tgagtctcgaaatgcaggaaag

SEQ ID NO: 8214151 - DNA, 22 bp, Homo sapiens
tgagtctcaggtttcccgtgcc

SEQ ID NO: 8214152 - DNA, 21 bp, Homo sapiens
tgagtctctcagcttcaggta

SEQ ID NO: 8214153 - DNA, 22 bp, Homo sapiens
tgagtctcggtttcccctccaa

SEQ ID NO: 8214154 - DNA, 21 bp, Homo sapiens
tgagtctctcagcttcaggta

SEQ ID NO: 8214155 - DNA, 22 bp, Homo sapiens
tgagtctctgcactaaggagag

SEQ ID NO: 8214156 - DNA, 22 bp, Homo sapiens
ccatcctgaatggtctcagcca

SEQ ID NO: 8214157 - DNA, 22 bp, Homo sapiens
ccatcctgaatggtctcagcca

SEQ ID NO: 8214158 - DNA, 22 bp, Homo sapiens
ccatcctgaatggtctcagcca

SEQ ID NO: 8214159 - DNA, 22 bp, Homo sapiens
ccatcctgcaggacctccatat

SEQ ID NO: 8214160 - DNA, 22 bp, Homo sapiens
tgaggtcatggctgatatttcc

SEQ ID NO: 8214161 - DNA, 22 bp, Homo sapiens
tgaggtcccaggggtagtgtgc

SEQ ID NO: 8214162 - DNA, 22 bp, Homo sapiens
ccatcctgcattgctattcaga

SEQ ID NO: 8214163 - DNA, 22 bp, Homo sapiens
tgagtcagtctgccctggcttc

SEQ ID NO: 8214164 - DNA, 20 bp, Homo sapiens
tgagtcagctgcatgggtgg

SEQ ID NO: 8214165 - DNA, 19 bp, Homo sapiens
tgaggtctacatgggcatc

SEQ ID NO: 8214166 - DNA, 22 bp, Homo sapiens
tgaggtcctagagagtgtgtgg

SEQ ID NO: 8214167 - DNA, 22 bp, Homo sapiens
tgaggtcctgcatgttgaggtc

SEQ ID NO: 8214168 - DNA, 22 bp, Homo sapiens
tgagtcagccagagctgccatg

SEQ ID NO: 8214169 - DNA, 22 bp, Homo sapiens
tgaggtcctgcatgttgaggtc

SEQ ID NO: 8214170 - DNA, 22 bp, Homo sapiens
tgagtccagatgggccagcagg

SEQ ID NO: 8214171 - DNA, 22 bp, Homo sapiens
ccatccctgggccatgtcccct

SEQ ID NO: 8214172 - DNA, 22 bp, Homo sapiens
ccatccctgggccatgtcccct

SEQ ID NO: 8214173 - DNA, 22 bp, Homo sapiens
ccatccctgggccatgtcccct

SEQ ID NO: 8214174 - DNA, 22 bp, Homo sapiens
ccatccctcctccaccagctag

SEQ ID NO: 8214175 - DNA, 22 bp, Homo sapiens
ccatccctcctccaccagctag

SEQ ID NO: 8214176 - DNA, 22 bp, Homo sapiens
ccatcccttctctggccagcag

SEQ ID NO: 8214177 - DNA, 23 bp, Homo sapiens
ccatcccttggaagctggtttta

SEQ ID NO: 8214178 - DNA, 22 bp, Homo sapiens
ccatccatatggtgacaaggtg

SEQ ID NO: 8214179 - DNA, 21 bp, Homo sapiens
ccatccatctccctttgctgg

SEQ ID NO: 8214180 - DNA, 21 bp, Homo sapiens
ccatccatctccctttgctgg

SEQ ID NO: 8214181 - DNA, 22 bp, Homo sapiens
ccatccatgaacgaggaagtgg

SEQ ID NO: 8214182 - DNA, 22 bp, Homo sapiens
ccatccctcctactcacagtca

SEQ ID NO: 8214183 - DNA, 22 bp, Homo sapiens
ccatccatgtggcagggctggc

SEQ ID NO: 8214184 - DNA, 22 bp, Homo sapiens
ccatccattttcttgcttgcct

SEQ ID NO: 8214185 - DNA, 22 bp, Homo sapiens
ccatccattttcttgcttgcct

SEQ ID NO: 8214186 - DNA, 22 bp, Homo sapiens
ccatccatgcgccagacagatt

SEQ ID NO: 8214187 - DNA, 22 bp, Homo sapiens
ccatccatggtgttggttgtat

SEQ ID NO: 8214188 - DNA, 19 bp, Homo sapiens
ccatccatggggccagagg

SEQ ID NO: 8214189 - DNA, 22 bp, Homo sapiens
ccatccatggtgttggttgtat

SEQ ID NO: 8214190 - DNA, 22 bp, Homo sapiens
ccatccatgtggcagggctggc

SEQ ID NO: 8214191 - DNA, 22 bp, Homo sapiens
tgcagagaaagtgtagacaggc

SEQ ID NO: 8214192 - DNA, 22 bp, Homo sapiens
tgcagagaaaccagtggaggac

SEQ ID NO: 8214193 - DNA, 22 bp, Homo sapiens
tgcagagaaaccagtggaggac

SEQ ID NO: 8214194 - DNA, 22 bp, Homo sapiens
tgcagagacttgtgtgcatttg

SEQ ID NO: 8214195 - DNA, 22 bp, Homo sapiens
tgcagagacttgtgtgcatttg

SEQ ID NO: 8214196 - DNA, 19 bp, Homo sapiens
tgcagagagaggcaaagaa

SEQ ID NO: 8214197 - DNA, 22 bp, Homo sapiens
tgcagagagatatggcaagagg

SEQ ID NO: 8214198 - DNA, 22 bp, Homo sapiens
tgcagagagatatggcaagagg

SEQ ID NO: 8214199 - DNA, 22 bp, Homo sapiens
tgcactgaatagtagactgtac

SEQ ID NO: 8214200 - DNA, 22 bp, Homo sapiens
tgcactgatcctgaccagtgaa

SEQ ID NO: 8214201 - DNA, 22 bp, Homo sapiens
tgcactgaatagtagactgtac

SEQ ID NO: 8214202 - DNA, 22 bp, Homo sapiens
tgcactccaggctgggtgacag

SEQ ID NO: 8214203 - DNA, 22 bp, Homo sapiens
tgcactccaggctgggtgacag

SEQ ID NO: 8214204 - DNA, 22 bp, Homo sapiens
tgcactccaggctgggtgacag

SEQ ID NO: 8214205 - DNA, 22 bp, Homo sapiens
tgcactgatgttttgccaagga

SEQ ID NO: 8214206 - DNA, 22 bp, Homo sapiens
tgcactgatcctgaccagtgaa

SEQ ID NO: 8214207 - DNA, 22 bp, Homo sapiens
tgcactgatcctgaccagtgaa

SEQ ID NO: 8214208 - DNA, 22 bp, Homo sapiens
tgcactggggtcccagcgcacg

SEQ ID NO: 8214209 - DNA, 22 bp, Homo sapiens
tgcacttattgacatagaaaaa

SEQ ID NO: 8214210 - DNA, 22 bp, Homo sapiens
tgcacttcaaaaatgtcactga

SEQ ID NO: 8214211 - DNA, 22 bp, Homo sapiens
tgcactttgcaggcatggaaac

SEQ ID NO: 8214212 - DNA, 22 bp, Homo sapiens
tgcactttgcaggcatggaaac

SEQ ID NO: 8214213 - DNA, 22 bp, Homo sapiens
tgcactttatttcctctcacac

SEQ ID NO: 8214214 - DNA, 22 bp, Homo sapiens
tgcactttaaaaaatggtgatg

SEQ ID NO: 8214215 - DNA, 23 bp, Homo sapiens
cccagaggagcagggcgtgagat

SEQ ID NO: 8214216 - DNA, 23 bp, Homo sapiens
cccagaggagcagggcgtgagat

SEQ ID NO: 8214217 - DNA, 22 bp, Homo sapiens
cccagaggaggatctcggcccg

SEQ ID NO: 8214218 - DNA, 19 bp, Homo sapiens
cccagaggaatgcctggaa

SEQ ID NO: 8214219 - DNA, 19 bp, Homo sapiens
cccagaggaatgcctggaa

SEQ ID NO: 8214220 - DNA, 19 bp, Homo sapiens
cccagaggaatgcctggaa

SEQ ID NO: 8214221 - DNA, 23 bp, Homo sapiens
cccagaggagcagggcgtgagat

SEQ ID NO: 8214222 - DNA, 19 bp, Homo sapiens
cccagaggaatgcctggaa

SEQ ID NO: 8214223 - DNA, 19 bp, Homo sapiens
cccagaggaatgcctggaa

SEQ ID NO: 8214224 - DNA, 22 bp, Homo sapiens
cccagagctgattgttggagcc

SEQ ID NO: 8214225 - DNA, 22 bp, Homo sapiens
cccagagctgattgttggagcc

SEQ ID NO: 8214226 - DNA, 22 bp, Homo sapiens
cccagagctgattgttggagcc

SEQ ID NO: 8214227 - DNA, 22 bp, Homo sapiens
cccagagctgggtgggcagcgg

SEQ ID NO: 8214228 - DNA, 18 bp, Homo sapiens
cccagaggaatgcctgga

SEQ ID NO: 8214229 - DNA, 18 bp, Homo sapiens
cccagaggaatgcctgga

SEQ ID NO: 8214230 - DNA, 18 bp, Homo sapiens
cccagaggaatgcctgga

SEQ ID NO: 8214231 - DNA, 18 bp, Homo sapiens
cccagaggaatgcctgga

SEQ ID NO: 8214232 - DNA, 18 bp, Homo sapiens
cccagaggaatgcctgga

SEQ ID NO: 8214233 - DNA, 18 bp, Homo sapiens
cccagaggaatgcctgga

SEQ ID NO: 8214234 - DNA, 22 bp, Homo sapiens
cccagagcctcattctgttggg

SEQ ID NO: 8214235 - DNA, 22 bp, Homo sapiens
cccagagcctcattctgttggg

SEQ ID NO: 8214236 - DNA, 17 bp, Homo sapiens
cccagagatgctgcctt

SEQ ID NO: 8214237 - DNA, 22 bp, Homo sapiens
cccagagatgggaggtgatcgg

SEQ ID NO: 8214238 - DNA, 22 bp, Homo sapiens
tgcagagagatcctcagggttt

SEQ ID NO: 8214239 - DNA, 22 bp, Homo sapiens
cccagagctccggtcctgccca

SEQ ID NO: 8214240 - DNA, 22 bp, Homo sapiens
cccagagcctcattctgttggg

SEQ ID NO: 8214241 - DNA, 22 bp, Homo sapiens
cccagagctcagtgtgcaaggt

SEQ ID NO: 8214242 - DNA, 22 bp, Homo sapiens
cccagagctgagtctgatatat

SEQ ID NO: 8214243 - DNA, 22 bp, Homo sapiens
cccagagctgagtctgatatat

SEQ ID NO: 8214244 - DNA, 22 bp, Homo sapiens
cccagagctgagggggcacgtt

SEQ ID NO: 8214245 - DNA, 22 bp, Homo sapiens
tgcaatcagaaagttcagcggt

SEQ ID NO: 8214246 - DNA, 22 bp, Homo sapiens
tgcaatattttatatccaacaa

SEQ ID NO: 8214247 - DNA, 22 bp, Homo sapiens
tgcaatatgttgcattgtatgg

SEQ ID NO: 8214248 - DNA, 22 bp, Homo sapiens
tgcaatatgttgcattgtatgg

SEQ ID NO: 8214249 - DNA, 22 bp, Homo sapiens
tgcaatatcagattcaacacat

SEQ ID NO: 8214250 - DNA, 22 bp, Homo sapiens
tgatacacagatttacatcaat

SEQ ID NO: 8214251 - DNA, 22 bp, Homo sapiens
tgataaatccatgtaaatggta

SEQ ID NO: 8214252 - DNA, 22 bp, Homo sapiens
tgataactctcagtttctcatg

SEQ ID NO: 8214253 - DNA, 22 bp, Homo sapiens
tgataactttaatttgatctga

SEQ ID NO: 8214254 - DNA, 19 bp, Homo sapiens
tgcaagtgtcttggacaag

SEQ ID NO: 8214255 - DNA, 19 bp, Homo sapiens
tgcaagtgtcttggacaag

SEQ ID NO: 8214256 - DNA, 22 bp, Homo sapiens
tgcaagtgccatgtgcacagtg

SEQ ID NO: 8214257 - DNA, 22 bp, Homo sapiens
tgcaagtgattctgttttctca

SEQ ID NO: 8214258 - DNA, 22 bp, Homo sapiens
tgcaaatattgggacagtctag

SEQ ID NO: 8214259 - DNA, 22 bp, Homo sapiens
tgcaaatattgggacagtctag

SEQ ID NO: 8214260 - DNA, 22 bp, Homo sapiens
tgcaaatattccatgctgttca

SEQ ID NO: 8214261 - DNA, 22 bp, Homo sapiens
tgcaataacccagtatctgtga

SEQ ID NO: 8214262 - DNA, 22 bp, Homo sapiens
cccaagggtgcccagcagagga

SEQ ID NO: 8214263 - DNA, 22 bp, Homo sapiens
cccaaggggtgttgatggagga

SEQ ID NO: 8214264 - DNA, 22 bp, Homo sapiens
cccaaggggtgttgatggagga

SEQ ID NO: 8214265 - DNA, 22 bp, Homo sapiens
cccaaggggtgttgatggagga

SEQ ID NO: 8214266 - DNA, 22 bp, Homo sapiens
cccaaggggagattttcttgag

SEQ ID NO: 8214267 - DNA, 22 bp, Homo sapiens
cccaagggatgcttgagtagtt

SEQ ID NO: 8214268 - DNA, 22 bp, Homo sapiens
cccaagggatgcttgagtagtt

SEQ ID NO: 8214269 - DNA, 22 bp, Homo sapiens
tgcactccaggctgggtgacag

SEQ ID NO: 8214270 - DNA, 22 bp, Homo sapiens
tgcacagatgggcttgttcata

SEQ ID NO: 8214271 - DNA, 23 bp, Homo sapiens
cccaagcctgtgccctctgactc

SEQ ID NO: 8214272 - DNA, 22 bp, Homo sapiens
cccaaggcatggcatggtggca

SEQ ID NO: 8214273 - DNA, 22 bp, Homo sapiens
cccaaggcctctccttggcttg

SEQ ID NO: 8214274 - DNA, 22 bp, Homo sapiens
cccaaggctgcagtgagcatga

SEQ ID NO: 8214275 - DNA, 23 bp, Homo sapiens
tgcaggactactcgagcactgct

SEQ ID NO: 8214276 - DNA, 22 bp, Homo sapiens
tgcaggaatgaggttctcagtt

SEQ ID NO: 8214277 - DNA, 20 bp, Homo sapiens
tgcaggaatttgcattcctt

SEQ ID NO: 8214278 - DNA, 22 bp, Homo sapiens
tgcaggaatattgatgaactta

SEQ ID NO: 8214279 - DNA, 22 bp, Homo sapiens
tgcaggaatattgatgaactta

SEQ ID NO: 8214280 - DNA, 22 bp, Homo sapiens
tgcaggaatcagaggggaagcg

SEQ ID NO: 8214281 - DNA, 22 bp, Homo sapiens
tgcaggaattttttgcagaaag

SEQ ID NO: 8214282 - DNA, 22 bp, Homo sapiens
tgcaggaattttttgcagaaag

SEQ ID NO: 8214283 - DNA, 22 bp, Homo sapiens
tgcaggaattttttgcagaaag

SEQ ID NO: 8214284 - DNA, 22 bp, Homo sapiens
tgcaggaattttttgcagaaag

SEQ ID NO: 8214285 - DNA, 22 bp, Homo sapiens
tgcagctgctcattctctcagt

SEQ ID NO: 8214286 - DNA, 22 bp, Homo sapiens
tgcaggaagtttcctgaacttt

SEQ ID NO: 8214287 - DNA, 22 bp, Homo sapiens
tgcaggaagtttcctgaacttt

SEQ ID NO: 8214288 - DNA, 22 bp, Homo sapiens
tgcaggaatagctacagagctg

SEQ ID NO: 8214289 - DNA, 22 bp, Homo sapiens
tgcaggaatattgatgaactta

SEQ ID NO: 8214290 - DNA, 22 bp, Homo sapiens
tgcaggaatagctacagagctg

SEQ ID NO: 8214291 - DNA, 22 bp, Homo sapiens
tgcaggaatagctacagagctg

SEQ ID NO: 8214292 - DNA, 23 bp, Homo sapiens
tgcagctgcctctggcgggccgg

SEQ ID NO: 8214293 - DNA, 23 bp, Homo sapiens
tgcagctgcctctggcgggccgg

SEQ ID NO: 8214294 - DNA, 22 bp, Homo sapiens
tgcagctgcctagggctggctt

SEQ ID NO: 8214295 - DNA, 22 bp, Homo sapiens
tgcagctgcaggagggtgggag

SEQ ID NO: 8214296 - DNA, 19 bp, Homo sapiens
tgcagccacgtgagagact

SEQ ID NO: 8214297 - DNA, 22 bp, Homo sapiens
tgcagctgattaaagggcagac

SEQ ID NO: 8214298 - DNA, 22 bp, Homo sapiens
tgcagctgattaaagggcagac

SEQ ID NO: 8214299 - DNA, 22 bp, Homo sapiens
tgcagctgattaaagggcagac

SEQ ID NO: 8214300 - DNA, 22 bp, Homo sapiens
cccagagggtggaggttgcagt

SEQ ID NO: 8214301 - DNA, 22 bp, Homo sapiens
cccagagggtggaggttgcagt

SEQ ID NO: 8214302 - DNA, 20 bp, Homo sapiens
tgcagctgcaggagggtggg

SEQ ID NO: 8214303 - DNA, 20 bp, Homo sapiens
tgcagctgcaggagggtggg

SEQ ID NO: 8214304 - DNA, 22 bp, Homo sapiens
tgcagctgcaagtccaggtcag

SEQ ID NO: 8214305 - DNA, 22 bp, Homo sapiens
tgcagctgattaaagggcagac

SEQ ID NO: 8214306 - DNA, 22 bp, Homo sapiens
tgcagctgcaagtccaggtcag

SEQ ID NO: 8214307 - DNA, 22 bp, Homo sapiens
tgcagctgcaagtccaggtcag

SEQ ID NO: 8214308 - DNA, 22 bp, Homo sapiens
cccagaggaggcaaagctctgt

SEQ ID NO: 8214309 - DNA, 22 bp, Homo sapiens
cccagaggctgagttgggagca

SEQ ID NO: 8214310 - DNA, 22 bp, Homo sapiens
cccagagggaagggaatgaggt

SEQ ID NO: 8214311 - DNA, 22 bp, Homo sapiens
cccagagggaagggaatgaggt

SEQ ID NO: 8214312 - DNA, 22 bp, Homo sapiens
cccagagggctgaggatatgaa

SEQ ID NO: 8214313 - DNA, 22 bp, Homo sapiens
cccagaggggtcgtctgagggg

SEQ ID NO: 8214314 - DNA, 22 bp, Homo sapiens
cccagcagggtctctgtgtcta

SEQ ID NO: 8214315 - DNA, 22 bp, Homo sapiens
cccagcagggtctctgtgtcta

SEQ ID NO: 8214316 - DNA, 22 bp, Homo sapiens
cccagcaggtcggtgctgcctg

SEQ ID NO: 8214317 - DNA, 22 bp, Homo sapiens
tgcagggatcctagctgaagag

SEQ ID NO: 8214318 - DNA, 22 bp, Homo sapiens
cccagcaggaggaggttgcagt

SEQ ID NO: 8214319 - DNA, 22 bp, Homo sapiens
cccagcagcttgcacagtgctg

SEQ ID NO: 8214320 - DNA, 22 bp, Homo sapiens
cccagcagcttgcacagtgctg

SEQ ID NO: 8214321 - DNA, 22 bp, Homo sapiens
cccagcaggcatgttgggagga

SEQ ID NO: 8214322 - DNA, 22 bp, Homo sapiens
cccagcaggcatgttgggagga

SEQ ID NO: 8214323 - DNA, 22 bp, Homo sapiens
tgcagggccttgggatgtgtcc

SEQ ID NO: 8214324 - DNA, 22 bp, Homo sapiens
tgcagggctaagtcagagcctg

SEQ ID NO: 8214325 - DNA, 22 bp, Homo sapiens
tgcagggctaagtcagagcctg

SEQ ID NO: 8214326 - DNA, 22 bp, Homo sapiens
tgcagggccttgttgatgtgct

SEQ ID NO: 8214327 - DNA, 22 bp, Homo sapiens
tgcagggccttgttgatgtgct

SEQ ID NO: 8214328 - DNA, 22 bp, Homo sapiens
tgcagggccttgttgatgtgct

SEQ ID NO: 8214329 - DNA, 22 bp, Homo sapiens
tgcagggccttgggtctttctt

SEQ ID NO: 8214330 - DNA, 22 bp, Homo sapiens
tgcagggccttgggtctttctt

SEQ ID NO: 8214331 - DNA, 22 bp, Homo sapiens
tgcagggccttgggtctttctt

SEQ ID NO: 8214332 - DNA, 22 bp, Homo sapiens
tgcagggccttgttgatgtgct

SEQ ID NO: 8214333 - DNA, 22 bp, Homo sapiens
tgcagggccttgggatgtgtcc

SEQ ID NO: 8214334 - DNA, 22 bp, Homo sapiens
tgcagggccgctggaggtcatg

SEQ ID NO: 8214335 - DNA, 20 bp, Homo sapiens
tgcagggcctaaaaagggaa

SEQ ID NO: 8214336 - DNA, 22 bp, Homo sapiens
tgcagggccgctggaggtcatg

SEQ ID NO: 8214337 - DNA, 22 bp, Homo sapiens
tgcagggccttctagaccatgg

SEQ ID NO: 8214338 - DNA, 22 bp, Homo sapiens
tgcagggccttgggatgtgtcc

SEQ ID NO: 8214339 - DNA, 22 bp, Homo sapiens
tgcagggccttgggatgtgtcc

SEQ ID NO: 8214340 - DNA, 22 bp, Homo sapiens
tgcagggccttctagaccatgg

SEQ ID NO: 8214341 - DNA, 22 bp, Homo sapiens
tgcagggccttctagaccatgg

SEQ ID NO: 8214342 - DNA, 22 bp, Homo sapiens
tgcagggccttctagaccatgg

SEQ ID NO: 8214343 - DNA, 20 bp, Homo sapiens
tgcagggcctaaaaagggaa

SEQ ID NO: 8214344 - DNA, 22 bp, Homo sapiens
tgcaggcattggtgagagaagc

SEQ ID NO: 8214345 - DNA, 22 bp, Homo sapiens
tgcaggcattggtgagagaagc

SEQ ID NO: 8214346 - DNA, 22 bp, Homo sapiens
tgcaggcataaccgatgttgat

SEQ ID NO: 8214347 - DNA, 22 bp, Homo sapiens
tgcaggcataaccgatgttgat

SEQ ID NO: 8214348 - DNA, 22 bp, Homo sapiens
tgcaggcagtaggccagctcca

SEQ ID NO: 8214349 - DNA, 22 bp, Homo sapiens
tgcaggcaggggatgagcagcc

SEQ ID NO: 8214350 - DNA, 22 bp, Homo sapiens
tgcaggcaggggatgagcagcc

SEQ ID NO: 8214351 - DNA, 22 bp, Homo sapiens
tgcaggcaggggatgagcagcc

SEQ ID NO: 8214352 - DNA, 22 bp, Homo sapiens
tgcaggcaggggatgagcagcc

SEQ ID NO: 8214353 - DNA, 22 bp, Homo sapiens
tgcaggcaggggatgagcagcc

SEQ ID NO: 8214354 - DNA, 22 bp, Homo sapiens
tgcaggagaaagtacggagcgt

SEQ ID NO: 8214355 - DNA, 21 bp, Homo sapiens
tgcaggcaggcagagatgctg

SEQ ID NO: 8214356 - DNA, 21 bp, Homo sapiens
tgcaggcaggcagagatgctg

SEQ ID NO: 8214357 - DNA, 21 bp, Homo sapiens
tgcaggcaggcagagatgctg

SEQ ID NO: 8214358 - DNA, 22 bp, Homo sapiens
tgcaggcaggggatgagcagcc

SEQ ID NO: 8214359 - DNA, 22 bp, Homo sapiens
tgcaggcagggccagcgtgagg

SEQ ID NO: 8214360 - DNA, 21 bp, Homo sapiens
tgcaggcaggcagagatgctg

SEQ ID NO: 8214361 - DNA, 22 bp, Homo sapiens
cccagcagcttgcacagtgctg

SEQ ID NO: 8214362 - DNA, 22 bp, Homo sapiens
cccagcagcttgcacagtgctg

SEQ ID NO: 8214363 - DNA, 22 bp, Homo sapiens
cccagcagcttgcacagtgctg

SEQ ID NO: 8214364 - DNA, 22 bp, Homo sapiens
tgcaggcccagtgtagaggctc

SEQ ID NO: 8214365 - DNA, 22 bp, Homo sapiens
tgcaggcccagtgtagaggctc

SEQ ID NO: 8214366 - DNA, 22 bp, Homo sapiens
tgcaggccggccctaggcctca

SEQ ID NO: 8214367 - DNA, 22 bp, Homo sapiens
tgcaggcccagtgtagaggctc

SEQ ID NO: 8214368 - DNA, 22 bp, Homo sapiens
tgcaggcctatggtggggcccc

SEQ ID NO: 8214369 - DNA, 22 bp, Homo sapiens
tgcaggccggccctaggcctca

SEQ ID NO: 8214370 - DNA, 22 bp, Homo sapiens
tgcaggcctcacacctggcacc

SEQ ID NO: 8214371 - DNA, 22 bp, Homo sapiens
tgcaggcctcacacctggcacc

SEQ ID NO: 8214372 - DNA, 20 bp, Homo sapiens
tctgggagggacaagtctcc

SEQ ID NO: 8214373 - DNA, 20 bp, Homo sapiens
tctgggagggacaagtctcc

SEQ ID NO: 8214374 - DNA, 22 bp, Homo sapiens
tctgggagggagcctcagaatc

SEQ ID NO: 8214375 - DNA, 22 bp, Homo sapiens
tctgggaggctgggtcccgtcc

SEQ ID NO: 8214376 - DNA, 22 bp, Homo sapiens
ccagcactcctgtctcaagtct

SEQ ID NO: 8214377 - DNA, 22 bp, Homo sapiens
ccagcactcctgtctcaagtct

SEQ ID NO: 8214378 - DNA, 22 bp, Homo sapiens
ccagcactctattgaatattct

SEQ ID NO: 8214379 - DNA, 22 bp, Homo sapiens
ccagcaccttgatcttggagtt

SEQ ID NO: 8214380 - DNA, 22 bp, Homo sapiens
tctgggccctgagatgttcttc

SEQ ID NO: 8214381 - DNA, 22 bp, Homo sapiens
tctgggccggagccgacggcag

SEQ ID NO: 8214382 - DNA, 22 bp, Homo sapiens
tctgggcctatagaagtctacc

SEQ ID NO: 8214383 - DNA, 22 bp, Homo sapiens
tctgggctctgggaattaggga

SEQ ID NO: 8214384 - DNA, 22 bp, Homo sapiens
tctgggctctgggaattaggga

SEQ ID NO: 8214385 - DNA, 22 bp, Homo sapiens
tctgggctctgcgaagcccttc

SEQ ID NO: 8214386 - DNA, 22 bp, Homo sapiens
tctgggctctgggaattaggga

SEQ ID NO: 8214387 - DNA, 22 bp, Homo sapiens
tctgggctcacgagtctggaca

SEQ ID NO: 8214388 - DNA, 22 bp, Homo sapiens
tctgggctcacgagtctggaca

SEQ ID NO: 8214389 - DNA, 22 bp, Homo sapiens
tctgggctctgcgaagcccttc

SEQ ID NO: 8214390 - DNA, 22 bp, Homo sapiens
tctgggctatatggtctctgct

SEQ ID NO: 8214391 - DNA, 22 bp, Homo sapiens
tctgggctcacgagtctggaca

SEQ ID NO: 8214392 - DNA, 22 bp, Homo sapiens
tctgggctatatggtctctgct

SEQ ID NO: 8214393 - DNA, 22 bp, Homo sapiens
tctgggcctgtctcagagctgg

SEQ ID NO: 8214394 - DNA, 22 bp, Homo sapiens
tctgggcctgatggctaaagcc

SEQ ID NO: 8214395 - DNA, 22 bp, Homo sapiens
tctgggcctcagtttcttcatc

SEQ ID NO: 8214396 - DNA, 22 bp, Homo sapiens
tctgggcctcagtttcttcatc

SEQ ID NO: 8214397 - DNA, 22 bp, Homo sapiens
tctgggcctcagtttcttcatc

SEQ ID NO: 8214398 - DNA, 22 bp, Homo sapiens
tctgggcctcacctgctgctca

SEQ ID NO: 8214399 - DNA, 22 bp, Homo sapiens
tctggggagtgcctaagtggaa

SEQ ID NO: 8214400 - DNA, 22 bp, Homo sapiens
tctggggagtgcctaagtggaa

SEQ ID NO: 8214401 - DNA, 22 bp, Homo sapiens
tctggggagtcaaagagacctg

SEQ ID NO: 8214402 - DNA, 22 bp, Homo sapiens
tctggggatgaggacctagatg

SEQ ID NO: 8214403 - DNA, 22 bp, Homo sapiens
tctggggatgaggacctagatg

SEQ ID NO: 8214404 - DNA, 22 bp, Homo sapiens
ccaggagagcaaaggtcactct

SEQ ID NO: 8214405 - DNA, 22 bp, Homo sapiens
ccaggagcaacttgaaggcaag

SEQ ID NO: 8214406 - DNA, 22 bp, Homo sapiens
ccaggagcaacttgaaggcaag

SEQ ID NO: 8214407 - DNA, 22 bp, Homo sapiens
ccaggagcaaagatcactggga

SEQ ID NO: 8214408 - DNA, 22 bp, Homo sapiens
ccaggagcaacttgaaggcaag

SEQ ID NO: 8214409 - DNA, 22 bp, Homo sapiens
ccaggagcaacttgaaggcaag

SEQ ID NO: 8214410 - DNA, 22 bp, Homo sapiens
ccaggagcaacttgaaggcaag

SEQ ID NO: 8214411 - DNA, 22 bp, Homo sapiens
ccaggagcaccaggcctgtgcc

SEQ ID NO: 8214412 - DNA, 22 bp, Homo sapiens
tctggggagcagccctggtgag

SEQ ID NO: 8214413 - DNA, 22 bp, Homo sapiens
tctggggagcagccctggtgag

SEQ ID NO: 8214414 - DNA, 22 bp, Homo sapiens
tctggggagggagccacaggtc

SEQ ID NO: 8214415 - DNA, 22 bp, Homo sapiens
tctggggagggagccacaggtc

SEQ ID NO: 8214416 - DNA, 22 bp, Homo sapiens
tctggggaccatggcatctaaa

SEQ ID NO: 8214417 - DNA, 22 bp, Homo sapiens
tctgggcttttgcactggccat

SEQ ID NO: 8214418 - DNA, 22 bp, Homo sapiens
tctgggcttttccatgcctgtg

SEQ ID NO: 8214419 - DNA, 22 bp, Homo sapiens
tctgggctctgtcagcacctct

SEQ ID NO: 8214420 - DNA, 22 bp, Homo sapiens
tctgggctctgtcagcacctct

SEQ ID NO: 8214421 - DNA, 21 bp, Homo sapiens
tctggggaagacatctaggat

SEQ ID NO: 8214422 - DNA, 21 bp, Homo sapiens
tctggggaagacatctaggat

SEQ ID NO: 8214423 - DNA, 22 bp, Homo sapiens
tctgggcttttgcactggccat

SEQ ID NO: 8214424 - DNA, 20 bp, Homo sapiens
tctgttattgcatgtacata

SEQ ID NO: 8214425 - DNA, 23 bp, Homo sapiens
tctgtggctccttcaggctgctg

SEQ ID NO: 8214426 - DNA, 22 bp, Homo sapiens
tctgttattctgtctattgcca

SEQ ID NO: 8214427 - DNA, 22 bp, Homo sapiens
ccaggagcctgggccaggctgg

SEQ ID NO: 8214428 - DNA, 22 bp, Homo sapiens
ccaggagcctgggccaggctgg

SEQ ID NO: 8214429 - DNA, 22 bp, Homo sapiens
ccaggagcctgggccaggctgg

SEQ ID NO: 8214430 - DNA, 22 bp, Homo sapiens
tctgtggctatcatactgaagg

SEQ ID NO: 8214431 - DNA, 22 bp, Homo sapiens
tctgtggctatcatactgaagg

SEQ ID NO: 8214432 - DNA, 22 bp, Homo sapiens
tctgttcagttgtaccttcccc

SEQ ID NO: 8214433 - DNA, 22 bp, Homo sapiens
tctgttcctttgtgcagtgatg

SEQ ID NO: 8214434 - DNA, 22 bp, Homo sapiens
tctgttcctttgtgcagtgatg

SEQ ID NO: 8214435 - DNA, 22 bp, Homo sapiens
tctgttcctgtcctaagggcca

SEQ ID NO: 8214436 - DNA, 22 bp, Homo sapiens
tctgttcctggtctctggagct

SEQ ID NO: 8214437 - DNA, 22 bp, Homo sapiens
tctgttcctgcatagtacctca

SEQ ID NO: 8214438 - DNA, 22 bp, Homo sapiens
tctgttcatgtctttttaagtg

SEQ ID NO: 8214439 - DNA, 22 bp, Homo sapiens
tctgttccagtagaaaggtgca

SEQ ID NO: 8214440 - DNA, 22 bp, Homo sapiens
tctgttccatgcagtgtcagat

SEQ ID NO: 8214441 - DNA, 22 bp, Homo sapiens
tctgttccatgcagtgtcagat

SEQ ID NO: 8214442 - DNA, 22 bp, Homo sapiens
tctgttcttctccactgtatgt

SEQ ID NO: 8214443 - DNA, 22 bp, Homo sapiens
tctgttcttctccactgtatgt

SEQ ID NO: 8214444 - DNA, 22 bp, Homo sapiens
ccaggagcattaagagaacata

SEQ ID NO: 8214445 - DNA, 22 bp, Homo sapiens
ccaggagcattaagagaacata

SEQ ID NO: 8214446 - DNA, 22 bp, Homo sapiens
ccaggagccactcaggcccaca

SEQ ID NO: 8214447 - DNA, 22 bp, Homo sapiens
ccaggagcattaagagaacata

SEQ ID NO: 8214448 - DNA, 22 bp, Homo sapiens
ccaggagccctgccacaatggt

SEQ ID NO: 8214449 - DNA, 22 bp, Homo sapiens
ccaggagccctgccacaatggt

SEQ ID NO: 8214450 - DNA, 22 bp, Homo sapiens
ccaggagccactcaggcccaca

SEQ ID NO: 8214451 - DNA, 22 bp, Homo sapiens
ccaggagccactcaggcccaca

SEQ ID NO: 8214452 - DNA, 22 bp, Homo sapiens
ccaggagccactcaggcccaca

SEQ ID NO: 8214453 - DNA, 22 bp, Homo sapiens
ccaggagcaggagctggacaga

SEQ ID NO: 8214454 - DNA, 22 bp, Homo sapiens
ccaggagcagggctggctgcac

SEQ ID NO: 8214455 - DNA, 22 bp, Homo sapiens
ccaggagcagggctggctgcac

SEQ ID NO: 8214456 - DNA, 22 bp, Homo sapiens
ccaggagcagggctggctgcac

SEQ ID NO: 8214457 - DNA, 19 bp, Homo sapiens
ccaggagcagtggtgagct

SEQ ID NO: 8214458 - DNA, 22 bp, Homo sapiens
ccaggagcagatatggacataa

SEQ ID NO: 8214459 - DNA, 22 bp, Homo sapiens
ccaggagcagatatggacataa

SEQ ID NO: 8214460 - DNA, 22 bp, Homo sapiens
ccaggagcagagtaggtgttca

SEQ ID NO: 8214461 - DNA, 22 bp, Homo sapiens
ccaggagcaccaggcctgtgcc

SEQ ID NO: 8214462 - DNA, 22 bp, Homo sapiens
ccaggagcaccaggcctgtgcc

SEQ ID NO: 8214463 - DNA, 22 bp, Homo sapiens
ccaggagcaggagctggacaga

SEQ ID NO: 8214464 - DNA, 22 bp, Homo sapiens
ccaggagcaggagctggacaga

SEQ ID NO: 8214465 - DNA, 22 bp, Homo sapiens
ccaggagcaggagctggacaga

SEQ ID NO: 8214466 - DNA, 22 bp, Homo sapiens
ccaggagcaggagctggacaga

SEQ ID NO: 8214467 - DNA, 22 bp, Homo sapiens
ccaggagcagccggcccacctg

SEQ ID NO: 8214468 - DNA, 22 bp, Homo sapiens
ccaggagcaggagctgcagctg

SEQ ID NO: 8214469 - DNA, 22 bp, Homo sapiens
ccaggagcaggagctgcagctg

SEQ ID NO: 8214470 - DNA, 22 bp, Homo sapiens
ccaggagcaggagctgcagctg

SEQ ID NO: 8214471 - DNA, 22 bp, Homo sapiens
ccaggagcagccggcccacctg

SEQ ID NO: 8214472 - DNA, 22 bp, Homo sapiens
ccaggagcagatatggacataa

SEQ ID NO: 8214473 - DNA, 22 bp, Homo sapiens
ccaggagcagccggcccacctg

SEQ ID NO: 8214474 - DNA, 22 bp, Homo sapiens
tcttcctcaatgtaacaacccc

SEQ ID NO: 8214475 - DNA, 22 bp, Homo sapiens
tcttagaagtttatggcacgga

SEQ ID NO: 8214476 - DNA, 22 bp, Homo sapiens
tcttagaagttcatgttccagc

SEQ ID NO: 8214477 - DNA, 22 bp, Homo sapiens
tcttagaagttcatgttccagc

SEQ ID NO: 8214478 - DNA, 22 bp, Homo sapiens
tcttagaaattccccagtggct

SEQ ID NO: 8214479 - DNA, 22 bp, Homo sapiens
tcttagaagttcatgttccagc

SEQ ID NO: 8214480 - DNA, 22 bp, Homo sapiens
tcttagaagttcatgttccagc

SEQ ID NO: 8214481 - DNA, 22 bp, Homo sapiens
tcttagaaattccccagtggct

SEQ ID NO: 8214482 - DNA, 22 bp, Homo sapiens
tcttagaaatgaagttctttct

SEQ ID NO: 8214483 - DNA, 22 bp, Homo sapiens
tcttagaaaaatggtatgtttt

SEQ ID NO: 8214484 - DNA, 22 bp, Homo sapiens
tcttagaaactgtatcgattag

SEQ ID NO: 8214485 - DNA, 22 bp, Homo sapiens
tcttcctcatgaattctcgtat

SEQ ID NO: 8214486 - DNA, 22 bp, Homo sapiens
tcttcctcatgaattctcgtat

SEQ ID NO: 8214487 - DNA, 22 bp, Homo sapiens
tcttctctcatgtaggagggaa

SEQ ID NO: 8214488 - DNA, 22 bp, Homo sapiens
tcttctctcctgcttggcagaa

SEQ ID NO: 8214489 - DNA, 22 bp, Homo sapiens
tcttctctgtggcctggtggtg

SEQ ID NO: 8214490 - DNA, 22 bp, Homo sapiens
tcttctctgtggcctggtggtg

SEQ ID NO: 8214491 - DNA, 22 bp, Homo sapiens
tcttctctgtggcctggtggtg

SEQ ID NO: 8214492 - DNA, 22 bp, Homo sapiens
tcttctctcctgcttggcagaa

SEQ ID NO: 8214493 - DNA, 22 bp, Homo sapiens
tcttctctcctgcttggcagaa

SEQ ID NO: 8214494 - DNA, 22 bp, Homo sapiens
tcttctctcctgcttggcagaa

SEQ ID NO: 8214495 - DNA, 17 bp, Homo sapiens
tcttctcttccagtctt

SEQ ID NO: 8214496 - DNA, 17 bp, Homo sapiens
tcttctcttccagtctt

SEQ ID NO: 8214497 - DNA, 17 bp, Homo sapiens
tcttctcttccagtctt

SEQ ID NO: 8214498 - DNA, 22 bp, Homo sapiens
tcttctctgtggcctggtggtg

SEQ ID NO: 8214499 - DNA, 17 bp, Homo sapiens
tcttctcttccagtctt

SEQ ID NO: 8214500 - DNA, 17 bp, Homo sapiens
tcttctcttccagtctt

SEQ ID NO: 8214501 - DNA, 17 bp, Homo sapiens
tcttctcttccagtctt

SEQ ID NO: 8214502 - DNA, 17 bp, Homo sapiens
tcttctcttccagtctt

SEQ ID NO: 8214503 - DNA, 19 bp, Homo sapiens
tcttctgacttcaagaaac

SEQ ID NO: 8214504 - DNA, 22 bp, Homo sapiens
tcttctgaaggtaggaagcatt

SEQ ID NO: 8214505 - DNA, 22 bp, Homo sapiens
tcttctggatcgatcacattgt

SEQ ID NO: 8214506 - DNA, 22 bp, Homo sapiens
ccaggcagcaaattttctgaat

SEQ ID NO: 8214507 - DNA, 22 bp, Homo sapiens
tcttctgatgccagtaaccatg

SEQ ID NO: 8214508 - DNA, 22 bp, Homo sapiens
ccaggcaggcgatggtgcagtg

SEQ ID NO: 8214509 - DNA, 22 bp, Homo sapiens
ccaggcccccgagcagaagaca

SEQ ID NO: 8214510 - DNA, 22 bp, Homo sapiens
ccaggcccccgagcagaagaca

SEQ ID NO: 8214511 - DNA, 22 bp, Homo sapiens
ccaggcctcctgtgagtggacc

SEQ ID NO: 8214512 - DNA, 22 bp, Homo sapiens
ccaggcctcctgtgagtggacc

SEQ ID NO: 8214513 - DNA, 22 bp, Homo sapiens
ccaggcctcctgtgagtggacc

SEQ ID NO: 8214514 - DNA, 19 bp, Homo sapiens
ccaggcctcctgggaggtc

SEQ ID NO: 8214515 - DNA, 19 bp, Homo sapiens
ccaggcctcctgggaggtc

SEQ ID NO: 8214516 - DNA, 19 bp, Homo sapiens
ccaggcctcctgggaggtc

SEQ ID NO: 8214517 - DNA, 22 bp, Homo sapiens
ccaggcagcctgctccattctg

SEQ ID NO: 8214518 - DNA, 22 bp, Homo sapiens
ccaggcagcctgctccattctg

SEQ ID NO: 8214519 - DNA, 22 bp, Homo sapiens
ccaggcagctctgatttatgtc

SEQ ID NO: 8214520 - DNA, 22 bp, Homo sapiens
ccaggcagctctgatttatgtc

SEQ ID NO: 8214521 - DNA, 22 bp, Homo sapiens
ccaggcagctctgatttatgtc

SEQ ID NO: 8214522 - DNA, 22 bp, Homo sapiens
ccaggcagccaagtgtgtgtgt

SEQ ID NO: 8214523 - DNA, 22 bp, Homo sapiens
ccaggcagccaagtgtgtgtgt

SEQ ID NO: 8214524 - DNA, 22 bp, Homo sapiens
ccaggcagccaagtgtgtgtgt

SEQ ID NO: 8214525 - DNA, 22 bp, Homo sapiens
ccaggcagccaagtgtgtgtgt

SEQ ID NO: 8214526 - DNA, 22 bp, Homo sapiens
ccaggcaggcgatggtgcagtg

SEQ ID NO: 8214527 - DNA, 22 bp, Homo sapiens
ccaggcaggcagcgttctcagg

SEQ ID NO: 8214528 - DNA, 22 bp, Homo sapiens
ccaggcaggcagcgttctcagg

SEQ ID NO: 8214529 - DNA, 22 bp, Homo sapiens
ccaggcaggcagcgttctcagg

SEQ ID NO: 8214530 - DNA, 22 bp, Homo sapiens
ccaggcaggcgatggtgcagtg

SEQ ID NO: 8214531 - DNA, 22 bp, Homo sapiens
ccaggcaggcgatggtgcagtg

SEQ ID NO: 8214532 - DNA, 22 bp, Homo sapiens
ccaggcaggcgatggtgcagtg

SEQ ID NO: 8214533 - DNA, 22 bp, Homo sapiens
ccaggcaggcgatggtgcagtg

SEQ ID NO: 8214534 - DNA, 22 bp, Homo sapiens
ccaggcaggcgatggtgcagtg

SEQ ID NO: 8214535 - DNA, 22 bp, Homo sapiens
ccaggaggcggaggttgcagcg

SEQ ID NO: 8214536 - DNA, 22 bp, Homo sapiens
ccaggaggcggaggttgcagcg

SEQ ID NO: 8214537 - DNA, 22 bp, Homo sapiens
ccaggaggcggaggttgcagtg

SEQ ID NO: 8214538 - DNA, 22 bp, Homo sapiens
ccaggaggcggaggttgcagtg

SEQ ID NO: 8214539 - DNA, 22 bp, Homo sapiens
ccaggaggcggaggttgcagtg

SEQ ID NO: 8214540 - DNA, 22 bp, Homo sapiens
ccaggaggcggaggttgcagtg

SEQ ID NO: 8214541 - DNA, 22 bp, Homo sapiens
ccaggaggcggaggttgcagtg

SEQ ID NO: 8214542 - DNA, 22 bp, Homo sapiens
ccaggaggctctgactggaccc

SEQ ID NO: 8214543 - DNA, 22 bp, Homo sapiens
ccaggaggctctgactggaccc

SEQ ID NO: 8214544 - DNA, 22 bp, Homo sapiens
ccaggaggctctgactggaccc

SEQ ID NO: 8214545 - DNA, 22 bp, Homo sapiens
ccaggaggctcttgtccctggt

SEQ ID NO: 8214546 - DNA, 22 bp, Homo sapiens
ccaggaggctctgcccatccca

SEQ ID NO: 8214547 - DNA, 22 bp, Homo sapiens
ccaggaggctcttgtccctggt

SEQ ID NO: 8214548 - DNA, 22 bp, Homo sapiens
ccaggcacactgccctgccctt

SEQ ID NO: 8214549 - DNA, 22 bp, Homo sapiens
ccaggcaagtagaagctgtggt

SEQ ID NO: 8214550 - DNA, 22 bp, Homo sapiens
ccaggcagaatgaaacccctgt

SEQ ID NO: 8214551 - DNA, 22 bp, Homo sapiens
ccaggcagaatgaaacccctgt

SEQ ID NO: 8214552 - DNA, 21 bp, Homo sapiens
ccaggcagagctgtgagttct

SEQ ID NO: 8214553 - DNA, 21 bp, Homo sapiens
ccaggcagagctgtgagttct

SEQ ID NO: 8214554 - DNA, 22 bp, Homo sapiens
ccaggcacttgtttgccaggca

SEQ ID NO: 8214555 - DNA, 22 bp, Homo sapiens
ccaggcacttgtttgccaggca

SEQ ID NO: 8214556 - DNA, 20 bp, Homo sapiens
tcttacaatcgttacatcca

SEQ ID NO: 8214557 - DNA, 20 bp, Homo sapiens
tcttacaatcgttacatcca

SEQ ID NO: 8214558 - DNA, 22 bp, Homo sapiens
tcttacagaaaatagataacat

SEQ ID NO: 8214559 - DNA, 22 bp, Homo sapiens
tcttaattgagaacagtgtagg

SEQ ID NO: 8214560 - DNA, 22 bp, Homo sapiens
tcttacaagaaataagccaatg

SEQ ID NO: 8214561 - DNA, 22 bp, Homo sapiens
tcttacaagaaataagccaatg

SEQ ID NO: 8214562 - DNA, 22 bp, Homo sapiens
tcttacaagaaataagccaatg

SEQ ID NO: 8214563 - DNA, 22 bp, Homo sapiens
tcttacaagaaggaaaagggag

SEQ ID NO: 8214564 - DNA, 22 bp, Homo sapiens
ccaggcagatgggccggcttca

SEQ ID NO: 8214565 - DNA, 22 bp, Homo sapiens
ccaggcagcaaattttctgaat

SEQ ID NO: 8214566 - DNA, 22 bp, Homo sapiens
ccaggcagatgggccggcttca

SEQ ID NO: 8214567 - DNA, 22 bp, Homo sapiens
ccaggcagagtgctccagaaag

SEQ ID NO: 8214568 - DNA, 22 bp, Homo sapiens
ccaggcagagtgctccagaaag

SEQ ID NO: 8214569 - DNA, 22 bp, Homo sapiens
ccaggcagagggatccccatcc

SEQ ID NO: 8214570 - DNA, 22 bp, Homo sapiens
ccaggcagagggatccccatcc

SEQ ID NO: 8214571 - DNA, 22 bp, Homo sapiens
ccaggcagagggatccccatcc

SEQ ID NO: 8214572 - DNA, 22 bp, Homo sapiens
ccaggcagagggatccccatcc

SEQ ID NO: 8214573 - DNA, 22 bp, Homo sapiens
ccaggcagagggaatagcaagt

SEQ ID NO: 8214574 - DNA, 21 bp, Homo sapiens
ccaggcagagctgtgagttct

SEQ ID NO: 8214575 - DNA, 22 bp, Homo sapiens
ccaggcagagggaatagcaagt

SEQ ID NO: 8214576 - DNA, 22 bp, Homo sapiens
ccaggcagagggaatagcaagt

SEQ ID NO: 8214577 - DNA, 22 bp, Homo sapiens
ccaggcagagggaatagcaagt

SEQ ID NO: 8214578 - DNA, 22 bp, Homo sapiens
tgaagtatacaggctctgctaa

SEQ ID NO: 8214579 - DNA, 22 bp, Homo sapiens
tgaagtatccatcttgttctag

SEQ ID NO: 8214580 - DNA, 22 bp, Homo sapiens
tgaagtatcccaagatttacag

SEQ ID NO: 8214581 - DNA, 22 bp, Homo sapiens
tgaagtcccattcttaggttga

SEQ ID NO: 8214582 - DNA, 22 bp, Homo sapiens
tgaagtgacctggggcagtgta

SEQ ID NO: 8214583 - DNA, 22 bp, Homo sapiens
tgaagtgaagaagcatgaatag

SEQ ID NO: 8214584 - DNA, 22 bp, Homo sapiens
tgaagtgagtagtgtctagggg

SEQ ID NO: 8214585 - DNA, 22 bp, Homo sapiens
tgaagtgattagaaccacttga

SEQ ID NO: 8214586 - DNA, 22 bp, Homo sapiens
tgaagtggaccctggacagacc

SEQ ID NO: 8214587 - DNA, 23 bp, Homo sapiens
tgaagtgaaatttcacaagggac

SEQ ID NO: 8214588 - DNA, 22 bp, Homo sapiens
tgaagtctttctgatcatttac

SEQ ID NO: 8214589 - DNA, 23 bp, Homo sapiens
tgaagtgaaatttcacaagggac

SEQ ID NO: 8214590 - DNA, 22 bp, Homo sapiens
tgaagtgaagaagcatgaatag

SEQ ID NO: 8214591 - DNA, 22 bp, Homo sapiens
tgaagtctctgttttctcattt

SEQ ID NO: 8214592 - DNA, 22 bp, Homo sapiens
ccagggcagtgggagaaggtgc

SEQ ID NO: 8214593 - DNA, 22 bp, Homo sapiens
ccagggcagtgggagaaggtgc

SEQ ID NO: 8214594 - DNA, 22 bp, Homo sapiens
ccagggcagtgggagaaggtgc

SEQ ID NO: 8214595 - DNA, 22 bp, Homo sapiens
ccagggcagtgggagaaggtgc

SEQ ID NO: 8214596 - DNA, 22 bp, Homo sapiens
ccagggcatcacatccagtgtt

SEQ ID NO: 8214597 - DNA, 22 bp, Homo sapiens
ccagggcatcctcacatcgcag

SEQ ID NO: 8214598 - DNA, 22 bp, Homo sapiens
ccagggcatcacatccagtgtt

SEQ ID NO: 8214599 - DNA, 22 bp, Homo sapiens
tgaaggtgtctttgtgaacatc

SEQ ID NO: 8214600 - DNA, 19 bp, Homo sapiens
tgaaggtgtatgtgctggg

SEQ ID NO: 8214601 - DNA, 22 bp, Homo sapiens
tgaaggtgtatgctgtgggtca

SEQ ID NO: 8214602 - DNA, 22 bp, Homo sapiens
ccagggcatgggaagaactgaa

SEQ ID NO: 8214603 - DNA, 22 bp, Homo sapiens
ccagggcatgggaagaactgaa

SEQ ID NO: 8214604 - DNA, 22 bp, Homo sapiens
ccagggcatcacatccagtgtt

SEQ ID NO: 8214605 - DNA, 22 bp, Homo sapiens
ccagggcatcctcacatcgcag

SEQ ID NO: 8214606 - DNA, 22 bp, Homo sapiens
ccagggcatcctcacatcgcag

SEQ ID NO: 8214607 - DNA, 22 bp, Homo sapiens
tgaagttatatatgttgaaaat

SEQ ID NO: 8214608 - DNA, 22 bp, Homo sapiens
ccagggcctacagcttaagtcc

SEQ ID NO: 8214609 - DNA, 22 bp, Homo sapiens
tgaagttagaactatgaggata

SEQ ID NO: 8214610 - DNA, 22 bp, Homo sapiens
tgaagtgggaatacttcttccc

SEQ ID NO: 8214611 - DNA, 22 bp, Homo sapiens
tgaagttagaactatgaggata

SEQ ID NO: 8214612 - DNA, 22 bp, Homo sapiens
ccagggcctcgtgttctgagtg

SEQ ID NO: 8214613 - DNA, 22 bp, Homo sapiens
ccagggcctcgtgttctgagtg

SEQ ID NO: 8214614 - DNA, 22 bp, Homo sapiens
ccagggctccattgctcatcct

SEQ ID NO: 8214615 - DNA, 22 bp, Homo sapiens
ccagggctccattgctcatcct

SEQ ID NO: 8214616 - DNA, 22 bp, Homo sapiens
ccagggctccccagaagtaccc

SEQ ID NO: 8214617 - DNA, 22 bp, Homo sapiens
ccagggctccccagaagtaccc

SEQ ID NO: 8214618 - DNA, 22 bp, Homo sapiens
ccagggctccattgctcatcct

SEQ ID NO: 8214619 - DNA, 22 bp, Homo sapiens
ccagggctccattgctcatcct

SEQ ID NO: 8214620 - DNA, 22 bp, Homo sapiens
ccagggctccccagaagtaccc

SEQ ID NO: 8214621 - DNA, 22 bp, Homo sapiens
ccagggctctatgagggtggag

SEQ ID NO: 8214622 - DNA, 22 bp, Homo sapiens
ccagggctcgggtgcttagtca

SEQ ID NO: 8214623 - DNA, 22 bp, Homo sapiens
ccagggctcgggtgcttagtca

SEQ ID NO: 8214624 - DNA, 22 bp, Homo sapiens
ccagggctctatgagggtggag

SEQ ID NO: 8214625 - DNA, 22 bp, Homo sapiens
ccagggctctatgagggtggag

SEQ ID NO: 8214626 - DNA, 22 bp, Homo sapiens
ccagggctctgcttctgccatg

SEQ ID NO: 8214627 - DNA, 22 bp, Homo sapiens
ccagggctctgcttctgccatg

SEQ ID NO: 8214628 - DNA, 22 bp, Homo sapiens
ccagggctctgcttctgccatg

SEQ ID NO: 8214629 - DNA, 22 bp, Homo sapiens
ccagggctgagactgtattggg

SEQ ID NO: 8214630 - DNA, 22 bp, Homo sapiens
ccagggctgagctgtgaccatg

SEQ ID NO: 8214631 - DNA, 22 bp, Homo sapiens
ccagggctctgcttctgccatg

SEQ ID NO: 8214632 - DNA, 22 bp, Homo sapiens
ccagggctctgcttctgccatg

SEQ ID NO: 8214633 - DNA, 22 bp, Homo sapiens
ccagggctctgcttctgccatg

SEQ ID NO: 8214634 - DNA, 22 bp, Homo sapiens
ccagggctgagctgtgaccatg

SEQ ID NO: 8214635 - DNA, 22 bp, Homo sapiens
ccagggctgagctgtgaccatg

SEQ ID NO: 8214636 - DNA, 22 bp, Homo sapiens
ccagggctgagctgtgaccatg

SEQ ID NO: 8214637 - DNA, 22 bp, Homo sapiens
ccagggctgagctgtgaccatg

SEQ ID NO: 8214638 - DNA, 22 bp, Homo sapiens
ccagggctgagctgtgaccatg

SEQ ID NO: 8214639 - DNA, 22 bp, Homo sapiens
ccagggctgagctgtgaccatg

SEQ ID NO: 8214640 - DNA, 22 bp, Homo sapiens
ccagggctgccgcatccctggt

SEQ ID NO: 8214641 - DNA, 22 bp, Homo sapiens
ccagggctgccgcatccctggt

SEQ ID NO: 8214642 - DNA, 22 bp, Homo sapiens
ccagggctgcctggccgtgtgt

SEQ ID NO: 8214643 - DNA, 22 bp, Homo sapiens
ccagggctgccgcatccctggt

SEQ ID NO: 8214644 - DNA, 22 bp, Homo sapiens
ccagggctgagctgtgaccatg

SEQ ID NO: 8214645 - DNA, 22 bp, Homo sapiens
ccagggctgccgcatccctggt

SEQ ID NO: 8214646 - DNA, 22 bp, Homo sapiens
tgaaatgagatagataatcagg

SEQ ID NO: 8214647 - DNA, 22 bp, Homo sapiens
tgaaatgagataatttaagtgc

SEQ ID NO: 8214648 - DNA, 22 bp, Homo sapiens
tgaaatgagataatttaagtgc

SEQ ID NO: 8214649 - DNA, 22 bp, Homo sapiens
tgaaatgagatagataatcagg

SEQ ID NO: 8214650 - DNA, 22 bp, Homo sapiens
tgaaatgagcatttattcttta

SEQ ID NO: 8214651 - DNA, 22 bp, Homo sapiens
tgaaatgagcatttattcttta

SEQ ID NO: 8214652 - DNA, 22 bp, Homo sapiens
tgaaatgagcatttattcttta

SEQ ID NO: 8214653 - DNA, 22 bp, Homo sapiens
tgaaatgatatctgataacaaa

SEQ ID NO: 8214654 - DNA, 22 bp, Homo sapiens
ccagggaagctggtcacgcagg

SEQ ID NO: 8214655 - DNA, 22 bp, Homo sapiens
tgaaatgatcagtttggttact

SEQ ID NO: 8214656 - DNA, 22 bp, Homo sapiens
tgaaatgatgtacaagaaggca

SEQ ID NO: 8214657 - DNA, 22 bp, Homo sapiens
ccagggaagattagaagccact

SEQ ID NO: 8214658 - DNA, 22 bp, Homo sapiens
tgaaatgatatctgataacaaa

SEQ ID NO: 8214659 - DNA, 22 bp, Homo sapiens
tgaaatgatcagtttggttact

SEQ ID NO: 8214660 - DNA, 22 bp, Homo sapiens
tgaaatgatcagtttggttact

SEQ ID NO: 8214661 - DNA, 22 bp, Homo sapiens
ccagggagggtcctgtggcttc

SEQ ID NO: 8214662 - DNA, 17 bp, Homo sapiens
ccagggaggggccgcgc

SEQ ID NO: 8214663 - DNA, 22 bp, Homo sapiens
ccagggagggtcctgtggcttc

SEQ ID NO: 8214664 - DNA, 22 bp, Homo sapiens
ccagggagggtcctgtggcttc

SEQ ID NO: 8214665 - DNA, 23 bp, Homo sapiens
ccagggaggttgattggttaccc

SEQ ID NO: 8214666 - DNA, 23 bp, Homo sapiens
ccagggagtgctactatcaagcc

SEQ ID NO: 8214667 - DNA, 18 bp, Homo sapiens
ccagggatgcatggtccc

SEQ ID NO: 8214668 - DNA, 22 bp, Homo sapiens
ccagggatgcagaggttgcagt

SEQ ID NO: 8214669 - DNA, 18 bp, Homo sapiens
ccagggatgcatggtccc

SEQ ID NO: 8214670 - DNA, 22 bp, Homo sapiens
ccagggatgccaagctttacca

SEQ ID NO: 8214671 - DNA, 22 bp, Homo sapiens
ccagggatgctttcccaggact

SEQ ID NO: 8214672 - DNA, 22 bp, Homo sapiens
ccagggatgctttcccaggact

SEQ ID NO: 8214673 - DNA, 22 bp, Homo sapiens
ccagggcaattatttggagggt

SEQ ID NO: 8214674 - DNA, 22 bp, Homo sapiens
ccagggcacgttgggacagtac

SEQ ID NO: 8214675 - DNA, 22 bp, Homo sapiens
ccagggcacgttgggacagtac

SEQ ID NO: 8214676 - DNA, 22 bp, Homo sapiens
ccagggcacgttgggacagtac

SEQ ID NO: 8214677 - DNA, 22 bp, Homo sapiens
ccagggcaggagaaagactcac

SEQ ID NO: 8214678 - DNA, 22 bp, Homo sapiens
ccagggcacgttgggacagtac

SEQ ID NO: 8214679 - DNA, 22 bp, Homo sapiens
ccagggcacgttgggacagtac

SEQ ID NO: 8214680 - DNA, 22 bp, Homo sapiens
ccagggcacgttgggacagtac

SEQ ID NO: 8214681 - DNA, 22 bp, Homo sapiens
ccagggcagggaccacgtgtct

SEQ ID NO: 8214682 - DNA, 22 bp, Homo sapiens
ccagggcaggagaaagactcac

SEQ ID NO: 8214683 - DNA, 22 bp, Homo sapiens
ccagggcaggagaaagactcac

SEQ ID NO: 8214684 - DNA, 22 bp, Homo sapiens
ccagggcagggaccacgtgtct

SEQ ID NO: 8214685 - DNA, 22 bp, Homo sapiens
ccagggcaggagaaagactcac

SEQ ID NO: 8214686 - DNA, 22 bp, Homo sapiens
ccagggcagggaccacgtgtct

SEQ ID NO: 8214687 - DNA, 22 bp, Homo sapiens
ccagggcaggggctggagttca

SEQ ID NO: 8214688 - DNA, 22 bp, Homo sapiens
ccagggcaggggctggagttca

SEQ ID NO: 8214689 - DNA, 22 bp, Homo sapiens
ccagggcagtgggagaaggtgc

SEQ ID NO: 8214690 - DNA, 22 bp, Homo sapiens
ccagggcaggggctggagttca

SEQ ID NO: 8214691 - DNA, 22 bp, Homo sapiens
ccagggcaggggctggagttca

SEQ ID NO: 8214692 - DNA, 22 bp, Homo sapiens
ccagggcaataggaacactttt

SEQ ID NO: 8214693 - DNA, 22 bp, Homo sapiens
ccagggcaattatttggagggt

SEQ ID NO: 8214694 - DNA, 22 bp, Homo sapiens
ccagggcaattatttggagggt

SEQ ID NO: 8214695 - DNA, 22 bp, Homo sapiens
ccagggcaattatttggagggt

SEQ ID NO: 8214696 - DNA, 22 bp, Homo sapiens
ccagggcaacgctgtctcagag

SEQ ID NO: 8214697 - DNA, 22 bp, Homo sapiens
ccagggcaataggaacactttt

SEQ ID NO: 8214698 - DNA, 22 bp, Homo sapiens
ccagggcaataggaacactttt

SEQ ID NO: 8214699 - DNA, 22 bp, Homo sapiens
ccagggcaacgctgtctcagag

SEQ ID NO: 8214700 - DNA, 22 bp, Homo sapiens
ccagggcaacgctgtctcagag

SEQ ID NO: 8214701 - DNA, 22 bp, Homo sapiens
ccagggcaacgctgtctcagag

SEQ ID NO: 8214702 - DNA, 22 bp, Homo sapiens
ccagggcaaatgagatcatagc

SEQ ID NO: 8214703 - DNA, 21 bp, Homo sapiens
ccagggatgttgaactgaaag

SEQ ID NO: 8214704 - DNA, 22 bp, Homo sapiens
ccagggatgtggcagcaccata

SEQ ID NO: 8214705 - DNA, 22 bp, Homo sapiens
ccagggcaacgctgtctcagag

SEQ ID NO: 8214706 - DNA, 22 bp, Homo sapiens
ccagggcaacgctgtctcagag

SEQ ID NO: 8214707 - DNA, 22 bp, Homo sapiens
ccagggcaaatgagatcatagc

SEQ ID NO: 8214708 - DNA, 22 bp, Homo sapiens
ccagggcaaatgagatcatagc

SEQ ID NO: 8214709 - DNA, 22 bp, Homo sapiens
tgaaacaaatttggaaaatcta

SEQ ID NO: 8214710 - DNA, 22 bp, Homo sapiens
tcttttgtggatgaagaaatgg

SEQ ID NO: 8214711 - DNA, 22 bp, Homo sapiens
tcttttgtggatgaagaaatgg

SEQ ID NO: 8214712 - DNA, 21 bp, Homo sapiens
ccaggctgggagggcagttcc

SEQ ID NO: 8214713 - DNA, 21 bp, Homo sapiens
ccaggctggccatggtattga

SEQ ID NO: 8214714 - DNA, 22 bp, Homo sapiens
tgaaacagaagatgttcatgtg

SEQ ID NO: 8214715 - DNA, 22 bp, Homo sapiens
tgaaacaatgtgaagttgctga

SEQ ID NO: 8214716 - DNA, 22 bp, Homo sapiens
tgaaacaattagaatgtaatga

SEQ ID NO: 8214717 - DNA, 22 bp, Homo sapiens
tgaaatgagagcacagaataaa

SEQ ID NO: 8214718 - DNA, 22 bp, Homo sapiens
tgaaatgagagcacagaataaa

SEQ ID NO: 8214719 - DNA, 21 bp, Homo sapiens
tgaaatgagaatgctgagcac

SEQ ID NO: 8214720 - DNA, 22 bp, Homo sapiens
tgaaatgacagtcttaagctct

SEQ ID NO: 8214721 - DNA, 21 bp, Homo sapiens
tgaaatgagaatgctgagcac

SEQ ID NO: 8214722 - DNA, 22 bp, Homo sapiens
tgaaatgacaaaggtttttctt

SEQ ID NO: 8214723 - DNA, 22 bp, Homo sapiens
tgaaatgacagtcttaagctct

SEQ ID NO: 8214724 - DNA, 22 bp, Homo sapiens
tgaaatgacaaaggtttttctt

SEQ ID NO: 8214725 - DNA, 22 bp, Homo sapiens
tgaaatgaatgtgattcgatag

SEQ ID NO: 8214726 - DNA, 22 bp, Homo sapiens
tgaaatgacaaaggtttttctt

SEQ ID NO: 8214727 - DNA, 22 bp, Homo sapiens
tgaaatgaagggcttgttctgg

SEQ ID NO: 8214728 - DNA, 22 bp, Homo sapiens
tgaaatgaatgtgattcgatag

SEQ ID NO: 8214729 - DNA, 22 bp, Homo sapiens
tgaaatgaatgtgattcgatag

SEQ ID NO: 8214730 - DNA, 22 bp, Homo sapiens
ccaggcttcctaatgtgtgcag

SEQ ID NO: 8214731 - DNA, 22 bp, Homo sapiens
ccaggcttcctaatgtgtgcag

SEQ ID NO: 8214732 - DNA, 22 bp, Homo sapiens
ccaggcttccctgagaggctgc

SEQ ID NO: 8214733 - DNA, 22 bp, Homo sapiens
ccaggcttccctgagaggctgc

SEQ ID NO: 8214734 - DNA, 22 bp, Homo sapiens
ccaggcttcccccatcctagga

SEQ ID NO: 8214735 - DNA, 22 bp, Homo sapiens
ccaggcttattatcttctccat

SEQ ID NO: 8214736 - DNA, 22 bp, Homo sapiens
ccaggcttcaggagtggtttcc

SEQ ID NO: 8214737 - DNA, 22 bp, Homo sapiens
ccaggcttctgattccaggcac

SEQ ID NO: 8214738 - DNA, 22 bp, Homo sapiens
ccaggcttcctaatgtgtgcag

SEQ ID NO: 8214739 - DNA, 22 bp, Homo sapiens
tgaaatgaaacagaacatatca

SEQ ID NO: 8214740 - DNA, 22 bp, Homo sapiens
ccaggcttgaagggaagaatgg

SEQ ID NO: 8214741 - DNA, 22 bp, Homo sapiens
tgaaatgaagggcttgttctgg

SEQ ID NO: 8214742 - DNA, 22 bp, Homo sapiens
ccaggctgttttcaaacttggg

SEQ ID NO: 8214743 - DNA, 22 bp, Homo sapiens
ccaggctgtggtttagatagag

SEQ ID NO: 8214744 - DNA, 22 bp, Homo sapiens
ccaggctgttttcaaacttggg

SEQ ID NO: 8214745 - DNA, 22 bp, Homo sapiens
ccaggctgttttcaaacttggg

SEQ ID NO: 8214746 - DNA, 22 bp, Homo sapiens
ccaggctgtggtttagatagag

SEQ ID NO: 8214747 - DNA, 22 bp, Homo sapiens
ccaggctgtggtttagatagag

SEQ ID NO: 8214748 - DNA, 22 bp, Homo sapiens
ccaggctgtggtttagatagag

SEQ ID NO: 8214749 - DNA, 21 bp, Homo sapiens
ccaggctgggagggcagttcc

SEQ ID NO: 8214750 - DNA, 21 bp, Homo sapiens
ccaggctgggagggcagttcc

SEQ ID NO: 8214751 - DNA, 22 bp, Homo sapiens
ccaggctgtaagagtgatgttg

SEQ ID NO: 8214752 - DNA, 22 bp, Homo sapiens
ccaggctgtaagagtgatgttg

SEQ ID NO: 8214753 - DNA, 22 bp, Homo sapiens
ccaggctgtaagagtgatgttg

SEQ ID NO: 8214754 - DNA, 22 bp, Homo sapiens
ccaggctgtgcttttcataaat

SEQ ID NO: 8214755 - DNA, 22 bp, Homo sapiens
ccaggctgtaagagtgatgttg

SEQ ID NO: 8214756 - DNA, 22 bp, Homo sapiens
ccaggctgtgcttttcataaat

SEQ ID NO: 8214757 - DNA, 22 bp, Homo sapiens
tcttttgggttcttatgattta

SEQ ID NO: 8214758 - DNA, 22 bp, Homo sapiens
tcttttggaaatgatgtgcagg

SEQ ID NO: 8214759 - DNA, 22 bp, Homo sapiens
tcttttcttcttaatggttaat

SEQ ID NO: 8214760 - DNA, 22 bp, Homo sapiens
tcttttcttcttaatggttaat

SEQ ID NO: 8214761 - DNA, 22 bp, Homo sapiens
tcttttgagggccagaggaaga

SEQ ID NO: 8214762 - DNA, 22 bp, Homo sapiens
tcttttcttgcattattgcact

SEQ ID NO: 8214763 - DNA, 22 bp, Homo sapiens
tcttttcttgcattattgcact

SEQ ID NO: 8214764 - DNA, 22 bp, Homo sapiens
tcttttctgtaactcagtgtct

SEQ ID NO: 8214765 - DNA, 22 bp, Homo sapiens
tcttttctggactctgcatgga

SEQ ID NO: 8214766 - DNA, 22 bp, Homo sapiens
tcttttctgtaactcagtgtct

SEQ ID NO: 8214767 - DNA, 22 bp, Homo sapiens
tcttttcttcttaatggttaat

SEQ ID NO: 8214768 - DNA, 22 bp, Homo sapiens
tcttttctggactctgcatgga

SEQ ID NO: 8214769 - DNA, 22 bp, Homo sapiens
tcttttctgccagctgagccct

SEQ ID NO: 8214770 - DNA, 22 bp, Homo sapiens
tcttttctgccagctgagccct

SEQ ID NO: 8214771 - DNA, 22 bp, Homo sapiens
tcttttctgccacagcctgagc

SEQ ID NO: 8214772 - DNA, 22 bp, Homo sapiens
tcttttctgccacagcctgagc

SEQ ID NO: 8214773 - DNA, 22 bp, Homo sapiens
tctttggtttctgtctctgtaa

SEQ ID NO: 8214774 - DNA, 22 bp, Homo sapiens
tctttggttgcactgcaggtgt

SEQ ID NO: 8214775 - DNA, 22 bp, Homo sapiens
tcttgccacttcatcccctttc

SEQ ID NO: 8214776 - DNA, 22 bp, Homo sapiens
ccaggcctgcatctgctgcgca

SEQ ID NO: 8214777 - DNA, 22 bp, Homo sapiens
ccaggcctgattgggaatcttg

SEQ ID NO: 8214778 - DNA, 22 bp, Homo sapiens
ccaggcctgattgggaatcttg

SEQ ID NO: 8214779 - DNA, 22 bp, Homo sapiens
ccaggcctgattgggaatcttg

SEQ ID NO: 8214780 - DNA, 22 bp, Homo sapiens
ccaggcctgattgggaatcttg

SEQ ID NO: 8214781 - DNA, 19 bp, Homo sapiens
ccaggcctctggggcctgt

SEQ ID NO: 8214782 - DNA, 19 bp, Homo sapiens
ccaggcctctggggcctgt

SEQ ID NO: 8214783 - DNA, 19 bp, Homo sapiens
ccaggcctctggggcctgt

SEQ ID NO: 8214784 - DNA, 23 bp, Homo sapiens
ccaggcctctcagagggtgtgcc

SEQ ID NO: 8214785 - DNA, 23 bp, Homo sapiens
ccaggcctctcagagggtgtgcc

SEQ ID NO: 8214786 - DNA, 23 bp, Homo sapiens
ccaggcctctcagagggtgtgcc

SEQ ID NO: 8214787 - DNA, 22 bp, Homo sapiens
ccaggcctctggctgcttagtc

SEQ ID NO: 8214788 - DNA, 19 bp, Homo sapiens
ccaggcctctggggcctgt

SEQ ID NO: 8214789 - DNA, 19 bp, Homo sapiens
ccaggcctctggggcctgt

SEQ ID NO: 8214790 - DNA, 22 bp, Homo sapiens
ccaggcctctggctgcttagtc

SEQ ID NO: 8214791 - DNA, 22 bp, Homo sapiens
ccaggcctctggctgcttagtc

SEQ ID NO: 8214792 - DNA, 22 bp, Homo sapiens
ccaggcctctggctgcttagtc

SEQ ID NO: 8214793 - DNA, 22 bp, Homo sapiens
tcttgcacttcatgaatatgtt

SEQ ID NO: 8214794 - DNA, 22 bp, Homo sapiens
tcttgcacttcatgaatatgtt

SEQ ID NO: 8214795 - DNA, 22 bp, Homo sapiens
tcttgcagcttcatctgcaatt

SEQ ID NO: 8214796 - DNA, 22 bp, Homo sapiens
tcttgcagcttcatctgcaatt

SEQ ID NO: 8214797 - DNA, 22 bp, Homo sapiens
tcttgcagagggcccttctgct

SEQ ID NO: 8214798 - DNA, 22 bp, Homo sapiens
tcttgcagagggcccttctgct

SEQ ID NO: 8214799 - DNA, 22 bp, Homo sapiens
tcttgcagaggcactgtgtcag

SEQ ID NO: 8214800 - DNA, 22 bp, Homo sapiens
cctgcccagagcccctttcact

SEQ ID NO: 8214801 - DNA, 22 bp, Homo sapiens
cctgcccagcttcacctcaggc

SEQ ID NO: 8214802 - DNA, 22 bp, Homo sapiens
cctgccctgtcactggctaggg

SEQ ID NO: 8214803 - DNA, 22 bp, Homo sapiens
cctgcccagcttcacctcaggc

SEQ ID NO: 8214804 - DNA, 22 bp, Homo sapiens
cctgcccagcttcacctcaggc

SEQ ID NO: 8214805 - DNA, 22 bp, Homo sapiens
cctgccctgtcactggctaggg

SEQ ID NO: 8214806 - DNA, 22 bp, Homo sapiens
cctgccctgtcactggctaggg

SEQ ID NO: 8214807 - DNA, 22 bp, Homo sapiens
tggtacacatgtccaaggtcag

SEQ ID NO: 8214808 - DNA, 17 bp, Homo sapiens
tggtacaggctgaggga

SEQ ID NO: 8214809 - DNA, 22 bp, Homo sapiens
tggtacataaatggatgttttc

SEQ ID NO: 8214810 - DNA, 22 bp, Homo sapiens
tggtacatgggtaggtatctct

SEQ ID NO: 8214811 - DNA, 22 bp, Homo sapiens
tggtactgtcatccattttaaa

SEQ ID NO: 8214812 - DNA, 22 bp, Homo sapiens
tggtactgagaatagcgtctac

SEQ ID NO: 8214813 - DNA, 17 bp, Homo sapiens
tggtagaatgacaggcc

SEQ ID NO: 8214814 - DNA, 22 bp, Homo sapiens
cctgcccttctttccccagcat

SEQ ID NO: 8214815 - DNA, 22 bp, Homo sapiens
cctgcccttctttccccagcat

SEQ ID NO: 8214816 - DNA, 22 bp, Homo sapiens
cctgccctgtgtttggggacta

SEQ ID NO: 8214817 - DNA, 22 bp, Homo sapiens
cctgcctcaggactctgcatat

SEQ ID NO: 8214818 - DNA, 22 bp, Homo sapiens
cctgcctcaggactctgcatat

SEQ ID NO: 8214819 - DNA, 22 bp, Homo sapiens
cctgcctcaggactctgcatat

SEQ ID NO: 8214820 - DNA, 22 bp, Homo sapiens
cctgcctatgagacgttttgcc

SEQ ID NO: 8214821 - DNA, 22 bp, Homo sapiens
cctgcctcatcaacttgtcgtg

SEQ ID NO: 8214822 - DNA, 22 bp, Homo sapiens
cctgcctcccagaggtcctcta

SEQ ID NO: 8214823 - DNA, 23 bp, Homo sapiens
cctgcctccccatcagttataca

SEQ ID NO: 8214824 - DNA, 22 bp, Homo sapiens
cctgcctgaaggtcagccaccc

SEQ ID NO: 8214825 - DNA, 22 bp, Homo sapiens
cctgcctgaaggtcagccaccc

SEQ ID NO: 8214826 - DNA, 22 bp, Homo sapiens
cctgcctgaaggtcagccaccc

SEQ ID NO: 8214827 - DNA, 22 bp, Homo sapiens
cctgcctgaaggtcagccaccc

SEQ ID NO: 8214828 - DNA, 22 bp, Homo sapiens
cctgcctgacagagaaggttca

SEQ ID NO: 8214829 - DNA, 19 bp, Homo sapiens
cctgcctgagctgtccctc

SEQ ID NO: 8214830 - DNA, 17 bp, Homo sapiens
cctgcctgagccatagc

SEQ ID NO: 8214831 - DNA, 19 bp, Homo sapiens
cctgcctgagctgtccctc

SEQ ID NO: 8214832 - DNA, 19 bp, Homo sapiens
cctgcctgagctgtccctc

SEQ ID NO: 8214833 - DNA, 22 bp, Homo sapiens
tggtgggagtccgctgtgctgc

SEQ ID NO: 8214834 - DNA, 22 bp, Homo sapiens
tggtgggagtccgctgtgctgc

SEQ ID NO: 8214835 - DNA, 22 bp, Homo sapiens
cctgcctgcagaaagtatctcc

SEQ ID NO: 8214836 - DNA, 22 bp, Homo sapiens
tggtgggagtccgctgtgctgc

SEQ ID NO: 8214837 - DNA, 22 bp, Homo sapiens
cctgcctgcagaaagtatctcc

SEQ ID NO: 8214838 - DNA, 22 bp, Homo sapiens
cctgcctgcaaaatgggacaag

SEQ ID NO: 8214839 - DNA, 22 bp, Homo sapiens
cctgcctgattccaggatggct

SEQ ID NO: 8214840 - DNA, 22 bp, Homo sapiens
cctgcctgattccaggatggct

SEQ ID NO: 8214841 - DNA, 22 bp, Homo sapiens
cctgcctgcaaaatgggacaag

SEQ ID NO: 8214842 - DNA, 22 bp, Homo sapiens
cctgcctgcaccttctctgggg

SEQ ID NO: 8214843 - DNA, 22 bp, Homo sapiens
tgggtccacaaacatcagatat

SEQ ID NO: 8214844 - DNA, 22 bp, Homo sapiens
tgggtcagtttgggggccagcc

SEQ ID NO: 8214845 - DNA, 22 bp, Homo sapiens
tgggtcagtttgggggccagcc

SEQ ID NO: 8214846 - DNA, 22 bp, Homo sapiens
cctgccagaaaagagggagttc

SEQ ID NO: 8214847 - DNA, 22 bp, Homo sapiens
cctgccacttcttgctatggag

SEQ ID NO: 8214848 - DNA, 22 bp, Homo sapiens
cctgccacttcttgctatggag

SEQ ID NO: 8214849 - DNA, 22 bp, Homo sapiens
cctgcatgtggtcagcactcct

SEQ ID NO: 8214850 - DNA, 17 bp, Homo sapiens
cctgcagtgcctgtcgg

SEQ ID NO: 8214851 - DNA, 22 bp, Homo sapiens
cctgcaggtttcccccggacgg

SEQ ID NO: 8214852 - DNA, 22 bp, Homo sapiens
cctgcaggttgcagaggcggaa

SEQ ID NO: 8214853 - DNA, 22 bp, Homo sapiens
cctgcaggttgcagaggcggaa

SEQ ID NO: 8214854 - DNA, 19 bp, Homo sapiens
cctgcagggatgagaggtt

SEQ ID NO: 8214855 - DNA, 19 bp, Homo sapiens
cctgcagggatgagaggtt

SEQ ID NO: 8214856 - DNA, 22 bp, Homo sapiens
cctgcagggtgctgccacagat

SEQ ID NO: 8214857 - DNA, 22 bp, Homo sapiens
cctgcaggggagagacttctag

SEQ ID NO: 8214858 - DNA, 22 bp, Homo sapiens
cctgcaggggagagacttctag

SEQ ID NO: 8214859 - DNA, 22 bp, Homo sapiens
cctgcaggggagagacttctag

SEQ ID NO: 8214860 - DNA, 22 bp, Homo sapiens
cctgcagggtgctgccacagat

SEQ ID NO: 8214861 - DNA, 22 bp, Homo sapiens
cctgcagggtgctgccacagat

SEQ ID NO: 8214862 - DNA, 22 bp, Homo sapiens
cctgcaggtaaggctaactgcc

SEQ ID NO: 8214863 - DNA, 22 bp, Homo sapiens
cctgcaggtccccggatgcgca

SEQ ID NO: 8214864 - DNA, 22 bp, Homo sapiens
cctgcaggtccccggatgcgca

SEQ ID NO: 8214865 - DNA, 22 bp, Homo sapiens
cctgcaggtccccggatgcgca

SEQ ID NO: 8214866 - DNA, 22 bp, Homo sapiens
cctgcaggtccccggatgcgca

SEQ ID NO: 8214867 - DNA, 23 bp, Homo sapiens
tggtaatagggagcagaaggtag

SEQ ID NO: 8214868 - DNA, 22 bp, Homo sapiens
tgggtgggagcaccctgtctgg

SEQ ID NO: 8214869 - DNA, 22 bp, Homo sapiens
tggtacacatgtccaaggtcag

SEQ ID NO: 8214870 - DNA, 22 bp, Homo sapiens
tggtacacatgtccaaggtcag

SEQ ID NO: 8214871 - DNA, 22 bp, Homo sapiens
tgggtggaataaatcagttctg

SEQ ID NO: 8214872 - DNA, 22 bp, Homo sapiens
tgggtccacaaacatcagatat

SEQ ID NO: 8214873 - DNA, 22 bp, Homo sapiens
tgggtggagctccacaacctgt

SEQ ID NO: 8214874 - DNA, 22 bp, Homo sapiens
tgggtggattaggatagggtat

SEQ ID NO: 8214875 - DNA, 22 bp, Homo sapiens
tgggtggattaggatagggtat

SEQ ID NO: 8214876 - DNA, 22 bp, Homo sapiens
tgggtggattaggatagggtat

SEQ ID NO: 8214877 - DNA, 22 bp, Homo sapiens
tgggtggcaaaggcccattgtc

SEQ ID NO: 8214878 - DNA, 22 bp, Homo sapiens
tgggtggcaaaggcccattgtc

SEQ ID NO: 8214879 - DNA, 22 bp, Homo sapiens
tgggtggcacttctggggtcca

SEQ ID NO: 8214880 - DNA, 22 bp, Homo sapiens
tgggtggcacttctggggtcca

SEQ ID NO: 8214881 - DNA, 22 bp, Homo sapiens
tgggtggcacttctggggtcca

SEQ ID NO: 8214882 - DNA, 22 bp, Homo sapiens
tgggtggcggcctggttctgag

SEQ ID NO: 8214883 - DNA, 22 bp, Homo sapiens
tgggtggcggcctggttctgag

SEQ ID NO: 8214884 - DNA, 18 bp, Homo sapiens
tgggtggctagggagttt

SEQ ID NO: 8214885 - DNA, 18 bp, Homo sapiens
tgggtggctagggagttt

SEQ ID NO: 8214886 - DNA, 22 bp, Homo sapiens
tgggtggcggcctggttctgag

SEQ ID NO: 8214887 - DNA, 22 bp, Homo sapiens
tgggtggcggcctggttctgag

SEQ ID NO: 8214888 - DNA, 18 bp, Homo sapiens
tgggtggctagggagttt

SEQ ID NO: 8214889 - DNA, 18 bp, Homo sapiens
tgggtggctagggagttt

SEQ ID NO: 8214890 - DNA, 22 bp, Homo sapiens
tgggtggcacttctggggtcca

SEQ ID NO: 8214891 - DNA, 22 bp, Homo sapiens
tgggtggcacttctggggtcca

SEQ ID NO: 8214892 - DNA, 22 bp, Homo sapiens
tgggtggcagcttcagcatgtt

SEQ ID NO: 8214893 - DNA, 22 bp, Homo sapiens
tgggtggcagcttcagcatgtt

SEQ ID NO: 8214894 - DNA, 22 bp, Homo sapiens
tgggtggcagcttcagcatgtt

SEQ ID NO: 8214895 - DNA, 22 bp, Homo sapiens
tgggcaggataatatctcatgt

SEQ ID NO: 8214896 - DNA, 22 bp, Homo sapiens
tgggcaggagagaagctaaaga

SEQ ID NO: 8214897 - DNA, 22 bp, Homo sapiens
tgggcaggatgcgttgattctt

SEQ ID NO: 8214898 - DNA, 22 bp, Homo sapiens
tgggcaggatgcgttgattctt

SEQ ID NO: 8214899 - DNA, 22 bp, Homo sapiens
tgggcaggataatatctcatgt

SEQ ID NO: 8214900 - DNA, 22 bp, Homo sapiens
tgggcaggataatatctcatgt

SEQ ID NO: 8214901 - DNA, 22 bp, Homo sapiens
tgggcaggcaagtgaatacctt

SEQ ID NO: 8214902 - DNA, 22 bp, Homo sapiens
tgggcaggatgcgttgattctt

SEQ ID NO: 8214903 - DNA, 22 bp, Homo sapiens
tgggcaggatgcgttgattctt

SEQ ID NO: 8214904 - DNA, 22 bp, Homo sapiens
tgggcaggcaagtgaatacctt

SEQ ID NO: 8214905 - DNA, 22 bp, Homo sapiens
tgggcaggcaagtgaatacctt

SEQ ID NO: 8214906 - DNA, 23 bp, Homo sapiens
tgggcccttggaatctctatttt

SEQ ID NO: 8214907 - DNA, 21 bp, Homo sapiens
tgggcctcaagtgggtggcag

SEQ ID NO: 8214908 - DNA, 22 bp, Homo sapiens
tgggcctggacatctgtatttt

SEQ ID NO: 8214909 - DNA, 22 bp, Homo sapiens
tgggcctggagtttgtccagag

SEQ ID NO: 8214910 - DNA, 22 bp, Homo sapiens
tgggcctggagccctggagagt

SEQ ID NO: 8214911 - DNA, 22 bp, Homo sapiens
tgggcctggagtttgtccagag

SEQ ID NO: 8214912 - DNA, 22 bp, Homo sapiens
tgggcctggagccctggagagt

SEQ ID NO: 8214913 - DNA, 22 bp, Homo sapiens
tgggcctggagccctggagagt

SEQ ID NO: 8214914 - DNA, 22 bp, Homo sapiens
tgggcctggagccctggagagt

SEQ ID NO: 8214915 - DNA, 22 bp, Homo sapiens
tgggcctggagccctggagagt

SEQ ID NO: 8214916 - DNA, 23 bp, Homo sapiens
tgggcctggcctcccagtccagc

SEQ ID NO: 8214917 - DNA, 22 bp, Homo sapiens
tgggcctgggagggcagacgct

SEQ ID NO: 8214918 - DNA, 22 bp, Homo sapiens
tgggcctgggagggcagacgct

SEQ ID NO: 8214919 - DNA, 22 bp, Homo sapiens
tgggctcatggcccagcactgg

SEQ ID NO: 8214920 - DNA, 22 bp, Homo sapiens
tgggctcatgctggagatgaga

SEQ ID NO: 8214921 - DNA, 22 bp, Homo sapiens
tgggctcagtgggagaaagggc

SEQ ID NO: 8214922 - DNA, 22 bp, Homo sapiens
tgggcctgggagggcagacgct

SEQ ID NO: 8214923 - DNA, 22 bp, Homo sapiens
tgggcctggccctgtggaggag

SEQ ID NO: 8214924 - DNA, 22 bp, Homo sapiens
tgggcctggccctgtggaggag

SEQ ID NO: 8214925 - DNA, 23 bp, Homo sapiens
tgggcctggcctcccagtccagc

SEQ ID NO: 8214926 - DNA, 22 bp, Homo sapiens
tgggcctggccctgtggaggag

SEQ ID NO: 8214927 - DNA, 22 bp, Homo sapiens
tgggctccggcggcctcaggct

SEQ ID NO: 8214928 - DNA, 19 bp, Homo sapiens
tgggctcattcaggtggtt

SEQ ID NO: 8214929 - DNA, 22 bp, Homo sapiens
tgggctcatgtttctttgagga

SEQ ID NO: 8214930 - DNA, 19 bp, Homo sapiens
tgggctcattcaggtggtt

SEQ ID NO: 8214931 - DNA, 22 bp, Homo sapiens
tgggctccagcacctgtgctct

SEQ ID NO: 8214932 - DNA, 22 bp, Homo sapiens
cctgcagaccacactcagtcct

SEQ ID NO: 8214933 - DNA, 22 bp, Homo sapiens
cctgcagctttgcctcctgaac

SEQ ID NO: 8214934 - DNA, 22 bp, Homo sapiens
cctgcaggctgcaggccagttc

SEQ ID NO: 8214935 - DNA, 22 bp, Homo sapiens
cctgcaggctgcaggccagttc

SEQ ID NO: 8214936 - DNA, 22 bp, Homo sapiens
cctgcagggaatcgaggcagaa

SEQ ID NO: 8214937 - DNA, 22 bp, Homo sapiens
cctgcaggctgcaggccagttc

SEQ ID NO: 8214938 - DNA, 22 bp, Homo sapiens
cctgcaggctgcaggccagttc

SEQ ID NO: 8214939 - DNA, 22 bp, Homo sapiens
cctgcagggaatcgaggcagaa

SEQ ID NO: 8214940 - DNA, 22 bp, Homo sapiens
cctgcagggaatcgaggcagaa

SEQ ID NO: 8214941 - DNA, 22 bp, Homo sapiens
tggggagagattgaggagtttt

SEQ ID NO: 8214942 - DNA, 22 bp, Homo sapiens
tggggagagattgaggagtttt

SEQ ID NO: 8214943 - DNA, 22 bp, Homo sapiens
tggggagagattgaggagtttt

SEQ ID NO: 8214944 - DNA, 22 bp, Homo sapiens
tggggagagttacaaggaatct

SEQ ID NO: 8214945 - DNA, 22 bp, Homo sapiens
tggggagaggtatcattgagat

SEQ ID NO: 8214946 - DNA, 23 bp, Homo sapiens
tggggagagttaccctggaagcg

SEQ ID NO: 8214947 - DNA, 22 bp, Homo sapiens
tggggagagaccggaatgtttc

SEQ ID NO: 8214948 - DNA, 22 bp, Homo sapiens
tggggagactggccgagatcct

SEQ ID NO: 8214949 - DNA, 22 bp, Homo sapiens
tggggacttgccttgttgctca

SEQ ID NO: 8214950 - DNA, 19 bp, Homo sapiens
cctgatggagctggtgcaa

SEQ ID NO: 8214951 - DNA, 22 bp, Homo sapiens
cctgatggagccctgctgcatg

SEQ ID NO: 8214952 - DNA, 22 bp, Homo sapiens
cctgatggagccctgctgcatg

SEQ ID NO: 8214953 - DNA, 22 bp, Homo sapiens
cctgatggagccctgctgcatg

SEQ ID NO: 8214954 - DNA, 22 bp, Homo sapiens
cctgataatgtaattgttaaat

SEQ ID NO: 8214955 - DNA, 22 bp, Homo sapiens
cctgataatattgacctacaga

SEQ ID NO: 8214956 - DNA, 22 bp, Homo sapiens
cctgagttagttgctgtgtctc

SEQ ID NO: 8214957 - DNA, 19 bp, Homo sapiens
cctgagttgggtgaagaga

SEQ ID NO: 8214958 - DNA, 22 bp, Homo sapiens
cctgataaaccctggaatttgt

SEQ ID NO: 8214959 - DNA, 22 bp, Homo sapiens
cctgataacacagatacaagat

SEQ ID NO: 8214960 - DNA, 22 bp, Homo sapiens
cctgagtgcttccagagtcatg

SEQ ID NO: 8214961 - DNA, 22 bp, Homo sapiens
cctgagtggccaggcagctgtg

SEQ ID NO: 8214962 - DNA, 22 bp, Homo sapiens
cctgagtggcagggtttgggct

SEQ ID NO: 8214963 - DNA, 22 bp, Homo sapiens
cctgaggtcatggtccagtgtt

SEQ ID NO: 8214964 - DNA, 22 bp, Homo sapiens
cctgaggtctagagtcagggtg

SEQ ID NO: 8214965 - DNA, 22 bp, Homo sapiens
tgggctcctcgtcactcgctgt

SEQ ID NO: 8214966 - DNA, 22 bp, Homo sapiens
cctgagtctttcccattgcgct

SEQ ID NO: 8214967 - DNA, 22 bp, Homo sapiens
cctgagtgaattccctcactgt

SEQ ID NO: 8214968 - DNA, 22 bp, Homo sapiens
cctgagtcttggcttcttggct

SEQ ID NO: 8214969 - DNA, 21 bp, Homo sapiens
cctgagtgagacctggcccgt

SEQ ID NO: 8214970 - DNA, 22 bp, Homo sapiens
cctgagtgccatgagagcaccc

SEQ ID NO: 8214971 - DNA, 22 bp, Homo sapiens
cctccagtactccagtccagcg

SEQ ID NO: 8214972 - DNA, 22 bp, Homo sapiens
cctccagtactccagtccagcg

SEQ ID NO: 8214973 - DNA, 22 bp, Homo sapiens
cctccaggtgttacatatgact

SEQ ID NO: 8214974 - DNA, 22 bp, Homo sapiens
cctccatcaccatctgccctca

SEQ ID NO: 8214975 - DNA, 22 bp, Homo sapiens
cctccatctccagcttctgcct

SEQ ID NO: 8214976 - DNA, 22 bp, Homo sapiens
cctccatcaccatctgccctca

SEQ ID NO: 8214977 - DNA, 22 bp, Homo sapiens
cctccatcaccatctgccctca

SEQ ID NO: 8214978 - DNA, 22 bp, Homo sapiens
cctccagtcacctggatgagaa

SEQ ID NO: 8214979 - DNA, 22 bp, Homo sapiens
cctccatgtaaaggtcccctca

SEQ ID NO: 8214980 - DNA, 22 bp, Homo sapiens
cctccatgtaaaggtcccctca

SEQ ID NO: 8214981 - DNA, 22 bp, Homo sapiens
cctccatgtaaaggtcccctca

SEQ ID NO: 8214982 - DNA, 23 bp, Homo sapiens
cctccatggtaagaagcttagag

SEQ ID NO: 8214983 - DNA, 23 bp, Homo sapiens
cctccatggtaagaagcttagag

SEQ ID NO: 8214984 - DNA, 17 bp, Homo sapiens
cctcccacaccgccctg

SEQ ID NO: 8214985 - DNA, 22 bp, Homo sapiens
cctcccacatcctagctctgct

SEQ ID NO: 8214986 - DNA, 22 bp, Homo sapiens
cctcctctggtgctgccaaccc

SEQ ID NO: 8214987 - DNA, 22 bp, Homo sapiens
cctcccacttcttgctgaggtc

SEQ ID NO: 8214988 - DNA, 23 bp, Homo sapiens
cctcccacctatttcactttctt

SEQ ID NO: 8214989 - DNA, 22 bp, Homo sapiens
cctcccacattgaggacatgct

SEQ ID NO: 8214990 - DNA, 22 bp, Homo sapiens
cctcccacattgaggacatgct

SEQ ID NO: 8214991 - DNA, 22 bp, Homo sapiens
cctcccaccatttagagagagc

SEQ ID NO: 8214992 - DNA, 22 bp, Homo sapiens
cctcccaccatttagagagagc

SEQ ID NO: 8214993 - DNA, 22 bp, Homo sapiens
cctcctctggtgctgccaaccc

SEQ ID NO: 8214994 - DNA, 22 bp, Homo sapiens
cctcctggccctgggcctggaa

SEQ ID NO: 8214995 - DNA, 22 bp, Homo sapiens
cctcctggcctgtgcagagccc

SEQ ID NO: 8214996 - DNA, 22 bp, Homo sapiens
cctcctggcctgtgcagagccc

SEQ ID NO: 8214997 - DNA, 22 bp, Homo sapiens
cctcctggcctgtgcagagccc

SEQ ID NO: 8214998 - DNA, 22 bp, Homo sapiens
cctcctggcctgtgcagagccc

SEQ ID NO: 8214999 - DNA, 22 bp, Homo sapiens
cctcctggcttttcccattgaa

SEQ ID NO: 8215000 - DNA, 22 bp, Homo sapiens
cctcctgggacaggctggcaca

SEQ ID NO: 8215001 - DNA, 22 bp, Homo sapiens
cctcctgggacaggctggcaca

SEQ ID NO: 8215002 - DNA, 22 bp, Homo sapiens
cctcctggcttttcccattgaa

SEQ ID NO: 8215003 - DNA, 22 bp, Homo sapiens
cctcctggcctgtgcagagccc

SEQ ID NO: 8215004 - DNA, 22 bp, Homo sapiens
cctcctggcttttcccattgaa

SEQ ID NO: 8215005 - DNA, 22 bp, Homo sapiens
cctcctgggacaggctggcaca

SEQ ID NO: 8215006 - DNA, 22 bp, Homo sapiens
cctcctgggactcattagcacc

SEQ ID NO: 8215007 - DNA, 22 bp, Homo sapiens
cctcctgggactcattagcacc

SEQ ID NO: 8215008 - DNA, 22 bp, Homo sapiens
cctcctgggacaggctggcaca

SEQ ID NO: 8215009 - DNA, 22 bp, Homo sapiens
cctcctgggactcattagcacc

SEQ ID NO: 8215010 - DNA, 22 bp, Homo sapiens
cctcctgggagagcacggaggg

SEQ ID NO: 8215011 - DNA, 22 bp, Homo sapiens
cctcctgggagagcacggaggg

SEQ ID NO: 8215012 - DNA, 22 bp, Homo sapiens
cctcctgggagagcacggaggg

SEQ ID NO: 8215013 - DNA, 22 bp, Homo sapiens
cctcctgggagagcacggaggg

SEQ ID NO: 8215014 - DNA, 22 bp, Homo sapiens
cctcctgggagagcacggaggg

SEQ ID NO: 8215015 - DNA, 23 bp, Homo sapiens
cctcctgggcacaggcctgatgg

SEQ ID NO: 8215016 - DNA, 23 bp, Homo sapiens
cctcctgggcacaggcctgatgg

SEQ ID NO: 8215017 - DNA, 23 bp, Homo sapiens
cctcctgggcacaggcctgatgg

SEQ ID NO: 8215018 - DNA, 23 bp, Homo sapiens
cctcctgggcacaggcctgatgg

SEQ ID NO: 8215019 - DNA, 23 bp, Homo sapiens
cctcctgggcacaggcctgatgg

SEQ ID NO: 8215020 - DNA, 22 bp, Homo sapiens
cctcctgggccttgctctgtga

SEQ ID NO: 8215021 - DNA, 22 bp, Homo sapiens
cctcctgggccttgctctgtga

SEQ ID NO: 8215022 - DNA, 22 bp, Homo sapiens
cctcctgggccttgctctgtga

SEQ ID NO: 8215023 - DNA, 22 bp, Homo sapiens
cctcctgggccttgctctgtga

SEQ ID NO: 8215024 - DNA, 22 bp, Homo sapiens
cctcctggggtgaaggatggga

SEQ ID NO: 8215025 - DNA, 22 bp, Homo sapiens
cctcctgggctcctgtctgcac

SEQ ID NO: 8215026 - DNA, 22 bp, Homo sapiens
cctcctgggccttgctctgtga

SEQ ID NO: 8215027 - DNA, 22 bp, Homo sapiens
cctcctgggctcctgtctgcac

SEQ ID NO: 8215028 - DNA, 22 bp, Homo sapiens
cctcctgggctcctgtctgcac

SEQ ID NO: 8215029 - DNA, 21 bp, Homo sapiens
tggccaaactggagcatttga

SEQ ID NO: 8215030 - DNA, 23 bp, Homo sapiens
tggccaagataatctcagttttc

SEQ ID NO: 8215031 - DNA, 22 bp, Homo sapiens
tggccaagccactgctgggtct

SEQ ID NO: 8215032 - DNA, 22 bp, Homo sapiens
tggccaagccactgctgggtct

SEQ ID NO: 8215033 - DNA, 22 bp, Homo sapiens
tggcattttccaatgatatgtt

SEQ ID NO: 8215034 - DNA, 22 bp, Homo sapiens
tggcattttgtagctgtgtatc

SEQ ID NO: 8215035 - DNA, 22 bp, Homo sapiens
tggcattttagacatgatggtg

SEQ ID NO: 8215036 - DNA, 22 bp, Homo sapiens
tggcatttgtagccacttgcct

SEQ ID NO: 8215037 - DNA, 22 bp, Homo sapiens
tggcatttgtagccacttgcct

SEQ ID NO: 8215038 - DNA, 21 bp, Homo sapiens
tggcatttgtacagggacttt

SEQ ID NO: 8215039 - DNA, 21 bp, Homo sapiens
cctccaggtgattccgtgctc

SEQ ID NO: 8215040 - DNA, 21 bp, Homo sapiens
cctccaggtgattccgtgctc

SEQ ID NO: 8215041 - DNA, 21 bp, Homo sapiens
cctccaggtgattccgtgctc

SEQ ID NO: 8215042 - DNA, 22 bp, Homo sapiens
cctccagggcagacggggagca

SEQ ID NO: 8215043 - DNA, 22 bp, Homo sapiens
cctccagggcccctctcactgg

SEQ ID NO: 8215044 - DNA, 22 bp, Homo sapiens
cctccagggcccctctcactgg

SEQ ID NO: 8215045 - DNA, 22 bp, Homo sapiens
cctccagggcccctctcactgg

SEQ ID NO: 8215046 - DNA, 22 bp, Homo sapiens
tggccacaaagagaacgaggtc

SEQ ID NO: 8215047 - DNA, 22 bp, Homo sapiens
tggccacaaagagaacgaggtc

SEQ ID NO: 8215048 - DNA, 21 bp, Homo sapiens
tggccaaggaatagaagctct

SEQ ID NO: 8215049 - DNA, 21 bp, Homo sapiens
tggccaaggaatagaagctct

SEQ ID NO: 8215050 - DNA, 20 bp, Homo sapiens
tggccaagtatccaactgga

SEQ ID NO: 8215051 - DNA, 22 bp, Homo sapiens
cctccagctgcctcagtctctt

SEQ ID NO: 8215052 - DNA, 22 bp, Homo sapiens
cctccagctgcctcagtctctt

SEQ ID NO: 8215053 - DNA, 19 bp, Homo sapiens
tggcatttggaggcaacct

SEQ ID NO: 8215054 - DNA, 22 bp, Homo sapiens
tggcatttgctcccttgtgttc

SEQ ID NO: 8215055 - DNA, 22 bp, Homo sapiens
tggcatttctgttagactctca

SEQ ID NO: 8215056 - DNA, 19 bp, Homo sapiens
tggcagtgtggggtatgaa

SEQ ID NO: 8215057 - DNA, 19 bp, Homo sapiens
tggcagtgtggggtatgaa

SEQ ID NO: 8215058 - DNA, 22 bp, Homo sapiens
tggcagtgtgggaggaaggtac

SEQ ID NO: 8215059 - DNA, 22 bp, Homo sapiens
tggcagtgtgggaggaaggtac

SEQ ID NO: 8215060 - DNA, 22 bp, Homo sapiens
tggcagtgtgggaggaaggtac

SEQ ID NO: 8215061 - DNA, 22 bp, Homo sapiens
tggcagtgtcttatcaggagtg

SEQ ID NO: 8215062 - DNA, 22 bp, Homo sapiens
tggcagtgtcttatcaggagtg

SEQ ID NO: 8215063 - DNA, 22 bp, Homo sapiens
tggcagtgtcttgctggggcag

SEQ ID NO: 8215064 - DNA, 22 bp, Homo sapiens
tggcagtgtcttgctggggcag

SEQ ID NO: 8215065 - DNA, 22 bp, Homo sapiens
tggcagtgtcctactggttggt

SEQ ID NO: 8215066 - DNA, 22 bp, Homo sapiens
tggcagtgtcttatcaggagtg

SEQ ID NO: 8215067 - DNA, 22 bp, Homo sapiens
tggcagtgtcttatcaggagtg

SEQ ID NO: 8215068 - DNA, 22 bp, Homo sapiens
tggcagtgtcttatcaggagtg

SEQ ID NO: 8215069 - DNA, 22 bp, Homo sapiens
tggcagtgtataggtggctcct

SEQ ID NO: 8215070 - DNA, 22 bp, Homo sapiens
tggcagtgggaagctggaagtc

SEQ ID NO: 8215071 - DNA, 22 bp, Homo sapiens
tggcagtggtgtctgcacaggc

SEQ ID NO: 8215072 - DNA, 22 bp, Homo sapiens
tggcagtggtgtctgcacaggc

SEQ ID NO: 8215073 - DNA, 22 bp, Homo sapiens
tggcagtggtaccggctctcag

SEQ ID NO: 8215074 - DNA, 22 bp, Homo sapiens
tggcagtgggaagctggaagtc

SEQ ID NO: 8215075 - DNA, 22 bp, Homo sapiens
tggcagtgggaagctggaagtc

SEQ ID NO: 8215076 - DNA, 22 bp, Homo sapiens
tggcagtgggaagctggaagtc

SEQ ID NO: 8215077 - DNA, 22 bp, Homo sapiens
tggcagtgggaagctggaagtc

SEQ ID NO: 8215078 - DNA, 22 bp, Homo sapiens
tggcagtgggaagctggaagtc

SEQ ID NO: 8215079 - DNA, 22 bp, Homo sapiens
tggcagtgggaagctggaagtc

SEQ ID NO: 8215080 - DNA, 22 bp, Homo sapiens
tggcagtgggaagctggaagtc

SEQ ID NO: 8215081 - DNA, 22 bp, Homo sapiens
tggcagtgggaagctggaagtc

SEQ ID NO: 8215082 - DNA, 22 bp, Homo sapiens
tggcagtgggaagctggaagtc

SEQ ID NO: 8215083 - DNA, 22 bp, Homo sapiens
tggcagtgggaagctggaagtc

SEQ ID NO: 8215084 - DNA, 22 bp, Homo sapiens
tggcagtggctttgctggtgga

SEQ ID NO: 8215085 - DNA, 22 bp, Homo sapiens
tggcagtggctttgctggtgga

SEQ ID NO: 8215086 - DNA, 19 bp, Homo sapiens
tggcaggtagtgagcagtc

SEQ ID NO: 8215087 - DNA, 19 bp, Homo sapiens
tggcaggtagtgagcagtc

SEQ ID NO: 8215088 - DNA, 19 bp, Homo sapiens
tggcaggtagtgagcagtc

SEQ ID NO: 8215089 - DNA, 22 bp, Homo sapiens
cctctcccctcccaaggcggga

SEQ ID NO: 8215090 - DNA, 22 bp, Homo sapiens
cctctcccctcccaaggcggga

SEQ ID NO: 8215091 - DNA, 19 bp, Homo sapiens
cctctcccatgcttacctc

SEQ ID NO: 8215092 - DNA, 22 bp, Homo sapiens
tgggaaggcagtcactgtccta

SEQ ID NO: 8215093 - DNA, 22 bp, Homo sapiens
tgggaaggcagtcactgtccta

SEQ ID NO: 8215094 - DNA, 22 bp, Homo sapiens
tgggacagagtgagctttggcc

SEQ ID NO: 8215095 - DNA, 22 bp, Homo sapiens
cctctccagcggcctcagggcc

SEQ ID NO: 8215096 - DNA, 22 bp, Homo sapiens
cctctccagcggcctcagggcc

SEQ ID NO: 8215097 - DNA, 22 bp, Homo sapiens
cctctccagcggcctcagggcc

SEQ ID NO: 8215098 - DNA, 22 bp, Homo sapiens
tggctttagggttccttctacc

SEQ ID NO: 8215099 - DNA, 22 bp, Homo sapiens
tggctttactgtcattcttatg

SEQ ID NO: 8215100 - DNA, 22 bp, Homo sapiens
tggctttacatcaaattgagta

SEQ ID NO: 8215101 - DNA, 22 bp, Homo sapiens
tggctttaggagctatatacct

SEQ ID NO: 8215102 - DNA, 22 bp, Homo sapiens
cctctcccaggcgcggcggcag

SEQ ID NO: 8215103 - DNA, 22 bp, Homo sapiens
cctctcccagggagagcctgag

SEQ ID NO: 8215104 - DNA, 22 bp, Homo sapiens
cctctcccacgtggcagaggct

SEQ ID NO: 8215105 - DNA, 22 bp, Homo sapiens
cctctcccacgtggcagaggct

SEQ ID NO: 8215106 - DNA, 20 bp, Homo sapiens
cctcctggtcaggtgtgcag

SEQ ID NO: 8215107 - DNA, 20 bp, Homo sapiens
cctcctggtcaggtgtgcag

SEQ ID NO: 8215108 - DNA, 22 bp, Homo sapiens
cctcctggtaattagcgaaagg

SEQ ID NO: 8215109 - DNA, 20 bp, Homo sapiens
cctcctggtcaggtgtgcag

SEQ ID NO: 8215110 - DNA, 20 bp, Homo sapiens
cctcctggtcaggtgtgcag

SEQ ID NO: 8215111 - DNA, 22 bp, Homo sapiens
cctcctggggtgaaggatggga

SEQ ID NO: 8215112 - DNA, 22 bp, Homo sapiens
cctcctggggtgaaggatggga

SEQ ID NO: 8215113 - DNA, 22 bp, Homo sapiens
cctcctgggttcaagcgattct

SEQ ID NO: 8215114 - DNA, 22 bp, Homo sapiens
cctcctggtaattagcgaaagg

SEQ ID NO: 8215115 - DNA, 22 bp, Homo sapiens
cctcctgggttcaagcgattct

SEQ ID NO: 8215116 - DNA, 22 bp, Homo sapiens
cctcctggtaattagcgaaagg

SEQ ID NO: 8215117 - DNA, 22 bp, Homo sapiens
tggcttctttccactgtcctgt

SEQ ID NO: 8215118 - DNA, 22 bp, Homo sapiens
tggcttctttccactgtcctgt

SEQ ID NO: 8215119 - DNA, 22 bp, Homo sapiens
tggcttctttccactgtcctgt

SEQ ID NO: 8215120 - DNA, 22 bp, Homo sapiens
tggcttcccctaccttccaatt

SEQ ID NO: 8215121 - DNA, 22 bp, Homo sapiens
cctcctggtccagcatctcttt

SEQ ID NO: 8215122 - DNA, 22 bp, Homo sapiens
cctcctggtccagcatctcttt

SEQ ID NO: 8215123 - DNA, 16 bp, Homo sapiens
tggcttcccagagata

SEQ ID NO: 8215124 - DNA, 22 bp, Homo sapiens
tggcttcccaggaaaggagaag

SEQ ID NO: 8215125 - DNA, 22 bp, Homo sapiens
tggcttcccatagcttgctagt

SEQ ID NO: 8215126 - DNA, 22 bp, Homo sapiens
tggcttgctactgaggtgtcag

SEQ ID NO: 8215127 - DNA, 22 bp, Homo sapiens
tggcttgcttccccattctcat

SEQ ID NO: 8215128 - DNA, 22 bp, Homo sapiens
tggcttctttgtagaaattgaa

SEQ ID NO: 8215129 - DNA, 22 bp, Homo sapiens
tggcttctttgtagaaattgaa

SEQ ID NO: 8215130 - DNA, 22 bp, Homo sapiens
tggctttaaaatggtttggtat

SEQ ID NO: 8215131 - DNA, 22 bp, Homo sapiens
tggctttaaatctgtattcata

SEQ ID NO: 8215132 - DNA, 22 bp, Homo sapiens
tggctttaagaagactgacagc

SEQ ID NO: 8215133 - DNA, 22 bp, Homo sapiens
tggctttaagaagactgacagc

SEQ ID NO: 8215134 - DNA, 20 bp, Homo sapiens
tggctttaagttttttgcta

SEQ ID NO: 8215135 - DNA, 22 bp, Homo sapiens
tggcttgtcatgtatctgaggc

SEQ ID NO: 8215136 - DNA, 22 bp, Homo sapiens
tggcttggtgagcagagtgtag

SEQ ID NO: 8215137 - DNA, 22 bp, Homo sapiens
tggcttgggagattctcgaact

SEQ ID NO: 8215138 - DNA, 22 bp, Homo sapiens
tggcttgggagattctcgaact

SEQ ID NO: 8215139 - DNA, 22 bp, Homo sapiens
tgggcagaaggaagagccacct

SEQ ID NO: 8215140 - DNA, 22 bp, Homo sapiens
tgggcagaaggaagagccacct

SEQ ID NO: 8215141 - DNA, 22 bp, Homo sapiens
tgggcagaaggaagagccacct

SEQ ID NO: 8215142 - DNA, 22 bp, Homo sapiens
tgggcagaaatcagtatcagat

SEQ ID NO: 8215143 - DNA, 22 bp, Homo sapiens
tgggcaggagagaagctaaaga

SEQ ID NO: 8215144 - DNA, 22 bp, Homo sapiens
tgggcagaattgtggtagttaa

SEQ ID NO: 8215145 - DNA, 22 bp, Homo sapiens
tgggagagcactgcagccccgg

SEQ ID NO: 8215146 - DNA, 22 bp, Homo sapiens
tgggagagcagagaaccctctt

SEQ ID NO: 8215147 - DNA, 22 bp, Homo sapiens
tgggagagcagagaaccctctt

SEQ ID NO: 8215148 - DNA, 21 bp, Homo sapiens
tgggagagcgttgctgtcctc

SEQ ID NO: 8215149 - DNA, 21 bp, Homo sapiens
tgggagagcgttgctgtcctc

SEQ ID NO: 8215150 - DNA, 21 bp, Homo sapiens
tgggagagcgttgctgtcctc

SEQ ID NO: 8215151 - DNA, 21 bp, Homo sapiens
tgggatagaaatatggctgct

SEQ ID NO: 8215152 - DNA, 23 bp, Homo sapiens
tgggatagaatttcatggctgct

SEQ ID NO: 8215153 - DNA, 22 bp, Homo sapiens
tgggcactgtagctggtgctgg

SEQ ID NO: 8215154 - DNA, 22 bp, Homo sapiens
tgggcactgtagctggtgctgg

SEQ ID NO: 8215155 - DNA, 22 bp, Homo sapiens
tgggcactggggctccagaggt

SEQ ID NO: 8215156 - DNA, 22 bp, Homo sapiens
tgggcactggaagcctgctgtg

SEQ ID NO: 8215157 - DNA, 21 bp, Homo sapiens
tgggcactgagggtgctgctc

SEQ ID NO: 8215158 - DNA, 22 bp, Homo sapiens
tgggcactggaagcctgctgtg

SEQ ID NO: 8215159 - DNA, 21 bp, Homo sapiens
tgggcactgagggtgctgctc

SEQ ID NO: 8215160 - DNA, 22 bp, Homo sapiens
tgggcactcctggggacagctg

SEQ ID NO: 8215161 - DNA, 22 bp, Homo sapiens
tgggcactgaagctttgagcag

SEQ ID NO: 8215162 - DNA, 22 bp, Homo sapiens
tgggacaggatgaccagaaggt

SEQ ID NO: 8215163 - DNA, 22 bp, Homo sapiens
tgggacaggatgaccagaaggt

SEQ ID NO: 8215164 - DNA, 22 bp, Homo sapiens
tgggacaggatgaccagaaggt

SEQ ID NO: 8215165 - DNA, 22 bp, Homo sapiens
tgggacaggaggcctctggaga

SEQ ID NO: 8215166 - DNA, 22 bp, Homo sapiens
tgggacaggaggcctctggaga

SEQ ID NO: 8215167 - DNA, 22 bp, Homo sapiens
tgggacaggaggcctctggaga

SEQ ID NO: 8215168 - DNA, 22 bp, Homo sapiens
tgggacaggaggcctctggaga

SEQ ID NO: 8215169 - DNA, 22 bp, Homo sapiens
tgggacaggaggcctctggaga

SEQ ID NO: 8215170 - DNA, 22 bp, Homo sapiens
tgggacagattataagtctgca

SEQ ID NO: 8215171 - DNA, 22 bp, Homo sapiens
tgggacagagtgagctttggcc

SEQ ID NO: 8215172 - DNA, 22 bp, Homo sapiens
tgggacagagtgagctttggcc

SEQ ID NO: 8215173 - DNA, 22 bp, Homo sapiens
tgggacagagtgagctttggcc

SEQ ID NO: 8215174 - DNA, 22 bp, Homo sapiens
tgggacagattataagtctgca

SEQ ID NO: 8215175 - DNA, 22 bp, Homo sapiens
tgggagagaattctggtgactg

SEQ ID NO: 8215176 - DNA, 22 bp, Homo sapiens
tgggagagagaattcccagtgg

SEQ ID NO: 8215177 - DNA, 22 bp, Homo sapiens
tgggagagagaattcccagtgg

SEQ ID NO: 8215178 - DNA, 22 bp, Homo sapiens
tgggagagagaattcccagtgg

SEQ ID NO: 8215179 - DNA, 22 bp, Homo sapiens
tgggagagagaattcccagtgg

SEQ ID NO: 8215180 - DNA, 22 bp, Homo sapiens
tgggagagagaattcccagtgg

SEQ ID NO: 8215181 - DNA, 22 bp, Homo sapiens
tgggagagataggcttctggac

SEQ ID NO: 8215182 - DNA, 22 bp, Homo sapiens
tgggagagataggcttctggac

SEQ ID NO: 8215183 - DNA, 22 bp, Homo sapiens
tgggagagataggcttctggac

SEQ ID NO: 8215184 - DNA, 22 bp, Homo sapiens
tgggagagcactgcagccccgg

SEQ ID NO: 8215185 - DNA, 22 bp, Homo sapiens
tgggagagcactgcagccccgg

SEQ ID NO: 8215186 - DNA, 22 bp, Homo sapiens
tgggagagaattctggtgactg

SEQ ID NO: 8215187 - DNA, 22 bp, Homo sapiens
tgggagagaataatcaataggt

SEQ ID NO: 8215188 - DNA, 22 bp, Homo sapiens
tgggagagaattctggtgactg

SEQ ID NO: 8215189 - DNA, 22 bp, Homo sapiens
tgggagagaattctggtgactg

SEQ ID NO: 8215190 - DNA, 22 bp, Homo sapiens
tgggagagaattctggtgactg

SEQ ID NO: 8215191 - DNA, 22 bp, Homo sapiens
tgggacagggaatctgatcccc

SEQ ID NO: 8215192 - DNA, 22 bp, Homo sapiens
tgggacagggaatctgatcccc

SEQ ID NO: 8215193 - DNA, 22 bp, Homo sapiens
tgggagagaataatcaataggt

SEQ ID NO: 8215194 - DNA, 22 bp, Homo sapiens
tgggagagaataatcaataggt

SEQ ID NO: 8215195 - DNA, 22 bp, Homo sapiens
tgggacagggaatctgatcccc

SEQ ID NO: 8215196 - DNA, 22 bp, Homo sapiens
tgggacagggaatctgatcccc

SEQ ID NO: 8215197 - DNA, 22 bp, Homo sapiens
tggagactcagaaggggaagca

SEQ ID NO: 8215198 - DNA, 22 bp, Homo sapiens
tggagactcagaaggggaagca

SEQ ID NO: 8215199 - DNA, 22 bp, Homo sapiens
tggagactctgcatctgtgaca

SEQ ID NO: 8215200 - DNA, 22 bp, Homo sapiens
tggagactctgcatctgtgaca

SEQ ID NO: 8215201 - DNA, 21 bp, Homo sapiens
tggagactctggttctttgtg

SEQ ID NO: 8215202 - DNA, 22 bp, Homo sapiens
tggagactgactgcctgtattt

SEQ ID NO: 8215203 - DNA, 22 bp, Homo sapiens
tggagactctgcatctgtgaca

SEQ ID NO: 8215204 - DNA, 22 bp, Homo sapiens
tggagactgtgctaagggagtt

SEQ ID NO: 8215205 - DNA, 22 bp, Homo sapiens
tggagactgataaaggctattg

SEQ ID NO: 8215206 - DNA, 22 bp, Homo sapiens
tggagactgataaaggctattg

SEQ ID NO: 8215207 - DNA, 19 bp, Homo sapiens
tggagactgagagtgagca

SEQ ID NO: 8215208 - DNA, 22 bp, Homo sapiens
tggagatgaacatggtgatgtt

SEQ ID NO: 8215209 - DNA, 22 bp, Homo sapiens
tggagatgaacatggtgatgtt

SEQ ID NO: 8215210 - DNA, 22 bp, Homo sapiens
tggagatgaatatgtgtacctg

SEQ ID NO: 8215211 - DNA, 22 bp, Homo sapiens
tggagatgaacatggtgatgtt

SEQ ID NO: 8215212 - DNA, 22 bp, Homo sapiens
tggagatgaacatggtgatgtt

SEQ ID NO: 8215213 - DNA, 22 bp, Homo sapiens
tggagagttctgtagatatcta

SEQ ID NO: 8215214 - DNA, 22 bp, Homo sapiens
tggagagtttagcctactggaa

SEQ ID NO: 8215215 - DNA, 22 bp, Homo sapiens
tggaaagaaagtaaaggcgtat

SEQ ID NO: 8215216 - DNA, 22 bp, Homo sapiens
tggacatgtcttctccaagaaa

SEQ ID NO: 8215217 - DNA, 22 bp, Homo sapiens
tggacatgtcttctccaagaaa

SEQ ID NO: 8215218 - DNA, 22 bp, Homo sapiens
tggacatgtccggccagacaat

SEQ ID NO: 8215219 - DNA, 22 bp, Homo sapiens
tggacatgtaaaggctcaaggt

SEQ ID NO: 8215220 - DNA, 22 bp, Homo sapiens
tggagaattctatgttgagggg

SEQ ID NO: 8215221 - DNA, 23 bp, Homo sapiens
tggagaattcagtctttgttttg

SEQ ID NO: 8215222 - DNA, 22 bp, Homo sapiens
tggagacatgggcgaatctaag

SEQ ID NO: 8215223 - DNA, 18 bp, Homo sapiens
tggagacatagacaatgt

SEQ ID NO: 8215224 - DNA, 20 bp, Homo sapiens
tggagacaattgcccttttt

SEQ ID NO: 8215225 - DNA, 22 bp, Homo sapiens
tggagaattctatgttgagggg

SEQ ID NO: 8215226 - DNA, 22 bp, Homo sapiens
tggaaactaacaacagagcaga

SEQ ID NO: 8215227 - DNA, 22 bp, Homo sapiens
tggaaactaagactagagagac

SEQ ID NO: 8215228 - DNA, 22 bp, Homo sapiens
tggaaactaagactagagagac

SEQ ID NO: 8215229 - DNA, 22 bp, Homo sapiens
tggaaactagagagtttgtatt

SEQ ID NO: 8215230 - DNA, 22 bp, Homo sapiens
tggaaactagagagtttgtatt

SEQ ID NO: 8215231 - DNA, 22 bp, Homo sapiens
tggaaactagagtgtgggaagc

SEQ ID NO: 8215232 - DNA, 22 bp, Homo sapiens
tggaaactaggatggaagaaat

SEQ ID NO: 8215233 - DNA, 22 bp, Homo sapiens
tggaaactaggatggaagaaat

SEQ ID NO: 8215234 - DNA, 22 bp, Homo sapiens
tggaaactagccttttaggttg

SEQ ID NO: 8215235 - DNA, 22 bp, Homo sapiens
tggaaactagccttttaggttg

SEQ ID NO: 8215236 - DNA, 22 bp, Homo sapiens
tggaaactatagtcacaataga

SEQ ID NO: 8215237 - DNA, 22 bp, Homo sapiens
tggaaactataaaagcaccttc

SEQ ID NO: 8215238 - DNA, 22 bp, Homo sapiens
tggaaactatagtcacaataga

SEQ ID NO: 8215239 - DNA, 22 bp, Homo sapiens
tggaaactatcctcacaactag

SEQ ID NO: 8215240 - DNA, 21 bp, Homo sapiens
tggaaacttctagcttacgta

SEQ ID NO: 8215241 - DNA, 21 bp, Homo sapiens
tggaaacttctagcttacgta

SEQ ID NO: 8215242 - DNA, 22 bp, Homo sapiens
tggaaacttggaacgtcttcag

SEQ ID NO: 8215243 - DNA, 23 bp, Homo sapiens
tggaaacttaagggggagatgtc

SEQ ID NO: 8215244 - DNA, 22 bp, Homo sapiens
tggaaacttaccgtttggggaa

SEQ ID NO: 8215245 - DNA, 22 bp, Homo sapiens
tggaaacttatctgacacgaac

SEQ ID NO: 8215246 - DNA, 23 bp, Homo sapiens
tggaaacttaagggggagatgtc

SEQ ID NO: 8215247 - DNA, 22 bp, Homo sapiens
tggaaactgtggtatttcttta

SEQ ID NO: 8215248 - DNA, 22 bp, Homo sapiens
tggaaactgtggtatttcttta

SEQ ID NO: 8215249 - DNA, 22 bp, Homo sapiens
tggaaactgcagttcccgggga

SEQ ID NO: 8215250 - DNA, 22 bp, Homo sapiens
tggaaactgggagttaaatgta

SEQ ID NO: 8215251 - DNA, 22 bp, Homo sapiens
tggaaactgggagttaaatgta

SEQ ID NO: 8215252 - DNA, 19 bp, Homo sapiens
tggaaactcctgatattag

SEQ ID NO: 8215253 - DNA, 22 bp, Homo sapiens
tggaaactctacctctctaaga

SEQ ID NO: 8215254 - DNA, 22 bp, Homo sapiens
tggaaactctacctctctaaga

SEQ ID NO: 8215255 - DNA, 22 bp, Homo sapiens
tggaaactcagggccagaagga

SEQ ID NO: 8215256 - DNA, 19 bp, Homo sapiens
tggaaactcctgatattag

SEQ ID NO: 8215257 - DNA, 23 bp, Homo sapiens
tggaaacattctgaatgtccatc

SEQ ID NO: 8215258 - DNA, 22 bp, Homo sapiens
ccctcctcaactctggcttcca

SEQ ID NO: 8215259 - DNA, 22 bp, Homo sapiens
ccctccctttgcagcagtgcat

SEQ ID NO: 8215260 - DNA, 22 bp, Homo sapiens
ccctcctcaactctggcttcca

SEQ ID NO: 8215261 - DNA, 22 bp, Homo sapiens
ccctcctcaactctggcttcca

SEQ ID NO: 8215262 - DNA, 22 bp, Homo sapiens
ccctcctcaactctggcttcca

SEQ ID NO: 8215263 - DNA, 22 bp, Homo sapiens
ccctccctgtgtgcctcatttg

SEQ ID NO: 8215264 - DNA, 22 bp, Homo sapiens
ccctccctgtgtgcctcatttg

SEQ ID NO: 8215265 - DNA, 22 bp, Homo sapiens
ccctccctgaagaagttactct

SEQ ID NO: 8215266 - DNA, 22 bp, Homo sapiens
ccctccctttgcagcagtgcat

SEQ ID NO: 8215267 - DNA, 22 bp, Homo sapiens
ccctccctgtgtgcctcatttg

SEQ ID NO: 8215268 - DNA, 22 bp, Homo sapiens
ccctccctgtgtgcctcatttg

SEQ ID NO: 8215269 - DNA, 23 bp, Homo sapiens
tggaggaaacacatcagaagacc

SEQ ID NO: 8215270 - DNA, 22 bp, Homo sapiens
tggagctgaggggaatgctgag

SEQ ID NO: 8215271 - DNA, 18 bp, Homo sapiens
tggagctgagggcaatgc

SEQ ID NO: 8215272 - DNA, 22 bp, Homo sapiens
tggagatgggttaatggagaga

SEQ ID NO: 8215273 - DNA, 22 bp, Homo sapiens
tggagatgggaaaaaggaggta

SEQ ID NO: 8215274 - DNA, 22 bp, Homo sapiens
tggagatgtaaagcaaggctta

SEQ ID NO: 8215275 - DNA, 22 bp, Homo sapiens
tggagatgtaaagcaaggctta

SEQ ID NO: 8215276 - DNA, 22 bp, Homo sapiens
tggagatgggttaatggagaga

SEQ ID NO: 8215277 - DNA, 22 bp, Homo sapiens
tggagatgggttaatggagaga

SEQ ID NO: 8215278 - DNA, 22 bp, Homo sapiens
tggagatgggaaaaaggaggta

SEQ ID NO: 8215279 - DNA, 22 bp, Homo sapiens
tggagatggcctcaggccctca

SEQ ID NO: 8215280 - DNA, 23 bp, Homo sapiens
tggagatgccccactccctgtct

SEQ ID NO: 8215281 - DNA, 22 bp, Homo sapiens
tggagatggcctcaggccctca

SEQ ID NO: 8215282 - DNA, 22 bp, Homo sapiens
tggagatgcacgagcaggtgga

SEQ ID NO: 8215283 - DNA, 22 bp, Homo sapiens
tggagatgaggacatggacgtc

SEQ ID NO: 8215284 - DNA, 22 bp, Homo sapiens
tggagatgcacgagcaggtgga

SEQ ID NO: 8215285 - DNA, 22 bp, Homo sapiens
tggagatgcacgagcaggtgga

SEQ ID NO: 8215286 - DNA, 23 bp, Homo sapiens
tggagatgccccactccctgtct

SEQ ID NO: 8215287 - DNA, 22 bp, Homo sapiens
tggaggacgtgtccaccatgaa

SEQ ID NO: 8215288 - DNA, 22 bp, Homo sapiens
tggaggaatcagggcttaggct

SEQ ID NO: 8215289 - DNA, 22 bp, Homo sapiens
tggaggaatcagggcttaggct

SEQ ID NO: 8215290 - DNA, 22 bp, Homo sapiens
tggaggacaggactggacagcc

SEQ ID NO: 8215291 - DNA, 22 bp, Homo sapiens
tggaggaatcagggcttaggct

SEQ ID NO: 8215292 - DNA, 18 bp, Homo sapiens
tggaggaatcacaatggc

SEQ ID NO: 8215293 - DNA, 22 bp, Homo sapiens
tggaggaataacagcaacctta

SEQ ID NO: 8215294 - DNA, 19 bp, Homo sapiens
tggaggaagtatatttcat

SEQ ID NO: 8215295 - DNA, 22 bp, Homo sapiens
tggaggaagtggacagttgtgt

SEQ ID NO: 8215296 - DNA, 22 bp, Homo sapiens
tggaggaagttgctggaagtca

SEQ ID NO: 8215297 - DNA, 22 bp, Homo sapiens
tggaggaagtggctggccagaa

SEQ ID NO: 8215298 - DNA, 22 bp, Homo sapiens
tggaggaagtggctggccagaa

SEQ ID NO: 8215299 - DNA, 22 bp, Homo sapiens
tggaggaagtggctggccagaa

SEQ ID NO: 8215300 - DNA, 22 bp, Homo sapiens
tggaggagaactccctggctac

SEQ ID NO: 8215301 - DNA, 22 bp, Homo sapiens
tggaggagaactccctggctac

SEQ ID NO: 8215302 - DNA, 22 bp, Homo sapiens
tggaggacgtgtccaccatgaa

SEQ ID NO: 8215303 - DNA, 22 bp, Homo sapiens
tggaggacaggactggacagcc

SEQ ID NO: 8215304 - DNA, 22 bp, Homo sapiens
tggaggcataggcctgggccct

SEQ ID NO: 8215305 - DNA, 22 bp, Homo sapiens
tggaggcataggcctgggccct

SEQ ID NO: 8215306 - DNA, 22 bp, Homo sapiens
tggaggcagtttaagtctgaga

SEQ ID NO: 8215307 - DNA, 22 bp, Homo sapiens
tggaggcagtttaagtctgaga

SEQ ID NO: 8215308 - DNA, 22 bp, Homo sapiens
tggaggcagtttaagtctgaga

SEQ ID NO: 8215309 - DNA, 22 bp, Homo sapiens
tggaggcagtttaagtctgaga

SEQ ID NO: 8215310 - DNA, 22 bp, Homo sapiens
tggaggcagtttaagtctgaga

SEQ ID NO: 8215311 - DNA, 22 bp, Homo sapiens
tggaggcatcagagtgcttggc

SEQ ID NO: 8215312 - DNA, 22 bp, Homo sapiens
tggaggcatcagagtgcttggc

SEQ ID NO: 8215313 - DNA, 22 bp, Homo sapiens
tggaggcatcagagtgcttggc

SEQ ID NO: 8215314 - DNA, 22 bp, Homo sapiens
tggaggcatgacagtgtctgga

SEQ ID NO: 8215315 - DNA, 22 bp, Homo sapiens
tggaggcatgacagtgtctgga

SEQ ID NO: 8215316 - DNA, 16 bp, Homo sapiens
tggaggcatctggccc

SEQ ID NO: 8215317 - DNA, 16 bp, Homo sapiens
tggaggcatctggccc

SEQ ID NO: 8215318 - DNA, 22 bp, Homo sapiens
tggaggcataggcctgggccct

SEQ ID NO: 8215319 - DNA, 22 bp, Homo sapiens
tggaggcataggcctgggccct

SEQ ID NO: 8215320 - DNA, 22 bp, Homo sapiens
tggaggcataggcctgggccct

SEQ ID NO: 8215321 - DNA, 22 bp, Homo sapiens
tggaggcatcagagtgcttggc

SEQ ID NO: 8215322 - DNA, 22 bp, Homo sapiens
tggaggcatcagagtgcttggc

SEQ ID NO: 8215323 - DNA, 22 bp, Homo sapiens
tggaggcatcagagtgcttggc

SEQ ID NO: 8215324 - DNA, 22 bp, Homo sapiens
tggaggccaaggcaggcggatc

SEQ ID NO: 8215325 - DNA, 22 bp, Homo sapiens
ccctggaggaccccaatgtggc

SEQ ID NO: 8215326 - DNA, 22 bp, Homo sapiens
ccctggaggaccccaatgtggc

SEQ ID NO: 8215327 - DNA, 22 bp, Homo sapiens
ccctggaggaccccaatgtggc

SEQ ID NO: 8215328 - DNA, 22 bp, Homo sapiens
ccctggagggacagctgctcta

SEQ ID NO: 8215329 - DNA, 22 bp, Homo sapiens
ccctggagggatttctcaatca

SEQ ID NO: 8215330 - DNA, 22 bp, Homo sapiens
ccctggagggatttctcaatca

SEQ ID NO: 8215331 - DNA, 22 bp, Homo sapiens
tggaggcattgtgactgctgaa

SEQ ID NO: 8215332 - DNA, 22 bp, Homo sapiens
tggaggcattgtgactgctgaa

SEQ ID NO: 8215333 - DNA, 22 bp, Homo sapiens
tggaggcatgacagtgtctgga

SEQ ID NO: 8215334 - DNA, 22 bp, Homo sapiens
tggaggcatgacagtgtctgga

SEQ ID NO: 8215335 - DNA, 22 bp, Homo sapiens
tggaggcatgacagtgtctgga

SEQ ID NO: 8215336 - DNA, 22 bp, Homo sapiens
tggaggcattttaggttgtcac

SEQ ID NO: 8215337 - DNA, 22 bp, Homo sapiens
tggaggcatttgatgttcataa

SEQ ID NO: 8215338 - DNA, 22 bp, Homo sapiens
tggaggcattttaggttgtcac

SEQ ID NO: 8215339 - DNA, 22 bp, Homo sapiens
tggaggcatttgatgttcataa

SEQ ID NO: 8215340 - DNA, 22 bp, Homo sapiens
tggaggcatttctttttggtcg

SEQ ID NO: 8215341 - DNA, 22 bp, Homo sapiens
tggaggcatttctttttggtcg

SEQ ID NO: 8215342 - DNA, 22 bp, Homo sapiens
ccctggagtcctggcagttgat

SEQ ID NO: 8215343 - DNA, 22 bp, Homo sapiens
ccctggagtgccggaatcaaga

SEQ ID NO: 8215344 - DNA, 22 bp, Homo sapiens
ccctggagtgccggaatcaaga

SEQ ID NO: 8215345 - DNA, 22 bp, Homo sapiens
ccctggagtccggagctcacct

SEQ ID NO: 8215346 - DNA, 22 bp, Homo sapiens
ccctggagtcctggcagttgat

SEQ ID NO: 8215347 - DNA, 22 bp, Homo sapiens
ccctggagtccggagctcacct

SEQ ID NO: 8215348 - DNA, 22 bp, Homo sapiens
ccctggagtcctggcagttgat

SEQ ID NO: 8215349 - DNA, 22 bp, Homo sapiens
ccctggagtcctggcagttgat

SEQ ID NO: 8215350 - DNA, 22 bp, Homo sapiens
ccctggagtagcactgggtcgc

SEQ ID NO: 8215351 - DNA, 22 bp, Homo sapiens
ccctggagtagcactgggtcgc

SEQ ID NO: 8215352 - DNA, 22 bp, Homo sapiens
ccctggagtcaggttggcctgg

SEQ ID NO: 8215353 - DNA, 22 bp, Homo sapiens
ccctggagtcaggttggcctgg

SEQ ID NO: 8215354 - DNA, 22 bp, Homo sapiens
ccctggagtcaggttggcctgg

SEQ ID NO: 8215355 - DNA, 23 bp, Homo sapiens
ccctggagtaaattcttggaagg

SEQ ID NO: 8215356 - DNA, 23 bp, Homo sapiens
ccctggagtaaattcttggaagg

SEQ ID NO: 8215357 - DNA, 22 bp, Homo sapiens
ccctggagtagcactgggtcgc

SEQ ID NO: 8215358 - DNA, 22 bp, Homo sapiens
ccctggagtagcactgggtcgc

SEQ ID NO: 8215359 - DNA, 22 bp, Homo sapiens
ccctggagtagcactgggtcgc

SEQ ID NO: 8215360 - DNA, 22 bp, Homo sapiens
ccctggagtagcactgggtcgc

SEQ ID NO: 8215361 - DNA, 22 bp, Homo sapiens
ccctggaggtcagaggcctggg

SEQ ID NO: 8215362 - DNA, 22 bp, Homo sapiens
ccctggaggtcagaggcctggg

SEQ ID NO: 8215363 - DNA, 22 bp, Homo sapiens
ccctggaggtcagaggcctggg

SEQ ID NO: 8215364 - DNA, 22 bp, Homo sapiens
ccctggaggtggaggttgcagg

SEQ ID NO: 8215365 - DNA, 22 bp, Homo sapiens
ccctggaggtcagaggcctggg

SEQ ID NO: 8215366 - DNA, 22 bp, Homo sapiens
ccctggaggtcagaggcctggg

SEQ ID NO: 8215367 - DNA, 22 bp, Homo sapiens
ccctggagggcagacagatgcc

SEQ ID NO: 8215368 - DNA, 22 bp, Homo sapiens
ccctggaggtcagaggcctggg

SEQ ID NO: 8215369 - DNA, 22 bp, Homo sapiens
ccctggagggcagacagatgcc

SEQ ID NO: 8215370 - DNA, 22 bp, Homo sapiens
ccctggagggcagacagatgcc

SEQ ID NO: 8215371 - DNA, 22 bp, Homo sapiens
ccctggagggcagacagatgcc

SEQ ID NO: 8215372 - DNA, 22 bp, Homo sapiens
ccctggagggcagacagatgcc

SEQ ID NO: 8215373 - DNA, 22 bp, Homo sapiens
ccctggaggttgaggctgcagt

SEQ ID NO: 8215374 - DNA, 22 bp, Homo sapiens
ccctggaggttgaggctgcagt

SEQ ID NO: 8215375 - DNA, 22 bp, Homo sapiens
ccctggaggttgaggctgcagt

SEQ ID NO: 8215376 - DNA, 22 bp, Homo sapiens
ccctggaggttgaggctgcagt

SEQ ID NO: 8215377 - DNA, 22 bp, Homo sapiens
ccctggaggttgaggctgcagt

SEQ ID NO: 8215378 - DNA, 22 bp, Homo sapiens
ccctggaggtggaggttgcagg

SEQ ID NO: 8215379 - DNA, 22 bp, Homo sapiens
ccctggaggttgaggctgcagt

SEQ ID NO: 8215380 - DNA, 22 bp, Homo sapiens
ccctggaggtggaggttgcagg

SEQ ID NO: 8215381 - DNA, 22 bp, Homo sapiens
ccctggaggtggaggttgcagg

SEQ ID NO: 8215382 - DNA, 22 bp, Homo sapiens
tggcacttttcccagttttggt

SEQ ID NO: 8215383 - DNA, 22 bp, Homo sapiens
tggcactttgagcaaaggtgca

SEQ ID NO: 8215384 - DNA, 22 bp, Homo sapiens
tggcactttgagcaaaggtgca

SEQ ID NO: 8215385 - DNA, 22 bp, Homo sapiens
tggcacttgtcacctgctttca

SEQ ID NO: 8215386 - DNA, 22 bp, Homo sapiens
tggcactttacacccatttggc

SEQ ID NO: 8215387 - DNA, 22 bp, Homo sapiens
tggcactttacttcctcaggag

SEQ ID NO: 8215388 - DNA, 22 bp, Homo sapiens
tggcactttacttcctcaggag

SEQ ID NO: 8215389 - DNA, 22 bp, Homo sapiens
tggcacttggtaaatatgtgtt

SEQ ID NO: 8215390 - DNA, 22 bp, Homo sapiens
tggcacttggctgagaggttct

SEQ ID NO: 8215391 - DNA, 22 bp, Homo sapiens
tggcacttgggagtcgtggcga

SEQ ID NO: 8215392 - DNA, 22 bp, Homo sapiens
tggcacttgggagtcgtggcga

SEQ ID NO: 8215393 - DNA, 22 bp, Homo sapiens
tggcacttggtaaatatgtgtt

SEQ ID NO: 8215394 - DNA, 22 bp, Homo sapiens
tggcagaagttcactagtagct

SEQ ID NO: 8215395 - DNA, 22 bp, Homo sapiens
tggcactttacacccatttggc

SEQ ID NO: 8215396 - DNA, 22 bp, Homo sapiens
tggcagaagtacacaagcatgc

SEQ ID NO: 8215397 - DNA, 22 bp, Homo sapiens
tggcacagtgctggatggtgct

SEQ ID NO: 8215398 - DNA, 22 bp, Homo sapiens
tggcacttgcttcagatgatgt

SEQ ID NO: 8215399 - DNA, 22 bp, Homo sapiens
tggcacttgatatttgatttgc

SEQ ID NO: 8215400 - DNA, 22 bp, Homo sapiens
ccctggagtgtgacgaggcatt

SEQ ID NO: 8215401 - DNA, 22 bp, Homo sapiens
ccctggagtgtgacgaggcatt

SEQ ID NO: 8215402 - DNA, 22 bp, Homo sapiens
ccctggatttacatcattctga

SEQ ID NO: 8215403 - DNA, 22 bp, Homo sapiens
ccctggagtgtgacgaggcatt

SEQ ID NO: 8215404 - DNA, 22 bp, Homo sapiens
ccctggagtgtgacgaggcatt

SEQ ID NO: 8215405 - DNA, 22 bp, Homo sapiens
tggcagaatttctagcagattc

SEQ ID NO: 8215406 - DNA, 22 bp, Homo sapiens
tggcagaatttctagcagattc

SEQ ID NO: 8215407 - DNA, 22 bp, Homo sapiens
tggcagaattttaaagacagat

SEQ ID NO: 8215408 - DNA, 22 bp, Homo sapiens
tggcagaattttaaagacagat

SEQ ID NO: 8215409 - DNA, 22 bp, Homo sapiens
tggcagaccatcttattaacaa

SEQ ID NO: 8215410 - DNA, 22 bp, Homo sapiens
tggcagagaacacacatgattc

SEQ ID NO: 8215411 - DNA, 22 bp, Homo sapiens
tggcagagaacacacatgattc

SEQ ID NO: 8215412 - DNA, 22 bp, Homo sapiens
tggcagagaacacacatgattc

SEQ ID NO: 8215413 - DNA, 22 bp, Homo sapiens
ccctggctgcttgtagtctggc

SEQ ID NO: 8215414 - DNA, 22 bp, Homo sapiens
ccctgggagaagttgagggctg

SEQ ID NO: 8215415 - DNA, 22 bp, Homo sapiens
ccctgggacccgctgcagaggc

SEQ ID NO: 8215416 - DNA, 22 bp, Homo sapiens
ccctgggaggcttccaggcaga

SEQ ID NO: 8215417 - DNA, 22 bp, Homo sapiens
ccctgggagctgcctggctgac

SEQ ID NO: 8215418 - DNA, 22 bp, Homo sapiens
ccctgggagaagttgagggctg

SEQ ID NO: 8215419 - DNA, 22 bp, Homo sapiens
ccctgggaagtattccagctat

SEQ ID NO: 8215420 - DNA, 22 bp, Homo sapiens
ccctgggaagtattccagctat

SEQ ID NO: 8215421 - DNA, 22 bp, Homo sapiens
ccctgggaagtattccagctat

SEQ ID NO: 8215422 - DNA, 22 bp, Homo sapiens
ccctggcttggcactctccact

SEQ ID NO: 8215423 - DNA, 22 bp, Homo sapiens
ccctggctggctctgcccggac

SEQ ID NO: 8215424 - DNA, 22 bp, Homo sapiens
ccctggctgcttgtagtctggc

SEQ ID NO: 8215425 - DNA, 22 bp, Homo sapiens
ccctggctgcttgtagtctggc

SEQ ID NO: 8215426 - DNA, 22 bp, Homo sapiens
tggcaggcgggagccatagagg

SEQ ID NO: 8215427 - DNA, 22 bp, Homo sapiens
tggcaggcggaggttgcagtga

SEQ ID NO: 8215428 - DNA, 22 bp, Homo sapiens
tggcaggctctgagtagcacct

SEQ ID NO: 8215429 - DNA, 22 bp, Homo sapiens
tggcaggctgagttggcctggt

SEQ ID NO: 8215430 - DNA, 22 bp, Homo sapiens
tggcaggctctgagtagcacct

SEQ ID NO: 8215431 - DNA, 22 bp, Homo sapiens
tggcaggctctgagtagcacct

SEQ ID NO: 8215432 - DNA, 22 bp, Homo sapiens
tggcaggctctgagtagcacct

SEQ ID NO: 8215433 - DNA, 22 bp, Homo sapiens
tggcagggaatacagatgttta

SEQ ID NO: 8215434 - DNA, 22 bp, Homo sapiens
tggcaggctgagttggcctggt

SEQ ID NO: 8215435 - DNA, 22 bp, Homo sapiens
tggcaggctgagttggcctggt

SEQ ID NO: 8215436 - DNA, 22 bp, Homo sapiens
tggcaggctgagttggcctggt

SEQ ID NO: 8215437 - DNA, 19 bp, Homo sapiens
tggcaggcccaggatggac

SEQ ID NO: 8215438 - DNA, 19 bp, Homo sapiens
tggcaggcccaggatggac

SEQ ID NO: 8215439 - DNA, 19 bp, Homo sapiens
tggcaggcccaggatggac

SEQ ID NO: 8215440 - DNA, 19 bp, Homo sapiens
tggcaggcccaggatggac

SEQ ID NO: 8215441 - DNA, 19 bp, Homo sapiens
tggcaggcccaggatggac

SEQ ID NO: 8215442 - DNA, 22 bp, Homo sapiens
cccttgctgccacagctgccca

SEQ ID NO: 8215443 - DNA, 22 bp, Homo sapiens
cccttgcacatttgtctttaat

SEQ ID NO: 8215444 - DNA, 22 bp, Homo sapiens
cccttgcatcccatgtgtggcc

SEQ ID NO: 8215445 - DNA, 22 bp, Homo sapiens
cccttgagcctggaggagctct

SEQ ID NO: 8215446 - DNA, 22 bp, Homo sapiens
cccttgagcctggaggagctct

SEQ ID NO: 8215447 - DNA, 22 bp, Homo sapiens
cccttgagctgtggctgggtga

SEQ ID NO: 8215448 - DNA, 22 bp, Homo sapiens
cccttgaggtagactgaacacc

SEQ ID NO: 8215449 - DNA, 22 bp, Homo sapiens
tggcagggagccaccggtcatg

SEQ ID NO: 8215450 - DNA, 22 bp, Homo sapiens
tggcagggaatacagatgttta

SEQ ID NO: 8215451 - DNA, 22 bp, Homo sapiens
tggcagggaatacagatgttta

SEQ ID NO: 8215452 - DNA, 19 bp, Homo sapiens
tggcagggagagtttgaag

SEQ ID NO: 8215453 - DNA, 19 bp, Homo sapiens
tggcagggagagtttgaag

SEQ ID NO: 8215454 - DNA, 22 bp, Homo sapiens
tggcagggagccaccggtcatg

SEQ ID NO: 8215455 - DNA, 19 bp, Homo sapiens
tggcagggagagtttgaag

SEQ ID NO: 8215456 - DNA, 19 bp, Homo sapiens
tggcagggagagtttgaag

SEQ ID NO: 8215457 - DNA, 22 bp, Homo sapiens
cccttggaggaagctctaggct

SEQ ID NO: 8215458 - DNA, 22 bp, Homo sapiens
cccttggaggaagctctaggct

SEQ ID NO: 8215459 - DNA, 22 bp, Homo sapiens
cccttggaggaagctctaggct

SEQ ID NO: 8215460 - DNA, 22 bp, Homo sapiens
cccttggggtggaggttgcagt

SEQ ID NO: 8215461 - DNA, 22 bp, Homo sapiens
cccttggggatgctgtgtctgg

SEQ ID NO: 8215462 - DNA, 22 bp, Homo sapiens
cccttggggctctttgccaggc

SEQ ID NO: 8215463 - DNA, 22 bp, Homo sapiens
cccttgggtgccagccacaagt

SEQ ID NO: 8215464 - DNA, 22 bp, Homo sapiens
cccttgggcttcagccctaccg

SEQ ID NO: 8215465 - DNA, 22 bp, Homo sapiens
cccttgggcttccacccagccc

SEQ ID NO: 8215466 - DNA, 22 bp, Homo sapiens
ccctttaaagttttaccagcag

SEQ ID NO: 8215467 - DNA, 22 bp, Homo sapiens
tggcaggtagtcagaggcgaca

SEQ ID NO: 8215468 - DNA, 22 bp, Homo sapiens
ccctttacagcctctagagggt

SEQ ID NO: 8215469 - DNA, 20 bp, Homo sapiens
tgctcaggatggagaggtgt

SEQ ID NO: 8215470 - DNA, 19 bp, Homo sapiens
tgctcaggccaaggagccc

SEQ ID NO: 8215471 - DNA, 22 bp, Homo sapiens
tgctcaggaggaggctgtgagg

SEQ ID NO: 8215472 - DNA, 22 bp, Homo sapiens
tgctcaggaggaggctgtgagg

SEQ ID NO: 8215473 - DNA, 22 bp, Homo sapiens
tgctcaggaaataatgtctgtg

SEQ ID NO: 8215474 - DNA, 22 bp, Homo sapiens
tgctcaggaaataatgtctgtg

SEQ ID NO: 8215475 - DNA, 22 bp, Homo sapiens
tgctcaggagcttagagcacag

SEQ ID NO: 8215476 - DNA, 22 bp, Homo sapiens
tgctcaggacagtggaacctaa

SEQ ID NO: 8215477 - DNA, 22 bp, Homo sapiens
tgctcaggccctgggccatcct

SEQ ID NO: 8215478 - DNA, 22 bp, Homo sapiens
tgctcaggccctgggccatcct

SEQ ID NO: 8215479 - DNA, 19 bp, Homo sapiens
tgctcaggccaaggagccc

SEQ ID NO: 8215480 - DNA, 22 bp, Homo sapiens
tgctcaggccagccggacagag

SEQ ID NO: 8215481 - DNA, 22 bp, Homo sapiens
tgctcagggagcatagtgaatt

SEQ ID NO: 8215482 - DNA, 22 bp, Homo sapiens
tgctcagggagcttcctggtgg

SEQ ID NO: 8215483 - DNA, 22 bp, Homo sapiens
tgctcagggacaatggagaggg

SEQ ID NO: 8215484 - DNA, 22 bp, Homo sapiens
tgctcagggacaatggagaggg

SEQ ID NO: 8215485 - DNA, 22 bp, Homo sapiens
tgctagtgtgtgagatgttcaa

SEQ ID NO: 8215486 - DNA, 22 bp, Homo sapiens
tgctagtgcagggttttcagtt

SEQ ID NO: 8215487 - DNA, 22 bp, Homo sapiens
tgctaggtgattttattacttg

SEQ ID NO: 8215488 - DNA, 22 bp, Homo sapiens
tgctagccaagcccatcccttt

SEQ ID NO: 8215489 - DNA, 22 bp, Homo sapiens
tgccttctcttccctgggagct

SEQ ID NO: 8215490 - DNA, 22 bp, Homo sapiens
tgccttctcttccctgggagct

SEQ ID NO: 8215491 - DNA, 22 bp, Homo sapiens
tgcaggtgctgtgtcaagagag

SEQ ID NO: 8215492 - DNA, 22 bp, Homo sapiens
tgcaggtgctgtgtcaagagag

SEQ ID NO: 8215493 - DNA, 22 bp, Homo sapiens
tgcaggtgctgtgtcaagagag

SEQ ID NO: 8215494 - DNA, 22 bp, Homo sapiens
tgctaagctgaggaagatgaga

SEQ ID NO: 8215495 - DNA, 22 bp, Homo sapiens
tgctacagagccaggaagagtg

SEQ ID NO: 8215496 - DNA, 22 bp, Homo sapiens
tgctacaggcgatcctcaacta

SEQ ID NO: 8215497 - DNA, 22 bp, Homo sapiens
tgcagggctaagtcagagcctg

SEQ ID NO: 8215498 - DNA, 22 bp, Homo sapiens
tgcagggccttgttgatgtgct

SEQ ID NO: 8215499 - DNA, 22 bp, Homo sapiens
tgcagggctaagtcagagcctg

SEQ ID NO: 8215500 - DNA, 22 bp, Homo sapiens
tgcagggctacaggactacaac

SEQ ID NO: 8215501 - DNA, 22 bp, Homo sapiens
tgcagggctaagtcagagcctg

SEQ ID NO: 8215502 - DNA, 22 bp, Homo sapiens
tgcaggtgcctcttgagcttgt

SEQ ID NO: 8215503 - DNA, 22 bp, Homo sapiens
tgcaggtgcctcttgagcttgt

SEQ ID NO: 8215504 - DNA, 22 bp, Homo sapiens
tgcaggtgcctcttgagcttgt

SEQ ID NO: 8215505 - DNA, 22 bp, Homo sapiens
tgcaggtgcctcttgagcttgt

SEQ ID NO: 8215506 - DNA, 22 bp, Homo sapiens
tgcaggtgccatcgctgctcat

SEQ ID NO: 8215507 - DNA, 22 bp, Homo sapiens
tgcaggtgccatcgctgctcat

SEQ ID NO: 8215508 - DNA, 22 bp, Homo sapiens
tgcaggtgccatcgctgctcat

SEQ ID NO: 8215509 - DNA, 22 bp, Homo sapiens
tgcaggtgccatcgctgctcat

SEQ ID NO: 8215510 - DNA, 22 bp, Homo sapiens
tgcaggtgctccgggggtgccc

SEQ ID NO: 8215511 - DNA, 22 bp, Homo sapiens
tgcaggtgctccgggggtgccc

SEQ ID NO: 8215512 - DNA, 22 bp, Homo sapiens
tgcaggtgctgatacctactcc

SEQ ID NO: 8215513 - DNA, 22 bp, Homo sapiens
tgcaggtgctgatacctactcc

SEQ ID NO: 8215514 - DNA, 22 bp, Homo sapiens
tgcaggtgctccgggggtgccc

SEQ ID NO: 8215515 - DNA, 22 bp, Homo sapiens
tgcaggtgctacaagaactcac

SEQ ID NO: 8215516 - DNA, 22 bp, Homo sapiens
tgcaggtgctacaagaactcac

SEQ ID NO: 8215517 - DNA, 22 bp, Homo sapiens
tgcaggtgcgttttcaagcctc

SEQ ID NO: 8215518 - DNA, 22 bp, Homo sapiens
tgcaggtgcgttttcaagcctc

SEQ ID NO: 8215519 - DNA, 22 bp, Homo sapiens
tgcaggtgcgttttcaagcctc

SEQ ID NO: 8215520 - DNA, 22 bp, Homo sapiens
tgcaggtgcgttttcaagcctc

SEQ ID NO: 8215521 - DNA, 22 bp, Homo sapiens
tgctctgcacatccctcacaaa

SEQ ID NO: 8215522 - DNA, 22 bp, Homo sapiens
tgctctgcacatccctcacaaa

SEQ ID NO: 8215523 - DNA, 20 bp, Homo sapiens
tgctctggaaatggtctgag

SEQ ID NO: 8215524 - DNA, 22 bp, Homo sapiens
tgctctggaatagtcctaggca

SEQ ID NO: 8215525 - DNA, 22 bp, Homo sapiens
tgctctggaatagtcctaggca

SEQ ID NO: 8215526 - DNA, 22 bp, Homo sapiens
tgctctggacgctgagtggttt

SEQ ID NO: 8215527 - DNA, 19 bp, Homo sapiens
tgctctggagccagctctc

SEQ ID NO: 8215528 - DNA, 22 bp, Homo sapiens
tgctctggacgctgagtggttt

SEQ ID NO: 8215529 - DNA, 19 bp, Homo sapiens
tgctctggagccagctctc

SEQ ID NO: 8215530 - DNA, 22 bp, Homo sapiens
tgctctggagggtgaagctttt

SEQ ID NO: 8215531 - DNA, 19 bp, Homo sapiens
tgctgcaggatgctgctgg

SEQ ID NO: 8215532 - DNA, 19 bp, Homo sapiens
tgctgcaggatgctgctgg

SEQ ID NO: 8215533 - DNA, 22 bp, Homo sapiens
tgctctggagtggcttgtgcac

SEQ ID NO: 8215534 - DNA, 22 bp, Homo sapiens
tgctgccttctaggcgtgccct

SEQ ID NO: 8215535 - DNA, 22 bp, Homo sapiens
tgctgccttagcagccaggcaa

SEQ ID NO: 8215536 - DNA, 22 bp, Homo sapiens
tgctgcctttcaatgttgtcat

SEQ ID NO: 8215537 - DNA, 22 bp, Homo sapiens
tgctgcctttctgaatggtgga

SEQ ID NO: 8215538 - DNA, 22 bp, Homo sapiens
tgctgcaggcagcccctctact

SEQ ID NO: 8215539 - DNA, 22 bp, Homo sapiens
tgctgcctgctacgagggaaga

SEQ ID NO: 8215540 - DNA, 22 bp, Homo sapiens
tgctgcctggagccttttgttt

SEQ ID NO: 8215541 - DNA, 22 bp, Homo sapiens
tgctgcctgttgtggggccacg

SEQ ID NO: 8215542 - DNA, 22 bp, Homo sapiens
tgctgcctgtgccaggagggtc

SEQ ID NO: 8215543 - DNA, 22 bp, Homo sapiens
tgctgcctgtgccaggagggtc

SEQ ID NO: 8215544 - DNA, 22 bp, Homo sapiens
tgctgcctggtttcttcttgct

SEQ ID NO: 8215545 - DNA, 22 bp, Homo sapiens
tgctctgcacatccctcacaaa

SEQ ID NO: 8215546 - DNA, 22 bp, Homo sapiens
tgctctgattggagtctgttgc

SEQ ID NO: 8215547 - DNA, 22 bp, Homo sapiens
cccagtggctgtccccatgggc

SEQ ID NO: 8215548 - DNA, 19 bp, Homo sapiens
tgctctctggtgcttcatg

SEQ ID NO: 8215549 - DNA, 22 bp, Homo sapiens
tgctctgaaggggaagggatgg

SEQ ID NO: 8215550 - DNA, 22 bp, Homo sapiens
cccagtggagataggagtgtgg

SEQ ID NO: 8215551 - DNA, 22 bp, Homo sapiens
cccagtggaaggagtagaagac

SEQ ID NO: 8215552 - DNA, 22 bp, Homo sapiens
cccagtggaaggagtagaagac

SEQ ID NO: 8215553 - DNA, 18 bp, Homo sapiens
cccagtgctcactgcctc

SEQ ID NO: 8215554 - DNA, 22 bp, Homo sapiens
cccagtgctatgcctattacat

SEQ ID NO: 8215555 - DNA, 18 bp, Homo sapiens
cccagtgctcactgcctc

SEQ ID NO: 8215556 - DNA, 22 bp, Homo sapiens
cccagtggcccagcatgtggtg

SEQ ID NO: 8215557 - DNA, 22 bp, Homo sapiens
cccagtggcccagcatgtggtg

SEQ ID NO: 8215558 - DNA, 22 bp, Homo sapiens
cccagtggcccagcatgtggtg

SEQ ID NO: 8215559 - DNA, 22 bp, Homo sapiens
cccagtggcaaagcagcttaga

SEQ ID NO: 8215560 - DNA, 22 bp, Homo sapiens
cccagtggcaaagcagcttaga

SEQ ID NO: 8215561 - DNA, 22 bp, Homo sapiens
cccagtggagataggagtgtgg

SEQ ID NO: 8215562 - DNA, 22 bp, Homo sapiens
tgctcaggtcgttctgcccctt

SEQ ID NO: 8215563 - DNA, 22 bp, Homo sapiens
tgctcaggtgccttggctgctg

SEQ ID NO: 8215564 - DNA, 22 bp, Homo sapiens
tgctcaggtcgttctgcccctt

SEQ ID NO: 8215565 - DNA, 22 bp, Homo sapiens
tgctcaggtgccttggctgctg

SEQ ID NO: 8215566 - DNA, 22 bp, Homo sapiens
cccaggtctgtgccagctctga

SEQ ID NO: 8215567 - DNA, 22 bp, Homo sapiens
cccaggtctgtgccagctctga

SEQ ID NO: 8215568 - DNA, 22 bp, Homo sapiens
cccaggtctgtgccagctctga

SEQ ID NO: 8215569 - DNA, 22 bp, Homo sapiens
cccagtgccaggcacaggcagc

SEQ ID NO: 8215570 - DNA, 22 bp, Homo sapiens
cccagtgccaggcacaggcagc

SEQ ID NO: 8215571 - DNA, 22 bp, Homo sapiens
cccagtccagaccatgacctca

SEQ ID NO: 8215572 - DNA, 22 bp, Homo sapiens
cccagtcctaaagcagacgcca

SEQ ID NO: 8215573 - DNA, 22 bp, Homo sapiens
tgctgggggttcagatgagtaa

SEQ ID NO: 8215574 - DNA, 22 bp, Homo sapiens
tgctgggggtgtctcaccaggc

SEQ ID NO: 8215575 - DNA, 22 bp, Homo sapiens
tgctgggggtgtctcaccaggc

SEQ ID NO: 8215576 - DNA, 22 bp, Homo sapiens
tgctgggggtagctctgcgtag

SEQ ID NO: 8215577 - DNA, 22 bp, Homo sapiens
tgctgggggtgtctcaccaggc

SEQ ID NO: 8215578 - DNA, 22 bp, Homo sapiens
tgctgggggtgtctcaccaggc

SEQ ID NO: 8215579 - DNA, 22 bp, Homo sapiens
tgctgggggtgtctcaccaggc

SEQ ID NO: 8215580 - DNA, 22 bp, Homo sapiens
tgctgggggtgtctcaccaggc

SEQ ID NO: 8215581 - DNA, 22 bp, Homo sapiens
tgctggggctctgaccactcca

SEQ ID NO: 8215582 - DNA, 22 bp, Homo sapiens
tgctggggctctgaccactcca

SEQ ID NO: 8215583 - DNA, 22 bp, Homo sapiens
tgctggggctctgaccactcca

SEQ ID NO: 8215584 - DNA, 22 bp, Homo sapiens
tgctggggctctgaccactcca

SEQ ID NO: 8215585 - DNA, 22 bp, Homo sapiens
tgctgggggctttctggatacc

SEQ ID NO: 8215586 - DNA, 22 bp, Homo sapiens
tgctgggggctttctggatacc

SEQ ID NO: 8215587 - DNA, 22 bp, Homo sapiens
tgctgggggctttctggatacc

SEQ ID NO: 8215588 - DNA, 22 bp, Homo sapiens
tgctgggggtagctctgcgtag

SEQ ID NO: 8215589 - DNA, 22 bp, Homo sapiens
tgctgggggtagctctgcgtag

SEQ ID NO: 8215590 - DNA, 22 bp, Homo sapiens
tgctgggggtagctctgcgtag

SEQ ID NO: 8215591 - DNA, 22 bp, Homo sapiens
tgctgggggtagctctgcgtag

SEQ ID NO: 8215592 - DNA, 22 bp, Homo sapiens
tgctgggggctttctggatacc

SEQ ID NO: 8215593 - DNA, 22 bp, Homo sapiens
tgctgggggctttctggatacc

SEQ ID NO: 8215594 - DNA, 22 bp, Homo sapiens
tgctgggggctttctggatacc

SEQ ID NO: 8215595 - DNA, 18 bp, Homo sapiens
tgctggggtagaatccac

SEQ ID NO: 8215596 - DNA, 18 bp, Homo sapiens
tgctggggtagaatccac

SEQ ID NO: 8215597 - DNA, 18 bp, Homo sapiens
tgctggggtagaatccac

SEQ ID NO: 8215598 - DNA, 22 bp, Homo sapiens
tgctgggggttcagatgagtaa

SEQ ID NO: 8215599 - DNA, 22 bp, Homo sapiens
tgctgggggttcagatgagtaa

SEQ ID NO: 8215600 - DNA, 22 bp, Homo sapiens
tgctgggggttcagatgagtaa

SEQ ID NO: 8215601 - DNA, 23 bp, Homo sapiens
tgctggggtagtttgtggcacag

SEQ ID NO: 8215602 - DNA, 23 bp, Homo sapiens
tgctggggtagtttgtggcacag

SEQ ID NO: 8215603 - DNA, 23 bp, Homo sapiens
tgctggggtagtttgtggcacag

SEQ ID NO: 8215604 - DNA, 22 bp, Homo sapiens
ccccagctcagtgcagggacat

SEQ ID NO: 8215605 - DNA, 22 bp, Homo sapiens
ccccagctgcatacttgccaag

SEQ ID NO: 8215606 - DNA, 22 bp, Homo sapiens
ccccagctcagtgcagggacat

SEQ ID NO: 8215607 - DNA, 22 bp, Homo sapiens
ccccaggaagcctcagatttgc

SEQ ID NO: 8215608 - DNA, 22 bp, Homo sapiens
ccccagctgcatacttgccaag

SEQ ID NO: 8215609 - DNA, 22 bp, Homo sapiens
ccccagctgcatacttgccaag

SEQ ID NO: 8215610 - DNA, 22 bp, Homo sapiens
ccccagctgcatacttgccaag

SEQ ID NO: 8215611 - DNA, 22 bp, Homo sapiens
cccagtgtctgggcctgcaggg

SEQ ID NO: 8215612 - DNA, 22 bp, Homo sapiens
cccagtgtcaccaacaggacac

SEQ ID NO: 8215613 - DNA, 22 bp, Homo sapiens
cccagtgtctccaacatcagat

SEQ ID NO: 8215614 - DNA, 22 bp, Homo sapiens
cccagtgtctcttgtgcctttc

SEQ ID NO: 8215615 - DNA, 22 bp, Homo sapiens
cccagttgttgccggctctgga

SEQ ID NO: 8215616 - DNA, 22 bp, Homo sapiens
cccagttgttgccggctctgga

SEQ ID NO: 8215617 - DNA, 22 bp, Homo sapiens
tgctgggcaccagtgcctgcag

SEQ ID NO: 8215618 - DNA, 22 bp, Homo sapiens
tgctggggctctgaccactcca

SEQ ID NO: 8215619 - DNA, 22 bp, Homo sapiens
tgctgcctttgtggggtcactg

SEQ ID NO: 8215620 - DNA, 22 bp, Homo sapiens
cccagtggcttttgcccaggtt

SEQ ID NO: 8215621 - DNA, 22 bp, Homo sapiens
cccagtggcttttgcccaggtt

SEQ ID NO: 8215622 - DNA, 22 bp, Homo sapiens
cccagtggtgctggcatctgtg

SEQ ID NO: 8215623 - DNA, 22 bp, Homo sapiens
cccagtggtgctggcatctgtg

SEQ ID NO: 8215624 - DNA, 22 bp, Homo sapiens
cccagtggtgctggcatctgtg

SEQ ID NO: 8215625 - DNA, 22 bp, Homo sapiens
cccagtggtttgcagaaccaag

SEQ ID NO: 8215626 - DNA, 22 bp, Homo sapiens
cccagtggtttgcagaaccaag

SEQ ID NO: 8215627 - DNA, 22 bp, Homo sapiens
cccagtggggaaatagctagct

SEQ ID NO: 8215628 - DNA, 22 bp, Homo sapiens
cccagtggggaaatagctagct

SEQ ID NO: 8215629 - DNA, 22 bp, Homo sapiens
cccagtggggagctgaggttca

SEQ ID NO: 8215630 - DNA, 22 bp, Homo sapiens
cccagtgggtcactgcatctca

SEQ ID NO: 8215631 - DNA, 22 bp, Homo sapiens
cccagtggggagcttctgcctt

SEQ ID NO: 8215632 - DNA, 22 bp, Homo sapiens
cccagtgggtcactgcatctca

SEQ ID NO: 8215633 - DNA, 22 bp, Homo sapiens
ccccaggcagggcctaacagag

SEQ ID NO: 8215634 - DNA, 22 bp, Homo sapiens
ccccaggcagggcctaacagag

SEQ ID NO: 8215635 - DNA, 22 bp, Homo sapiens
ccccaggagcttgttttagaga

SEQ ID NO: 8215636 - DNA, 22 bp, Homo sapiens
tgcttaaaaacagtatggtagt

SEQ ID NO: 8215637 - DNA, 22 bp, Homo sapiens
tgcttccctgctctgcacacct

SEQ ID NO: 8215638 - DNA, 22 bp, Homo sapiens
tgcttccctgctctgcacacct

SEQ ID NO: 8215639 - DNA, 21 bp, Homo sapiens
tgcttccctgggccacactga

SEQ ID NO: 8215640 - DNA, 22 bp, Homo sapiens
ccccaggagatttgggagcaca

SEQ ID NO: 8215641 - DNA, 22 bp, Homo sapiens
ccccaggagatttgggagcaca

SEQ ID NO: 8215642 - DNA, 22 bp, Homo sapiens
ccccaggagaaatcttaaacta

SEQ ID NO: 8215643 - DNA, 22 bp, Homo sapiens
ccccaggacgtggccctcatag

SEQ ID NO: 8215644 - DNA, 22 bp, Homo sapiens
ccccaggacacatggaccaagt

SEQ ID NO: 8215645 - DNA, 16 bp, Homo sapiens
ccccaggacttggcac

SEQ ID NO: 8215646 - DNA, 22 bp, Homo sapiens
tgcttcctgctaaggctgcctg

SEQ ID NO: 8215647 - DNA, 20 bp, Homo sapiens
tgcttcctggccactgcggg

SEQ ID NO: 8215648 - DNA, 20 bp, Homo sapiens
tgcttcctggccactgcggg

SEQ ID NO: 8215649 - DNA, 20 bp, Homo sapiens
tgcttcctggccactgcggg

SEQ ID NO: 8215650 - DNA, 22 bp, Homo sapiens
tgcttccttcccgttcttctcc

SEQ ID NO: 8215651 - DNA, 22 bp, Homo sapiens
tgcttccttgagctctccaatc

SEQ ID NO: 8215652 - DNA, 22 bp, Homo sapiens
tgcttccttgatcattcccaaa

SEQ ID NO: 8215653 - DNA, 19 bp, Homo sapiens
tgcttcctcaccatctccc

SEQ ID NO: 8215654 - DNA, 19 bp, Homo sapiens
tgcttcctcaccatctccc

SEQ ID NO: 8215655 - DNA, 22 bp, Homo sapiens
tgcttcctgaggccgtcttctc

SEQ ID NO: 8215656 - DNA, 22 bp, Homo sapiens
tgcttcctgctaaggctgcctg

SEQ ID NO: 8215657 - DNA, 21 bp, Homo sapiens
tgcttccctgggccacactga

SEQ ID NO: 8215658 - DNA, 22 bp, Homo sapiens
tgcttccgctaaaaattaatcc

SEQ ID NO: 8215659 - DNA, 22 bp, Homo sapiens
tgcttcctatccacacaatgcc

SEQ ID NO: 8215660 - DNA, 22 bp, Homo sapiens
tgcttgtcaggataagctctgg

SEQ ID NO: 8215661 - DNA, 20 bp, Homo sapiens
tgcttgtcatgcactcaggc

SEQ ID NO: 8215662 - DNA, 20 bp, Homo sapiens
tgcttgtcatgcactcaggc

SEQ ID NO: 8215663 - DNA, 22 bp, Homo sapiens
ccctccccacaaagcttcacac

SEQ ID NO: 8215664 - DNA, 22 bp, Homo sapiens
ccctccccacaaagcttcacac

SEQ ID NO: 8215665 - DNA, 22 bp, Homo sapiens
ccctccagtgtcccagtgggga

SEQ ID NO: 8215666 - DNA, 22 bp, Homo sapiens
ccctccctatgtagatgatgtt

SEQ ID NO: 8215667 - DNA, 22 bp, Homo sapiens
ccctccccagggtcatattgaa

SEQ ID NO: 8215668 - DNA, 22 bp, Homo sapiens
ccctccctctgctgggtgtaga

SEQ ID NO: 8215669 - DNA, 22 bp, Homo sapiens
ccctccctatgtagatgatgtt

SEQ ID NO: 8215670 - DNA, 22 bp, Homo sapiens
ccctccccacaaagcttcacac

SEQ ID NO: 8215671 - DNA, 22 bp, Homo sapiens
ccctccccacaaagcttcacac

SEQ ID NO: 8215672 - DNA, 22 bp, Homo sapiens
tgcttggcctacttgtcctttg

SEQ ID NO: 8215673 - DNA, 22 bp, Homo sapiens
tgcttggctttctgagcttctg

SEQ ID NO: 8215674 - DNA, 22 bp, Homo sapiens
tgcttggctagcttggcagctc

SEQ ID NO: 8215675 - DNA, 22 bp, Homo sapiens
tgcttgctgggccaatggcaat

SEQ ID NO: 8215676 - DNA, 22 bp, Homo sapiens
tgcttccttgatcattcccaaa

SEQ ID NO: 8215677 - DNA, 22 bp, Homo sapiens
tgcttgctggaggcagacagaa

SEQ ID NO: 8215678 - DNA, 22 bp, Homo sapiens
tgcttgtcacatacaggagcat

SEQ ID NO: 8215679 - DNA, 22 bp, Homo sapiens
tgcttgtcaccctgcctgagtg

SEQ ID NO: 8215680 - DNA, 22 bp, Homo sapiens
tgcttggctttctgagcttctg

SEQ ID NO: 8215681 - DNA, 22 bp, Homo sapiens
tgcttgggcggccagcatggcg

SEQ ID NO: 8215682 - DNA, 22 bp, Homo sapiens
tgcttgggcggccagcatggcg

SEQ ID NO: 8215683 - DNA, 22 bp, Homo sapiens
tgcttgggcggccagcatggcg

SEQ ID NO: 8215684 - DNA, 18 bp, Homo sapiens
tctagaaacccagactct

SEQ ID NO: 8215685 - DNA, 18 bp, Homo sapiens
tctagaaacccagactct

SEQ ID NO: 8215686 - DNA, 22 bp, Homo sapiens
tctagaaagccaaattaggaat

SEQ ID NO: 8215687 - DNA, 22 bp, Homo sapiens
tctagaaagccaaattaggaat

SEQ ID NO: 8215688 - DNA, 18 bp, Homo sapiens
tctagaaacttctctcct

SEQ ID NO: 8215689 - DNA, 22 bp, Homo sapiens
tctagaaagtactagagctggt

SEQ ID NO: 8215690 - DNA, 22 bp, Homo sapiens
tctagaaagtttgtactgattt

SEQ ID NO: 8215691 - DNA, 22 bp, Homo sapiens
tctagaaattttgccttgtatt

SEQ ID NO: 8215692 - DNA, 22 bp, Homo sapiens
tctagaagatacctgctgccaa

SEQ ID NO: 8215693 - DNA, 17 bp, Homo sapiens
tctagaagtgcttacat

SEQ ID NO: 8215694 - DNA, 17 bp, Homo sapiens
tctagaagtgcttacat

SEQ ID NO: 8215695 - DNA, 22 bp, Homo sapiens
tcctgtgttactgcctggagcg

SEQ ID NO: 8215696 - DNA, 22 bp, Homo sapiens
tcctgtgttaaagggggtgcta

SEQ ID NO: 8215697 - DNA, 22 bp, Homo sapiens
tcctgtgttacccttgcagtga

SEQ ID NO: 8215698 - DNA, 22 bp, Homo sapiens
tcctgtgttctaggtatggtct

SEQ ID NO: 8215699 - DNA, 22 bp, Homo sapiens
tcctgtgttgatagagatggtt

SEQ ID NO: 8215700 - DNA, 22 bp, Homo sapiens
tcctgttagtgttagacttccc

SEQ ID NO: 8215701 - DNA, 22 bp, Homo sapiens
tcctgttgttcgcctgcgatgg

SEQ ID NO: 8215702 - DNA, 22 bp, Homo sapiens
tcctgttgctgtagtggttaag

SEQ ID NO: 8215703 - DNA, 21 bp, Homo sapiens
tctaatgacatcctctgacaa

SEQ ID NO: 8215704 - DNA, 22 bp, Homo sapiens
tctaatgaaagatgtaggaact

SEQ ID NO: 8215705 - DNA, 22 bp, Homo sapiens
tctaatgatcaagtgatgacag

SEQ ID NO: 8215706 - DNA, 22 bp, Homo sapiens
tctaatgctctgagaacagtgc

SEQ ID NO: 8215707 - DNA, 22 bp, Homo sapiens
tctaatgcagttctgggtattt

SEQ ID NO: 8215708 - DNA, 23 bp, Homo sapiens
tctaatgcaattagaaattaggg

SEQ ID NO: 8215709 - DNA, 22 bp, Homo sapiens
tctagaaacatgacattgatct

SEQ ID NO: 8215710 - DNA, 22 bp, Homo sapiens
tctaatgcttcctctcatccca

SEQ ID NO: 8215711 - DNA, 22 bp, Homo sapiens
ccacccctgggtgcagggagcg

SEQ ID NO: 8215712 - DNA, 22 bp, Homo sapiens
ccacccctgtagagggacagac

SEQ ID NO: 8215713 - DNA, 19 bp, Homo sapiens
ccacccctttgctgggccc

SEQ ID NO: 8215714 - DNA, 20 bp, Homo sapiens
ccaccctccaggaacacata

SEQ ID NO: 8215715 - DNA, 19 bp, Homo sapiens
ccacccctttgctgggccc

SEQ ID NO: 8215716 - DNA, 22 bp, Homo sapiens
ccacccatgtgactacctcatg

SEQ ID NO: 8215717 - DNA, 18 bp, Homo sapiens
ccacccatctctgccttt

SEQ ID NO: 8215718 - DNA, 18 bp, Homo sapiens
ccacccagggggagagga

SEQ ID NO: 8215719 - DNA, 18 bp, Homo sapiens
ccacccagggggagagga

SEQ ID NO: 8215720 - DNA, 22 bp, Homo sapiens
tcctgtggtctggaaggaatgg

SEQ ID NO: 8215721 - DNA, 22 bp, Homo sapiens
tcctgtggtcattcttctgccc

SEQ ID NO: 8215722 - DNA, 22 bp, Homo sapiens
tcctgtggtcattcttctgccc

SEQ ID NO: 8215723 - DNA, 22 bp, Homo sapiens
tcctgtgtctcagcgtgaagca

SEQ ID NO: 8215724 - DNA, 22 bp, Homo sapiens
tcctgtgtaaatagatctggtt

SEQ ID NO: 8215725 - DNA, 20 bp, Homo sapiens
tcctgtgtgtctcatcaacc

SEQ ID NO: 8215726 - DNA, 22 bp, Homo sapiens
tcctgtgtgtggcctttcccag

SEQ ID NO: 8215727 - DNA, 22 bp, Homo sapiens
tcctgtgttaaagggggtgcta

SEQ ID NO: 8215728 - DNA, 22 bp, Homo sapiens
ccaccctgagccgcaagagcag

SEQ ID NO: 8215729 - DNA, 22 bp, Homo sapiens
ccaccctggacaggcctctgag

SEQ ID NO: 8215730 - DNA, 22 bp, Homo sapiens
ccaccctggacaggcctctgag

SEQ ID NO: 8215731 - DNA, 22 bp, Homo sapiens
tcctgtggtcattcttctgccc

SEQ ID NO: 8215732 - DNA, 22 bp, Homo sapiens
tcctgtggtcattcttctgccc

SEQ ID NO: 8215733 - DNA, 21 bp, Homo sapiens
tctataactatagtgacagat

SEQ ID NO: 8215734 - DNA, 21 bp, Homo sapiens
tctataactatagtgacagat

SEQ ID NO: 8215735 - DNA, 22 bp, Homo sapiens
tctataaattatgcagtctcag

SEQ ID NO: 8215736 - DNA, 22 bp, Homo sapiens
tctataaattatgcagtctcag

SEQ ID NO: 8215737 - DNA, 22 bp, Homo sapiens
tctataaattatgcagtctcag

SEQ ID NO: 8215738 - DNA, 22 bp, Homo sapiens
tctatacaagtttcactttgac

SEQ ID NO: 8215739 - DNA, 22 bp, Homo sapiens
tctataatcctatttcaactgc

SEQ ID NO: 8215740 - DNA, 22 bp, Homo sapiens
tctataaatgcagatatgtgtg

SEQ ID NO: 8215741 - DNA, 22 bp, Homo sapiens
tctataaatgcagatatgtgtg

SEQ ID NO: 8215742 - DNA, 21 bp, Homo sapiens
tctagaatcctgtataagact

SEQ ID NO: 8215743 - DNA, 22 bp, Homo sapiens
tctagaatgacatgcaagagta

SEQ ID NO: 8215744 - DNA, 22 bp, Homo sapiens
tctcaggaaataggatttgagt

SEQ ID NO: 8215745 - DNA, 22 bp, Homo sapiens
tctcagcttgagtggatgagct

SEQ ID NO: 8215746 - DNA, 22 bp, Homo sapiens
tctcagcttgagtggatgagct

SEQ ID NO: 8215747 - DNA, 22 bp, Homo sapiens
tctcagagacctgaactccctg

SEQ ID NO: 8215748 - DNA, 22 bp, Homo sapiens
tctcagagaagtgatgagcaat

SEQ ID NO: 8215749 - DNA, 22 bp, Homo sapiens
tctatacatgtgcacacacatc

SEQ ID NO: 8215750 - DNA, 22 bp, Homo sapiens
tctatagacttggacatatagt

SEQ ID NO: 8215751 - DNA, 23 bp, Homo sapiens
tctatacatactgcagcctctgg

SEQ ID NO: 8215752 - DNA, 22 bp, Homo sapiens
tctatacacacaaagaatgctt

SEQ ID NO: 8215753 - DNA, 22 bp, Homo sapiens
tctatacatgtgcacacacatc

SEQ ID NO: 8215754 - DNA, 22 bp, Homo sapiens
tctatacatgtgcacacacatc

SEQ ID NO: 8215755 - DNA, 22 bp, Homo sapiens
ccagagaggccttggcaagaca

SEQ ID NO: 8215756 - DNA, 22 bp, Homo sapiens
ccagagaggccttggcaagaca

SEQ ID NO: 8215757 - DNA, 23 bp, Homo sapiens
tctcagttccagaggctacaagt

SEQ ID NO: 8215758 - DNA, 22 bp, Homo sapiens
tctcagtgtttaaaaagatttc

SEQ ID NO: 8215759 - DNA, 22 bp, Homo sapiens
tctcagtgtgttttctctcaga

SEQ ID NO: 8215760 - DNA, 22 bp, Homo sapiens
tctcagtgggaagggcacagtt

SEQ ID NO: 8215761 - DNA, 22 bp, Homo sapiens
tctcagtgggttaaaagagaag

SEQ ID NO: 8215762 - DNA, 22 bp, Homo sapiens
tctcagtggtgttttgagtcca

SEQ ID NO: 8215763 - DNA, 22 bp, Homo sapiens
tctcagtgtgttgagaggtctg

SEQ ID NO: 8215764 - DNA, 22 bp, Homo sapiens
tctcaggcattcccacatagaa

SEQ ID NO: 8215765 - DNA, 22 bp, Homo sapiens
tctcaggcccactgtgttgaaa

SEQ ID NO: 8215766 - DNA, 22 bp, Homo sapiens
tctcagtggatctcagaatttt

SEQ ID NO: 8215767 - DNA, 20 bp, Homo sapiens
tctcaggccccagttttctt

SEQ ID NO: 8215768 - DNA, 22 bp, Homo sapiens
tctcaggcatggtttgttcatc

SEQ ID NO: 8215769 - DNA, 22 bp, Homo sapiens
tctcaggcatctgtgtggcaca

SEQ ID NO: 8215770 - DNA, 17 bp, Homo sapiens
tctcaggcacgtgtggc

SEQ ID NO: 8215771 - DNA, 22 bp, Homo sapiens
tctcaggcactgggtgccaact

SEQ ID NO: 8215772 - DNA, 22 bp, Homo sapiens
tctcaggactcctctggccata

SEQ ID NO: 8215773 - DNA, 22 bp, Homo sapiens
tctcaggagccacagcgggagt

SEQ ID NO: 8215774 - DNA, 23 bp, Homo sapiens
tctcaggcaaaccaggacaagtt

SEQ ID NO: 8215775 - DNA, 23 bp, Homo sapiens
tctcaggcaaaccaggacaagtt

SEQ ID NO: 8215776 - DNA, 22 bp, Homo sapiens
tctcaggatctaatacatggta

SEQ ID NO: 8215777 - DNA, 22 bp, Homo sapiens
ccagagcccagcacacggtgct

SEQ ID NO: 8215778 - DNA, 22 bp, Homo sapiens
ccagagcccagcacacggtgct

SEQ ID NO: 8215779 - DNA, 22 bp, Homo sapiens
ccagagcccagggtcatgcagg

SEQ ID NO: 8215780 - DNA, 22 bp, Homo sapiens
ccagagcatgaagggcaatgac

SEQ ID NO: 8215781 - DNA, 22 bp, Homo sapiens
ccagagcatgaagggcaatgac

SEQ ID NO: 8215782 - DNA, 22 bp, Homo sapiens
ccagagccagagaggtgcctgc

SEQ ID NO: 8215783 - DNA, 22 bp, Homo sapiens
ccagagcatgaagggcaatgac

SEQ ID NO: 8215784 - DNA, 22 bp, Homo sapiens
ccagagcatgaagggcaatgac

SEQ ID NO: 8215785 - DNA, 22 bp, Homo sapiens
ccagagcagggcagcagggctc

SEQ ID NO: 8215786 - DNA, 20 bp, Homo sapiens
ccagagcagccactgaagtt

SEQ ID NO: 8215787 - DNA, 20 bp, Homo sapiens
ccagagcagccactgaagtt

SEQ ID NO: 8215788 - DNA, 20 bp, Homo sapiens
ccagagcagccactgaagtt

SEQ ID NO: 8215789 - DNA, 20 bp, Homo sapiens
ccagagcagccactgaagtt

SEQ ID NO: 8215790 - DNA, 20 bp, Homo sapiens
ccagagcagccactgaagtt

SEQ ID NO: 8215791 - DNA, 22 bp, Homo sapiens
ccagagcagggcagcagggctc

SEQ ID NO: 8215792 - DNA, 22 bp, Homo sapiens
ccagagcagggcagcagggctc

SEQ ID NO: 8215793 - DNA, 22 bp, Homo sapiens
ccagagcagggcagcagggctc

SEQ ID NO: 8215794 - DNA, 22 bp, Homo sapiens
ccagagccggctccctcagctt

SEQ ID NO: 8215795 - DNA, 22 bp, Homo sapiens
ccagagccggctccctcagctt

SEQ ID NO: 8215796 - DNA, 22 bp, Homo sapiens
ccagagcccgggacctggactt

SEQ ID NO: 8215797 - DNA, 22 bp, Homo sapiens
ccagagccggctccctcagctt

SEQ ID NO: 8215798 - DNA, 22 bp, Homo sapiens
ccagagccggattgtgaagtgc

SEQ ID NO: 8215799 - DNA, 19 bp, Homo sapiens
ccagagcccgccagatggg

SEQ ID NO: 8215800 - DNA, 19 bp, Homo sapiens
ccagagcccgccagatggg

SEQ ID NO: 8215801 - DNA, 19 bp, Homo sapiens
ccagagcccgccagatggg

SEQ ID NO: 8215802 - DNA, 19 bp, Homo sapiens
ccagagcccgccagatggg

SEQ ID NO: 8215803 - DNA, 19 bp, Homo sapiens
ccagagcccgccagatggg

SEQ ID NO: 8215804 - DNA, 22 bp, Homo sapiens
ccagagcccagggtcatgcagg

SEQ ID NO: 8215805 - DNA, 22 bp, Homo sapiens
ccagagcccctgagcttccctg

SEQ ID NO: 8215806 - DNA, 22 bp, Homo sapiens
ccagagcccctgagcttccctg

SEQ ID NO: 8215807 - DNA, 22 bp, Homo sapiens
ccagagggaagaggaagcgctg

SEQ ID NO: 8215808 - DNA, 22 bp, Homo sapiens
ccagagggaactgggcctcatt

SEQ ID NO: 8215809 - DNA, 22 bp, Homo sapiens
ccagagggagccaccagggtgt

SEQ ID NO: 8215810 - DNA, 22 bp, Homo sapiens
ccagagggagccaccagggtgt

SEQ ID NO: 8215811 - DNA, 22 bp, Homo sapiens
ccagagggaagaggaagcgctg

SEQ ID NO: 8215812 - DNA, 22 bp, Homo sapiens
ccagaggctggcagccagctga

SEQ ID NO: 8215813 - DNA, 22 bp, Homo sapiens
ccagaggctgggttcacctcag

SEQ ID NO: 8215814 - DNA, 22 bp, Homo sapiens
ccagaggctggcagccagctga

SEQ ID NO: 8215815 - DNA, 22 bp, Homo sapiens
ccagaggatcagtactggctgg

SEQ ID NO: 8215816 - DNA, 22 bp, Homo sapiens
ccagaggatcagtactggctgg

SEQ ID NO: 8215817 - DNA, 21 bp, Homo sapiens
ccagagcctgagaggattatg

SEQ ID NO: 8215818 - DNA, 22 bp, Homo sapiens
ccagagcctcgcccggagcctc

SEQ ID NO: 8215819 - DNA, 22 bp, Homo sapiens
ccagagcctcgcccggagcctc

SEQ ID NO: 8215820 - DNA, 22 bp, Homo sapiens
ccagagcctcttatgaagatcg

SEQ ID NO: 8215821 - DNA, 22 bp, Homo sapiens
ccagagcctcttatgaagatcg

SEQ ID NO: 8215822 - DNA, 22 bp, Homo sapiens
ccagagcctcgcccggagcctc

SEQ ID NO: 8215823 - DNA, 22 bp, Homo sapiens
ccagagcctcaacacaggtcct

SEQ ID NO: 8215824 - DNA, 22 bp, Homo sapiens
ccagagcctcaacacaggtcct

SEQ ID NO: 8215825 - DNA, 22 bp, Homo sapiens
ccagagcctcaacacaggtcct

SEQ ID NO: 8215826 - DNA, 22 bp, Homo sapiens
ccagagcctcaacacaggtcct

SEQ ID NO: 8215827 - DNA, 22 bp, Homo sapiens
ccagagcctaagatctgatcct

SEQ ID NO: 8215828 - DNA, 22 bp, Homo sapiens
tctctgtcacacaatctacaca

SEQ ID NO: 8215829 - DNA, 22 bp, Homo sapiens
tctctgtattctgatattcact

SEQ ID NO: 8215830 - DNA, 22 bp, Homo sapiens
tctctgtagttgggcagctgct

SEQ ID NO: 8215831 - DNA, 22 bp, Homo sapiens
tctctgtagggctgcttgagta

SEQ ID NO: 8215832 - DNA, 22 bp, Homo sapiens
tctctgtagggctgcttgagta

SEQ ID NO: 8215833 - DNA, 22 bp, Homo sapiens
tctctgtaaaatgtggatgata

SEQ ID NO: 8215834 - DNA, 22 bp, Homo sapiens
tctctgggataaactgggccag

SEQ ID NO: 8215835 - DNA, 23 bp, Homo sapiens
tctctgtacagatgaggacacac

SEQ ID NO: 8215836 - DNA, 22 bp, Homo sapiens
tctctgtagagacagcactgtg

SEQ ID NO: 8215837 - DNA, 22 bp, Homo sapiens
tctctgtaaggaagaattagat

SEQ ID NO: 8215838 - DNA, 22 bp, Homo sapiens
tctctgtaaggaagaattagat

SEQ ID NO: 8215839 - DNA, 22 bp, Homo sapiens
ccagatgtccctctcaggtttg

SEQ ID NO: 8215840 - DNA, 22 bp, Homo sapiens
ccagatgtccctctcaggtttg

SEQ ID NO: 8215841 - DNA, 22 bp, Homo sapiens
ccagatgtccctctcaggtttg

SEQ ID NO: 8215842 - DNA, 22 bp, Homo sapiens
ccagatgtccctctcaggtttg

SEQ ID NO: 8215843 - DNA, 22 bp, Homo sapiens
ccagatttgagcgtcttaaacc

SEQ ID NO: 8215844 - DNA, 22 bp, Homo sapiens
ccagattcatagaaactcatag

SEQ ID NO: 8215845 - DNA, 22 bp, Homo sapiens
ccagatttgagcgtcttaaacc

SEQ ID NO: 8215846 - DNA, 22 bp, Homo sapiens
ccagattcagatatggcagtgg

SEQ ID NO: 8215847 - DNA, 20 bp, Homo sapiens
ccagcaccctctcagctgaa

SEQ ID NO: 8215848 - DNA, 20 bp, Homo sapiens
ccagcaccctctcagctgaa

SEQ ID NO: 8215849 - DNA, 22 bp, Homo sapiens
ccagcaccttgatcttggagtt

SEQ ID NO: 8215850 - DNA, 20 bp, Homo sapiens
ccagcaccctctcagctgaa

SEQ ID NO: 8215851 - DNA, 22 bp, Homo sapiens
ccagcaagtgcagatggccaag

SEQ ID NO: 8215852 - DNA, 22 bp, Homo sapiens
ccagcaagccaggtctgtggct

SEQ ID NO: 8215853 - DNA, 22 bp, Homo sapiens
ccagaggggctgagcaggtcac

SEQ ID NO: 8215854 - DNA, 20 bp, Homo sapiens
ccagagggtagggccgcccc

SEQ ID NO: 8215855 - DNA, 20 bp, Homo sapiens
ccagagggtagggccgcccc

SEQ ID NO: 8215856 - DNA, 22 bp, Homo sapiens
ccagagggcaaaatgaagctta

SEQ ID NO: 8215857 - DNA, 22 bp, Homo sapiens
ccagagggccctggtctcagct

SEQ ID NO: 8215858 - DNA, 22 bp, Homo sapiens
ccagaggtctcctgcacgggat

SEQ ID NO: 8215859 - DNA, 22 bp, Homo sapiens
ccagaggtctcctgcacgggat

SEQ ID NO: 8215860 - DNA, 22 bp, Homo sapiens
tctctgggataaactgggccag

SEQ ID NO: 8215861 - DNA, 18 bp, Homo sapiens
ccagagggtgcgtcagct

SEQ ID NO: 8215862 - DNA, 18 bp, Homo sapiens
ccagagggtgcgtcagct

SEQ ID NO: 8215863 - DNA, 18 bp, Homo sapiens
ccagagggtgcgtcagct

SEQ ID NO: 8215864 - DNA, 18 bp, Homo sapiens
ccagagggtgcgtcagct

SEQ ID NO: 8215865 - DNA, 22 bp, Homo sapiens
ccagaggtcctgctcactggtg

SEQ ID NO: 8215866 - DNA, 22 bp, Homo sapiens
ccaacacagatgtgttagtgtt

SEQ ID NO: 8215867 - DNA, 22 bp, Homo sapiens
ccaacaacatagggctagttgg

SEQ ID NO: 8215868 - DNA, 22 bp, Homo sapiens
tcctgaggtggattgagcagag

SEQ ID NO: 8215869 - DNA, 22 bp, Homo sapiens
tcctgaggtggattgagcagag

SEQ ID NO: 8215870 - DNA, 22 bp, Homo sapiens
tcctgaggtggattgagcagag

SEQ ID NO: 8215871 - DNA, 22 bp, Homo sapiens
tcctgaggtgctcagccaggaa

SEQ ID NO: 8215872 - DNA, 22 bp, Homo sapiens
tcctgaggtgctcagccaggaa

SEQ ID NO: 8215873 - DNA, 22 bp, Homo sapiens
tcctgaggtgctcagccaggaa

SEQ ID NO: 8215874 - DNA, 22 bp, Homo sapiens
tcctgaggtgctcagccaggaa

SEQ ID NO: 8215875 - DNA, 22 bp, Homo sapiens
tcctgaggtgctcagccaggaa

SEQ ID NO: 8215876 - DNA, 22 bp, Homo sapiens
tcctgaggtatatgctttgcag

SEQ ID NO: 8215877 - DNA, 22 bp, Homo sapiens
tcctgagggctgcagtcatagg

SEQ ID NO: 8215878 - DNA, 23 bp, Homo sapiens
tcctgagggtttcccagccttgg

SEQ ID NO: 8215879 - DNA, 23 bp, Homo sapiens
ccaagactgttaggagtggggag

SEQ ID NO: 8215880 - DNA, 22 bp, Homo sapiens
ccaacaggttgagagtctgaat

SEQ ID NO: 8215881 - DNA, 19 bp, Homo sapiens
ccaacagtactgaagcact

SEQ ID NO: 8215882 - DNA, 22 bp, Homo sapiens
ccaacagtccagatgagatggt

SEQ ID NO: 8215883 - DNA, 22 bp, Homo sapiens
ccaacagtccagatgagatggt

SEQ ID NO: 8215884 - DNA, 22 bp, Homo sapiens
ccaagaggaccttgccagggca

SEQ ID NO: 8215885 - DNA, 22 bp, Homo sapiens
ccaagagcctcagctgccgtgc

SEQ ID NO: 8215886 - DNA, 21 bp, Homo sapiens
ccaagagcaatgctaaggaga

SEQ ID NO: 8215887 - DNA, 23 bp, Homo sapiens
ccaagactgttaggagtggggag

SEQ ID NO: 8215888 - DNA, 23 bp, Homo sapiens
ccaagactgttaggagtggggag

SEQ ID NO: 8215889 - DNA, 22 bp, Homo sapiens
tcctgccttcatactgctgtat

SEQ ID NO: 8215890 - DNA, 22 bp, Homo sapiens
tcctgccttcatactgctgtat

SEQ ID NO: 8215891 - DNA, 22 bp, Homo sapiens
tcctgccttcatactgctgtat

SEQ ID NO: 8215892 - DNA, 22 bp, Homo sapiens
tcctgccttgcctgggacatca

SEQ ID NO: 8215893 - DNA, 22 bp, Homo sapiens
tcctgccttgcctgggacatca

SEQ ID NO: 8215894 - DNA, 22 bp, Homo sapiens
tcctgccttgcctgggacatca

SEQ ID NO: 8215895 - DNA, 22 bp, Homo sapiens
tcctgccttgcctgggacatca

SEQ ID NO: 8215896 - DNA, 22 bp, Homo sapiens
tcctgctctgatgggttctcct

SEQ ID NO: 8215897 - DNA, 22 bp, Homo sapiens
tcctgctccaccgtgggctgga

SEQ ID NO: 8215898 - DNA, 22 bp, Homo sapiens
tcctgctccaccgtgggctgga

SEQ ID NO: 8215899 - DNA, 22 bp, Homo sapiens
tcctggagccaggacccttccc

SEQ ID NO: 8215900 - DNA, 22 bp, Homo sapiens
tcctggagccaggacccttccc

SEQ ID NO: 8215901 - DNA, 22 bp, Homo sapiens
tcctggagccacggagctttca

SEQ ID NO: 8215902 - DNA, 22 bp, Homo sapiens
tcctggagccacggagctttca

SEQ ID NO: 8215903 - DNA, 22 bp, Homo sapiens
tcctggagccaggacccttccc

SEQ ID NO: 8215904 - DNA, 22 bp, Homo sapiens
tcctggagccaggacccttccc

SEQ ID NO: 8215905 - DNA, 22 bp, Homo sapiens
tcctggagccatgattcccctc

SEQ ID NO: 8215906 - DNA, 22 bp, Homo sapiens
tcctggagccatgattcccctc

SEQ ID NO: 8215907 - DNA, 21 bp, Homo sapiens
tcctgccttagtccagagcag

SEQ ID NO: 8215908 - DNA, 22 bp, Homo sapiens
tcctgccttcatactgctgtat

SEQ ID NO: 8215909 - DNA, 21 bp, Homo sapiens
tcctgccttagtccagagcag

SEQ ID NO: 8215910 - DNA, 21 bp, Homo sapiens
tcctgccttagtccagagcag

SEQ ID NO: 8215911 - DNA, 21 bp, Homo sapiens
tcctgccttagtccagagcag

SEQ ID NO: 8215912 - DNA, 22 bp, Homo sapiens
tcctgccttagagcaaggaaaa

SEQ ID NO: 8215913 - DNA, 22 bp, Homo sapiens
tcctgccttagagcaaggaaaa

SEQ ID NO: 8215914 - DNA, 22 bp, Homo sapiens
tcctgccttagagcaaggaaaa

SEQ ID NO: 8215915 - DNA, 22 bp, Homo sapiens
ccaagaggggaagggccgcagc

SEQ ID NO: 8215916 - DNA, 22 bp, Homo sapiens
ccaagagggttgccctgagcgt

SEQ ID NO: 8215917 - DNA, 22 bp, Homo sapiens
ccaagaggtaatacgagatatc

SEQ ID NO: 8215918 - DNA, 22 bp, Homo sapiens
ccaagaggtatcttgccataaa

SEQ ID NO: 8215919 - DNA, 19 bp, Homo sapiens
tcctgcccaccagccaggg

SEQ ID NO: 8215920 - DNA, 16 bp, Homo sapiens
ccacagggcaaggggc

SEQ ID NO: 8215921 - DNA, 22 bp, Homo sapiens
ccacagggcacagacaggaagc

SEQ ID NO: 8215922 - DNA, 22 bp, Homo sapiens
ccacagggcctttcctgctggc

SEQ ID NO: 8215923 - DNA, 22 bp, Homo sapiens
ccacagggactgttaaaaccct

SEQ ID NO: 8215924 - DNA, 22 bp, Homo sapiens
ccacagggaacatgacagcctt

SEQ ID NO: 8215925 - DNA, 22 bp, Homo sapiens
ccacaggctgctgcaggtcccg

SEQ ID NO: 8215926 - DNA, 22 bp, Homo sapiens
ccacaggctgctgcaggtcccg

SEQ ID NO: 8215927 - DNA, 22 bp, Homo sapiens
ccacaggctgctgcaggtcccg

SEQ ID NO: 8215928 - DNA, 22 bp, Homo sapiens
ccacagctgaccgcaggtgagc

SEQ ID NO: 8215929 - DNA, 22 bp, Homo sapiens
ccacagctgaccgcaggtgagc

SEQ ID NO: 8215930 - DNA, 22 bp, Homo sapiens
tcctggagcttccttcatggta

SEQ ID NO: 8215931 - DNA, 22 bp, Homo sapiens
tcctggagcttccttcatggta

SEQ ID NO: 8215932 - DNA, 22 bp, Homo sapiens
tcctggagcttccttcatggta

SEQ ID NO: 8215933 - DNA, 22 bp, Homo sapiens
tcctggagcttccttcatggta

SEQ ID NO: 8215934 - DNA, 22 bp, Homo sapiens
tcctggaggacagaggcatctc

SEQ ID NO: 8215935 - DNA, 22 bp, Homo sapiens
tcctggaggaataagttttcca

SEQ ID NO: 8215936 - DNA, 22 bp, Homo sapiens
tcctggaggaataagttttcca

SEQ ID NO: 8215937 - DNA, 22 bp, Homo sapiens
tcctggagcttccttcatggta

SEQ ID NO: 8215938 - DNA, 22 bp, Homo sapiens
tcctggagctggtgtctttccc

SEQ ID NO: 8215939 - DNA, 22 bp, Homo sapiens
tcctggagctggtgtctttccc

SEQ ID NO: 8215940 - DNA, 22 bp, Homo sapiens
tcctggagcttcagtttccttt

SEQ ID NO: 8215941 - DNA, 22 bp, Homo sapiens
tcctggagcttcagtttccttt

SEQ ID NO: 8215942 - DNA, 22 bp, Homo sapiens
tcctggagcttcagtttccttt

SEQ ID NO: 8215943 - DNA, 22 bp, Homo sapiens
tcctggagctgactccgtttga

SEQ ID NO: 8215944 - DNA, 22 bp, Homo sapiens
tcctggagctgactccgtttga

SEQ ID NO: 8215945 - DNA, 22 bp, Homo sapiens
tcctggagcctcattcaaacac

SEQ ID NO: 8215946 - DNA, 22 bp, Homo sapiens
tcctggagcctcattcaaacac

SEQ ID NO: 8215947 - DNA, 20 bp, Homo sapiens
tcctggagctgcttgaattc

SEQ ID NO: 8215948 - DNA, 20 bp, Homo sapiens
tcctggagctgcttgaattc

SEQ ID NO: 8215949 - DNA, 20 bp, Homo sapiens
tcctggagctgcttgaattc

SEQ ID NO: 8215950 - DNA, 22 bp, Homo sapiens
tcctggagctgactccgtttga

SEQ ID NO: 8215951 - DNA, 22 bp, Homo sapiens
tcctggccttgctcctgatgcc

SEQ ID NO: 8215952 - DNA, 22 bp, Homo sapiens
tcctggccttgctcctgatgcc

SEQ ID NO: 8215953 - DNA, 22 bp, Homo sapiens
tcctggccttgcgtcttgggag

SEQ ID NO: 8215954 - DNA, 22 bp, Homo sapiens
tcctggccttgcgtcttgggag

SEQ ID NO: 8215955 - DNA, 22 bp, Homo sapiens
tcctggctaacacggtgacacc

SEQ ID NO: 8215956 - DNA, 22 bp, Homo sapiens
tcctggctaacacggtgacacc

SEQ ID NO: 8215957 - DNA, 22 bp, Homo sapiens
ccaccaggacagccctgagggg

SEQ ID NO: 8215958 - DNA, 22 bp, Homo sapiens
tcctggctccactgagcaggcc

SEQ ID NO: 8215959 - DNA, 22 bp, Homo sapiens
tcctggctccactgagcaggcc

SEQ ID NO: 8215960 - DNA, 22 bp, Homo sapiens
ccacagggcctttcctgctggc

SEQ ID NO: 8215961 - DNA, 22 bp, Homo sapiens
ccacagggctctaggcgcttcc

SEQ ID NO: 8215962 - DNA, 22 bp, Homo sapiens
ccacaggggcccacgagccgct

SEQ ID NO: 8215963 - DNA, 21 bp, Homo sapiens
ccacaggggctcccctgtcag

SEQ ID NO: 8215964 - DNA, 22 bp, Homo sapiens
ccacaggggtctctgtagctga

SEQ ID NO: 8215965 - DNA, 21 bp, Homo sapiens
ccacaggggctcccctgtcag

SEQ ID NO: 8215966 - DNA, 22 bp, Homo sapiens
ccacaggggtctctgtagctga

SEQ ID NO: 8215967 - DNA, 17 bp, Homo sapiens
tcctggcctggtgtgtg

SEQ ID NO: 8215968 - DNA, 22 bp, Homo sapiens
tcctggccttagcgaggcggtc

SEQ ID NO: 8215969 - DNA, 22 bp, Homo sapiens
tcctggcctgtctggagtagct

SEQ ID NO: 8215970 - DNA, 20 bp, Homo sapiens
tcctggccttctcgggcagt

SEQ ID NO: 8215971 - DNA, 20 bp, Homo sapiens
tcctggccttctcgggcagt

SEQ ID NO: 8215972 - DNA, 20 bp, Homo sapiens
tcctggccttctcgggcagt

SEQ ID NO: 8215973 - DNA, 22 bp, Homo sapiens
tccataaaccagaaaatcaaga

SEQ ID NO: 8215974 - DNA, 22 bp, Homo sapiens
tccataaaccagaaaatcaaga

SEQ ID NO: 8215975 - DNA, 22 bp, Homo sapiens
tccataaatgaaatagaacgct

SEQ ID NO: 8215976 - DNA, 22 bp, Homo sapiens
tccataaattttatgaacatat

SEQ ID NO: 8215977 - DNA, 22 bp, Homo sapiens
tccataaattttatgaacatat

SEQ ID NO: 8215978 - DNA, 21 bp, Homo sapiens
tccataagagaccatctccta

SEQ ID NO: 8215979 - DNA, 22 bp, Homo sapiens
tccatacacattgaattttagt

SEQ ID NO: 8215980 - DNA, 22 bp, Homo sapiens
tccataaaccagaaaatcaaga

SEQ ID NO: 8215981 - DNA, 19 bp, Homo sapiens
tccagtttggcaggaagac

SEQ ID NO: 8215982 - DNA, 22 bp, Homo sapiens
catttcacgcacactcattact

SEQ ID NO: 8215983 - DNA, 22 bp, Homo sapiens
catttcacgcacactcattact

SEQ ID NO: 8215984 - DNA, 22 bp, Homo sapiens
catttattgagtggccacagtg

SEQ ID NO: 8215985 - DNA, 22 bp, Homo sapiens
catttattggcatgtagtaggt

SEQ ID NO: 8215986 - DNA, 22 bp, Homo sapiens
catttattggcatgtagtaggt

SEQ ID NO: 8215987 - DNA, 22 bp, Homo sapiens
catttattggcatgtagtaggt

SEQ ID NO: 8215988 - DNA, 22 bp, Homo sapiens
tccatatacaacttaatcttta

SEQ ID NO: 8215989 - DNA, 22 bp, Homo sapiens
tccatagtgaatgggtaatgca

SEQ ID NO: 8215990 - DNA, 22 bp, Homo sapiens
tccatagtagaaaatgggacag

SEQ ID NO: 8215991 - DNA, 22 bp, Homo sapiens
tccatagtagaaaatgggacag

SEQ ID NO: 8215992 - DNA, 22 bp, Homo sapiens
tccatacccagctttctcacac

SEQ ID NO: 8215993 - DNA, 21 bp, Homo sapiens
catttcatgattatagaaatg

SEQ ID NO: 8215994 - DNA, 22 bp, Homo sapiens
catttcatagttgtcacaataa

SEQ ID NO: 8215995 - DNA, 21 bp, Homo sapiens
catttcagtaaggaagcctgt

SEQ ID NO: 8215996 - DNA, 21 bp, Homo sapiens
catttcatgattatagaaatg

SEQ ID NO: 8215997 - DNA, 21 bp, Homo sapiens
catttcatgattatagaaatg

SEQ ID NO: 8215998 - DNA, 22 bp, Homo sapiens
catttcattcctttgaaagtgg

SEQ ID NO: 8215999 - DNA, 22 bp, Homo sapiens
catttcattcctttgaaagtgg

SEQ ID NO: 8216000 - DNA, 21 bp, Homo sapiens
catttcatgattatagaaatg

SEQ ID NO: 8216001 - DNA, 22 bp, Homo sapiens
catttcattcctttgaaagtgg

SEQ ID NO: 8216002 - DNA, 22 bp, Homo sapiens
catttcattcctttgaaagtgg

SEQ ID NO: 8216003 - DNA, 22 bp, Homo sapiens
catttcctgtctggaggtcaaa

SEQ ID NO: 8216004 - DNA, 22 bp, Homo sapiens
catttcctgtctggaggtcaaa

SEQ ID NO: 8216005 - DNA, 22 bp, Homo sapiens
catttccttcctgctgctcctc

SEQ ID NO: 8216006 - DNA, 22 bp, Homo sapiens
catttccttcctgctgctcctc

SEQ ID NO: 8216007 - DNA, 22 bp, Homo sapiens
catttccacttctgaaaactgg

SEQ ID NO: 8216008 - DNA, 22 bp, Homo sapiens
catttccactctgggagtcaga

SEQ ID NO: 8216009 - DNA, 22 bp, Homo sapiens
catttccacttctgaaaactgg

SEQ ID NO: 8216010 - DNA, 22 bp, Homo sapiens
catttccacttctgaaaactgg

SEQ ID NO: 8216011 - DNA, 22 bp, Homo sapiens
catttccagctcctgcatcatg

SEQ ID NO: 8216012 - DNA, 22 bp, Homo sapiens
catttccccctcatgttgcagc

SEQ ID NO: 8216013 - DNA, 22 bp, Homo sapiens
catttccagctcctgcatcatg

SEQ ID NO: 8216014 - DNA, 22 bp, Homo sapiens
catttctacagcttcttcagaa

SEQ ID NO: 8216015 - DNA, 22 bp, Homo sapiens
catttctaccaaatgtgactgg

SEQ ID NO: 8216016 - DNA, 22 bp, Homo sapiens
catttctaagaaggctgcacat

SEQ ID NO: 8216017 - DNA, 21 bp, Homo sapiens
catttctaagcctggctatag

SEQ ID NO: 8216018 - DNA, 22 bp, Homo sapiens
catttctagggatcataaagta

SEQ ID NO: 8216019 - DNA, 22 bp, Homo sapiens
catttctaccaaatgtgactgg

SEQ ID NO: 8216020 - DNA, 22 bp, Homo sapiens
cattttcatgagtttctgttca

SEQ ID NO: 8216021 - DNA, 22 bp, Homo sapiens
cattttcatgagtttctgttca

SEQ ID NO: 8216022 - DNA, 22 bp, Homo sapiens
cattttcatgagtttctgttca

SEQ ID NO: 8216023 - DNA, 19 bp, Homo sapiens
cattttcccatcatccttt

SEQ ID NO: 8216024 - DNA, 22 bp, Homo sapiens
cattttgtagcaatgactgttg

SEQ ID NO: 8216025 - DNA, 22 bp, Homo sapiens
cattttgtaagtctctcttgtt

SEQ ID NO: 8216026 - DNA, 22 bp, Homo sapiens
cattttgtagcaatgactgttg

SEQ ID NO: 8216027 - DNA, 22 bp, Homo sapiens
cattttgtagcaatgactgttg

SEQ ID NO: 8216028 - DNA, 22 bp, Homo sapiens
cattttgtgcacacgtggagtt

SEQ ID NO: 8216029 - DNA, 22 bp, Homo sapiens
cattttgtgctagacactatgg

SEQ ID NO: 8216030 - DNA, 22 bp, Homo sapiens
ccaaaaattagatacacatata

SEQ ID NO: 8216031 - DNA, 22 bp, Homo sapiens
tcctgagaaggcacagcttgca

SEQ ID NO: 8216032 - DNA, 20 bp, Homo sapiens
tcctgaggcttcgccagtgt

SEQ ID NO: 8216033 - DNA, 22 bp, Homo sapiens
tcctgaggctcactttgaatgt

SEQ ID NO: 8216034 - DNA, 22 bp, Homo sapiens
ccaaaaattagatacacatata

SEQ ID NO: 8216035 - DNA, 22 bp, Homo sapiens
ccaaaaattagatacacatata

SEQ ID NO: 8216036 - DNA, 22 bp, Homo sapiens
ccaaaaattagatacacatata

SEQ ID NO: 8216037 - DNA, 22 bp, Homo sapiens
tcctgacttaactactctctgg

SEQ ID NO: 8216038 - DNA, 22 bp, Homo sapiens
ccaaaaagctcagagatatgtt

SEQ ID NO: 8216039 - DNA, 22 bp, Homo sapiens
tcctgagggcgattcagcaggt

SEQ ID NO: 8216040 - DNA, 22 bp, Homo sapiens
tcctgagggcgattcagcaggt

SEQ ID NO: 8216041 - DNA, 22 bp, Homo sapiens
tcctgagggcgattcagcaggt

SEQ ID NO: 8216042 - DNA, 22 bp, Homo sapiens
tcctgagggcgattcagcaggt

SEQ ID NO: 8216043 - DNA, 22 bp, Homo sapiens
tcctgagggcgattcagcaggt

SEQ ID NO: 8216044 - DNA, 22 bp, Homo sapiens
cattttatgtttatggagtgct

SEQ ID NO: 8216045 - DNA, 22 bp, Homo sapiens
cattttatcctctgggaagcta

SEQ ID NO: 8216046 - DNA, 22 bp, Homo sapiens
cattttatcctctgggaagcta

SEQ ID NO: 8216047 - DNA, 22 bp, Homo sapiens
cattttactgactcttgaatta

SEQ ID NO: 8216048 - DNA, 22 bp, Homo sapiens
cattttatcctctgggaagcta

SEQ ID NO: 8216049 - DNA, 22 bp, Homo sapiens
cattttactgactcttgaatta

SEQ ID NO: 8216050 - DNA, 19 bp, Homo sapiens
cattttaagcatccccagt

SEQ ID NO: 8216051 - DNA, 22 bp, Homo sapiens
cattttacctagaagctgaaag

SEQ ID NO: 8216052 - DNA, 22 bp, Homo sapiens
cattttcagcacccatctgaaa

SEQ ID NO: 8216053 - DNA, 22 bp, Homo sapiens
cattttcagcacccatctgaaa

SEQ ID NO: 8216054 - DNA, 22 bp, Homo sapiens
cattttcagcacccatctgaaa

SEQ ID NO: 8216055 - DNA, 22 bp, Homo sapiens
cattttcagcacccatctgaaa

SEQ ID NO: 8216056 - DNA, 22 bp, Homo sapiens
cattttcagcacccatctgaaa

SEQ ID NO: 8216057 - DNA, 22 bp, Homo sapiens
cattttcagcacccatctgaaa

SEQ ID NO: 8216058 - DNA, 22 bp, Homo sapiens
cattttatgtttatggagtgct

SEQ ID NO: 8216059 - DNA, 22 bp, Homo sapiens
cattttatgtttatggagtgct

SEQ ID NO: 8216060 - DNA, 22 bp, Homo sapiens
cattttatgtttatggagtgct

SEQ ID NO: 8216061 - DNA, 22 bp, Homo sapiens
cattttatgtttatggagtgct

SEQ ID NO: 8216062 - DNA, 22 bp, Homo sapiens
cattttaagatgacctggtttc

SEQ ID NO: 8216063 - DNA, 22 bp, Homo sapiens
cattttaaatgatttaagccaa

SEQ ID NO: 8216064 - DNA, 22 bp, Homo sapiens
cattttaaatgatttaagccaa

SEQ ID NO: 8216065 - DNA, 19 bp, Homo sapiens
cattttaagcatccccagt

SEQ ID NO: 8216066 - DNA, 22 bp, Homo sapiens
cattttaagatgacctggtttc

SEQ ID NO: 8216067 - DNA, 22 bp, Homo sapiens
catttctagggatcataaagta

SEQ ID NO: 8216068 - DNA, 21 bp, Homo sapiens
catttctattgatgagaaaag

SEQ ID NO: 8216069 - DNA, 21 bp, Homo sapiens
catttctattgatgagaaaag

SEQ ID NO: 8216070 - DNA, 21 bp, Homo sapiens
catttctattgatgagaaaag

SEQ ID NO: 8216071 - DNA, 22 bp, Homo sapiens
catttgtctctaggaagtgagg

SEQ ID NO: 8216072 - DNA, 22 bp, Homo sapiens
tcataattgtatacatttatgg

SEQ ID NO: 8216073 - DNA, 22 bp, Homo sapiens
tcataatgacaaacatactcag

SEQ ID NO: 8216074 - DNA, 22 bp, Homo sapiens
tcatacaaggagggtgttcaaa

SEQ ID NO: 8216075 - DNA, 20 bp, Homo sapiens
tcatacacatgagcatgcag

SEQ ID NO: 8216076 - DNA, 22 bp, Homo sapiens
tcatcaaagtcaaagaatgact

SEQ ID NO: 8216077 - DNA, 20 bp, Homo sapiens
tcatcagataggttagtaca

SEQ ID NO: 8216078 - DNA, 22 bp, Homo sapiens
tcatcagctcatctgctcctag

SEQ ID NO: 8216079 - DNA, 22 bp, Homo sapiens
tcatcagcaccctatgtccttt

SEQ ID NO: 8216080 - DNA, 22 bp, Homo sapiens
tcatcacatatgtcatgatttg

SEQ ID NO: 8216081 - DNA, 22 bp, Homo sapiens
tcatcacatatgtcatgatttg

SEQ ID NO: 8216082 - DNA, 22 bp, Homo sapiens
tcatcacatgtgtagtcatccc

SEQ ID NO: 8216083 - DNA, 22 bp, Homo sapiens
tcatcacatgtgtagtcatccc

SEQ ID NO: 8216084 - DNA, 22 bp, Homo sapiens
tcatcacatgtgtagtcatccc

SEQ ID NO: 8216085 - DNA, 19 bp, Homo sapiens
tcatcacccctcctctcta

SEQ ID NO: 8216086 - DNA, 19 bp, Homo sapiens
tcatcacctaattctctat

SEQ ID NO: 8216087 - DNA, 22 bp, Homo sapiens
catctacctccaccctatatat

SEQ ID NO: 8216088 - DNA, 22 bp, Homo sapiens
catctaatacctcatttaatct

SEQ ID NO: 8216089 - DNA, 22 bp, Homo sapiens
catcgtgtctaggtgtgcagca

SEQ ID NO: 8216090 - DNA, 22 bp, Homo sapiens
catctacaggagaatgtcactg

SEQ ID NO: 8216091 - DNA, 22 bp, Homo sapiens
catctacactgattaggtgaac

SEQ ID NO: 8216092 - DNA, 19 bp, Homo sapiens
tcataaggagagaggaaat

SEQ ID NO: 8216093 - DNA, 19 bp, Homo sapiens
catctatcctcattctctg

SEQ ID NO: 8216094 - DNA, 22 bp, Homo sapiens
tcagtttcacagtctgtgcaga

SEQ ID NO: 8216095 - DNA, 22 bp, Homo sapiens
catccttcaaaggctacaatta

SEQ ID NO: 8216096 - DNA, 22 bp, Homo sapiens
catccttcatacgactgaccct

SEQ ID NO: 8216097 - DNA, 22 bp, Homo sapiens
catcctggttaccccatagtca

SEQ ID NO: 8216098 - DNA, 18 bp, Homo sapiens
catccttatagctgagaa

SEQ ID NO: 8216099 - DNA, 22 bp, Homo sapiens
catctaaatttgactccaagga

SEQ ID NO: 8216100 - DNA, 22 bp, Homo sapiens
catcctgcggggagcagagggc

SEQ ID NO: 8216101 - DNA, 22 bp, Homo sapiens
catccctgtctgccactctgaa

SEQ ID NO: 8216102 - DNA, 19 bp, Homo sapiens
tcagtgtgtgggaggtggt

SEQ ID NO: 8216103 - DNA, 22 bp, Homo sapiens
catccctgtctgccactctgaa

SEQ ID NO: 8216104 - DNA, 19 bp, Homo sapiens
tcagtgtgtgggaggtggt

SEQ ID NO: 8216105 - DNA, 17 bp, Homo sapiens
catccgtgagctcggca

SEQ ID NO: 8216106 - DNA, 22 bp, Homo sapiens
tcagtgtgagtaccatgctcag

SEQ ID NO: 8216107 - DNA, 22 bp, Homo sapiens
tcagtgtgactgatggctttat

SEQ ID NO: 8216108 - DNA, 22 bp, Homo sapiens
tcagtgtgaattcaggagccta

SEQ ID NO: 8216109 - DNA, 22 bp, Homo sapiens
tcagtgtcttgggcttgaatgc

SEQ ID NO: 8216110 - DNA, 22 bp, Homo sapiens
tcagtgtcttgacctgggtgtg

SEQ ID NO: 8216111 - DNA, 22 bp, Homo sapiens
tcagtgtcttgggcttgaatgc

SEQ ID NO: 8216112 - DNA, 22 bp, Homo sapiens
tcagtgtggaaaatcctttggc

SEQ ID NO: 8216113 - DNA, 22 bp, Homo sapiens
tcagtgtgcacatggtagcagt

SEQ ID NO: 8216114 - DNA, 22 bp, Homo sapiens
catcataaaattgagataactg

SEQ ID NO: 8216115 - DNA, 22 bp, Homo sapiens
catcagtttggtcaatgatggg

SEQ ID NO: 8216116 - DNA, 22 bp, Homo sapiens
catcataataacccagacacag

SEQ ID NO: 8216117 - DNA, 22 bp, Homo sapiens
catcatcaaaagtgacagagaa

SEQ ID NO: 8216118 - DNA, 22 bp, Homo sapiens
catcatcaaaacaaatggagtc

SEQ ID NO: 8216119 - DNA, 22 bp, Homo sapiens
catcatcaaaagtgacagagaa

SEQ ID NO: 8216120 - DNA, 22 bp, Homo sapiens
catcatcaaaacaaatggagtc

SEQ ID NO: 8216121 - DNA, 22 bp, Homo sapiens
tcagtgtcttctctttcctacc

SEQ ID NO: 8216122 - DNA, 22 bp, Homo sapiens
tcagtgtctgtgggcaggatgg

SEQ ID NO: 8216123 - DNA, 22 bp, Homo sapiens
tcagtgtctgtgggcaggatgg

SEQ ID NO: 8216124 - DNA, 22 bp, Homo sapiens
tcagtgtctgtgggcaggatgg

SEQ ID NO: 8216125 - DNA, 22 bp, Homo sapiens
tcagtgtcttctctttcctacc

SEQ ID NO: 8216126 - DNA, 22 bp, Homo sapiens
tcagtgtcttctctttcctacc

SEQ ID NO: 8216127 - DNA, 22 bp, Homo sapiens
tcagtgtcttctctttcctacc

SEQ ID NO: 8216128 - DNA, 22 bp, Homo sapiens
tcagtgtcttgacctgggtgtg

SEQ ID NO: 8216129 - DNA, 22 bp, Homo sapiens
tcagtgtcttgacctgggtgtg

SEQ ID NO: 8216130 - DNA, 20 bp, Homo sapiens
catcatcacatgagccaatt

SEQ ID NO: 8216131 - DNA, 22 bp, Homo sapiens
catcatcaactggcaggtaagt

SEQ ID NO: 8216132 - DNA, 22 bp, Homo sapiens
catcatcaacaggtagactggt

SEQ ID NO: 8216133 - DNA, 22 bp, Homo sapiens
catcatcaaactggggggctgg

SEQ ID NO: 8216134 - DNA, 22 bp, Homo sapiens
tcagtgctgtaaacaaaaggaa

SEQ ID NO: 8216135 - DNA, 22 bp, Homo sapiens
tcagtgctgctttatgacagtt

SEQ ID NO: 8216136 - DNA, 22 bp, Homo sapiens
tcagtgctgctttatgacagtt

SEQ ID NO: 8216137 - DNA, 22 bp, Homo sapiens
tcagtgctgctttatgacagtt

SEQ ID NO: 8216138 - DNA, 22 bp, Homo sapiens
catcagcagtcacatgatgctg

SEQ ID NO: 8216139 - DNA, 22 bp, Homo sapiens
catcagctgagggtgagcagaa

SEQ ID NO: 8216140 - DNA, 22 bp, Homo sapiens
catcagcaggcaacactcttgg

SEQ ID NO: 8216141 - DNA, 22 bp, Homo sapiens
catcagcaggcaacactcttgg

SEQ ID NO: 8216142 - DNA, 22 bp, Homo sapiens
catcagagtggtggcctggtgt

SEQ ID NO: 8216143 - DNA, 21 bp, Homo sapiens
catcagatttagaagttctat

SEQ ID NO: 8216144 - DNA, 22 bp, Homo sapiens
catcagtcagtctcttcagtat

SEQ ID NO: 8216145 - DNA, 22 bp, Homo sapiens
catcaggagaccaggtcctgct

SEQ ID NO: 8216146 - DNA, 22 bp, Homo sapiens
catcagtgtctctctggtactt

SEQ ID NO: 8216147 - DNA, 22 bp, Homo sapiens
catcagtgcggcatctgtcatc

SEQ ID NO: 8216148 - DNA, 22 bp, Homo sapiens
catcagtttggtcaatgatggg

SEQ ID NO: 8216149 - DNA, 20 bp, Homo sapiens
catcagtgcctgacaggtcc

SEQ ID NO: 8216150 - DNA, 22 bp, Homo sapiens
tcaggaggccaccaggacctgt

SEQ ID NO: 8216151 - DNA, 22 bp, Homo sapiens
tcaggaggccaccaggacctgt

SEQ ID NO: 8216152 - DNA, 22 bp, Homo sapiens
tcaggaggccgtgtgctcagtg

SEQ ID NO: 8216153 - DNA, 22 bp, Homo sapiens
tcaggaggccggcaggatttga

SEQ ID NO: 8216154 - DNA, 22 bp, Homo sapiens
tcaggaatgaggataaacattg

SEQ ID NO: 8216155 - DNA, 22 bp, Homo sapiens
tcaggaggccaccaggacctgt

SEQ ID NO: 8216156 - DNA, 22 bp, Homo sapiens
tcaggaatgaggataaacattg

SEQ ID NO: 8216157 - DNA, 22 bp, Homo sapiens
tcaggaatgaggataaacattg

SEQ ID NO: 8216158 - DNA, 22 bp, Homo sapiens
tcaggaggcggtgctgcctttg

SEQ ID NO: 8216159 - DNA, 22 bp, Homo sapiens
tcaggaggcggaggttgcagtg

SEQ ID NO: 8216160 - DNA, 22 bp, Homo sapiens
tcaggaggcggaggttgcagtg

SEQ ID NO: 8216161 - DNA, 22 bp, Homo sapiens
tcaggaggccgtgtgctcagtg

SEQ ID NO: 8216162 - DNA, 22 bp, Homo sapiens
tcaggaggccgtgtgctcagtg

SEQ ID NO: 8216163 - DNA, 22 bp, Homo sapiens
tcaggaggccgtgtgctcagtg

SEQ ID NO: 8216164 - DNA, 22 bp, Homo sapiens
tcaggaggccgtgtgctcagtg

SEQ ID NO: 8216165 - DNA, 22 bp, Homo sapiens
tcaggaggcctgagtagctcta

SEQ ID NO: 8216166 - DNA, 22 bp, Homo sapiens
tcaggaggcctgagtagctcta

SEQ ID NO: 8216167 - DNA, 22 bp, Homo sapiens
tcaggaggcctgagtagctcta

SEQ ID NO: 8216168 - DNA, 22 bp, Homo sapiens
tcaggaggcctgagtagctcta

SEQ ID NO: 8216169 - DNA, 21 bp, Homo sapiens
tcaggaggctcagactcctgc

SEQ ID NO: 8216170 - DNA, 22 bp, Homo sapiens
tcaggaggctcaagacctggca

SEQ ID NO: 8216171 - DNA, 21 bp, Homo sapiens
tcaggaggctcagactcctgc

SEQ ID NO: 8216172 - DNA, 22 bp, Homo sapiens
tcaggcagaaaaatcactaatt

SEQ ID NO: 8216173 - DNA, 22 bp, Homo sapiens
tcaggcagaaaaatcactaatt

SEQ ID NO: 8216174 - DNA, 22 bp, Homo sapiens
tcaggcagaaaaatcactaatt

SEQ ID NO: 8216175 - DNA, 22 bp, Homo sapiens
tcaggcagaattatcaaaagat

SEQ ID NO: 8216176 - DNA, 22 bp, Homo sapiens
tcaggcagaattatcaaaagat

SEQ ID NO: 8216177 - DNA, 22 bp, Homo sapiens
tcaggaggcggtgctgcctttg

SEQ ID NO: 8216178 - DNA, 22 bp, Homo sapiens
tcaggaggcgtctcgctggggc

SEQ ID NO: 8216179 - DNA, 22 bp, Homo sapiens
tcaggaggctcaagacctggca

SEQ ID NO: 8216180 - DNA, 22 bp, Homo sapiens
cagtgtctcaaaacaagttgct

SEQ ID NO: 8216181 - DNA, 22 bp, Homo sapiens
cagtgtctacagtggctggagg

SEQ ID NO: 8216182 - DNA, 22 bp, Homo sapiens
tcactgtttcctgtactggaca

SEQ ID NO: 8216183 - DNA, 22 bp, Homo sapiens
tcactgtttcatccctagcact

SEQ ID NO: 8216184 - DNA, 22 bp, Homo sapiens
cagtgtctacagtggctggagg

SEQ ID NO: 8216185 - DNA, 22 bp, Homo sapiens
cagtgtcctcagccagcagcta

SEQ ID NO: 8216186 - DNA, 22 bp, Homo sapiens
cagtgtcaggatcagtatattt

SEQ ID NO: 8216187 - DNA, 22 bp, Homo sapiens
cagtgtcaggatcagtatattt

SEQ ID NO: 8216188 - DNA, 22 bp, Homo sapiens
cagtgtcaccaggcgagtctcc

SEQ ID NO: 8216189 - DNA, 22 bp, Homo sapiens
cagtgtaagctctagactagaa

SEQ ID NO: 8216190 - DNA, 22 bp, Homo sapiens
cagtgtataaactttaacatag

SEQ ID NO: 8216191 - DNA, 22 bp, Homo sapiens
cagtgtcaccaggcgagtctcc

SEQ ID NO: 8216192 - DNA, 22 bp, Homo sapiens
cagtggttttgagattcagggt

SEQ ID NO: 8216193 - DNA, 22 bp, Homo sapiens
cagtggttttatatctaagctt

SEQ ID NO: 8216194 - DNA, 22 bp, Homo sapiens
cagtggttttcagctgggagtt

SEQ ID NO: 8216195 - DNA, 22 bp, Homo sapiens
cagtggtttccaaacttgttcc

SEQ ID NO: 8216196 - DNA, 22 bp, Homo sapiens
cagtggtttctgaacagtgtgc

SEQ ID NO: 8216197 - DNA, 22 bp, Homo sapiens
cagtggtttctgaacagtgtgc

SEQ ID NO: 8216198 - DNA, 22 bp, Homo sapiens
tcactgtttcctgtactggaca

SEQ ID NO: 8216199 - DNA, 22 bp, Homo sapiens
tcactgttttgcctgcacttcc

SEQ ID NO: 8216200 - DNA, 22 bp, Homo sapiens
tcacttagatggggatcatcac

SEQ ID NO: 8216201 - DNA, 22 bp, Homo sapiens
tcacttagatggggatcatcac

SEQ ID NO: 8216202 - DNA, 22 bp, Homo sapiens
tcacttagatggggatcatcac

SEQ ID NO: 8216203 - DNA, 21 bp, Homo sapiens
tcacttataatgtatttgctg

SEQ ID NO: 8216204 - DNA, 22 bp, Homo sapiens
tcacttataaaatgcaagatct

SEQ ID NO: 8216205 - DNA, 22 bp, Homo sapiens
tcacttattgctcatctcatgc

SEQ ID NO: 8216206 - DNA, 22 bp, Homo sapiens
tcacttattttctaaccaaagg

SEQ ID NO: 8216207 - DNA, 22 bp, Homo sapiens
tcaggaagttttgaatcaactg

SEQ ID NO: 8216208 - DNA, 22 bp, Homo sapiens
tcaggaagttttgaatcaactg

SEQ ID NO: 8216209 - DNA, 22 bp, Homo sapiens
tcacttcccagacggggtggca

SEQ ID NO: 8216210 - DNA, 22 bp, Homo sapiens
tcacttatgccagctctggaag

SEQ ID NO: 8216211 - DNA, 22 bp, Homo sapiens
tcacttatatttcaggagatat

SEQ ID NO: 8216212 - DNA, 22 bp, Homo sapiens
tcacttatgtgtaggcagctta

SEQ ID NO: 8216213 - DNA, 22 bp, Homo sapiens
tcacttatgtgtgattgatgcc

SEQ ID NO: 8216214 - DNA, 22 bp, Homo sapiens
tcacttatgtgtgattgatgcc

SEQ ID NO: 8216215 - DNA, 22 bp, Homo sapiens
tcacttattgctcatctcatgc

SEQ ID NO: 8216216 - DNA, 20 bp, Homo sapiens
tcacttattctcaacttgtg

SEQ ID NO: 8216217 - DNA, 22 bp, Homo sapiens
tcacttattaactcataccatt

SEQ ID NO: 8216218 - DNA, 22 bp, Homo sapiens
catcaaataaagaaattccttg

SEQ ID NO: 8216219 - DNA, 22 bp, Homo sapiens
catcaaatgccatatatggttg

SEQ ID NO: 8216220 - DNA, 22 bp, Homo sapiens
catcaaatctgacttttcttcc

SEQ ID NO: 8216221 - DNA, 22 bp, Homo sapiens
catcaaatggcaagtgaaagct

SEQ ID NO: 8216222 - DNA, 22 bp, Homo sapiens
catcaaaattagacattgttga

SEQ ID NO: 8216223 - DNA, 17 bp, Homo sapiens
catcaaagaaatttcca

SEQ ID NO: 8216224 - DNA, 22 bp, Homo sapiens
catcaaaattagacattgttga

SEQ ID NO: 8216225 - DNA, 21 bp, Homo sapiens
catattaaatcggtgccttta

SEQ ID NO: 8216226 - DNA, 22 bp, Homo sapiens
tcaggcagaccaccgtgggcag

SEQ ID NO: 8216227 - DNA, 22 bp, Homo sapiens
tcaggcagagctgtggagctct

SEQ ID NO: 8216228 - DNA, 22 bp, Homo sapiens
tcaggcagagctgtggagctct

SEQ ID NO: 8216229 - DNA, 22 bp, Homo sapiens
tcaggcagagctgtggagctct

SEQ ID NO: 8216230 - DNA, 22 bp, Homo sapiens
tcaggcagagggagaagccaag

SEQ ID NO: 8216231 - DNA, 22 bp, Homo sapiens
tcaggcagagggagaagccaag

SEQ ID NO: 8216232 - DNA, 22 bp, Homo sapiens
tcaggcagaggatggggagcgt

SEQ ID NO: 8216233 - DNA, 22 bp, Homo sapiens
tcaggcagagggagaagccaag

SEQ ID NO: 8216234 - DNA, 22 bp, Homo sapiens
tcaggcagagggagaagccaag

SEQ ID NO: 8216235 - DNA, 22 bp, Homo sapiens
tcaggcagagggagaagccaag

SEQ ID NO: 8216236 - DNA, 20 bp, Homo sapiens
catcaacaccttgtcagcct

SEQ ID NO: 8216237 - DNA, 22 bp, Homo sapiens
catcaagagtcttactatcagt

SEQ ID NO: 8216238 - DNA, 22 bp, Homo sapiens
catcaagagtcttactatcagt

SEQ ID NO: 8216239 - DNA, 22 bp, Homo sapiens
catcaagagtcttactatcagt

SEQ ID NO: 8216240 - DNA, 22 bp, Homo sapiens
catcaatagggtttgaaagcaa

SEQ ID NO: 8216241 - DNA, 22 bp, Homo sapiens
tcaggctgatttcttttgaggg

SEQ ID NO: 8216242 - DNA, 22 bp, Homo sapiens
tcaggctgatttcttttgaggg

SEQ ID NO: 8216243 - DNA, 22 bp, Homo sapiens
catcaatagggtttgaaagcaa

SEQ ID NO: 8216244 - DNA, 22 bp, Homo sapiens
catcacaaaatgattattccct

SEQ ID NO: 8216245 - DNA, 21 bp, Homo sapiens
tcaggctgatgtcgatgttag

SEQ ID NO: 8216246 - DNA, 22 bp, Homo sapiens
tcaggctgcagtggcaaaagac

SEQ ID NO: 8216247 - DNA, 22 bp, Homo sapiens
tcaggctgcagctgtcagcagc

SEQ ID NO: 8216248 - DNA, 22 bp, Homo sapiens
tcaggctgcagctgtcagcagc

SEQ ID NO: 8216249 - DNA, 22 bp, Homo sapiens
tcaggctgcagctgtcagcagc

SEQ ID NO: 8216250 - DNA, 18 bp, Homo sapiens
tcaggctgccctgtgtct

SEQ ID NO: 8216251 - DNA, 18 bp, Homo sapiens
tcaggctgccctgtgtct

SEQ ID NO: 8216252 - DNA, 18 bp, Homo sapiens
tcaggctgccctgtgtct

SEQ ID NO: 8216253 - DNA, 18 bp, Homo sapiens
tcaggctgccctgtgtct

SEQ ID NO: 8216254 - DNA, 22 bp, Homo sapiens
tcaggctgcctatcagactgtg

SEQ ID NO: 8216255 - DNA, 22 bp, Homo sapiens
catcacattagtctcaagagaa

SEQ ID NO: 8216256 - DNA, 22 bp, Homo sapiens
tcaggctgcatctgtaagggtg

SEQ ID NO: 8216257 - DNA, 22 bp, Homo sapiens
tcaggctgcatctgtaagggtg

SEQ ID NO: 8216258 - DNA, 22 bp, Homo sapiens
tcaggctgcatctgtaagggtg

SEQ ID NO: 8216259 - DNA, 22 bp, Homo sapiens
tcaggctgcagtggcaaaagac

SEQ ID NO: 8216260 - DNA, 22 bp, Homo sapiens
tcaggctgcccgttcagggctc

SEQ ID NO: 8216261 - DNA, 22 bp, Homo sapiens
tcaggctgcccgttcagggctc

SEQ ID NO: 8216262 - DNA, 22 bp, Homo sapiens
tcaggctgcccgttcagggctc

SEQ ID NO: 8216263 - DNA, 22 bp, Homo sapiens
tcaggctgcccgttcagggctc

SEQ ID NO: 8216264 - DNA, 18 bp, Homo sapiens
tcaggctgccctgtgtct

SEQ ID NO: 8216265 - DNA, 22 bp, Homo sapiens
cattacaaagttataaacagtt

SEQ ID NO: 8216266 - DNA, 22 bp, Homo sapiens
cattacaaagttataaacagtt

SEQ ID NO: 8216267 - DNA, 22 bp, Homo sapiens
cattacaaagttataaacagtt

SEQ ID NO: 8216268 - DNA, 22 bp, Homo sapiens
cattacaacaatctgccatggc

SEQ ID NO: 8216269 - DNA, 19 bp, Homo sapiens
cattacaaatttgtaggga

SEQ ID NO: 8216270 - DNA, 19 bp, Homo sapiens
cattacaaatttgtaggga

SEQ ID NO: 8216271 - DNA, 22 bp, Homo sapiens
cattacaaccccaaattacaaa

SEQ ID NO: 8216272 - DNA, 22 bp, Homo sapiens
cattacaaccccaaattacaaa

SEQ ID NO: 8216273 - DNA, 22 bp, Homo sapiens
cattacaaacatgttaagattt

SEQ ID NO: 8216274 - DNA, 22 bp, Homo sapiens
cattacaaacatgttaagattt

SEQ ID NO: 8216275 - DNA, 22 bp, Homo sapiens
cattacaaacatgttaagattt

SEQ ID NO: 8216276 - DNA, 22 bp, Homo sapiens
cattacaaacatgttaagattt

SEQ ID NO: 8216277 - DNA, 22 bp, Homo sapiens
cattaatttaatattcaaagaa

SEQ ID NO: 8216278 - DNA, 22 bp, Homo sapiens
cattaatattgttcttctttag

SEQ ID NO: 8216279 - DNA, 22 bp, Homo sapiens
cattaattgtatttttcaaagt

SEQ ID NO: 8216280 - DNA, 22 bp, Homo sapiens
cattaataaacatttcagaaga

SEQ ID NO: 8216281 - DNA, 22 bp, Homo sapiens
cattacaaccccaaattacaaa

SEQ ID NO: 8216282 - DNA, 22 bp, Homo sapiens
cattacaaccccaaattacaaa

SEQ ID NO: 8216283 - DNA, 22 bp, Homo sapiens
cattacaaccccaaattacaaa

SEQ ID NO: 8216284 - DNA, 21 bp, Homo sapiens
cattacaagatttccaatttg

SEQ ID NO: 8216285 - DNA, 21 bp, Homo sapiens
cattacaagatttccaatttg

SEQ ID NO: 8216286 - DNA, 22 bp, Homo sapiens
tccagggcagggtgcgcatggg

SEQ ID NO: 8216287 - DNA, 22 bp, Homo sapiens
tccagggcagggtgcgcatggg

SEQ ID NO: 8216288 - DNA, 22 bp, Homo sapiens
tccagggcaggtgctgggctct

SEQ ID NO: 8216289 - DNA, 22 bp, Homo sapiens
tccagggcagggtgcgcatggg

SEQ ID NO: 8216290 - DNA, 23 bp, Homo sapiens
tccagggcagtggctgggtctgc

SEQ ID NO: 8216291 - DNA, 22 bp, Homo sapiens
tccagggcagtgactacagcgg

SEQ ID NO: 8216292 - DNA, 22 bp, Homo sapiens
tccagggcagtgactacagcgg

SEQ ID NO: 8216293 - DNA, 22 bp, Homo sapiens
tccagggcagtgactacagcgg

SEQ ID NO: 8216294 - DNA, 22 bp, Homo sapiens
tccagggcagtgactacagcgg

SEQ ID NO: 8216295 - DNA, 22 bp, Homo sapiens
tccagggcaggtgctgggctct

SEQ ID NO: 8216296 - DNA, 22 bp, Homo sapiens
tccagggcaggtgctgggctct

SEQ ID NO: 8216297 - DNA, 22 bp, Homo sapiens
tccagggcaggtgctgggctct

SEQ ID NO: 8216298 - DNA, 22 bp, Homo sapiens
tccaggggtgatttttgacttg

SEQ ID NO: 8216299 - DNA, 22 bp, Homo sapiens
tccagggttgtgggcttcagca

SEQ ID NO: 8216300 - DNA, 22 bp, Homo sapiens
tccagggttgtgggcttcagca

SEQ ID NO: 8216301 - DNA, 22 bp, Homo sapiens
tccagggtgtgtttactggggt

SEQ ID NO: 8216302 - DNA, 22 bp, Homo sapiens
tccagggtcagaagtcacatac

SEQ ID NO: 8216303 - DNA, 21 bp, Homo sapiens
tccagggtcagaagttcagtg

SEQ ID NO: 8216304 - DNA, 22 bp, Homo sapiens
tccagggtgtgtttactggggt

SEQ ID NO: 8216305 - DNA, 19 bp, Homo sapiens
tccagggtcattaacaatg

SEQ ID NO: 8216306 - DNA, 22 bp, Homo sapiens
tccaggtcagacttctgtgccc

SEQ ID NO: 8216307 - DNA, 20 bp, Homo sapiens
tccaggtaacatctctctgg

SEQ ID NO: 8216308 - DNA, 17 bp, Homo sapiens
tccagggtttatgaaat

SEQ ID NO: 8216309 - DNA, 22 bp, Homo sapiens
tccaggtaatttggatgctagt

SEQ ID NO: 8216310 - DNA, 22 bp, Homo sapiens
tccaggtcccagactgggcagc

SEQ ID NO: 8216311 - DNA, 22 bp, Homo sapiens
tccaggtccagaggttcaactg

SEQ ID NO: 8216312 - DNA, 23 bp, Homo sapiens
tccagggcagtggctgggtctgc

SEQ ID NO: 8216313 - DNA, 23 bp, Homo sapiens
tccagggcagtggctgggtctgc

SEQ ID NO: 8216314 - DNA, 23 bp, Homo sapiens
tccagggcagtggctgggtctgc

SEQ ID NO: 8216315 - DNA, 22 bp, Homo sapiens
tccagggcatgctcagactcag

SEQ ID NO: 8216316 - DNA, 22 bp, Homo sapiens
tccagggcatccacgcgtgggg

SEQ ID NO: 8216317 - DNA, 22 bp, Homo sapiens
tccagggcatggggagagagtg

SEQ ID NO: 8216318 - DNA, 22 bp, Homo sapiens
tccagggcatgctcagactcag

SEQ ID NO: 8216319 - DNA, 22 bp, Homo sapiens
tccagggcatggggagagagtg

SEQ ID NO: 8216320 - DNA, 22 bp, Homo sapiens
tccagggcatggggagagagtg

SEQ ID NO: 8216321 - DNA, 22 bp, Homo sapiens
tccaggggacactgtttctcca

SEQ ID NO: 8216322 - DNA, 22 bp, Homo sapiens
tccaggggagactagacccaca

SEQ ID NO: 8216323 - DNA, 21 bp, Homo sapiens
tccaggggccagcacccaagc

SEQ ID NO: 8216324 - DNA, 19 bp, Homo sapiens
tccaggggctccacctcct

SEQ ID NO: 8216325 - DNA, 22 bp, Homo sapiens
catgtacagtttttctgtcctg

SEQ ID NO: 8216326 - DNA, 22 bp, Homo sapiens
catgtacagtttttctgtcctg

SEQ ID NO: 8216327 - DNA, 22 bp, Homo sapiens
catgtacagtttttctgtcctg

SEQ ID NO: 8216328 - DNA, 22 bp, Homo sapiens
catgtacatgcctactatcaat

SEQ ID NO: 8216329 - DNA, 22 bp, Homo sapiens
catgtacatgcctactatcaat

SEQ ID NO: 8216330 - DNA, 22 bp, Homo sapiens
catgtacatgcatgggcactgt

SEQ ID NO: 8216331 - DNA, 22 bp, Homo sapiens
tccaggctgggctgaagggtgc

SEQ ID NO: 8216332 - DNA, 22 bp, Homo sapiens
tccaggctcctgactttttggg

SEQ ID NO: 8216333 - DNA, 22 bp, Homo sapiens
tccaggctcctgactttttggg

SEQ ID NO: 8216334 - DNA, 20 bp, Homo sapiens
tccaggctcctccacttagt

SEQ ID NO: 8216335 - DNA, 22 bp, Homo sapiens
tccaggctgggctgaagggtgc

SEQ ID NO: 8216336 - DNA, 22 bp, Homo sapiens
tccaggctgtgcatgagtttag

SEQ ID NO: 8216337 - DNA, 22 bp, Homo sapiens
tccaggctgtgcatgagtttag

SEQ ID NO: 8216338 - DNA, 22 bp, Homo sapiens
tccaggcttcacgtctgccctc

SEQ ID NO: 8216339 - DNA, 22 bp, Homo sapiens
tccaggcttcacgtctgccctc

SEQ ID NO: 8216340 - DNA, 22 bp, Homo sapiens
tccaggcttcacgtctgccctc

SEQ ID NO: 8216341 - DNA, 22 bp, Homo sapiens
tccaggcttcacgtctgccctc

SEQ ID NO: 8216342 - DNA, 22 bp, Homo sapiens
tccaggcttgagaccaggctct

SEQ ID NO: 8216343 - DNA, 22 bp, Homo sapiens
tccaggctgtgcgcaccgtgtg

SEQ ID NO: 8216344 - DNA, 22 bp, Homo sapiens
tccaggctgtgcgcaccgtgtg

SEQ ID NO: 8216345 - DNA, 22 bp, Homo sapiens
tccaggcttcacgtctgccctc

SEQ ID NO: 8216346 - DNA, 22 bp, Homo sapiens
catgtacaaggatgctcagagt

SEQ ID NO: 8216347 - DNA, 22 bp, Homo sapiens
catgtacaaggatgctcagagt

SEQ ID NO: 8216348 - DNA, 22 bp, Homo sapiens
catgtacacacaaagggacaat

SEQ ID NO: 8216349 - DNA, 23 bp, Homo sapiens
catgtacacacagctgtacagtg

SEQ ID NO: 8216350 - DNA, 22 bp, Homo sapiens
catgtacacacaaagggacaat

SEQ ID NO: 8216351 - DNA, 22 bp, Homo sapiens
catgtacacacaaagggacaat

SEQ ID NO: 8216352 - DNA, 23 bp, Homo sapiens
catgtacacacagctgtacagtg

SEQ ID NO: 8216353 - DNA, 23 bp, Homo sapiens
catgtacacacagctgtacagtg

SEQ ID NO: 8216354 - DNA, 23 bp, Homo sapiens
catgtacacacagctgtacagtg

SEQ ID NO: 8216355 - DNA, 23 bp, Homo sapiens
catgtacacacagctgtacagtg

SEQ ID NO: 8216356 - DNA, 23 bp, Homo sapiens
catgtacacacagctgtacagtg

SEQ ID NO: 8216357 - DNA, 22 bp, Homo sapiens
catgtacactcatgtaactata

SEQ ID NO: 8216358 - DNA, 22 bp, Homo sapiens
catgtacactcatgtaactata

SEQ ID NO: 8216359 - DNA, 22 bp, Homo sapiens
catgtacactcatgtaactata

SEQ ID NO: 8216360 - DNA, 23 bp, Homo sapiens
catgtacagagtttgataaagtg

SEQ ID NO: 8216361 - DNA, 22 bp, Homo sapiens
catgtacagccagggttgagaa

SEQ ID NO: 8216362 - DNA, 22 bp, Homo sapiens
catgtacagccagggttgagaa

SEQ ID NO: 8216363 - DNA, 23 bp, Homo sapiens
catgtacagagtttgataaagtg

SEQ ID NO: 8216364 - DNA, 23 bp, Homo sapiens
catgtacagagtttgataaagtg

SEQ ID NO: 8216365 - DNA, 23 bp, Homo sapiens
catgtacagagtttgataaagtg

SEQ ID NO: 8216366 - DNA, 23 bp, Homo sapiens
catgtacagagtttgataaagtg

SEQ ID NO: 8216367 - DNA, 22 bp, Homo sapiens
tccaggctttttcatgctgtct

SEQ ID NO: 8216368 - DNA, 22 bp, Homo sapiens
tccaggctttggggcaggagcg

SEQ ID NO: 8216369 - DNA, 22 bp, Homo sapiens
tccaggctttggggcaggagcg

SEQ ID NO: 8216370 - DNA, 22 bp, Homo sapiens
tccaggcttgagaccaggctct

SEQ ID NO: 8216371 - DNA, 22 bp, Homo sapiens
tccaggcttgagaccaggctct

SEQ ID NO: 8216372 - DNA, 22 bp, Homo sapiens
tccaggcttgagaccaggctct

SEQ ID NO: 8216373 - DNA, 22 bp, Homo sapiens
tccaggcttgagaccaggctct

SEQ ID NO: 8216374 - DNA, 22 bp, Homo sapiens
tccaggctttggggcaggagcg

SEQ ID NO: 8216375 - DNA, 22 bp, Homo sapiens
tccaggctttttcatgctgtct

SEQ ID NO: 8216376 - DNA, 22 bp, Homo sapiens
catgtgctgtagcagagaggaa

SEQ ID NO: 8216377 - DNA, 22 bp, Homo sapiens
catgtgctgtagcagagaggaa

SEQ ID NO: 8216378 - DNA, 22 bp, Homo sapiens
catgtggctttggcatgtgccc

SEQ ID NO: 8216379 - DNA, 22 bp, Homo sapiens
catgtggatatgaattgtagaa

SEQ ID NO: 8216380 - DNA, 22 bp, Homo sapiens
catgtggcacaaagaaggaaat

SEQ ID NO: 8216381 - DNA, 22 bp, Homo sapiens
catgtgtcaaatgatgtagctg

SEQ ID NO: 8216382 - DNA, 22 bp, Homo sapiens
catgttttgtgtacagaatatt

SEQ ID NO: 8216383 - DNA, 22 bp, Homo sapiens
cattaagtatttcagttactgt

SEQ ID NO: 8216384 - DNA, 19 bp, Homo sapiens
catgtgtcaatactgtacc

SEQ ID NO: 8216385 - DNA, 22 bp, Homo sapiens
catgtgtcaaatgatgtagctg

SEQ ID NO: 8216386 - DNA, 22 bp, Homo sapiens
catgtgtcaaatgatgtagctg

SEQ ID NO: 8216387 - DNA, 20 bp, Homo sapiens
catgtgtcagttctcaccca

SEQ ID NO: 8216388 - DNA, 22 bp, Homo sapiens
catgtgtcacagccttttattg

SEQ ID NO: 8216389 - DNA, 22 bp, Homo sapiens
catgttttctaggctttcacaa

SEQ ID NO: 8216390 - DNA, 22 bp, Homo sapiens
catgtgtcacagccttttattg

SEQ ID NO: 8216391 - DNA, 19 bp, Homo sapiens
catgtgtcaatactgtacc

SEQ ID NO: 8216392 - DNA, 22 bp, Homo sapiens
catgtgtatgcattcatacata

SEQ ID NO: 8216393 - DNA, 22 bp, Homo sapiens
catgtgtagtgaaataagcagt

SEQ ID NO: 8216394 - DNA, 22 bp, Homo sapiens
catgtgtaggtatacaaaattc

SEQ ID NO: 8216395 - DNA, 22 bp, Homo sapiens
catgtgtagtgaaataagcagt

SEQ ID NO: 8216396 - DNA, 22 bp, Homo sapiens
catgtgtaccagctgttctttg

SEQ ID NO: 8216397 - DNA, 22 bp, Homo sapiens
catgtgtaattgtaaaaggtaa

SEQ ID NO: 8216398 - DNA, 22 bp, Homo sapiens
catgtgtaggtataacttgtga

SEQ ID NO: 8216399 - DNA, 22 bp, Homo sapiens
catgtgtaaggctcacaggcag

SEQ ID NO: 8216400 - DNA, 22 bp, Homo sapiens
catgtgggttattgggttctag

SEQ ID NO: 8216401 - DNA, 22 bp, Homo sapiens
catgtgggactcctgctgtttt

SEQ ID NO: 8216402 - DNA, 22 bp, Homo sapiens
catgtgggaagaggccagctgg

SEQ ID NO: 8216403 - DNA, 22 bp, Homo sapiens
catgtgggacaatctcaggtat

SEQ ID NO: 8216404 - DNA, 22 bp, Homo sapiens
catgtgggactcctgctgtttt

SEQ ID NO: 8216405 - DNA, 22 bp, Homo sapiens
catgctttttgacaacaagctg

SEQ ID NO: 8216406 - DNA, 22 bp, Homo sapiens
catgcttttcaatctatcttaa

SEQ ID NO: 8216407 - DNA, 22 bp, Homo sapiens
catgctttgggtcagaaatgcc

SEQ ID NO: 8216408 - DNA, 22 bp, Homo sapiens
catgcttcctccaaactaccct

SEQ ID NO: 8216409 - DNA, 22 bp, Homo sapiens
catgcttacttgtctcagcaga

SEQ ID NO: 8216410 - DNA, 22 bp, Homo sapiens
catgctgttgaatatgacattg

SEQ ID NO: 8216411 - DNA, 22 bp, Homo sapiens
catgctgttgaatatgacattg

SEQ ID NO: 8216412 - DNA, 22 bp, Homo sapiens
tccagcagaaaagaggtaggga

SEQ ID NO: 8216413 - DNA, 22 bp, Homo sapiens
tccagcactcgcccagggcttg

SEQ ID NO: 8216414 - DNA, 22 bp, Homo sapiens
tccagcacctggaggcgtcccc

SEQ ID NO: 8216415 - DNA, 22 bp, Homo sapiens
catgctgtgttacttggcatct

SEQ ID NO: 8216416 - DNA, 22 bp, Homo sapiens
tccagcagaaccagagacctgg

SEQ ID NO: 8216417 - DNA, 22 bp, Homo sapiens
tccagcacagaatttcctagct

SEQ ID NO: 8216418 - DNA, 21 bp, Homo sapiens
tccagcacagatgacctcccc

SEQ ID NO: 8216419 - DNA, 22 bp, Homo sapiens
tccagcaaagtgataggatttc

SEQ ID NO: 8216420 - DNA, 20 bp, Homo sapiens
tccagcaccctcacagagaa

SEQ ID NO: 8216421 - DNA, 22 bp, Homo sapiens
tccagcacccaatgtggctaag

SEQ ID NO: 8216422 - DNA, 22 bp, Homo sapiens
tccagcacccaatgtggctaag

SEQ ID NO: 8216423 - DNA, 22 bp, Homo sapiens
tccagcaccaccacagggaaga

SEQ ID NO: 8216424 - DNA, 22 bp, Homo sapiens
catggtgtgaatgagcggataa

SEQ ID NO: 8216425 - DNA, 22 bp, Homo sapiens
catggtttattagagcttattt

SEQ ID NO: 8216426 - DNA, 20 bp, Homo sapiens
catggtggaggagcagggcc

SEQ ID NO: 8216427 - DNA, 22 bp, Homo sapiens
catggtttattagagcttattt

SEQ ID NO: 8216428 - DNA, 22 bp, Homo sapiens
catggtttcatgagaattaccc

SEQ ID NO: 8216429 - DNA, 22 bp, Homo sapiens
catggtttggtctttgtagtgg

SEQ ID NO: 8216430 - DNA, 22 bp, Homo sapiens
catggtttggtctttgtagtgg

SEQ ID NO: 8216431 - DNA, 22 bp, Homo sapiens
catggtttgatgactggaagga

SEQ ID NO: 8216432 - DNA, 20 bp, Homo sapiens
catggtggaggagcagggcc

SEQ ID NO: 8216433 - DNA, 23 bp, Homo sapiens
catggaaaactgaaagctgacct

SEQ ID NO: 8216434 - DNA, 23 bp, Homo sapiens
catggaaaactgaaagctgacct

SEQ ID NO: 8216435 - DNA, 22 bp, Homo sapiens
catggaaagcactcagcccagt

SEQ ID NO: 8216436 - DNA, 23 bp, Homo sapiens
catggaaaactgaaagctgacct

SEQ ID NO: 8216437 - DNA, 22 bp, Homo sapiens
catggaacaaggaagatgtttg

SEQ ID NO: 8216438 - DNA, 22 bp, Homo sapiens
catgggctctctgagctccagg

SEQ ID NO: 8216439 - DNA, 22 bp, Homo sapiens
catgggctcttctggactgcac

SEQ ID NO: 8216440 - DNA, 22 bp, Homo sapiens
catgggctcttctggactgcac

SEQ ID NO: 8216441 - DNA, 22 bp, Homo sapiens
catgggctcttctggactgcac

SEQ ID NO: 8216442 - DNA, 22 bp, Homo sapiens
catgtacaaaaggcaaatgcct

SEQ ID NO: 8216443 - DNA, 22 bp, Homo sapiens
catgtaaagcatccttctaggg

SEQ ID NO: 8216444 - DNA, 22 bp, Homo sapiens
catgtaatcctggggagatgaa

SEQ ID NO: 8216445 - DNA, 22 bp, Homo sapiens
catgtaaagcacttcataacag

SEQ ID NO: 8216446 - DNA, 22 bp, Homo sapiens
catgtaaagcacttcataacag

SEQ ID NO: 8216447 - DNA, 22 bp, Homo sapiens
catgtaaaaagaagaatctgga

SEQ ID NO: 8216448 - DNA, 22 bp, Homo sapiens
catgtaaaacactcagaacagt

SEQ ID NO: 8216449 - DNA, 22 bp, Homo sapiens
catggttttgagcctattatgc

SEQ ID NO: 8216450 - DNA, 22 bp, Homo sapiens
catggttttgagcctattatgc

SEQ ID NO: 8216451 - DNA, 22 bp, Homo sapiens
catggttttaaggtcactgccg

SEQ ID NO: 8216452 - DNA, 22 bp, Homo sapiens
catggttttaaggtcactgccg

SEQ ID NO: 8216453 - DNA, 22 bp, Homo sapiens
catggtttttaccctacaccat

SEQ ID NO: 8216454 - DNA, 22 bp, Homo sapiens
catgctgagcacattctgtatt

SEQ ID NO: 8216455 - DNA, 22 bp, Homo sapiens
catgctctctggcaacttgtgt

SEQ ID NO: 8216456 - DNA, 20 bp, Homo sapiens
catgctgcctccattgatgc

SEQ ID NO: 8216457 - DNA, 22 bp, Homo sapiens
catgctgattcttcctgagctt

SEQ ID NO: 8216458 - DNA, 22 bp, Homo sapiens
catgctgggtaaaggtggtgaa

SEQ ID NO: 8216459 - DNA, 22 bp, Homo sapiens
catgctgtgtgttttagctcca

SEQ ID NO: 8216460 - DNA, 22 bp, Homo sapiens
catgctgtgtggttagaactgt

SEQ ID NO: 8216461 - DNA, 22 bp, Homo sapiens
catgctgtgtggttagaactgt

SEQ ID NO: 8216462 - DNA, 22 bp, Homo sapiens
catgctgtgcatcttgatgacc

SEQ ID NO: 8216463 - DNA, 22 bp, Homo sapiens
catgctgtgcatcttgatgacc

SEQ ID NO: 8216464 - DNA, 22 bp, Homo sapiens
catgctgtgctattcgtgctgt

SEQ ID NO: 8216465 - DNA, 22 bp, Homo sapiens
catgctgtcctgccagggatgg

SEQ ID NO: 8216466 - DNA, 22 bp, Homo sapiens
catgctgtgctattcgtgctgt

SEQ ID NO: 8216467 - DNA, 22 bp, Homo sapiens
catgctggtcagccagtggatg

SEQ ID NO: 8216468 - DNA, 22 bp, Homo sapiens
catgctgtactctgtgtcagaa

SEQ ID NO: 8216469 - DNA, 23 bp, Homo sapiens
catgctgtgatacaggaaggttg

SEQ ID NO: 8216470 - DNA, 23 bp, Homo sapiens
catgctgtgatacaggaaggttg

SEQ ID NO: 8216471 - DNA, 22 bp, Homo sapiens
catgctcacaaaagatggcaaa

SEQ ID NO: 8216472 - DNA, 22 bp, Homo sapiens
catgctactgaacaagtccatg

SEQ ID NO: 8216473 - DNA, 22 bp, Homo sapiens
catgctctagattctctctaat

SEQ ID NO: 8216474 - DNA, 22 bp, Homo sapiens
catgctctagattctctctaat

SEQ ID NO: 8216475 - DNA, 22 bp, Homo sapiens
catgctctctggcaacttgtgt

SEQ ID NO: 8216476 - DNA, 22 bp, Homo sapiens
catgctctccattggacacaga

SEQ ID NO: 8216477 - DNA, 22 bp, Homo sapiens
tcatcagtccttttcattatga

SEQ ID NO: 8216478 - DNA, 22 bp, Homo sapiens
tcatcagggatattggcctgaa

SEQ ID NO: 8216479 - DNA, 22 bp, Homo sapiens
tcatcagggatattggcctgaa

SEQ ID NO: 8216480 - DNA, 22 bp, Homo sapiens
tcatcagctcatctgctcctag

SEQ ID NO: 8216481 - DNA, 22 bp, Homo sapiens
catgccaggactctggaggctt

SEQ ID NO: 8216482 - DNA, 22 bp, Homo sapiens
tccaagagaatactggagagta

SEQ ID NO: 8216483 - DNA, 22 bp, Homo sapiens
tccaagagaatactggagagta

SEQ ID NO: 8216484 - DNA, 22 bp, Homo sapiens
tccaagacaagcacattcctgc

SEQ ID NO: 8216485 - DNA, 22 bp, Homo sapiens
tccaagaagtcatctaaactgt

SEQ ID NO: 8216486 - DNA, 22 bp, Homo sapiens
tccaagatctacagcagtttag

SEQ ID NO: 8216487 - DNA, 22 bp, Homo sapiens
tccaagatctacagcagtttag

SEQ ID NO: 8216488 - DNA, 22 bp, Homo sapiens
tccaagagttcaaggctacagt

SEQ ID NO: 8216489 - DNA, 22 bp, Homo sapiens
tccaagagttcaaggctacagt

SEQ ID NO: 8216490 - DNA, 22 bp, Homo sapiens
tccaagagttcaaggctacagt

SEQ ID NO: 8216491 - DNA, 20 bp, Homo sapiens
tccaagagtgatgtttcata

SEQ ID NO: 8216492 - DNA, 22 bp, Homo sapiens
tccaagaggagacactgggatg

SEQ ID NO: 8216493 - DNA, 22 bp, Homo sapiens
tccagagtacggaagagtcatc

SEQ ID NO: 8216494 - DNA, 18 bp, Homo sapiens
tccagaggtgttggagcc

SEQ ID NO: 8216495 - DNA, 22 bp, Homo sapiens
tccagagtctcctgttgttgtt

SEQ ID NO: 8216496 - DNA, 22 bp, Homo sapiens
tccagagtttgagtctccttcc

SEQ ID NO: 8216497 - DNA, 22 bp, Homo sapiens
tccagatagagtcctgttagta

SEQ ID NO: 8216498 - DNA, 18 bp, Homo sapiens
tccagaggtgttggagcc

SEQ ID NO: 8216499 - DNA, 22 bp, Homo sapiens
tccagaggtgaacacccaggca

SEQ ID NO: 8216500 - DNA, 22 bp, Homo sapiens
tccagaggtgaacacccaggca

SEQ ID NO: 8216501 - DNA, 22 bp, Homo sapiens
tccagaggtgaacacccaggca

SEQ ID NO: 8216502 - DNA, 22 bp, Homo sapiens
tccaagcatgtggtcaggagcc

SEQ ID NO: 8216503 - DNA, 22 bp, Homo sapiens
tccaagcactgttaattaaact

SEQ ID NO: 8216504 - DNA, 20 bp, Homo sapiens
gtggagaggctggcgggact

SEQ ID NO: 8216505 - DNA, 22 bp, Homo sapiens
gtggagcaatcagagggtcagt

SEQ ID NO: 8216506 - DNA, 21 bp, Homo sapiens
gtggagagtgattttgatgca

SEQ ID NO: 8216507 - DNA, 22 bp, Homo sapiens
gtggagcacggaggaggcccct

SEQ ID NO: 8216508 - DNA, 22 bp, Homo sapiens
gtggagcaggactagctgagaa

SEQ ID NO: 8216509 - DNA, 22 bp, Homo sapiens
gtggagcaatcagagggtcagt

SEQ ID NO: 8216510 - DNA, 22 bp, Homo sapiens
gtggagcatgtgaggactgagt

SEQ ID NO: 8216511 - DNA, 22 bp, Homo sapiens
gtggagcaggactagctgagaa

SEQ ID NO: 8216512 - DNA, 22 bp, Homo sapiens
gtggagcaggactagctgagaa

SEQ ID NO: 8216513 - DNA, 23 bp, Homo sapiens
gtggagccacatcacaggctcct

SEQ ID NO: 8216514 - DNA, 22 bp, Homo sapiens
gtggagcatgtgaggactgagt

SEQ ID NO: 8216515 - DNA, 22 bp, Homo sapiens
gtggagcatgtgaggactgagt

SEQ ID NO: 8216516 - DNA, 22 bp, Homo sapiens
gtggagccaggatctccgcaca

SEQ ID NO: 8216517 - DNA, 22 bp, Homo sapiens
gtggagccaggatctccgcaca

SEQ ID NO: 8216518 - DNA, 23 bp, Homo sapiens
gtggagccacatcacaggctcct

SEQ ID NO: 8216519 - DNA, 22 bp, Homo sapiens
cagctctgccacttcctagcta

SEQ ID NO: 8216520 - DNA, 22 bp, Homo sapiens
cagctctgccacttcctagcta

SEQ ID NO: 8216521 - DNA, 22 bp, Homo sapiens
cagctctgccacttcctagcta

SEQ ID NO: 8216522 - DNA, 17 bp, Homo sapiens
cagctctgcatcttcct

SEQ ID NO: 8216523 - DNA, 17 bp, Homo sapiens
cagctctgcatcttcct

SEQ ID NO: 8216524 - DNA, 22 bp, Homo sapiens
cagctctgccacttcctagcta

SEQ ID NO: 8216525 - DNA, 22 bp, Homo sapiens
cagctctgctgggaggatgcag

SEQ ID NO: 8216526 - DNA, 22 bp, Homo sapiens
gtggagaggagcagctacctca

SEQ ID NO: 8216527 - DNA, 22 bp, Homo sapiens
cagctctgcctctggggctgag

SEQ ID NO: 8216528 - DNA, 22 bp, Homo sapiens
cagctctgccatcatctgcctt

SEQ ID NO: 8216529 - DNA, 22 bp, Homo sapiens
cagctctgccatcatctgcctt

SEQ ID NO: 8216530 - DNA, 22 bp, Homo sapiens
cagctctgcctctggggctgag

SEQ ID NO: 8216531 - DNA, 22 bp, Homo sapiens
tacacagcctgtaatgatgact

SEQ ID NO: 8216532 - DNA, 22 bp, Homo sapiens
tacacagatttcagtatcatca

SEQ ID NO: 8216533 - DNA, 22 bp, Homo sapiens
tacacaggctgcctctttgcat

SEQ ID NO: 8216534 - DNA, 22 bp, Homo sapiens
tacacagggaaaggtctcagag

SEQ ID NO: 8216535 - DNA, 22 bp, Homo sapiens
tacacagggtatggcttgagga

SEQ ID NO: 8216536 - DNA, 22 bp, Homo sapiens
tacacagactcttcaattcaga

SEQ ID NO: 8216537 - DNA, 22 bp, Homo sapiens
tacacagaagccagaaggcctg

SEQ ID NO: 8216538 - DNA, 22 bp, Homo sapiens
tacaatatgtgaactttggtgt

SEQ ID NO: 8216539 - DNA, 22 bp, Homo sapiens
tacacagaggctgatgtcttag

SEQ ID NO: 8216540 - DNA, 22 bp, Homo sapiens
tacacagaggctgatgtcttag

SEQ ID NO: 8216541 - DNA, 22 bp, Homo sapiens
tacacagaggctgatgtcttag

SEQ ID NO: 8216542 - DNA, 22 bp, Homo sapiens
tacacttataactctgtgtgtg

SEQ ID NO: 8216543 - DNA, 22 bp, Homo sapiens
tacactgtttttggaaagaaga

SEQ ID NO: 8216544 - DNA, 22 bp, Homo sapiens
tacactgtttgaactgtggtcg

SEQ ID NO: 8216545 - DNA, 22 bp, Homo sapiens
tacactttatggatcctacttt

SEQ ID NO: 8216546 - DNA, 22 bp, Homo sapiens
tacacttttcaatgtagtctgt

SEQ ID NO: 8216547 - DNA, 22 bp, Homo sapiens
tacactttgtgatgccgggagc

SEQ ID NO: 8216548 - DNA, 22 bp, Homo sapiens
tacagacatttactccactcct

SEQ ID NO: 8216549 - DNA, 22 bp, Homo sapiens
tacagacatttactccactcct

SEQ ID NO: 8216550 - DNA, 22 bp, Homo sapiens
caggccctgccttggcatgtgt

SEQ ID NO: 8216551 - DNA, 22 bp, Homo sapiens
caggccctgccttggcatgtgt

SEQ ID NO: 8216552 - DNA, 22 bp, Homo sapiens
caggccctgccttggcatgtgt

SEQ ID NO: 8216553 - DNA, 22 bp, Homo sapiens
caggccctgccttgagggacct

SEQ ID NO: 8216554 - DNA, 22 bp, Homo sapiens
caggccctgctgctgagacctt

SEQ ID NO: 8216555 - DNA, 22 bp, Homo sapiens
tacactgtaggtggcaggcagc

SEQ ID NO: 8216556 - DNA, 22 bp, Homo sapiens
tacactgtacgctctgcttcaa

SEQ ID NO: 8216557 - DNA, 22 bp, Homo sapiens
tacactgtgtaaaatgcacttt

SEQ ID NO: 8216558 - DNA, 22 bp, Homo sapiens
tacactgtgtaaaatgcacttt

SEQ ID NO: 8216559 - DNA, 22 bp, Homo sapiens
tacactgtgaggtttccaaggg

SEQ ID NO: 8216560 - DNA, 22 bp, Homo sapiens
tacactgtggtaaactcaaagt

SEQ ID NO: 8216561 - DNA, 22 bp, Homo sapiens
tacactgtcttagaaaggggca

SEQ ID NO: 8216562 - DNA, 22 bp, Homo sapiens
tacactgtcagatttcgattgc

SEQ ID NO: 8216563 - DNA, 22 bp, Homo sapiens
tacactgtgacaatcatgacag

SEQ ID NO: 8216564 - DNA, 22 bp, Homo sapiens
tacactgtgacaatcatgacag

SEQ ID NO: 8216565 - DNA, 22 bp, Homo sapiens
tacactgtgacaatcatgacag

SEQ ID NO: 8216566 - DNA, 22 bp, Homo sapiens
caggccccattcctcttgggac

SEQ ID NO: 8216567 - DNA, 22 bp, Homo sapiens
caggccctcaggcaagggctct

SEQ ID NO: 8216568 - DNA, 22 bp, Homo sapiens
caggcccaggggtctggcccac

SEQ ID NO: 8216569 - DNA, 22 bp, Homo sapiens
caggcccaggggtctggcccac

SEQ ID NO: 8216570 - DNA, 22 bp, Homo sapiens
caggcccaggggtctggcccac

SEQ ID NO: 8216571 - DNA, 22 bp, Homo sapiens
caggccacgccccggcgtgtga

SEQ ID NO: 8216572 - DNA, 22 bp, Homo sapiens
caggccacgccccggcgtgtga

SEQ ID NO: 8216573 - DNA, 22 bp, Homo sapiens
caggcccaggggtctggcccac

SEQ ID NO: 8216574 - DNA, 22 bp, Homo sapiens
caggccaccagatacatgcccc

SEQ ID NO: 8216575 - DNA, 22 bp, Homo sapiens
caggccacagctaaagaggatt

SEQ ID NO: 8216576 - DNA, 22 bp, Homo sapiens
caggccacacggcggctccctg

SEQ ID NO: 8216577 - DNA, 22 bp, Homo sapiens
caggccctcctgtgatctgcct

SEQ ID NO: 8216578 - DNA, 22 bp, Homo sapiens
caggccctcctgtgatctgcct

SEQ ID NO: 8216579 - DNA, 22 bp, Homo sapiens
caggccctcctgtgatctgcct

SEQ ID NO: 8216580 - DNA, 22 bp, Homo sapiens
caggccctcaggcaagggctct

SEQ ID NO: 8216581 - DNA, 22 bp, Homo sapiens
caggccctcaggcaagggctct

SEQ ID NO: 8216582 - DNA, 22 bp, Homo sapiens
caggccctcctgtgatctgcct

SEQ ID NO: 8216583 - DNA, 22 bp, Homo sapiens
caggccctcgtggtgagctggg

SEQ ID NO: 8216584 - DNA, 22 bp, Homo sapiens
caggccctcgcccgcagcgacc

SEQ ID NO: 8216585 - DNA, 22 bp, Homo sapiens
caggccctcgcccgcagcgacc

SEQ ID NO: 8216586 - DNA, 22 bp, Homo sapiens
caggccctcgcccgcagcgacc

SEQ ID NO: 8216587 - DNA, 22 bp, Homo sapiens
caggccctcgtggtgagctggg

SEQ ID NO: 8216588 - DNA, 22 bp, Homo sapiens
caggccctcgtggtgagctggg

SEQ ID NO: 8216589 - DNA, 22 bp, Homo sapiens
caggccctcgtggtgagctggg

SEQ ID NO: 8216590 - DNA, 22 bp, Homo sapiens
caggccctcgtggtgagctggg

SEQ ID NO: 8216591 - DNA, 22 bp, Homo sapiens
caggccctctgcaccctcgtct

SEQ ID NO: 8216592 - DNA, 22 bp, Homo sapiens
caggccctctgcaccctcgtct

SEQ ID NO: 8216593 - DNA, 22 bp, Homo sapiens
caggccctgaggattcggcggg

SEQ ID NO: 8216594 - DNA, 22 bp, Homo sapiens
caggccctgaggattcggcggg

SEQ ID NO: 8216595 - DNA, 22 bp, Homo sapiens
caggccctgcacagtggtcctg

SEQ ID NO: 8216596 - DNA, 22 bp, Homo sapiens
caggccctgcacagtggtcctg

SEQ ID NO: 8216597 - DNA, 22 bp, Homo sapiens
caggccctgcacagtggtcctg

SEQ ID NO: 8216598 - DNA, 22 bp, Homo sapiens
caggccctgcactaggccctgg

SEQ ID NO: 8216599 - DNA, 22 bp, Homo sapiens
caggccctgcactaggccctgg

SEQ ID NO: 8216600 - DNA, 22 bp, Homo sapiens
caggccctgcactaggccctgg

SEQ ID NO: 8216601 - DNA, 22 bp, Homo sapiens
caggccctgccttgagggacct

SEQ ID NO: 8216602 - DNA, 22 bp, Homo sapiens
caggccctgccttgagggacct

SEQ ID NO: 8216603 - DNA, 22 bp, Homo sapiens
tacagagagctccggacattca

SEQ ID NO: 8216604 - DNA, 22 bp, Homo sapiens
tacagagagctccggacattca

SEQ ID NO: 8216605 - DNA, 22 bp, Homo sapiens
tacagagagtacagcatccaca

SEQ ID NO: 8216606 - DNA, 22 bp, Homo sapiens
tacagcagggcgctgtgatgaa

SEQ ID NO: 8216607 - DNA, 22 bp, Homo sapiens
tacagcatgatcacaatggaaa

SEQ ID NO: 8216608 - DNA, 22 bp, Homo sapiens
tacagcatatacagaatgaaca

SEQ ID NO: 8216609 - DNA, 22 bp, Homo sapiens
tacagagactttatggcacaaa

SEQ ID NO: 8216610 - DNA, 22 bp, Homo sapiens
tacagagacccacaagagactg

SEQ ID NO: 8216611 - DNA, 22 bp, Homo sapiens
tacagagacccacaagagactg

SEQ ID NO: 8216612 - DNA, 20 bp, Homo sapiens
tacagagagctagctctctg

SEQ ID NO: 8216613 - DNA, 22 bp, Homo sapiens
tacagagagataagtgtaaaag

SEQ ID NO: 8216614 - DNA, 22 bp, Homo sapiens
tacagagagataagtgtaaaag

SEQ ID NO: 8216615 - DNA, 22 bp, Homo sapiens
tacagagagataagtgtaaaag

SEQ ID NO: 8216616 - DNA, 22 bp, Homo sapiens
tacagagagataagtgtaaaag

SEQ ID NO: 8216617 - DNA, 22 bp, Homo sapiens
tacagagagaggggttaccagg

SEQ ID NO: 8216618 - DNA, 22 bp, Homo sapiens
tacagagagaggggttaccagg

SEQ ID NO: 8216619 - DNA, 22 bp, Homo sapiens
tacagagagaggggttaccagg

SEQ ID NO: 8216620 - DNA, 22 bp, Homo sapiens
tacagcattttgtagagtacta

SEQ ID NO: 8216621 - DNA, 22 bp, Homo sapiens
tacagccacaggtgactctcat

SEQ ID NO: 8216622 - DNA, 22 bp, Homo sapiens
tacagccatggttaatttacct

SEQ ID NO: 8216623 - DNA, 22 bp, Homo sapiens
tacagctaggcaaaaatgacat

SEQ ID NO: 8216624 - DNA, 22 bp, Homo sapiens
tacagcgatcagtgtcattagc

SEQ ID NO: 8216625 - DNA, 22 bp, Homo sapiens
tacagctcagaacctcactgtc

SEQ ID NO: 8216626 - DNA, 22 bp, Homo sapiens
tacagctccaaaaatcactgtt

SEQ ID NO: 8216627 - DNA, 22 bp, Homo sapiens
tacagcgaaaatttagcttgat

SEQ ID NO: 8216628 - DNA, 22 bp, Homo sapiens
tacagcctcttccctggagtgg

SEQ ID NO: 8216629 - DNA, 22 bp, Homo sapiens
caggcctggagtgcaatggcac

SEQ ID NO: 8216630 - DNA, 22 bp, Homo sapiens
caggcctggagtgcaatggcac

SEQ ID NO: 8216631 - DNA, 22 bp, Homo sapiens
caggcctggagtgcaatggcac

SEQ ID NO: 8216632 - DNA, 22 bp, Homo sapiens
caggcctggagtgcaatggcac

SEQ ID NO: 8216633 - DNA, 22 bp, Homo sapiens
caggcctgtctgcacatgaggc

SEQ ID NO: 8216634 - DNA, 22 bp, Homo sapiens
caggcctgtgagttgaggcccc

SEQ ID NO: 8216635 - DNA, 22 bp, Homo sapiens
caggcctgtgacaccgtgtctg

SEQ ID NO: 8216636 - DNA, 22 bp, Homo sapiens
caggcctgtgacaccgtgtctg

SEQ ID NO: 8216637 - DNA, 22 bp, Homo sapiens
caggcctgtgagttgaggcccc

SEQ ID NO: 8216638 - DNA, 22 bp, Homo sapiens
caggcctgtgagttgaggcccc

SEQ ID NO: 8216639 - DNA, 22 bp, Homo sapiens
caggcctgtgagttgaggcccc

SEQ ID NO: 8216640 - DNA, 22 bp, Homo sapiens
caggcctgtgagttgaggcccc

SEQ ID NO: 8216641 - DNA, 22 bp, Homo sapiens
caggccttgaaggcctgcggga

SEQ ID NO: 8216642 - DNA, 22 bp, Homo sapiens
caggccttagtaggtgctccct

SEQ ID NO: 8216643 - DNA, 22 bp, Homo sapiens
caggccttgcgtcccatggcct

SEQ ID NO: 8216644 - DNA, 22 bp, Homo sapiens
caggccttgcgtcccatggcct

SEQ ID NO: 8216645 - DNA, 22 bp, Homo sapiens
caggccttgggacccagactgg

SEQ ID NO: 8216646 - DNA, 22 bp, Homo sapiens
tacagtttacatgagaggaagc

SEQ ID NO: 8216647 - DNA, 22 bp, Homo sapiens
tacagtttacatgagaggaagc

SEQ ID NO: 8216648 - DNA, 22 bp, Homo sapiens
tacagtttaacactttggagaa

SEQ ID NO: 8216649 - DNA, 22 bp, Homo sapiens
tacagttctagtcaaaaatcac

SEQ ID NO: 8216650 - DNA, 23 bp, Homo sapiens
tacagttatgttcctgggtcact

SEQ ID NO: 8216651 - DNA, 22 bp, Homo sapiens
tacagttatatgtgataagtaa

SEQ ID NO: 8216652 - DNA, 22 bp, Homo sapiens
tacagtttctcattatgctctc

SEQ ID NO: 8216653 - DNA, 22 bp, Homo sapiens
tacagtttctcattatgctctc

SEQ ID NO: 8216654 - DNA, 22 bp, Homo sapiens
tacagtttcccagcagatgcaa

SEQ ID NO: 8216655 - DNA, 22 bp, Homo sapiens
tacagtttcccagcagatgcaa

SEQ ID NO: 8216656 - DNA, 22 bp, Homo sapiens
tacagtttcccagcagatgcaa

SEQ ID NO: 8216657 - DNA, 22 bp, Homo sapiens
tacagtttcccagcagatgcaa

SEQ ID NO: 8216658 - DNA, 22 bp, Homo sapiens
tacagtttagaaccatagatgg

SEQ ID NO: 8216659 - DNA, 22 bp, Homo sapiens
tacagtttagaaccatagatgg

SEQ ID NO: 8216660 - DNA, 22 bp, Homo sapiens
tacagtttctgtccttgtggag

SEQ ID NO: 8216661 - DNA, 22 bp, Homo sapiens
tacagtttgtatggtcaggaat

SEQ ID NO: 8216662 - DNA, 22 bp, Homo sapiens
caggctcactgtaaggtcagct

SEQ ID NO: 8216663 - DNA, 22 bp, Homo sapiens
caggctcaatggccacttgggc

SEQ ID NO: 8216664 - DNA, 22 bp, Homo sapiens
caggctcaaggctgacttccat

SEQ ID NO: 8216665 - DNA, 22 bp, Homo sapiens
caggctcaatggccacttgggc

SEQ ID NO: 8216666 - DNA, 22 bp, Homo sapiens
caggctccagcttcctgctcag

SEQ ID NO: 8216667 - DNA, 22 bp, Homo sapiens
caggctcccacaagctcccagc

SEQ ID NO: 8216668 - DNA, 22 bp, Homo sapiens
caggctccattaatcatcctgc

SEQ ID NO: 8216669 - DNA, 22 bp, Homo sapiens
caggctcccaccctcctgcagc

SEQ ID NO: 8216670 - DNA, 22 bp, Homo sapiens
caggctcccacttggcttaaag

SEQ ID NO: 8216671 - DNA, 22 bp, Homo sapiens
caggctcccgaaatcacccatg

SEQ ID NO: 8216672 - DNA, 22 bp, Homo sapiens
caggctcccgctccactgggca

SEQ ID NO: 8216673 - DNA, 22 bp, Homo sapiens
caggctcggtccagtggcaccc

SEQ ID NO: 8216674 - DNA, 22 bp, Homo sapiens
caggctctaggttagtaggaga

SEQ ID NO: 8216675 - DNA, 22 bp, Homo sapiens
caggctctaggttagtaggaga

SEQ ID NO: 8216676 - DNA, 22 bp, Homo sapiens
caggctctaggttagtaggaga

SEQ ID NO: 8216677 - DNA, 21 bp, Homo sapiens
caggctctgctagaggagcct

SEQ ID NO: 8216678 - DNA, 22 bp, Homo sapiens
caggctctaggttagtaggaga

SEQ ID NO: 8216679 - DNA, 22 bp, Homo sapiens
caggctcggaagtgctggcttt

SEQ ID NO: 8216680 - DNA, 22 bp, Homo sapiens
caggctccttcccagggatggt

SEQ ID NO: 8216681 - DNA, 22 bp, Homo sapiens
caggctccttatcttacaactt

SEQ ID NO: 8216682 - DNA, 17 bp, Homo sapiens
caggctccttccagatt

SEQ ID NO: 8216683 - DNA, 20 bp, Homo sapiens
caggctccgcaggactaggg

SEQ ID NO: 8216684 - DNA, 20 bp, Homo sapiens
caggctccgcaggactaggg

SEQ ID NO: 8216685 - DNA, 22 bp, Homo sapiens
caggctcctcactcatgctccc

SEQ ID NO: 8216686 - DNA, 23 bp, Homo sapiens
caggctcccggaccaggatccgc

SEQ ID NO: 8216687 - DNA, 23 bp, Homo sapiens
caggctcccggaccaggatccgc

SEQ ID NO: 8216688 - DNA, 22 bp, Homo sapiens
caggctcccgctccactgggca

SEQ ID NO: 8216689 - DNA, 22 bp, Homo sapiens
caggctcccgctccactgggca

SEQ ID NO: 8216690 - DNA, 22 bp, Homo sapiens
caggctccctaagtcagcagcc

SEQ ID NO: 8216691 - DNA, 22 bp, Homo sapiens
caggctccctaagtcagcagcc

SEQ ID NO: 8216692 - DNA, 22 bp, Homo sapiens
caggctccctgcaggccagtga

SEQ ID NO: 8216693 - DNA, 22 bp, Homo sapiens
caggctccctgcaggccagtga

SEQ ID NO: 8216694 - DNA, 22 bp, Homo sapiens
caggctccctgcaggccagtga

SEQ ID NO: 8216695 - DNA, 22 bp, Homo sapiens
caggctccctgggcagtggcag

SEQ ID NO: 8216696 - DNA, 22 bp, Homo sapiens
caggctccctgccagggccggc

SEQ ID NO: 8216697 - DNA, 22 bp, Homo sapiens
caggctccctgccagggccggc

SEQ ID NO: 8216698 - DNA, 20 bp, Homo sapiens
caggctccgcaggactaggg

SEQ ID NO: 8216699 - DNA, 22 bp, Homo sapiens
caggctcccttctcggaattct

SEQ ID NO: 8216700 - DNA, 22 bp, Homo sapiens
caggctccctgggcagtggcag

SEQ ID NO: 8216701 - DNA, 22 bp, Homo sapiens
caggctccctgggcagtggcag

SEQ ID NO: 8216702 - DNA, 21 bp, Homo sapiens
tagcaattatagatgtctaaa

SEQ ID NO: 8216703 - DNA, 22 bp, Homo sapiens
cagggatggcctggcgggccac

SEQ ID NO: 8216704 - DNA, 22 bp, Homo sapiens
tagcagcaaaatgaccttctaa

SEQ ID NO: 8216705 - DNA, 22 bp, Homo sapiens
tagcagcaaagcaggatctgct

SEQ ID NO: 8216706 - DNA, 22 bp, Homo sapiens
tagcagcaaagcaggatctgct

SEQ ID NO: 8216707 - DNA, 22 bp, Homo sapiens
tagcagcacagaaagcctggag

SEQ ID NO: 8216708 - DNA, 22 bp, Homo sapiens
tagcagcaatttcagaagtttg

SEQ ID NO: 8216709 - DNA, 22 bp, Homo sapiens
tagcagcaatttcagaagtttg

SEQ ID NO: 8216710 - DNA, 22 bp, Homo sapiens
tagcagcacaaatggactatga

SEQ ID NO: 8216711 - DNA, 22 bp, Homo sapiens
tagcagcaattacacagtccgt

SEQ ID NO: 8216712 - DNA, 22 bp, Homo sapiens
tagcagcaagaatgggatgtgt

SEQ ID NO: 8216713 - DNA, 22 bp, Homo sapiens
tagcagcaagaatgggatgtgt

SEQ ID NO: 8216714 - DNA, 22 bp, Homo sapiens
tagcagcaattcaggtgtgatg

SEQ ID NO: 8216715 - DNA, 22 bp, Homo sapiens
tagcagcaattacacagtccgt

SEQ ID NO: 8216716 - DNA, 22 bp, Homo sapiens
cagggatgagagatggcacaga

SEQ ID NO: 8216717 - DNA, 22 bp, Homo sapiens
cagggatgagagatggcacaga

SEQ ID NO: 8216718 - DNA, 22 bp, Homo sapiens
cagggatgagagatggcacaga

SEQ ID NO: 8216719 - DNA, 22 bp, Homo sapiens
cagggatgagagatggcacaga

SEQ ID NO: 8216720 - DNA, 22 bp, Homo sapiens
cagggatgagcagatggagcaa

SEQ ID NO: 8216721 - DNA, 22 bp, Homo sapiens
cagggatgagcagatggagcaa

SEQ ID NO: 8216722 - DNA, 22 bp, Homo sapiens
cagggatgagcagatggagcaa

SEQ ID NO: 8216723 - DNA, 22 bp, Homo sapiens
cagggatgagcagatggagcaa

SEQ ID NO: 8216724 - DNA, 22 bp, Homo sapiens
cagggatgagagatggcacaga

SEQ ID NO: 8216725 - DNA, 22 bp, Homo sapiens
cagggatgagcagatggagcaa

SEQ ID NO: 8216726 - DNA, 22 bp, Homo sapiens
cagggatggagagactactggc

SEQ ID NO: 8216727 - DNA, 22 bp, Homo sapiens
cagggatggagagactactggc

SEQ ID NO: 8216728 - DNA, 22 bp, Homo sapiens
cagggatggagagactactggc

SEQ ID NO: 8216729 - DNA, 22 bp, Homo sapiens
cagggatggcctggcgggccac

SEQ ID NO: 8216730 - DNA, 22 bp, Homo sapiens
cagggatgctgcttaggcagtt

SEQ ID NO: 8216731 - DNA, 22 bp, Homo sapiens
cagggatgctgcttaggcagtt

SEQ ID NO: 8216732 - DNA, 22 bp, Homo sapiens
cagggatgctgcttaggcagtt

SEQ ID NO: 8216733 - DNA, 22 bp, Homo sapiens
cagggagctttcccaggaccct

SEQ ID NO: 8216734 - DNA, 22 bp, Homo sapiens
cagggagctttcccaggaccct

SEQ ID NO: 8216735 - DNA, 22 bp, Homo sapiens
cagggaggatgggctgttttgc

SEQ ID NO: 8216736 - DNA, 22 bp, Homo sapiens
cagggaggatgggctgttttgc

SEQ ID NO: 8216737 - DNA, 22 bp, Homo sapiens
cagggaggctgtcttatgcctg

SEQ ID NO: 8216738 - DNA, 22 bp, Homo sapiens
cagggagggaggaaaatttgct

SEQ ID NO: 8216739 - DNA, 22 bp, Homo sapiens
cagggagggacaattgtcacct

SEQ ID NO: 8216740 - DNA, 22 bp, Homo sapiens
cagggatgaccagagggatgtg

SEQ ID NO: 8216741 - DNA, 22 bp, Homo sapiens
cagggatgagaaagctctctaa

SEQ ID NO: 8216742 - DNA, 22 bp, Homo sapiens
cagggatgaccagagggatgtg

SEQ ID NO: 8216743 - DNA, 22 bp, Homo sapiens
cagggatgagaaagctctctaa

SEQ ID NO: 8216744 - DNA, 22 bp, Homo sapiens
cagggatgaccagagggatgtg

SEQ ID NO: 8216745 - DNA, 22 bp, Homo sapiens
cagggatgaccagagggatgtg

SEQ ID NO: 8216746 - DNA, 22 bp, Homo sapiens
cagggagtgtacaccatgtgta

SEQ ID NO: 8216747 - DNA, 22 bp, Homo sapiens
cagggagtcaacaaacagatca

SEQ ID NO: 8216748 - DNA, 22 bp, Homo sapiens
cagggcagtaccgccctctggc

SEQ ID NO: 8216749 - DNA, 22 bp, Homo sapiens
cagggcagtaccgccctctggc

SEQ ID NO: 8216750 - DNA, 22 bp, Homo sapiens
cagggcagtgaagaacacacgt

SEQ ID NO: 8216751 - DNA, 22 bp, Homo sapiens
cagggcagtaccgccctctggc

SEQ ID NO: 8216752 - DNA, 22 bp, Homo sapiens
cagggcaggacagatacattac

SEQ ID NO: 8216753 - DNA, 22 bp, Homo sapiens
cagggcaggatgctgtgattat

SEQ ID NO: 8216754 - DNA, 22 bp, Homo sapiens
cagggcaggacagatacattac

SEQ ID NO: 8216755 - DNA, 22 bp, Homo sapiens
cagggcagtaccgccctctggc

SEQ ID NO: 8216756 - DNA, 22 bp, Homo sapiens
cagggcagtaccgccctctggc

SEQ ID NO: 8216757 - DNA, 22 bp, Homo sapiens
cagggcagtaccgccctctggc

SEQ ID NO: 8216758 - DNA, 22 bp, Homo sapiens
cagggcagtgaagaacacacgt

SEQ ID NO: 8216759 - DNA, 22 bp, Homo sapiens
cagggcagtgaagaacacacgt

SEQ ID NO: 8216760 - DNA, 22 bp, Homo sapiens
cagggcagtttgtgcctatgag

SEQ ID NO: 8216761 - DNA, 22 bp, Homo sapiens
cagggcagtttgtgcctatgag

SEQ ID NO: 8216762 - DNA, 22 bp, Homo sapiens
cagggcagtttgtgcctatgag

SEQ ID NO: 8216763 - DNA, 22 bp, Homo sapiens
cagggcagtttgtgcctatgag

SEQ ID NO: 8216764 - DNA, 22 bp, Homo sapiens
cagggcagtttgtgcctatgag

SEQ ID NO: 8216765 - DNA, 22 bp, Homo sapiens
cagggcagtttgtgcctatgag

SEQ ID NO: 8216766 - DNA, 22 bp, Homo sapiens
cagggccaagctgcagcatctg

SEQ ID NO: 8216767 - DNA, 22 bp, Homo sapiens
cagggcatccgtgctccatgct

SEQ ID NO: 8216768 - DNA, 22 bp, Homo sapiens
cagggcatccgtgctccatgct

SEQ ID NO: 8216769 - DNA, 22 bp, Homo sapiens
cagggcataagatgaggctgta

SEQ ID NO: 8216770 - DNA, 22 bp, Homo sapiens
cagggcatctggagtcgggcgg

SEQ ID NO: 8216771 - DNA, 22 bp, Homo sapiens
cagggcatccgtgctccatgct

SEQ ID NO: 8216772 - DNA, 22 bp, Homo sapiens
cagggcatgaggtgtgcttctc

SEQ ID NO: 8216773 - DNA, 22 bp, Homo sapiens
cagggcatgaggtgtgcttctc

SEQ ID NO: 8216774 - DNA, 22 bp, Homo sapiens
cagggcatctggagtcgggcgg

SEQ ID NO: 8216775 - DNA, 22 bp, Homo sapiens
cagggcagttttacttctctct

SEQ ID NO: 8216776 - DNA, 22 bp, Homo sapiens
cagggcagttttacttctctct

SEQ ID NO: 8216777 - DNA, 22 bp, Homo sapiens
cagggcagtttgtgcctatgag

SEQ ID NO: 8216778 - DNA, 22 bp, Homo sapiens
cagggcataagatgaggctgta

SEQ ID NO: 8216779 - DNA, 22 bp, Homo sapiens
cagggcataagatgaggctgta

SEQ ID NO: 8216780 - DNA, 22 bp, Homo sapiens
cagggcagttttacttctctct

SEQ ID NO: 8216781 - DNA, 22 bp, Homo sapiens
tagcagcaggggaaacagctgt

SEQ ID NO: 8216782 - DNA, 20 bp, Homo sapiens
tagcagcagaaagaacttag

SEQ ID NO: 8216783 - DNA, 18 bp, Homo sapiens
tagcagcactggccgctt

SEQ ID NO: 8216784 - DNA, 20 bp, Homo sapiens
tagcagcagaaagaacttag

SEQ ID NO: 8216785 - DNA, 20 bp, Homo sapiens
tagcagcagaaagaacttag

SEQ ID NO: 8216786 - DNA, 22 bp, Homo sapiens
tagcagcacctacacgtcagag

SEQ ID NO: 8216787 - DNA, 22 bp, Homo sapiens
tagcagcacctttctaatctga

SEQ ID NO: 8216788 - DNA, 22 bp, Homo sapiens
tagcataacaggtaagagtgag

SEQ ID NO: 8216789 - DNA, 22 bp, Homo sapiens
tagcagtgtctaggtaggccat

SEQ ID NO: 8216790 - DNA, 22 bp, Homo sapiens
tagcataacaggtaagagtgag

SEQ ID NO: 8216791 - DNA, 22 bp, Homo sapiens
tagcataacaggtaagagtgag

SEQ ID NO: 8216792 - DNA, 22 bp, Homo sapiens
tagcataacaggtaagagtgag

SEQ ID NO: 8216793 - DNA, 22 bp, Homo sapiens
tagcataatttgtagaaaatca

SEQ ID NO: 8216794 - DNA, 22 bp, Homo sapiens
tagcatagcacctgacacagag

SEQ ID NO: 8216795 - DNA, 22 bp, Homo sapiens
tagcatggggagcagaaagtca

SEQ ID NO: 8216796 - DNA, 22 bp, Homo sapiens
tagcattaaaggtaagacatta

SEQ ID NO: 8216797 - DNA, 22 bp, Homo sapiens
tagcattagagatagaaatagt

SEQ ID NO: 8216798 - DNA, 22 bp, Homo sapiens
tagcattaaaggtaagacatta

SEQ ID NO: 8216799 - DNA, 22 bp, Homo sapiens
cagggcaggacagatacattac

SEQ ID NO: 8216800 - DNA, 22 bp, Homo sapiens
cagggcaggacagatacattac

SEQ ID NO: 8216801 - DNA, 22 bp, Homo sapiens
tagcattagtcagatatgtttt

SEQ ID NO: 8216802 - DNA, 22 bp, Homo sapiens
tagaaatgttggtattaacatt

SEQ ID NO: 8216803 - DNA, 22 bp, Homo sapiens
tagaaatgttggtattaacatt

SEQ ID NO: 8216804 - DNA, 22 bp, Homo sapiens
tagaaatgttagatgtattgag

SEQ ID NO: 8216805 - DNA, 22 bp, Homo sapiens
tagaaatgttagatgtattgag

SEQ ID NO: 8216806 - DNA, 22 bp, Homo sapiens
tagaaatgttagatgtattgag

SEQ ID NO: 8216807 - DNA, 22 bp, Homo sapiens
tagaaatgttggtattaacatt

SEQ ID NO: 8216808 - DNA, 22 bp, Homo sapiens
tagaaatgttggtattaacatt

SEQ ID NO: 8216809 - DNA, 22 bp, Homo sapiens
tagaaatgtaggcttcctgaca

SEQ ID NO: 8216810 - DNA, 22 bp, Homo sapiens
tagaaatgtaggcttcctgaca

SEQ ID NO: 8216811 - DNA, 22 bp, Homo sapiens
tagaaatgtgataatagcttaa

SEQ ID NO: 8216812 - DNA, 22 bp, Homo sapiens
cagggagaagtctggtcagtcc

SEQ ID NO: 8216813 - DNA, 22 bp, Homo sapiens
cagggagaagtctggtcagtcc

SEQ ID NO: 8216814 - DNA, 22 bp, Homo sapiens
cagggagaaatctccaggaggt

SEQ ID NO: 8216815 - DNA, 22 bp, Homo sapiens
cagggacagccttggggtggcg

SEQ ID NO: 8216816 - DNA, 22 bp, Homo sapiens
cagggacagccttggggtggcg

SEQ ID NO: 8216817 - DNA, 22 bp, Homo sapiens
cagggacagccttggggtggcg

SEQ ID NO: 8216818 - DNA, 22 bp, Homo sapiens
tagaacataagtcattcatttg

SEQ ID NO: 8216819 - DNA, 22 bp, Homo sapiens
tagaacataagtcattcatttg

SEQ ID NO: 8216820 - DNA, 22 bp, Homo sapiens
tagaacagcatttggctattaa

SEQ ID NO: 8216821 - DNA, 22 bp, Homo sapiens
tagaacagcatttggctattaa

SEQ ID NO: 8216822 - DNA, 22 bp, Homo sapiens
tagaacagagggttgcccagat

SEQ ID NO: 8216823 - DNA, 22 bp, Homo sapiens
tagaacagaaggcaccttctct

SEQ ID NO: 8216824 - DNA, 22 bp, Homo sapiens
tagaacagagttccagtgatca

SEQ ID NO: 8216825 - DNA, 22 bp, Homo sapiens
cagggagaggcatcatagggaa

SEQ ID NO: 8216826 - DNA, 22 bp, Homo sapiens
cagggagaagtctggtcagtcc

SEQ ID NO: 8216827 - DNA, 22 bp, Homo sapiens
cagggagaaatctccaggaggt

SEQ ID NO: 8216828 - DNA, 22 bp, Homo sapiens
cagggagaagtctggtcagtcc

SEQ ID NO: 8216829 - DNA, 22 bp, Homo sapiens
cagggagaggcatcatagggaa

SEQ ID NO: 8216830 - DNA, 22 bp, Homo sapiens
cagggagaggcatcatagggaa

SEQ ID NO: 8216831 - DNA, 22 bp, Homo sapiens
cagggagaggcatcatagggaa

SEQ ID NO: 8216832 - DNA, 22 bp, Homo sapiens
cagggagaggctggtggagtaa

SEQ ID NO: 8216833 - DNA, 22 bp, Homo sapiens
cagggagatcttggctcctggt

SEQ ID NO: 8216834 - DNA, 22 bp, Homo sapiens
cagggagaggctggtggagtaa

SEQ ID NO: 8216835 - DNA, 22 bp, Homo sapiens
cagggagaggctggtggagtaa

SEQ ID NO: 8216836 - DNA, 22 bp, Homo sapiens
cagggagaggctggtggagtaa

SEQ ID NO: 8216837 - DNA, 22 bp, Homo sapiens
tagacagggtggcttagaaaca

SEQ ID NO: 8216838 - DNA, 22 bp, Homo sapiens
tagacagggtggcttagaaaca

SEQ ID NO: 8216839 - DNA, 22 bp, Homo sapiens
tagacaggagtcaggctagaat

SEQ ID NO: 8216840 - DNA, 22 bp, Homo sapiens
tagacaggagtcaggctagaat

SEQ ID NO: 8216841 - DNA, 22 bp, Homo sapiens
tagacatagtttttatgactta

SEQ ID NO: 8216842 - DNA, 22 bp, Homo sapiens
tagacatacagtgcagtacata

SEQ ID NO: 8216843 - DNA, 22 bp, Homo sapiens
tagacatattgtatttacttaa

SEQ ID NO: 8216844 - DNA, 22 bp, Homo sapiens
tagacattaggtaggttcatgg

SEQ ID NO: 8216845 - DNA, 22 bp, Homo sapiens
tagacattatgtattaagttct

SEQ ID NO: 8216846 - DNA, 22 bp, Homo sapiens
tagacatttgtcaagaatgact

SEQ ID NO: 8216847 - DNA, 22 bp, Homo sapiens
tagacatttggagttttatgac

SEQ ID NO: 8216848 - DNA, 22 bp, Homo sapiens
tagacatttggagttttatgac

SEQ ID NO: 8216849 - DNA, 22 bp, Homo sapiens
tagacattatgtattaagttct

SEQ ID NO: 8216850 - DNA, 22 bp, Homo sapiens
tagacattggccattcctgtgg

SEQ ID NO: 8216851 - DNA, 22 bp, Homo sapiens
tagacattggccattcctgtgg

SEQ ID NO: 8216852 - DNA, 22 bp, Homo sapiens
tagacatttctggttattgaca

SEQ ID NO: 8216853 - DNA, 22 bp, Homo sapiens
tagacatttctggttattgaca

SEQ ID NO: 8216854 - DNA, 22 bp, Homo sapiens
tacctcaagttccaggaaagcg

SEQ ID NO: 8216855 - DNA, 22 bp, Homo sapiens
tacctcaagttccaggaaagcg

SEQ ID NO: 8216856 - DNA, 22 bp, Homo sapiens
tacctctctaaacccagggaca

SEQ ID NO: 8216857 - DNA, 22 bp, Homo sapiens
tagaaagacaatgggaagtgct

SEQ ID NO: 8216858 - DNA, 22 bp, Homo sapiens
tagaaacaagtttctctttggg

SEQ ID NO: 8216859 - DNA, 22 bp, Homo sapiens
tagaaagaacttcatgtaaaac

SEQ ID NO: 8216860 - DNA, 22 bp, Homo sapiens
tagaaagaacttcatgtaaaac

SEQ ID NO: 8216861 - DNA, 22 bp, Homo sapiens
tagaaagagctttgcttccttt

SEQ ID NO: 8216862 - DNA, 22 bp, Homo sapiens
tagaaagatctgtaggcaagag

SEQ ID NO: 8216863 - DNA, 22 bp, Homo sapiens
tagaaagagcatagtattataa

SEQ ID NO: 8216864 - DNA, 22 bp, Homo sapiens
tagaaagactgtccagatttca

SEQ ID NO: 8216865 - DNA, 22 bp, Homo sapiens
tagaaagactgtccagatttca

SEQ ID NO: 8216866 - DNA, 22 bp, Homo sapiens
caggctgcagcagcagtggccc

SEQ ID NO: 8216867 - DNA, 22 bp, Homo sapiens
caggctgcagcagcagtggccc

SEQ ID NO: 8216868 - DNA, 22 bp, Homo sapiens
caggctgcagcagcagtggccc

SEQ ID NO: 8216869 - DNA, 22 bp, Homo sapiens
caggctgcagaggcctttcatg

SEQ ID NO: 8216870 - DNA, 22 bp, Homo sapiens
caggctgcagaggcctttcatg

SEQ ID NO: 8216871 - DNA, 22 bp, Homo sapiens
caggctgcagaggcctttcatg

SEQ ID NO: 8216872 - DNA, 22 bp, Homo sapiens
caggctgcaagaaaggcattca

SEQ ID NO: 8216873 - DNA, 22 bp, Homo sapiens
caggctgcaagaaaggcattca

SEQ ID NO: 8216874 - DNA, 22 bp, Homo sapiens
caggctgcaagaaaggcattca

SEQ ID NO: 8216875 - DNA, 22 bp, Homo sapiens
caggctgcaagaaaggcattca

SEQ ID NO: 8216876 - DNA, 22 bp, Homo sapiens
caggctgattaggcctcgtcca

SEQ ID NO: 8216877 - DNA, 22 bp, Homo sapiens
caggctgatagggtccaaagtt

SEQ ID NO: 8216878 - DNA, 22 bp, Homo sapiens
caggctgagggttaggccttag

SEQ ID NO: 8216879 - DNA, 22 bp, Homo sapiens
caggctgaggcagtagggtttg

SEQ ID NO: 8216880 - DNA, 22 bp, Homo sapiens
caggctgattaggcctcgtcca

SEQ ID NO: 8216881 - DNA, 22 bp, Homo sapiens
caggctgattaggcctcgtcca

SEQ ID NO: 8216882 - DNA, 22 bp, Homo sapiens
caggctgatcagggctgggatg

SEQ ID NO: 8216883 - DNA, 22 bp, Homo sapiens
caggctgatcagggctgggatg

SEQ ID NO: 8216884 - DNA, 22 bp, Homo sapiens
caggctgatagggtccaaagtt

SEQ ID NO: 8216885 - DNA, 22 bp, Homo sapiens
caggctgatcagggctgggatg

SEQ ID NO: 8216886 - DNA, 22 bp, Homo sapiens
caggctgatcagggctgggatg

SEQ ID NO: 8216887 - DNA, 22 bp, Homo sapiens
tacccaggaggaaactgaggct

SEQ ID NO: 8216888 - DNA, 22 bp, Homo sapiens
tacccagtgcaactggagtctc

SEQ ID NO: 8216889 - DNA, 22 bp, Homo sapiens
tacccaggagaaacagcagggc

SEQ ID NO: 8216890 - DNA, 22 bp, Homo sapiens
caggctgcagcagcagtggccc

SEQ ID NO: 8216891 - DNA, 22 bp, Homo sapiens
caggctgcagcagcagtggccc

SEQ ID NO: 8216892 - DNA, 22 bp, Homo sapiens
caggctgcagcagcagtggccc

SEQ ID NO: 8216893 - DNA, 22 bp, Homo sapiens
caggctgcagcagcagtggccc

SEQ ID NO: 8216894 - DNA, 22 bp, Homo sapiens
taccctctcccggtccagcttt

SEQ ID NO: 8216895 - DNA, 19 bp, Homo sapiens
taccctcagggcctcattt

SEQ ID NO: 8216896 - DNA, 22 bp, Homo sapiens
tacccagttccacacactgatg

SEQ ID NO: 8216897 - DNA, 22 bp, Homo sapiens
tacccagttattttgtctttgt

SEQ ID NO: 8216898 - DNA, 22 bp, Homo sapiens
tacccagttcagtgtttaaaaa

SEQ ID NO: 8216899 - DNA, 22 bp, Homo sapiens
tacccagtgccaccctctgagg

SEQ ID NO: 8216900 - DNA, 20 bp, Homo sapiens
tacccagtggtggatggtaa

SEQ ID NO: 8216901 - DNA, 20 bp, Homo sapiens
taccctggctatgcttctga

SEQ ID NO: 8216902 - DNA, 22 bp, Homo sapiens
taccctggagcaagtttcctca

SEQ ID NO: 8216903 - DNA, 22 bp, Homo sapiens
tcaaattctattctatactcag

SEQ ID NO: 8216904 - DNA, 22 bp, Homo sapiens
tcaaattgtcatcttgataatg

SEQ ID NO: 8216905 - DNA, 22 bp, Homo sapiens
tcaaattttaacatgcattaga

SEQ ID NO: 8216906 - DNA, 22 bp, Homo sapiens
tcaaattagtggaataataatg

SEQ ID NO: 8216907 - DNA, 22 bp, Homo sapiens
tcaaattagtggaataataatg

SEQ ID NO: 8216908 - DNA, 22 bp, Homo sapiens
tcaaattagtggaataataatg

SEQ ID NO: 8216909 - DNA, 22 bp, Homo sapiens
cagtctttgttcccattactga

SEQ ID NO: 8216910 - DNA, 22 bp, Homo sapiens
cagtctttgttcccattactga

SEQ ID NO: 8216911 - DNA, 22 bp, Homo sapiens
cagtctttgttcccattactga

SEQ ID NO: 8216912 - DNA, 22 bp, Homo sapiens
cagtcttttgtatattagcaga

SEQ ID NO: 8216913 - DNA, 22 bp, Homo sapiens
cagtgaaatagtggacatcaaa

SEQ ID NO: 8216914 - DNA, 22 bp, Homo sapiens
cagtcttttgtatattagcaga

SEQ ID NO: 8216915 - DNA, 22 bp, Homo sapiens
cagtctttgatgcatcctagcc

SEQ ID NO: 8216916 - DNA, 22 bp, Homo sapiens
cagtcttatcctgaaaacaaca

SEQ ID NO: 8216917 - DNA, 22 bp, Homo sapiens
cagtctggcacagcacactgaa

SEQ ID NO: 8216918 - DNA, 22 bp, Homo sapiens
cagtctggcacagcacactgaa

SEQ ID NO: 8216919 - DNA, 22 bp, Homo sapiens
cagtctggcacagcacactgaa

SEQ ID NO: 8216920 - DNA, 22 bp, Homo sapiens
cagtctgtttctgagaaacaga

SEQ ID NO: 8216921 - DNA, 22 bp, Homo sapiens
cagtctgtaatgggttttaaaa

SEQ ID NO: 8216922 - DNA, 22 bp, Homo sapiens
cagtctctaaatcaatctgaat

SEQ ID NO: 8216923 - DNA, 22 bp, Homo sapiens
cagtctctcagctttcagctgt

SEQ ID NO: 8216924 - DNA, 22 bp, Homo sapiens
cagtctctcagctttcagctgt

SEQ ID NO: 8216925 - DNA, 23 bp, Homo sapiens
cagtctctccccggacagcaaaa

SEQ ID NO: 8216926 - DNA, 22 bp, Homo sapiens
cagtctctctccttgcaggcgt

SEQ ID NO: 8216927 - DNA, 22 bp, Homo sapiens
cagtctggaggtcagctggctt

SEQ ID NO: 8216928 - DNA, 22 bp, Homo sapiens
cagtctggactcaggcatacct

SEQ ID NO: 8216929 - DNA, 22 bp, Homo sapiens
cagtcccagctgctcagaaggc

SEQ ID NO: 8216930 - DNA, 22 bp, Homo sapiens
cagtcccagctgctcagaaggc

SEQ ID NO: 8216931 - DNA, 22 bp, Homo sapiens
cagtcccagggttggttcagct

SEQ ID NO: 8216932 - DNA, 22 bp, Homo sapiens
cagtcccatctcccaggtggct

SEQ ID NO: 8216933 - DNA, 22 bp, Homo sapiens
cagtcccatctcccaggtggct

SEQ ID NO: 8216934 - DNA, 22 bp, Homo sapiens
cagtcccatctcccaggtggct

SEQ ID NO: 8216935 - DNA, 22 bp, Homo sapiens
cagtccctgggggagtcaccag

SEQ ID NO: 8216936 - DNA, 22 bp, Homo sapiens
tcaaaggaaacgtggtcctggc

SEQ ID NO: 8216937 - DNA, 20 bp, Homo sapiens
tcaaaggcaaaggtgggtgt

SEQ ID NO: 8216938 - DNA, 22 bp, Homo sapiens
tcaaaggataactgagggcagt

SEQ ID NO: 8216939 - DNA, 22 bp, Homo sapiens
tcaaaggataactgagggcagt

SEQ ID NO: 8216940 - DNA, 22 bp, Homo sapiens
tcaaaggcaccaaggtcactgc

SEQ ID NO: 8216941 - DNA, 19 bp, Homo sapiens
tcaaaggcaaggaggaact

SEQ ID NO: 8216942 - DNA, 22 bp, Homo sapiens
tcaaagcacacttagtggtaga

SEQ ID NO: 8216943 - DNA, 20 bp, Homo sapiens
tcaaagcactgcctgtcatc

SEQ ID NO: 8216944 - DNA, 21 bp, Homo sapiens
tcaaagcacatatttgcacat

SEQ ID NO: 8216945 - DNA, 22 bp, Homo sapiens
tcaaaacctaggctctctgctt

SEQ ID NO: 8216946 - DNA, 22 bp, Homo sapiens
tattcctaatttgcagggcatg

SEQ ID NO: 8216947 - DNA, 20 bp, Homo sapiens
tattccaagggtagagaaaa

SEQ ID NO: 8216948 - DNA, 22 bp, Homo sapiens
tattccaattggttgtaaagaa

SEQ ID NO: 8216949 - DNA, 22 bp, Homo sapiens
tattccaattggttgtaaagaa

SEQ ID NO: 8216950 - DNA, 22 bp, Homo sapiens
tattccatttgggtcaggatga

SEQ ID NO: 8216951 - DNA, 22 bp, Homo sapiens
tattccatgccagagtttattg

SEQ ID NO: 8216952 - DNA, 22 bp, Homo sapiens
tattccagttcaccttttcatc

SEQ ID NO: 8216953 - DNA, 22 bp, Homo sapiens
cagtagacacatttgtttttcc

SEQ ID NO: 8216954 - DNA, 22 bp, Homo sapiens
cagtagacagctgatgatgggc

SEQ ID NO: 8216955 - DNA, 22 bp, Homo sapiens
cagtagacacatttgtttttcc

SEQ ID NO: 8216956 - DNA, 22 bp, Homo sapiens
cagtactttgcatcattccact

SEQ ID NO: 8216957 - DNA, 22 bp, Homo sapiens
cagtactttgaagatattttag

SEQ ID NO: 8216958 - DNA, 22 bp, Homo sapiens
cagtagcaggcaggtgcttttg

SEQ ID NO: 8216959 - DNA, 22 bp, Homo sapiens
cagtagcatgcaccaggagggt

SEQ ID NO: 8216960 - DNA, 22 bp, Homo sapiens
tattccaactgtcatagtcata

SEQ ID NO: 8216961 - DNA, 22 bp, Homo sapiens
tcacacatttgaaggcctgtca

SEQ ID NO: 8216962 - DNA, 16 bp, Homo sapiens
tcacacatttgttggt

SEQ ID NO: 8216963 - DNA, 22 bp, Homo sapiens
tcacacatttctcaagtgtagg

SEQ ID NO: 8216964 - DNA, 22 bp, Homo sapiens
tcacacatttgaaggcctgtca

SEQ ID NO: 8216965 - DNA, 22 bp, Homo sapiens
tcacacatttctcaagtgtagg

SEQ ID NO: 8216966 - DNA, 22 bp, Homo sapiens
tcacacattgttgcttaagttg

SEQ ID NO: 8216967 - DNA, 22 bp, Homo sapiens
tcacacattgttgcttaagttg

SEQ ID NO: 8216968 - DNA, 22 bp, Homo sapiens
tcacacattgttgcttaagttg

SEQ ID NO: 8216969 - DNA, 22 bp, Homo sapiens
tcacacattctaggtatgttga

SEQ ID NO: 8216970 - DNA, 22 bp, Homo sapiens
tcacacattctaggtatgttga

SEQ ID NO: 8216971 - DNA, 22 bp, Homo sapiens
tcacacatgtaagggctttgga

SEQ ID NO: 8216972 - DNA, 22 bp, Homo sapiens
tcacacatgtaagggctttgga

SEQ ID NO: 8216973 - DNA, 20 bp, Homo sapiens
tcacacatggtaagctatga

SEQ ID NO: 8216974 - DNA, 22 bp, Homo sapiens
cagtgcatagatcctgaggcct

SEQ ID NO: 8216975 - DNA, 20 bp, Homo sapiens
tcacacatggtaagctatga

SEQ ID NO: 8216976 - DNA, 22 bp, Homo sapiens
cagtgcatagatcctgaggcct

SEQ ID NO: 8216977 - DNA, 22 bp, Homo sapiens
cagtgcagtttcccagatgctg

SEQ ID NO: 8216978 - DNA, 22 bp, Homo sapiens
cagtgcagtttcccagatgctg

SEQ ID NO: 8216979 - DNA, 22 bp, Homo sapiens
cagtgcagttggtggcaggggt

SEQ ID NO: 8216980 - DNA, 22 bp, Homo sapiens
cagtgcagttggtggcaggggt

SEQ ID NO: 8216981 - DNA, 22 bp, Homo sapiens
cagtgcagttggtggcaggggt

SEQ ID NO: 8216982 - DNA, 22 bp, Homo sapiens
cagtgcagttggtggcaggggt

SEQ ID NO: 8216983 - DNA, 22 bp, Homo sapiens
cagtgcagttggtggcaggggt

SEQ ID NO: 8216984 - DNA, 22 bp, Homo sapiens
cagtgcagtcaaggaagaacca

SEQ ID NO: 8216985 - DNA, 22 bp, Homo sapiens
cagtgcaggtttagggctgggg

SEQ ID NO: 8216986 - DNA, 22 bp, Homo sapiens
cagtgcaggtttagggctgggg

SEQ ID NO: 8216987 - DNA, 22 bp, Homo sapiens
cagtgcaggtttagggctgggg

SEQ ID NO: 8216988 - DNA, 22 bp, Homo sapiens
cagtgcaggtggcagaggacag

SEQ ID NO: 8216989 - DNA, 22 bp, Homo sapiens
cagtgcaggtggcagaggacag

SEQ ID NO: 8216990 - DNA, 22 bp, Homo sapiens
tcacactggcagtgctgaaggc

SEQ ID NO: 8216991 - DNA, 22 bp, Homo sapiens
tcacactggcagtgctgaaggc

SEQ ID NO: 8216992 - DNA, 23 bp, Homo sapiens
tcacactggatacacatgcaaga

SEQ ID NO: 8216993 - DNA, 23 bp, Homo sapiens
tcacactggatacacatgcaaga

SEQ ID NO: 8216994 - DNA, 22 bp, Homo sapiens
tcacacctgtaatcccaggcct

SEQ ID NO: 8216995 - DNA, 22 bp, Homo sapiens
tcacaccttgctggctgagtgc

SEQ ID NO: 8216996 - DNA, 22 bp, Homo sapiens
tcacactaagacaaaataattt

SEQ ID NO: 8216997 - DNA, 22 bp, Homo sapiens
cagtgctgttgtaagctcattg

SEQ ID NO: 8216998 - DNA, 22 bp, Homo sapiens
tcacacttagagcgaattgttt

SEQ ID NO: 8216999 - DNA, 22 bp, Homo sapiens
tcacactgtgaagagacaagca

SEQ ID NO: 8217000 - DNA, 22 bp, Homo sapiens
tcacactgtgaagagacaagca

SEQ ID NO: 8217001 - DNA, 22 bp, Homo sapiens
cagtgctgttgtaagctcattg

SEQ ID NO: 8217002 - DNA, 22 bp, Homo sapiens
cagtgctgttgtaagctcattg

SEQ ID NO: 8217003 - DNA, 22 bp, Homo sapiens
cagtgctgttgtaagctcattg

SEQ ID NO: 8217004 - DNA, 22 bp, Homo sapiens
cagtgctgttgtaagctcattg

SEQ ID NO: 8217005 - DNA, 19 bp, Homo sapiens
cagtggagattggaggagg

SEQ ID NO: 8217006 - DNA, 19 bp, Homo sapiens
cagtggagattggaggagg

SEQ ID NO: 8217007 - DNA, 19 bp, Homo sapiens
cagtggagattggaggagg

SEQ ID NO: 8217008 - DNA, 19 bp, Homo sapiens
cagtggagattggaggagg

SEQ ID NO: 8217009 - DNA, 22 bp, Homo sapiens
cagtggcaagtccggtattgaa

SEQ ID NO: 8217010 - DNA, 22 bp, Homo sapiens
cagtggcaaggacagtaataat

SEQ ID NO: 8217011 - DNA, 22 bp, Homo sapiens
cagtggattagccagagctgga

SEQ ID NO: 8217012 - DNA, 22 bp, Homo sapiens
cagtggattaaggagggcagct

SEQ ID NO: 8217013 - DNA, 22 bp, Homo sapiens
cagtggattagccagagctgga

SEQ ID NO: 8217014 - DNA, 22 bp, Homo sapiens
cagtggcaagaacagtaataat

SEQ ID NO: 8217015 - DNA, 22 bp, Homo sapiens
cagtggcaatgggacagagcac

SEQ ID NO: 8217016 - DNA, 22 bp, Homo sapiens
cagtggcaatgggacagagcac

SEQ ID NO: 8217017 - DNA, 22 bp, Homo sapiens
tcacatgcttgaggaaagaaaa

SEQ ID NO: 8217018 - DNA, 22 bp, Homo sapiens
cagtggcaagtccggtattgaa

SEQ ID NO: 8217019 - DNA, 22 bp, Homo sapiens
tcacatgtatatgcagcacagc

SEQ ID NO: 8217020 - DNA, 22 bp, Homo sapiens
tcacatgtatatgcagcacagc

SEQ ID NO: 8217021 - DNA, 22 bp, Homo sapiens
cagtggagtgggactggtctga

SEQ ID NO: 8217022 - DNA, 22 bp, Homo sapiens
cagtggaggctcaagtgtgctt

SEQ ID NO: 8217023 - DNA, 22 bp, Homo sapiens
cagtggaggctcaagtgtgctt

SEQ ID NO: 8217024 - DNA, 22 bp, Homo sapiens
cagtggaggctcaagtgtgctt

SEQ ID NO: 8217025 - DNA, 22 bp, Homo sapiens
cagtggagtgggactggtctga

SEQ ID NO: 8217026 - DNA, 22 bp, Homo sapiens
cagtggatgatttggctgctag

SEQ ID NO: 8217027 - DNA, 22 bp, Homo sapiens
cagtggatggtttgtcttgcct

SEQ ID NO: 8217028 - DNA, 22 bp, Homo sapiens
cagtggaggccttgggaccttt

SEQ ID NO: 8217029 - DNA, 19 bp, Homo sapiens
cagtggagattggaggagg

SEQ ID NO: 8217030 - DNA, 22 bp, Homo sapiens
cagtggaggctcaagtgtgctt

SEQ ID NO: 8217031 - DNA, 22 bp, Homo sapiens
cagtggcagagaacagagacct

SEQ ID NO: 8217032 - DNA, 22 bp, Homo sapiens
cagtggcagagaacagagacct

SEQ ID NO: 8217033 - DNA, 22 bp, Homo sapiens
cagtggcagagaacagagacct

SEQ ID NO: 8217034 - DNA, 22 bp, Homo sapiens
cagtggcacttgtcatttctga

SEQ ID NO: 8217035 - DNA, 22 bp, Homo sapiens
cagtggcacttgtcatttctga

SEQ ID NO: 8217036 - DNA, 22 bp, Homo sapiens
cagtggcagagaacagagacct

SEQ ID NO: 8217037 - DNA, 22 bp, Homo sapiens
cagtggcagagaacagagacct

SEQ ID NO: 8217038 - DNA, 22 bp, Homo sapiens
cagtggcaggatttcagctcag

SEQ ID NO: 8217039 - DNA, 17 bp, Homo sapiens
cagtggcagatcttctc

SEQ ID NO: 8217040 - DNA, 22 bp, Homo sapiens
cagtggcagagccgttgccatc

SEQ ID NO: 8217041 - DNA, 22 bp, Homo sapiens
cagtggcagatcaccaactgga

SEQ ID NO: 8217042 - DNA, 22 bp, Homo sapiens
cagtggtttaggtcaaggggag

SEQ ID NO: 8217043 - DNA, 22 bp, Homo sapiens
cagtggttgtcagcaacaatat

SEQ ID NO: 8217044 - DNA, 22 bp, Homo sapiens
cagtggtttaggtcaaggggag

SEQ ID NO: 8217045 - DNA, 22 bp, Homo sapiens
cagtggttggtagatacttgag

SEQ ID NO: 8217046 - DNA, 22 bp, Homo sapiens
cagtggttgcttgcatggctcc

SEQ ID NO: 8217047 - DNA, 22 bp, Homo sapiens
cagtggttggtagatacttgag

SEQ ID NO: 8217048 - DNA, 22 bp, Homo sapiens
cagtggcaggatttcagctcag

SEQ ID NO: 8217049 - DNA, 22 bp, Homo sapiens
cagtgggtcctgcgtctgccag

SEQ ID NO: 8217050 - DNA, 21 bp, Homo sapiens
cagtggttgctgaattagtgg

SEQ ID NO: 8217051 - DNA, 22 bp, Homo sapiens
cagtgggtgatgagtcctgggg

SEQ ID NO: 8217052 - DNA, 22 bp, Homo sapiens
cagtgggtgaaagatggctaag

SEQ ID NO: 8217053 - DNA, 22 bp, Homo sapiens
cagtgggtgagaggaaaagctt

SEQ ID NO: 8217054 - DNA, 22 bp, Homo sapiens
tcactgcactccagcactcagg

SEQ ID NO: 8217055 - DNA, 21 bp, Homo sapiens
tcactgcaatgctaggagaaa

SEQ ID NO: 8217056 - DNA, 22 bp, Homo sapiens
tcactgcactccagcctgggca

SEQ ID NO: 8217057 - DNA, 22 bp, Homo sapiens
tcactgcactccagcctgggtg

SEQ ID NO: 8217058 - DNA, 22 bp, Homo sapiens
tcactgcaggtttttcaggagg

SEQ ID NO: 8217059 - DNA, 22 bp, Homo sapiens
tcactgcagcctctgcctcccg

SEQ ID NO: 8217060 - DNA, 22 bp, Homo sapiens
tcactgcagagacctctagtca

SEQ ID NO: 8217061 - DNA, 22 bp, Homo sapiens
tcactgcacttcagcttgggca

SEQ ID NO: 8217062 - DNA, 22 bp, Homo sapiens
tcactgcagacaacctcagtca

SEQ ID NO: 8217063 - DNA, 22 bp, Homo sapiens
cagtggcacccacgggctgggc

SEQ ID NO: 8217064 - DNA, 22 bp, Homo sapiens
cagtggcacatggaccttgtca

SEQ ID NO: 8217065 - DNA, 22 bp, Homo sapiens
cagtggcacatggaccttgtca

SEQ ID NO: 8217066 - DNA, 22 bp, Homo sapiens
cagtggcaatgggacagagcac

SEQ ID NO: 8217067 - DNA, 22 bp, Homo sapiens
cagtggcaatgggacagagcac

SEQ ID NO: 8217068 - DNA, 22 bp, Homo sapiens
cagtggcaatgggacagagcac

SEQ ID NO: 8217069 - DNA, 22 bp, Homo sapiens
cagtggcaatgggacagagcac

SEQ ID NO: 8217070 - DNA, 22 bp, Homo sapiens
cagtggcacccacgggctgggc

SEQ ID NO: 8217071 - DNA, 22 bp, Homo sapiens
cagtggcacccacgggctgggc

SEQ ID NO: 8217072 - DNA, 22 bp, Homo sapiens
cagtggcacgatctcagctcac

SEQ ID NO: 8217073 - DNA, 22 bp, Homo sapiens
cagtggcacgatctcagctcac

SEQ ID NO: 8217074 - DNA, 21 bp, Homo sapiens
cagtggcacgatttcggctca

SEQ ID NO: 8217075 - DNA, 22 bp, Homo sapiens
tcactctgaatggtactgagga

SEQ ID NO: 8217076 - DNA, 22 bp, Homo sapiens
tcactctgaatggtactgagga

SEQ ID NO: 8217077 - DNA, 22 bp, Homo sapiens
tcactcctcattgctgcccatt

SEQ ID NO: 8217078 - DNA, 22 bp, Homo sapiens
tcactcctcattgctgcccatt

SEQ ID NO: 8217079 - DNA, 22 bp, Homo sapiens
tcactcctcattgctgcccatt

SEQ ID NO: 8217080 - DNA, 22 bp, Homo sapiens
tcactgcaacctccgcctgctg

SEQ ID NO: 8217081 - DNA, 22 bp, Homo sapiens
tcactgcaacctctgcctcccg

SEQ ID NO: 8217082 - DNA, 22 bp, Homo sapiens
tcactgcaacctccacctcctg

SEQ ID NO: 8217083 - DNA, 22 bp, Homo sapiens
tcactgcaacctccacctcctg

SEQ ID NO: 8217084 - DNA, 22 bp, Homo sapiens
tcactgcaagctcagcctcccg

SEQ ID NO: 8217085 - DNA, 22 bp, Homo sapiens
tcactgcaagctccacctcccg

SEQ ID NO: 8217086 - DNA, 22 bp, Homo sapiens
tcactgcaacctctgccttccg

SEQ ID NO: 8217087 - DNA, 22 bp, Homo sapiens
tcactgcaacctctgcctgcca

SEQ ID NO: 8217088 - DNA, 22 bp, Homo sapiens
tcactgcaacctctgcctcttg

SEQ ID NO: 8217089 - DNA, 22 bp, Homo sapiens
tcactgcaagctctgccttccg

SEQ ID NO: 8217090 - DNA, 22 bp, Homo sapiens
tcactgcaagctcctcctcctg

SEQ ID NO: 8217091 - DNA, 22 bp, Homo sapiens
tcactgcaaggaggcttctcaa

SEQ ID NO: 8217092 - DNA, 22 bp, Homo sapiens
tcactgcaatctcagcctcctg

SEQ ID NO: 8217093 - DNA, 22 bp, Homo sapiens
tcactgcaatctctgccttcca

SEQ ID NO: 8217094 - DNA, 22 bp, Homo sapiens
tcacatgtgttttctcaccaac

SEQ ID NO: 8217095 - DNA, 22 bp, Homo sapiens
tcacatgttaggtcgggcaagg

SEQ ID NO: 8217096 - DNA, 22 bp, Homo sapiens
tcacatgtgtggcagtgcaagt

SEQ ID NO: 8217097 - DNA, 22 bp, Homo sapiens
tcacatgtgtggcagtgcaagt

SEQ ID NO: 8217098 - DNA, 22 bp, Homo sapiens
tcacatgtgtggcagtgcaagt

SEQ ID NO: 8217099 - DNA, 22 bp, Homo sapiens
tcacatgtgtggcagtgcaagt

SEQ ID NO: 8217100 - DNA, 22 bp, Homo sapiens
tcacatgtcagaataagtgcat

SEQ ID NO: 8217101 - DNA, 22 bp, Homo sapiens
tcacatgtatatgcagcacagc

SEQ ID NO: 8217102 - DNA, 22 bp, Homo sapiens
tatgtacatggagagcaattga

SEQ ID NO: 8217103 - DNA, 22 bp, Homo sapiens
tatgtacatgatttcatttgct

SEQ ID NO: 8217104 - DNA, 22 bp, Homo sapiens
tatgtacatgatttcatttgct

SEQ ID NO: 8217105 - DNA, 22 bp, Homo sapiens
tatgtacatggagagcaattga

SEQ ID NO: 8217106 - DNA, 22 bp, Homo sapiens
tatgtacatgttaaagggcaaa

SEQ ID NO: 8217107 - DNA, 22 bp, Homo sapiens
tatgtacatgttaaagggcaaa

SEQ ID NO: 8217108 - DNA, 22 bp, Homo sapiens
tatgtacatggagagcaattga

SEQ ID NO: 8217109 - DNA, 22 bp, Homo sapiens
tatgtacatggagagcaattga

SEQ ID NO: 8217110 - DNA, 22 bp, Homo sapiens
tatgtacatggagagcaattga

SEQ ID NO: 8217111 - DNA, 22 bp, Homo sapiens
cagtaaaaatgttgtcaaggca

SEQ ID NO: 8217112 - DNA, 22 bp, Homo sapiens
cagtaaaagatggaaatagaat

SEQ ID NO: 8217113 - DNA, 22 bp, Homo sapiens
tatgtacatgatttcatttgct

SEQ ID NO: 8217114 - DNA, 22 bp, Homo sapiens
tatgtacatcttgagcaatgaa

SEQ ID NO: 8217115 - DNA, 22 bp, Homo sapiens
tatgtacatcttgagcaatgaa

SEQ ID NO: 8217116 - DNA, 22 bp, Homo sapiens
tatgtacatcttgagcaatgaa

SEQ ID NO: 8217117 - DNA, 22 bp, Homo sapiens
tatgtacatcgttgaattcaaa

SEQ ID NO: 8217118 - DNA, 22 bp, Homo sapiens
tatgtacatcgttgaattcaaa

SEQ ID NO: 8217119 - DNA, 22 bp, Homo sapiens
tatgtacatcgttgaattcaaa

SEQ ID NO: 8217120 - DNA, 22 bp, Homo sapiens
tatgtacatcttgagcaatgaa

SEQ ID NO: 8217121 - DNA, 22 bp, Homo sapiens
tatgtacatcttgagcaatgaa

SEQ ID NO: 8217122 - DNA, 22 bp, Homo sapiens
cagtacatttcatatgattcta

SEQ ID NO: 8217123 - DNA, 22 bp, Homo sapiens
cagtacataatgcgcaaaaccg

SEQ ID NO: 8217124 - DNA, 22 bp, Homo sapiens
cagtacttatttctatttaggg

SEQ ID NO: 8217125 - DNA, 22 bp, Homo sapiens
cagtaaaagatggaaatagaat

SEQ ID NO: 8217126 - DNA, 22 bp, Homo sapiens
cagtaaaagatggaaatagaat

SEQ ID NO: 8217127 - DNA, 22 bp, Homo sapiens
cagtaattccaagtgcttatac

SEQ ID NO: 8217128 - DNA, 23 bp, Homo sapiens
cagtacaatgtggaaaaggagtg

SEQ ID NO: 8217129 - DNA, 22 bp, Homo sapiens
cagtaattccaagtgcttatac

SEQ ID NO: 8217130 - DNA, 22 bp, Homo sapiens
cagtacacaagctttcatgtat

SEQ ID NO: 8217131 - DNA, 22 bp, Homo sapiens
caggtgggcttgggagaacact

SEQ ID NO: 8217132 - DNA, 22 bp, Homo sapiens
caggtggggagagtgtggagca

SEQ ID NO: 8217133 - DNA, 22 bp, Homo sapiens
caggtggggagagtgtggagca

SEQ ID NO: 8217134 - DNA, 22 bp, Homo sapiens
caggtgggcttgggagaacact

SEQ ID NO: 8217135 - DNA, 22 bp, Homo sapiens
caggtggcttattagggtcagt

SEQ ID NO: 8217136 - DNA, 22 bp, Homo sapiens
tatgcacacatgtatgcatgtg

SEQ ID NO: 8217137 - DNA, 22 bp, Homo sapiens
caggtggcttattagggtcagt

SEQ ID NO: 8217138 - DNA, 22 bp, Homo sapiens
caggtgggcgtggcgagaaggc

SEQ ID NO: 8217139 - DNA, 22 bp, Homo sapiens
caggtgggcgtggcgagaaggc

SEQ ID NO: 8217140 - DNA, 22 bp, Homo sapiens
caggtggggagagtgtggagca

SEQ ID NO: 8217141 - DNA, 22 bp, Homo sapiens
caggtggggagagtgtggagca

SEQ ID NO: 8217142 - DNA, 22 bp, Homo sapiens
caggtggggcgccctcaggcag

SEQ ID NO: 8217143 - DNA, 22 bp, Homo sapiens
caggtggggcgccctcaggcag

SEQ ID NO: 8217144 - DNA, 22 bp, Homo sapiens
caggtggggcagctgtgggagc

SEQ ID NO: 8217145 - DNA, 22 bp, Homo sapiens
caggtggggcagctgtgggagc

SEQ ID NO: 8217146 - DNA, 22 bp, Homo sapiens
caggtggggcagctgtgggagc

SEQ ID NO: 8217147 - DNA, 22 bp, Homo sapiens
caggtggggcgccctcaggcag

SEQ ID NO: 8217148 - DNA, 22 bp, Homo sapiens
caggtggggcgccctcaggcag

SEQ ID NO: 8217149 - DNA, 22 bp, Homo sapiens
caggtggggcgccctcaggcag

SEQ ID NO: 8217150 - DNA, 22 bp, Homo sapiens
tatgtacatcgttgaattcaaa

SEQ ID NO: 8217151 - DNA, 22 bp, Homo sapiens
tatgtacatcgttgaattcaaa

SEQ ID NO: 8217152 - DNA, 22 bp, Homo sapiens
tatgatttgtagacatttgatt

SEQ ID NO: 8217153 - DNA, 22 bp, Homo sapiens
tatgcaaacagttcaggtgaca

SEQ ID NO: 8217154 - DNA, 22 bp, Homo sapiens
tatgatgtgtacctaagtcacc

SEQ ID NO: 8217155 - DNA, 22 bp, Homo sapiens
tatgcaaagccacccagggacg

SEQ ID NO: 8217156 - DNA, 22 bp, Homo sapiens
tatgcaaatgactggtatgttt

SEQ ID NO: 8217157 - DNA, 22 bp, Homo sapiens
tatgcacaatatgatctatttg

SEQ ID NO: 8217158 - DNA, 22 bp, Homo sapiens
tatgcaaatgactggtatgttt

SEQ ID NO: 8217159 - DNA, 22 bp, Homo sapiens
tatgcaaatcattagatttcct

SEQ ID NO: 8217160 - DNA, 22 bp, Homo sapiens
tatgatatgcactttatcagaa

SEQ ID NO: 8217161 - DNA, 22 bp, Homo sapiens
tatgaagatatatctgatctct

SEQ ID NO: 8217162 - DNA, 22 bp, Homo sapiens
tatgaagatatatctgatctct

SEQ ID NO: 8217163 - DNA, 20 bp, Homo sapiens
tatgaagatatgtgaacagc

SEQ ID NO: 8217164 - DNA, 22 bp, Homo sapiens
tatgatgggaggaatggaattt

SEQ ID NO: 8217165 - DNA, 22 bp, Homo sapiens
tatgatattctaaattgacacc

SEQ ID NO: 8217166 - DNA, 22 bp, Homo sapiens
tatgatattctaaattgacacc

SEQ ID NO: 8217167 - DNA, 19 bp, Homo sapiens
tatgaagaatgtggcaaag

SEQ ID NO: 8217168 - DNA, 22 bp, Homo sapiens
tatgaagaagacaaatgacact

SEQ ID NO: 8217169 - DNA, 22 bp, Homo sapiens
tatgaacattttggtatatatg

SEQ ID NO: 8217170 - DNA, 22 bp, Homo sapiens
tatgaacatgctgtggttataa

SEQ ID NO: 8217171 - DNA, 23 bp, Homo sapiens
tatgaactgcattgctggtgtgt

SEQ ID NO: 8217172 - DNA, 22 bp, Homo sapiens
tatgaactgctcttgtgttttg

SEQ ID NO: 8217173 - DNA, 22 bp, Homo sapiens
tatgaactgtgagtgtgatggg

SEQ ID NO: 8217174 - DNA, 22 bp, Homo sapiens
tatgaactgtactgtactaagc

SEQ ID NO: 8217175 - DNA, 22 bp, Homo sapiens
tatgaactgtgagtgtgatggg

SEQ ID NO: 8217176 - DNA, 22 bp, Homo sapiens
tatgaacttttgatgtgacatg

SEQ ID NO: 8217177 - DNA, 22 bp, Homo sapiens
tatgaagaagacaaatgacact

SEQ ID NO: 8217178 - DNA, 22 bp, Homo sapiens
tatattgtagctgatgacaaat

SEQ ID NO: 8217179 - DNA, 22 bp, Homo sapiens
tatctgtagtcagaataatttt

SEQ ID NO: 8217180 - DNA, 22 bp, Homo sapiens
tatattgtaggtgctatttgaa

SEQ ID NO: 8217181 - DNA, 22 bp, Homo sapiens
tatattgagatttgagcattgt

SEQ ID NO: 8217182 - DNA, 22 bp, Homo sapiens
tatattgaccagtacaattggt

SEQ ID NO: 8217183 - DNA, 22 bp, Homo sapiens
tatattcttaccagtgtatgta

SEQ ID NO: 8217184 - DNA, 22 bp, Homo sapiens
tatattcttaccagtgtatgta

SEQ ID NO: 8217185 - DNA, 22 bp, Homo sapiens
tatattctttcaccttcttcct

SEQ ID NO: 8217186 - DNA, 22 bp, Homo sapiens
tatattcttaccagtgtatgta

SEQ ID NO: 8217187 - DNA, 18 bp, Homo sapiens
tatattctgtgccctggt

SEQ ID NO: 8217188 - DNA, 18 bp, Homo sapiens
tatattctgtgccctggt

SEQ ID NO: 8217189 - DNA, 22 bp, Homo sapiens
tatattctgattccatctgtgt

SEQ ID NO: 8217190 - DNA, 22 bp, Homo sapiens
tatattctgattccatctgtgt

SEQ ID NO: 8217191 - DNA, 22 bp, Homo sapiens
tatattcattttaaagccatct

SEQ ID NO: 8217192 - DNA, 22 bp, Homo sapiens
tatattctattgtacctctcct

SEQ ID NO: 8217193 - DNA, 22 bp, Homo sapiens
tatattctgattccatctgtgt

SEQ ID NO: 8217194 - DNA, 22 bp, Homo sapiens
cagggccaagttggtgcctttt

SEQ ID NO: 8217195 - DNA, 22 bp, Homo sapiens
cagggccaagctgcagcatctg

SEQ ID NO: 8217196 - DNA, 21 bp, Homo sapiens
cagggccaatcctgacctcta

SEQ ID NO: 8217197 - DNA, 21 bp, Homo sapiens
cagggccaatcctgacctcta

SEQ ID NO: 8217198 - DNA, 22 bp, Homo sapiens
cagggccactgcatgaggttca

SEQ ID NO: 8217199 - DNA, 22 bp, Homo sapiens
cagggccaccctctgctgggtg

SEQ ID NO: 8217200 - DNA, 22 bp, Homo sapiens
cagggccaccctctgctgggtg

SEQ ID NO: 8217201 - DNA, 22 bp, Homo sapiens
tagtaacttttgttataaatca

SEQ ID NO: 8217202 - DNA, 22 bp, Homo sapiens
tagtaacaacaactagcatttt

SEQ ID NO: 8217203 - DNA, 22 bp, Homo sapiens
tagtaaatctcagaaaaagatc

SEQ ID NO: 8217204 - DNA, 22 bp, Homo sapiens
tagtaaatctcagaaaaagatc

SEQ ID NO: 8217205 - DNA, 22 bp, Homo sapiens
tagtaaatctcagaaaaagatc

SEQ ID NO: 8217206 - DNA, 22 bp, Homo sapiens
taggtatacagagatttctggg

SEQ ID NO: 8217207 - DNA, 22 bp, Homo sapiens
taggtatacagagatttctggg

SEQ ID NO: 8217208 - DNA, 22 bp, Homo sapiens
tagtaaatacacagtggaaaaa

SEQ ID NO: 8217209 - DNA, 22 bp, Homo sapiens
tagtaaattaaaatattgactt

SEQ ID NO: 8217210 - DNA, 17 bp, Homo sapiens
tagtaaatgagtagagc

SEQ ID NO: 8217211 - DNA, 22 bp, Homo sapiens
tagtaaattaaaatattgactt

SEQ ID NO: 8217212 - DNA, 22 bp, Homo sapiens
tagtgattttcatattacatta

SEQ ID NO: 8217213 - DNA, 22 bp, Homo sapiens
tagtgattttcatattacatta

SEQ ID NO: 8217214 - DNA, 22 bp, Homo sapiens
tagtgattttctgtttccatca

SEQ ID NO: 8217215 - DNA, 22 bp, Homo sapiens
tagtgtctattgaccggaaaga

SEQ ID NO: 8217216 - DNA, 22 bp, Homo sapiens
tagtgtctagtgagtttgatgc

SEQ ID NO: 8217217 - DNA, 22 bp, Homo sapiens
tagtgtctgaatgcacctgttt

SEQ ID NO: 8217218 - DNA, 22 bp, Homo sapiens
tagtgtctcttcctgtttgaaa

SEQ ID NO: 8217219 - DNA, 22 bp, Homo sapiens
tagtgtctcggggcccaggatt

SEQ ID NO: 8217220 - DNA, 22 bp, Homo sapiens
cagggctggatttcatttctag

SEQ ID NO: 8217221 - DNA, 22 bp, Homo sapiens
tagtgattctgatgtaagacaa

SEQ ID NO: 8217222 - DNA, 22 bp, Homo sapiens
tagtgattctgtgagcctttac

SEQ ID NO: 8217223 - DNA, 22 bp, Homo sapiens
tagtgattgctgatattccatt

SEQ ID NO: 8217224 - DNA, 22 bp, Homo sapiens
tagtgatttaatggcaagagga

SEQ ID NO: 8217225 - DNA, 22 bp, Homo sapiens
tagtgatttaagaaaggtgact

SEQ ID NO: 8217226 - DNA, 23 bp, Homo sapiens
tagtgattggaaaaactagtttt

SEQ ID NO: 8217227 - DNA, 22 bp, Homo sapiens
tagtgatttcagtgggttttgc

SEQ ID NO: 8217228 - DNA, 22 bp, Homo sapiens
tagtgatttagaattcaaatgt

SEQ ID NO: 8217229 - DNA, 22 bp, Homo sapiens
tagtgatttccatttcagggtt

SEQ ID NO: 8217230 - DNA, 22 bp, Homo sapiens
cagggctggatcctccagactc

SEQ ID NO: 8217231 - DNA, 22 bp, Homo sapiens
cagggctggatcctccagactc

SEQ ID NO: 8217232 - DNA, 22 bp, Homo sapiens
cagggctggatcctccagactc

SEQ ID NO: 8217233 - DNA, 22 bp, Homo sapiens
cagggctgctggccgtgccctc

SEQ ID NO: 8217234 - DNA, 22 bp, Homo sapiens
cagggctgctggccgtgccctc

SEQ ID NO: 8217235 - DNA, 22 bp, Homo sapiens
cagggctgctggccgtgccctc

SEQ ID NO: 8217236 - DNA, 22 bp, Homo sapiens
cagggctgctggccgtgccctc

SEQ ID NO: 8217237 - DNA, 22 bp, Homo sapiens
cagggctgctggccgtgccctc

SEQ ID NO: 8217238 - DNA, 22 bp, Homo sapiens
cagggctggatcctccagactc

SEQ ID NO: 8217239 - DNA, 22 bp, Homo sapiens
tagtacactaccatcaggtttt

SEQ ID NO: 8217240 - DNA, 22 bp, Homo sapiens
tagtacaactcacttgatttta

SEQ ID NO: 8217241 - DNA, 22 bp, Homo sapiens
tagtacagagacactggaggaa

SEQ ID NO: 8217242 - DNA, 22 bp, Homo sapiens
tagtacagtactgggctctagt

SEQ ID NO: 8217243 - DNA, 22 bp, Homo sapiens
cagggctgaggacacaagtaaa

SEQ ID NO: 8217244 - DNA, 22 bp, Homo sapiens
cagggctgagaatttagagaca

SEQ ID NO: 8217245 - DNA, 22 bp, Homo sapiens
cagggctgagaatttagagaca

SEQ ID NO: 8217246 - DNA, 22 bp, Homo sapiens
cagggctgagtcatatagcctt

SEQ ID NO: 8217247 - DNA, 22 bp, Homo sapiens
cagggctgagtcatatagcctt

SEQ ID NO: 8217248 - DNA, 22 bp, Homo sapiens
cagggctgaggacacaagtaaa

SEQ ID NO: 8217249 - DNA, 22 bp, Homo sapiens
cagggctgagtcatatagcctt

SEQ ID NO: 8217250 - DNA, 22 bp, Homo sapiens
cagggctgctggccgtgccctc

SEQ ID NO: 8217251 - DNA, 22 bp, Homo sapiens
tatattcacttgtgtccaacca

SEQ ID NO: 8217252 - DNA, 22 bp, Homo sapiens
tatattcatattgttgtctctc

SEQ ID NO: 8217253 - DNA, 22 bp, Homo sapiens
tatatatatgcacacacaccta

SEQ ID NO: 8217254 - DNA, 22 bp, Homo sapiens
tatatatatgcacacacaccta

SEQ ID NO: 8217255 - DNA, 22 bp, Homo sapiens
tatatatatgcacacacaccta

SEQ ID NO: 8217256 - DNA, 22 bp, Homo sapiens
tatatatatgcacacacaccta

SEQ ID NO: 8217257 - DNA, 22 bp, Homo sapiens
tatatatatgcacacacaccta

SEQ ID NO: 8217258 - DNA, 22 bp, Homo sapiens
tatatagaaaagcagatgttgg

SEQ ID NO: 8217259 - DNA, 22 bp, Homo sapiens
tatatagaaaagcagatgttgg

SEQ ID NO: 8217260 - DNA, 19 bp, Homo sapiens
tatatagatgtgtgtgtat

SEQ ID NO: 8217261 - DNA, 22 bp, Homo sapiens
tatatagctaaaagagatattg

SEQ ID NO: 8217262 - DNA, 22 bp, Homo sapiens
tatatatatgcacacacaccta

SEQ ID NO: 8217263 - DNA, 20 bp, Homo sapiens
tatataggaaatattgtgtt

SEQ ID NO: 8217264 - DNA, 19 bp, Homo sapiens
tatatagatgtgtgtgtat

SEQ ID NO: 8217265 - DNA, 22 bp, Homo sapiens
tatatatatgcacacacaccta

SEQ ID NO: 8217266 - DNA, 22 bp, Homo sapiens
tatatactttcttcctgggtag

SEQ ID NO: 8217267 - DNA, 22 bp, Homo sapiens
tatatacttttgtaagttggct

SEQ ID NO: 8217268 - DNA, 22 bp, Homo sapiens
tatatacaaggtaggtttaggt

SEQ ID NO: 8217269 - DNA, 22 bp, Homo sapiens
tatatacaaggtaggtttaggt

SEQ ID NO: 8217270 - DNA, 22 bp, Homo sapiens
tatataatttgtaaaagcacct

SEQ ID NO: 8217271 - DNA, 22 bp, Homo sapiens
tatataattttctgccatatcc

SEQ ID NO: 8217272 - DNA, 22 bp, Homo sapiens
tatataattttctgccatatcc

SEQ ID NO: 8217273 - DNA, 22 bp, Homo sapiens
tatatacaaggtaggtttaggt

SEQ ID NO: 8217274 - DNA, 22 bp, Homo sapiens
tatataattttctgccatatcc

SEQ ID NO: 8217275 - DNA, 22 bp, Homo sapiens
tatataattttctgccatatcc

SEQ ID NO: 8217276 - DNA, 22 bp, Homo sapiens
tatataattttctgccatatcc

SEQ ID NO: 8217277 - DNA, 22 bp, Homo sapiens
tatatacaaggtaggtttaggt

SEQ ID NO: 8217278 - DNA, 22 bp, Homo sapiens
tatatacaaggtaggtttaggt

SEQ ID NO: 8217279 - DNA, 22 bp, Homo sapiens
tagttttagcagcaatgggatg

SEQ ID NO: 8217280 - DNA, 22 bp, Homo sapiens
tatataactactattttgctca

SEQ ID NO: 8217281 - DNA, 21 bp, Homo sapiens
tatacatgtgcacacacatgc

SEQ ID NO: 8217282 - DNA, 21 bp, Homo sapiens
tatacatgtgtgcatacgtgt

SEQ ID NO: 8217283 - DNA, 22 bp, Homo sapiens
tagtgtgtccctggggagtgtt

SEQ ID NO: 8217284 - DNA, 22 bp, Homo sapiens
tagtgttaattcagtttataat

SEQ ID NO: 8217285 - DNA, 22 bp, Homo sapiens
tagtgttcagctttatttccag

SEQ ID NO: 8217286 - DNA, 22 bp, Homo sapiens
tagtgttctaagaacatccatg

SEQ ID NO: 8217287 - DNA, 22 bp, Homo sapiens
tagtgtggtatcttctatggaa

SEQ ID NO: 8217288 - DNA, 22 bp, Homo sapiens
tagtgtggccccaagaggatct

SEQ ID NO: 8217289 - DNA, 22 bp, Homo sapiens
tagtgtcttcaggagatatgag

SEQ ID NO: 8217290 - DNA, 22 bp, Homo sapiens
tagtgtcttccaggacatggta

SEQ ID NO: 8217291 - DNA, 22 bp, Homo sapiens
tagtgtctgatccgtagttaca

SEQ ID NO: 8217292 - DNA, 22 bp, Homo sapiens
tagtgtctgacatttaagagca

SEQ ID NO: 8217293 - DNA, 21 bp, Homo sapiens
tagtgtcttaagagccttgca

SEQ ID NO: 8217294 - DNA, 22 bp, Homo sapiens
tagtgtctgttgcttttgttca

SEQ ID NO: 8217295 - DNA, 22 bp, Homo sapiens
tagtgtctgtccatcagtaact

SEQ ID NO: 8217296 - DNA, 22 bp, Homo sapiens
tagtgtctgtccatcagtaact

SEQ ID NO: 8217297 - DNA, 22 bp, Homo sapiens
tagtttgagaattgaaatagaa

SEQ ID NO: 8217298 - DNA, 22 bp, Homo sapiens
tagttttacatcagccattgtt

SEQ ID NO: 8217299 - DNA, 22 bp, Homo sapiens
tagttttacttgcgatgataat

SEQ ID NO: 8217300 - DNA, 22 bp, Homo sapiens
tagttttacttgcgatgataat

SEQ ID NO: 8217301 - DNA, 22 bp, Homo sapiens
ttgtagctgaaagtaaagaagt

SEQ ID NO: 8217302 - DNA, 22 bp, Homo sapiens
ttgtagctaggtttttgtagaa

SEQ ID NO: 8217303 - DNA, 22 bp, Homo sapiens
ttgtacttacattttaaagcta

SEQ ID NO: 8217304 - DNA, 22 bp, Homo sapiens
ttgtacttttgtcaggtggaca

SEQ ID NO: 8217305 - DNA, 22 bp, Homo sapiens
ttgtagaacatgcagcacaatg

SEQ ID NO: 8217306 - DNA, 22 bp, Homo sapiens
ttgtagaagcagggtgccctct

SEQ ID NO: 8217307 - DNA, 22 bp, Homo sapiens
ttgggggaagaggatagacagt

SEQ ID NO: 8217308 - DNA, 22 bp, Homo sapiens
ttgggggcatattgagtagtgg

SEQ ID NO: 8217309 - DNA, 20 bp, Homo sapiens
ttggggcatccaccgaatgg

SEQ ID NO: 8217310 - DNA, 22 bp, Homo sapiens
ttggggcagttattctgtgccc

SEQ ID NO: 8217311 - DNA, 22 bp, Homo sapiens
ttgggggaagaggatagacagt

SEQ ID NO: 8217312 - DNA, 22 bp, Homo sapiens
ttggggcatgattagattatga

SEQ ID NO: 8217313 - DNA, 22 bp, Homo sapiens
ttggggccgggataaggttgtt

SEQ ID NO: 8217314 - DNA, 22 bp, Homo sapiens
ttggggtacgcaggtctgggag

SEQ ID NO: 8217315 - DNA, 22 bp, Homo sapiens
ttggggtaaggaaatatggctt

SEQ ID NO: 8217316 - DNA, 22 bp, Homo sapiens
ttggggtaagtttgtcaagctg

SEQ ID NO: 8217317 - DNA, 22 bp, Homo sapiens
ttggggggttgaggagtagata

SEQ ID NO: 8217318 - DNA, 22 bp, Homo sapiens
ttggggtaaaatgtcgtaagag

SEQ ID NO: 8217319 - DNA, 19 bp, Homo sapiens
ttggggtgaatgccagaca

SEQ ID NO: 8217320 - DNA, 19 bp, Homo sapiens
ttggggtgaatgccagaca

SEQ ID NO: 8217321 - DNA, 18 bp, Homo sapiens
ttggggtgaggccaggaa

SEQ ID NO: 8217322 - DNA, 18 bp, Homo sapiens
ttggggtgaggccaggaa

SEQ ID NO: 8217323 - DNA, 22 bp, Homo sapiens
ttgtatgtaccacaggtggtgg

SEQ ID NO: 8217324 - DNA, 22 bp, Homo sapiens
ttgtatgtctcaatatcctgtc

SEQ ID NO: 8217325 - DNA, 22 bp, Homo sapiens
ttgtatgtggcaaatgggggag

SEQ ID NO: 8217326 - DNA, 21 bp, Homo sapiens
ttgtatgcatacatacacaca

SEQ ID NO: 8217327 - DNA, 22 bp, Homo sapiens
ttgtatgagtatggtgtatagg

SEQ ID NO: 8217328 - DNA, 22 bp, Homo sapiens
ttgtatgatcaaaagaaatgta

SEQ ID NO: 8217329 - DNA, 22 bp, Homo sapiens
ttgtatgagtatggtgtatagg

SEQ ID NO: 8217330 - DNA, 22 bp, Homo sapiens
ttgtatgaatgtatcctaattt

SEQ ID NO: 8217331 - DNA, 22 bp, Homo sapiens
ttgtatacaggtcttgtccatt

SEQ ID NO: 8217332 - DNA, 22 bp, Homo sapiens
ttgtatagcccagagagtgaga

SEQ ID NO: 8217333 - DNA, 22 bp, Homo sapiens
ttgtatagcccagagagtgaga

SEQ ID NO: 8217334 - DNA, 22 bp, Homo sapiens
ttgtatagcccagagagtgaga

SEQ ID NO: 8217335 - DNA, 22 bp, Homo sapiens
ttgtagtctaggatagattttt

SEQ ID NO: 8217336 - DNA, 22 bp, Homo sapiens
ttgtataagaagttggcagata

SEQ ID NO: 8217337 - DNA, 22 bp, Homo sapiens
ttgtatagtaagtgaatgttta

SEQ ID NO: 8217338 - DNA, 22 bp, Homo sapiens
ttgtatataaagcccccactgt

SEQ ID NO: 8217339 - DNA, 22 bp, Homo sapiens
ttgtattaattgaaatgaatgc

SEQ ID NO: 8217340 - DNA, 22 bp, Homo sapiens
ttgtatgtttctgtgcacatga

SEQ ID NO: 8217341 - DNA, 22 bp, Homo sapiens
ttgtattaattgaaatgaatgc

SEQ ID NO: 8217342 - DNA, 22 bp, Homo sapiens
ttgtattaattgaaatgaatgc

SEQ ID NO: 8217343 - DNA, 22 bp, Homo sapiens
ttgtattaaaatgtgtttctgt

SEQ ID NO: 8217344 - DNA, 22 bp, Homo sapiens
ttgtattagctgtaaattttct

SEQ ID NO: 8217345 - DNA, 22 bp, Homo sapiens
ttgtattccagccaccacaggc

SEQ ID NO: 8217346 - DNA, 22 bp, Homo sapiens
ttgtattggcaaagaacttgag

SEQ ID NO: 8217347 - DNA, 22 bp, Homo sapiens
ttgtatttatattgaatagctt

SEQ ID NO: 8217348 - DNA, 22 bp, Homo sapiens
ttgtatttatattgaatagctt

SEQ ID NO: 8217349 - DNA, 22 bp, Homo sapiens
ttgtatttatattgaatagctt

SEQ ID NO: 8217350 - DNA, 22 bp, Homo sapiens
ttgtatttcctataacctttct

SEQ ID NO: 8217351 - DNA, 22 bp, Homo sapiens
ttgtatttcctataacctttct

SEQ ID NO: 8217352 - DNA, 22 bp, Homo sapiens
ttgtatttcctataacctttct

SEQ ID NO: 8217353 - DNA, 22 bp, Homo sapiens
ttgttatttaggtctgggttag

SEQ ID NO: 8217354 - DNA, 22 bp, Homo sapiens
ttgttatttacaacaatcctat

SEQ ID NO: 8217355 - DNA, 22 bp, Homo sapiens
ttgtggaatgtggctgtcaatt

SEQ ID NO: 8217356 - DNA, 22 bp, Homo sapiens
ttgtggaatgtggctgtcaatt

SEQ ID NO: 8217357 - DNA, 22 bp, Homo sapiens
ttgtggcagaccatgagtctaa

SEQ ID NO: 8217358 - DNA, 22 bp, Homo sapiens
ttgtggcagaccatgagtctaa

SEQ ID NO: 8217359 - DNA, 22 bp, Homo sapiens
ttgttcataaagacagttcaga

SEQ ID NO: 8217360 - DNA, 22 bp, Homo sapiens
ttgttcataaagacagttcaga

SEQ ID NO: 8217361 - DNA, 22 bp, Homo sapiens
ttgttcatccaacacaaggttg

SEQ ID NO: 8217362 - DNA, 22 bp, Homo sapiens
ttgttcatcaggtgacacatac

SEQ ID NO: 8217363 - DNA, 22 bp, Homo sapiens
ttgttctatggtgaggcagcca

SEQ ID NO: 8217364 - DNA, 22 bp, Homo sapiens
ttgttcttacttaagagtgaat

SEQ ID NO: 8217365 - DNA, 22 bp, Homo sapiens
ttgttcttacttaagagtgaat

SEQ ID NO: 8217366 - DNA, 22 bp, Homo sapiens
ttgttctagcctcctgttttga

SEQ ID NO: 8217367 - DNA, 22 bp, Homo sapiens
ttgttcatggttgtaagtttga

SEQ ID NO: 8217368 - DNA, 22 bp, Homo sapiens
ttgttcatctggaacccagagc

SEQ ID NO: 8217369 - DNA, 22 bp, Homo sapiens
ttgttcatggttgtaagtttga

SEQ ID NO: 8217370 - DNA, 22 bp, Homo sapiens
ttgttcattagcgcttgggcac

SEQ ID NO: 8217371 - DNA, 22 bp, Homo sapiens
ttgttcatcgtccttgctctgt

SEQ ID NO: 8217372 - DNA, 22 bp, Homo sapiens
ttgttcatcgtccttgctctgt

SEQ ID NO: 8217373 - DNA, 20 bp, Homo sapiens
ttgttcattgagctgttttc

SEQ ID NO: 8217374 - DNA, 20 bp, Homo sapiens
ttgttcattgagctgttttc

SEQ ID NO: 8217375 - DNA, 19 bp, Homo sapiens
ttgttcattgtgtgtcctt

SEQ ID NO: 8217376 - DNA, 22 bp, Homo sapiens
ttgtggaactcatctgcctggt

SEQ ID NO: 8217377 - DNA, 22 bp, Homo sapiens
ttgtggaaatacagactccaag

SEQ ID NO: 8217378 - DNA, 22 bp, Homo sapiens
ttgtggaagccctatgagagac

SEQ ID NO: 8217379 - DNA, 22 bp, Homo sapiens
ttgtggaagccctatgagagac

SEQ ID NO: 8217380 - DNA, 22 bp, Homo sapiens
ttgtgctgtatcatatttgtat

SEQ ID NO: 8217381 - DNA, 22 bp, Homo sapiens
ttgtgctgtgagaatgctcatt

SEQ ID NO: 8217382 - DNA, 22 bp, Homo sapiens
ttgtgctctgtgttatttaagg

SEQ ID NO: 8217383 - DNA, 22 bp, Homo sapiens
ttgtgctcctatgagaatctaa

SEQ ID NO: 8217384 - DNA, 22 bp, Homo sapiens
ttgtgctcctgtgagaatctag

SEQ ID NO: 8217385 - DNA, 22 bp, Homo sapiens
ttgtgctcctgtgagaatctag

SEQ ID NO: 8217386 - DNA, 22 bp, Homo sapiens
ttgtgatagggcaatttttctc

SEQ ID NO: 8217387 - DNA, 22 bp, Homo sapiens
ttgtgataacagaattcactct

SEQ ID NO: 8217388 - DNA, 22 bp, Homo sapiens
ttgtgcaagaagccagcaccaa

SEQ ID NO: 8217389 - DNA, 22 bp, Homo sapiens
ttgtgcaagaattggaaagcaa

SEQ ID NO: 8217390 - DNA, 22 bp, Homo sapiens
ttgtgcaagaagccagcaccaa

SEQ ID NO: 8217391 - DNA, 22 bp, Homo sapiens
ttgtgcaagaattggaaagcaa

SEQ ID NO: 8217392 - DNA, 22 bp, Homo sapiens
ttgtgcaaagggggttaatcat

SEQ ID NO: 8217393 - DNA, 22 bp, Homo sapiens
ttgtgcaaagggggttaatcat

SEQ ID NO: 8217394 - DNA, 22 bp, Homo sapiens
ttgtgcaaggtctggactatag

SEQ ID NO: 8217395 - DNA, 22 bp, Homo sapiens
ttgtgcaatagttttctcatga

SEQ ID NO: 8217396 - DNA, 22 bp, Homo sapiens
ttgtgcaaggtctggactatag

SEQ ID NO: 8217397 - DNA, 22 bp, Homo sapiens
ttgtgcaaggtaaagagggctt

SEQ ID NO: 8217398 - DNA, 22 bp, Homo sapiens
ttgtgcaaggtaaagagggctt

SEQ ID NO: 8217399 - DNA, 22 bp, Homo sapiens
ttgtgcaaggctcttggaatgt

SEQ ID NO: 8217400 - DNA, 22 bp, Homo sapiens
ttgtgcaaggctcttggaatgt

SEQ ID NO: 8217401 - DNA, 22 bp, Homo sapiens
ttgtgcaatttaaaatcttcct

SEQ ID NO: 8217402 - DNA, 22 bp, Homo sapiens
ttgtgcaatggtgtttaggttt

SEQ ID NO: 8217403 - DNA, 22 bp, Homo sapiens
ttgtgcaatggtgtttaggttt

SEQ ID NO: 8217404 - DNA, 22 bp, Homo sapiens
ttgtgcaatcccctcattttat

SEQ ID NO: 8217405 - DNA, 22 bp, Homo sapiens
ttgtgcaatagttttctcatga

SEQ ID NO: 8217406 - DNA, 22 bp, Homo sapiens
ttgtgcaatcccctcattttat

SEQ ID NO: 8217407 - DNA, 22 bp, Homo sapiens
ttgtgagagccaaacatgtaag

SEQ ID NO: 8217408 - DNA, 22 bp, Homo sapiens
ttgtgagagaaaatgtgtatat

SEQ ID NO: 8217409 - DNA, 22 bp, Homo sapiens
ttgtgagagaaaatgtgtatat

SEQ ID NO: 8217410 - DNA, 22 bp, Homo sapiens
ttgtgagagccaaacatgtaag

SEQ ID NO: 8217411 - DNA, 23 bp, Homo sapiens
ttgtgagaccttggaagaagtat

SEQ ID NO: 8217412 - DNA, 22 bp, Homo sapiens
ttgtgagatgatttgaaagtgt

SEQ ID NO: 8217413 - DNA, 22 bp, Homo sapiens
ttgtgcctggcttgtattcaca

SEQ ID NO: 8217414 - DNA, 22 bp, Homo sapiens
ttgtgcctttgcttttacaagt

SEQ ID NO: 8217415 - DNA, 22 bp, Homo sapiens
ttgtgctcctatgagaatctaa

SEQ ID NO: 8217416 - DNA, 22 bp, Homo sapiens
ttgtgcatttctctgagtgtgt

SEQ ID NO: 8217417 - DNA, 22 bp, Homo sapiens
ttgtgcaatttaaaatcttcct

SEQ ID NO: 8217418 - DNA, 19 bp, Homo sapiens
ttgtgcatatgcagtgcat

SEQ ID NO: 8217419 - DNA, 22 bp, Homo sapiens
ttgtgcatatagagttagatgg

SEQ ID NO: 8217420 - DNA, 22 bp, Homo sapiens
ttgtgcatattaggtacatgct

SEQ ID NO: 8217421 - DNA, 22 bp, Homo sapiens
ttgtgcatgactgtgaatagct

SEQ ID NO: 8217422 - DNA, 22 bp, Homo sapiens
ttgtgcatggagaaggcagggc

SEQ ID NO: 8217423 - DNA, 22 bp, Homo sapiens
ttgtgcatgcatacgtatgtgt

SEQ ID NO: 8217424 - DNA, 22 bp, Homo sapiens
ttgtgcatgcatacgtatgtgt

SEQ ID NO: 8217425 - DNA, 22 bp, Homo sapiens
ttgtgcatgatgcatacatggt

SEQ ID NO: 8217426 - DNA, 22 bp, Homo sapiens
ttgtgcatggctactttttatg

SEQ ID NO: 8217427 - DNA, 22 bp, Homo sapiens
ttgtgcattgcagcagtgcttt

SEQ ID NO: 8217428 - DNA, 23 bp, Homo sapiens
ttgggctcagtggcaggaagagt

SEQ ID NO: 8217429 - DNA, 22 bp, Homo sapiens
ttgggctgaaccctgcagctga

SEQ ID NO: 8217430 - DNA, 22 bp, Homo sapiens
ttgggctgaaccctgcagctga

SEQ ID NO: 8217431 - DNA, 22 bp, Homo sapiens
ttgggctcctgttgatcctgtc

SEQ ID NO: 8217432 - DNA, 22 bp, Homo sapiens
ttgggctcaggagtttgagacc

SEQ ID NO: 8217433 - DNA, 22 bp, Homo sapiens
ttgggctgaagtagagggcaga

SEQ ID NO: 8217434 - DNA, 22 bp, Homo sapiens
ttgggctgaagtagagggcaga

SEQ ID NO: 8217435 - DNA, 22 bp, Homo sapiens
ttgggctgaagtagagggcaga

SEQ ID NO: 8217436 - DNA, 22 bp, Homo sapiens
ttgggctgaggagggcgtggcc

SEQ ID NO: 8217437 - DNA, 22 bp, Homo sapiens
ttgggctgatctgtggaagaag

SEQ ID NO: 8217438 - DNA, 22 bp, Homo sapiens
ttgggctgaggagggcgtggcc

SEQ ID NO: 8217439 - DNA, 22 bp, Homo sapiens
ttggggaggttgccacattcca

SEQ ID NO: 8217440 - DNA, 22 bp, Homo sapiens
ttggggagttaatgccaaagat

SEQ ID NO: 8217441 - DNA, 22 bp, Homo sapiens
ttggggagttaatgccaaagat

SEQ ID NO: 8217442 - DNA, 22 bp, Homo sapiens
ttggggagaaatgaaatgaagt

SEQ ID NO: 8217443 - DNA, 22 bp, Homo sapiens
ttggggagaaatgaaatgaagt

SEQ ID NO: 8217444 - DNA, 22 bp, Homo sapiens
ttggggcagagaggatacggca

SEQ ID NO: 8217445 - DNA, 22 bp, Homo sapiens
ttggggcacctccccagcattt

SEQ ID NO: 8217446 - DNA, 22 bp, Homo sapiens
ttggggagttaatgccaaagat

SEQ ID NO: 8217447 - DNA, 22 bp, Homo sapiens
ttgggcttgtctgggaaactgc

SEQ ID NO: 8217448 - DNA, 22 bp, Homo sapiens
ttgggcttggtcggtttgaggc

SEQ ID NO: 8217449 - DNA, 22 bp, Homo sapiens
ttgggcttgacaagctgtcaag

SEQ ID NO: 8217450 - DNA, 22 bp, Homo sapiens
ttggggaagctttgaaatactt

SEQ ID NO: 8217451 - DNA, 22 bp, Homo sapiens
ttgggctttaattccagagagg

SEQ ID NO: 8217452 - DNA, 22 bp, Homo sapiens
ttgggctggcagaggtggtctt

SEQ ID NO: 8217453 - DNA, 22 bp, Homo sapiens
ttgggaaatatggattgttatt

SEQ ID NO: 8217454 - DNA, 23 bp, Homo sapiens
ttgggaaatagttaagacatgag

SEQ ID NO: 8217455 - DNA, 22 bp, Homo sapiens
ttgggaagaatggaggtggtta

SEQ ID NO: 8217456 - DNA, 22 bp, Homo sapiens
ttgggaagaaacatgtccatca

SEQ ID NO: 8217457 - DNA, 23 bp, Homo sapiens
ttgggaaatagttaagacatgag

SEQ ID NO: 8217458 - DNA, 22 bp, Homo sapiens
ttgggaaacagtatagctaaca

SEQ ID NO: 8217459 - DNA, 22 bp, Homo sapiens
ttggctttagcccaaatgactg

SEQ ID NO: 8217460 - DNA, 22 bp, Homo sapiens
ttggctttcagaatccctatct

SEQ ID NO: 8217461 - DNA, 22 bp, Homo sapiens
ttggcttcaatgtcagagacag

SEQ ID NO: 8217462 - DNA, 22 bp, Homo sapiens
ttggcttcattgatctcacttt

SEQ ID NO: 8217463 - DNA, 22 bp, Homo sapiens
ttggcttccaggatctcagcag

SEQ ID NO: 8217464 - DNA, 22 bp, Homo sapiens
ttggcttctcttaaccctaaag

SEQ ID NO: 8217465 - DNA, 18 bp, Homo sapiens
ttggcttctttccttcct

SEQ ID NO: 8217466 - DNA, 22 bp, Homo sapiens
ttggcttctttagtcagtttgg

SEQ ID NO: 8217467 - DNA, 22 bp, Homo sapiens
ttggcttcttataatgcaatag

SEQ ID NO: 8217468 - DNA, 22 bp, Homo sapiens
ttggcttctgttttggctctgt

SEQ ID NO: 8217469 - DNA, 22 bp, Homo sapiens
ttggcttctgttttggctctgt

SEQ ID NO: 8217470 - DNA, 22 bp, Homo sapiens
ttggccctttatgggatgggca

SEQ ID NO: 8217471 - DNA, 22 bp, Homo sapiens
ttggccctgaggaggcagctgc

SEQ ID NO: 8217472 - DNA, 22 bp, Homo sapiens
ttggccctccacctggctgtgc

SEQ ID NO: 8217473 - DNA, 22 bp, Homo sapiens
ttggccctagatgattaagttg

SEQ ID NO: 8217474 - DNA, 22 bp, Homo sapiens
ttggccctggcacacccccacg

SEQ ID NO: 8217475 - DNA, 22 bp, Homo sapiens
ttggccctgaggttatcatcta

SEQ ID NO: 8217476 - DNA, 22 bp, Homo sapiens
ttggccctggggccagcttcga

SEQ ID NO: 8217477 - DNA, 21 bp, Homo sapiens
ttggcctgatatcttggagca

SEQ ID NO: 8217478 - DNA, 22 bp, Homo sapiens
ttggcctgctccagagaggcca

SEQ ID NO: 8217479 - DNA, 22 bp, Homo sapiens
ttggcctggcgcggtggctcac

SEQ ID NO: 8217480 - DNA, 22 bp, Homo sapiens
ttggcagcagagtgtggtgctc

SEQ ID NO: 8217481 - DNA, 20 bp, Homo sapiens
ttggcagcagctcagccacc

SEQ ID NO: 8217482 - DNA, 22 bp, Homo sapiens
ttggcagcacggggaacgtctg

SEQ ID NO: 8217483 - DNA, 22 bp, Homo sapiens
ttggcagcagagtgtggtgctc

SEQ ID NO: 8217484 - DNA, 22 bp, Homo sapiens
ttggcagcaagaggctcttctg

SEQ ID NO: 8217485 - DNA, 22 bp, Homo sapiens
ttggccctagactctaagtccg

SEQ ID NO: 8217486 - DNA, 22 bp, Homo sapiens
ttggcagcagggagttggccgc

SEQ ID NO: 8217487 - DNA, 22 bp, Homo sapiens
ttggcagagagtatgctgaaga

SEQ ID NO: 8217488 - DNA, 22 bp, Homo sapiens
ttggcagactgggtcctgggga

SEQ ID NO: 8217489 - DNA, 22 bp, Homo sapiens
ttggcagatgaacacaactgga

SEQ ID NO: 8217490 - DNA, 22 bp, Homo sapiens
ttggctgctggtctttggatat

SEQ ID NO: 8217491 - DNA, 22 bp, Homo sapiens
ttggctctaggaaccaaagtga

SEQ ID NO: 8217492 - DNA, 22 bp, Homo sapiens
ttggctcctgttcctctgtctg

SEQ ID NO: 8217493 - DNA, 22 bp, Homo sapiens
ttggctggctacctgggccgag

SEQ ID NO: 8217494 - DNA, 22 bp, Homo sapiens
ttggctgctttactctgacggg

SEQ ID NO: 8217495 - DNA, 22 bp, Homo sapiens
ttggctgggcacagtgtctcat

SEQ ID NO: 8217496 - DNA, 22 bp, Homo sapiens
ttggctgggcacagtgtctcat

SEQ ID NO: 8217497 - DNA, 22 bp, Homo sapiens
ttggctggcttctcgacttgtt

SEQ ID NO: 8217498 - DNA, 22 bp, Homo sapiens
ttggctggcttctcgacttgtt

SEQ ID NO: 8217499 - DNA, 22 bp, Homo sapiens
ttggctggtaagccaaatgaaa

SEQ ID NO: 8217500 - DNA, 22 bp, Homo sapiens
ttggctggttttgagtatgtgc

SEQ ID NO: 8217501 - DNA, 22 bp, Homo sapiens
ttggctggttttgagtatgtgc

SEQ ID NO: 8217502 - DNA, 22 bp, Homo sapiens
ttggctggtttcaagaaggcat

SEQ ID NO: 8217503 - DNA, 20 bp, Homo sapiens
ttggcggctattatgaataa

SEQ ID NO: 8217504 - DNA, 22 bp, Homo sapiens
ttggcgcccaggacgccgccgc

SEQ ID NO: 8217505 - DNA, 22 bp, Homo sapiens
ttggctatgcttgtgttcagtt

SEQ ID NO: 8217506 - DNA, 22 bp, Homo sapiens
ttggctacatcgaggctccagc

SEQ ID NO: 8217507 - DNA, 22 bp, Homo sapiens
ttggctatgcttgtgttcagtt

SEQ ID NO: 8217508 - DNA, 22 bp, Homo sapiens
ttggattcctgggaaccatgca

SEQ ID NO: 8217509 - DNA, 22 bp, Homo sapiens
ttggcacagtaatctctcttca

SEQ ID NO: 8217510 - DNA, 22 bp, Homo sapiens
ttggcacaaatttctgaaataa

SEQ ID NO: 8217511 - DNA, 22 bp, Homo sapiens
ttggcacagagctgcagcctgg

SEQ ID NO: 8217512 - DNA, 22 bp, Homo sapiens
ttggcacttttaggcagtaccg

SEQ ID NO: 8217513 - DNA, 22 bp, Homo sapiens
ttggcactttctcagcagcctg

SEQ ID NO: 8217514 - DNA, 22 bp, Homo sapiens
ttggcactttgaatgagctcag

SEQ ID NO: 8217515 - DNA, 22 bp, Homo sapiens
ttggcacttcacgagacagcta

SEQ ID NO: 8217516 - DNA, 22 bp, Homo sapiens
ttggcactgtgcctggcacatt

SEQ ID NO: 8217517 - DNA, 22 bp, Homo sapiens
ttggcactctccctgcactggt

SEQ ID NO: 8217518 - DNA, 22 bp, Homo sapiens
ttggcactcatcctggttgttt

SEQ ID NO: 8217519 - DNA, 22 bp, Homo sapiens
ttggcactcagcaagtgttaat

SEQ ID NO: 8217520 - DNA, 22 bp, Homo sapiens
ttggcactgaccaaagaagtcc

SEQ ID NO: 8217521 - DNA, 22 bp, Homo sapiens
ttggcactgcagatgaattgca

SEQ ID NO: 8217522 - DNA, 22 bp, Homo sapiens
ttggcactgcattgaccacacc

SEQ ID NO: 8217523 - DNA, 22 bp, Homo sapiens
ttggcactattcactccatggg

SEQ ID NO: 8217524 - DNA, 22 bp, Homo sapiens
ttggcactcaaaatagatggtt

SEQ ID NO: 8217525 - DNA, 22 bp, Homo sapiens
ttggcactattgacattttggg

SEQ ID NO: 8217526 - DNA, 22 bp, Homo sapiens
ttggcactcaaaatagatggtt

SEQ ID NO: 8217527 - DNA, 22 bp, Homo sapiens
ttggcactcaaaattttatcgg

SEQ ID NO: 8217528 - DNA, 22 bp, Homo sapiens
ttggcactcaactgtcgttgtt

SEQ ID NO: 8217529 - DNA, 22 bp, Homo sapiens
ttggcactcaactgtcgttgtt

SEQ ID NO: 8217530 - DNA, 22 bp, Homo sapiens
ttggcactcaaagccctctgca

SEQ ID NO: 8217531 - DNA, 22 bp, Homo sapiens
ttggaatatcatgcagaataaa

SEQ ID NO: 8217532 - DNA, 22 bp, Homo sapiens
ttggaatagggaatcaaagttt

SEQ ID NO: 8217533 - DNA, 20 bp, Homo sapiens
ttggaatcacctggagaggt

SEQ ID NO: 8217534 - DNA, 22 bp, Homo sapiens
ttggaatcattcttaaaggtct

SEQ ID NO: 8217535 - DNA, 22 bp, Homo sapiens
ttggaatctgcaatttaacaaa

SEQ ID NO: 8217536 - DNA, 22 bp, Homo sapiens
ttggaatatgtgtatgaaaagc

SEQ ID NO: 8217537 - DNA, 22 bp, Homo sapiens
ttggaatcctgagatgagaatt

SEQ ID NO: 8217538 - DNA, 22 bp, Homo sapiens
ttggaagacattaaagagagtg

SEQ ID NO: 8217539 - DNA, 22 bp, Homo sapiens
ttggaagaggaaaatgagccta

SEQ ID NO: 8217540 - DNA, 22 bp, Homo sapiens
ttggaagagagccacagttaat

SEQ ID NO: 8217541 - DNA, 22 bp, Homo sapiens
ttggaagaccagaggccttgtc

SEQ ID NO: 8217542 - DNA, 22 bp, Homo sapiens
ttggaagttgatttaaaaagga

SEQ ID NO: 8217543 - DNA, 22 bp, Homo sapiens
ttggaggatgcaatgagggagt

SEQ ID NO: 8217544 - DNA, 22 bp, Homo sapiens
ttggaggatggagttagcatct

SEQ ID NO: 8217545 - DNA, 22 bp, Homo sapiens
ttggaggataaggatattgatt

SEQ ID NO: 8217546 - DNA, 22 bp, Homo sapiens
ttggaattcagcttgcttataa

SEQ ID NO: 8217547 - DNA, 22 bp, Homo sapiens
ttggaattcaagttgtagctta

SEQ ID NO: 8217548 - DNA, 21 bp, Homo sapiens
ttggaatcttaggagtgtggg

SEQ ID NO: 8217549 - DNA, 22 bp, Homo sapiens
ttggaatgcacactgagcctgc

SEQ ID NO: 8217550 - DNA, 22 bp, Homo sapiens
ttggaattaatatttgtataca

SEQ ID NO: 8217551 - DNA, 22 bp, Homo sapiens
ttggatgtttgaaatcacgtac

SEQ ID NO: 8217552 - DNA, 20 bp, Homo sapiens
ttggatgtgcatggccgtgc

SEQ ID NO: 8217553 - DNA, 22 bp, Homo sapiens
ttggaggattgctctcagccca

SEQ ID NO: 8217554 - DNA, 18 bp, Homo sapiens
ttggaggatgtccatgaa

SEQ ID NO: 8217555 - DNA, 15 bp, Homo sapiens
ttggaggatgtagta

SEQ ID NO: 8217556 - DNA, 22 bp, Homo sapiens
ttggaggatgtcggcatattta

SEQ ID NO: 8217557 - DNA, 23 bp, Homo sapiens
ttggaacacagtaaatgcacaat

SEQ ID NO: 8217558 - DNA, 23 bp, Homo sapiens
ttggaacacagtaaatgcacaat

SEQ ID NO: 8217559 - DNA, 20 bp, Homo sapiens
ttgctttatcagacatgata

SEQ ID NO: 8217560 - DNA, 22 bp, Homo sapiens
ttgctttatattcaagagagga

SEQ ID NO: 8217561 - DNA, 22 bp, Homo sapiens
ttgctttaggatttaagtggca

SEQ ID NO: 8217562 - DNA, 22 bp, Homo sapiens
ttgctttagggcaaatatttca

SEQ ID NO: 8217563 - DNA, 22 bp, Homo sapiens
ttgctttagggcaaatatttca

SEQ ID NO: 8217564 - DNA, 22 bp, Homo sapiens
ttggaactggaggaacatgcta

SEQ ID NO: 8217565 - DNA, 22 bp, Homo sapiens
ttggaacatgccggggtccagg

SEQ ID NO: 8217566 - DNA, 22 bp, Homo sapiens
ttggaacatgccggggtccagg

SEQ ID NO: 8217567 - DNA, 22 bp, Homo sapiens
ttggaagaaatatcaatagtgt

SEQ ID NO: 8217568 - DNA, 22 bp, Homo sapiens
ttggaagacaatgctgattctc

SEQ ID NO: 8217569 - DNA, 22 bp, Homo sapiens
ttggaagacagccgtctttatt

SEQ ID NO: 8217570 - DNA, 22 bp, Homo sapiens
ttggaagacagtgaaacagcac

SEQ ID NO: 8217571 - DNA, 22 bp, Homo sapiens
ttggaacaggattcaattaaag

SEQ ID NO: 8217572 - DNA, 22 bp, Homo sapiens
ttggaacagaactgcgttcatt

SEQ ID NO: 8217573 - DNA, 22 bp, Homo sapiens
ttggaacagagccctaaggaca

SEQ ID NO: 8217574 - DNA, 22 bp, Homo sapiens
ttggaacagagccctaaggaca

SEQ ID NO: 8217575 - DNA, 22 bp, Homo sapiens
ttggaacagaaacagacaaata

SEQ ID NO: 8217576 - DNA, 22 bp, Homo sapiens
ttggaacatccaggacagatat

SEQ ID NO: 8217577 - DNA, 22 bp, Homo sapiens
ttggaacagtgtgaaaaggtta

SEQ ID NO: 8217578 - DNA, 20 bp, Homo sapiens
ttggaacagtggatcagcag

SEQ ID NO: 8217579 - DNA, 20 bp, Homo sapiens
ttggaacagtggatcagcag

SEQ ID NO: 8217580 - DNA, 22 bp, Homo sapiens
ttggaacagtgtgaaaaggtta

SEQ ID NO: 8217581 - DNA, 22 bp, Homo sapiens
ttggaacatccaggacagatat

SEQ ID NO: 8217582 - DNA, 22 bp, Homo sapiens
ttgctttacaaaaattgatggt

SEQ ID NO: 8217583 - DNA, 22 bp, Homo sapiens
ttgctttaactagtaaatgggg

SEQ ID NO: 8217584 - DNA, 22 bp, Homo sapiens
ttgctttacaaaaattgatggt

SEQ ID NO: 8217585 - DNA, 22 bp, Homo sapiens
ttgctttaatgagattttgcca

SEQ ID NO: 8217586 - DNA, 23 bp, Homo sapiens
ttgcttctgtgcaattcagtact

SEQ ID NO: 8217587 - DNA, 22 bp, Homo sapiens
ttgcttctggaactttctgttc

SEQ ID NO: 8217588 - DNA, 22 bp, Homo sapiens
ttgcttgcctgttaggagaaac

SEQ ID NO: 8217589 - DNA, 22 bp, Homo sapiens
ttgcttcttagatattcctctc

SEQ ID NO: 8217590 - DNA, 22 bp, Homo sapiens
ttgcatttttgagcacgaagtt

SEQ ID NO: 8217591 - DNA, 22 bp, Homo sapiens
ttgcatttttagatgcttctgt

SEQ ID NO: 8217592 - DNA, 22 bp, Homo sapiens
ttgcatttttagatgcttctgt

SEQ ID NO: 8217593 - DNA, 22 bp, Homo sapiens
ttgcatttttacaagtagccag

SEQ ID NO: 8217594 - DNA, 22 bp, Homo sapiens
ttgcatttttacaagtagccag

SEQ ID NO: 8217595 - DNA, 22 bp, Homo sapiens
ttgcatttttacaagtagccag

SEQ ID NO: 8217596 - DNA, 22 bp, Homo sapiens
ttgcatttttagatgcttctgt

SEQ ID NO: 8217597 - DNA, 22 bp, Homo sapiens
ttgcatttttagatgcttctgt

SEQ ID NO: 8217598 - DNA, 22 bp, Homo sapiens
ttgcatttttagatgcttctgt

SEQ ID NO: 8217599 - DNA, 22 bp, Homo sapiens
ttgcatttgctcatttgatatg

SEQ ID NO: 8217600 - DNA, 22 bp, Homo sapiens
ttgcatttgctcatttgatatg

SEQ ID NO: 8217601 - DNA, 22 bp, Homo sapiens
ttgcatttgtggcatgggtgtt

SEQ ID NO: 8217602 - DNA, 22 bp, Homo sapiens
ttgcatttgtttgagtagaatg

SEQ ID NO: 8217603 - DNA, 22 bp, Homo sapiens
ttgcatttgtttgagtagaatg

SEQ ID NO: 8217604 - DNA, 21 bp, Homo sapiens
ttgcattttaagtttactgct

SEQ ID NO: 8217605 - DNA, 21 bp, Homo sapiens
ttgcattttaagtttactgct

SEQ ID NO: 8217606 - DNA, 22 bp, Homo sapiens
ttgcattttggttgtaaatatg

SEQ ID NO: 8217607 - DNA, 22 bp, Homo sapiens
ttgcattttggttgtaaatatg

SEQ ID NO: 8217608 - DNA, 22 bp, Homo sapiens
ttgcattttggttgtaaatatg

SEQ ID NO: 8217609 - DNA, 22 bp, Homo sapiens
ttgccagggccagtgggggtgt

SEQ ID NO: 8217610 - DNA, 22 bp, Homo sapiens
ttgccagggaacagggagaggc

SEQ ID NO: 8217611 - DNA, 22 bp, Homo sapiens
ttgccagggctttggtggcatc

SEQ ID NO: 8217612 - DNA, 22 bp, Homo sapiens
ttgccagtttccctggatgtgt

SEQ ID NO: 8217613 - DNA, 22 bp, Homo sapiens
ttgccatcccttacctcagtca

SEQ ID NO: 8217614 - DNA, 22 bp, Homo sapiens
ttgccagtgccagcccaggcag

SEQ ID NO: 8217615 - DNA, 22 bp, Homo sapiens
ttgccaggagagccacttgcag

SEQ ID NO: 8217616 - DNA, 22 bp, Homo sapiens
ttgccagggaacagggagaggc

SEQ ID NO: 8217617 - DNA, 22 bp, Homo sapiens
ttgccagggaacagggagaggc

SEQ ID NO: 8217618 - DNA, 22 bp, Homo sapiens
ttgcatttcctgtactgtttga

SEQ ID NO: 8217619 - DNA, 22 bp, Homo sapiens
ttgcatttcccattgagtaatg

SEQ ID NO: 8217620 - DNA, 22 bp, Homo sapiens
ttgcatttcctgtactgtttga

SEQ ID NO: 8217621 - DNA, 22 bp, Homo sapiens
ttgcatttgacaaattatttaa

SEQ ID NO: 8217622 - DNA, 22 bp, Homo sapiens
ttgcatttcctgtactgtttga

SEQ ID NO: 8217623 - DNA, 22 bp, Homo sapiens
ttgcatttgagaaagttctcct

SEQ ID NO: 8217624 - DNA, 22 bp, Homo sapiens
ttgcatttgagaaagttctcct

SEQ ID NO: 8217625 - DNA, 22 bp, Homo sapiens
ttgcatttgacaaattatttaa

SEQ ID NO: 8217626 - DNA, 22 bp, Homo sapiens
ttgcatttgagaaagttctcct

SEQ ID NO: 8217627 - DNA, 22 bp, Homo sapiens
ttgcatttgatcttgggttctc

SEQ ID NO: 8217628 - DNA, 22 bp, Homo sapiens
ttgcatttgctcatttgatatg

SEQ ID NO: 8217629 - DNA, 22 bp, Homo sapiens
ttgaggtcttgagtactgggga

SEQ ID NO: 8217630 - DNA, 22 bp, Homo sapiens
ttgaggtcttcattcttgggca

SEQ ID NO: 8217631 - DNA, 22 bp, Homo sapiens
ttgaggtctttgagcaaacgca

SEQ ID NO: 8217632 - DNA, 22 bp, Homo sapiens
ttgaggtctttgagcaaacgca

SEQ ID NO: 8217633 - DNA, 22 bp, Homo sapiens
ttgcatttcactttcagtaggc

SEQ ID NO: 8217634 - DNA, 22 bp, Homo sapiens
ttgcatttcactttcagtaggc

SEQ ID NO: 8217635 - DNA, 19 bp, Homo sapiens
ttgcatttcatgtttgatt

SEQ ID NO: 8217636 - DNA, 22 bp, Homo sapiens
ttgcatttcccattgagtaatg

SEQ ID NO: 8217637 - DNA, 22 bp, Homo sapiens
ttgaggtctggcagtagcgttg

SEQ ID NO: 8217638 - DNA, 22 bp, Homo sapiens
ttgaggtctgtgataaaagtca

SEQ ID NO: 8217639 - DNA, 22 bp, Homo sapiens
ttgaggtctgtgtaggcagcaa

SEQ ID NO: 8217640 - DNA, 22 bp, Homo sapiens
ttgaggtcttcagctgacacct

SEQ ID NO: 8217641 - DNA, 22 bp, Homo sapiens
ttgaggtcttcagctgacacct

SEQ ID NO: 8217642 - DNA, 22 bp, Homo sapiens
ttgaggtcttcaggatcaggct

SEQ ID NO: 8217643 - DNA, 22 bp, Homo sapiens
ttgaggtctctacagaagagtg

SEQ ID NO: 8217644 - DNA, 22 bp, Homo sapiens
ttgaggtctggcagtagcgttg

SEQ ID NO: 8217645 - DNA, 22 bp, Homo sapiens
ttgaggtctgtgataaaagtca

SEQ ID NO: 8217646 - DNA, 22 bp, Homo sapiens
ttgaggtctgtgtaggcagcaa

SEQ ID NO: 8217647 - DNA, 22 bp, Homo sapiens
ttgaggtcttcaggatcaggct

SEQ ID NO: 8217648 - DNA, 22 bp, Homo sapiens
ttgaggtcttcattcttgggca

SEQ ID NO: 8217649 - DNA, 22 bp, Homo sapiens
ttgaggtcttgagtactgggga

SEQ ID NO: 8217650 - DNA, 22 bp, Homo sapiens
ttgaggtccccagtacccactg

SEQ ID NO: 8217651 - DNA, 22 bp, Homo sapiens
ttgaggtccaggtgtgggcagg

SEQ ID NO: 8217652 - DNA, 22 bp, Homo sapiens
ttgaggtccagtctccacccac

SEQ ID NO: 8217653 - DNA, 22 bp, Homo sapiens
ttgaggtcccaaacccactgag

SEQ ID NO: 8217654 - DNA, 22 bp, Homo sapiens
ttgaggtccccagtacccactg

SEQ ID NO: 8217655 - DNA, 22 bp, Homo sapiens
ttgaggtccctgccttgccttc

SEQ ID NO: 8217656 - DNA, 23 bp, Homo sapiens
ttgaggtcggctctctgagcctg

SEQ ID NO: 8217657 - DNA, 22 bp, Homo sapiens
ttgaggtctctacagaagagtg

SEQ ID NO: 8217658 - DNA, 22 bp, Homo sapiens
ttgaggtctctacagaagagtg

SEQ ID NO: 8217659 - DNA, 22 bp, Homo sapiens
ttgaggtctgagactgtgcagg

SEQ ID NO: 8217660 - DNA, 22 bp, Homo sapiens
ttgaggtccccagtacccactg

SEQ ID NO: 8217661 - DNA, 22 bp, Homo sapiens
ttgaggtctgagactgtgcagg

SEQ ID NO: 8217662 - DNA, 22 bp, Homo sapiens
ttgaggtccctgccttgccttc

SEQ ID NO: 8217663 - DNA, 23 bp, Homo sapiens
ttgaggtcggctctctgagcctg

SEQ ID NO: 8217664 - DNA, 22 bp, Homo sapiens
ttgaggtcaagtaaccactgga

SEQ ID NO: 8217665 - DNA, 22 bp, Homo sapiens
ttgaggtcaattctgtttcctg

SEQ ID NO: 8217666 - DNA, 22 bp, Homo sapiens
ttgaggtcatatatatttggca

SEQ ID NO: 8217667 - DNA, 22 bp, Homo sapiens
ttgaggtcaagtaaccactgga

SEQ ID NO: 8217668 - DNA, 20 bp, Homo sapiens
ttgaggtcaaggactaggcc

SEQ ID NO: 8217669 - DNA, 22 bp, Homo sapiens
ttgaggtcaattctgtttcctg

SEQ ID NO: 8217670 - DNA, 22 bp, Homo sapiens
ttgaggtcatatatatttggca

SEQ ID NO: 8217671 - DNA, 22 bp, Homo sapiens
ttgaggtcatctgaagtactag

SEQ ID NO: 8217672 - DNA, 22 bp, Homo sapiens
ttgaggtcatctgaagtactag

SEQ ID NO: 8217673 - DNA, 22 bp, Homo sapiens
ttgaggtccaggtgtgggcagg

SEQ ID NO: 8217674 - DNA, 22 bp, Homo sapiens
ttgaggtccagtctccacccac

SEQ ID NO: 8217675 - DNA, 22 bp, Homo sapiens
ttgaggtcccaaacccactgag

SEQ ID NO: 8217676 - DNA, 22 bp, Homo sapiens
ttgaggtcaaagaagtgagtgg

SEQ ID NO: 8217677 - DNA, 22 bp, Homo sapiens
ttgaggtcaaagaagtgagtgg

SEQ ID NO: 8217678 - DNA, 20 bp, Homo sapiens
ttgaggtcaaggactaggcc

SEQ ID NO: 8217679 - DNA, 22 bp, Homo sapiens
ttgaggtcaaagaagtgagtgg

SEQ ID NO: 8217680 - DNA, 22 bp, Homo sapiens
ttgaggtattgatattttatga

SEQ ID NO: 8217681 - DNA, 22 bp, Homo sapiens
ttgccttactgcattcagtaaa

SEQ ID NO: 8217682 - DNA, 22 bp, Homo sapiens
ttgcctttcccctctggaagca

SEQ ID NO: 8217683 - DNA, 22 bp, Homo sapiens
ttgcctgtttgagagctgtgtt

SEQ ID NO: 8217684 - DNA, 22 bp, Homo sapiens
ttgccattccagggtattaggg

SEQ ID NO: 8217685 - DNA, 22 bp, Homo sapiens
ttgccattgcaaagtactatga

SEQ ID NO: 8217686 - DNA, 22 bp, Homo sapiens
ttgccattgctcagtgaacaga

SEQ ID NO: 8217687 - DNA, 22 bp, Homo sapiens
ttgccattaaaacatgttatct

SEQ ID NO: 8217688 - DNA, 16 bp, Homo sapiens
ttgcccacttgttcat

SEQ ID NO: 8217689 - DNA, 22 bp, Homo sapiens
ttgcctcaagattttttattga

SEQ ID NO: 8217690 - DNA, 22 bp, Homo sapiens
ttgcctgattagtctcagattg

SEQ ID NO: 8217691 - DNA, 22 bp, Homo sapiens
ttgcctccttttaaggaaatca

SEQ ID NO: 8217692 - DNA, 22 bp, Homo sapiens
ttgcttcctcgaggccagcgtg

SEQ ID NO: 8217693 - DNA, 22 bp, Homo sapiens
ttgcttcctctgtgcaatcctc

SEQ ID NO: 8217694 - DNA, 22 bp, Homo sapiens
ttgctcaggctggtgtgcagtg

SEQ ID NO: 8217695 - DNA, 22 bp, Homo sapiens
ttgctcagcactggagccagct

SEQ ID NO: 8217696 - DNA, 22 bp, Homo sapiens
ttgctcagcactggagccagct

SEQ ID NO: 8217697 - DNA, 22 bp, Homo sapiens
ttgctcagcactggagccagct

SEQ ID NO: 8217698 - DNA, 18 bp, Homo sapiens
ttgctcactctccttccc

SEQ ID NO: 8217699 - DNA, 18 bp, Homo sapiens
ttgctcactctccttccc

SEQ ID NO: 8217700 - DNA, 22 bp, Homo sapiens
ttgctattttgagagtcatagt

SEQ ID NO: 8217701 - DNA, 22 bp, Homo sapiens
ttgctcaggctggtgtgcagtg

SEQ ID NO: 8217702 - DNA, 22 bp, Homo sapiens
ttgctcaggcttagagctacta

SEQ ID NO: 8217703 - DNA, 22 bp, Homo sapiens
ttgctaccattgataccagcac

SEQ ID NO: 8217704 - DNA, 22 bp, Homo sapiens
ttgctactggcatctcgtgggt

SEQ ID NO: 8217705 - DNA, 22 bp, Homo sapiens
ttgctaccattgataccagcac

SEQ ID NO: 8217706 - DNA, 22 bp, Homo sapiens
ttgctagctggtgtatgcattg

SEQ ID NO: 8217707 - DNA, 22 bp, Homo sapiens
ttgctacttagagtgcagcagc

SEQ ID NO: 8217708 - DNA, 22 bp, Homo sapiens
ttgctatttcctgaaataagca

SEQ ID NO: 8217709 - DNA, 22 bp, Homo sapiens
ttgctatactcattagttattt

SEQ ID NO: 8217710 - DNA, 22 bp, Homo sapiens
ttgctaaatgtttgtttccaga

SEQ ID NO: 8217711 - DNA, 22 bp, Homo sapiens
ttgctaaatttattttcgaaca

SEQ ID NO: 8217712 - DNA, 22 bp, Homo sapiens
tttcatatgggcattggcaata

SEQ ID NO: 8217713 - DNA, 22 bp, Homo sapiens
tttcatagccttctaatgagtt

SEQ ID NO: 8217714 - DNA, 22 bp, Homo sapiens
tttcataccatatccacacatc

SEQ ID NO: 8217715 - DNA, 22 bp, Homo sapiens
tttcatatgggcattggcaata

SEQ ID NO: 8217716 - DNA, 22 bp, Homo sapiens
tttcatcatcaaaatagtgagg

SEQ ID NO: 8217717 - DNA, 22 bp, Homo sapiens
tttcatcatgttggcagattgg

SEQ ID NO: 8217718 - DNA, 22 bp, Homo sapiens
tttcatctatttgctttgtgaa

SEQ ID NO: 8217719 - DNA, 22 bp, Homo sapiens
tttcatctaacactacataggg

SEQ ID NO: 8217720 - DNA, 22 bp, Homo sapiens
tttcataatactgtacatgaaa

SEQ ID NO: 8217721 - DNA, 22 bp, Homo sapiens
tttcataacctcaagctacagt

SEQ ID NO: 8217722 - DNA, 22 bp, Homo sapiens
tttcataatctgtcaagtgggg

SEQ ID NO: 8217723 - DNA, 22 bp, Homo sapiens
tttcataatctgtcaagtgggg

SEQ ID NO: 8217724 - DNA, 22 bp, Homo sapiens
tttcataatatccagagatttt

SEQ ID NO: 8217725 - DNA, 22 bp, Homo sapiens
tttcataatagtgcagtttgtt

SEQ ID NO: 8217726 - DNA, 22 bp, Homo sapiens
tttccaggtattaatactgtat

SEQ ID NO: 8217727 - DNA, 22 bp, Homo sapiens
tttccaggtatcaagcttcagg

SEQ ID NO: 8217728 - DNA, 22 bp, Homo sapiens
tttccaggccagacctttcaat

SEQ ID NO: 8217729 - DNA, 22 bp, Homo sapiens
tttccagggaggaatgtggggt

SEQ ID NO: 8217730 - DNA, 22 bp, Homo sapiens
tttccagggaggaatgtggggt

SEQ ID NO: 8217731 - DNA, 18 bp, Homo sapiens
tttccagggattaggtgg

SEQ ID NO: 8217732 - DNA, 22 bp, Homo sapiens
tttccagtctctgcctccaagg

SEQ ID NO: 8217733 - DNA, 22 bp, Homo sapiens
tttccagtctcagccctgtaac

SEQ ID NO: 8217734 - DNA, 22 bp, Homo sapiens
tttccagtaagtggcaaggagc

SEQ ID NO: 8217735 - DNA, 22 bp, Homo sapiens
tttccagtcaccactagatcag

SEQ ID NO: 8217736 - DNA, 22 bp, Homo sapiens
tttccagtaagtggcaaggagc

SEQ ID NO: 8217737 - DNA, 22 bp, Homo sapiens
tttccagtccctggatttaacc

SEQ ID NO: 8217738 - DNA, 22 bp, Homo sapiens
tttccagtccctggatttaacc

SEQ ID NO: 8217739 - DNA, 22 bp, Homo sapiens
tttccagtgattgctgctctca

SEQ ID NO: 8217740 - DNA, 22 bp, Homo sapiens
tttccagtgatggggtctggct

SEQ ID NO: 8217741 - DNA, 22 bp, Homo sapiens
tttccagtgagcaaatgtagaa

SEQ ID NO: 8217742 - DNA, 22 bp, Homo sapiens
tttccagtgagcaaatgtagaa

SEQ ID NO: 8217743 - DNA, 22 bp, Homo sapiens
tttccagtgaattagtctgttt

SEQ ID NO: 8217744 - DNA, 22 bp, Homo sapiens
tttccagtgaattagtctgttt

SEQ ID NO: 8217745 - DNA, 22 bp, Homo sapiens
tttccagtgaaattttgaatgt

SEQ ID NO: 8217746 - DNA, 22 bp, Homo sapiens
tttccagtgaaattttgaatgt

SEQ ID NO: 8217747 - DNA, 22 bp, Homo sapiens
tttccagtgaaattttgaatgt

SEQ ID NO: 8217748 - DNA, 22 bp, Homo sapiens
tttccagattaagataccactt

SEQ ID NO: 8217749 - DNA, 22 bp, Homo sapiens
tttccagattaagataccactt

SEQ ID NO: 8217750 - DNA, 22 bp, Homo sapiens
tttccaggaagtaaggataatc

SEQ ID NO: 8217751 - DNA, 22 bp, Homo sapiens
tttccaggagaaagagagcctt

SEQ ID NO: 8217752 - DNA, 22 bp, Homo sapiens
tttcatcttcccagagaccttg

SEQ ID NO: 8217753 - DNA, 22 bp, Homo sapiens
tttcatcttatttgtctacatc

SEQ ID NO: 8217754 - DNA, 17 bp, Homo sapiens
tttcatctgggaccacc

SEQ ID NO: 8217755 - DNA, 22 bp, Homo sapiens
tttccaaataaggtcacattct

SEQ ID NO: 8217756 - DNA, 22 bp, Homo sapiens
tttccttgcacattggtttcca

SEQ ID NO: 8217757 - DNA, 22 bp, Homo sapiens
tttccttgcacattggtttcca

SEQ ID NO: 8217758 - DNA, 22 bp, Homo sapiens
tttccttgcctcctgtccttct

SEQ ID NO: 8217759 - DNA, 22 bp, Homo sapiens
tttcctttctggtttggtcata

SEQ ID NO: 8217760 - DNA, 22 bp, Homo sapiens
tttccttgcacattggtttcca

SEQ ID NO: 8217761 - DNA, 22 bp, Homo sapiens
tttccttcttagcggtgttctt

SEQ ID NO: 8217762 - DNA, 22 bp, Homo sapiens
tttccagtgggccccttgaaat

SEQ ID NO: 8217763 - DNA, 22 bp, Homo sapiens
tttccagtgcatggcaaatgct

SEQ ID NO: 8217764 - DNA, 22 bp, Homo sapiens
tttccagtgcatggcaaatgct

SEQ ID NO: 8217765 - DNA, 22 bp, Homo sapiens
tttccagtgcatggcaaatgct

SEQ ID NO: 8217766 - DNA, 22 bp, Homo sapiens
tttccagttgttctagaaagct

SEQ ID NO: 8217767 - DNA, 22 bp, Homo sapiens
tttccagttgttctagaaagct

SEQ ID NO: 8217768 - DNA, 22 bp, Homo sapiens
tttccagttgttctagaaagct

SEQ ID NO: 8217769 - DNA, 22 bp, Homo sapiens
tttccagtgggccccttgaaat

SEQ ID NO: 8217770 - DNA, 22 bp, Homo sapiens
tttccagttgtcctatcacctg

SEQ ID NO: 8217771 - DNA, 22 bp, Homo sapiens
tttccatgttatcttgcagact

SEQ ID NO: 8217772 - DNA, 22 bp, Homo sapiens
tttccatatttaatcaaaataa

SEQ ID NO: 8217773 - DNA, 22 bp, Homo sapiens
tttcccacacagtccactgcag

SEQ ID NO: 8217774 - DNA, 22 bp, Homo sapiens
tttcccaaagcctggggtgagt

SEQ ID NO: 8217775 - DNA, 22 bp, Homo sapiens
tttctaaactggattcagcctg

SEQ ID NO: 8217776 - DNA, 22 bp, Homo sapiens
tttctaaaatagattttatggt

SEQ ID NO: 8217777 - DNA, 22 bp, Homo sapiens
tttctaaaatagattttatggt

SEQ ID NO: 8217778 - DNA, 22 bp, Homo sapiens
tttcgtcaattgtaacaaatgt

SEQ ID NO: 8217779 - DNA, 22 bp, Homo sapiens
tttcgagggattagctaggact

SEQ ID NO: 8217780 - DNA, 22 bp, Homo sapiens
tttctaaatggtggctgcattg

SEQ ID NO: 8217781 - DNA, 22 bp, Homo sapiens
tttctaaatggtggctgcattg

SEQ ID NO: 8217782 - DNA, 22 bp, Homo sapiens
tttctaacagcaaatgtttatc

SEQ ID NO: 8217783 - DNA, 22 bp, Homo sapiens
tttctaacgtagacagggaggt

SEQ ID NO: 8217784 - DNA, 22 bp, Homo sapiens
tttctaacgtagacagggaggt

SEQ ID NO: 8217785 - DNA, 22 bp, Homo sapiens
tttctaagacatttgtcatctt

SEQ ID NO: 8217786 - DNA, 22 bp, Homo sapiens
tttctaagacatttgtcatctt

SEQ ID NO: 8217787 - DNA, 22 bp, Homo sapiens
tttctaagcttagtatgaggca

SEQ ID NO: 8217788 - DNA, 22 bp, Homo sapiens
tttcaagtggcgagataaggaa

SEQ ID NO: 8217789 - DNA, 22 bp, Homo sapiens
tttcaagtggcgagataaggaa

SEQ ID NO: 8217790 - DNA, 22 bp, Homo sapiens
tttcaagtggggacatttgaga

SEQ ID NO: 8217791 - DNA, 22 bp, Homo sapiens
tttcaagtggggacatttgaga

SEQ ID NO: 8217792 - DNA, 22 bp, Homo sapiens
tttcaagtggggacatttgaga

SEQ ID NO: 8217793 - DNA, 22 bp, Homo sapiens
tttcaagttcccagttttgtgg

SEQ ID NO: 8217794 - DNA, 22 bp, Homo sapiens
tttcaagttaaatggggtcttt

SEQ ID NO: 8217795 - DNA, 22 bp, Homo sapiens
tttcaagtgtcctgattaatgg

SEQ ID NO: 8217796 - DNA, 22 bp, Homo sapiens
tttcaagttctgttcctaaact

SEQ ID NO: 8217797 - DNA, 22 bp, Homo sapiens
tttcaagttctgttcctaaact

SEQ ID NO: 8217798 - DNA, 22 bp, Homo sapiens
tttcaagttctgttcctaaact

SEQ ID NO: 8217799 - DNA, 20 bp, Homo sapiens
tttcaagttgtaaggtatca

SEQ ID NO: 8217800 - DNA, 22 bp, Homo sapiens
tttcaagttgttgcattaaatg

SEQ ID NO: 8217801 - DNA, 22 bp, Homo sapiens
tttcaagttgttgcattaaatg

SEQ ID NO: 8217802 - DNA, 20 bp, Homo sapiens
tttcaagttgtaaggtatca

SEQ ID NO: 8217803 - DNA, 22 bp, Homo sapiens
tttcaagttgtttatatccaga

SEQ ID NO: 8217804 - DNA, 22 bp, Homo sapiens
tttcaagttgttgcattaaatg

SEQ ID NO: 8217805 - DNA, 22 bp, Homo sapiens
tttcaagttgttgcattaaatg

SEQ ID NO: 8217806 - DNA, 22 bp, Homo sapiens
tttcaagttgtttatatccaga

SEQ ID NO: 8217807 - DNA, 22 bp, Homo sapiens
tttcaatcaccataaagcaact

SEQ ID NO: 8217808 - DNA, 18 bp, Homo sapiens
tttcacaacctccagagg

SEQ ID NO: 8217809 - DNA, 19 bp, Homo sapiens
tttcaatggcttagagaaa

SEQ ID NO: 8217810 - DNA, 22 bp, Homo sapiens
tttcacaacgttgtggtgagag

SEQ ID NO: 8217811 - DNA, 22 bp, Homo sapiens
tttcacaagacagctactgttg

SEQ ID NO: 8217812 - DNA, 22 bp, Homo sapiens
tttcacaagacagctactgttg

SEQ ID NO: 8217813 - DNA, 22 bp, Homo sapiens
tttcacaactgcttatttgaga

SEQ ID NO: 8217814 - DNA, 22 bp, Homo sapiens
tttcaagtcagtagctaatcat

SEQ ID NO: 8217815 - DNA, 20 bp, Homo sapiens
tttcaagtcggtagagtcta

SEQ ID NO: 8217816 - DNA, 20 bp, Homo sapiens
tttcaagtcggtagagtcta

SEQ ID NO: 8217817 - DNA, 22 bp, Homo sapiens
tttcaagtcattctataatatc

SEQ ID NO: 8217818 - DNA, 22 bp, Homo sapiens
tttcaagtcattctataatatc

SEQ ID NO: 8217819 - DNA, 22 bp, Homo sapiens
tttcaagtaagatacatttcag

SEQ ID NO: 8217820 - DNA, 22 bp, Homo sapiens
tttcaagtaagatacatttcag

SEQ ID NO: 8217821 - DNA, 22 bp, Homo sapiens
tttcaagtactgtaaacatgct

SEQ ID NO: 8217822 - DNA, 22 bp, Homo sapiens
tttcaagtactgtaaacatgct

SEQ ID NO: 8217823 - DNA, 22 bp, Homo sapiens
tttcaagtagagggatcgctag

SEQ ID NO: 8217824 - DNA, 22 bp, Homo sapiens
tttcaaggtgcaggagggtttt

SEQ ID NO: 8217825 - DNA, 22 bp, Homo sapiens
tttcaaggccttctggttcagt

SEQ ID NO: 8217826 - DNA, 23 bp, Homo sapiens
tttatttatttaggctgagggat

SEQ ID NO: 8217827 - DNA, 23 bp, Homo sapiens
tttatttatttaggctgagggat

SEQ ID NO: 8217828 - DNA, 21 bp, Homo sapiens
tttatttatataggacacatg

SEQ ID NO: 8217829 - DNA, 21 bp, Homo sapiens
tttatttatataggacacatg

SEQ ID NO: 8217830 - DNA, 21 bp, Homo sapiens
tttatttatataggacacatg

SEQ ID NO: 8217831 - DNA, 21 bp, Homo sapiens
tttatttatataggacacatg

SEQ ID NO: 8217832 - DNA, 21 bp, Homo sapiens
tttatttatataggacacatg

SEQ ID NO: 8217833 - DNA, 21 bp, Homo sapiens
tttatttatataggacacatg

SEQ ID NO: 8217834 - DNA, 22 bp, Homo sapiens
tttatttataagccacttgctg

SEQ ID NO: 8217835 - DNA, 22 bp, Homo sapiens
tttatttataagccacttgctg

SEQ ID NO: 8217836 - DNA, 22 bp, Homo sapiens
tttatttataagccacttgctg

SEQ ID NO: 8217837 - DNA, 22 bp, Homo sapiens
tttatttataagccacttgctg

SEQ ID NO: 8217838 - DNA, 22 bp, Homo sapiens
tttatttataagccacttgctg

SEQ ID NO: 8217839 - DNA, 23 bp, Homo sapiens
tttatttatttaggctgagggat

SEQ ID NO: 8217840 - DNA, 22 bp, Homo sapiens
tttatttatccttctggattgc

SEQ ID NO: 8217841 - DNA, 22 bp, Homo sapiens
tttatttatccttctggattgc

SEQ ID NO: 8217842 - DNA, 22 bp, Homo sapiens
tttatttatccttctggattgc

SEQ ID NO: 8217843 - DNA, 22 bp, Homo sapiens
tttatttatccttctggattgc

SEQ ID NO: 8217844 - DNA, 22 bp, Homo sapiens
tttatttatccttctggattgc

SEQ ID NO: 8217845 - DNA, 22 bp, Homo sapiens
tttatttatccttctggattgc

SEQ ID NO: 8217846 - DNA, 21 bp, Homo sapiens
tttatttatataggacacatg

SEQ ID NO: 8217847 - DNA, 22 bp, Homo sapiens
tttcacatggactttttgttct

SEQ ID NO: 8217848 - DNA, 22 bp, Homo sapiens
tttcacaatcaaatggtgaaat

SEQ ID NO: 8217849 - DNA, 20 bp, Homo sapiens
tttcacaatgaacatgtctc

SEQ ID NO: 8217850 - DNA, 20 bp, Homo sapiens
tttcacaatgaacatgtctc

SEQ ID NO: 8217851 - DNA, 22 bp, Homo sapiens
tttcacaggagtcctttctata

SEQ ID NO: 8217852 - DNA, 22 bp, Homo sapiens
tttcacaggaatacccggcttt

SEQ ID NO: 8217853 - DNA, 22 bp, Homo sapiens
tttcacaggaatacccggcttt

SEQ ID NO: 8217854 - DNA, 23 bp, Homo sapiens
tttcacagcttttattctgcatc

SEQ ID NO: 8217855 - DNA, 22 bp, Homo sapiens
tttcacatcagaggtagattag

SEQ ID NO: 8217856 - DNA, 22 bp, Homo sapiens
tttcacaggtaagcaatacagg

SEQ ID NO: 8217857 - DNA, 22 bp, Homo sapiens
tttcacattggcttctatttct

SEQ ID NO: 8217858 - DNA, 22 bp, Homo sapiens
tttcacattggcttctatttct

SEQ ID NO: 8217859 - DNA, 22 bp, Homo sapiens
tttcacattcttctgaatctac

SEQ ID NO: 8217860 - DNA, 22 bp, Homo sapiens
tttcacattctctggttatcga

SEQ ID NO: 8217861 - DNA, 22 bp, Homo sapiens
tttcagtgtcagtaatgcagca

SEQ ID NO: 8217862 - DNA, 22 bp, Homo sapiens
tttcagtgtatcttccaaaagc

SEQ ID NO: 8217863 - DNA, 21 bp, Homo sapiens
tttcagtgtatgacagtgaaa

SEQ ID NO: 8217864 - DNA, 22 bp, Homo sapiens
tttcagtgtgagtgtcttattt

SEQ ID NO: 8217865 - DNA, 22 bp, Homo sapiens
tttcagtttgaaggaaaggcca

SEQ ID NO: 8217866 - DNA, 22 bp, Homo sapiens
tttcagtgtaaggtttccagga

SEQ ID NO: 8217867 - DNA, 22 bp, Homo sapiens
tttcagtgtaaggtttccagga

SEQ ID NO: 8217868 - DNA, 20 bp, Homo sapiens
tttcagtggtttgtgcctag

SEQ ID NO: 8217869 - DNA, 22 bp, Homo sapiens
tttcagtggcatcgattaccct

SEQ ID NO: 8217870 - DNA, 22 bp, Homo sapiens
tttcagtgggtttatttcatgt

SEQ ID NO: 8217871 - DNA, 22 bp, Homo sapiens
tttcacatttgttttaagaagt

SEQ ID NO: 8217872 - DNA, 22 bp, Homo sapiens
ttgtttaaaagaaatcatagaa

SEQ ID NO: 8217873 - DNA, 22 bp, Homo sapiens
ttgtttaaaagaaatcatagaa

SEQ ID NO: 8217874 - DNA, 22 bp, Homo sapiens
ttgttgtttccaggatactgtg

SEQ ID NO: 8217875 - DNA, 22 bp, Homo sapiens
ttgtttaaaagaaatcatagaa

SEQ ID NO: 8217876 - DNA, 22 bp, Homo sapiens
ttgttgttggagccaatatgca

SEQ ID NO: 8217877 - DNA, 22 bp, Homo sapiens
ttgttgttataggtggtacaag

SEQ ID NO: 8217878 - DNA, 22 bp, Homo sapiens
ttgttgtcattgtagaggattt

SEQ ID NO: 8217879 - DNA, 22 bp, Homo sapiens
ttgttgggcatgcagtggctgt

SEQ ID NO: 8217880 - DNA, 22 bp, Homo sapiens
ttgttgcatttcaagtatgaga

SEQ ID NO: 8217881 - DNA, 22 bp, Homo sapiens
ttgttgctcttgttgccacatg

SEQ ID NO: 8217882 - DNA, 22 bp, Homo sapiens
ttgttggtgaatagggtggaat

SEQ ID NO: 8217883 - DNA, 22 bp, Homo sapiens
ttgttggtggaattgatgctag

SEQ ID NO: 8217884 - DNA, 22 bp, Homo sapiens
ttgttgtagacgcgaagtgact

SEQ ID NO: 8217885 - DNA, 22 bp, Homo sapiens
ttgttgtcattgtagaggattt

SEQ ID NO: 8217886 - DNA, 22 bp, Homo sapiens
ttgttcttctctagagaagtgg

SEQ ID NO: 8217887 - DNA, 22 bp, Homo sapiens
ttgttcttggagcaggcagaga

SEQ ID NO: 8217888 - DNA, 23 bp, Homo sapiens
ttgttcttggatcttcctgaagc

SEQ ID NO: 8217889 - DNA, 22 bp, Homo sapiens
ttgttcttggagcaggcagaga

SEQ ID NO: 8217890 - DNA, 22 bp, Homo sapiens
ttgttcttggagcaggcagaga

SEQ ID NO: 8217891 - DNA, 22 bp, Homo sapiens
ttgttcttggagcaggcagaga

SEQ ID NO: 8217892 - DNA, 22 bp, Homo sapiens
ttgttcttctctagagaagtgg

SEQ ID NO: 8217893 - DNA, 21 bp, Homo sapiens
ttgttcttccagaagcaaagt

SEQ ID NO: 8217894 - DNA, 22 bp, Homo sapiens
ttgttcttagtatgcattgttt

SEQ ID NO: 8217895 - DNA, 22 bp, Homo sapiens
ttgttcttacttaagagtgaat

SEQ ID NO: 8217896 - DNA, 22 bp, Homo sapiens
ttgttcttacttaagagtgaat

SEQ ID NO: 8217897 - DNA, 22 bp, Homo sapiens
ttgttcttttgcttagacagat

SEQ ID NO: 8217898 - DNA, 22 bp, Homo sapiens
ttgttctttatcctggaagcct

SEQ ID NO: 8217899 - DNA, 22 bp, Homo sapiens
ttgttgcaacagacaccatatg

SEQ ID NO: 8217900 - DNA, 22 bp, Homo sapiens
ttgttgatgtggacgtctggaa

SEQ ID NO: 8217901 - DNA, 23 bp, Homo sapiens
tttaactttccaataattcattg

SEQ ID NO: 8217902 - DNA, 23 bp, Homo sapiens
tttaactttccaataattcattg

SEQ ID NO: 8217903 - DNA, 22 bp, Homo sapiens
tttaagaagttatgttataaat

SEQ ID NO: 8217904 - DNA, 22 bp, Homo sapiens
tttaacttagaagagatatcct

SEQ ID NO: 8217905 - DNA, 22 bp, Homo sapiens
tttaacttaatctgcttgatga

SEQ ID NO: 8217906 - DNA, 22 bp, Homo sapiens
tttaacctgtcaatttgcatgc

SEQ ID NO: 8217907 - DNA, 22 bp, Homo sapiens
tttaacctctaatttagttctc

SEQ ID NO: 8217908 - DNA, 22 bp, Homo sapiens
tttaacatgttcaagaaacata

SEQ ID NO: 8217909 - DNA, 22 bp, Homo sapiens
tttaacatgttcaagaaacata

SEQ ID NO: 8217910 - DNA, 22 bp, Homo sapiens
tttaacatgttcaagaaacata

SEQ ID NO: 8217911 - DNA, 23 bp, Homo sapiens
tttaacatttgaacatgtggcca

SEQ ID NO: 8217912 - DNA, 22 bp, Homo sapiens
tttaaattatagttaatgtctg

SEQ ID NO: 8217913 - DNA, 22 bp, Homo sapiens
tttaaattatagttaatgtctg

SEQ ID NO: 8217914 - DNA, 22 bp, Homo sapiens
tttaaattatagttaatgtctg

SEQ ID NO: 8217915 - DNA, 22 bp, Homo sapiens
tttaacagatgtgaaattttca

SEQ ID NO: 8217916 - DNA, 22 bp, Homo sapiens
tttaacaggtaaagtaaatgtg

SEQ ID NO: 8217917 - DNA, 22 bp, Homo sapiens
tttaacaggtaaagtaaatgtg

SEQ ID NO: 8217918 - DNA, 22 bp, Homo sapiens
tttaacatgtaattgctgcttt

SEQ ID NO: 8217919 - DNA, 22 bp, Homo sapiens
tttaacatgtgaattttggaag

SEQ ID NO: 8217920 - DNA, 22 bp, Homo sapiens
tttaacatgttcaagaaacata

SEQ ID NO: 8217921 - DNA, 22 bp, Homo sapiens
tttacagatctgttgatttgtt

SEQ ID NO: 8217922 - DNA, 22 bp, Homo sapiens
tttacagaggtgtcctgcattg

SEQ ID NO: 8217923 - DNA, 22 bp, Homo sapiens
tttacagatgaggaaactgaga

SEQ ID NO: 8217924 - DNA, 22 bp, Homo sapiens
tttacagatgaggaaactgaga

SEQ ID NO: 8217925 - DNA, 22 bp, Homo sapiens
tttacagatgaggatactgagg

SEQ ID NO: 8217926 - DNA, 22 bp, Homo sapiens
tttacagatgaggatactgagg

SEQ ID NO: 8217927 - DNA, 22 bp, Homo sapiens
tttacagatgtggaaagtgagc

SEQ ID NO: 8217928 - DNA, 22 bp, Homo sapiens
tttacagatgtggaaagtgagc

SEQ ID NO: 8217929 - DNA, 22 bp, Homo sapiens
tttacagatgtggaaagtgagc

SEQ ID NO: 8217930 - DNA, 22 bp, Homo sapiens
tttacagattctgggtattagg

SEQ ID NO: 8217931 - DNA, 22 bp, Homo sapiens
tttacagcagcatgatttataa

SEQ ID NO: 8217932 - DNA, 22 bp, Homo sapiens
tttacagcactgaagccagggg

SEQ ID NO: 8217933 - DNA, 22 bp, Homo sapiens
tttacagagaatgtacataaag

SEQ ID NO: 8217934 - DNA, 22 bp, Homo sapiens
tttacagagaatgtacataaag

SEQ ID NO: 8217935 - DNA, 22 bp, Homo sapiens
tttacagagaatgtacataaag

SEQ ID NO: 8217936 - DNA, 22 bp, Homo sapiens
tttacagagagagaactggact

SEQ ID NO: 8217937 - DNA, 22 bp, Homo sapiens
tttacagagaatgtacataaag

SEQ ID NO: 8217938 - DNA, 22 bp, Homo sapiens
tttacagaatgttgaatttggg

SEQ ID NO: 8217939 - DNA, 22 bp, Homo sapiens
tttacacttgaggaaactgagg

SEQ ID NO: 8217940 - DNA, 22 bp, Homo sapiens
tttacacttgaggaaactgagg

SEQ ID NO: 8217941 - DNA, 22 bp, Homo sapiens
tttacacttgaggaaactgagg

SEQ ID NO: 8217942 - DNA, 22 bp, Homo sapiens
tttacactgtgaaacaggtatc

SEQ ID NO: 8217943 - DNA, 22 bp, Homo sapiens
tttacacttattatgaagcttt

SEQ ID NO: 8217944 - DNA, 22 bp, Homo sapiens
tttaagagcatttgcaatttat

SEQ ID NO: 8217945 - DNA, 22 bp, Homo sapiens
tttaagagcatttgcaatttat

SEQ ID NO: 8217946 - DNA, 22 bp, Homo sapiens
tttaagacttagatttattggg

SEQ ID NO: 8217947 - DNA, 22 bp, Homo sapiens
tttaagactcttgtagtacaca

SEQ ID NO: 8217948 - DNA, 22 bp, Homo sapiens
tttaagaagttatgttataaat

SEQ ID NO: 8217949 - DNA, 22 bp, Homo sapiens
tttaagagctagtatgtcattt

SEQ ID NO: 8217950 - DNA, 22 bp, Homo sapiens
tttaagagttaaactttgacct

SEQ ID NO: 8217951 - DNA, 22 bp, Homo sapiens
tttaagagctagtatgtcattt

SEQ ID NO: 8217952 - DNA, 22 bp, Homo sapiens
tttaagagcctgtacaaatatt

SEQ ID NO: 8217953 - DNA, 22 bp, Homo sapiens
tttaagatcatttgtattatcc

SEQ ID NO: 8217954 - DNA, 22 bp, Homo sapiens
tttaagatcatttgtattatcc

SEQ ID NO: 8217955 - DNA, 22 bp, Homo sapiens
tttaagatcatttgtattatcc

SEQ ID NO: 8217956 - DNA, 19 bp, Homo sapiens
tttacaagttctttgtatg

SEQ ID NO: 8217957 - DNA, 22 bp, Homo sapiens
tttacaagtctgttgatcccaa

SEQ ID NO: 8217958 - DNA, 22 bp, Homo sapiens
tttacaagtcagggactgttct

SEQ ID NO: 8217959 - DNA, 19 bp, Homo sapiens
tttacaagttctttgtatg

SEQ ID NO: 8217960 - DNA, 22 bp, Homo sapiens
tttacaagtttacagaatgatg

SEQ ID NO: 8217961 - DNA, 22 bp, Homo sapiens
tttacacattattttcagtgtg

SEQ ID NO: 8217962 - DNA, 22 bp, Homo sapiens
tttacacattattttcagtgtg

SEQ ID NO: 8217963 - DNA, 22 bp, Homo sapiens
tttacacattattttcagtgtg

SEQ ID NO: 8217964 - DNA, 22 bp, Homo sapiens
tttacactgcttgaacaatctc

SEQ ID NO: 8217965 - DNA, 22 bp, Homo sapiens
tttacactgcttgaacaatctc

SEQ ID NO: 8217966 - DNA, 22 bp, Homo sapiens
tttacactgtgaaacaggtatc

SEQ ID NO: 8217967 - DNA, 22 bp, Homo sapiens
tttacactgtgaaacaggtatc

SEQ ID NO: 8217968 - DNA, 22 bp, Homo sapiens
tttacactgacagcacataagg

SEQ ID NO: 8217969 - DNA, 22 bp, Homo sapiens
tttacacgtcacattagcggag

SEQ ID NO: 8217970 - DNA, 22 bp, Homo sapiens
tttacacggcattatcttcatg

SEQ ID NO: 8217971 - DNA, 22 bp, Homo sapiens
tttacactcctggaaatgatat

SEQ ID NO: 8217972 - DNA, 22 bp, Homo sapiens
tttacaccaaaatgacacagag

SEQ ID NO: 8217973 - DNA, 22 bp, Homo sapiens
tttacacattattttcagtgtg

SEQ ID NO: 8217974 - DNA, 18 bp, Homo sapiens
tttagtggtgcatttgac

SEQ ID NO: 8217975 - DNA, 22 bp, Homo sapiens
tttagtgtaagcataaagaaca

SEQ ID NO: 8217976 - DNA, 22 bp, Homo sapiens
tttagtgctttgctattcatgg

SEQ ID NO: 8217977 - DNA, 22 bp, Homo sapiens
tttagtgtaattctgccttttg

SEQ ID NO: 8217978 - DNA, 22 bp, Homo sapiens
tttagtgtaagcataaagaaca

SEQ ID NO: 8217979 - DNA, 22 bp, Homo sapiens
tttagtgtagcattcagagtca

SEQ ID NO: 8217980 - DNA, 22 bp, Homo sapiens
tttagtgtagcattcagagtca

SEQ ID NO: 8217981 - DNA, 22 bp, Homo sapiens
tttagtgtaattctgccttttg

SEQ ID NO: 8217982 - DNA, 22 bp, Homo sapiens
tttagtgtagcctaagcagaat

SEQ ID NO: 8217983 - DNA, 22 bp, Homo sapiens
tttagtgtgacagtccccagta

SEQ ID NO: 8217984 - DNA, 22 bp, Homo sapiens
tttagtgtggcactgatgttca

SEQ ID NO: 8217985 - DNA, 22 bp, Homo sapiens
tttagtgtggcactgatgttca

SEQ ID NO: 8217986 - DNA, 22 bp, Homo sapiens
tttagtgtttgcgtgtactcct

SEQ ID NO: 8217987 - DNA, 22 bp, Homo sapiens
tttatctggactgtgatataaa

SEQ ID NO: 8217988 - DNA, 22 bp, Homo sapiens
tttatctgttcctcttggaggc

SEQ ID NO: 8217989 - DNA, 22 bp, Homo sapiens
tttatctgtggtaaataacatt

SEQ ID NO: 8217990 - DNA, 22 bp, Homo sapiens
tttatctttaggactttgcaga

SEQ ID NO: 8217991 - DNA, 22 bp, Homo sapiens
tttatctttaggactttgcaga

SEQ ID NO: 8217992 - DNA, 22 bp, Homo sapiens
tttatctttaggactttgcaga

SEQ ID NO: 8217993 - DNA, 22 bp, Homo sapiens
tttatctttaggactttgcaga

SEQ ID NO: 8217994 - DNA, 22 bp, Homo sapiens
tttatctttaggactttgcaga

SEQ ID NO: 8217995 - DNA, 22 bp, Homo sapiens
tttatctgttgtacatttatgc

SEQ ID NO: 8217996 - DNA, 22 bp, Homo sapiens
tttatctgttgtacatttatgc

SEQ ID NO: 8217997 - DNA, 22 bp, Homo sapiens
tttagcttaaattgtaagtgaa

SEQ ID NO: 8217998 - DNA, 19 bp, Homo sapiens
tttagcttacgtttcattg

SEQ ID NO: 8217999 - DNA, 22 bp, Homo sapiens
tttagcttaaatggagaaagag

SEQ ID NO: 8218000 - DNA, 22 bp, Homo sapiens
tttagcttcatcttcaagctgg

SEQ ID NO: 8218001 - DNA, 22 bp, Homo sapiens
tttagcattaagcttttcaaat

SEQ ID NO: 8218002 - DNA, 22 bp, Homo sapiens
tttacagcttctatactatgtg

SEQ ID NO: 8218003 - DNA, 22 bp, Homo sapiens
tttacagctgctggcaagcttg

SEQ ID NO: 8218004 - DNA, 22 bp, Homo sapiens
tttacagcttctatactatgtg

SEQ ID NO: 8218005 - DNA, 22 bp, Homo sapiens
tttagcttttgtgtcagataag

SEQ ID NO: 8218006 - DNA, 22 bp, Homo sapiens
tttaggcaagaactcactgaga

SEQ ID NO: 8218007 - DNA, 22 bp, Homo sapiens
tttaggatgctctattctgact

SEQ ID NO: 8218008 - DNA, 22 bp, Homo sapiens
tttatgagcctcaaatctgagt

SEQ ID NO: 8218009 - DNA, 22 bp, Homo sapiens
tttatgacccaagaagatacca

SEQ ID NO: 8218010 - DNA, 22 bp, Homo sapiens
tttatgacttctaatctgaagc

SEQ ID NO: 8218011 - DNA, 22 bp, Homo sapiens
tttatgacattacaatatcaag

SEQ ID NO: 8218012 - DNA, 22 bp, Homo sapiens
tttatgacccaagaagatacca

SEQ ID NO: 8218013 - DNA, 21 bp, Homo sapiens
tttatgtacttcatagagtag

SEQ ID NO: 8218014 - DNA, 22 bp, Homo sapiens
tttatgtaatttcataggtgtg

SEQ ID NO: 8218015 - DNA, 22 bp, Homo sapiens
tttatgtacatatccacaagga

SEQ ID NO: 8218016 - DNA, 22 bp, Homo sapiens
tttatgaaccactctacacctt

SEQ ID NO: 8218017 - DNA, 22 bp, Homo sapiens
tttatctttggatcttcagaaa

SEQ ID NO: 8218018 - DNA, 22 bp, Homo sapiens
tttatctttggatcttcagaaa

SEQ ID NO: 8218019 - DNA, 22 bp, Homo sapiens
tttatgaactacagatataact

SEQ ID NO: 8218020 - DNA, 22 bp, Homo sapiens
tttatgacaagcattactgatt

SEQ ID NO: 8218021 - DNA, 22 bp, Homo sapiens
tttatgacattacaatatcaag

SEQ ID NO: 8218022 - DNA, 22 bp, Homo sapiens
tttatgaactacagatataact

SEQ ID NO: 8218023 - DNA, 22 bp, Homo sapiens
tttatgaactacagatataact

SEQ ID NO: 8218024 - DNA, 21 bp, Homo sapiens
tttatgtacttcatagagtag

SEQ ID NO: 8218025 - DNA, 21 bp, Homo sapiens
tttatgtacttcatagagtag

SEQ ID NO: 8218026 - DNA, 21 bp, Homo sapiens
tttatgtacttcatagagtag

SEQ ID NO: 8218027 - DNA, 21 bp, Homo sapiens
tttatgtacttcatagagtag

SEQ ID NO: 8218028 - DNA, 22 bp, Homo sapiens
tttatgtcccttcaaatgttta

SEQ ID NO: 8218029 - DNA, 22 bp, Homo sapiens
tttatgtcactttgaaagagag

SEQ ID NO: 8218030 - DNA, 22 bp, Homo sapiens
tttatgttcctcttgagctttc

SEQ ID NO: 8218031 - DNA, 22 bp, Homo sapiens
tttatgttcctcttgagctttc

SEQ ID NO: 8218032 - DNA, 22 bp, Homo sapiens
tttatgtttgacaatgatctgg

SEQ ID NO: 8218033 - DNA, 22 bp, Homo sapiens
tttatgtttgacaatgatctgg

SEQ ID NO: 8218034 - DNA, 22 bp, Homo sapiens
tttatgttcctcttgagctttc

SEQ ID NO: 8218035 - DNA, 22 bp, Homo sapiens
tttatgtttgacaatgatctgg

SEQ ID NO: 8218036 - DNA, 22 bp, Homo sapiens
tttatgtttgacaatgatctgg

SEQ ID NO: 8218037 - DNA, 22 bp, Homo sapiens
tttatgtttgcattttcaaaga

SEQ ID NO: 8218038 - DNA, 22 bp, Homo sapiens
tttatgtttgcattttcaaaga

SEQ ID NO: 8218039 - DNA, 22 bp, Homo sapiens
tttattgccctgtagtacagga

SEQ ID NO: 8218040 - DNA, 22 bp, Homo sapiens
tttattgccctgtagtacagga

SEQ ID NO: 8218041 - DNA, 22 bp, Homo sapiens
tttattgccctgtagtacagga

SEQ ID NO: 8218042 - DNA, 22 bp, Homo sapiens
tttattggatatttacaagata

SEQ ID NO: 8218043 - DNA, 22 bp, Homo sapiens
tttattggatatttacaagata

SEQ ID NO: 8218044 - DNA, 22 bp, Homo sapiens
tttattggatggatggatggat

SEQ ID NO: 8218045 - DNA, 22 bp, Homo sapiens
tttattggatgggtcagctcta

SEQ ID NO: 8218046 - DNA, 20 bp, Homo sapiens
tttattggcctttcaggaac

SEQ ID NO: 8218047 - DNA, 22 bp, Homo sapiens
tttattggaacacagccatgac

SEQ ID NO: 8218048 - DNA, 22 bp, Homo sapiens
tttattggaacacagccatgac

SEQ ID NO: 8218049 - DNA, 22 bp, Homo sapiens
tttattggaacacagccatgac

SEQ ID NO: 8218050 - DNA, 22 bp, Homo sapiens
tttattgctgtgttagggacag

SEQ ID NO: 8218051 - DNA, 22 bp, Homo sapiens
tttattgctgtgttagggacag

SEQ ID NO: 8218052 - DNA, 22 bp, Homo sapiens
tttattgggcctggaggatcta

SEQ ID NO: 8218053 - DNA, 22 bp, Homo sapiens
tttattgggtgcagtgcccaca

SEQ ID NO: 8218054 - DNA, 22 bp, Homo sapiens
tttattgtctatgaactgcttg

SEQ ID NO: 8218055 - DNA, 16 bp, Homo sapiens
tttatttactagtgtt

SEQ ID NO: 8218056 - DNA, 16 bp, Homo sapiens
tttatttactagtgtt

SEQ ID NO: 8218057 - DNA, 16 bp, Homo sapiens
tttatttactagtgtt

SEQ ID NO: 8218058 - DNA, 22 bp, Homo sapiens
tttattgtgttgaaactgaatt

SEQ ID NO: 8218059 - DNA, 22 bp, Homo sapiens
tttatttataagccacttgctg

SEQ ID NO: 8218060 - DNA, 22 bp, Homo sapiens
tttatttataagccacttgctg

SEQ ID NO: 8218061 - DNA, 22 bp, Homo sapiens
tttattgtctatgaactgcttg

SEQ ID NO: 8218062 - DNA, 22 bp, Homo sapiens
ttattttgtagctctgatcttt

SEQ ID NO: 8218063 - DNA, 23 bp, Homo sapiens
ttcaaaactggaaaatcagatgc

SEQ ID NO: 8218064 - DNA, 22 bp, Homo sapiens
ttattttggtaaatgtttgcct

SEQ ID NO: 8218065 - DNA, 22 bp, Homo sapiens
ttattttggtaaatgtttgcct

SEQ ID NO: 8218066 - DNA, 22 bp, Homo sapiens
ttattttggtaaatgtttgcct

SEQ ID NO: 8218067 - DNA, 22 bp, Homo sapiens
ttattttgtagctctgatcttt

SEQ ID NO: 8218068 - DNA, 21 bp, Homo sapiens
ttcaaaatggtgtgtttgtct

SEQ ID NO: 8218069 - DNA, 22 bp, Homo sapiens
ttattttgagagaatgtgtgct

SEQ ID NO: 8218070 - DNA, 22 bp, Homo sapiens
ttattttgccacaggtgacctt

SEQ ID NO: 8218071 - DNA, 22 bp, Homo sapiens
ttattttgccacaggtgacctt

SEQ ID NO: 8218072 - DNA, 22 bp, Homo sapiens
ttattttctcctcagaaagtgg

SEQ ID NO: 8218073 - DNA, 22 bp, Homo sapiens
ttattttctcctcagaaagtgg

SEQ ID NO: 8218074 - DNA, 22 bp, Homo sapiens
ttattttctcctcagaaagtgg

SEQ ID NO: 8218075 - DNA, 22 bp, Homo sapiens
ttattttaccttcctctgagct

SEQ ID NO: 8218076 - DNA, 22 bp, Homo sapiens
ttattttaccttcctctgagct

SEQ ID NO: 8218077 - DNA, 22 bp, Homo sapiens
ttattttaccttcctctgagct

SEQ ID NO: 8218078 - DNA, 22 bp, Homo sapiens
ttattttctcctcagaaagtgg

SEQ ID NO: 8218079 - DNA, 22 bp, Homo sapiens
ttcaagcagggattggtgatgg

SEQ ID NO: 8218080 - DNA, 22 bp, Homo sapiens
ttcaagcagttaagcagtctcc

SEQ ID NO: 8218081 - DNA, 22 bp, Homo sapiens
ttcaagcagggattggtgatgg

SEQ ID NO: 8218082 - DNA, 22 bp, Homo sapiens
ttcaaggagattggagtctact

SEQ ID NO: 8218083 - DNA, 22 bp, Homo sapiens
ttcaagcaagtcctttgtgcat

SEQ ID NO: 8218084 - DNA, 22 bp, Homo sapiens
ttcaagcagggattggtgatgg

SEQ ID NO: 8218085 - DNA, 22 bp, Homo sapiens
ttcaagcagagatatttcaaga

SEQ ID NO: 8218086 - DNA, 22 bp, Homo sapiens
ttcaagatggctgcaaatactt

SEQ ID NO: 8218087 - DNA, 22 bp, Homo sapiens
ttcaagatggccccagtgagcc

SEQ ID NO: 8218088 - DNA, 22 bp, Homo sapiens
ttcaagatgacccagtcacacg

SEQ ID NO: 8218089 - DNA, 22 bp, Homo sapiens
ttcaagatgccagggacgcggc

SEQ ID NO: 8218090 - DNA, 22 bp, Homo sapiens
ttcaagatggcaccagtgagtg

SEQ ID NO: 8218091 - DNA, 22 bp, Homo sapiens
ttcaagatcgagtttaaagtga

SEQ ID NO: 8218092 - DNA, 22 bp, Homo sapiens
ttcaagatcttccaaaggatac

SEQ ID NO: 8218093 - DNA, 22 bp, Homo sapiens
ttcaagatcttccaaaggatac

SEQ ID NO: 8218094 - DNA, 22 bp, Homo sapiens
ttcaagaatcttcctgaccact

SEQ ID NO: 8218095 - DNA, 22 bp, Homo sapiens
ttcaagaggcttaattctggat

SEQ ID NO: 8218096 - DNA, 18 bp, Homo sapiens
ttcaagagtttctctagg

SEQ ID NO: 8218097 - DNA, 21 bp, Homo sapiens
ttcaagatatttaaaaggtgg

SEQ ID NO: 8218098 - DNA, 17 bp, Homo sapiens
ttcaagatattgaaatg

SEQ ID NO: 8218099 - DNA, 22 bp, Homo sapiens
ttcaagataataggaatgaaaa

SEQ ID NO: 8218100 - DNA, 22 bp, Homo sapiens
ttcaaaattgttctaagctctg

SEQ ID NO: 8218101 - DNA, 22 bp, Homo sapiens
ttatttgttttctgagaagtat

SEQ ID NO: 8218102 - DNA, 22 bp, Homo sapiens
ttattttaccttcctctgagct

SEQ ID NO: 8218103 - DNA, 22 bp, Homo sapiens
ttatttgtggcatccatgttgg

SEQ ID NO: 8218104 - DNA, 22 bp, Homo sapiens
ttatttgtggcatatgagacga

SEQ ID NO: 8218105 - DNA, 22 bp, Homo sapiens
ttatttgtggcatatgagacga

SEQ ID NO: 8218106 - DNA, 22 bp, Homo sapiens
ttatttgtggcatatgagacga

SEQ ID NO: 8218107 - DNA, 22 bp, Homo sapiens
ttatttatatctctgcagttta

SEQ ID NO: 8218108 - DNA, 22 bp, Homo sapiens
ttatttagtctagatgaatttt

SEQ ID NO: 8218109 - DNA, 22 bp, Homo sapiens
ttatttagtctagatgaatttt

SEQ ID NO: 8218110 - DNA, 22 bp, Homo sapiens
ttatttatggcactgttggtgg

SEQ ID NO: 8218111 - DNA, 22 bp, Homo sapiens
ttatttgtggcatatgagacga

SEQ ID NO: 8218112 - DNA, 22 bp, Homo sapiens
ttatttatggcactgttggtgg

SEQ ID NO: 8218113 - DNA, 22 bp, Homo sapiens
ttatttatatctctgcagttta

SEQ ID NO: 8218114 - DNA, 22 bp, Homo sapiens
ttatttatatctctgcagttta

SEQ ID NO: 8218115 - DNA, 22 bp, Homo sapiens
ttatttacaactcttctcttcc

SEQ ID NO: 8218116 - DNA, 22 bp, Homo sapiens
ttatttacaactcttctcttcc

SEQ ID NO: 8218117 - DNA, 22 bp, Homo sapiens
ttatttactggatggccttggg

SEQ ID NO: 8218118 - DNA, 22 bp, Homo sapiens
ttatttactggatggccttggg

SEQ ID NO: 8218119 - DNA, 22 bp, Homo sapiens
ttatttaggaggaaactgaggt

SEQ ID NO: 8218120 - DNA, 22 bp, Homo sapiens
ttatttaattttctcactcaga

SEQ ID NO: 8218121 - DNA, 22 bp, Homo sapiens
ttatttaattttctcactcaga

SEQ ID NO: 8218122 - DNA, 22 bp, Homo sapiens
ttatttaattttctcactcaga

SEQ ID NO: 8218123 - DNA, 22 bp, Homo sapiens
ttatttaattttctcactcaga

SEQ ID NO: 8218124 - DNA, 22 bp, Homo sapiens
ttatttaattttctcactcaga

SEQ ID NO: 8218125 - DNA, 22 bp, Homo sapiens
ttatttaattttctcactcaga

SEQ ID NO: 8218126 - DNA, 22 bp, Homo sapiens
ttatttaattttctcactcaga

SEQ ID NO: 8218127 - DNA, 22 bp, Homo sapiens
ttatgtttgagtatatgactca

SEQ ID NO: 8218128 - DNA, 22 bp, Homo sapiens
ttatgttatgctatttcagata

SEQ ID NO: 8218129 - DNA, 22 bp, Homo sapiens
ttatgttatgaatggatgatct

SEQ ID NO: 8218130 - DNA, 22 bp, Homo sapiens
ttatgttatgctatttcagata

SEQ ID NO: 8218131 - DNA, 22 bp, Homo sapiens
ttatgttttatggctatatcat

SEQ ID NO: 8218132 - DNA, 22 bp, Homo sapiens
ttatgttttatggctatatcat

SEQ ID NO: 8218133 - DNA, 22 bp, Homo sapiens
ttatgttttaagtgtgtatctt

SEQ ID NO: 8218134 - DNA, 22 bp, Homo sapiens
ttatgtttgagtatatgactca

SEQ ID NO: 8218135 - DNA, 22 bp, Homo sapiens
ttatgttttaagtgtgtatctt

SEQ ID NO: 8218136 - DNA, 22 bp, Homo sapiens
ttattgttagtgagactgtaga

SEQ ID NO: 8218137 - DNA, 22 bp, Homo sapiens
ttattgttagtgagactgtaga

SEQ ID NO: 8218138 - DNA, 22 bp, Homo sapiens
ttattgttagtgagactgtaga

SEQ ID NO: 8218139 - DNA, 22 bp, Homo sapiens
ttattgtttactagtttgcaga

SEQ ID NO: 8218140 - DNA, 22 bp, Homo sapiens
ttattgtttactagtttgcaga

SEQ ID NO: 8218141 - DNA, 22 bp, Homo sapiens
ttatttaatgtgatctgaagag

SEQ ID NO: 8218142 - DNA, 22 bp, Homo sapiens
ttatttaatgtgatctgaagag

SEQ ID NO: 8218143 - DNA, 22 bp, Homo sapiens
ttatttaaaatgtaggttggga

SEQ ID NO: 8218144 - DNA, 22 bp, Homo sapiens
ttatttaaaagtggtaagattc

SEQ ID NO: 8218145 - DNA, 22 bp, Homo sapiens
ttatttaaaagtggtaagattc

SEQ ID NO: 8218146 - DNA, 22 bp, Homo sapiens
ttattgtttgggtataatttga

SEQ ID NO: 8218147 - DNA, 22 bp, Homo sapiens
ttattgtttgggtataatttga

SEQ ID NO: 8218148 - DNA, 22 bp, Homo sapiens
ttattgtttgggtataatttga

SEQ ID NO: 8218149 - DNA, 22 bp, Homo sapiens
ttattgtttgggtataatttga

SEQ ID NO: 8218150 - DNA, 22 bp, Homo sapiens
ttattgtttgggtataatttga

SEQ ID NO: 8218151 - DNA, 22 bp, Homo sapiens
ttattgtttgggtataatttga

SEQ ID NO: 8218152 - DNA, 22 bp, Homo sapiens
ttatttaaaagtggtaagattc

SEQ ID NO: 8218153 - DNA, 22 bp, Homo sapiens
ttatttaaaagtggtaagattc

SEQ ID NO: 8218154 - DNA, 22 bp, Homo sapiens
ttatttaaaagtggtaagattc

SEQ ID NO: 8218155 - DNA, 22 bp, Homo sapiens
ttatttaaaagtggtaagattc

SEQ ID NO: 8218156 - DNA, 22 bp, Homo sapiens
ttatttaaaagtggtaagattc

SEQ ID NO: 8218157 - DNA, 22 bp, Homo sapiens
ttatttaaaagtggtaagattc

SEQ ID NO: 8218158 - DNA, 22 bp, Homo sapiens
ttatttaaaagtggtaagattc

SEQ ID NO: 8218159 - DNA, 19 bp, Homo sapiens
tcctccttacttcctcttg

SEQ ID NO: 8218160 - DNA, 22 bp, Homo sapiens
tcctcctgtttctcaggcctgg

SEQ ID NO: 8218161 - DNA, 20 bp, Homo sapiens
tcctccttgcagagcccaga

SEQ ID NO: 8218162 - DNA, 22 bp, Homo sapiens
tcctccttgttcttttgcctac

SEQ ID NO: 8218163 - DNA, 22 bp, Homo sapiens
tcctccttcgggactgcttgac

SEQ ID NO: 8218164 - DNA, 22 bp, Homo sapiens
tcctccttcgggactgcttgac

SEQ ID NO: 8218165 - DNA, 21 bp, Homo sapiens
tcctccttcaagtcctggcct

SEQ ID NO: 8218166 - DNA, 21 bp, Homo sapiens
tcctccttcaagtcctggcct

SEQ ID NO: 8218167 - DNA, 21 bp, Homo sapiens
tcctccttcaagtcctggcct

SEQ ID NO: 8218168 - DNA, 22 bp, Homo sapiens
tcctcctgtctaccagttcctg

SEQ ID NO: 8218169 - DNA, 21 bp, Homo sapiens
tcctcctgtagagggtcctgg

SEQ ID NO: 8218170 - DNA, 21 bp, Homo sapiens
tcctcctgtagagggtcctgg

SEQ ID NO: 8218171 - DNA, 22 bp, Homo sapiens
tcctcctgtctaccagttcctg

SEQ ID NO: 8218172 - DNA, 22 bp, Homo sapiens
tcctcctgtctaccagttcctg

SEQ ID NO: 8218173 - DNA, 22 bp, Homo sapiens
tcctcctgtctaccagttcctg

SEQ ID NO: 8218174 - DNA, 22 bp, Homo sapiens
tcctcctgtttctcaggcctgg

SEQ ID NO: 8218175 - DNA, 22 bp, Homo sapiens
tcctcctgtttctcaggcctgg

SEQ ID NO: 8218176 - DNA, 22 bp, Homo sapiens
tcctcctgtttctcaggcctgg

SEQ ID NO: 8218177 - DNA, 22 bp, Homo sapiens
tcctctccagcaaactggctat

SEQ ID NO: 8218178 - DNA, 22 bp, Homo sapiens
tcctctccagcaaactggctat

SEQ ID NO: 8218179 - DNA, 22 bp, Homo sapiens
tcctctccagcaaactggctat

SEQ ID NO: 8218180 - DNA, 22 bp, Homo sapiens
tcctctccagcaaactggctat

SEQ ID NO: 8218181 - DNA, 22 bp, Homo sapiens
tcctctgctcagcattcctcac

SEQ ID NO: 8218182 - DNA, 22 bp, Homo sapiens
tcctctgccccagatgaaattt

SEQ ID NO: 8218183 - DNA, 23 bp, Homo sapiens
tcctcgcaggagggagatgatgc

SEQ ID NO: 8218184 - DNA, 23 bp, Homo sapiens
tcctcgcaggagggagatgatgc

SEQ ID NO: 8218185 - DNA, 21 bp, Homo sapiens
tcctctactgagccatgcaga

SEQ ID NO: 8218186 - DNA, 22 bp, Homo sapiens
tcctcctttccccgctggagcc

SEQ ID NO: 8218187 - DNA, 22 bp, Homo sapiens
tcctcctttccccgctggagcc

SEQ ID NO: 8218188 - DNA, 23 bp, Homo sapiens
tcctccttttgcttgtgcttccc

SEQ ID NO: 8218189 - DNA, 22 bp, Homo sapiens
tcctccttgttttgtctctgct

SEQ ID NO: 8218190 - DNA, 22 bp, Homo sapiens
tcctccttgttttgtctctgct

SEQ ID NO: 8218191 - DNA, 22 bp, Homo sapiens
tcctccttgttttcctgtttac

SEQ ID NO: 8218192 - DNA, 17 bp, Homo sapiens
ttagtgtatctgttttg

SEQ ID NO: 8218193 - DNA, 23 bp, Homo sapiens
ttagtgtaaggcaggcacagttg

SEQ ID NO: 8218194 - DNA, 22 bp, Homo sapiens
ttagtgtattttcaaatgtaga

SEQ ID NO: 8218195 - DNA, 22 bp, Homo sapiens
ttagtggtgttggtgaggactg

SEQ ID NO: 8218196 - DNA, 22 bp, Homo sapiens
tcctctgggcctatttgttcac

SEQ ID NO: 8218197 - DNA, 22 bp, Homo sapiens
ttagtgcttctgtccaaatata

SEQ ID NO: 8218198 - DNA, 22 bp, Homo sapiens
ttagttaaaagataattttgga

SEQ ID NO: 8218199 - DNA, 22 bp, Homo sapiens
ttagttaattgactatgttgca

SEQ ID NO: 8218200 - DNA, 22 bp, Homo sapiens
ttagtgtttaaaggtttcagag

SEQ ID NO: 8218201 - DNA, 22 bp, Homo sapiens
ttagtgttagggcctgttacct

SEQ ID NO: 8218202 - DNA, 22 bp, Homo sapiens
ttagtgtgtccagttctgaaaa

SEQ ID NO: 8218203 - DNA, 22 bp, Homo sapiens
ttagtgtgcatggatctgtgga

SEQ ID NO: 8218204 - DNA, 22 bp, Homo sapiens
ttagtgtctggctatatttaaa

SEQ ID NO: 8218205 - DNA, 22 bp, Homo sapiens
ttagtgtcttcttcatcctctg

SEQ ID NO: 8218206 - DNA, 22 bp, Homo sapiens
tcctctgctccatctttactgt

SEQ ID NO: 8218207 - DNA, 22 bp, Homo sapiens
tcctctggatataagcctcacc

SEQ ID NO: 8218208 - DNA, 22 bp, Homo sapiens
tcctctggatataagcctcacc

SEQ ID NO: 8218209 - DNA, 22 bp, Homo sapiens
tcctctggatataagcctcacc

SEQ ID NO: 8218210 - DNA, 22 bp, Homo sapiens
tcctctggaacctcacccttgc

SEQ ID NO: 8218211 - DNA, 22 bp, Homo sapiens
tcctctggcccagctgcctctg

SEQ ID NO: 8218212 - DNA, 22 bp, Homo sapiens
tcctctggcccagctgcctctg

SEQ ID NO: 8218213 - DNA, 22 bp, Homo sapiens
tcctctggccttggaatccttt

SEQ ID NO: 8218214 - DNA, 22 bp, Homo sapiens
tcctctggctctttccctagga

SEQ ID NO: 8218215 - DNA, 22 bp, Homo sapiens
tcctctggctctttccctagga

SEQ ID NO: 8218216 - DNA, 22 bp, Homo sapiens
ttatgcatgagataaaaattgg

SEQ ID NO: 8218217 - DNA, 22 bp, Homo sapiens
ttatggaaaactccagagagta

SEQ ID NO: 8218218 - DNA, 22 bp, Homo sapiens
ttatgcttcctgattggactct

SEQ ID NO: 8218219 - DNA, 22 bp, Homo sapiens
ttatggaaaatacaattataag

SEQ ID NO: 8218220 - DNA, 22 bp, Homo sapiens
ttatggaaatgaaattttattg

SEQ ID NO: 8218221 - DNA, 22 bp, Homo sapiens
ttatggaaaatacaattataag

SEQ ID NO: 8218222 - DNA, 22 bp, Homo sapiens
ttatggaataacctttctgaaa

SEQ ID NO: 8218223 - DNA, 22 bp, Homo sapiens
ttatggaagtgcaaattgtgtg

SEQ ID NO: 8218224 - DNA, 22 bp, Homo sapiens
ttatggaatacttatgctgcag

SEQ ID NO: 8218225 - DNA, 22 bp, Homo sapiens
ttatggaatacttatgctgcag

SEQ ID NO: 8218226 - DNA, 22 bp, Homo sapiens
ttatggaatttgcaaaaggtta

SEQ ID NO: 8218227 - DNA, 22 bp, Homo sapiens
ttatggaatggagaaagtctgc

SEQ ID NO: 8218228 - DNA, 22 bp, Homo sapiens
ttatggcatattcctcattgta

SEQ ID NO: 8218229 - DNA, 22 bp, Homo sapiens
ttatggagtgcttacctgccag

SEQ ID NO: 8218230 - DNA, 23 bp, Homo sapiens
ttatggagtgccagacatttggc

SEQ ID NO: 8218231 - DNA, 22 bp, Homo sapiens
ttatggagcagacagctggtca

SEQ ID NO: 8218232 - DNA, 22 bp, Homo sapiens
ttatggagcagacagctggtca

SEQ ID NO: 8218233 - DNA, 20 bp, Homo sapiens
ttatgtgtacctgtgctccc

SEQ ID NO: 8218234 - DNA, 22 bp, Homo sapiens
ttatgtgtataattacaggaag

SEQ ID NO: 8218235 - DNA, 22 bp, Homo sapiens
ttatgtgtgtacatgcatatgt

SEQ ID NO: 8218236 - DNA, 22 bp, Homo sapiens
ttatgtgtgtacatgcatatgt

SEQ ID NO: 8218237 - DNA, 22 bp, Homo sapiens
ttatgttatgaatggatgatct

SEQ ID NO: 8218238 - DNA, 22 bp, Homo sapiens
ttatgtgtgtgtatacatacaa

SEQ ID NO: 8218239 - DNA, 22 bp, Homo sapiens
ttatgtgtgtgtatacatacaa

SEQ ID NO: 8218240 - DNA, 22 bp, Homo sapiens
ttatgtcttaagtatgctaatt

SEQ ID NO: 8218241 - DNA, 22 bp, Homo sapiens
ttatgtcttaagtatgctaatt

SEQ ID NO: 8218242 - DNA, 20 bp, Homo sapiens
ttatgtgtacctgtgctccc

SEQ ID NO: 8218243 - DNA, 23 bp, Homo sapiens
ttatgcaagcttcctggtctcag

SEQ ID NO: 8218244 - DNA, 20 bp, Homo sapiens
ttatgcaagcatcaatattg

SEQ ID NO: 8218245 - DNA, 22 bp, Homo sapiens
ttatacagtttatacttagaat

SEQ ID NO: 8218246 - DNA, 22 bp, Homo sapiens
ttatacaggagattccttactt

SEQ ID NO: 8218247 - DNA, 22 bp, Homo sapiens
ttataattctggcataggctgt

SEQ ID NO: 8218248 - DNA, 22 bp, Homo sapiens
ttataattctggcataggctgt

SEQ ID NO: 8218249 - DNA, 22 bp, Homo sapiens
ttatacagcattgctagtgatg

SEQ ID NO: 8218250 - DNA, 22 bp, Homo sapiens
ttagttcttgggtgaacttttg

SEQ ID NO: 8218251 - DNA, 22 bp, Homo sapiens
ttagttctcatgaattttaagt

SEQ ID NO: 8218252 - DNA, 22 bp, Homo sapiens
ttagttgatgttctggaggtag

SEQ ID NO: 8218253 - DNA, 22 bp, Homo sapiens
ttagttacttataggtgataga

SEQ ID NO: 8218254 - DNA, 22 bp, Homo sapiens
ttagttatagtgaagaaatact

SEQ ID NO: 8218255 - DNA, 22 bp, Homo sapiens
ttataagagtatatagtgtact

SEQ ID NO: 8218256 - DNA, 23 bp, Homo sapiens
ttataagaagcatcacaggaaga

SEQ ID NO: 8218257 - DNA, 22 bp, Homo sapiens
ttataagactgtagtgagtatt

SEQ ID NO: 8218258 - DNA, 22 bp, Homo sapiens
ttataagagtatatagtgtact

SEQ ID NO: 8218259 - DNA, 22 bp, Homo sapiens
ttataattctggcataggctgt

SEQ ID NO: 8218260 - DNA, 22 bp, Homo sapiens
ttataactttggatatgacaag

SEQ ID NO: 8218261 - DNA, 22 bp, Homo sapiens
ttcatacatttttactaacagc

SEQ ID NO: 8218262 - DNA, 22 bp, Homo sapiens
ttcatagacaggataacaggat

SEQ ID NO: 8218263 - DNA, 22 bp, Homo sapiens
ttcagaccaagctggtggcatg

SEQ ID NO: 8218264 - DNA, 22 bp, Homo sapiens
ttcatacatttttactaacagc

SEQ ID NO: 8218265 - DNA, 22 bp, Homo sapiens
ttcatacatttttactaacagc

SEQ ID NO: 8218266 - DNA, 22 bp, Homo sapiens
ttcagacagttttcagattcat

SEQ ID NO: 8218267 - DNA, 22 bp, Homo sapiens
ttcagaatgtgaccttatttgg

SEQ ID NO: 8218268 - DNA, 22 bp, Homo sapiens
ttcagaatgattacattctggt

SEQ ID NO: 8218269 - DNA, 22 bp, Homo sapiens
ttcagaatgtactgatagaaca

SEQ ID NO: 8218270 - DNA, 22 bp, Homo sapiens
ttcatattttctgcttgctcac

SEQ ID NO: 8218271 - DNA, 22 bp, Homo sapiens
ttcatatttgaaacagaagtta

SEQ ID NO: 8218272 - DNA, 22 bp, Homo sapiens
ttcatattcaaatactctgctt

SEQ ID NO: 8218273 - DNA, 22 bp, Homo sapiens
ttcatattcaaatactctgctt

SEQ ID NO: 8218274 - DNA, 22 bp, Homo sapiens
ttcatattgcttccgtggagtg

SEQ ID NO: 8218275 - DNA, 22 bp, Homo sapiens
ttcatattgcttccgtggagtg

SEQ ID NO: 8218276 - DNA, 22 bp, Homo sapiens
ttcatatttctttaaggacttt

SEQ ID NO: 8218277 - DNA, 22 bp, Homo sapiens
ttcatatgcagattaacaaata

SEQ ID NO: 8218278 - DNA, 22 bp, Homo sapiens
ttcatattatgatttgaaatgc

SEQ ID NO: 8218279 - DNA, 22 bp, Homo sapiens
ttcatattatgatttgaaatgc

SEQ ID NO: 8218280 - DNA, 22 bp, Homo sapiens
ttcatagtgtttccttccagtg

SEQ ID NO: 8218281 - DNA, 22 bp, Homo sapiens
ttcatagtgtttccttccagtg

SEQ ID NO: 8218282 - DNA, 22 bp, Homo sapiens
ttcatagtgattgttcagatag

SEQ ID NO: 8218283 - DNA, 22 bp, Homo sapiens
ttcatataaatggaatcagaat

SEQ ID NO: 8218284 - DNA, 22 bp, Homo sapiens
ttcatagtgtttccttccagtg

SEQ ID NO: 8218285 - DNA, 22 bp, Homo sapiens
ttcatagtgtttccttccagtg

SEQ ID NO: 8218286 - DNA, 22 bp, Homo sapiens
ttcatagtgtttccttccagtg

SEQ ID NO: 8218287 - DNA, 22 bp, Homo sapiens
ttcatagtgtttccttccagtg

SEQ ID NO: 8218288 - DNA, 22 bp, Homo sapiens
ttcatagtaacagtaactatgg

SEQ ID NO: 8218289 - DNA, 22 bp, Homo sapiens
ttcataggtttgctgtgaacat

SEQ ID NO: 8218290 - DNA, 22 bp, Homo sapiens
ttcataggtggatgctgccagg

SEQ ID NO: 8218291 - DNA, 22 bp, Homo sapiens
ttcatagcagtccctttctggg

SEQ ID NO: 8218292 - DNA, 22 bp, Homo sapiens
ttcatagcagtccctttctggg

SEQ ID NO: 8218293 - DNA, 20 bp, Homo sapiens
ttcagaaataaggaatgagg

SEQ ID NO: 8218294 - DNA, 22 bp, Homo sapiens
ttcactgtgatgtttaagagaa

SEQ ID NO: 8218295 - DNA, 22 bp, Homo sapiens
ttcagaaatccctcttctaccc

SEQ ID NO: 8218296 - DNA, 22 bp, Homo sapiens
ttcagaaattcatggagttcag

SEQ ID NO: 8218297 - DNA, 22 bp, Homo sapiens
ttcagaaatgaatattggtatt

SEQ ID NO: 8218298 - DNA, 22 bp, Homo sapiens
ttcagaaatgaatattggtatt

SEQ ID NO: 8218299 - DNA, 23 bp, Homo sapiens
ttcagaagaaatgagtacaggag

SEQ ID NO: 8218300 - DNA, 23 bp, Homo sapiens
ttcagaagaaatgagtacaggag

SEQ ID NO: 8218301 - DNA, 22 bp, Homo sapiens
ttcagaaggattttaacacatg

SEQ ID NO: 8218302 - DNA, 22 bp, Homo sapiens
ttcagaataactttttattgaa

SEQ ID NO: 8218303 - DNA, 21 bp, Homo sapiens
ttcagaagttgagggcaggtt

SEQ ID NO: 8218304 - DNA, 21 bp, Homo sapiens
ttcagaagttgagggcaggtt

SEQ ID NO: 8218305 - DNA, 22 bp, Homo sapiens
ttcaaggtatggtagctggtca

SEQ ID NO: 8218306 - DNA, 22 bp, Homo sapiens
ttcaatatctctaagaatgagg

SEQ ID NO: 8218307 - DNA, 22 bp, Homo sapiens
ttcaagtcaatttttgaatgac

SEQ ID NO: 8218308 - DNA, 22 bp, Homo sapiens
ttcaagtcaaggaaagaggtct

SEQ ID NO: 8218309 - DNA, 22 bp, Homo sapiens
ttcaatcattagaatctcaggc

SEQ ID NO: 8218310 - DNA, 22 bp, Homo sapiens
ttcaatatgatattagctgtgg

SEQ ID NO: 8218311 - DNA, 22 bp, Homo sapiens
ttcaatatgatattagctgtgg

SEQ ID NO: 8218312 - DNA, 22 bp, Homo sapiens
ttcaatatctctaagaatgagg

SEQ ID NO: 8218313 - DNA, 22 bp, Homo sapiens
ttcaatatctctaagaatgagg

SEQ ID NO: 8218314 - DNA, 22 bp, Homo sapiens
ttcactgtactgactgtcttat

SEQ ID NO: 8218315 - DNA, 22 bp, Homo sapiens
ttcaatgatttttagggatcat

SEQ ID NO: 8218316 - DNA, 17 bp, Homo sapiens
ttcaatgattaatgcat

SEQ ID NO: 8218317 - DNA, 17 bp, Homo sapiens
ttcaatgattaatgcat

SEQ ID NO: 8218318 - DNA, 22 bp, Homo sapiens
ttcaatgaggatagaactggat

SEQ ID NO: 8218319 - DNA, 22 bp, Homo sapiens
ttccaaggtgggactggggtgc

SEQ ID NO: 8218320 - DNA, 22 bp, Homo sapiens
ttccaagtagaagcatttgcat

SEQ ID NO: 8218321 - DNA, 22 bp, Homo sapiens
ttccaagtgggggaagctgagt

SEQ ID NO: 8218322 - DNA, 22 bp, Homo sapiens
ttccaagtgtcagatcagattt

SEQ ID NO: 8218323 - DNA, 22 bp, Homo sapiens
ttccaagtgttgagattagagg

SEQ ID NO: 8218324 - DNA, 22 bp, Homo sapiens
ttccaagtgtcagatcagattt

SEQ ID NO: 8218325 - DNA, 22 bp, Homo sapiens
ttccaagttgagcgattttcct

SEQ ID NO: 8218326 - DNA, 22 bp, Homo sapiens
ttccaagtgttgagattagagg

SEQ ID NO: 8218327 - DNA, 22 bp, Homo sapiens
ttccaagtctaagttataaatc

SEQ ID NO: 8218328 - DNA, 22 bp, Homo sapiens
ttccaagtcacccttagggtca

SEQ ID NO: 8218329 - DNA, 22 bp, Homo sapiens
ttccaagtgctgaggacagtag

SEQ ID NO: 8218330 - DNA, 22 bp, Homo sapiens
ttccaagtgcccatatttcatc

SEQ ID NO: 8218331 - DNA, 22 bp, Homo sapiens
ttccatacgactgaggtctcgg

SEQ ID NO: 8218332 - DNA, 22 bp, Homo sapiens
ttccatacgactgaggtctcgg

SEQ ID NO: 8218333 - DNA, 22 bp, Homo sapiens
ttccaatgactagtggcatcct

SEQ ID NO: 8218334 - DNA, 22 bp, Homo sapiens
ttccaatggaatcatgtcttga

SEQ ID NO: 8218335 - DNA, 22 bp, Homo sapiens
ttccaatatttacaatgcatta

SEQ ID NO: 8218336 - DNA, 22 bp, Homo sapiens
ttccaataaaatgttatttgca

SEQ ID NO: 8218337 - DNA, 22 bp, Homo sapiens
ttccataaaggtgatagtatac

SEQ ID NO: 8218338 - DNA, 22 bp, Homo sapiens
ttccataaaggtgatagtatac

SEQ ID NO: 8218339 - DNA, 21 bp, Homo sapiens
ttccagttttaattaaattgt

SEQ ID NO: 8218340 - DNA, 21 bp, Homo sapiens
ttccagttttaattaaattgt

SEQ ID NO: 8218341 - DNA, 22 bp, Homo sapiens
ttccaattgtgagattttttaa

SEQ ID NO: 8218342 - DNA, 22 bp, Homo sapiens
ttccagtttgcagttgacacta

SEQ ID NO: 8218343 - DNA, 22 bp, Homo sapiens
ttccaattgtgagattttttaa

SEQ ID NO: 8218344 - DNA, 22 bp, Homo sapiens
ttccaattgcagatcagataca

SEQ ID NO: 8218345 - DNA, 22 bp, Homo sapiens
ttccaattgtgagattttttaa

SEQ ID NO: 8218346 - DNA, 22 bp, Homo sapiens
ttccaaaacaatattctgtgaa

SEQ ID NO: 8218347 - DNA, 22 bp, Homo sapiens
ttcatttttaccgcgtgtcaaa

SEQ ID NO: 8218348 - DNA, 19 bp, Homo sapiens
ttccaaaatcaggatttga

SEQ ID NO: 8218349 - DNA, 19 bp, Homo sapiens
ttccaaaatcaggatttga

SEQ ID NO: 8218350 - DNA, 22 bp, Homo sapiens
ttccaagaaacaagtgatgcag

SEQ ID NO: 8218351 - DNA, 22 bp, Homo sapiens
ttccaagaaacaagtgatgcag

SEQ ID NO: 8218352 - DNA, 22 bp, Homo sapiens
ttccaagaaacaagtgatgcag

SEQ ID NO: 8218353 - DNA, 22 bp, Homo sapiens
ttccaagacacctttagtcact

SEQ ID NO: 8218354 - DNA, 22 bp, Homo sapiens
ttccaactttgtcatatattat

SEQ ID NO: 8218355 - DNA, 22 bp, Homo sapiens
ttccaactttgaaaatgttatg

SEQ ID NO: 8218356 - DNA, 22 bp, Homo sapiens
ttccaactttgaaaatgttatg

SEQ ID NO: 8218357 - DNA, 22 bp, Homo sapiens
ttccaactttaaaattcattct

SEQ ID NO: 8218358 - DNA, 22 bp, Homo sapiens
ttccaactttaaaattcattct

SEQ ID NO: 8218359 - DNA, 22 bp, Homo sapiens
ttccaagagctgctggggtaag

SEQ ID NO: 8218360 - DNA, 22 bp, Homo sapiens
ttccaagagcctttcttctaga

SEQ ID NO: 8218361 - DNA, 22 bp, Homo sapiens
ttccaagacttggccagcaggg

SEQ ID NO: 8218362 - DNA, 22 bp, Homo sapiens
ttccaagacttggccagcaggg

SEQ ID NO: 8218363 - DNA, 22 bp, Homo sapiens
ttccaagagcctttcttctaga

SEQ ID NO: 8218364 - DNA, 22 bp, Homo sapiens
ttccaagagcctttcttctaga

SEQ ID NO: 8218365 - DNA, 22 bp, Homo sapiens
ttccaagagctgctggggtaag

SEQ ID NO: 8218366 - DNA, 22 bp, Homo sapiens
ttccaagagctttaattgttga

SEQ ID NO: 8218367 - DNA, 22 bp, Homo sapiens
ttccaagagtcagctgatccca

SEQ ID NO: 8218368 - DNA, 22 bp, Homo sapiens
ttccatcacatcactgaagaca

SEQ ID NO: 8218369 - DNA, 22 bp, Homo sapiens
ttccatccatgtcccgtttctg

SEQ ID NO: 8218370 - DNA, 22 bp, Homo sapiens
ttccatattgtactctttggag

SEQ ID NO: 8218371 - DNA, 22 bp, Homo sapiens
ttccatattcccaattttgcca

SEQ ID NO: 8218372 - DNA, 22 bp, Homo sapiens
ttccatctttcagctttgttgg

SEQ ID NO: 8218373 - DNA, 22 bp, Homo sapiens
ttccatctttcagctttgttgg

SEQ ID NO: 8218374 - DNA, 19 bp, Homo sapiens
ttccatctatcttcttact

SEQ ID NO: 8218375 - DNA, 19 bp, Homo sapiens
ttccatctatcttcttact

SEQ ID NO: 8218376 - DNA, 19 bp, Homo sapiens
ttccatctatcttcttact

SEQ ID NO: 8218377 - DNA, 22 bp, Homo sapiens
ttccatgcaagaagtatggctc

SEQ ID NO: 8218378 - DNA, 22 bp, Homo sapiens
ttccatgaagggcagcctctca

SEQ ID NO: 8218379 - DNA, 22 bp, Homo sapiens
ttccatgactgaagcaggggcg

SEQ ID NO: 8218380 - DNA, 22 bp, Homo sapiens
ttcccagacctgtaggatcaga

SEQ ID NO: 8218381 - DNA, 22 bp, Homo sapiens
ttcccagacctgtaggatcaga

SEQ ID NO: 8218382 - DNA, 22 bp, Homo sapiens
ttcccagactccacactgaggc

SEQ ID NO: 8218383 - DNA, 22 bp, Homo sapiens
ttccatgtactgggttttgtat

SEQ ID NO: 8218384 - DNA, 22 bp, Homo sapiens
ttccatgtactgggttttgtat

SEQ ID NO: 8218385 - DNA, 21 bp, Homo sapiens
ttccattatctctcagccatc

SEQ ID NO: 8218386 - DNA, 19 bp, Homo sapiens
ttcccagagccatgagtga

SEQ ID NO: 8218387 - DNA, 19 bp, Homo sapiens
ttcccagagccatgagtga

SEQ ID NO: 8218388 - DNA, 22 bp, Homo sapiens
ttcccagaggagatttgcttat

SEQ ID NO: 8218389 - DNA, 22 bp, Homo sapiens
ttcccagaggcaaagtctggat

SEQ ID NO: 8218390 - DNA, 22 bp, Homo sapiens
ttcccagactccacactgaggc

SEQ ID NO: 8218391 - DNA, 22 bp, Homo sapiens
ttcccagactccacactgaggc

SEQ ID NO: 8218392 - DNA, 22 bp, Homo sapiens
ttcccagagaaggatgaaaaag

SEQ ID NO: 8218393 - DNA, 22 bp, Homo sapiens
ttcccagagaaggatgaaaaag

SEQ ID NO: 8218394 - DNA, 22 bp, Homo sapiens
ttcccagagataagacgtctta

SEQ ID NO: 8218395 - DNA, 22 bp, Homo sapiens
ttcccaggctgtgctaccagag

SEQ ID NO: 8218396 - DNA, 21 bp, Homo sapiens
ttcccagcacctagcacaggt

SEQ ID NO: 8218397 - DNA, 22 bp, Homo sapiens
ttcccagattggagggcagggg

SEQ ID NO: 8218398 - DNA, 19 bp, Homo sapiens
ttcccaggaaaggggtgca

SEQ ID NO: 8218399 - DNA, 21 bp, Homo sapiens
ttcccagcacctagcacaggt

SEQ ID NO: 8218400 - DNA, 22 bp, Homo sapiens
ttcccaggtaattctgaggcag

SEQ ID NO: 8218401 - DNA, 22 bp, Homo sapiens
ttcccagtcaaacgaaggactt

SEQ ID NO: 8218402 - DNA, 22 bp, Homo sapiens
ttcccatagtgaccgatgctga

SEQ ID NO: 8218403 - DNA, 22 bp, Homo sapiens
ttcccatgcctggcccctatcc

SEQ ID NO: 8218404 - DNA, 22 bp, Homo sapiens
ttccccttgcactatcaccctg

SEQ ID NO: 8218405 - DNA, 22 bp, Homo sapiens
ttccccttgataagcagggttg

SEQ ID NO: 8218406 - DNA, 17 bp, Homo sapiens
ttcccctgaccaagcct

SEQ ID NO: 8218407 - DNA, 22 bp, Homo sapiens
ttcccctgtcacagtggttctc

SEQ ID NO: 8218408 - DNA, 22 bp, Homo sapiens
ttccccttataagtctggcttc

SEQ ID NO: 8218409 - DNA, 22 bp, Homo sapiens
ttccccttatcaccagcctgtc

SEQ ID NO: 8218410 - DNA, 22 bp, Homo sapiens
ttccccaggctggagtgcagtg

SEQ ID NO: 8218411 - DNA, 22 bp, Homo sapiens
ttccccagggaagctcctgcgc

SEQ ID NO: 8218412 - DNA, 22 bp, Homo sapiens
ttccccagggaagctcctgcgc

SEQ ID NO: 8218413 - DNA, 22 bp, Homo sapiens
ttccccaggggctcctgccttt

SEQ ID NO: 8218414 - DNA, 22 bp, Homo sapiens
ttctctgttttcccctcgatgt

SEQ ID NO: 8218415 - DNA, 22 bp, Homo sapiens
ttctcttagcactttgtgttac

SEQ ID NO: 8218416 - DNA, 22 bp, Homo sapiens
ttctcttagctgtaaagtcaat

SEQ ID NO: 8218417 - DNA, 22 bp, Homo sapiens
ttctcttagctgtaaagtcaat

SEQ ID NO: 8218418 - DNA, 22 bp, Homo sapiens
ttctcttagctgtaaagtcaat

SEQ ID NO: 8218419 - DNA, 22 bp, Homo sapiens
ttctcttattctggatatgcag

SEQ ID NO: 8218420 - DNA, 22 bp, Homo sapiens
ttctcttattctggatatgcag

SEQ ID NO: 8218421 - DNA, 22 bp, Homo sapiens
ttctcttcatctcagtaaatgt

SEQ ID NO: 8218422 - DNA, 22 bp, Homo sapiens
ttctcttatctggcattattgg

SEQ ID NO: 8218423 - DNA, 22 bp, Homo sapiens
ttctctgtgagggtgctggatt

SEQ ID NO: 8218424 - DNA, 22 bp, Homo sapiens
ttctctgtgagggtgctggatt

SEQ ID NO: 8218425 - DNA, 22 bp, Homo sapiens
ttctctgtagttgcctggtgga

SEQ ID NO: 8218426 - DNA, 22 bp, Homo sapiens
ttctctgtagttgcctggtgga

SEQ ID NO: 8218427 - DNA, 22 bp, Homo sapiens
ttctctggtttgctgtttctga

SEQ ID NO: 8218428 - DNA, 19 bp, Homo sapiens
ttctctgtgctagactctg

SEQ ID NO: 8218429 - DNA, 22 bp, Homo sapiens
ttctctgtgagggtgctggatt

SEQ ID NO: 8218430 - DNA, 22 bp, Homo sapiens
ttctctgtgagggtgctggatt

SEQ ID NO: 8218431 - DNA, 22 bp, Homo sapiens
ttctctgttttcccctcgatgt

SEQ ID NO: 8218432 - DNA, 16 bp, Homo sapiens
ttctctgttccttgtg

SEQ ID NO: 8218433 - DNA, 16 bp, Homo sapiens
ttctctgttccttgtg

SEQ ID NO: 8218434 - DNA, 22 bp, Homo sapiens
ttctctgtggattgggtgagag

SEQ ID NO: 8218435 - DNA, 19 bp, Homo sapiens
ttctctgtgctagactctg

SEQ ID NO: 8218436 - DNA, 19 bp, Homo sapiens
ttctctgtgctagactctg

SEQ ID NO: 8218437 - DNA, 23 bp, Homo sapiens
ttctctttagatttacattactc

SEQ ID NO: 8218438 - DNA, 22 bp, Homo sapiens
ttctcttgtgccaagttgttgc

SEQ ID NO: 8218439 - DNA, 23 bp, Homo sapiens
ttctctttagatttacattactc

SEQ ID NO: 8218440 - DNA, 22 bp, Homo sapiens
ttctcttctgttcagtgcccaa

SEQ ID NO: 8218441 - DNA, 22 bp, Homo sapiens
ttctcttctgttcagtgcccaa

SEQ ID NO: 8218442 - DNA, 22 bp, Homo sapiens
ttctcttgactaccagttagga

SEQ ID NO: 8218443 - DNA, 22 bp, Homo sapiens
ttctcttgagctggtcatgttt

SEQ ID NO: 8218444 - DNA, 22 bp, Homo sapiens
ttctcttcccactttctgtatt

SEQ ID NO: 8218445 - DNA, 22 bp, Homo sapiens
ttctcttcccactttctgtatt

SEQ ID NO: 8218446 - DNA, 22 bp, Homo sapiens
ttctcttcccactttctgtatt

SEQ ID NO: 8218447 - DNA, 22 bp, Homo sapiens
ttctcttccagccgggcttgca

SEQ ID NO: 8218448 - DNA, 22 bp, Homo sapiens
ttctcttccagccgggcttgca

SEQ ID NO: 8218449 - DNA, 22 bp, Homo sapiens
ttctcttcatctcagtaaatgt

SEQ ID NO: 8218450 - DNA, 22 bp, Homo sapiens
ttctcttcccactttctgtatt

SEQ ID NO: 8218451 - DNA, 17 bp, Homo sapiens
ttctcttcctggatagt

SEQ ID NO: 8218452 - DNA, 17 bp, Homo sapiens
ttctcttcctggatagt

SEQ ID NO: 8218453 - DNA, 22 bp, Homo sapiens
ttctcttcccactttctgtatt

SEQ ID NO: 8218454 - DNA, 22 bp, Homo sapiens
ttctcttcccactttctgtatt

SEQ ID NO: 8218455 - DNA, 22 bp, Homo sapiens
ttctcctctgttaccttgcaaa

SEQ ID NO: 8218456 - DNA, 22 bp, Homo sapiens
ttctcctctgttaccttgcaaa

SEQ ID NO: 8218457 - DNA, 22 bp, Homo sapiens
ttctcctctgttaccttgcaaa

SEQ ID NO: 8218458 - DNA, 22 bp, Homo sapiens
ttctcctctgttggccttccct

SEQ ID NO: 8218459 - DNA, 21 bp, Homo sapiens
ttctcctccaagttgctcctg

SEQ ID NO: 8218460 - DNA, 21 bp, Homo sapiens
ttctcctccaagttgctcctg

SEQ ID NO: 8218461 - DNA, 17 bp, Homo sapiens
ttctcctctgtgtcctt

SEQ ID NO: 8218462 - DNA, 22 bp, Homo sapiens
ttctccctgtcctatcaagact

SEQ ID NO: 8218463 - DNA, 22 bp, Homo sapiens
ttctccctgtcctatcaagact

SEQ ID NO: 8218464 - DNA, 22 bp, Homo sapiens
ttctccgctaagttctctgcag

SEQ ID NO: 8218465 - DNA, 22 bp, Homo sapiens
ttctccgctaagttctctgcag

SEQ ID NO: 8218466 - DNA, 22 bp, Homo sapiens
ttctccgctaagttctctgcag

SEQ ID NO: 8218467 - DNA, 22 bp, Homo sapiens
ttctcctcactgcagcctttca

SEQ ID NO: 8218468 - DNA, 22 bp, Homo sapiens
ttctcctcagcaaggcagcttt

SEQ ID NO: 8218469 - DNA, 21 bp, Homo sapiens
ttctcctccaagttgctcctg

SEQ ID NO: 8218470 - DNA, 22 bp, Homo sapiens
ttctcccactccgtgcttcagt

SEQ ID NO: 8218471 - DNA, 22 bp, Homo sapiens
ttctcccagaccaaaggcagca

SEQ ID NO: 8218472 - DNA, 22 bp, Homo sapiens
ttctcccactccgtgcttcagt

SEQ ID NO: 8218473 - DNA, 22 bp, Homo sapiens
ttctcccactccgtgcttcagt

SEQ ID NO: 8218474 - DNA, 22 bp, Homo sapiens
ttctcccatctcagtcttacat

SEQ ID NO: 8218475 - DNA, 22 bp, Homo sapiens
ttctccccaactccatcaacac

SEQ ID NO: 8218476 - DNA, 21 bp, Homo sapiens
ttctccccagcgaatcctcgg

SEQ ID NO: 8218477 - DNA, 22 bp, Homo sapiens
ttctccccgtctctctgaggcc

SEQ ID NO: 8218478 - DNA, 22 bp, Homo sapiens
ttctcccctctgaaatggggct

SEQ ID NO: 8218479 - DNA, 22 bp, Homo sapiens
ttctcccctgaccctgatgagg

SEQ ID NO: 8218480 - DNA, 22 bp, Homo sapiens
ttctcccctttagggcctacgg

SEQ ID NO: 8218481 - DNA, 22 bp, Homo sapiens
ttctccccgtctctctgaggcc

SEQ ID NO: 8218482 - DNA, 20 bp, Homo sapiens
ttctccagtgcggtagccat

SEQ ID NO: 8218483 - DNA, 20 bp, Homo sapiens
ttctccagtgcggtagccat

SEQ ID NO: 8218484 - DNA, 20 bp, Homo sapiens
ttctccagtgcggtagccat

SEQ ID NO: 8218485 - DNA, 21 bp, Homo sapiens
ttctccagggggagctctctc

SEQ ID NO: 8218486 - DNA, 22 bp, Homo sapiens
ttctccagtttctcccttcagt

SEQ ID NO: 8218487 - DNA, 22 bp, Homo sapiens
ttctccagtttctcccttcagt

SEQ ID NO: 8218488 - DNA, 22 bp, Homo sapiens
ttctccatttaacttccttatg

SEQ ID NO: 8218489 - DNA, 22 bp, Homo sapiens
ttctgccatttacaaatttcat

SEQ ID NO: 8218490 - DNA, 22 bp, Homo sapiens
ttctgcccttgccagacaagta

SEQ ID NO: 8218491 - DNA, 20 bp, Homo sapiens
ttctgcctagggttagcctg

SEQ ID NO: 8218492 - DNA, 22 bp, Homo sapiens
ttctgcctgatgtagtcatacc

SEQ ID NO: 8218493 - DNA, 22 bp, Homo sapiens
ttctggaggagaaagggtgggc

SEQ ID NO: 8218494 - DNA, 22 bp, Homo sapiens
ttctggaggctccagggaagaa

SEQ ID NO: 8218495 - DNA, 22 bp, Homo sapiens
ttctgcagatcaacttgactgc

SEQ ID NO: 8218496 - DNA, 22 bp, Homo sapiens
ttctgcagcatgaggctggagc

SEQ ID NO: 8218497 - DNA, 22 bp, Homo sapiens
ttctgcagatcaacttgactgc

SEQ ID NO: 8218498 - DNA, 22 bp, Homo sapiens
ttctgcaccgttacagcaagag

SEQ ID NO: 8218499 - DNA, 22 bp, Homo sapiens
ttctgcacagtcactcctggct

SEQ ID NO: 8218500 - DNA, 22 bp, Homo sapiens
ttctgcattcaaattatgtgag

SEQ ID NO: 8218501 - DNA, 23 bp, Homo sapiens
ttctgcatgtttcagagctggga

SEQ ID NO: 8218502 - DNA, 22 bp, Homo sapiens
ttctgccaaaggctttgttttg

SEQ ID NO: 8218503 - DNA, 22 bp, Homo sapiens
ttctgcattggagtctattctt

SEQ ID NO: 8218504 - DNA, 22 bp, Homo sapiens
ttctgcatttctaataagttcc

SEQ ID NO: 8218505 - DNA, 22 bp, Homo sapiens
ttctgcattggagtctattctt

SEQ ID NO: 8218506 - DNA, 22 bp, Homo sapiens
ttctgcattgacttttatttcc

SEQ ID NO: 8218507 - DNA, 22 bp, Homo sapiens
ttctgcattcaaattatgtgag

SEQ ID NO: 8218508 - DNA, 22 bp, Homo sapiens
ttctgagctgcaacactaacat

SEQ ID NO: 8218509 - DNA, 20 bp, Homo sapiens
ttctctttgggtccagagaa

SEQ ID NO: 8218510 - DNA, 22 bp, Homo sapiens
ttctgaggcactggctctccca

SEQ ID NO: 8218511 - DNA, 22 bp, Homo sapiens
ttctgaggcatagaggatgaga

SEQ ID NO: 8218512 - DNA, 22 bp, Homo sapiens
ttctgaggcatagaggatgaga

SEQ ID NO: 8218513 - DNA, 22 bp, Homo sapiens
ttctctttatgtatttagtggg

SEQ ID NO: 8218514 - DNA, 22 bp, Homo sapiens
ttctctttgacattattcaggt

SEQ ID NO: 8218515 - DNA, 22 bp, Homo sapiens
ttctctttgacattattcaggt

SEQ ID NO: 8218516 - DNA, 22 bp, Homo sapiens
ttctctttgacattattcaggt

SEQ ID NO: 8218517 - DNA, 22 bp, Homo sapiens
ttctgattgctgatgaggccca

SEQ ID NO: 8218518 - DNA, 22 bp, Homo sapiens
ttctgatatagtgattgattta

SEQ ID NO: 8218519 - DNA, 22 bp, Homo sapiens
ttctgatgatggcggctggagc

SEQ ID NO: 8218520 - DNA, 22 bp, Homo sapiens
ttctgataccttgcaggatcct

SEQ ID NO: 8218521 - DNA, 22 bp, Homo sapiens
ttctgataccttgcaggatcct

SEQ ID NO: 8218522 - DNA, 22 bp, Homo sapiens
ttctgataataccacatcgcag

SEQ ID NO: 8218523 - DNA, 22 bp, Homo sapiens
ttctgatacagtcccaacacaa

SEQ ID NO: 8218524 - DNA, 22 bp, Homo sapiens
ttctgataataccacatcgcag

SEQ ID NO: 8218525 - DNA, 22 bp, Homo sapiens
ttctgatacagtcccaacacaa

SEQ ID NO: 8218526 - DNA, 22 bp, Homo sapiens
ttctgataacaaacaccaattt

SEQ ID NO: 8218527 - DNA, 22 bp, Homo sapiens
ttctgataacaaacaccaattt

SEQ ID NO: 8218528 - DNA, 22 bp, Homo sapiens
ttctgaggctttcccgtcccct

SEQ ID NO: 8218529 - DNA, 22 bp, Homo sapiens
ttctgagggctaatgtactgta

SEQ ID NO: 8218530 - DNA, 22 bp, Homo sapiens
ttctaaattttggaagatgcag

SEQ ID NO: 8218531 - DNA, 22 bp, Homo sapiens
ttctaaatgtaaatagtatgat

SEQ ID NO: 8218532 - DNA, 22 bp, Homo sapiens
ttctaaatgtaaatagtatgat

SEQ ID NO: 8218533 - DNA, 22 bp, Homo sapiens
ttctaaagtgcaatctgacaga

SEQ ID NO: 8218534 - DNA, 22 bp, Homo sapiens
ttctaaagtgcaatctgacaga

SEQ ID NO: 8218535 - DNA, 22 bp, Homo sapiens
ttctaaagtgcaatctgacaga

SEQ ID NO: 8218536 - DNA, 22 bp, Homo sapiens
ttctaactctgttatgtgtttc

SEQ ID NO: 8218537 - DNA, 22 bp, Homo sapiens
ttctaactctgttatgtgtttc

SEQ ID NO: 8218538 - DNA, 22 bp, Homo sapiens
ttctaactctacactagctttg

SEQ ID NO: 8218539 - DNA, 22 bp, Homo sapiens
ttctaactctacactagctttg

SEQ ID NO: 8218540 - DNA, 22 bp, Homo sapiens
ttctaactcaaagcttctttca

SEQ ID NO: 8218541 - DNA, 22 bp, Homo sapiens
ttctaactaaagtctttgtttt

SEQ ID NO: 8218542 - DNA, 22 bp, Homo sapiens
ttctaaattttggaagatgcag

SEQ ID NO: 8218543 - DNA, 22 bp, Homo sapiens
ttctaaaataagtttatctggt

SEQ ID NO: 8218544 - DNA, 22 bp, Homo sapiens
ttctaaaaccaattctgcttct

SEQ ID NO: 8218545 - DNA, 22 bp, Homo sapiens
ttctaaaaccaattctgcttct

SEQ ID NO: 8218546 - DNA, 22 bp, Homo sapiens
ttctaaaataagtttatctggt

SEQ ID NO: 8218547 - DNA, 22 bp, Homo sapiens
ttctaaaaccaattctgcttct

SEQ ID NO: 8218548 - DNA, 22 bp, Homo sapiens
ttcgctgggagtggccaggcac

SEQ ID NO: 8218549 - DNA, 22 bp, Homo sapiens
ttcctttagtgtcatatacttt

SEQ ID NO: 8218550 - DNA, 22 bp, Homo sapiens
ttcctttagggaaatcgtctca

SEQ ID NO: 8218551 - DNA, 22 bp, Homo sapiens
ttcctttagtgtcatatacttt

SEQ ID NO: 8218552 - DNA, 22 bp, Homo sapiens
ttcctttagtgtcatatacttt

SEQ ID NO: 8218553 - DNA, 22 bp, Homo sapiens
ttcctttagtgtcatatacttt

SEQ ID NO: 8218554 - DNA, 22 bp, Homo sapiens
ttcgactctgtgcctgaagagc

SEQ ID NO: 8218555 - DNA, 22 bp, Homo sapiens
ttcgactctgtgcctgaagagc

SEQ ID NO: 8218556 - DNA, 20 bp, Homo sapiens
ttcgctgggagtggccaggc

SEQ ID NO: 8218557 - DNA, 22 bp, Homo sapiens
ttccctgcaacctttccctggg

SEQ ID NO: 8218558 - DNA, 22 bp, Homo sapiens
ttccctgatggccccaaggata

SEQ ID NO: 8218559 - DNA, 22 bp, Homo sapiens
ttccctgatcacgtgtcaggag

SEQ ID NO: 8218560 - DNA, 22 bp, Homo sapiens
ttccctgagtctccctgagtct

SEQ ID NO: 8218561 - DNA, 22 bp, Homo sapiens
ttccctgagtctccctgagtct

SEQ ID NO: 8218562 - DNA, 22 bp, Homo sapiens
ttccctgaagacctcatgtgac

SEQ ID NO: 8218563 - DNA, 22 bp, Homo sapiens
ttccctgaagacctcatgtgac

SEQ ID NO: 8218564 - DNA, 22 bp, Homo sapiens
ttccctctttcactgtgatttt

SEQ ID NO: 8218565 - DNA, 22 bp, Homo sapiens
ttccctctcctactcaggaaag

SEQ ID NO: 8218566 - DNA, 22 bp, Homo sapiens
ttccctctgcgcattgaatttc

SEQ ID NO: 8218567 - DNA, 22 bp, Homo sapiens
ttccctcctatgcccactgaaa

SEQ ID NO: 8218568 - DNA, 22 bp, Homo sapiens
ttccctctccaggagccctgag

SEQ ID NO: 8218569 - DNA, 22 bp, Homo sapiens
ttccctccatttcattttataa

SEQ ID NO: 8218570 - DNA, 22 bp, Homo sapiens
ttccctcccccagcctggcagg

SEQ ID NO: 8218571 - DNA, 22 bp, Homo sapiens
ttccctcctatgcccactgaaa

SEQ ID NO: 8218572 - DNA, 22 bp, Homo sapiens
ttccctccgaacctcagtgctg

SEQ ID NO: 8218573 - DNA, 22 bp, Homo sapiens
ttccctccctggctgccatttc

SEQ ID NO: 8218574 - DNA, 22 bp, Homo sapiens
ttccctccctggctgccatttc

SEQ ID NO: 8218575 - DNA, 22 bp, Homo sapiens
ttccctccgaacctcagtgctg

SEQ ID NO: 8218576 - DNA, 22 bp, Homo sapiens
ttctcacaggctggaatgatga

SEQ ID NO: 8218577 - DNA, 22 bp, Homo sapiens
ttctcacaggctggaatgatga

SEQ ID NO: 8218578 - DNA, 22 bp, Homo sapiens
ttctcacaggatttcttttagt

SEQ ID NO: 8218579 - DNA, 22 bp, Homo sapiens
ttctcacaggaagtaggacttt

SEQ ID NO: 8218580 - DNA, 22 bp, Homo sapiens
ttctcacaggaagtaggacttt

SEQ ID NO: 8218581 - DNA, 22 bp, Homo sapiens
ttctcacaattcttgtatttgc

SEQ ID NO: 8218582 - DNA, 22 bp, Homo sapiens
ttctcacactttccactgaggt

SEQ ID NO: 8218583 - DNA, 22 bp, Homo sapiens
ttctcacactttccactgaggt

SEQ ID NO: 8218584 - DNA, 22 bp, Homo sapiens
ttctcacaaatccatccaggag

SEQ ID NO: 8218585 - DNA, 22 bp, Homo sapiens
ttctcacaaatccatccaggag

SEQ ID NO: 8218586 - DNA, 22 bp, Homo sapiens
ttctcacagtacctaacatgta

SEQ ID NO: 8218587 - DNA, 22 bp, Homo sapiens
ttctcacattcagaacttttat

SEQ ID NO: 8218588 - DNA, 22 bp, Homo sapiens
ttctcacattcagaacttttat

SEQ ID NO: 8218589 - DNA, 22 bp, Homo sapiens
ttctcacagtacctaacatgta

SEQ ID NO: 8218590 - DNA, 22 bp, Homo sapiens
ttctcactatgtatgtagattg

SEQ ID NO: 8218591 - DNA, 22 bp, Homo sapiens
ttctcagaaaatgtagagaaaa

SEQ ID NO: 8218592 - DNA, 22 bp, Homo sapiens
ttctcagaattgactgggagca

SEQ ID NO: 8218593 - DNA, 22 bp, Homo sapiens
ttctcagaaaatgtagagaaaa

SEQ ID NO: 8218594 - DNA, 22 bp, Homo sapiens
ttctcagaaaagcaagctttct

SEQ ID NO: 8218595 - DNA, 22 bp, Homo sapiens
ttctcaaagaaagctgtcatta

SEQ ID NO: 8218596 - DNA, 19 bp, Homo sapiens
ttctatgattaacatgaga

SEQ ID NO: 8218597 - DNA, 22 bp, Homo sapiens
ttctcaaagggtggtttgcaaa

SEQ ID NO: 8218598 - DNA, 22 bp, Homo sapiens
ttctcaaggacaaaatgacatg

SEQ ID NO: 8218599 - DNA, 22 bp, Homo sapiens
ttctcaagaacatatgtagggt

SEQ ID NO: 8218600 - DNA, 22 bp, Homo sapiens
ttctcaactctcaagagaagct

SEQ ID NO: 8218601 - DNA, 22 bp, Homo sapiens
ttctcaactctcaagagaagct

SEQ ID NO: 8218602 - DNA, 22 bp, Homo sapiens
ttctatcatacttgaatacatt

SEQ ID NO: 8218603 - DNA, 22 bp, Homo sapiens
ttctatcagcatagttgaaata

SEQ ID NO: 8218604 - DNA, 22 bp, Homo sapiens
ttctatatttatgggcatcacc

SEQ ID NO: 8218605 - DNA, 22 bp, Homo sapiens
ttctatgaaggtaagatgtacg

SEQ ID NO: 8218606 - DNA, 22 bp, Homo sapiens
ttctatctcatatgtgttctag

SEQ ID NO: 8218607 - DNA, 21 bp, Homo sapiens
ttctaactgggtgggccttga

SEQ ID NO: 8218608 - DNA, 22 bp, Homo sapiens
ttctaactggcttgacagtttc

SEQ ID NO: 8218609 - DNA, 22 bp, Homo sapiens
ttctaactttcaaggtcctttc

SEQ ID NO: 8218610 - DNA, 22 bp, Homo sapiens
ttctaactttcaaggtcctttc

SEQ ID NO: 8218611 - DNA, 22 bp, Homo sapiens
ttctcagatatttgtatggaac

SEQ ID NO: 8218612 - DNA, 22 bp, Homo sapiens
ttctcagatatttactgagcat

SEQ ID NO: 8218613 - DNA, 22 bp, Homo sapiens
ttctcagatatttactgagcat

SEQ ID NO: 8218614 - DNA, 22 bp, Homo sapiens
ttctcagatatttgtatggaac

SEQ ID NO: 8218615 - DNA, 22 bp, Homo sapiens
ttctcagatccatcagaagtcc

SEQ ID NO: 8218616 - DNA, 22 bp, Homo sapiens
ttctccagaggtggctagagtt

SEQ ID NO: 8218617 - DNA, 22 bp, Homo sapiens
ttctccagaggtggctagagtt

SEQ ID NO: 8218618 - DNA, 22 bp, Homo sapiens
ttctcagagtgaccaagtcttt

SEQ ID NO: 8218619 - DNA, 22 bp, Homo sapiens
ttctcagagtgaccaagtcttt

SEQ ID NO: 8218620 - DNA, 21 bp, Homo sapiens
ttctcagagtctattacagtt

SEQ ID NO: 8218621 - DNA, 22 bp, Homo sapiens
ttctcagagtgaccaagtcttt

SEQ ID NO: 8218622 - DNA, 21 bp, Homo sapiens
ttctcagagtctattacagtt

SEQ ID NO: 8218623 - DNA, 22 bp, Homo sapiens
ttctcagaggctgctaagtgca

SEQ ID NO: 8218624 - DNA, 22 bp, Homo sapiens
ttctcagaggctgctaagtgca

SEQ ID NO: 8218625 - DNA, 22 bp, Homo sapiens
ttctcagacttccagcaccagc

SEQ ID NO: 8218626 - DNA, 22 bp, Homo sapiens
ttctcagaattgactgggagca

SEQ ID NO: 8218627 - DNA, 22 bp, Homo sapiens
ttctcagaattgactgggagca

SEQ ID NO: 8218628 - DNA, 18 bp, Homo sapiens
ttctcagactttggaagt

SEQ ID NO: 8218629 - DNA, 18 bp, Homo sapiens
ttctcagactttggaagt

SEQ ID NO: 8218630 - DNA, 22 bp, Homo sapiens
ttctcagagcactgctgacaaa

SEQ ID NO: 8218631 - DNA, 22 bp, Homo sapiens
ttctcagagcactgctgacaaa

SEQ ID NO: 8218632 - DNA, 22 bp, Homo sapiens
ttctcagagctcactgtagtaa

SEQ ID NO: 8218633 - DNA, 22 bp, Homo sapiens
ttctcagagctcactgtagtaa

SEQ ID NO: 8218634 - DNA, 22 bp, Homo sapiens
ttctcagagctcactgtagtaa

SEQ ID NO: 8218635 - DNA, 19 bp, Homo sapiens
ttctcagagcttgcagcac

SEQ ID NO: 8218636 - DNA, 22 bp, Homo sapiens
ttctcagaggagtcgggagctg

SEQ ID NO: 8218637 - DNA, 22 bp, Homo sapiens
ttctcagaggagtcgggagctg

SEQ ID NO: 8218638 - DNA, 22 bp, Homo sapiens
ttctccagcctattggcctatc

SEQ ID NO: 8218639 - DNA, 22 bp, Homo sapiens
ttctccagcctattggcctatc

SEQ ID NO: 8218640 - DNA, 22 bp, Homo sapiens
ttctccagagtttctctcactg

SEQ ID NO: 8218641 - DNA, 22 bp, Homo sapiens
ttctccagagtttctctcactg

SEQ ID NO: 8218642 - DNA, 19 bp, Homo sapiens
ttctccagcctgacctgag

SEQ ID NO: 8218643 - DNA, 19 bp, Homo sapiens
ttctccagcctgacctgag

SEQ ID NO: 8218644 - DNA, 22 bp, Homo sapiens
ttctccagctcatcagggaggg

SEQ ID NO: 8218645 - DNA, 19 bp, Homo sapiens
ttctccagcctgacctgag

SEQ ID NO: 8218646 - DNA, 19 bp, Homo sapiens
ttctccaggctgcagaggg

SEQ ID NO: 8218647 - DNA, 19 bp, Homo sapiens
ttctccaggctgcagaggg

SEQ ID NO: 8218648 - DNA, 19 bp, Homo sapiens
ttctccaggctgcagaggg

SEQ ID NO: 8218649 - DNA, 22 bp, Homo sapiens
ttctccaggggagggttctcca

SEQ ID NO: 8218650 - DNA, 19 bp, Homo sapiens
ttctccagggacttaggga

SEQ ID NO: 8218651 - DNA, 22 bp, Homo sapiens
ttgaaagacattatttatatat

SEQ ID NO: 8218652 - DNA, 22 bp, Homo sapiens
ttgaaagatagtgaagccagcc

SEQ ID NO: 8218653 - DNA, 22 bp, Homo sapiens
ttgaaacttttcttggagaaac

SEQ ID NO: 8218654 - DNA, 22 bp, Homo sapiens
ttgaaagaactcttcagagata

SEQ ID NO: 8218655 - DNA, 22 bp, Homo sapiens
ttgaaacattacctgtatttcc

SEQ ID NO: 8218656 - DNA, 22 bp, Homo sapiens
ttgaaacattctcctattgatt

SEQ ID NO: 8218657 - DNA, 22 bp, Homo sapiens
ttgaaactcatcttagtgatgt

SEQ ID NO: 8218658 - DNA, 22 bp, Homo sapiens
ttgaaacttagaaattgagctg

SEQ ID NO: 8218659 - DNA, 22 bp, Homo sapiens
ttgaaactgagtgtgtttgggg

SEQ ID NO: 8218660 - DNA, 22 bp, Homo sapiens
ttgaaactgcttattgaatttg

SEQ ID NO: 8218661 - DNA, 22 bp, Homo sapiens
ttgagaaacctggcagtagaga

SEQ ID NO: 8218662 - DNA, 22 bp, Homo sapiens
ttgagaaactaacggcttgagc

SEQ ID NO: 8218663 - DNA, 22 bp, Homo sapiens
ttgacatcaaatagatatcttt

SEQ ID NO: 8218664 - DNA, 22 bp, Homo sapiens
ttgaaaggaatacagaggccta

SEQ ID NO: 8218665 - DNA, 23 bp, Homo sapiens
ttgaaagattgctaagtaaaaat

SEQ ID NO: 8218666 - DNA, 22 bp, Homo sapiens
ttgacataagacttagagtatt

SEQ ID NO: 8218667 - DNA, 22 bp, Homo sapiens
ttgacagttgcaatggtgatct

SEQ ID NO: 8218668 - DNA, 22 bp, Homo sapiens
ttgacagttgagggttgtctaa

SEQ ID NO: 8218669 - DNA, 22 bp, Homo sapiens
ttgaaacagacaagtaaatgtc

SEQ ID NO: 8218670 - DNA, 22 bp, Homo sapiens
ttgaaaatggtaagcatgatat

SEQ ID NO: 8218671 - DNA, 22 bp, Homo sapiens
ttgaaaatggtaagcatgatat

SEQ ID NO: 8218672 - DNA, 22 bp, Homo sapiens
ttgaaaatggtaagcatgatat

SEQ ID NO: 8218673 - DNA, 22 bp, Homo sapiens
ttgaaacagtagctcatagacc

SEQ ID NO: 8218674 - DNA, 22 bp, Homo sapiens
ttgaaacagtagctcatagacc

SEQ ID NO: 8218675 - DNA, 22 bp, Homo sapiens
ttgaaaatatcacaggagcagc

SEQ ID NO: 8218676 - DNA, 22 bp, Homo sapiens
ttgaaaactttctagaccaaga

SEQ ID NO: 8218677 - DNA, 22 bp, Homo sapiens
ttgaaaagttttgaaacactct

SEQ ID NO: 8218678 - DNA, 17 bp, Homo sapiens
ttgaaaagtaagctccc

SEQ ID NO: 8218679 - DNA, 20 bp, Homo sapiens
ttgaaaatgcattgtgcagt

SEQ ID NO: 8218680 - DNA, 20 bp, Homo sapiens
ttgaaaatgcattgtgcagt

SEQ ID NO: 8218681 - DNA, 22 bp, Homo sapiens
ttgaaaatatcacaggagcagc

SEQ ID NO: 8218682 - DNA, 22 bp, Homo sapiens
ttgaaaaaattggtagaggatg

SEQ ID NO: 8218683 - DNA, 22 bp, Homo sapiens
ttctttttggatagctgatgaa

SEQ ID NO: 8218684 - DNA, 22 bp, Homo sapiens
ttctttggtgggagattgaggt

SEQ ID NO: 8218685 - DNA, 22 bp, Homo sapiens
ttgaaaacagcgtagattcaca

SEQ ID NO: 8218686 - DNA, 22 bp, Homo sapiens
ttgaaaacagcgtagattcaca

SEQ ID NO: 8218687 - DNA, 23 bp, Homo sapiens
ttgaaaaatatagtcccattgtc

SEQ ID NO: 8218688 - DNA, 22 bp, Homo sapiens
ttgagacacaaggcacagtaag

SEQ ID NO: 8218689 - DNA, 22 bp, Homo sapiens
ttgagacacaaggcacagtaag

SEQ ID NO: 8218690 - DNA, 22 bp, Homo sapiens
ttgagacacagtttcactctgt

SEQ ID NO: 8218691 - DNA, 22 bp, Homo sapiens
ttgagacactttgggcatcact

SEQ ID NO: 8218692 - DNA, 22 bp, Homo sapiens
ttgagacactttgggcatcact

SEQ ID NO: 8218693 - DNA, 22 bp, Homo sapiens
ttgagacactttgggcatcact

SEQ ID NO: 8218694 - DNA, 22 bp, Homo sapiens
ttgagaactctgtatgtccagc

SEQ ID NO: 8218695 - DNA, 22 bp, Homo sapiens
ttgagaactactttattattct

SEQ ID NO: 8218696 - DNA, 22 bp, Homo sapiens
ttgagaacaggagtgttctttt

SEQ ID NO: 8218697 - DNA, 22 bp, Homo sapiens
ttgagaaccactgagttagata

SEQ ID NO: 8218698 - DNA, 22 bp, Homo sapiens
ttgagaaatgttttttaagctg

SEQ ID NO: 8218699 - DNA, 19 bp, Homo sapiens
ttgagaaatgggaaaagca

SEQ ID NO: 8218700 - DNA, 16 bp, Homo sapiens
ttgagaaatgaagttt

SEQ ID NO: 8218701 - DNA, 18 bp, Homo sapiens
ttgagaaataagcactaa

SEQ ID NO: 8218702 - DNA, 22 bp, Homo sapiens
ttgagaaataagcatgtctaga

SEQ ID NO: 8218703 - DNA, 22 bp, Homo sapiens
ttgagggtctggatctgctgct

SEQ ID NO: 8218704 - DNA, 22 bp, Homo sapiens
ttgagggtctggatctgctgct

SEQ ID NO: 8218705 - DNA, 22 bp, Homo sapiens
ttgagggtctggatctgctgct

SEQ ID NO: 8218706 - DNA, 22 bp, Homo sapiens
ttgaggtagtacttattattgg

SEQ ID NO: 8218707 - DNA, 22 bp, Homo sapiens
ttgagatagatctcatcttccc

SEQ ID NO: 8218708 - DNA, 22 bp, Homo sapiens
ttgagatagatctcatcttccc

SEQ ID NO: 8218709 - DNA, 22 bp, Homo sapiens
ttgagaggatggattagacaaa

SEQ ID NO: 8218710 - DNA, 22 bp, Homo sapiens
ttgaggctgcacagtacaggct

SEQ ID NO: 8218711 - DNA, 22 bp, Homo sapiens
ttgagggaacatgagaatcatc

SEQ ID NO: 8218712 - DNA, 22 bp, Homo sapiens
ttgagggaacatgagaatcatc

SEQ ID NO: 8218713 - DNA, 22 bp, Homo sapiens
ttgagggaacatgagaatcatc

SEQ ID NO: 8218714 - DNA, 22 bp, Homo sapiens
ttgagggacagaggtgctgtct

SEQ ID NO: 8218715 - DNA, 22 bp, Homo sapiens
ttgaggcccggcaggccgagcg

SEQ ID NO: 8218716 - DNA, 22 bp, Homo sapiens
ttgaggcccggcaggccgagcg

SEQ ID NO: 8218717 - DNA, 22 bp, Homo sapiens
ttcttcctcacactctcaccca

SEQ ID NO: 8218718 - DNA, 22 bp, Homo sapiens
ttcttcctcagcagggctgcct

SEQ ID NO: 8218719 - DNA, 22 bp, Homo sapiens
ttcttcctcagcagggctgcct

SEQ ID NO: 8218720 - DNA, 22 bp, Homo sapiens
ttcttcctcagcagggctgcct

SEQ ID NO: 8218721 - DNA, 22 bp, Homo sapiens
ttcttcagcccatatcttccag

SEQ ID NO: 8218722 - DNA, 22 bp, Homo sapiens
ttcttcagatggtgagacctcc

SEQ ID NO: 8218723 - DNA, 22 bp, Homo sapiens
ttcttcagatggtgagacctcc

SEQ ID NO: 8218724 - DNA, 22 bp, Homo sapiens
ttctgggaggctggctgtcata

SEQ ID NO: 8218725 - DNA, 19 bp, Homo sapiens
ttctgggaggggctgactg

SEQ ID NO: 8218726 - DNA, 22 bp, Homo sapiens
ttctgggcacacaggccctggt

SEQ ID NO: 8218727 - DNA, 22 bp, Homo sapiens
ttcttcagactccctctttaag

SEQ ID NO: 8218728 - DNA, 22 bp, Homo sapiens
ttctgggaggatgggaaatcat

SEQ ID NO: 8218729 - DNA, 22 bp, Homo sapiens
ttctgggaggctggctgtcata

SEQ ID NO: 8218730 - DNA, 22 bp, Homo sapiens
ttctgggagattcatatgaaaa

SEQ ID NO: 8218731 - DNA, 22 bp, Homo sapiens
ttctgggagaatctaaatggtt

SEQ ID NO: 8218732 - DNA, 22 bp, Homo sapiens
ttctgggacattgcaggtattc

SEQ ID NO: 8218733 - DNA, 23 bp, Homo sapiens
ttcttctcaattagttgattcag

SEQ ID NO: 8218734 - DNA, 22 bp, Homo sapiens
ttcttctcagggtcccacatgg

SEQ ID NO: 8218735 - DNA, 22 bp, Homo sapiens
ttcttctcagggtcccacatgg

SEQ ID NO: 8218736 - DNA, 22 bp, Homo sapiens
ttcttctccgaggagggctggt

SEQ ID NO: 8218737 - DNA, 22 bp, Homo sapiens
ttcttctcggctgtcagatagt

SEQ ID NO: 8218738 - DNA, 22 bp, Homo sapiens
ttcttctcggctgtcagatagt

SEQ ID NO: 8218739 - DNA, 22 bp, Homo sapiens
ttcttctcggctgtcagatagt

SEQ ID NO: 8218740 - DNA, 22 bp, Homo sapiens
ttcttctcctaaggagagtcct

SEQ ID NO: 8218741 - DNA, 22 bp, Homo sapiens
ttcttctccgaggagggctggt

SEQ ID NO: 8218742 - DNA, 22 bp, Homo sapiens
ttcttccttggtttcctggata

SEQ ID NO: 8218743 - DNA, 22 bp, Homo sapiens
ttcttccttggtttcctggata

SEQ ID NO: 8218744 - DNA, 22 bp, Homo sapiens
ttcttccttggtttcctggata

SEQ ID NO: 8218745 - DNA, 22 bp, Homo sapiens
ttcttcctctgtaaaaggtgac

SEQ ID NO: 8218746 - DNA, 23 bp, Homo sapiens
ttcttctcaattagttgattcag

SEQ ID NO: 8218747 - DNA, 22 bp, Homo sapiens
ttcttctaaatgtgcttattaa

SEQ ID NO: 8218748 - DNA, 21 bp, Homo sapiens
ttctgggaaatgagctggggc

SEQ ID NO: 8218749 - DNA, 20 bp, Homo sapiens
ttctgggaattgggtagctg

SEQ ID NO: 8218750 - DNA, 22 bp, Homo sapiens
ttctggcttttcatgttccagt

SEQ ID NO: 8218751 - DNA, 22 bp, Homo sapiens
ttctggctttggagaggatagc

SEQ ID NO: 8218752 - DNA, 22 bp, Homo sapiens
ttctggctttgaccaagttcaa

SEQ ID NO: 8218753 - DNA, 22 bp, Homo sapiens
ttctgggacatctggacagttt

SEQ ID NO: 8218754 - DNA, 22 bp, Homo sapiens
ttctgggacattgcaggtattc

SEQ ID NO: 8218755 - DNA, 22 bp, Homo sapiens
ttctgggaacaaagtggagtgg

SEQ ID NO: 8218756 - DNA, 22 bp, Homo sapiens
ttctgggacatctggacagttt

SEQ ID NO: 8218757 - DNA, 22 bp, Homo sapiens
ttctgggaacaaagtggagtgg

SEQ ID NO: 8218758 - DNA, 22 bp, Homo sapiens
ttctggagtttgaagatcaggt

SEQ ID NO: 8218759 - DNA, 22 bp, Homo sapiens
ttctggagttgtgacctcaggg

SEQ ID NO: 8218760 - DNA, 22 bp, Homo sapiens
ttctggctttcttgtcaggatg

SEQ ID NO: 8218761 - DNA, 22 bp, Homo sapiens
ttctggatatgggagagggagc

SEQ ID NO: 8218762 - DNA, 22 bp, Homo sapiens
ttctggagtcccacagccaggg

SEQ ID NO: 8218763 - DNA, 22 bp, Homo sapiens
ttctggagtgtattgggtctgc

SEQ ID NO: 8218764 - DNA, 22 bp, Homo sapiens
ttctggagttcaggtccctaaa

SEQ ID NO: 8218765 - DNA, 22 bp, Homo sapiens
ttctggagtattcctggcagcc

SEQ ID NO: 8218766 - DNA, 22 bp, Homo sapiens
ttctggagtattcctggcagcc

SEQ ID NO: 8218767 - DNA, 22 bp, Homo sapiens
ttctggagtcattggggctgat

SEQ ID NO: 8218768 - DNA, 22 bp, Homo sapiens
ttctggaggctctaagggacaa

SEQ ID NO: 8218769 - DNA, 22 bp, Homo sapiens
ttctggagggcatgctgctgcc

SEQ ID NO: 8218770 - DNA, 22 bp, Homo sapiens
ttctggagggcctgatcacaca

SEQ ID NO: 8218771 - DNA, 22 bp, Homo sapiens
ttctggagggcctgatcacaca

SEQ ID NO: 8218772 - DNA, 19 bp, Homo sapiens
ttctggaggttaccctgag

SEQ ID NO: 8218773 - DNA, 22 bp, Homo sapiens
ttctggaggttattaggagtct

SEQ ID NO: 8218774 - DNA, 22 bp, Homo sapiens
ttcttcttgaaactttaggttg

SEQ ID NO: 8218775 - DNA, 22 bp, Homo sapiens
ttcttcttcaagtgctgcattc

SEQ ID NO: 8218776 - DNA, 22 bp, Homo sapiens
ttcttcttcatttctgacgatg

SEQ ID NO: 8218777 - DNA, 22 bp, Homo sapiens
ttctttcttctcaggctgggta

SEQ ID NO: 8218778 - DNA, 22 bp, Homo sapiens
ttctttctctactagcagagct

SEQ ID NO: 8218779 - DNA, 22 bp, Homo sapiens
ttctttctcactctttaggaag

SEQ ID NO: 8218780 - DNA, 22 bp, Homo sapiens
ttctttctcactctttaggaag

SEQ ID NO: 8218781 - DNA, 22 bp, Homo sapiens
ttctttctcagtgggcagatac

SEQ ID NO: 8218782 - DNA, 22 bp, Homo sapiens
ttctttctcactctttaggaag

SEQ ID NO: 8218783 - DNA, 22 bp, Homo sapiens
ttctttctcactctttaggaag

SEQ ID NO: 8218784 - DNA, 22 bp, Homo sapiens
ttcttctgtgaggtgtgtgcct

SEQ ID NO: 8218785 - DNA, 22 bp, Homo sapiens
ttcttctgtgaggtgtgtgcct

SEQ ID NO: 8218786 - DNA, 22 bp, Homo sapiens
ttcttctgttggcagagcatac

SEQ ID NO: 8218787 - DNA, 22 bp, Homo sapiens
ttcttctgcctcccacctgata

SEQ ID NO: 8218788 - DNA, 22 bp, Homo sapiens
ttcttctgcctcccacctgata

SEQ ID NO: 8218789 - DNA, 22 bp, Homo sapiens
ttcttctgagagaaaaagctca

SEQ ID NO: 8218790 - DNA, 22 bp, Homo sapiens
ttcttctgattgccttctgcaa

SEQ ID NO: 8218791 - DNA, 22 bp, Homo sapiens
ttcttctgaaacataatcaata

SEQ ID NO: 8218792 - DNA, 22 bp, Homo sapiens
ttcttctgaaacataatcaata

SEQ ID NO: 8218793 - DNA, 22 bp, Homo sapiens
ttcttctgaaacataatcaata

SEQ ID NO: 8218794 - DNA, 22 bp, Homo sapiens
ttcttctgacactgatgctgta

SEQ ID NO: 8218795 - DNA, 22 bp, Homo sapiens
ttcttctgacactgatgctgta

SEQ ID NO: 8218796 - DNA, 22 bp, Homo sapiens
ttcttctctcatagattaaggt

SEQ ID NO: 8218797 - DNA, 22 bp, Homo sapiens
ttcttctctcatagattaaggt

SEQ ID NO: 8218798 - DNA, 20 bp, Homo sapiens
ttcttctctagttatcttca

SEQ ID NO: 8218799 - DNA, 22 bp, Homo sapiens
ttcttctctcatagattaaggt

SEQ ID NO: 8218800 - DNA, 20 bp, Homo sapiens
ttcttctctagttatcttca

SEQ ID NO: 8218801 - DNA, 20 bp, Homo sapiens
ttcttctctagttatcttca

SEQ ID NO: 8218802 - DNA, 20 bp, Homo sapiens
ttcttctctagttatcttca

SEQ ID NO: 8218803 - DNA, 22 bp, Homo sapiens
ttctttggggaatattctggtt

SEQ ID NO: 8218804 - DNA, 22 bp, Homo sapiens
ttctttgggcaattgctggccc

SEQ ID NO: 8218805 - DNA, 22 bp, Homo sapiens
ttctttgggctcagagagggag

SEQ ID NO: 8218806 - DNA, 22 bp, Homo sapiens
ttctttggggtctccagcatag

SEQ ID NO: 8218807 - DNA, 22 bp, Homo sapiens
ttctttggctgccagtctggag

SEQ ID NO: 8218808 - DNA, 22 bp, Homo sapiens
ttctttggcttacgtctggcct

SEQ ID NO: 8218809 - DNA, 22 bp, Homo sapiens
ttctttggcttacgtctggcct

SEQ ID NO: 8218810 - DNA, 22 bp, Homo sapiens
ttctttgggattgtagctgtct

SEQ ID NO: 8218811 - DNA, 22 bp, Homo sapiens
ttctttcttggggaacacactc

SEQ ID NO: 8218812 - DNA, 22 bp, Homo sapiens
ttctttcttggggaacacactc

SEQ ID NO: 8218813 - DNA, 22 bp, Homo sapiens
ttctttcttctcaggctgggta

SEQ ID NO: 8218814 - DNA, 22 bp, Homo sapiens
ttctttctttgtagtcctgaac

SEQ ID NO: 8218815 - DNA, 22 bp, Homo sapiens
ttctttctttgtagtcctgaac

SEQ ID NO: 8218816 - DNA, 19 bp, Homo sapiens
ttctttgagttcttctgag

SEQ ID NO: 8218817 - DNA, 22 bp, Homo sapiens
ttctttgagttagtacagtcca

SEQ ID NO: 8218818 - DNA, 22 bp, Homo sapiens
ttctttctttgtagtcctgaac

SEQ ID NO: 8218819 - DNA, 22 bp, Homo sapiens
ttctttggaataagtcaagctg

SEQ ID NO: 8218820 - DNA, 22 bp, Homo sapiens
ttctttgcccatgtttcctaag

SEQ ID NO: 8218821 - DNA, 22 bp, Homo sapiens
ttctttggcatttcctgtatgt

SEQ ID NO: 8218822 - DNA, 23 bp, Homo sapiens
ttctttggaattgggctgcaagg

SEQ ID NO: 8218823 - DNA, 22 bp, Homo sapiens
tttgtgtaccttgtacatttgt

SEQ ID NO: 8218824 - DNA, 22 bp, Homo sapiens
tttgtggcaggagcggagaccg

SEQ ID NO: 8218825 - DNA, 23 bp, Homo sapiens
ttttaatttggacataagaagat

SEQ ID NO: 8218826 - DNA, 23 bp, Homo sapiens
ttttaatttggacataagaagat

SEQ ID NO: 8218827 - DNA, 22 bp, Homo sapiens
ttttaattttgcaaatctggtg

SEQ ID NO: 8218828 - DNA, 22 bp, Homo sapiens
ttttaattttagcccttctggt

SEQ ID NO: 8218829 - DNA, 22 bp, Homo sapiens
ttttacaaatgaggagctggag

SEQ ID NO: 8218830 - DNA, 22 bp, Homo sapiens
ttttacaagctgagtcgttaaa

SEQ ID NO: 8218831 - DNA, 22 bp, Homo sapiens
ttttacaagctgagtcgttaaa

SEQ ID NO: 8218832 - DNA, 22 bp, Homo sapiens
ttttacacctcagatgagcaga

SEQ ID NO: 8218833 - DNA, 22 bp, Homo sapiens
ttttacacctcagatgagcaga

SEQ ID NO: 8218834 - DNA, 22 bp, Homo sapiens
ttttacaggtcataggtatagt

SEQ ID NO: 8218835 - DNA, 22 bp, Homo sapiens
ttttacaggtcataggtatagt

SEQ ID NO: 8218836 - DNA, 22 bp, Homo sapiens
ttttacacttcggttgtgtgca

SEQ ID NO: 8218837 - DNA, 21 bp, Homo sapiens
ttttacagatgaggggaaggg

SEQ ID NO: 8218838 - DNA, 22 bp, Homo sapiens
ttttacacctgttaactctaag

SEQ ID NO: 8218839 - DNA, 22 bp, Homo sapiens
ttttacacctgttaactctaag

SEQ ID NO: 8218840 - DNA, 22 bp, Homo sapiens
ttttacacctgttaactctaag

SEQ ID NO: 8218841 - DNA, 22 bp, Homo sapiens
ttttacacttcggttgtgtgca

SEQ ID NO: 8218842 - DNA, 22 bp, Homo sapiens
ttttacaggtcataggtatagt

SEQ ID NO: 8218843 - DNA, 22 bp, Homo sapiens
ttttacaggtgaaaaatgaaga

SEQ ID NO: 8218844 - DNA, 22 bp, Homo sapiens
ttttacaggtgaaaaatgaaga

SEQ ID NO: 8218845 - DNA, 22 bp, Homo sapiens
ttttacagttccatgcaaagcg

SEQ ID NO: 8218846 - DNA, 22 bp, Homo sapiens
ttttacagttccatgcaaagcg

SEQ ID NO: 8218847 - DNA, 22 bp, Homo sapiens
ttttacagttccatgcaaagcg

SEQ ID NO: 8218848 - DNA, 22 bp, Homo sapiens
ttttacaggtgtgagccaccat

SEQ ID NO: 8218849 - DNA, 22 bp, Homo sapiens
ttttacagttccatgcaaagcg

SEQ ID NO: 8218850 - DNA, 22 bp, Homo sapiens
ttttacagtcagtcaaactcag

SEQ ID NO: 8218851 - DNA, 22 bp, Homo sapiens
tttgtcttaaatcttgttactg

SEQ ID NO: 8218852 - DNA, 22 bp, Homo sapiens
tttgtccttgtcctacatcggt

SEQ ID NO: 8218853 - DNA, 22 bp, Homo sapiens
tttgtccttgaatcaattcaca

SEQ ID NO: 8218854 - DNA, 19 bp, Homo sapiens
tttgtcctgccctttctca

SEQ ID NO: 8218855 - DNA, 20 bp, Homo sapiens
tttgtctgttaagtgtttct

SEQ ID NO: 8218856 - DNA, 22 bp, Homo sapiens
tttgtggaactctcttcttgca

SEQ ID NO: 8218857 - DNA, 22 bp, Homo sapiens
tttgtggaactctcttcttgca

SEQ ID NO: 8218858 - DNA, 22 bp, Homo sapiens
tttgtgcaggtgtgtcagatcg

SEQ ID NO: 8218859 - DNA, 22 bp, Homo sapiens
tttgtgcagtggttaagaccat

SEQ ID NO: 8218860 - DNA, 22 bp, Homo sapiens
tttgtgcagctaagaaaatggc

SEQ ID NO: 8218861 - DNA, 22 bp, Homo sapiens
tttgtgcaggtataggcggaga

SEQ ID NO: 8218862 - DNA, 22 bp, Homo sapiens
tttgtgcatgggtatggccaat

SEQ ID NO: 8218863 - DNA, 22 bp, Homo sapiens
tttgtgcataaagggctatagt

SEQ ID NO: 8218864 - DNA, 22 bp, Homo sapiens
tttgtgcattcaagtaggagcc

SEQ ID NO: 8218865 - DNA, 22 bp, Homo sapiens
tttgtgcacattgcttttctat

SEQ ID NO: 8218866 - DNA, 22 bp, Homo sapiens
tttgtgcacattgcttttctat

SEQ ID NO: 8218867 - DNA, 22 bp, Homo sapiens
tttgtgcacttctgtagctgcc

SEQ ID NO: 8218868 - DNA, 22 bp, Homo sapiens
tttgtgcagataggagacaatc

SEQ ID NO: 8218869 - DNA, 23 bp, Homo sapiens
tttgtgcagaagacaaagtggcc

SEQ ID NO: 8218870 - DNA, 19 bp, Homo sapiens
tttgtgcagcaacattaat

SEQ ID NO: 8218871 - DNA, 22 bp, Homo sapiens
tttgtgcagatgtatatttgtg

SEQ ID NO: 8218872 - DNA, 19 bp, Homo sapiens
tttgtgcagcaacattaat

SEQ ID NO: 8218873 - DNA, 22 bp, Homo sapiens
tttgtgcaagagggccacctta

SEQ ID NO: 8218874 - DNA, 22 bp, Homo sapiens
tttgtgcaagacatgctaagag

SEQ ID NO: 8218875 - DNA, 22 bp, Homo sapiens
tttgtgcaatttatgtactata

SEQ ID NO: 8218876 - DNA, 22 bp, Homo sapiens
tttgtgcaatttatgtactata

SEQ ID NO: 8218877 - DNA, 22 bp, Homo sapiens
tttgtgcaagagggccacctta

SEQ ID NO: 8218878 - DNA, 22 bp, Homo sapiens
tttgtgcacattgcttttctat

SEQ ID NO: 8218879 - DNA, 22 bp, Homo sapiens
ttttagaagtgcctatcctatg

SEQ ID NO: 8218880 - DNA, 22 bp, Homo sapiens
ttttagaagtgcctatcctatg

SEQ ID NO: 8218881 - DNA, 22 bp, Homo sapiens
ttttagaagtgcctatcctatg

SEQ ID NO: 8218882 - DNA, 22 bp, Homo sapiens
ttttattgggagtcctctactg

SEQ ID NO: 8218883 - DNA, 22 bp, Homo sapiens
ttttattgggagtcctctactg

SEQ ID NO: 8218884 - DNA, 22 bp, Homo sapiens
ttttattgggagtcctctactg

SEQ ID NO: 8218885 - DNA, 22 bp, Homo sapiens
ttttattgggagtcctctactg

SEQ ID NO: 8218886 - DNA, 22 bp, Homo sapiens
ttttattgggagtcctctactg

SEQ ID NO: 8218887 - DNA, 22 bp, Homo sapiens
ttttattgggagtcctctactg

SEQ ID NO: 8218888 - DNA, 22 bp, Homo sapiens
ttttattggtaatgataaaagt

SEQ ID NO: 8218889 - DNA, 22 bp, Homo sapiens
ttttattggtaatgataaaagt

SEQ ID NO: 8218890 - DNA, 22 bp, Homo sapiens
ttttattggtaatgataaaagt

SEQ ID NO: 8218891 - DNA, 22 bp, Homo sapiens
ttttattggtaatgataaaagt

SEQ ID NO: 8218892 - DNA, 22 bp, Homo sapiens
ttttattggtaatgataaaagt

SEQ ID NO: 8218893 - DNA, 22 bp, Homo sapiens
ttttattggtaatgataaaagt

SEQ ID NO: 8218894 - DNA, 22 bp, Homo sapiens
ttttattggtaatgataaaagt

SEQ ID NO: 8218895 - DNA, 22 bp, Homo sapiens
ttttattggtaatgataaaagt

SEQ ID NO: 8218896 - DNA, 22 bp, Homo sapiens
ttttagaaagatccctggcagg

SEQ ID NO: 8218897 - DNA, 22 bp, Homo sapiens
ttttagaaatactgatttagtg

SEQ ID NO: 8218898 - DNA, 22 bp, Homo sapiens
ttttagaaggaatgctatggtg

SEQ ID NO: 8218899 - DNA, 22 bp, Homo sapiens
ttttagaaatactgatttagtg

SEQ ID NO: 8218900 - DNA, 22 bp, Homo sapiens
ttttacttcattcctgacttca

SEQ ID NO: 8218901 - DNA, 22 bp, Homo sapiens
ttttacttcattcctgacttca

SEQ ID NO: 8218902 - DNA, 22 bp, Homo sapiens
ttttacttaattcttggtcatg

SEQ ID NO: 8218903 - DNA, 22 bp, Homo sapiens
ttttattgtcaatgaagacaga

SEQ ID NO: 8218904 - DNA, 22 bp, Homo sapiens
ttttattgtcaatgaagacaga

SEQ ID NO: 8218905 - DNA, 22 bp, Homo sapiens
ttttattgtcaatgaagacaga

SEQ ID NO: 8218906 - DNA, 22 bp, Homo sapiens
ttttattgtcaatgaagacaga

SEQ ID NO: 8218907 - DNA, 22 bp, Homo sapiens
ttttattgtcaatgaagacaga

SEQ ID NO: 8218908 - DNA, 22 bp, Homo sapiens
ttttattgtcaatgaagacaga

SEQ ID NO: 8218909 - DNA, 22 bp, Homo sapiens
ttttattgtctcccagttctgg

SEQ ID NO: 8218910 - DNA, 22 bp, Homo sapiens
ttttattgtctcccagttctgg

SEQ ID NO: 8218911 - DNA, 22 bp, Homo sapiens
ttttattgtctcccagttctgg

SEQ ID NO: 8218912 - DNA, 22 bp, Homo sapiens
ttttattgtctcccagttctgg

SEQ ID NO: 8218913 - DNA, 22 bp, Homo sapiens
ttttattgtctcccagttctgg

SEQ ID NO: 8218914 - DNA, 22 bp, Homo sapiens
ttttattgtctgtattgcctat

SEQ ID NO: 8218915 - DNA, 22 bp, Homo sapiens
ttttattgtctgtattgcctat

SEQ ID NO: 8218916 - DNA, 22 bp, Homo sapiens
ttttattgtctgtattgcctat

SEQ ID NO: 8218917 - DNA, 22 bp, Homo sapiens
ttttattgtctgtattgcctat

SEQ ID NO: 8218918 - DNA, 22 bp, Homo sapiens
ttttattgtctgtattgcctat

SEQ ID NO: 8218919 - DNA, 16 bp, Homo sapiens
ttttattgtgacagcc

SEQ ID NO: 8218920 - DNA, 16 bp, Homo sapiens
ttttattgtgacagcc

SEQ ID NO: 8218921 - DNA, 16 bp, Homo sapiens
ttttattgtgacagcc

SEQ ID NO: 8218922 - DNA, 16 bp, Homo sapiens
ttttattgtgacagcc

SEQ ID NO: 8218923 - DNA, 16 bp, Homo sapiens
ttttattgtgacagcc

SEQ ID NO: 8218924 - DNA, 22 bp, Homo sapiens
ttttattgtctgtattgcctat

SEQ ID NO: 8218925 - DNA, 16 bp, Homo sapiens
ttttattgtgacagcc

SEQ ID NO: 8218926 - DNA, 22 bp, Homo sapiens
ttttcaagagagtgttctatgt

SEQ ID NO: 8218927 - DNA, 16 bp, Homo sapiens
ttttcaagagcggaga

SEQ ID NO: 8218928 - DNA, 22 bp, Homo sapiens
ttttcaagggcagggaaatcat

SEQ ID NO: 8218929 - DNA, 22 bp, Homo sapiens
ttttcaagggcagggaaatcat

SEQ ID NO: 8218930 - DNA, 22 bp, Homo sapiens
ttttcaagggcagggaaatcat

SEQ ID NO: 8218931 - DNA, 20 bp, Homo sapiens
ttttccactcctcaaaacag

SEQ ID NO: 8218932 - DNA, 22 bp, Homo sapiens
ttttccactttagtgcaataac

SEQ ID NO: 8218933 - DNA, 20 bp, Homo sapiens
ttttccagaaagtatcattg

SEQ ID NO: 8218934 - DNA, 20 bp, Homo sapiens
ttttccagaaagtatcattg

SEQ ID NO: 8218935 - DNA, 20 bp, Homo sapiens
ttttccactcctcaaaacag

SEQ ID NO: 8218936 - DNA, 22 bp, Homo sapiens
ttttcacaagggtccaactagt

SEQ ID NO: 8218937 - DNA, 22 bp, Homo sapiens
ttttgtgttgccatgttaagca

SEQ ID NO: 8218938 - DNA, 22 bp, Homo sapiens
ttttgtgagctgagaaatgtat

SEQ ID NO: 8218939 - DNA, 22 bp, Homo sapiens
ttttgtgagctgagaaatgtat

SEQ ID NO: 8218940 - DNA, 22 bp, Homo sapiens
ttttgtgagctccttggaggta

SEQ ID NO: 8218941 - DNA, 22 bp, Homo sapiens
ttttgtgagatgcgtatgaatg

SEQ ID NO: 8218942 - DNA, 22 bp, Homo sapiens
ttttgtgagcccataaatgcca

SEQ ID NO: 8218943 - DNA, 22 bp, Homo sapiens
ttttgtgagcccataaatgcca

SEQ ID NO: 8218944 - DNA, 17 bp, Homo sapiens
ttttgttcatcttcaaa

SEQ ID NO: 8218945 - DNA, 22 bp, Homo sapiens
tttttgtatagaaatgaactaa

SEQ ID NO: 8218946 - DNA, 22 bp, Homo sapiens
tttttgtagtcattagaagagg

SEQ ID NO: 8218947 - DNA, 22 bp, Homo sapiens
tttttgtagtcattagaagagg

SEQ ID NO: 8218948 - DNA, 22 bp, Homo sapiens
ttttgtcagtgagaacagagtt

SEQ ID NO: 8218949 - DNA, 22 bp, Homo sapiens
ttttgtatgagaagtgctttac

SEQ ID NO: 8218950 - DNA, 22 bp, Homo sapiens
ttttgtatcctccctttcactg

SEQ ID NO: 8218951 - DNA, 22 bp, Homo sapiens
ttttgtatcctccctttcactg

SEQ ID NO: 8218952 - DNA, 22 bp, Homo sapiens
ttttgtatagtcaaagacaaga

SEQ ID NO: 8218953 - DNA, 22 bp, Homo sapiens
ttttgtatagtcaaagacaaga

SEQ ID NO: 8218954 - DNA, 22 bp, Homo sapiens
ttttgtatagtcaaagacaaga

SEQ ID NO: 8218955 - DNA, 22 bp, Homo sapiens
ttttgtaagaaactgccaagcc

SEQ ID NO: 8218956 - DNA, 22 bp, Homo sapiens
ttttgtctaagaactttgcaaa

SEQ ID NO: 8218957 - DNA, 22 bp, Homo sapiens
ttttgtgacagaaagattaagt

SEQ ID NO: 8218958 - DNA, 22 bp, Homo sapiens
ttttgtgagatgcgtatgaatg

SEQ ID NO: 8218959 - DNA, 22 bp, Homo sapiens
ttttgtgacagaaagattaagt

SEQ ID NO: 8218960 - DNA, 22 bp, Homo sapiens
ttttgtgaatagtttatctaag

SEQ ID NO: 8218961 - DNA, 22 bp, Homo sapiens
ttttgtgaatagtttatctaag

SEQ ID NO: 8218962 - DNA, 22 bp, Homo sapiens
ttttttatatcaactgaagtct

SEQ ID NO: 8218963 - DNA, 22 bp, Homo sapiens
ttttttatatcaactgaagtct

SEQ ID NO: 8218964 - DNA, 22 bp, Homo sapiens
ttttttatatcaactgaagtct

SEQ ID NO: 8218965 - DNA, 22 bp, Homo sapiens
ttttttatatcaactgaagtct

SEQ ID NO: 8218966 - DNA, 22 bp, Homo sapiens
ttttttacagaatcattaatca

SEQ ID NO: 8218967 - DNA, 22 bp, Homo sapiens
ttttttatagcaatgaacccac

SEQ ID NO: 8218968 - DNA, 22 bp, Homo sapiens
ttttttatagcaatgaacccac

SEQ ID NO: 8218969 - DNA, 22 bp, Homo sapiens
ttttttccaacttaagacttca

SEQ ID NO: 8218970 - DNA, 22 bp, Homo sapiens
ttttttccaacttaagacttca

SEQ ID NO: 8218971 - DNA, 22 bp, Homo sapiens
ttttttccagcttctagaggcc

SEQ ID NO: 8218972 - DNA, 22 bp, Homo sapiens
ttttttatctatggtagtacca

SEQ ID NO: 8218973 - DNA, 22 bp, Homo sapiens
ttttttatctatggtagtacca

SEQ ID NO: 8218974 - DNA, 22 bp, Homo sapiens
ttttttatctatggtagtacca

SEQ ID NO: 8218975 - DNA, 22 bp, Homo sapiens
ttttttatctatggtagtacca

SEQ ID NO: 8218976 - DNA, 22 bp, Homo sapiens
tttttgttcccagagaatttgt

SEQ ID NO: 8218977 - DNA, 22 bp, Homo sapiens
tttttgttcccagagaatttgt

SEQ ID NO: 8218978 - DNA, 22 bp, Homo sapiens
tttttgttctgattatactggt

SEQ ID NO: 8218979 - DNA, 22 bp, Homo sapiens
tttttgttctgattatactggt

SEQ ID NO: 8218980 - DNA, 22 bp, Homo sapiens
ttttttacagaatcattaatca

SEQ ID NO: 8218981 - DNA, 22 bp, Homo sapiens
tttttgtatatgcttcgaggat

SEQ ID NO: 8218982 - DNA, 22 bp, Homo sapiens
tttttgtatatgcttcgaggat

SEQ ID NO: 8218983 - DNA, 22 bp, Homo sapiens
tttttgtatagaaatgaactaa

SEQ ID NO: 8218984 - DNA, 22 bp, Homo sapiens
tttttgtatagaaatgaactaa

SEQ ID NO: 8218985 - DNA, 22 bp, Homo sapiens
ttttcctcaggaatgctaagct

SEQ ID NO: 8218986 - DNA, 22 bp, Homo sapiens
ttttcctatatgcaaagaatgc

SEQ ID NO: 8218987 - DNA, 22 bp, Homo sapiens
ttttcccatctacaaagcaggg

SEQ ID NO: 8218988 - DNA, 22 bp, Homo sapiens
ttttcctactgataaacagtta

SEQ ID NO: 8218989 - DNA, 22 bp, Homo sapiens
ttttcctagtaggcctattaga

SEQ ID NO: 8218990 - DNA, 22 bp, Homo sapiens
ttttccagatgaattccacagt

SEQ ID NO: 8218991 - DNA, 22 bp, Homo sapiens
ttttccagatgaattccacagt

SEQ ID NO: 8218992 - DNA, 22 bp, Homo sapiens
ttttccagatggatactagaat

SEQ ID NO: 8218993 - DNA, 22 bp, Homo sapiens
ttttccagatggatactagaat

SEQ ID NO: 8218994 - DNA, 23 bp, Homo sapiens
ttttccagaatcgactctgtaga

SEQ ID NO: 8218995 - DNA, 23 bp, Homo sapiens
ttttccagaatcgactctgtaga

SEQ ID NO: 8218996 - DNA, 22 bp, Homo sapiens
ttttccagagctgtctcttgca

SEQ ID NO: 8218997 - DNA, 22 bp, Homo sapiens
ttttccagagctgtctcttgca

SEQ ID NO: 8218998 - DNA, 22 bp, Homo sapiens
ttttccagagctgtctcttgca

SEQ ID NO: 8218999 - DNA, 23 bp, Homo sapiens
ttttccagaatcgactctgtaga

SEQ ID NO: 8219000 - DNA, 22 bp, Homo sapiens
ttttccagatggatactagaat

SEQ ID NO: 8219001 - DNA, 22 bp, Homo sapiens
ttttccagattggacttagtcc

SEQ ID NO: 8219002 - DNA, 22 bp, Homo sapiens
ttttccagattggacttagtcc

SEQ ID NO: 8219003 - DNA, 22 bp, Homo sapiens
ttttccagcataggtacatata

SEQ ID NO: 8219004 - DNA, 22 bp, Homo sapiens
ttttccagcataggtacatata

SEQ ID NO: 8219005 - DNA, 20 bp, Homo sapiens
ttttcctcgtgtttgttcta

SEQ ID NO: 8219006 - DNA, 22 bp, Homo sapiens
ttttcctctgagctttgaataa

SEQ ID NO: 8219007 - DNA, 22 bp, Homo sapiens
ttttcctctgagctttgaataa

SEQ ID NO: 8219008 - DNA, 22 bp, Homo sapiens
ttttcctctgagctttgaataa

SEQ ID NO: 8219009 - DNA, 22 bp, Homo sapiens
ttttcctctgcagagcagttag

SEQ ID NO: 8219010 - DNA, 22 bp, Homo sapiens
ttttcctctgtatgcgtgagat

SEQ ID NO: 8219011 - DNA, 22 bp, Homo sapiens
ttttcctctgcagagcagttag

SEQ ID NO: 8219012 - DNA, 22 bp, Homo sapiens
ttttcctctgcaataaaagcag

SEQ ID NO: 8219013 - DNA, 22 bp, Homo sapiens
ttttcctctgcaataaaagcag

SEQ ID NO: 8219014 - DNA, 22 bp, Homo sapiens
ttttccttaacagagggagaaa

SEQ ID NO: 8219015 - DNA, 22 bp, Homo sapiens
ttttccttagcttctctgcgag

SEQ ID NO: 8219016 - DNA, 22 bp, Homo sapiens
ttttccttcacctcttgagcct

SEQ ID NO: 8219017 - DNA, 22 bp, Homo sapiens
ttttccttcacctcttgagcct

SEQ ID NO: 8219018 - DNA, 22 bp, Homo sapiens
ttttccttcacctcttgagcct

SEQ ID NO: 8219019 - DNA, 22 bp, Homo sapiens
ttttccttcatatcccttatgt

SEQ ID NO: 8219020 - DNA, 22 bp, Homo sapiens
ttttccttcatatcccttatgt

SEQ ID NO: 8219021 - DNA, 17 bp, Homo sapiens
ttttggtgagttgtttc

SEQ ID NO: 8219022 - DNA, 22 bp, Homo sapiens
ttttggtttcccttcttatggt

SEQ ID NO: 8219023 - DNA, 22 bp, Homo sapiens
ttttggtaatgcctaacttcgt

SEQ ID NO: 8219024 - DNA, 22 bp, Homo sapiens
ttttggtacatgcaatagcaat

SEQ ID NO: 8219025 - DNA, 22 bp, Homo sapiens
ttttggtagaatcaacaatgta

SEQ ID NO: 8219026 - DNA, 22 bp, Homo sapiens
ttttggtagaatgatattggat

SEQ ID NO: 8219027 - DNA, 22 bp, Homo sapiens
ttttggtacctacagctgaatt

SEQ ID NO: 8219028 - DNA, 22 bp, Homo sapiens
ttttggtagccaacaaaatgtt

SEQ ID NO: 8219029 - DNA, 22 bp, Homo sapiens
ttttggtagcttatgtgcagtt

SEQ ID NO: 8219030 - DNA, 22 bp, Homo sapiens
ttttggctcttggtaggtcaga

SEQ ID NO: 8219031 - DNA, 22 bp, Homo sapiens
ttttggtaatgaacttaggaag

SEQ ID NO: 8219032 - DNA, 22 bp, Homo sapiens
ttttggtaaataatcaactttg

SEQ ID NO: 8219033 - DNA, 22 bp, Homo sapiens
ttttggggagaacggttgctat

SEQ ID NO: 8219034 - DNA, 22 bp, Homo sapiens
ttttgggtgaatttgccagtta

SEQ ID NO: 8219035 - DNA, 22 bp, Homo sapiens
ttttggcttttcctcagcaagc

SEQ ID NO: 8219036 - DNA, 18 bp, Homo sapiens
ttttccttccaccttgaa

SEQ ID NO: 8219037 - DNA, 18 bp, Homo sapiens
ttttccttccaccttgaa

SEQ ID NO: 8219038 - DNA, 22 bp, Homo sapiens
ttttccttctagagcagatttc

SEQ ID NO: 8219039 - DNA, 19 bp, Homo sapiens
ttttccttctatatgtttc

SEQ ID NO: 8219040 - DNA, 19 bp, Homo sapiens
ttttccttctatatgtttc

SEQ ID NO: 8219041 - DNA, 21 bp, Homo sapiens
tttgtccacctgtgttcacca

SEQ ID NO: 8219042 - DNA, 22 bp, Homo sapiens
tttgtcattctgtgtatttaaa

SEQ ID NO: 8219043 - DNA, 20 bp, Homo sapiens
tttgtccagcgtctactctg

SEQ ID NO: 8219044 - DNA, 22 bp, Homo sapiens
tttgtccagatgcacagataat

SEQ ID NO: 8219045 - DNA, 20 bp, Homo sapiens
tttgtccagcgtctactctg

SEQ ID NO: 8219046 - DNA, 22 bp, Homo sapiens
tttgtcctataatcctcttaca

SEQ ID NO: 8219047 - DNA, 22 bp, Homo sapiens
tttgtcctaacagtggtaaagg

SEQ ID NO: 8219048 - DNA, 22 bp, Homo sapiens
tttgtcctctccatgtacaata

SEQ ID NO: 8219049 - DNA, 22 bp, Homo sapiens
tttgtcctctccatgtacaata

SEQ ID NO: 8219050 - DNA, 22 bp, Homo sapiens
tttggggccagccccatgtctg

SEQ ID NO: 8219051 - DNA, 22 bp, Homo sapiens
tttggggctcagcaggctgttt

SEQ ID NO: 8219052 - DNA, 22 bp, Homo sapiens
tttggggctcagcaggctgttt

SEQ ID NO: 8219053 - DNA, 22 bp, Homo sapiens
tttggggatgtctgagttgttg

SEQ ID NO: 8219054 - DNA, 22 bp, Homo sapiens
tttggggatgacaggttaggaa

SEQ ID NO: 8219055 - DNA, 22 bp, Homo sapiens
tttgggctggtttgccatgccc

SEQ ID NO: 8219056 - DNA, 22 bp, Homo sapiens
tttggggagacatggccagctg

SEQ ID NO: 8219057 - DNA, 22 bp, Homo sapiens
tttggggaggttatcggtgtgc

SEQ ID NO: 8219058 - DNA, 22 bp, Homo sapiens
tttggggagacatggccagctg

SEQ ID NO: 8219059 - DNA, 22 bp, Homo sapiens
tttgggctcactatgctgaaga

SEQ ID NO: 8219060 - DNA, 22 bp, Homo sapiens
tttgggctcttgctgacctggg

SEQ ID NO: 8219061 - DNA, 22 bp, Homo sapiens
tttgggcaggcttttccctaga

SEQ ID NO: 8219062 - DNA, 22 bp, Homo sapiens
tttggctcatctcagtcctagg

SEQ ID NO: 8219063 - DNA, 23 bp, Homo sapiens
tttggctccatgggtggctcatt

SEQ ID NO: 8219064 - DNA, 22 bp, Homo sapiens
tttggctcggctgctgatggtg

SEQ ID NO: 8219065 - DNA, 22 bp, Homo sapiens
tttggctctggttctggctcca

SEQ ID NO: 8219066 - DNA, 19 bp, Homo sapiens
tttggctctggtcagagag

SEQ ID NO: 8219067 - DNA, 22 bp, Homo sapiens
tttggctttagtgccttctgat

SEQ ID NO: 8219068 - DNA, 21 bp, Homo sapiens
tttggcttctctgctgcagcc

SEQ ID NO: 8219069 - DNA, 22 bp, Homo sapiens
tttggcttaacttacatgatat

SEQ ID NO: 8219070 - DNA, 22 bp, Homo sapiens
tttggctgagaagttgtgcttt

SEQ ID NO: 8219071 - DNA, 18 bp, Homo sapiens
tttggctgttcaagagca

SEQ ID NO: 8219072 - DNA, 22 bp, Homo sapiens
tttggcatttaataggtgatca

SEQ ID NO: 8219073 - DNA, 22 bp, Homo sapiens
tttggcatagctctttgttcct

SEQ ID NO: 8219074 - DNA, 22 bp, Homo sapiens
tttgcattgtttcaaaagtgaa

SEQ ID NO: 8219075 - DNA, 22 bp, Homo sapiens
tttgcatttgcaaataatgaaa

SEQ ID NO: 8219076 - DNA, 22 bp, Homo sapiens
tttgcatttgttcaagtattga

SEQ ID NO: 8219077 - DNA, 22 bp, Homo sapiens
tttgcatttgttcaagtattga

SEQ ID NO: 8219078 - DNA, 22 bp, Homo sapiens
tttgcatttgttcaagtattga

SEQ ID NO: 8219079 - DNA, 22 bp, Homo sapiens
tttgcattgcattaagtattct

SEQ ID NO: 8219080 - DNA, 22 bp, Homo sapiens
tttgcattgtaatatttagttc

SEQ ID NO: 8219081 - DNA, 22 bp, Homo sapiens
tttgcattgtaatatttagttc

SEQ ID NO: 8219082 - DNA, 22 bp, Homo sapiens
tttgcattgtaatatttagttc

SEQ ID NO: 8219083 - DNA, 22 bp, Homo sapiens
tttgcattgcattaagtattct

SEQ ID NO: 8219084 - DNA, 22 bp, Homo sapiens
tttgcattgcattaagtattct

SEQ ID NO: 8219085 - DNA, 22 bp, Homo sapiens
tttgcattgtaatatttagttc

SEQ ID NO: 8219086 - DNA, 22 bp, Homo sapiens
tttgctgtgaatccattactgt

SEQ ID NO: 8219087 - DNA, 22 bp, Homo sapiens
tttgctgtgggatatccatgtg

SEQ ID NO: 8219088 - DNA, 20 bp, Homo sapiens
tttgctgtgggtgtaagaat

SEQ ID NO: 8219089 - DNA, 22 bp, Homo sapiens
tttgcttcacaagtatggttct

SEQ ID NO: 8219090 - DNA, 22 bp, Homo sapiens
tttgctgaatagattgtaaact

SEQ ID NO: 8219091 - DNA, 21 bp, Homo sapiens
tttgctgaagattttaggctg

SEQ ID NO: 8219092 - DNA, 22 bp, Homo sapiens
tttgctgggctctgtgccagac

SEQ ID NO: 8219093 - DNA, 22 bp, Homo sapiens
tttgcagtttcattgctgaaat

SEQ ID NO: 8219094 - DNA, 22 bp, Homo sapiens
tttgcagtttcattgctgaaat

SEQ ID NO: 8219095 - DNA, 22 bp, Homo sapiens
tttgcagtttcattgctgaaat

SEQ ID NO: 8219096 - DNA, 22 bp, Homo sapiens
tttgcagttccatccaggcaga

SEQ ID NO: 8219097 - DNA, 22 bp, Homo sapiens
tttgcagttcatctgagaaaaa

SEQ ID NO: 8219098 - DNA, 22 bp, Homo sapiens
tttgcataaaggagcatttctc

SEQ ID NO: 8219099 - DNA, 22 bp, Homo sapiens
tttgcagtttgttcagctcttt

SEQ ID NO: 8219100 - DNA, 22 bp, Homo sapiens
tttgcataagtcatgtccagtg

SEQ ID NO: 8219101 - DNA, 22 bp, Homo sapiens
tttgcatacatgagaatgtctt

SEQ ID NO: 8219102 - DNA, 22 bp, Homo sapiens
tttgcataggatggacatttta

SEQ ID NO: 8219103 - DNA, 22 bp, Homo sapiens
tttgcataggatggacatttta

SEQ ID NO: 8219104 - DNA, 22 bp, Homo sapiens
tttgcattatctcacttatata

SEQ ID NO: 8219105 - DNA, 22 bp, Homo sapiens
tttgcattatatttatagaaga

SEQ ID NO: 8219106 - DNA, 22 bp, Homo sapiens
tttgcattagtttagatttcaa

SEQ ID NO: 8219107 - DNA, 22 bp, Homo sapiens
tttgcattagtttagatttcaa

SEQ ID NO: 8219108 - DNA, 22 bp, Homo sapiens
tttgcattacttgactttagtt

SEQ ID NO: 8219109 - DNA, 22 bp, Homo sapiens
tttgcattacttgactttagtt

SEQ ID NO: 8219110 - DNA, 19 bp, Homo sapiens
tttgagaagttattatcta

SEQ ID NO: 8219111 - DNA, 18 bp, Homo sapiens
tttgagaatgcatgactg

SEQ ID NO: 8219112 - DNA, 22 bp, Homo sapiens
tttgagaatggtaagtggatcg

SEQ ID NO: 8219113 - DNA, 20 bp, Homo sapiens
tttgagaccagtctgcccaa

SEQ ID NO: 8219114 - DNA, 20 bp, Homo sapiens
tttgagaccagtctgcccaa

SEQ ID NO: 8219115 - DNA, 20 bp, Homo sapiens
tttgagaccagtctgcccaa

SEQ ID NO: 8219116 - DNA, 22 bp, Homo sapiens
tttgcagtgtcagcttctgtgt

SEQ ID NO: 8219117 - DNA, 22 bp, Homo sapiens
tttgcagtgttcatcagtattt

SEQ ID NO: 8219118 - DNA, 22 bp, Homo sapiens
tttgagatggagtcttgctctg

SEQ ID NO: 8219119 - DNA, 21 bp, Homo sapiens
tttgaaagtgggtgattcttt

SEQ ID NO: 8219120 - DNA, 21 bp, Homo sapiens
tttgaaagtgggtgattcttt

SEQ ID NO: 8219121 - DNA, 22 bp, Homo sapiens
tttgaaagtcctaggagagtcc

SEQ ID NO: 8219122 - DNA, 22 bp, Homo sapiens
tttctattgatctaataaacat

SEQ ID NO: 8219123 - DNA, 22 bp, Homo sapiens
tttctattggcgtcactgttgt

SEQ ID NO: 8219124 - DNA, 22 bp, Homo sapiens
tttctattggcgtcactgttgt

SEQ ID NO: 8219125 - DNA, 22 bp, Homo sapiens
tttctatctagggttagagtga

SEQ ID NO: 8219126 - DNA, 20 bp, Homo sapiens
tttctatggggccagcacat

SEQ ID NO: 8219127 - DNA, 22 bp, Homo sapiens
tttctattctggatctgtggca

SEQ ID NO: 8219128 - DNA, 22 bp, Homo sapiens
tttctatatgaggagctaaagt

SEQ ID NO: 8219129 - DNA, 22 bp, Homo sapiens
tttctatatgaggagctaaagt

SEQ ID NO: 8219130 - DNA, 22 bp, Homo sapiens
tttctattgatctaataaacat

SEQ ID NO: 8219131 - DNA, 22 bp, Homo sapiens
tttgaaattaagatattgtcca

SEQ ID NO: 8219132 - DNA, 22 bp, Homo sapiens
tttgaaatgtatcagtataggt

SEQ ID NO: 8219133 - DNA, 22 bp, Homo sapiens
tttgaaatctaatcaaggaaca

SEQ ID NO: 8219134 - DNA, 22 bp, Homo sapiens
tttgaaatctaatcaaggaaca

SEQ ID NO: 8219135 - DNA, 22 bp, Homo sapiens
tttgaaagttcttctgacacta

SEQ ID NO: 8219136 - DNA, 22 bp, Homo sapiens
tttgaaatatgaggcattatga

SEQ ID NO: 8219137 - DNA, 22 bp, Homo sapiens
tttgaaatatgaggcattatga

SEQ ID NO: 8219138 - DNA, 22 bp, Homo sapiens
tttgaaatatgaggcattatga

SEQ ID NO: 8219139 - DNA, 22 bp, Homo sapiens
tttgaaatatgtgatgagagag

SEQ ID NO: 8219140 - DNA, 22 bp, Homo sapiens
tttctagatgcttttgaaaatc

SEQ ID NO: 8219141 - DNA, 22 bp, Homo sapiens
tttctagatgatacggtatgtg

SEQ ID NO: 8219142 - DNA, 22 bp, Homo sapiens
tttctagatgagttttgaagat

SEQ ID NO: 8219143 - DNA, 22 bp, Homo sapiens
tttctagatgcggggcttgtgc

SEQ ID NO: 8219144 - DNA, 17 bp, Homo sapiens
tttctagattatcctct

SEQ ID NO: 8219145 - DNA, 22 bp, Homo sapiens
tttctagctgtaggaagctgag

SEQ ID NO: 8219146 - DNA, 22 bp, Homo sapiens
tttctagatcaaacttttatat

SEQ ID NO: 8219147 - DNA, 22 bp, Homo sapiens
tttctagagtgggcatgtctta

SEQ ID NO: 8219148 - DNA, 22 bp, Homo sapiens
tttctagagttcatcatggtaa

SEQ ID NO: 8219149 - DNA, 22 bp, Homo sapiens
tttctagagttcatcatggtaa

SEQ ID NO: 8219150 - DNA, 22 bp, Homo sapiens
tttctagactcaaagaggatat

SEQ ID NO: 8219151 - DNA, 22 bp, Homo sapiens
tttctagacatttctatgtaca

SEQ ID NO: 8219152 - DNA, 22 bp, Homo sapiens
tttctagtctcgatctcttaat

SEQ ID NO: 8219153 - DNA, 22 bp, Homo sapiens
tttctagtcagccatatctagt

SEQ ID NO: 8219154 - DNA, 22 bp, Homo sapiens
tttctatagctttcttgggagt

SEQ ID NO: 8219155 - DNA, 22 bp, Homo sapiens
tttctataactggactggattg

SEQ ID NO: 8219156 - DNA, 22 bp, Homo sapiens
tttctagtggttaagatttaca

SEQ ID NO: 8219157 - DNA, 22 bp, Homo sapiens
tttctagtggttaagatttaca

SEQ ID NO: 8219158 - DNA, 22 bp, Homo sapiens
tttgacagtgctgctaaaatgc

SEQ ID NO: 8219159 - DNA, 22 bp, Homo sapiens
tttgacatcaataccctagaat

SEQ ID NO: 8219160 - DNA, 22 bp, Homo sapiens
tttgacatctaagaattcttac

SEQ ID NO: 8219161 - DNA, 22 bp, Homo sapiens
tttgacagtgctattaagaaac

SEQ ID NO: 8219162 - DNA, 22 bp, Homo sapiens
tttgacagtgctattaagaaac

SEQ ID NO: 8219163 - DNA, 22 bp, Homo sapiens
tttgacagtactctgtaggatc

SEQ ID NO: 8219164 - DNA, 22 bp, Homo sapiens
tttgacagcttgttacaaagtt

SEQ ID NO: 8219165 - DNA, 22 bp, Homo sapiens
tttgacagcttgttacaaagtt

SEQ ID NO: 8219166 - DNA, 22 bp, Homo sapiens
tttgacaggactaacatatggc

SEQ ID NO: 8219167 - DNA, 22 bp, Homo sapiens
tttgacagtaataaagcacaag

SEQ ID NO: 8219168 - DNA, 22 bp, Homo sapiens
tttgacagggtgatgaggtggt

SEQ ID NO: 8219169 - DNA, 22 bp, Homo sapiens
tttgacattggcttattctgtt

SEQ ID NO: 8219170 - DNA, 22 bp, Homo sapiens
tttgagaagcatctggtccact

SEQ ID NO: 8219171 - DNA, 22 bp, Homo sapiens
tttgacattgccaatttgctca

SEQ ID NO: 8219172 - DNA, 22 bp, Homo sapiens
tttgagaagctgtcttgggctc

SEQ ID NO: 8219173 - DNA, 22 bp, Homo sapiens
tttgagaaggtgacaaattcta

SEQ ID NO: 8219174 - DNA, 19 bp, Homo sapiens
tttgagaagttattatcta

SEQ ID NO: 8219175 - DNA, 22 bp, Homo sapiens
tttgacattaaggaacatatat

SEQ ID NO: 8219176 - DNA, 22 bp, Homo sapiens
tttgacattatcctgttactgg

SEQ ID NO: 8219177 - DNA, 22 bp, Homo sapiens
tttgacattatcctgttactgg

SEQ ID NO: 8219178 - DNA, 22 bp, Homo sapiens
tttgacatgtgcttataacttt

SEQ ID NO: 8219179 - DNA, 22 bp, Homo sapiens
tttgacatgaagtagcttataa

SEQ ID NO: 8219180 - DNA, 22 bp, Homo sapiens
tttgacatgcaaagcactttag

SEQ ID NO: 8219181 - DNA, 22 bp, Homo sapiens
tttgacatgcaaagcactttag

SEQ ID NO: 8219182 - DNA, 22 bp, Homo sapiens
tttgaacagtagcttaggtgtg

SEQ ID NO: 8219183 - DNA, 22 bp, Homo sapiens
tttgaacagggaatgttccaca

SEQ ID NO: 8219184 - DNA, 22 bp, Homo sapiens
tttgaacagggaatgttccaca

SEQ ID NO: 8219185 - DNA, 22 bp, Homo sapiens
tttgaacaggagtatctatagt

SEQ ID NO: 8219186 - DNA, 22 bp, Homo sapiens
tttgaacaggagtatctatagt

SEQ ID NO: 8219187 - DNA, 22 bp, Homo sapiens
tttgaaattggctcattggttt

SEQ ID NO: 8219188 - DNA, 22 bp, Homo sapiens
tttgaacaagagcttcacatta

SEQ ID NO: 8219189 - DNA, 22 bp, Homo sapiens
tttgaacaagagcttcacatta

SEQ ID NO: 8219190 - DNA, 22 bp, Homo sapiens
tttgaacagacactttctacag

SEQ ID NO: 8219191 - DNA, 22 bp, Homo sapiens
tttgaacagacactttctacag

SEQ ID NO: 8219192 - DNA, 22 bp, Homo sapiens
tttgaacaggagtatctatagt

SEQ ID NO: 8219193 - DNA, 22 bp, Homo sapiens
tttgaacattcaacagacccag

SEQ ID NO: 8219194 - DNA, 22 bp, Homo sapiens
tttgaacatgctgcatgataat

SEQ ID NO: 8219195 - DNA, 22 bp, Homo sapiens
tttgaacatgctgcatgataat

SEQ ID NO: 8219196 - DNA, 22 bp, Homo sapiens
tttgaacatcactgtagggtga

SEQ ID NO: 8219197 - DNA, 23 bp, Homo sapiens
tttgaacatttctagattacata

SEQ ID NO: 8219198 - DNA, 22 bp, Homo sapiens
tttgacagcataatcctacacc

SEQ ID NO: 8219199 - DNA, 22 bp, Homo sapiens
tttgacagcagataaaataaaa

SEQ ID NO: 8219200 - DNA, 22 bp, Homo sapiens
tttgacagcagataaaataaaa

SEQ ID NO: 8219201 - DNA, 22 bp, Homo sapiens
tttgaagactactgggagtgaa

SEQ ID NO: 8219202 - DNA, 22 bp, Homo sapiens
tttgaagactactgggagtgaa

SEQ ID NO: 8219203 - DNA, 22 bp, Homo sapiens
tttgaagactactgggagtgaa

SEQ ID NO: 8219204 - DNA, 22 bp, Homo sapiens
tttgaagaagctgacctatttt

SEQ ID NO: 8219205 - DNA, 23 bp, Homo sapiens
tttgaagaagtgaatatcatata

SEQ ID NO: 8219206 - DNA, 22 bp, Homo sapiens
tttgaagacagatcaatataag

SEQ ID NO: 8219207 - DNA, 22 bp, Homo sapiens
tttgaacttctacctgtcatat

SEQ ID NO: 8219208 - DNA, 22 bp, Homo sapiens
tttgaagaagctgacctatttt

SEQ ID NO: 8219209 - DNA, 22 bp, Homo sapiens
tttgaagacatattgttacata

SEQ ID NO: 8219210 - DNA, 22 bp, Homo sapiens
tttgaagacatattgttacata

SEQ ID NO: 8219211 - DNA, 22 bp, Homo sapiens
ttttttggataataaacgatct

SEQ ID NO: 8219212 - DNA, 22 bp, Homo sapiens
ttttttggtgctcctaggaagg

SEQ ID NO: 8219213 - DNA, 22 bp, Homo sapiens
ttttttcctgagccttgtggtc

SEQ ID NO: 8219214 - DNA, 22 bp, Homo sapiens
ttttttcctgagccttgtggtc

SEQ ID NO: 8219215 - DNA, 22 bp, Homo sapiens
ttttttccttcatgacttaaga

SEQ ID NO: 8219216 - DNA, 22 bp, Homo sapiens
ttttttccttcatgacttaaga

SEQ ID NO: 8219217 - DNA, 22 bp, Homo sapiens
ttttttccagcttctagaggcc

SEQ ID NO: 8219218 - DNA, 22 bp, Homo sapiens
ttttttccagcttctagaggcc

SEQ ID NO: 8219219 - DNA, 22 bp, Homo sapiens
ttttttcctctgtgatggcaaa

SEQ ID NO: 8219220 - DNA, 22 bp, Homo sapiens
ttttttcctctgtgatggcaaa

SEQ ID NO: 8219221 - DNA, 22 bp, Homo sapiens
ttttttccaggaagccactgga

SEQ ID NO: 8219222 - DNA, 22 bp, Homo sapiens
ttttttccaggaagccactgga

SEQ ID NO: 8219223 - DNA, 22 bp, Homo sapiens
attccctgaaattgtgctttca

SEQ ID NO: 8219224 - DNA, 21 bp, Homo sapiens
attccacttttccttcaggga

SEQ ID NO: 8219225 - DNA, 22 bp, Homo sapiens
attccactttgctaatcttctg

SEQ ID NO: 8219226 - DNA, 22 bp, Homo sapiens
attccactttatgtctgtatga

SEQ ID NO: 8219227 - DNA, 22 bp, Homo sapiens
attcctaaagtaatacactaga

SEQ ID NO: 8219228 - DNA, 22 bp, Homo sapiens
gcagagcttctgtccttcagga

SEQ ID NO: 8219229 - DNA, 22 bp, Homo sapiens
gcagagcttctgtccttcagga

SEQ ID NO: 8219230 - DNA, 22 bp, Homo sapiens
gcagagcttctgtccttcagga

SEQ ID NO: 8219231 - DNA, 22 bp, Homo sapiens
attcctcatttgttgagaacca

SEQ ID NO: 8219232 - DNA, 22 bp, Homo sapiens
attcctaaggaaggctggcaag

SEQ ID NO: 8219233 - DNA, 22 bp, Homo sapiens
gcagcaggcttttcataccttg

SEQ ID NO: 8219234 - DNA, 22 bp, Homo sapiens
gcagcaggcttttcataccttg

SEQ ID NO: 8219235 - DNA, 22 bp, Homo sapiens
gcagcaggcatggccgccctgg

SEQ ID NO: 8219236 - DNA, 22 bp, Homo sapiens
gcagcaggcatggccgccctgg

SEQ ID NO: 8219237 - DNA, 22 bp, Homo sapiens
gcagcaggcatggccgccctgg

SEQ ID NO: 8219238 - DNA, 22 bp, Homo sapiens
gcagcaggcacttaccgttgct

SEQ ID NO: 8219239 - DNA, 22 bp, Homo sapiens
attccttctattctctgtgggt

SEQ ID NO: 8219240 - DNA, 22 bp, Homo sapiens
attccttctaaaacgctgccct

SEQ ID NO: 8219241 - DNA, 22 bp, Homo sapiens
attccttctaaaacgctgccct

SEQ ID NO: 8219242 - DNA, 22 bp, Homo sapiens
attccttctattctctgtgggt

SEQ ID NO: 8219243 - DNA, 22 bp, Homo sapiens
attcctggtggcagaaacatga

SEQ ID NO: 8219244 - DNA, 22 bp, Homo sapiens
attctactgcttggaatatctt

SEQ ID NO: 8219245 - DNA, 22 bp, Homo sapiens
attctacatttggagtgatgtc

SEQ ID NO: 8219246 - DNA, 22 bp, Homo sapiens
attctacatttggagtgatgtc

SEQ ID NO: 8219247 - DNA, 22 bp, Homo sapiens
attctactcattgatctatata

SEQ ID NO: 8219248 - DNA, 22 bp, Homo sapiens
attctacatttggagtgatgtc

SEQ ID NO: 8219249 - DNA, 22 bp, Homo sapiens
attctagaaggcaaagcaaggg

SEQ ID NO: 8219250 - DNA, 22 bp, Homo sapiens
attctacagatgaaagcggctg

SEQ ID NO: 8219251 - DNA, 22 bp, Homo sapiens
attctacacctctctcatttag

SEQ ID NO: 8219252 - DNA, 22 bp, Homo sapiens
attctacaggactggcaatccc

SEQ ID NO: 8219253 - DNA, 22 bp, Homo sapiens
attctacagggtacgttgggga

SEQ ID NO: 8219254 - DNA, 22 bp, Homo sapiens
attctacatgatagaagggaga

SEQ ID NO: 8219255 - DNA, 22 bp, Homo sapiens
attctacatgatagaagggaga

SEQ ID NO: 8219256 - DNA, 22 bp, Homo sapiens
attctacacctctctcatttag

SEQ ID NO: 8219257 - DNA, 22 bp, Homo sapiens
attctacacaacatgatgatgg

SEQ ID NO: 8219258 - DNA, 22 bp, Homo sapiens
attctacacctctctcatttag

SEQ ID NO: 8219259 - DNA, 22 bp, Homo sapiens
attctacacaacatgatgatgg

SEQ ID NO: 8219260 - DNA, 22 bp, Homo sapiens
attctacacaacatgatgatgg

SEQ ID NO: 8219261 - DNA, 22 bp, Homo sapiens
attctacacaacatgatgatgg

SEQ ID NO: 8219262 - DNA, 22 bp, Homo sapiens
gcagcagggtgccagctttgca

SEQ ID NO: 8219263 - DNA, 22 bp, Homo sapiens
gcagcagggagcaggggtgtca

SEQ ID NO: 8219264 - DNA, 22 bp, Homo sapiens
gcagcagggagcaggggtgtca

SEQ ID NO: 8219265 - DNA, 22 bp, Homo sapiens
gcagcagggagcaggggtgtca

SEQ ID NO: 8219266 - DNA, 22 bp, Homo sapiens
gcagcagggagcaggggtgtca

SEQ ID NO: 8219267 - DNA, 22 bp, Homo sapiens
gcagcagggagcaggggtgtca

SEQ ID NO: 8219268 - DNA, 22 bp, Homo sapiens
gcagcaggcttttcataccttg

SEQ ID NO: 8219269 - DNA, 22 bp, Homo sapiens
gcagcaggcttttcataccttg

SEQ ID NO: 8219270 - DNA, 22 bp, Homo sapiens
gcagcagggtgccagctttgca

SEQ ID NO: 8219271 - DNA, 22 bp, Homo sapiens
gcagcaggtccgcatcatcatc

SEQ ID NO: 8219272 - DNA, 22 bp, Homo sapiens
gcagcagggtgccagctttgca

SEQ ID NO: 8219273 - DNA, 22 bp, Homo sapiens
gcagcagggtgccagctttgca

SEQ ID NO: 8219274 - DNA, 22 bp, Homo sapiens
attctacacaaagcaagaagac

SEQ ID NO: 8219275 - DNA, 22 bp, Homo sapiens
attctacacaaagcaagaagac

SEQ ID NO: 8219276 - DNA, 22 bp, Homo sapiens
attctacaatcatgtagatcct

SEQ ID NO: 8219277 - DNA, 22 bp, Homo sapiens
attcagttagtagatttggtca

SEQ ID NO: 8219278 - DNA, 22 bp, Homo sapiens
attcagtgtagttattatcttt

SEQ ID NO: 8219279 - DNA, 22 bp, Homo sapiens
attcagtgtatcaatgaatgct

SEQ ID NO: 8219280 - DNA, 22 bp, Homo sapiens
attcagtgtctactccattgcc

SEQ ID NO: 8219281 - DNA, 19 bp, Homo sapiens
attcagtgtctctgacttc

SEQ ID NO: 8219282 - DNA, 22 bp, Homo sapiens
attcagtgtggacccatttaaa

SEQ ID NO: 8219283 - DNA, 22 bp, Homo sapiens
attcagtgtgaggttttcaagt

SEQ ID NO: 8219284 - DNA, 22 bp, Homo sapiens
attcagtgtcttgatctgggaa

SEQ ID NO: 8219285 - DNA, 22 bp, Homo sapiens
attcagtgtttgcagcaacttt

SEQ ID NO: 8219286 - DNA, 22 bp, Homo sapiens
gcagagctgtctaagtcacttc

SEQ ID NO: 8219287 - DNA, 22 bp, Homo sapiens
gcagagctgtctaagtcacttc

SEQ ID NO: 8219288 - DNA, 22 bp, Homo sapiens
gcagagctgtctaagtcacttc

SEQ ID NO: 8219289 - DNA, 22 bp, Homo sapiens
gcagagctggtacttgagcctg

SEQ ID NO: 8219290 - DNA, 22 bp, Homo sapiens
gcagagctgttaatggagctga

SEQ ID NO: 8219291 - DNA, 21 bp, Homo sapiens
gcagagctggaaccaggaccc

SEQ ID NO: 8219292 - DNA, 22 bp, Homo sapiens
gcagagctgggtctgtatccaa

SEQ ID NO: 8219293 - DNA, 22 bp, Homo sapiens
gcagagctgggtctgtatccaa

SEQ ID NO: 8219294 - DNA, 21 bp, Homo sapiens
gcagagctggaaccaggaccc

SEQ ID NO: 8219295 - DNA, 23 bp, Homo sapiens
gcagagctgccctattgccttgg

SEQ ID NO: 8219296 - DNA, 22 bp, Homo sapiens
attatttacagtgtgctcgaag

SEQ ID NO: 8219297 - DNA, 22 bp, Homo sapiens
attattgttttaatagtagaga

SEQ ID NO: 8219298 - DNA, 22 bp, Homo sapiens
attattgttttaatagtagaga

SEQ ID NO: 8219299 - DNA, 22 bp, Homo sapiens
attatttagaaatcgattgaaa

SEQ ID NO: 8219300 - DNA, 22 bp, Homo sapiens
attattgttttaatagtagaga

SEQ ID NO: 8219301 - DNA, 22 bp, Homo sapiens
attattgttttaatagtagaga

SEQ ID NO: 8219302 - DNA, 22 bp, Homo sapiens
attattgttagtgacagggtga

SEQ ID NO: 8219303 - DNA, 22 bp, Homo sapiens
attattgttgcggctgttaccg

SEQ ID NO: 8219304 - DNA, 22 bp, Homo sapiens
attattgtactttcaataaggt

SEQ ID NO: 8219305 - DNA, 22 bp, Homo sapiens
attattgtactttcaataaggt

SEQ ID NO: 8219306 - DNA, 22 bp, Homo sapiens
attattgtcatcttaatcttaa

SEQ ID NO: 8219307 - DNA, 22 bp, Homo sapiens
attattgctgacatggtgttga

SEQ ID NO: 8219308 - DNA, 22 bp, Homo sapiens
attattggacacttcttctgca

SEQ ID NO: 8219309 - DNA, 22 bp, Homo sapiens
attattgtactttcaataaggt

SEQ ID NO: 8219310 - DNA, 22 bp, Homo sapiens
attattggtacaccgtagtcat

SEQ ID NO: 8219311 - DNA, 22 bp, Homo sapiens
attattggacacttcttctgca

SEQ ID NO: 8219312 - DNA, 21 bp, Homo sapiens
attcagagtaattcatcttta

SEQ ID NO: 8219313 - DNA, 22 bp, Homo sapiens
attcagtattctgctgcataat

SEQ ID NO: 8219314 - DNA, 22 bp, Homo sapiens
attcagtattcttgaaaggttc

SEQ ID NO: 8219315 - DNA, 22 bp, Homo sapiens
attcagtgacctaattacttac

SEQ ID NO: 8219316 - DNA, 22 bp, Homo sapiens
attcagtgagtgtttaccggaa

SEQ ID NO: 8219317 - DNA, 22 bp, Homo sapiens
attcagtgattcatttgtacaa

SEQ ID NO: 8219318 - DNA, 22 bp, Homo sapiens
attcagtgccaaggagaacttg

SEQ ID NO: 8219319 - DNA, 22 bp, Homo sapiens
attcagtgctgtaatacgctaa

SEQ ID NO: 8219320 - DNA, 22 bp, Homo sapiens
attcagtggatatcttcacttt

SEQ ID NO: 8219321 - DNA, 22 bp, Homo sapiens
attcagtggatatcttcacttt

SEQ ID NO: 8219322 - DNA, 22 bp, Homo sapiens
attcagtgggtgctcagcacaa

SEQ ID NO: 8219323 - DNA, 22 bp, Homo sapiens
attatttagaaatcgattgaaa

SEQ ID NO: 8219324 - DNA, 22 bp, Homo sapiens
attatttatcctcttggtctat

SEQ ID NO: 8219325 - DNA, 22 bp, Homo sapiens
attatttatcctcttggtctat

SEQ ID NO: 8219326 - DNA, 22 bp, Homo sapiens
attatttatcctcttggtctat

SEQ ID NO: 8219327 - DNA, 21 bp, Homo sapiens
attcagagtaattcatcttta

SEQ ID NO: 8219328 - DNA, 22 bp, Homo sapiens
attatttcagtcagacactggc

SEQ ID NO: 8219329 - DNA, 22 bp, Homo sapiens
attatttcagtcagacactggc

SEQ ID NO: 8219330 - DNA, 22 bp, Homo sapiens
attatttcagtcagacactggc

SEQ ID NO: 8219331 - DNA, 22 bp, Homo sapiens
attctagacatctgcagttgtt

SEQ ID NO: 8219332 - DNA, 22 bp, Homo sapiens
attctagtgtttccattacaag

SEQ ID NO: 8219333 - DNA, 22 bp, Homo sapiens
attctcaaaacataacttcact

SEQ ID NO: 8219334 - DNA, 22 bp, Homo sapiens
attctattttttaagaagtagt

SEQ ID NO: 8219335 - DNA, 22 bp, Homo sapiens
attctattttttaagaagtagt

SEQ ID NO: 8219336 - DNA, 22 bp, Homo sapiens
attctattttttaagaagtagt

SEQ ID NO: 8219337 - DNA, 22 bp, Homo sapiens
attctagtgtttccattacaag

SEQ ID NO: 8219338 - DNA, 22 bp, Homo sapiens
attctatagacagaaggtcaat

SEQ ID NO: 8219339 - DNA, 22 bp, Homo sapiens
attctgtgatagttgatcctta

SEQ ID NO: 8219340 - DNA, 22 bp, Homo sapiens
attctgtctttttaaaataata

SEQ ID NO: 8219341 - DNA, 22 bp, Homo sapiens
attctgtcatttcaagaaaaac

SEQ ID NO: 8219342 - DNA, 22 bp, Homo sapiens
attctgtctttttaaaataata

SEQ ID NO: 8219343 - DNA, 22 bp, Homo sapiens
attctggaagcaagcttttaaa

SEQ ID NO: 8219344 - DNA, 22 bp, Homo sapiens
attctggaagcaagcttttaaa

SEQ ID NO: 8219345 - DNA, 22 bp, Homo sapiens
attctggaattctaagattctg

SEQ ID NO: 8219346 - DNA, 22 bp, Homo sapiens
attctggaattctaagattctg

SEQ ID NO: 8219347 - DNA, 22 bp, Homo sapiens
attctgtcattacaaaaggcag

SEQ ID NO: 8219348 - DNA, 21 bp, Homo sapiens
attctcaggcccatcctcagg

SEQ ID NO: 8219349 - DNA, 22 bp, Homo sapiens
attctcagctttcaaatagaca

SEQ ID NO: 8219350 - DNA, 22 bp, Homo sapiens
attctcagctttcaaatagaca

SEQ ID NO: 8219351 - DNA, 22 bp, Homo sapiens
attctcaagctggctgggagca

SEQ ID NO: 8219352 - DNA, 22 bp, Homo sapiens
attctcaactactgcgagagct

SEQ ID NO: 8219353 - DNA, 22 bp, Homo sapiens
attctcaaagccagagtcaacg

SEQ ID NO: 8219354 - DNA, 22 bp, Homo sapiens
attcttcacaaatatatagaag

SEQ ID NO: 8219355 - DNA, 22 bp, Homo sapiens
attcttcacaaatatatagaag

SEQ ID NO: 8219356 - DNA, 22 bp, Homo sapiens
attcttcacataagtgctgtac

SEQ ID NO: 8219357 - DNA, 22 bp, Homo sapiens
attcttcacactaaccctgtga

SEQ ID NO: 8219358 - DNA, 22 bp, Homo sapiens
attcttcaaagagtgtcaaagt

SEQ ID NO: 8219359 - DNA, 22 bp, Homo sapiens
attcttcaaagagtgtcaaagt

SEQ ID NO: 8219360 - DNA, 22 bp, Homo sapiens
attcttcactgtttcagaatga

SEQ ID NO: 8219361 - DNA, 22 bp, Homo sapiens
attcttcactgtttcagaatga

SEQ ID NO: 8219362 - DNA, 22 bp, Homo sapiens
attcttcactgtttcagaatga

SEQ ID NO: 8219363 - DNA, 22 bp, Homo sapiens
attcttcactgtttcagaatga

SEQ ID NO: 8219364 - DNA, 22 bp, Homo sapiens
attcttcaccatggataatttg

SEQ ID NO: 8219365 - DNA, 22 bp, Homo sapiens
attcttcacatggataggatct

SEQ ID NO: 8219366 - DNA, 22 bp, Homo sapiens
attcttaattccaaagactgag

SEQ ID NO: 8219367 - DNA, 22 bp, Homo sapiens
attctgttacttggtgatcttc

SEQ ID NO: 8219368 - DNA, 22 bp, Homo sapiens
attcttaattgccatgctgtat

SEQ ID NO: 8219369 - DNA, 22 bp, Homo sapiens
attcttaattccaaagactgag

SEQ ID NO: 8219370 - DNA, 22 bp, Homo sapiens
attcttaattccaaagactgag

SEQ ID NO: 8219371 - DNA, 22 bp, Homo sapiens
attcttattatagtaaaacagt

SEQ ID NO: 8219372 - DNA, 22 bp, Homo sapiens
attcttattatagtaaaacagt

SEQ ID NO: 8219373 - DNA, 22 bp, Homo sapiens
attcttattatagtaaaacagt

SEQ ID NO: 8219374 - DNA, 22 bp, Homo sapiens
attcttattaaatagccagaag

SEQ ID NO: 8219375 - DNA, 22 bp, Homo sapiens
attcttaattgccatgctgtat

SEQ ID NO: 8219376 - DNA, 22 bp, Homo sapiens
attgacacacttccaggaccag

SEQ ID NO: 8219377 - DNA, 20 bp, Homo sapiens
attgacagaaagtgttcacc

SEQ ID NO: 8219378 - DNA, 22 bp, Homo sapiens
attgacagcaggggctgtcact

SEQ ID NO: 8219379 - DNA, 22 bp, Homo sapiens
attgacacaatgggatgtaagg

SEQ ID NO: 8219380 - DNA, 22 bp, Homo sapiens
attgacaattctatgcagagca

SEQ ID NO: 8219381 - DNA, 22 bp, Homo sapiens
attgacaatgtatttgtatctg

SEQ ID NO: 8219382 - DNA, 22 bp, Homo sapiens
attgacaatgtatttgtatctg

SEQ ID NO: 8219383 - DNA, 22 bp, Homo sapiens
attgacaaatggatgttgacat

SEQ ID NO: 8219384 - DNA, 22 bp, Homo sapiens
attgacaaccctggtatgagca

SEQ ID NO: 8219385 - DNA, 22 bp, Homo sapiens
attgacaaatggatgttgacat

SEQ ID NO: 8219386 - DNA, 22 bp, Homo sapiens
attgacaagacaatggctctta

SEQ ID NO: 8219387 - DNA, 22 bp, Homo sapiens
attgacaagaaagatattttta

SEQ ID NO: 8219388 - DNA, 22 bp, Homo sapiens
attgacaagaaagatattttta

SEQ ID NO: 8219389 - DNA, 22 bp, Homo sapiens
attgacaagcagtatgtcttag

SEQ ID NO: 8219390 - DNA, 22 bp, Homo sapiens
attgacaatctactatgttctg

SEQ ID NO: 8219391 - DNA, 22 bp, Homo sapiens
attgacaagtgagctgggctgc

SEQ ID NO: 8219392 - DNA, 22 bp, Homo sapiens
attgacagtggtgttctgggga

SEQ ID NO: 8219393 - DNA, 22 bp, Homo sapiens
attgcacttcagcctgggtgac

SEQ ID NO: 8219394 - DNA, 22 bp, Homo sapiens
attgctggatgagctcttggat

SEQ ID NO: 8219395 - DNA, 22 bp, Homo sapiens
attgctggcatcagtgacaata

SEQ ID NO: 8219396 - DNA, 22 bp, Homo sapiens
attgctggcagctggatctgca

SEQ ID NO: 8219397 - DNA, 22 bp, Homo sapiens
attgctggcagctggatctgca

SEQ ID NO: 8219398 - DNA, 22 bp, Homo sapiens
attgctgtggaaatataagatg

SEQ ID NO: 8219399 - DNA, 22 bp, Homo sapiens
attgctgtgatgatgttctgag

SEQ ID NO: 8219400 - DNA, 22 bp, Homo sapiens
attgctgtacacttctagatct

SEQ ID NO: 8219401 - DNA, 22 bp, Homo sapiens
attgctgtaaattatcttatta

SEQ ID NO: 8219402 - DNA, 22 bp, Homo sapiens
attgaacagaaaccatcagagt

SEQ ID NO: 8219403 - DNA, 23 bp, Homo sapiens
attgaacagagagaaaaacatcc

SEQ ID NO: 8219404 - DNA, 20 bp, Homo sapiens
attgaaatttttctgagatt

SEQ ID NO: 8219405 - DNA, 22 bp, Homo sapiens
attgaacagaaaaactcagaga

SEQ ID NO: 8219406 - DNA, 23 bp, Homo sapiens
attgaacagagagaaaaacatcc

SEQ ID NO: 8219407 - DNA, 22 bp, Homo sapiens
attgaacagcccaggtttacct

SEQ ID NO: 8219408 - DNA, 22 bp, Homo sapiens
attgaacatacatatccacacc

SEQ ID NO: 8219409 - DNA, 22 bp, Homo sapiens
attgaactaaataagcagtcat

SEQ ID NO: 8219410 - DNA, 22 bp, Homo sapiens
attgaacattgttctaggaggc

SEQ ID NO: 8219411 - DNA, 22 bp, Homo sapiens
attgaactgaatcctggattgc

SEQ ID NO: 8219412 - DNA, 22 bp, Homo sapiens
attgaactctgcaggagctgcc

SEQ ID NO: 8219413 - DNA, 22 bp, Homo sapiens
attgaaattgatgaaattcttg

SEQ ID NO: 8219414 - DNA, 22 bp, Homo sapiens
attgaaaaatgactattgctta

SEQ ID NO: 8219415 - DNA, 19 bp, Homo sapiens
attcttcagcagtgagacc

SEQ ID NO: 8219416 - DNA, 22 bp, Homo sapiens
attgaaaaatgactattgctta

SEQ ID NO: 8219417 - DNA, 22 bp, Homo sapiens
attcttcagcaggggacactat

SEQ ID NO: 8219418 - DNA, 22 bp, Homo sapiens
attcttcagaatatctggcact

SEQ ID NO: 8219419 - DNA, 22 bp, Homo sapiens
attcttcagcaggggacactat

SEQ ID NO: 8219420 - DNA, 22 bp, Homo sapiens
attcttcagcaggggacactat

SEQ ID NO: 8219421 - DNA, 22 bp, Homo sapiens
attcttcagcaggggacactat

SEQ ID NO: 8219422 - DNA, 22 bp, Homo sapiens
attgaatagatgcattatacta

SEQ ID NO: 8219423 - DNA, 22 bp, Homo sapiens
attgaatagctgcttgttgtat

SEQ ID NO: 8219424 - DNA, 22 bp, Homo sapiens
attgaatagatgcattatacta

SEQ ID NO: 8219425 - DNA, 22 bp, Homo sapiens
attgaatagatgcattatacta

SEQ ID NO: 8219426 - DNA, 22 bp, Homo sapiens
attgaatgtcctttagtaaaaa

SEQ ID NO: 8219427 - DNA, 22 bp, Homo sapiens
attgacaaaaacaggtggttga

SEQ ID NO: 8219428 - DNA, 22 bp, Homo sapiens
attgaatgtctactatgtgcaa

SEQ ID NO: 8219429 - DNA, 22 bp, Homo sapiens
attgacaaaaacaggtggttga

SEQ ID NO: 8219430 - DNA, 22 bp, Homo sapiens
attgaagattctgacatcagaa

SEQ ID NO: 8219431 - DNA, 22 bp, Homo sapiens
attgaagattaaatgcttcctt

SEQ ID NO: 8219432 - DNA, 22 bp, Homo sapiens
attgaactgttggagaggtttt

SEQ ID NO: 8219433 - DNA, 22 bp, Homo sapiens
attgaacttaacagtaagtggc

SEQ ID NO: 8219434 - DNA, 22 bp, Homo sapiens
atgtgtttgtacctttaaatat

SEQ ID NO: 8219435 - DNA, 22 bp, Homo sapiens
atgtgtttgtacctttaaatat

SEQ ID NO: 8219436 - DNA, 22 bp, Homo sapiens
atgtgtttggttatatggtatt

SEQ ID NO: 8219437 - DNA, 22 bp, Homo sapiens
atgtgtttataattactcaatc

SEQ ID NO: 8219438 - DNA, 22 bp, Homo sapiens
atgtgtttataattactcaatc

SEQ ID NO: 8219439 - DNA, 22 bp, Homo sapiens
atgtgttttggtaatttctgct

SEQ ID NO: 8219440 - DNA, 22 bp, Homo sapiens
atgttaaaaaccagtacagttg

SEQ ID NO: 8219441 - DNA, 22 bp, Homo sapiens
atgttaaaaaccagtacagttg

SEQ ID NO: 8219442 - DNA, 22 bp, Homo sapiens
atgttaaaaaccagtacagttg

SEQ ID NO: 8219443 - DNA, 22 bp, Homo sapiens
atgtgtgtgtgcgcgcgcagga

SEQ ID NO: 8219444 - DNA, 22 bp, Homo sapiens
atgtgtgtgtgcgcgcgcagga

SEQ ID NO: 8219445 - DNA, 22 bp, Homo sapiens
atgtgtgtgtatatacacacat

SEQ ID NO: 8219446 - DNA, 22 bp, Homo sapiens
atgtgtgtgtatatacacacat

SEQ ID NO: 8219447 - DNA, 22 bp, Homo sapiens
atgtgtgtgtttaatcctcaaa

SEQ ID NO: 8219448 - DNA, 22 bp, Homo sapiens
atgtgtgtgtttaatcctcaaa

SEQ ID NO: 8219449 - DNA, 22 bp, Homo sapiens
atgtgttaatgtcaaccagaaa

SEQ ID NO: 8219450 - DNA, 22 bp, Homo sapiens
atgtgttagtttgtgattatac

SEQ ID NO: 8219451 - DNA, 22 bp, Homo sapiens
atgttttgctggatgttggcta

SEQ ID NO: 8219452 - DNA, 22 bp, Homo sapiens
atgttttctagagtttaaaatc

SEQ ID NO: 8219453 - DNA, 22 bp, Homo sapiens
atgttttctccatgttatgctt

SEQ ID NO: 8219454 - DNA, 22 bp, Homo sapiens
atgttttctagagtttaaaatc

SEQ ID NO: 8219455 - DNA, 22 bp, Homo sapiens
atgttttctagagtttaaaatc

SEQ ID NO: 8219456 - DNA, 22 bp, Homo sapiens
atgtttctgaagtttacagata

SEQ ID NO: 8219457 - DNA, 22 bp, Homo sapiens
atgttttaccctttgcacaaac

SEQ ID NO: 8219458 - DNA, 22 bp, Homo sapiens
atgttttattaccaacttgtac

SEQ ID NO: 8219459 - DNA, 22 bp, Homo sapiens
gatgagtgaggacagggtggca

SEQ ID NO: 8219460 - DNA, 22 bp, Homo sapiens
gatgatatatatggaaagccta

SEQ ID NO: 8219461 - DNA, 22 bp, Homo sapiens
gatgaggggtcattggctggga

SEQ ID NO: 8219462 - DNA, 22 bp, Homo sapiens
gatgagggcctggtggctgtgc

SEQ ID NO: 8219463 - DNA, 22 bp, Homo sapiens
gatgagggcctggtggctgtgc

SEQ ID NO: 8219464 - DNA, 22 bp, Homo sapiens
gatgagggcctggtggctgtgc

SEQ ID NO: 8219465 - DNA, 22 bp, Homo sapiens
gatgaggggtcattggctggga

SEQ ID NO: 8219466 - DNA, 22 bp, Homo sapiens
gatgaggggtcattggctggga

SEQ ID NO: 8219467 - DNA, 22 bp, Homo sapiens
gatgaggtgtgtggccactaga

SEQ ID NO: 8219468 - DNA, 22 bp, Homo sapiens
gatgaggctgtgtctgcacaag

SEQ ID NO: 8219469 - DNA, 22 bp, Homo sapiens
gatgaggctcatgcaccctgcg

SEQ ID NO: 8219470 - DNA, 22 bp, Homo sapiens
attaaattaagtggctaattta

SEQ ID NO: 8219471 - DNA, 22 bp, Homo sapiens
attaaattaagtggctaattta

SEQ ID NO: 8219472 - DNA, 22 bp, Homo sapiens
attaaattagcaaactgtgaaa

SEQ ID NO: 8219473 - DNA, 22 bp, Homo sapiens
attaaattagcaaactgtgaaa

SEQ ID NO: 8219474 - DNA, 22 bp, Homo sapiens
attaaatgttggcatattttgt

SEQ ID NO: 8219475 - DNA, 22 bp, Homo sapiens
attaaatgttggacgtatacat

SEQ ID NO: 8219476 - DNA, 22 bp, Homo sapiens
attaaatgttggacgtatacat

SEQ ID NO: 8219477 - DNA, 22 bp, Homo sapiens
attaaatgttccttaaattata

SEQ ID NO: 8219478 - DNA, 22 bp, Homo sapiens
attaaaattccaaggtatgcca

SEQ ID NO: 8219479 - DNA, 22 bp, Homo sapiens
attaaatactgcaggctaagca

SEQ ID NO: 8219480 - DNA, 22 bp, Homo sapiens
attaaatactgcaggctaagca

SEQ ID NO: 8219481 - DNA, 22 bp, Homo sapiens
attaaaattccaaggtatgcca

SEQ ID NO: 8219482 - DNA, 22 bp, Homo sapiens
attaaaattccaaggtatgcca

SEQ ID NO: 8219483 - DNA, 22 bp, Homo sapiens
attaaaattccaaggtatgcca

SEQ ID NO: 8219484 - DNA, 22 bp, Homo sapiens
attaaatggtggtcattcattt

SEQ ID NO: 8219485 - DNA, 22 bp, Homo sapiens
attaaatggtggtcattcattt

SEQ ID NO: 8219486 - DNA, 22 bp, Homo sapiens
attaaatgttccttaaattata

SEQ ID NO: 8219487 - DNA, 22 bp, Homo sapiens
attaaatgttccttaaattata

SEQ ID NO: 8219488 - DNA, 22 bp, Homo sapiens
attaaatactgcaggctaagca

SEQ ID NO: 8219489 - DNA, 22 bp, Homo sapiens
attaaatactgcaggctaagca

SEQ ID NO: 8219490 - DNA, 22 bp, Homo sapiens
attaaatggtggtcattcattt

SEQ ID NO: 8219491 - DNA, 22 bp, Homo sapiens
attaaatgatggcatgtcttat

SEQ ID NO: 8219492 - DNA, 22 bp, Homo sapiens
attaaatgatggcatgtcttat

SEQ ID NO: 8219493 - DNA, 22 bp, Homo sapiens
attaaatgatggcatgtcttat

SEQ ID NO: 8219494 - DNA, 22 bp, Homo sapiens
atgtttttggaaatgggaacat

SEQ ID NO: 8219495 - DNA, 22 bp, Homo sapiens
atgtttttgagatacaaacaga

SEQ ID NO: 8219496 - DNA, 22 bp, Homo sapiens
atgtttttggaaatgggaacat

SEQ ID NO: 8219497 - DNA, 22 bp, Homo sapiens
atgtttttaaatagacttacag

SEQ ID NO: 8219498 - DNA, 22 bp, Homo sapiens
atgtttttaaatagacttacag

SEQ ID NO: 8219499 - DNA, 22 bp, Homo sapiens
atgtttttgagatacaaacaga

SEQ ID NO: 8219500 - DNA, 22 bp, Homo sapiens
atgtttttgagatacaaacaga

SEQ ID NO: 8219501 - DNA, 22 bp, Homo sapiens
atgtttttgagatacaaacaga

SEQ ID NO: 8219502 - DNA, 22 bp, Homo sapiens
attacaactggaatggtgctgg

SEQ ID NO: 8219503 - DNA, 22 bp, Homo sapiens
attacaagatgcatccatattt

SEQ ID NO: 8219504 - DNA, 22 bp, Homo sapiens
attacaagatgcatccatattt

SEQ ID NO: 8219505 - DNA, 22 bp, Homo sapiens
attacaagatgcatccatattt

SEQ ID NO: 8219506 - DNA, 22 bp, Homo sapiens
attacaacaagaaaagggtaag

SEQ ID NO: 8219507 - DNA, 22 bp, Homo sapiens
attacaactacataatctcaga

SEQ ID NO: 8219508 - DNA, 22 bp, Homo sapiens
attacaactacataatctcaga

SEQ ID NO: 8219509 - DNA, 22 bp, Homo sapiens
attacaagtttcagtgttttgc

SEQ ID NO: 8219510 - DNA, 22 bp, Homo sapiens
attacaagtagactaactttca

SEQ ID NO: 8219511 - DNA, 22 bp, Homo sapiens
attacaagggtctgactggagg

SEQ ID NO: 8219512 - DNA, 22 bp, Homo sapiens
attacaagtagactaactttca

SEQ ID NO: 8219513 - DNA, 22 bp, Homo sapiens
attacaataaggtttatttgta

SEQ ID NO: 8219514 - DNA, 22 bp, Homo sapiens
attacaagtagactaactttca

SEQ ID NO: 8219515 - DNA, 22 bp, Homo sapiens
attaattttacctttgtaaaca

SEQ ID NO: 8219516 - DNA, 22 bp, Homo sapiens
attaatttttctgacagccaca

SEQ ID NO: 8219517 - DNA, 22 bp, Homo sapiens
attaattttacctttgtaaaca

SEQ ID NO: 8219518 - DNA, 22 bp, Homo sapiens
attacaaaagaagggagaaggt

SEQ ID NO: 8219519 - DNA, 22 bp, Homo sapiens
attacaaaagaagggagaaggt

SEQ ID NO: 8219520 - DNA, 22 bp, Homo sapiens
attacaaaagaagggagaaggt

SEQ ID NO: 8219521 - DNA, 22 bp, Homo sapiens
attacaaaagaagggagaaggt

SEQ ID NO: 8219522 - DNA, 22 bp, Homo sapiens
attacaataaggtttatttgta

SEQ ID NO: 8219523 - DNA, 22 bp, Homo sapiens
attacaataaggtttatttgta

SEQ ID NO: 8219524 - DNA, 22 bp, Homo sapiens
attacaataatacatgctcatt

SEQ ID NO: 8219525 - DNA, 22 bp, Homo sapiens
attacaataatacatgctcatt

SEQ ID NO: 8219526 - DNA, 22 bp, Homo sapiens
attacaataatacatgctcatt

SEQ ID NO: 8219527 - DNA, 22 bp, Homo sapiens
attacaataatacatgctcatt

SEQ ID NO: 8219528 - DNA, 22 bp, Homo sapiens
attacaataatacatgctcatt

SEQ ID NO: 8219529 - DNA, 22 bp, Homo sapiens
gcaaggctgacctctctagact

SEQ ID NO: 8219530 - DNA, 22 bp, Homo sapiens
gcaaggctgagcacatttgcat

SEQ ID NO: 8219531 - DNA, 22 bp, Homo sapiens
gcaaggctgggagatgaggcct

SEQ ID NO: 8219532 - DNA, 22 bp, Homo sapiens
attaattttacctttgtaaaca

SEQ ID NO: 8219533 - DNA, 22 bp, Homo sapiens
attaattttacctttgtaaaca

SEQ ID NO: 8219534 - DNA, 22 bp, Homo sapiens
attaatttccaggcactgtgct

SEQ ID NO: 8219535 - DNA, 22 bp, Homo sapiens
attaatttccaggcactgtgct

SEQ ID NO: 8219536 - DNA, 22 bp, Homo sapiens
attaattttacctttgtaaaca

SEQ ID NO: 8219537 - DNA, 22 bp, Homo sapiens
attaattgggaacttgttgaaa

SEQ ID NO: 8219538 - DNA, 22 bp, Homo sapiens
attaattgggaacttgttgaaa

SEQ ID NO: 8219539 - DNA, 22 bp, Homo sapiens
attaatttccaggcactgtgct

SEQ ID NO: 8219540 - DNA, 22 bp, Homo sapiens
attaatgtgtagccaacttaat

SEQ ID NO: 8219541 - DNA, 22 bp, Homo sapiens
attaatgaaactttggttaagc

SEQ ID NO: 8219542 - DNA, 18 bp, Homo sapiens
attaatcataaaatgctg

SEQ ID NO: 8219543 - DNA, 18 bp, Homo sapiens
attaatcataaaatgctg

SEQ ID NO: 8219544 - DNA, 22 bp, Homo sapiens
attaatattggttcattagctg

SEQ ID NO: 8219545 - DNA, 22 bp, Homo sapiens
attaatgtctaccagttgtgtg

SEQ ID NO: 8219546 - DNA, 22 bp, Homo sapiens
gatgatcatctgtaaagttaga

SEQ ID NO: 8219547 - DNA, 22 bp, Homo sapiens
gatgatcatctgtaaagttaga

SEQ ID NO: 8219548 - DNA, 22 bp, Homo sapiens
gatgatgagataaggataactt

SEQ ID NO: 8219549 - DNA, 22 bp, Homo sapiens
attaagatgtgggaaaatttaa

SEQ ID NO: 8219550 - DNA, 22 bp, Homo sapiens
attaatatacactgttagcatg

SEQ ID NO: 8219551 - DNA, 22 bp, Homo sapiens
attaagcacttggggaaaggat

SEQ ID NO: 8219552 - DNA, 22 bp, Homo sapiens
attaagctccaagttgctctga

SEQ ID NO: 8219553 - DNA, 22 bp, Homo sapiens
attaatatcctgctggctaaat

SEQ ID NO: 8219554 - DNA, 22 bp, Homo sapiens
attaatatcctgctggctaaat

SEQ ID NO: 8219555 - DNA, 22 bp, Homo sapiens
attaatatacactgttagcatg

SEQ ID NO: 8219556 - DNA, 22 bp, Homo sapiens
gcaagttatttccatttaaagc

SEQ ID NO: 8219557 - DNA, 21 bp, Homo sapiens
gcaagtgtttctgacagtggc

SEQ ID NO: 8219558 - DNA, 22 bp, Homo sapiens
gcaataaaatgtaatgattggg

SEQ ID NO: 8219559 - DNA, 22 bp, Homo sapiens
attagaatgaagtataggattt

SEQ ID NO: 8219560 - DNA, 22 bp, Homo sapiens
attagaatgaagtataggattt

SEQ ID NO: 8219561 - DNA, 22 bp, Homo sapiens
attagaattatgcttgctaatg

SEQ ID NO: 8219562 - DNA, 22 bp, Homo sapiens
attagaattatgcttgctaatg

SEQ ID NO: 8219563 - DNA, 22 bp, Homo sapiens
attagaattatgcttgctaatg

SEQ ID NO: 8219564 - DNA, 22 bp, Homo sapiens
attagaatgacagaaatgaggc

SEQ ID NO: 8219565 - DNA, 22 bp, Homo sapiens
attagaatgcagggttcattgt

SEQ ID NO: 8219566 - DNA, 22 bp, Homo sapiens
attagaatgcagggttcattgt

SEQ ID NO: 8219567 - DNA, 22 bp, Homo sapiens
attagaatgcagggttcattgt

SEQ ID NO: 8219568 - DNA, 22 bp, Homo sapiens
attagaattatgcttgctaatg

SEQ ID NO: 8219569 - DNA, 22 bp, Homo sapiens
gcaagggtgtgaaccaatgaga

SEQ ID NO: 8219570 - DNA, 17 bp, Homo sapiens
gcaagggatgggagatt

SEQ ID NO: 8219571 - DNA, 22 bp, Homo sapiens
gcaaggctgttgctgctgcaag

SEQ ID NO: 8219572 - DNA, 22 bp, Homo sapiens
gcaagtgagaggcatcattaga

SEQ ID NO: 8219573 - DNA, 20 bp, Homo sapiens
gcaagtgaaaactatgggtg

SEQ ID NO: 8219574 - DNA, 22 bp, Homo sapiens
gcaagtgaatgaggttgagatt

SEQ ID NO: 8219575 - DNA, 21 bp, Homo sapiens
gcaagtgtttctgacagtggc

SEQ ID NO: 8219576 - DNA, 22 bp, Homo sapiens
gcaagtgattgtcacgtccctt

SEQ ID NO: 8219577 - DNA, 23 bp, Homo sapiens
gcaagtgaggcgtcagcagtcaa

SEQ ID NO: 8219578 - DNA, 22 bp, Homo sapiens
gcaagtgatgatggcaacttca

SEQ ID NO: 8219579 - DNA, 23 bp, Homo sapiens
gcaagtgaggcgtcagcagtcaa

SEQ ID NO: 8219580 - DNA, 22 bp, Homo sapiens
gcaaggtgttttaacaggaaaa

SEQ ID NO: 8219581 - DNA, 22 bp, Homo sapiens
gcaaggtgttttataggcagga

SEQ ID NO: 8219582 - DNA, 22 bp, Homo sapiens
gcaaggtgttttaacaggaaaa

SEQ ID NO: 8219583 - DNA, 19 bp, Homo sapiens
gcaaggttcactcccagag

SEQ ID NO: 8219584 - DNA, 22 bp, Homo sapiens
attattcttatgtcatcatggc

SEQ ID NO: 8219585 - DNA, 22 bp, Homo sapiens
attattcttaatgcagggatta

SEQ ID NO: 8219586 - DNA, 22 bp, Homo sapiens
attattcttgaggtgtttattg

SEQ ID NO: 8219587 - DNA, 20 bp, Homo sapiens
attattcatacatgtgtgac

SEQ ID NO: 8219588 - DNA, 22 bp, Homo sapiens
attattcagtcttgtaaggagt

SEQ ID NO: 8219589 - DNA, 20 bp, Homo sapiens
attattcatacatgtgtgac

SEQ ID NO: 8219590 - DNA, 22 bp, Homo sapiens
attattcattggtaggcaagct

SEQ ID NO: 8219591 - DNA, 22 bp, Homo sapiens
attattcatggtcttccacaat

SEQ ID NO: 8219592 - DNA, 22 bp, Homo sapiens
attagagattatgaattcctag

SEQ ID NO: 8219593 - DNA, 22 bp, Homo sapiens
attagagagagcatattactgg

SEQ ID NO: 8219594 - DNA, 22 bp, Homo sapiens
attagagaatgtgctgacattg

SEQ ID NO: 8219595 - DNA, 22 bp, Homo sapiens
attattaaaatgtgtttctctt

SEQ ID NO: 8219596 - DNA, 22 bp, Homo sapiens
attattaaaatgtgtttctctt

SEQ ID NO: 8219597 - DNA, 22 bp, Homo sapiens
attattaaagctacatcaagga

SEQ ID NO: 8219598 - DNA, 22 bp, Homo sapiens
attattaaagctacatcaagga

SEQ ID NO: 8219599 - DNA, 22 bp, Homo sapiens
attattcaatcatattaaaagt

SEQ ID NO: 8219600 - DNA, 22 bp, Homo sapiens
attattcaatcatattaaaagt

SEQ ID NO: 8219601 - DNA, 22 bp, Homo sapiens
attattcaatgttatttcagtg

SEQ ID NO: 8219602 - DNA, 22 bp, Homo sapiens
attattcaatgttatttcagtg

SEQ ID NO: 8219603 - DNA, 22 bp, Homo sapiens
caaactttcagttataacatga

SEQ ID NO: 8219604 - DNA, 22 bp, Homo sapiens
caaactttcagttataacatga

SEQ ID NO: 8219605 - DNA, 22 bp, Homo sapiens
caaacttacgtagtcttactac

SEQ ID NO: 8219606 - DNA, 22 bp, Homo sapiens
gctcaggaaggctcaaccagga

SEQ ID NO: 8219607 - DNA, 22 bp, Homo sapiens
gctcaggactggaggagcgggg

SEQ ID NO: 8219608 - DNA, 22 bp, Homo sapiens
gctcaggaccgaggggtgggaa

SEQ ID NO: 8219609 - DNA, 22 bp, Homo sapiens
gctcaggaaacagcagggcttg

SEQ ID NO: 8219610 - DNA, 22 bp, Homo sapiens
gctcaggaaaacagtctagtaa

SEQ ID NO: 8219611 - DNA, 22 bp, Homo sapiens
gctcaggcaccatatgatgtgt

SEQ ID NO: 8219612 - DNA, 22 bp, Homo sapiens
gctcaggcaaatttctggtgaa

SEQ ID NO: 8219613 - DNA, 22 bp, Homo sapiens
gctcaggcaggagtgcagtggc

SEQ ID NO: 8219614 - DNA, 22 bp, Homo sapiens
gctcaggcaccatatgatgtgt

SEQ ID NO: 8219615 - DNA, 22 bp, Homo sapiens
gctcaggcaggagtgcagtggc

SEQ ID NO: 8219616 - DNA, 22 bp, Homo sapiens
gctcaggcaggagtgcagtggc

SEQ ID NO: 8219617 - DNA, 22 bp, Homo sapiens
gctcaggcaggagtgcagtggc

SEQ ID NO: 8219618 - DNA, 22 bp, Homo sapiens
caaaggtattctcattttggaa

SEQ ID NO: 8219619 - DNA, 22 bp, Homo sapiens
caaaggcacacatacctttctg

SEQ ID NO: 8219620 - DNA, 22 bp, Homo sapiens
caaaggcacacatacctttctg

SEQ ID NO: 8219621 - DNA, 22 bp, Homo sapiens
gctcaggcaaatttctggtgaa

SEQ ID NO: 8219622 - DNA, 22 bp, Homo sapiens
gctcaggagctgacagcctcaa

SEQ ID NO: 8219623 - DNA, 22 bp, Homo sapiens
gctcaggagctcttggtggcgc

SEQ ID NO: 8219624 - DNA, 22 bp, Homo sapiens
gctcaggagctgacagcctcaa

SEQ ID NO: 8219625 - DNA, 22 bp, Homo sapiens
gctcaggatcagccacctcttt

SEQ ID NO: 8219626 - DNA, 22 bp, Homo sapiens
gctcaggagctgacagcctcaa

SEQ ID NO: 8219627 - DNA, 22 bp, Homo sapiens
caaaccatgacatgaagcgtga

SEQ ID NO: 8219628 - DNA, 22 bp, Homo sapiens
caaacattgcactttctgctat

SEQ ID NO: 8219629 - DNA, 22 bp, Homo sapiens
caaaccattaagcatgttgagt

SEQ ID NO: 8219630 - DNA, 22 bp, Homo sapiens
caaacctgttagaggtcatcgt

SEQ ID NO: 8219631 - DNA, 23 bp, Homo sapiens
caaacctgttctccccacatgca

SEQ ID NO: 8219632 - DNA, 22 bp, Homo sapiens
caaaccttgcagaactgggcag

SEQ ID NO: 8219633 - DNA, 22 bp, Homo sapiens
caaactatttacaatggaatca

SEQ ID NO: 8219634 - DNA, 22 bp, Homo sapiens
caaactgaacacgaaagtcttt

SEQ ID NO: 8219635 - DNA, 22 bp, Homo sapiens
caaactgaacacgaaagtcttt

SEQ ID NO: 8219636 - DNA, 22 bp, Homo sapiens
caaactgagcatcagaaagttt

SEQ ID NO: 8219637 - DNA, 22 bp, Homo sapiens
caaactgagcatcagaaagttt

SEQ ID NO: 8219638 - DNA, 22 bp, Homo sapiens
gcgcagctcagtgagggaactt

SEQ ID NO: 8219639 - DNA, 22 bp, Homo sapiens
gcgcagctttgtaaagatctgg

SEQ ID NO: 8219640 - DNA, 22 bp, Homo sapiens
caaacattccgcttctcccagg

SEQ ID NO: 8219641 - DNA, 22 bp, Homo sapiens
caaacattccgcttctcccagg

SEQ ID NO: 8219642 - DNA, 22 bp, Homo sapiens
gcgcaggacgcccagttgcctt

SEQ ID NO: 8219643 - DNA, 22 bp, Homo sapiens
gcgcacatgttcagatgtgtga

SEQ ID NO: 8219644 - DNA, 22 bp, Homo sapiens
gcgagggcacgcggttgaaggc

SEQ ID NO: 8219645 - DNA, 22 bp, Homo sapiens
gcgagtgccgagagggcagggc

SEQ ID NO: 8219646 - DNA, 22 bp, Homo sapiens
gcgagtgccgagagggcagggc

SEQ ID NO: 8219647 - DNA, 22 bp, Homo sapiens
gcgagtgccgagagggcagggc

SEQ ID NO: 8219648 - DNA, 22 bp, Homo sapiens
gcgagtgccgagagggcagggc

SEQ ID NO: 8219649 - DNA, 22 bp, Homo sapiens
gcgaggctgggccctgcaggcg

SEQ ID NO: 8219650 - DNA, 22 bp, Homo sapiens
gcgaggaggggtgctgggcccc

SEQ ID NO: 8219651 - DNA, 22 bp, Homo sapiens
gcgagggcacgcggttgaaggc

SEQ ID NO: 8219652 - DNA, 22 bp, Homo sapiens
gcgagggcacgcggttgaaggc

SEQ ID NO: 8219653 - DNA, 22 bp, Homo sapiens
gcgagggcacgcggttgaaggc

SEQ ID NO: 8219654 - DNA, 23 bp, Homo sapiens
gcctgggagttgcgatctgcccg

SEQ ID NO: 8219655 - DNA, 22 bp, Homo sapiens
gcctgtcccgcaccggagcccg

SEQ ID NO: 8219656 - DNA, 22 bp, Homo sapiens
gcctgtccccaggagagtccgg

SEQ ID NO: 8219657 - DNA, 22 bp, Homo sapiens
gcctgtccactaaacagccaag

SEQ ID NO: 8219658 - DNA, 19 bp, Homo sapiens
gcctgtccagtagcatttt

SEQ ID NO: 8219659 - DNA, 22 bp, Homo sapiens
gcctgggagtgcacagtgaggt

SEQ ID NO: 8219660 - DNA, 22 bp, Homo sapiens
gcctgggagtgcacagtgaggt

SEQ ID NO: 8219661 - DNA, 22 bp, Homo sapiens
gcctgggagtgcacagtgaggt

SEQ ID NO: 8219662 - DNA, 22 bp, Homo sapiens
gcctgggagggcagcagtgtgg

SEQ ID NO: 8219663 - DNA, 22 bp, Homo sapiens
gcctgggagtgcacagtgaggt

SEQ ID NO: 8219664 - DNA, 22 bp, Homo sapiens
gcctgggagggcagcagtgtgg

SEQ ID NO: 8219665 - DNA, 22 bp, Homo sapiens
gcctgggagggcagcagtgtgg

SEQ ID NO: 8219666 - DNA, 22 bp, Homo sapiens
gcctgggagggcagcagtgtgg

SEQ ID NO: 8219667 - DNA, 18 bp, Homo sapiens
gcctgggaggaggaaatg

SEQ ID NO: 8219668 - DNA, 22 bp, Homo sapiens
gcctgggagggcagcagtgtgg

SEQ ID NO: 8219669 - DNA, 22 bp, Homo sapiens
gcctgtgactcgtcttgggcca

SEQ ID NO: 8219670 - DNA, 22 bp, Homo sapiens
gcctgtctgcgtcacgcttatt

SEQ ID NO: 8219671 - DNA, 23 bp, Homo sapiens
gcctgtgcctatgcccagctctg

SEQ ID NO: 8219672 - DNA, 22 bp, Homo sapiens
gcctgtgcatagcagcggactc

SEQ ID NO: 8219673 - DNA, 22 bp, Homo sapiens
gcctgtctgcagggctgtcatt

SEQ ID NO: 8219674 - DNA, 22 bp, Homo sapiens
gcctgtctcttggaacttggta

SEQ ID NO: 8219675 - DNA, 22 bp, Homo sapiens
gcctgtctacactttctctgca

SEQ ID NO: 8219676 - DNA, 22 bp, Homo sapiens
gcctgtccttgtgaggtcccag

SEQ ID NO: 8219677 - DNA, 22 bp, Homo sapiens
gcctgtcctcccctgcgctgag

SEQ ID NO: 8219678 - DNA, 20 bp, Homo sapiens
gcctgtcctgagtgtcatgg

SEQ ID NO: 8219679 - DNA, 22 bp, Homo sapiens
gcctgtcctggatgctctgcaa

SEQ ID NO: 8219680 - DNA, 22 bp, Homo sapiens
gcctgtcctggatgctctgcaa

SEQ ID NO: 8219681 - DNA, 22 bp, Homo sapiens
caaaacattcagagagctcact

SEQ ID NO: 8219682 - DNA, 19 bp, Homo sapiens
gcgaggaagtcactgtggc

SEQ ID NO: 8219683 - DNA, 19 bp, Homo sapiens
gcgaggaagtcactgtggt

SEQ ID NO: 8219684 - DNA, 22 bp, Homo sapiens
gcgagcctctggagtcctctgg

SEQ ID NO: 8219685 - DNA, 21 bp, Homo sapiens
caaaacttaggtgacttagga

SEQ ID NO: 8219686 - DNA, 22 bp, Homo sapiens
caaaaagcttaggtaacaagcc

SEQ ID NO: 8219687 - DNA, 22 bp, Homo sapiens
caaaaactgcaattacttttac

SEQ ID NO: 8219688 - DNA, 22 bp, Homo sapiens
caaaaagcttaggtaacaagcc

SEQ ID NO: 8219689 - DNA, 22 bp, Homo sapiens
caaaacattcagagagctcact

SEQ ID NO: 8219690 - DNA, 22 bp, Homo sapiens
attttttagaacctggcctgat

SEQ ID NO: 8219691 - DNA, 22 bp, Homo sapiens
caaaaaacacagatgtctgtgt

SEQ ID NO: 8219692 - DNA, 22 bp, Homo sapiens
attttttagaacctggcctgat

SEQ ID NO: 8219693 - DNA, 22 bp, Homo sapiens
attttttagaacctggcctgat

SEQ ID NO: 8219694 - DNA, 22 bp, Homo sapiens
atttctcaaccaggtcaaaaag

SEQ ID NO: 8219695 - DNA, 22 bp, Homo sapiens
atttctcaaccaggtcaaaaag

SEQ ID NO: 8219696 - DNA, 22 bp, Homo sapiens
atttctcaaaggaatagagtga

SEQ ID NO: 8219697 - DNA, 22 bp, Homo sapiens
atttctcaagtaaatgagtcat

SEQ ID NO: 8219698 - DNA, 22 bp, Homo sapiens
atttctcacaaagttgcttatc

SEQ ID NO: 8219699 - DNA, 22 bp, Homo sapiens
atttctcactcacagtccatgt

SEQ ID NO: 8219700 - DNA, 22 bp, Homo sapiens
atttctcacaaagttgcttatc

SEQ ID NO: 8219701 - DNA, 22 bp, Homo sapiens
atttctcaccctacctcactcc

SEQ ID NO: 8219702 - DNA, 22 bp, Homo sapiens
atttctcacagtggaatctctg

SEQ ID NO: 8219703 - DNA, 22 bp, Homo sapiens
atttctcactgagcagataaaa

SEQ ID NO: 8219704 - DNA, 22 bp, Homo sapiens
atttctcactcacagtccatgt

SEQ ID NO: 8219705 - DNA, 22 bp, Homo sapiens
atttctcagaccagagaggtgt

SEQ ID NO: 8219706 - DNA, 22 bp, Homo sapiens
atttctcagcacttcctatctc

SEQ ID NO: 8219707 - DNA, 22 bp, Homo sapiens
atttctcagtaatctcagcaat

SEQ ID NO: 8219708 - DNA, 22 bp, Homo sapiens
atttctcagtaatctcagcaat

SEQ ID NO: 8219709 - DNA, 22 bp, Homo sapiens
atttctcagggtccaggtccca

SEQ ID NO: 8219710 - DNA, 22 bp, Homo sapiens
atttctcagtaggtgcacagtg

SEQ ID NO: 8219711 - DNA, 22 bp, Homo sapiens
atttctcaggactccatgggcg

SEQ ID NO: 8219712 - DNA, 22 bp, Homo sapiens
atttctcagggctgaggaggag

SEQ ID NO: 8219713 - DNA, 22 bp, Homo sapiens
gcctcagaaagcttttattcat

SEQ ID NO: 8219714 - DNA, 21 bp, Homo sapiens
gcctcaccatgtcaagccagg

SEQ ID NO: 8219715 - DNA, 22 bp, Homo sapiens
gcctcactgcagccccaggaag

SEQ ID NO: 8219716 - DNA, 22 bp, Homo sapiens
gcctccacttttgctggcttct

SEQ ID NO: 8219717 - DNA, 22 bp, Homo sapiens
gcctccacttttgctggcttct

SEQ ID NO: 8219718 - DNA, 22 bp, Homo sapiens
gcctccagcccacgcaggcctg

SEQ ID NO: 8219719 - DNA, 22 bp, Homo sapiens
gcctccagcccacgcaggcctg

SEQ ID NO: 8219720 - DNA, 22 bp, Homo sapiens
gcctccagcccacgcaggcctg

SEQ ID NO: 8219721 - DNA, 21 bp, Homo sapiens
gcctccagccagatggcctcc

SEQ ID NO: 8219722 - DNA, 21 bp, Homo sapiens
gcctccagccagatggcctcc

SEQ ID NO: 8219723 - DNA, 22 bp, Homo sapiens
gcctccagcccacgcaggcctg

SEQ ID NO: 8219724 - DNA, 21 bp, Homo sapiens
gcctccagccagatggcctcc

SEQ ID NO: 8219725 - DNA, 22 bp, Homo sapiens
atttctcagtgtacattatgtt

SEQ ID NO: 8219726 - DNA, 22 bp, Homo sapiens
atttctcagtgtacattatgtt

SEQ ID NO: 8219727 - DNA, 22 bp, Homo sapiens
atttctcagtaggtgcacagtg

SEQ ID NO: 8219728 - DNA, 22 bp, Homo sapiens
atttctcagtgaaatgacaggc

SEQ ID NO: 8219729 - DNA, 22 bp, Homo sapiens
atttctcagtaatctcagcaat

SEQ ID NO: 8219730 - DNA, 22 bp, Homo sapiens
atttctcagtgaaatgacaggc

SEQ ID NO: 8219731 - DNA, 22 bp, Homo sapiens
atttctcagtgaaatgacaggc

SEQ ID NO: 8219732 - DNA, 22 bp, Homo sapiens
gcctccccaaagtgctgacagc

SEQ ID NO: 8219733 - DNA, 22 bp, Homo sapiens
gcctccccaaagtgctgacagc

SEQ ID NO: 8219734 - DNA, 22 bp, Homo sapiens
gcctccccaagcagcagggatt

SEQ ID NO: 8219735 - DNA, 22 bp, Homo sapiens
gcctccattgaaagctgtctat

SEQ ID NO: 8219736 - DNA, 22 bp, Homo sapiens
gcctccatgtgtcctgagtcgc

SEQ ID NO: 8219737 - DNA, 22 bp, Homo sapiens
gcctccatgtgtcctgagtcgc

SEQ ID NO: 8219738 - DNA, 22 bp, Homo sapiens
gcctccagtttttttctgaact

SEQ ID NO: 8219739 - DNA, 22 bp, Homo sapiens
gcctccagggtagaggaggaag

SEQ ID NO: 8219740 - DNA, 22 bp, Homo sapiens
gcctccagggatgattccttcc

SEQ ID NO: 8219741 - DNA, 22 bp, Homo sapiens
gcctccagggtagaggaggaag

SEQ ID NO: 8219742 - DNA, 22 bp, Homo sapiens
gcctccagggtagaggaggaag

SEQ ID NO: 8219743 - DNA, 22 bp, Homo sapiens
gcctccagggtagaggaggaag

SEQ ID NO: 8219744 - DNA, 22 bp, Homo sapiens
gcctccagcccacgcaggcctg

SEQ ID NO: 8219745 - DNA, 22 bp, Homo sapiens
gcctccagctggggcatttcag

SEQ ID NO: 8219746 - DNA, 22 bp, Homo sapiens
gcctctcctcttaataccatta

SEQ ID NO: 8219747 - DNA, 22 bp, Homo sapiens
gcctctcctcttaataccatta

SEQ ID NO: 8219748 - DNA, 22 bp, Homo sapiens
gcctctccgagccactgcctct

SEQ ID NO: 8219749 - DNA, 22 bp, Homo sapiens
gcctctctccttggcttgcagt

SEQ ID NO: 8219750 - DNA, 22 bp, Homo sapiens
gcctctcctggagaaggcaggg

SEQ ID NO: 8219751 - DNA, 22 bp, Homo sapiens
gcctctcctggagaaggcaggg

SEQ ID NO: 8219752 - DNA, 22 bp, Homo sapiens
gcctctctcgggcttgtagcgg

SEQ ID NO: 8219753 - DNA, 22 bp, Homo sapiens
gcctctctccttggcttgcagt

SEQ ID NO: 8219754 - DNA, 21 bp, Homo sapiens
gcctctccaaatcctgccttc

SEQ ID NO: 8219755 - DNA, 22 bp, Homo sapiens
gcctctccgagccactgcctct

SEQ ID NO: 8219756 - DNA, 22 bp, Homo sapiens
gcctctccgagccactgcctct

SEQ ID NO: 8219757 - DNA, 21 bp, Homo sapiens
gcctctccaaatcctgccttc

SEQ ID NO: 8219758 - DNA, 21 bp, Homo sapiens
gcctctccaaatcctgccttc

SEQ ID NO: 8219759 - DNA, 22 bp, Homo sapiens
gcctgctggaggagcctcaggg

SEQ ID NO: 8219760 - DNA, 22 bp, Homo sapiens
gcctgctggatgtggccaggcc

SEQ ID NO: 8219761 - DNA, 22 bp, Homo sapiens
gcctgctggatgtggccaggcc

SEQ ID NO: 8219762 - DNA, 22 bp, Homo sapiens
gcctgctggatgtggccaggcc

SEQ ID NO: 8219763 - DNA, 22 bp, Homo sapiens
gcctgctgcatccaggctattg

SEQ ID NO: 8219764 - DNA, 22 bp, Homo sapiens
gcctgctgccaccctggctccg

SEQ ID NO: 8219765 - DNA, 22 bp, Homo sapiens
gcctgctgccaccctggctccg

SEQ ID NO: 8219766 - DNA, 22 bp, Homo sapiens
gcctgctgccaccctggctccg

SEQ ID NO: 8219767 - DNA, 22 bp, Homo sapiens
gcctctctctacccagtatgat

SEQ ID NO: 8219768 - DNA, 22 bp, Homo sapiens
gcctctctgggctgccgaggct

SEQ ID NO: 8219769 - DNA, 22 bp, Homo sapiens
gcctctctgggctgccgaggct

SEQ ID NO: 8219770 - DNA, 18 bp, Homo sapiens
gcctgcctagagcttgcc

SEQ ID NO: 8219771 - DNA, 22 bp, Homo sapiens
gcctgctgaacctcatgcagtc

SEQ ID NO: 8219772 - DNA, 22 bp, Homo sapiens
gcctgctgaacctcatgcagtc

SEQ ID NO: 8219773 - DNA, 22 bp, Homo sapiens
gcctgctgaacctcatgcagtc

SEQ ID NO: 8219774 - DNA, 22 bp, Homo sapiens
gcctggagctctccacttgggg

SEQ ID NO: 8219775 - DNA, 22 bp, Homo sapiens
gcctggagctcggctgagggcg

SEQ ID NO: 8219776 - DNA, 22 bp, Homo sapiens
gcctggagctcggctgagggcg

SEQ ID NO: 8219777 - DNA, 22 bp, Homo sapiens
gcctggagctcggctgagggcg

SEQ ID NO: 8219778 - DNA, 22 bp, Homo sapiens
gcctggagctcggctgagggcg

SEQ ID NO: 8219779 - DNA, 22 bp, Homo sapiens
gcctggagctcatgtgggcatt

SEQ ID NO: 8219780 - DNA, 22 bp, Homo sapiens
gcctggagctcatgtgggcatt

SEQ ID NO: 8219781 - DNA, 22 bp, Homo sapiens
gcctggagctcatgtgggcatt

SEQ ID NO: 8219782 - DNA, 22 bp, Homo sapiens
gcctggagctcatgtgggcatt

SEQ ID NO: 8219783 - DNA, 22 bp, Homo sapiens
gcctggagctcggctgagggcg

SEQ ID NO: 8219784 - DNA, 22 bp, Homo sapiens
gcctggagctcggctgagggcg

SEQ ID NO: 8219785 - DNA, 22 bp, Homo sapiens
gcctggagctcatgtgggcatt

SEQ ID NO: 8219786 - DNA, 22 bp, Homo sapiens
gcctggagctcatgtgggcatt

SEQ ID NO: 8219787 - DNA, 22 bp, Homo sapiens
gcctggagctactggacactga

SEQ ID NO: 8219788 - DNA, 22 bp, Homo sapiens
gcctggagctactggacactga

SEQ ID NO: 8219789 - DNA, 22 bp, Homo sapiens
gcctggagctactggacactga

SEQ ID NO: 8219790 - DNA, 22 bp, Homo sapiens
gcctggagctactggacactga

SEQ ID NO: 8219791 - DNA, 22 bp, Homo sapiens
gcctgggagcacatcggggtcc

SEQ ID NO: 8219792 - DNA, 22 bp, Homo sapiens
gcctgggagattaattaggaag

SEQ ID NO: 8219793 - DNA, 22 bp, Homo sapiens
gcctgggagcacatcggggtcc

SEQ ID NO: 8219794 - DNA, 22 bp, Homo sapiens
gcctgggagcacatcggggtcc

SEQ ID NO: 8219795 - DNA, 22 bp, Homo sapiens
gcctgggagattaattaggaag

SEQ ID NO: 8219796 - DNA, 22 bp, Homo sapiens
gcctgggagagggatagtgcag

SEQ ID NO: 8219797 - DNA, 22 bp, Homo sapiens
gcctgggagagggatagtgcag

SEQ ID NO: 8219798 - DNA, 22 bp, Homo sapiens
gcctggaggaatgtagctgagg

SEQ ID NO: 8219799 - DNA, 22 bp, Homo sapiens
gcctggagctctccacttgggg

SEQ ID NO: 8219800 - DNA, 22 bp, Homo sapiens
gcctggagctctccacttgggg

SEQ ID NO: 8219801 - DNA, 22 bp, Homo sapiens
gcctggagctctccacttgggg

SEQ ID NO: 8219802 - DNA, 22 bp, Homo sapiens
gcctggagctctccacttgggg

SEQ ID NO: 8219803 - DNA, 22 bp, Homo sapiens
attgcttttccttaacacatgc

SEQ ID NO: 8219804 - DNA, 22 bp, Homo sapiens
attgcttttccttaacacatgc

SEQ ID NO: 8219805 - DNA, 22 bp, Homo sapiens
attgcttttgagctagaatttt

SEQ ID NO: 8219806 - DNA, 22 bp, Homo sapiens
attgcttttgagctagaatttt

SEQ ID NO: 8219807 - DNA, 22 bp, Homo sapiens
attgctttagaaagaaaaatat

SEQ ID NO: 8219808 - DNA, 22 bp, Homo sapiens
attgctttagaaagaaaaatat

SEQ ID NO: 8219809 - DNA, 22 bp, Homo sapiens
attgcttttagtgaaattatat

SEQ ID NO: 8219810 - DNA, 22 bp, Homo sapiens
attggaaatacagtagaaaaat

SEQ ID NO: 8219811 - DNA, 22 bp, Homo sapiens
attggaaagttcttaagggata

SEQ ID NO: 8219812 - DNA, 22 bp, Homo sapiens
attggaaatacagtagaaaaat

SEQ ID NO: 8219813 - DNA, 22 bp, Homo sapiens
attggaaatactgagagataaa

SEQ ID NO: 8219814 - DNA, 22 bp, Homo sapiens
attggaaatactgagagataaa

SEQ ID NO: 8219815 - DNA, 22 bp, Homo sapiens
attggaaatacagtagaaaaat

SEQ ID NO: 8219816 - DNA, 22 bp, Homo sapiens
attggaaatacagtagaaaaat

SEQ ID NO: 8219817 - DNA, 22 bp, Homo sapiens
attggaaatacagtagaaaaat

SEQ ID NO: 8219818 - DNA, 22 bp, Homo sapiens
attggaagtatttcatcaaaag

SEQ ID NO: 8219819 - DNA, 22 bp, Homo sapiens
attggaaatgctacaagttaga

SEQ ID NO: 8219820 - DNA, 22 bp, Homo sapiens
attggaaatgctacaagttaga

SEQ ID NO: 8219821 - DNA, 22 bp, Homo sapiens
attggaaatgctacaagttaga

SEQ ID NO: 8219822 - DNA, 19 bp, Homo sapiens
attggagcagaaaggtggt

SEQ ID NO: 8219823 - DNA, 22 bp, Homo sapiens
attggagccccagaagcaaggt

SEQ ID NO: 8219824 - DNA, 22 bp, Homo sapiens
atttaaattttctgatggagag

SEQ ID NO: 8219825 - DNA, 22 bp, Homo sapiens
atttaaattttctgatggagag

SEQ ID NO: 8219826 - DNA, 22 bp, Homo sapiens
atttaatgtcgagctattgtag

SEQ ID NO: 8219827 - DNA, 22 bp, Homo sapiens
atttaatgtcgagctattgtag

SEQ ID NO: 8219828 - DNA, 21 bp, Homo sapiens
attggcacaccttttattgga

SEQ ID NO: 8219829 - DNA, 22 bp, Homo sapiens
attggcactgcacatgattgct

SEQ ID NO: 8219830 - DNA, 22 bp, Homo sapiens
atttaatttacatttgacagag

SEQ ID NO: 8219831 - DNA, 22 bp, Homo sapiens
atttaatttacatttgacagag

SEQ ID NO: 8219832 - DNA, 22 bp, Homo sapiens
atttaattgttcttctggctat

SEQ ID NO: 8219833 - DNA, 22 bp, Homo sapiens
atttaattgttcttctggctat

SEQ ID NO: 8219834 - DNA, 22 bp, Homo sapiens
atttaatttacatttgacagag

SEQ ID NO: 8219835 - DNA, 22 bp, Homo sapiens
atttaattaatcatggtgaatt

SEQ ID NO: 8219836 - DNA, 22 bp, Homo sapiens
atttaattttctcaacagtgct

SEQ ID NO: 8219837 - DNA, 22 bp, Homo sapiens
atttaattttctcaacagtgct

SEQ ID NO: 8219838 - DNA, 21 bp, Homo sapiens
atttacaaaacagtcccttcc

SEQ ID NO: 8219839 - DNA, 22 bp, Homo sapiens
atttaattttctcaacagtgct

SEQ ID NO: 8219840 - DNA, 22 bp, Homo sapiens
atttaatttgtgtctttagctg

SEQ ID NO: 8219841 - DNA, 22 bp, Homo sapiens
atttaatttgtgtctttagctg

SEQ ID NO: 8219842 - DNA, 22 bp, Homo sapiens
atttaatttggagagagaaacc

SEQ ID NO: 8219843 - DNA, 22 bp, Homo sapiens
atttaatttggagagagaaacc

SEQ ID NO: 8219844 - DNA, 22 bp, Homo sapiens
atttaatttacatttgacagag

SEQ ID NO: 8219845 - DNA, 22 bp, Homo sapiens
atttaatttatagatgtggata

SEQ ID NO: 8219846 - DNA, 22 bp, Homo sapiens
atttaatttatagatgtggata

SEQ ID NO: 8219847 - DNA, 19 bp, Homo sapiens
atttactgcctaaaatctc

SEQ ID NO: 8219848 - DNA, 22 bp, Homo sapiens
atttactgaggtaaataaactg

SEQ ID NO: 8219849 - DNA, 22 bp, Homo sapiens
atttactgaggtaaataaactg

SEQ ID NO: 8219850 - DNA, 22 bp, Homo sapiens
atttagaactttgtttgccaat

SEQ ID NO: 8219851 - DNA, 22 bp, Homo sapiens
atttagaactttgtttgccaat

SEQ ID NO: 8219852 - DNA, 22 bp, Homo sapiens
atttagaactttgtttgccaat

SEQ ID NO: 8219853 - DNA, 22 bp, Homo sapiens
atttagaactttgtttgccaat

SEQ ID NO: 8219854 - DNA, 22 bp, Homo sapiens
atttagaagctaatttttcaga

SEQ ID NO: 8219855 - DNA, 22 bp, Homo sapiens
atttagaagctaatttttcaga

SEQ ID NO: 8219856 - DNA, 22 bp, Homo sapiens
atttagaaattccaaaagtatt

SEQ ID NO: 8219857 - DNA, 22 bp, Homo sapiens
atttagaaccccttccaacctg

SEQ ID NO: 8219858 - DNA, 22 bp, Homo sapiens
atttactactgctatctagaag

SEQ ID NO: 8219859 - DNA, 22 bp, Homo sapiens
atttactagggctgtttaagta

SEQ ID NO: 8219860 - DNA, 22 bp, Homo sapiens
atttactagggctgtttaagta

SEQ ID NO: 8219861 - DNA, 22 bp, Homo sapiens
atttactactgctatctagaag

SEQ ID NO: 8219862 - DNA, 22 bp, Homo sapiens
gccaggagtgtgtggctatgtt

SEQ ID NO: 8219863 - DNA, 22 bp, Homo sapiens
gccaggagtgtgtggctatgtt

SEQ ID NO: 8219864 - DNA, 22 bp, Homo sapiens
gccaggagtgtcccactcattt

SEQ ID NO: 8219865 - DNA, 20 bp, Homo sapiens
gccaggagggtgtgatgagc

SEQ ID NO: 8219866 - DNA, 22 bp, Homo sapiens
gccaggaggtcagcccctcaac

SEQ ID NO: 8219867 - DNA, 22 bp, Homo sapiens
gccaggaggtcagcccctcaac

SEQ ID NO: 8219868 - DNA, 22 bp, Homo sapiens
atttacagaaacttaatcatag

SEQ ID NO: 8219869 - DNA, 22 bp, Homo sapiens
atttacagaaacttaatcatag

SEQ ID NO: 8219870 - DNA, 22 bp, Homo sapiens
atttacagaaacttaatcatag

SEQ ID NO: 8219871 - DNA, 22 bp, Homo sapiens
atttacacttggtttactagag

SEQ ID NO: 8219872 - DNA, 22 bp, Homo sapiens
atttacagaaacttaatcatag

SEQ ID NO: 8219873 - DNA, 22 bp, Homo sapiens
atttacacttggtttactagag

SEQ ID NO: 8219874 - DNA, 22 bp, Homo sapiens
atttacacttggtttactagag

SEQ ID NO: 8219875 - DNA, 22 bp, Homo sapiens
atttacagaagcatgtaatagc

SEQ ID NO: 8219876 - DNA, 22 bp, Homo sapiens
atttacagaagcatgtaatagc

SEQ ID NO: 8219877 - DNA, 22 bp, Homo sapiens
atttacagaaacttaatcatag

SEQ ID NO: 8219878 - DNA, 22 bp, Homo sapiens
atttacagaaacttaatcatag

SEQ ID NO: 8219879 - DNA, 22 bp, Homo sapiens
atttacagaaacttaatcatag

SEQ ID NO: 8219880 - DNA, 22 bp, Homo sapiens
atttacacattcataagatttc

SEQ ID NO: 8219881 - DNA, 22 bp, Homo sapiens
atttacacattcataagatttc

SEQ ID NO: 8219882 - DNA, 22 bp, Homo sapiens
atttacacattcataagatttc

SEQ ID NO: 8219883 - DNA, 22 bp, Homo sapiens
atttacacattcataagatttc

SEQ ID NO: 8219884 - DNA, 21 bp, Homo sapiens
atttacaaaacagtcccttcc

SEQ ID NO: 8219885 - DNA, 21 bp, Homo sapiens
atttacaaaacagtcccttcc

SEQ ID NO: 8219886 - DNA, 22 bp, Homo sapiens
atttacactggttctcagagct

SEQ ID NO: 8219887 - DNA, 22 bp, Homo sapiens
atttacactggttctcagagct

SEQ ID NO: 8219888 - DNA, 22 bp, Homo sapiens
atttacactggttctcagagct

SEQ ID NO: 8219889 - DNA, 22 bp, Homo sapiens
atttacaccttcttcgattctc

SEQ ID NO: 8219890 - DNA, 22 bp, Homo sapiens
atttacactaaaggaaggagga

SEQ ID NO: 8219891 - DNA, 22 bp, Homo sapiens
atttacaccttcttcgattctc

SEQ ID NO: 8219892 - DNA, 22 bp, Homo sapiens
atttacagaagcatgtaatagc

SEQ ID NO: 8219893 - DNA, 22 bp, Homo sapiens
atttacagaagcatgtaatagc

SEQ ID NO: 8219894 - DNA, 22 bp, Homo sapiens
atttacagaagcatgtaatagc

SEQ ID NO: 8219895 - DNA, 22 bp, Homo sapiens
gccagctggagtgagagtgggc

SEQ ID NO: 8219896 - DNA, 22 bp, Homo sapiens
gccagctggagtgagagtgggc

SEQ ID NO: 8219897 - DNA, 22 bp, Homo sapiens
atttacagaagcatgtaatagc

SEQ ID NO: 8219898 - DNA, 22 bp, Homo sapiens
atttacagaagcatgtaatagc

SEQ ID NO: 8219899 - DNA, 22 bp, Homo sapiens
gccaggaggcttaactggacag

SEQ ID NO: 8219900 - DNA, 22 bp, Homo sapiens
gccaggaggcttaactggacag

SEQ ID NO: 8219901 - DNA, 22 bp, Homo sapiens
gccagctggagtgagagtgggc

SEQ ID NO: 8219902 - DNA, 22 bp, Homo sapiens
gccagctggctgcaggtcccag

SEQ ID NO: 8219903 - DNA, 22 bp, Homo sapiens
gccagctggctgcaggtcccag

SEQ ID NO: 8219904 - DNA, 22 bp, Homo sapiens
gccaggaggcttaactggacag

SEQ ID NO: 8219905 - DNA, 22 bp, Homo sapiens
gccaggagggaaaggacaattt

SEQ ID NO: 8219906 - DNA, 22 bp, Homo sapiens
gccaggaggcttaactggacag

SEQ ID NO: 8219907 - DNA, 22 bp, Homo sapiens
gccaggagggaaaggacaattt

SEQ ID NO: 8219908 - DNA, 19 bp, Homo sapiens
gccaggagggctctggctg

SEQ ID NO: 8219909 - DNA, 19 bp, Homo sapiens
gccaggagggctctggctg

SEQ ID NO: 8219910 - DNA, 22 bp, Homo sapiens
gccaggccactcccgggtcctg

SEQ ID NO: 8219911 - DNA, 22 bp, Homo sapiens
gccaggccactcccgggtcctg

SEQ ID NO: 8219912 - DNA, 22 bp, Homo sapiens
gccaggccctgggcacttcgtg

SEQ ID NO: 8219913 - DNA, 22 bp, Homo sapiens
gccaggcctgcaagtgctggtg

SEQ ID NO: 8219914 - DNA, 22 bp, Homo sapiens
gccaggcctgcaagtgctggtg

SEQ ID NO: 8219915 - DNA, 22 bp, Homo sapiens
gccaggcctgcaagtgctggtg

SEQ ID NO: 8219916 - DNA, 22 bp, Homo sapiens
gccaggccctgggcacttcgtg

SEQ ID NO: 8219917 - DNA, 22 bp, Homo sapiens
gccaggccctgggcacttcgtg

SEQ ID NO: 8219918 - DNA, 22 bp, Homo sapiens
gccaggcctgcaagtgctggtg

SEQ ID NO: 8219919 - DNA, 22 bp, Homo sapiens
gccaggcctgcaagtgctggtg

SEQ ID NO: 8219920 - DNA, 19 bp, Homo sapiens
gccaggcctggacctgcag

SEQ ID NO: 8219921 - DNA, 19 bp, Homo sapiens
gccaggcctggacctgcag

SEQ ID NO: 8219922 - DNA, 22 bp, Homo sapiens
atttcacaaaccatcctgattt

SEQ ID NO: 8219923 - DNA, 21 bp, Homo sapiens
atttcagaaatattggtggga

SEQ ID NO: 8219924 - DNA, 22 bp, Homo sapiens
atttcacaaaccatcctgattt

SEQ ID NO: 8219925 - DNA, 22 bp, Homo sapiens
atttcacaaaccatcctgattt

SEQ ID NO: 8219926 - DNA, 22 bp, Homo sapiens
atttcacaaaccatcctgattt

SEQ ID NO: 8219927 - DNA, 19 bp, Homo sapiens
gccaggcctggacctgcag

SEQ ID NO: 8219928 - DNA, 22 bp, Homo sapiens
atttcagagtgagagtgctcaa

SEQ ID NO: 8219929 - DNA, 22 bp, Homo sapiens
atttcagagtgagagtgctcaa

SEQ ID NO: 8219930 - DNA, 22 bp, Homo sapiens
atttcagaatgtcctaatttag

SEQ ID NO: 8219931 - DNA, 22 bp, Homo sapiens
atttcagactgtgttggaaaat

SEQ ID NO: 8219932 - DNA, 21 bp, Homo sapiens
atttcagagcacacaagtaaa

SEQ ID NO: 8219933 - DNA, 22 bp, Homo sapiens
atttattgagagggaggggaat

SEQ ID NO: 8219934 - DNA, 22 bp, Homo sapiens
atttattgagagggaggggaat

SEQ ID NO: 8219935 - DNA, 22 bp, Homo sapiens
atttattgagagggaggggaat

SEQ ID NO: 8219936 - DNA, 22 bp, Homo sapiens
atttattgagagggaggggaat

SEQ ID NO: 8219937 - DNA, 22 bp, Homo sapiens
atttattgagagggaggggaat

SEQ ID NO: 8219938 - DNA, 22 bp, Homo sapiens
atttattgagcctttcctatgt

SEQ ID NO: 8219939 - DNA, 22 bp, Homo sapiens
atttattgagagggaggggaat

SEQ ID NO: 8219940 - DNA, 22 bp, Homo sapiens
atttattgagagggaggggaat

SEQ ID NO: 8219941 - DNA, 22 bp, Homo sapiens
atttattgagcctttcctatgt

SEQ ID NO: 8219942 - DNA, 22 bp, Homo sapiens
atttattgagcctttcctatgt

SEQ ID NO: 8219943 - DNA, 22 bp, Homo sapiens
atttattgagcctttcctatgt

SEQ ID NO: 8219944 - DNA, 22 bp, Homo sapiens
atttattgagacttaacaaccc

SEQ ID NO: 8219945 - DNA, 22 bp, Homo sapiens
atttattgagacttaacaaccc

SEQ ID NO: 8219946 - DNA, 22 bp, Homo sapiens
atttattgagacttaacaaccc

SEQ ID NO: 8219947 - DNA, 22 bp, Homo sapiens
atttattgagacttaacaaccc

SEQ ID NO: 8219948 - DNA, 22 bp, Homo sapiens
atttattatgggatttggcaca

SEQ ID NO: 8219949 - DNA, 22 bp, Homo sapiens
atttattatgggatttggcaca

SEQ ID NO: 8219950 - DNA, 22 bp, Homo sapiens
atttattatgggatttggcaca

SEQ ID NO: 8219951 - DNA, 22 bp, Homo sapiens
atttattgagacttaacaaccc

SEQ ID NO: 8219952 - DNA, 22 bp, Homo sapiens
atttattatgggatttggctca

SEQ ID NO: 8219953 - DNA, 22 bp, Homo sapiens
atttattggtttgcatggtgaa

SEQ ID NO: 8219954 - DNA, 22 bp, Homo sapiens
gccaggcattctagaagtagtg

SEQ ID NO: 8219955 - DNA, 22 bp, Homo sapiens
gccaggcattctagaagtagtg

SEQ ID NO: 8219956 - DNA, 22 bp, Homo sapiens
gccaggcatttattgattgaat

SEQ ID NO: 8219957 - DNA, 22 bp, Homo sapiens
gccaggcatttgttaggtgctg

SEQ ID NO: 8219958 - DNA, 22 bp, Homo sapiens
gccaggcatttgttaggtgctg

SEQ ID NO: 8219959 - DNA, 22 bp, Homo sapiens
gccaggccactcccgggtcctg

SEQ ID NO: 8219960 - DNA, 22 bp, Homo sapiens
atttattgagcctttcctatgt

SEQ ID NO: 8219961 - DNA, 22 bp, Homo sapiens
atttattggatgcttacttggg

SEQ ID NO: 8219962 - DNA, 22 bp, Homo sapiens
atttattggatgcttacttggg

SEQ ID NO: 8219963 - DNA, 22 bp, Homo sapiens
atttattggtttgcatggtgaa

SEQ ID NO: 8219964 - DNA, 22 bp, Homo sapiens
atttattggatgcttacttggg

SEQ ID NO: 8219965 - DNA, 22 bp, Homo sapiens
atttattggatgcttacttggg

SEQ ID NO: 8219966 - DNA, 22 bp, Homo sapiens
atttattggatgcttacttggg

SEQ ID NO: 8219967 - DNA, 22 bp, Homo sapiens
atttcagtgttggttagcaagc

SEQ ID NO: 8219968 - DNA, 22 bp, Homo sapiens
atttcagtgttggttagcaagc

SEQ ID NO: 8219969 - DNA, 22 bp, Homo sapiens
atttcagtgagaaagcaatcaa

SEQ ID NO: 8219970 - DNA, 22 bp, Homo sapiens
atttcagtgagaaagcaatcaa

SEQ ID NO: 8219971 - DNA, 22 bp, Homo sapiens
atttcagtgtcttcttctccct

SEQ ID NO: 8219972 - DNA, 22 bp, Homo sapiens
atttcagtagaaaatcttgatt

SEQ ID NO: 8219973 - DNA, 22 bp, Homo sapiens
atttcagtagtccttacttgta

SEQ ID NO: 8219974 - DNA, 22 bp, Homo sapiens
atttcagtattatacaactgct

SEQ ID NO: 8219975 - DNA, 22 bp, Homo sapiens
atttcatgagttattatagtgg

SEQ ID NO: 8219976 - DNA, 21 bp, Homo sapiens
atttcatggtgcttttaagaa

SEQ ID NO: 8219977 - DNA, 22 bp, Homo sapiens
atttcatatgtatcacctagcc

SEQ ID NO: 8219978 - DNA, 22 bp, Homo sapiens
atttcatagattgtaaatccct

SEQ ID NO: 8219979 - DNA, 20 bp, Homo sapiens
atttcagtgtttgcaatttc

SEQ ID NO: 8219980 - DNA, 20 bp, Homo sapiens
atttcagtgtttgcaatttc

SEQ ID NO: 8219981 - DNA, 22 bp, Homo sapiens
atttcagtgttttaagagttca

SEQ ID NO: 8219982 - DNA, 22 bp, Homo sapiens
atttcagtgttttaagagttca

SEQ ID NO: 8219983 - DNA, 22 bp, Homo sapiens
atttcatactaaggctcaaaaa

SEQ ID NO: 8219984 - DNA, 22 bp, Homo sapiens
atttcctttgcaaagactgtgc

SEQ ID NO: 8219985 - DNA, 22 bp, Homo sapiens
atttcctttgcaaagactgtgc

SEQ ID NO: 8219986 - DNA, 18 bp, Homo sapiens
atttctactactataaag

SEQ ID NO: 8219987 - DNA, 22 bp, Homo sapiens
atttctacattgagttttagca

SEQ ID NO: 8219988 - DNA, 18 bp, Homo sapiens
atttctactactataaag

SEQ ID NO: 8219989 - DNA, 22 bp, Homo sapiens
atttctacattgagttttagca

SEQ ID NO: 8219990 - DNA, 22 bp, Homo sapiens
atttctactgtgagaaacatga

SEQ ID NO: 8219991 - DNA, 18 bp, Homo sapiens
atttctactactataaag

SEQ ID NO: 8219992 - DNA, 18 bp, Homo sapiens
atttctactactataaag

SEQ ID NO: 8219993 - DNA, 22 bp, Homo sapiens
atttctagacttagaactctta

SEQ ID NO: 8219994 - DNA, 22 bp, Homo sapiens
atttctagaggcagcttctagg

SEQ ID NO: 8219995 - DNA, 22 bp, Homo sapiens
atttctcaaaggaatagagtga

SEQ ID NO: 8219996 - DNA, 22 bp, Homo sapiens
atttctaggtagagaagcttag

SEQ ID NO: 8219997 - DNA, 22 bp, Homo sapiens
atttctaggttcacatgtgttt

SEQ ID NO: 8219998 - DNA, 22 bp, Homo sapiens
atttccttcccagatttggttc

SEQ ID NO: 8219999 - DNA, 22 bp, Homo sapiens
atttcctagggtagatgtcaca

SEQ ID NO: 8220000 - DNA, 22 bp, Homo sapiens
atttcatgtgaagaagagataa

SEQ ID NO: 8220001 - DNA, 22 bp, Homo sapiens
atttcatgtgaagaagagataa

SEQ ID NO: 8220002 - DNA, 22 bp, Homo sapiens
atttcctagcctctcttgcagt

SEQ ID NO: 8220003 - DNA, 22 bp, Homo sapiens
atttcctttgcaaagactgtgc

SEQ ID NO: 8220004 - DNA, 22 bp, Homo sapiens
atttccttgcaagtttctgtaa

SEQ ID NO: 8220005 - DNA, 22 bp, Homo sapiens
cttgctggagcggagcgggtgt

SEQ ID NO: 8220006 - DNA, 22 bp, Homo sapiens
cttgctggaaactctctctgcc

SEQ ID NO: 8220007 - DNA, 22 bp, Homo sapiens
cttgcggagaactgtgccctta

SEQ ID NO: 8220008 - DNA, 22 bp, Homo sapiens
cttgctcacagtacctggcttg

SEQ ID NO: 8220009 - DNA, 22 bp, Homo sapiens
cttgctcacagtacctggcttg

SEQ ID NO: 8220010 - DNA, 22 bp, Homo sapiens
cttgctcattaagtagctcaca

SEQ ID NO: 8220011 - DNA, 22 bp, Homo sapiens
cttgcctttgtcttcaaaggct

SEQ ID NO: 8220012 - DNA, 22 bp, Homo sapiens
cttgcctttgtcttcaaaggct

SEQ ID NO: 8220013 - DNA, 22 bp, Homo sapiens
cttgcctttgtcttcaaaggct

SEQ ID NO: 8220014 - DNA, 22 bp, Homo sapiens
cttgcctttgtcttcaaaggct

SEQ ID NO: 8220015 - DNA, 22 bp, Homo sapiens
atctatgtgggaatcataatag

SEQ ID NO: 8220016 - DNA, 22 bp, Homo sapiens
atctatgtgcctttgtatagaa

SEQ ID NO: 8220017 - DNA, 22 bp, Homo sapiens
atctatgtgggaatcataatag

SEQ ID NO: 8220018 - DNA, 22 bp, Homo sapiens
atctattatgctgagaaactgt

SEQ ID NO: 8220019 - DNA, 22 bp, Homo sapiens
atctatactcagagttaatatc

SEQ ID NO: 8220020 - DNA, 22 bp, Homo sapiens
atctatcacctttaggtttgtt

SEQ ID NO: 8220021 - DNA, 22 bp, Homo sapiens
atctatatcatggggtaaggta

SEQ ID NO: 8220022 - DNA, 22 bp, Homo sapiens
atctatacccatcatgatttaa

SEQ ID NO: 8220023 - DNA, 22 bp, Homo sapiens
atctacatgttgatttaaagaa

SEQ ID NO: 8220024 - DNA, 22 bp, Homo sapiens
atctacataaaacgaatacata

SEQ ID NO: 8220025 - DNA, 22 bp, Homo sapiens
atctacagccagtctggtttgt

SEQ ID NO: 8220026 - DNA, 22 bp, Homo sapiens
atctacagccagtctggtttgt

SEQ ID NO: 8220027 - DNA, 19 bp, Homo sapiens
atctacaattattctcagt

SEQ ID NO: 8220028 - DNA, 19 bp, Homo sapiens
atctacaattattctcagt

SEQ ID NO: 8220029 - DNA, 22 bp, Homo sapiens
atctacaggattttacagagtt

SEQ ID NO: 8220030 - DNA, 22 bp, Homo sapiens
atctacaggattttacagagtt

SEQ ID NO: 8220031 - DNA, 22 bp, Homo sapiens
atctacagctgtctgcacagta

SEQ ID NO: 8220032 - DNA, 22 bp, Homo sapiens
atctacaggatagtttaatatt

SEQ ID NO: 8220033 - DNA, 22 bp, Homo sapiens
atctacaggatagtttaatatt

SEQ ID NO: 8220034 - DNA, 22 bp, Homo sapiens
atctacaggatagtttaatatt

SEQ ID NO: 8220035 - DNA, 22 bp, Homo sapiens
atctaggatttgaatgcacagt

SEQ ID NO: 8220036 - DNA, 22 bp, Homo sapiens
atctagaggagggctgctggat

SEQ ID NO: 8220037 - DNA, 22 bp, Homo sapiens
atctagaaagtgttgaagatca

SEQ ID NO: 8220038 - DNA, 22 bp, Homo sapiens
atctagaaagtgttgaagatca

SEQ ID NO: 8220039 - DNA, 22 bp, Homo sapiens
atctagaagtggcatgaattac

SEQ ID NO: 8220040 - DNA, 22 bp, Homo sapiens
cttggcatgcagcaggcactca

SEQ ID NO: 8220041 - DNA, 22 bp, Homo sapiens
cttggcctcttctcagggtggg

SEQ ID NO: 8220042 - DNA, 21 bp, Homo sapiens
cttggcctctagctagagctg

SEQ ID NO: 8220043 - DNA, 22 bp, Homo sapiens
cttgctggggtaagtctgtgct

SEQ ID NO: 8220044 - DNA, 22 bp, Homo sapiens
cttgctggctggcaacctgggc

SEQ ID NO: 8220045 - DNA, 22 bp, Homo sapiens
cttgctggcagtcactgttgcg

SEQ ID NO: 8220046 - DNA, 22 bp, Homo sapiens
cttggcagggtggaggatgcag

SEQ ID NO: 8220047 - DNA, 22 bp, Homo sapiens
cttggcagggtggaggatgcag

SEQ ID NO: 8220048 - DNA, 22 bp, Homo sapiens
cttggcagtttcggaaggatga

SEQ ID NO: 8220049 - DNA, 22 bp, Homo sapiens
cttggcagggtggaggatgcag

SEQ ID NO: 8220050 - DNA, 22 bp, Homo sapiens
cttggcctcttctcagggtggg

SEQ ID NO: 8220051 - DNA, 22 bp, Homo sapiens
cttggcctgacatgtggcaggg

SEQ ID NO: 8220052 - DNA, 22 bp, Homo sapiens
cttggcctgggccgcagccact

SEQ ID NO: 8220053 - DNA, 22 bp, Homo sapiens
cttggcctgcaggcagcagcgc

SEQ ID NO: 8220054 - DNA, 22 bp, Homo sapiens
cttggcctgcaggcagcagcgc

SEQ ID NO: 8220055 - DNA, 22 bp, Homo sapiens
cttggcctgtggctcaagaatt

SEQ ID NO: 8220056 - DNA, 22 bp, Homo sapiens
cttggctccaatcccagctctg

SEQ ID NO: 8220057 - DNA, 22 bp, Homo sapiens
cttggctccttcacagggagat

SEQ ID NO: 8220058 - DNA, 22 bp, Homo sapiens
cttggctctgtgttgatgggac

SEQ ID NO: 8220059 - DNA, 22 bp, Homo sapiens
cttggctccaatcccagctctg

SEQ ID NO: 8220060 - DNA, 22 bp, Homo sapiens
cttggtaaaactgtcttaaatt

SEQ ID NO: 8220061 - DNA, 22 bp, Homo sapiens
cttgggtgttttaaaactagat

SEQ ID NO: 8220062 - DNA, 22 bp, Homo sapiens
cttggtccgagggcgcctaggc

SEQ ID NO: 8220063 - DNA, 22 bp, Homo sapiens
cttggtcagctcgagagtttgt

SEQ ID NO: 8220064 - DNA, 22 bp, Homo sapiens
cttggtcatgcaagatatcgat

SEQ ID NO: 8220065 - DNA, 22 bp, Homo sapiens
cttggtcaggcttttgtaactg

SEQ ID NO: 8220066 - DNA, 22 bp, Homo sapiens
atcttctggtcaaatttttgca

SEQ ID NO: 8220067 - DNA, 22 bp, Homo sapiens
atcttctgggcagtgaaaattg

SEQ ID NO: 8220068 - DNA, 20 bp, Homo sapiens
atcttcttggccagcttgct

SEQ ID NO: 8220069 - DNA, 20 bp, Homo sapiens
atcttcttggccagcttgct

SEQ ID NO: 8220070 - DNA, 22 bp, Homo sapiens
atcttgaaaagcagcatggcct

SEQ ID NO: 8220071 - DNA, 22 bp, Homo sapiens
atcttgaaggttctaccataca

SEQ ID NO: 8220072 - DNA, 22 bp, Homo sapiens
atcttgaaatactttctagaat

SEQ ID NO: 8220073 - DNA, 22 bp, Homo sapiens
atcttccttcactttctcccac

SEQ ID NO: 8220074 - DNA, 22 bp, Homo sapiens
atcttctcaagcagcatcctgt

SEQ ID NO: 8220075 - DNA, 22 bp, Homo sapiens
atcttctcaagcagcatcctgt

SEQ ID NO: 8220076 - DNA, 22 bp, Homo sapiens
atcttctcaagcagcatcctgt

SEQ ID NO: 8220077 - DNA, 22 bp, Homo sapiens
atcttctactttgccaatcagg

SEQ ID NO: 8220078 - DNA, 22 bp, Homo sapiens
atcttctcatgtgtaatgaggt

SEQ ID NO: 8220079 - DNA, 22 bp, Homo sapiens
atcttctcaagcagcatcctgt

SEQ ID NO: 8220080 - DNA, 22 bp, Homo sapiens
cttggtgcccagcaggtggctg

SEQ ID NO: 8220081 - DNA, 22 bp, Homo sapiens
cttggtgccacagcagcttgcg

SEQ ID NO: 8220082 - DNA, 22 bp, Homo sapiens
cttggtcctgcagggtctcttg

SEQ ID NO: 8220083 - DNA, 22 bp, Homo sapiens
cttggtctagtgagtgagcata

SEQ ID NO: 8220084 - DNA, 22 bp, Homo sapiens
cttggtgcattactcaatctgt

SEQ ID NO: 8220085 - DNA, 22 bp, Homo sapiens
cttgtaaatgcagattctgatt

SEQ ID NO: 8220086 - DNA, 19 bp, Homo sapiens
cttgtaaagggctgtttct

SEQ ID NO: 8220087 - DNA, 22 bp, Homo sapiens
cttggtttacctaaacaatagg

SEQ ID NO: 8220088 - DNA, 22 bp, Homo sapiens
cttggtttacctaaacaatagg

SEQ ID NO: 8220089 - DNA, 22 bp, Homo sapiens
cttgtaaactttctaggcctat

SEQ ID NO: 8220090 - DNA, 22 bp, Homo sapiens
cttgtaaaatatccagttaagg

SEQ ID NO: 8220091 - DNA, 22 bp, Homo sapiens
atgaaatggtggttttccattt

SEQ ID NO: 8220092 - DNA, 22 bp, Homo sapiens
atgaaatggtggttttccattt

SEQ ID NO: 8220093 - DNA, 23 bp, Homo sapiens
atgaaatgctggctcagggaggt

SEQ ID NO: 8220094 - DNA, 22 bp, Homo sapiens
atgaaatgctgagaggtgcttc

SEQ ID NO: 8220095 - DNA, 22 bp, Homo sapiens
atgaaatgattgaaatctttac

SEQ ID NO: 8220096 - DNA, 22 bp, Homo sapiens
atgaaatgattgaaatctttac

SEQ ID NO: 8220097 - DNA, 22 bp, Homo sapiens
atgaaatgctattttggctaga

SEQ ID NO: 8220098 - DNA, 22 bp, Homo sapiens
atgaaatgtctggatctttttc

SEQ ID NO: 8220099 - DNA, 22 bp, Homo sapiens
atgaaatgtgaatgcttttcat

SEQ ID NO: 8220100 - DNA, 22 bp, Homo sapiens
atgaaatgtgaatgcttttcat

SEQ ID NO: 8220101 - DNA, 22 bp, Homo sapiens
atgaaatgtctggatctttttc

SEQ ID NO: 8220102 - DNA, 22 bp, Homo sapiens
atgaaatgtattcagatatgta

SEQ ID NO: 8220103 - DNA, 22 bp, Homo sapiens
atgaaatgtatgagtctgggtt

SEQ ID NO: 8220104 - DNA, 22 bp, Homo sapiens
atgaaatgtaagtagagagttt

SEQ ID NO: 8220105 - DNA, 22 bp, Homo sapiens
atgaaatgtatgagtctgggtt

SEQ ID NO: 8220106 - DNA, 22 bp, Homo sapiens
atgaaatgaagttggcctggct

SEQ ID NO: 8220107 - DNA, 23 bp, Homo sapiens
atgaaatgatactttattcactg

SEQ ID NO: 8220108 - DNA, 23 bp, Homo sapiens
atgaaatgatactttattcactg

SEQ ID NO: 8220109 - DNA, 22 bp, Homo sapiens
atgaaatgagtcaatgcgacta

SEQ ID NO: 8220110 - DNA, 22 bp, Homo sapiens
atgaaatgaagttggcctggct

SEQ ID NO: 8220111 - DNA, 22 bp, Homo sapiens
atgaaatgagtcaatgcgacta

SEQ ID NO: 8220112 - DNA, 22 bp, Homo sapiens
atgaaatatcttgaagaaattc

SEQ ID NO: 8220113 - DNA, 22 bp, Homo sapiens
atgaaatatcttgaagaaattc

SEQ ID NO: 8220114 - DNA, 22 bp, Homo sapiens
atgaaatatcttgaagaaattc

SEQ ID NO: 8220115 - DNA, 22 bp, Homo sapiens
atgaaatatcttgaagaaattc

SEQ ID NO: 8220116 - DNA, 22 bp, Homo sapiens
atgaaatatcttgaagaaattc

SEQ ID NO: 8220117 - DNA, 22 bp, Homo sapiens
atgaaatatcttgaagaaattc

SEQ ID NO: 8220118 - DNA, 22 bp, Homo sapiens
atgaaatatcttgaagaaattc

SEQ ID NO: 8220119 - DNA, 22 bp, Homo sapiens
cttttcatgagtctgttatggg

SEQ ID NO: 8220120 - DNA, 22 bp, Homo sapiens
cttttcaggctacattatggga

SEQ ID NO: 8220121 - DNA, 22 bp, Homo sapiens
cttttattttgaattaagggct

SEQ ID NO: 8220122 - DNA, 19 bp, Homo sapiens
cttttcaagccatcagttt

SEQ ID NO: 8220123 - DNA, 22 bp, Homo sapiens
cttttcagagctgagatcaccg

SEQ ID NO: 8220124 - DNA, 22 bp, Homo sapiens
cttttcaggctacattatggga

SEQ ID NO: 8220125 - DNA, 22 bp, Homo sapiens
cttttcagagctgagatcaccg

SEQ ID NO: 8220126 - DNA, 22 bp, Homo sapiens
atgaaattaatcaacacataca

SEQ ID NO: 8220127 - DNA, 22 bp, Homo sapiens
cttttacatttgttgaagagta

SEQ ID NO: 8220128 - DNA, 22 bp, Homo sapiens
cttttacatttgttgaagagta

SEQ ID NO: 8220129 - DNA, 22 bp, Homo sapiens
ctttggtgtcatgtttctgcgg

SEQ ID NO: 8220130 - DNA, 20 bp, Homo sapiens
ctttggtgggggtagcccag

SEQ ID NO: 8220131 - DNA, 22 bp, Homo sapiens
cttttattttgaattaagggct

SEQ ID NO: 8220132 - DNA, 22 bp, Homo sapiens
cttttattttgaattaagggct

SEQ ID NO: 8220133 - DNA, 22 bp, Homo sapiens
cttttactgtgaaaagaaactg

SEQ ID NO: 8220134 - DNA, 22 bp, Homo sapiens
cttttacatttgttgaagagta

SEQ ID NO: 8220135 - DNA, 22 bp, Homo sapiens
cttttattttgaattaagggct

SEQ ID NO: 8220136 - DNA, 22 bp, Homo sapiens
cttttattttgaattaagggct

SEQ ID NO: 8220137 - DNA, 22 bp, Homo sapiens
cttttattttgaattaagggct

SEQ ID NO: 8220138 - DNA, 22 bp, Homo sapiens
cttttattttgaattaagggct

SEQ ID NO: 8220139 - DNA, 22 bp, Homo sapiens
cttttattttgaattaagggct

SEQ ID NO: 8220140 - DNA, 22 bp, Homo sapiens
cttttattttgaattaagggct

SEQ ID NO: 8220141 - DNA, 22 bp, Homo sapiens
atcttgctgctacaaagtgccc

SEQ ID NO: 8220142 - DNA, 22 bp, Homo sapiens
atcttgaatgaatgactcttta

SEQ ID NO: 8220143 - DNA, 22 bp, Homo sapiens
atcttgcatttgctaaaatgca

SEQ ID NO: 8220144 - DNA, 22 bp, Homo sapiens
atcttgccagtctccaaatcaa

SEQ ID NO: 8220145 - DNA, 22 bp, Homo sapiens
atcttgatcaaggctatcatga

SEQ ID NO: 8220146 - DNA, 22 bp, Homo sapiens
atcttgaatgaatgactcttta

SEQ ID NO: 8220147 - DNA, 22 bp, Homo sapiens
atcttttctgtttgctatgtct

SEQ ID NO: 8220148 - DNA, 22 bp, Homo sapiens
atcttttatgagcgttctgaca

SEQ ID NO: 8220149 - DNA, 22 bp, Homo sapiens
atcttttatgagcgttctgaca

SEQ ID NO: 8220150 - DNA, 22 bp, Homo sapiens
atcttttactacaaatcaggtg

SEQ ID NO: 8220151 - DNA, 22 bp, Homo sapiens
atctttgttgctctcatttctg

SEQ ID NO: 8220152 - DNA, 22 bp, Homo sapiens
atcttttacattactgcccaga

SEQ ID NO: 8220153 - DNA, 22 bp, Homo sapiens
atctttgttttgatgcagatct

SEQ ID NO: 8220154 - DNA, 22 bp, Homo sapiens
atcttttctgtttgctatgtct

SEQ ID NO: 8220155 - DNA, 22 bp, Homo sapiens
atctttttactaacactgctta

SEQ ID NO: 8220156 - DNA, 22 bp, Homo sapiens
atctttttgacatggtgatggt

SEQ ID NO: 8220157 - DNA, 22 bp, Homo sapiens
atgaaaacggaccagagctatt

SEQ ID NO: 8220158 - DNA, 22 bp, Homo sapiens
cttgttgttatggctggtggag

SEQ ID NO: 8220159 - DNA, 22 bp, Homo sapiens
cttgtttaaataagatagcagt

SEQ ID NO: 8220160 - DNA, 22 bp, Homo sapiens
cttgttgttatggctggtggag

SEQ ID NO: 8220161 - DNA, 18 bp, Homo sapiens
cttgttcttctcttggcg

SEQ ID NO: 8220162 - DNA, 18 bp, Homo sapiens
cttgttcttctcttggcg

SEQ ID NO: 8220163 - DNA, 18 bp, Homo sapiens
cttgttcttctcttggcg

SEQ ID NO: 8220164 - DNA, 22 bp, Homo sapiens
cttgttctgtgcttcttacatt

SEQ ID NO: 8220165 - DNA, 22 bp, Homo sapiens
cttgttctgtgcttcttacatt

SEQ ID NO: 8220166 - DNA, 23 bp, Homo sapiens
atgaaacatcacaatggtaccat

SEQ ID NO: 8220167 - DNA, 22 bp, Homo sapiens
atgaaatatcttgaagaaattc

SEQ ID NO: 8220168 - DNA, 22 bp, Homo sapiens
atgaaaagggagtgatatttgt

SEQ ID NO: 8220169 - DNA, 22 bp, Homo sapiens
cttgtgtatatatagtaactta

SEQ ID NO: 8220170 - DNA, 22 bp, Homo sapiens
cttgtggccaatgtttgttata

SEQ ID NO: 8220171 - DNA, 22 bp, Homo sapiens
cttgttcagttgcctctcctgc

SEQ ID NO: 8220172 - DNA, 23 bp, Homo sapiens
cttgttataagaagactgtctgg

SEQ ID NO: 8220173 - DNA, 20 bp, Homo sapiens
cttgttaaatatgcaggtag

SEQ ID NO: 8220174 - DNA, 22 bp, Homo sapiens
cttgttaaattatataagcaga

SEQ ID NO: 8220175 - DNA, 22 bp, Homo sapiens
cttgttaaattatataagcaga

SEQ ID NO: 8220176 - DNA, 22 bp, Homo sapiens
cttgtgttgtacattctatggg

SEQ ID NO: 8220177 - DNA, 22 bp, Homo sapiens
cttgtgttgtacattctatggg

SEQ ID NO: 8220178 - DNA, 19 bp, Homo sapiens
atgatacaggtgaaaattg

SEQ ID NO: 8220179 - DNA, 22 bp, Homo sapiens
atgatacaagcaaaactaatca

SEQ ID NO: 8220180 - DNA, 22 bp, Homo sapiens
atgatacaagcaaaactaatca

SEQ ID NO: 8220181 - DNA, 22 bp, Homo sapiens
atgatacaagcaaaactaatca

SEQ ID NO: 8220182 - DNA, 22 bp, Homo sapiens
atgatacaagcaaaactaatca

SEQ ID NO: 8220183 - DNA, 20 bp, Homo sapiens
atgagtttaaacattcagag

SEQ ID NO: 8220184 - DNA, 22 bp, Homo sapiens
atgagttgaagctacaagaggc

SEQ ID NO: 8220185 - DNA, 22 bp, Homo sapiens
atgagttaggggcctgagtgga

SEQ ID NO: 8220186 - DNA, 22 bp, Homo sapiens
atgagttaggggcctgagtgga

SEQ ID NO: 8220187 - DNA, 22 bp, Homo sapiens
atgagtgcctaactgtcagatt

SEQ ID NO: 8220188 - DNA, 22 bp, Homo sapiens
atgagtgatacagcaagctctc

SEQ ID NO: 8220189 - DNA, 22 bp, Homo sapiens
atgagtgatgggtacattggct

SEQ ID NO: 8220190 - DNA, 22 bp, Homo sapiens
atgagtgtttagaaaacactgg

SEQ ID NO: 8220191 - DNA, 22 bp, Homo sapiens
atgagtgtgaagttagctcagt

SEQ ID NO: 8220192 - DNA, 22 bp, Homo sapiens
atgagtgtgaagttagctcagt

SEQ ID NO: 8220193 - DNA, 22 bp, Homo sapiens
atgagtgtacgtgaaagtagat

SEQ ID NO: 8220194 - DNA, 22 bp, Homo sapiens
atgcaaaaactgcacttacgct

SEQ ID NO: 8220195 - DNA, 22 bp, Homo sapiens
atgcaaaagactatttgttgct

SEQ ID NO: 8220196 - DNA, 22 bp, Homo sapiens
atgcaaaagtaactgtgatttt

SEQ ID NO: 8220197 - DNA, 22 bp, Homo sapiens
atgcaaaagtaactgtgatttt

SEQ ID NO: 8220198 - DNA, 20 bp, Homo sapiens
atgattttgcactaacttca

SEQ ID NO: 8220199 - DNA, 20 bp, Homo sapiens
atgattttgcactaacttca

SEQ ID NO: 8220200 - DNA, 22 bp, Homo sapiens
atgatttttcagcagaggatct

SEQ ID NO: 8220201 - DNA, 22 bp, Homo sapiens
atgatttttcagcagaggatct

SEQ ID NO: 8220202 - DNA, 22 bp, Homo sapiens
atgattttttctaacacagtcg

SEQ ID NO: 8220203 - DNA, 20 bp, Homo sapiens
atgattttgcactaacttca

SEQ ID NO: 8220204 - DNA, 22 bp, Homo sapiens
atgattcagcccaatttttcta

SEQ ID NO: 8220205 - DNA, 20 bp, Homo sapiens
atgattttgcactaacttca

SEQ ID NO: 8220206 - DNA, 20 bp, Homo sapiens
atgattttgcactaacttca

SEQ ID NO: 8220207 - DNA, 22 bp, Homo sapiens
atgaggccacagttatagattt

SEQ ID NO: 8220208 - DNA, 22 bp, Homo sapiens
atgaggccaccttctacatttc

SEQ ID NO: 8220209 - DNA, 23 bp, Homo sapiens
atgaggtaaagatcagctttaaa

SEQ ID NO: 8220210 - DNA, 22 bp, Homo sapiens
atgaggccaccttctacatttc

SEQ ID NO: 8220211 - DNA, 22 bp, Homo sapiens
atgagggcagctatgtaagtgt

SEQ ID NO: 8220212 - DNA, 22 bp, Homo sapiens
gaaagcagctaagtcttatgat

SEQ ID NO: 8220213 - DNA, 22 bp, Homo sapiens
gaaagcagtaaatgggtcccat

SEQ ID NO: 8220214 - DNA, 22 bp, Homo sapiens
atgaggtactagtatatacgta

SEQ ID NO: 8220215 - DNA, 22 bp, Homo sapiens
atgaggtatctcatttcctgaa

SEQ ID NO: 8220216 - DNA, 22 bp, Homo sapiens
atgaggtagtattagaaggaga

SEQ ID NO: 8220217 - DNA, 22 bp, Homo sapiens
atgaggtgttcgctggcctttt

SEQ ID NO: 8220218 - DNA, 22 bp, Homo sapiens
atgagtgatacagcaagctctc

SEQ ID NO: 8220219 - DNA, 22 bp, Homo sapiens
atgaggtcacagtgtttggcat

SEQ ID NO: 8220220 - DNA, 23 bp, Homo sapiens
atgaggtcagccataagacggaa

SEQ ID NO: 8220221 - DNA, 22 bp, Homo sapiens
atgaggtcatcttgaagtaggg

SEQ ID NO: 8220222 - DNA, 22 bp, Homo sapiens
atgaggtcatcttgaagtaggg

SEQ ID NO: 8220223 - DNA, 23 bp, Homo sapiens
atgaggtcagccataagacggaa

SEQ ID NO: 8220224 - DNA, 22 bp, Homo sapiens
atgaggtcatcctggagtaagg

SEQ ID NO: 8220225 - DNA, 22 bp, Homo sapiens
atgaggtcacagtgtttggcat

SEQ ID NO: 8220226 - DNA, 22 bp, Homo sapiens
atgaggtattcgtaatatttcc

SEQ ID NO: 8220227 - DNA, 17 bp, Homo sapiens
atgaggtcattaagata

SEQ ID NO: 8220228 - DNA, 22 bp, Homo sapiens
atgaggtcattcttggattaca

SEQ ID NO: 8220229 - DNA, 22 bp, Homo sapiens
atgaggtccagggaagttaaat

SEQ ID NO: 8220230 - DNA, 22 bp, Homo sapiens
atgaggtctggcaatcagaaac

SEQ ID NO: 8220231 - DNA, 22 bp, Homo sapiens
atgaggtcttattgcagtagtt

SEQ ID NO: 8220232 - DNA, 22 bp, Homo sapiens
atgaggtcttattgcagtagtt

SEQ ID NO: 8220233 - DNA, 22 bp, Homo sapiens
atgaggtctggcaatcagaaac

SEQ ID NO: 8220234 - DNA, 17 bp, Homo sapiens
atgaggtcattaagata

SEQ ID NO: 8220235 - DNA, 22 bp, Homo sapiens
atgaggtcatcctggagtaagg

SEQ ID NO: 8220236 - DNA, 22 bp, Homo sapiens
atgaggtcattcttggattaca

SEQ ID NO: 8220237 - DNA, 22 bp, Homo sapiens
atgaggtgatggacatattaac

SEQ ID NO: 8220238 - DNA, 22 bp, Homo sapiens
atgaggtccagggaagttaaat

SEQ ID NO: 8220239 - DNA, 22 bp, Homo sapiens
atgaggtgggagaatcacttga

SEQ ID NO: 8220240 - DNA, 18 bp, Homo sapiens
gaaagatgaacttttttc

SEQ ID NO: 8220241 - DNA, 19 bp, Homo sapiens
gaaagatttcagttgagga

SEQ ID NO: 8220242 - DNA, 22 bp, Homo sapiens
gaaagcaagttgactgcagaat

SEQ ID NO: 8220243 - DNA, 22 bp, Homo sapiens
gaaagcacgatagtagcaaaag

SEQ ID NO: 8220244 - DNA, 22 bp, Homo sapiens
atgaggcagctgctggagaacg

SEQ ID NO: 8220245 - DNA, 22 bp, Homo sapiens
atgaggcaggaaaggcgtatct

SEQ ID NO: 8220246 - DNA, 22 bp, Homo sapiens
atgaggcagctggctttctccc

SEQ ID NO: 8220247 - DNA, 22 bp, Homo sapiens
atgaggcaggagtgcagtggca

SEQ ID NO: 8220248 - DNA, 22 bp, Homo sapiens
atgaggcaggagtgcagtggca

SEQ ID NO: 8220249 - DNA, 22 bp, Homo sapiens
atgaggcaggagcggggaccct

SEQ ID NO: 8220250 - DNA, 22 bp, Homo sapiens
atgaggcagtacacacaaagcc

SEQ ID NO: 8220251 - DNA, 22 bp, Homo sapiens
gaaagatatttattggcaacag

SEQ ID NO: 8220252 - DNA, 22 bp, Homo sapiens
atgaggcagtctggcctgaggg

SEQ ID NO: 8220253 - DNA, 22 bp, Homo sapiens
atgaggcaggattaagctatca

SEQ ID NO: 8220254 - DNA, 22 bp, Homo sapiens
atgaggcaggattaagctatca

SEQ ID NO: 8220255 - DNA, 22 bp, Homo sapiens
atgaggcaggatattaactttt

SEQ ID NO: 8220256 - DNA, 22 bp, Homo sapiens
atgaggcaggtggaggctgcca

SEQ ID NO: 8220257 - DNA, 22 bp, Homo sapiens
atgaggcaggtggaggctgcca

SEQ ID NO: 8220258 - DNA, 22 bp, Homo sapiens
atgaagcagaatttcccactct

SEQ ID NO: 8220259 - DNA, 22 bp, Homo sapiens
atgaagcagaatttcccactct

SEQ ID NO: 8220260 - DNA, 22 bp, Homo sapiens
atgaagcaacagccctcctatt

SEQ ID NO: 8220261 - DNA, 22 bp, Homo sapiens
atgaagatttcccagagacatg

SEQ ID NO: 8220262 - DNA, 22 bp, Homo sapiens
atgaagatttcccagagacatg

SEQ ID NO: 8220263 - DNA, 22 bp, Homo sapiens
atgaagataatagcattggttg

SEQ ID NO: 8220264 - DNA, 22 bp, Homo sapiens
atgaagataagaccaggctgga

SEQ ID NO: 8220265 - DNA, 22 bp, Homo sapiens
atgaagatattcttgttttctg

SEQ ID NO: 8220266 - DNA, 22 bp, Homo sapiens
atgaagatggttcaactggcct

SEQ ID NO: 8220267 - DNA, 22 bp, Homo sapiens
atgaagatgtgaaggctggatt

SEQ ID NO: 8220268 - DNA, 19 bp, Homo sapiens
atgaggaactgaggctcag

SEQ ID NO: 8220269 - DNA, 19 bp, Homo sapiens
atgaggaactgaggctcag

SEQ ID NO: 8220270 - DNA, 22 bp, Homo sapiens
atgaagcagcgttgtagagtga

SEQ ID NO: 8220271 - DNA, 22 bp, Homo sapiens
atgaggcagagggctgtgccag

SEQ ID NO: 8220272 - DNA, 22 bp, Homo sapiens
atgaggcagagggctgtgccag

SEQ ID NO: 8220273 - DNA, 22 bp, Homo sapiens
atgaggcagatgttgcatgagg

SEQ ID NO: 8220274 - DNA, 22 bp, Homo sapiens
atgaggcagatgttgcatgagg

SEQ ID NO: 8220275 - DNA, 22 bp, Homo sapiens
atgaggcagatgttgcatgagg

SEQ ID NO: 8220276 - DNA, 22 bp, Homo sapiens
atgaggcagcacatgggattgt

SEQ ID NO: 8220277 - DNA, 22 bp, Homo sapiens
atgaggcagcacatgggattgt

SEQ ID NO: 8220278 - DNA, 22 bp, Homo sapiens
atgaggcagctgacagctgttc

SEQ ID NO: 8220279 - DNA, 22 bp, Homo sapiens
atgaggcagctgacagctgttc

SEQ ID NO: 8220280 - DNA, 22 bp, Homo sapiens
atgaggcagcccttcccttctc

SEQ ID NO: 8220281 - DNA, 22 bp, Homo sapiens
atgcatgtaacagtgttatgaa

SEQ ID NO: 8220282 - DNA, 22 bp, Homo sapiens
atgcatgtattatctagatgag

SEQ ID NO: 8220283 - DNA, 21 bp, Homo sapiens
atgcatggatttcagtgagag

SEQ ID NO: 8220284 - DNA, 22 bp, Homo sapiens
atgcatggtctgaagtcaacct

SEQ ID NO: 8220285 - DNA, 21 bp, Homo sapiens
atgcatggatttcagtgagag

SEQ ID NO: 8220286 - DNA, 22 bp, Homo sapiens
atgcatgtcagctgtgcccatg

SEQ ID NO: 8220287 - DNA, 22 bp, Homo sapiens
atgcatgtgcatacatgcacag

SEQ ID NO: 8220288 - DNA, 22 bp, Homo sapiens
atgcatgttgcttggcccactc

SEQ ID NO: 8220289 - DNA, 21 bp, Homo sapiens
atgcatgttccataaagtggg

SEQ ID NO: 8220290 - DNA, 22 bp, Homo sapiens
atgcatgtgtgaattatttgac

SEQ ID NO: 8220291 - DNA, 22 bp, Homo sapiens
atgcatgtgtgaattatttgac

SEQ ID NO: 8220292 - DNA, 22 bp, Homo sapiens
atgcatgtgtgtagcatcagca

SEQ ID NO: 8220293 - DNA, 22 bp, Homo sapiens
atgcatgttaagctcttaaaat

SEQ ID NO: 8220294 - DNA, 22 bp, Homo sapiens
atgcatgttaagcctgactgga

SEQ ID NO: 8220295 - DNA, 22 bp, Homo sapiens
atgcatttatgtgtgtacattg

SEQ ID NO: 8220296 - DNA, 22 bp, Homo sapiens
atgcatttatgtgtgtacattg

SEQ ID NO: 8220297 - DNA, 22 bp, Homo sapiens
atgcatttatgtgtgtacattg

SEQ ID NO: 8220298 - DNA, 22 bp, Homo sapiens
atgcatttatgtgtgtacattg

SEQ ID NO: 8220299 - DNA, 22 bp, Homo sapiens
atgcatttatgtgtgtacattg

SEQ ID NO: 8220300 - DNA, 22 bp, Homo sapiens
atgcattgtctggtttcatttt

SEQ ID NO: 8220301 - DNA, 20 bp, Homo sapiens
atgcattgtgattctgtttt

SEQ ID NO: 8220302 - DNA, 19 bp, Homo sapiens
atgcattgtttgaagttga

SEQ ID NO: 8220303 - DNA, 22 bp, Homo sapiens
atgcattgaggatgacatgagt

SEQ ID NO: 8220304 - DNA, 22 bp, Homo sapiens
atgcattgctcaacagaataca

SEQ ID NO: 8220305 - DNA, 22 bp, Homo sapiens
atgcattgctgctttcaaaaca

SEQ ID NO: 8220306 - DNA, 22 bp, Homo sapiens
atgcattgcttgagggtaggaa

SEQ ID NO: 8220307 - DNA, 22 bp, Homo sapiens
atgcattgtaacgatgtgcaca

SEQ ID NO: 8220308 - DNA, 22 bp, Homo sapiens
atgcattggataagaaccccat

SEQ ID NO: 8220309 - DNA, 22 bp, Homo sapiens
atgcattggtcagggtcttagg

SEQ ID NO: 8220310 - DNA, 22 bp, Homo sapiens
atgcattgtctggtttcatttt

SEQ ID NO: 8220311 - DNA, 22 bp, Homo sapiens
atgcattgtcaggcaatttcat

SEQ ID NO: 8220312 - DNA, 22 bp, Homo sapiens
atgcattgtatgaaaggaaata

SEQ ID NO: 8220313 - DNA, 22 bp, Homo sapiens
atgcattgtcaggcaatttcat

SEQ ID NO: 8220314 - DNA, 22 bp, Homo sapiens
atgcattgtaacgatgtgcaca

SEQ ID NO: 8220315 - DNA, 22 bp, Homo sapiens
atgcagctgacattttcatgtt

SEQ ID NO: 8220316 - DNA, 22 bp, Homo sapiens
atgcagctcatttgtttaaaag

SEQ ID NO: 8220317 - DNA, 22 bp, Homo sapiens
atgcagctatttgagcatgtca

SEQ ID NO: 8220318 - DNA, 22 bp, Homo sapiens
atgcagctgctgacagctttca

SEQ ID NO: 8220319 - DNA, 23 bp, Homo sapiens
atgcaggacttataaggtaaggt

SEQ ID NO: 8220320 - DNA, 22 bp, Homo sapiens
atgcatatgccgtagaataagt

SEQ ID NO: 8220321 - DNA, 20 bp, Homo sapiens
atgcatctggtatctttcct

SEQ ID NO: 8220322 - DNA, 22 bp, Homo sapiens
atgcatctgtagtgttatatga

SEQ ID NO: 8220323 - DNA, 19 bp, Homo sapiens
atgcatctgcattgacagg

SEQ ID NO: 8220324 - DNA, 22 bp, Homo sapiens
atgcatgcacacactgcattgc

SEQ ID NO: 8220325 - DNA, 20 bp, Homo sapiens
atgcatgcatgcacatgcac

SEQ ID NO: 8220326 - DNA, 22 bp, Homo sapiens
atgcatgaaagaatccaagcct

SEQ ID NO: 8220327 - DNA, 22 bp, Homo sapiens
atgcatgagaatatcccatgct

SEQ ID NO: 8220328 - DNA, 22 bp, Homo sapiens
atgcatcttttcaaggtatttc

SEQ ID NO: 8220329 - DNA, 22 bp, Homo sapiens
atgcatgcaagtgcacatatgc

SEQ ID NO: 8220330 - DNA, 22 bp, Homo sapiens
atgcatgatcctgagcaaccca

SEQ ID NO: 8220331 - DNA, 22 bp, Homo sapiens
atgcatgatgaacttgctttca

SEQ ID NO: 8220332 - DNA, 22 bp, Homo sapiens
atgcatgagctttgtgatcctg

SEQ ID NO: 8220333 - DNA, 22 bp, Homo sapiens
atgcatgagtcactcagtgcag

SEQ ID NO: 8220334 - DNA, 22 bp, Homo sapiens
atgcagatctgtgaaaggaata

SEQ ID NO: 8220335 - DNA, 22 bp, Homo sapiens
atgcagatttctttgctgcacc

SEQ ID NO: 8220336 - DNA, 22 bp, Homo sapiens
atgcagaattgctaagtatctg

SEQ ID NO: 8220337 - DNA, 22 bp, Homo sapiens
atgcagaattgctaagtatctg

SEQ ID NO: 8220338 - DNA, 22 bp, Homo sapiens
atgcagagacagatgtggcatg

SEQ ID NO: 8220339 - DNA, 22 bp, Homo sapiens
atgcacagtatgtagggtctat

SEQ ID NO: 8220340 - DNA, 22 bp, Homo sapiens
atgcacttaaataacataactt

SEQ ID NO: 8220341 - DNA, 22 bp, Homo sapiens
atgcacttcaagcatctctctg

SEQ ID NO: 8220342 - DNA, 22 bp, Homo sapiens
atgcacttcaagcatctctctg

SEQ ID NO: 8220343 - DNA, 22 bp, Homo sapiens
atgcagaagaaaccatggcttc

SEQ ID NO: 8220344 - DNA, 22 bp, Homo sapiens
atgcagaaagagaatgtaatgt

SEQ ID NO: 8220345 - DNA, 22 bp, Homo sapiens
atgcacttgcgtgtttgcaaat

SEQ ID NO: 8220346 - DNA, 22 bp, Homo sapiens
atgcactttctagagattctga

SEQ ID NO: 8220347 - DNA, 22 bp, Homo sapiens
atgcactttgtaatctgttcaa

SEQ ID NO: 8220348 - DNA, 22 bp, Homo sapiens
atgcagaatcttgagaaaaatt

SEQ ID NO: 8220349 - DNA, 22 bp, Homo sapiens
atgcagaaggagccatgcttgc

SEQ ID NO: 8220350 - DNA, 20 bp, Homo sapiens
atgcaaatcccaaaatcagg

SEQ ID NO: 8220351 - DNA, 22 bp, Homo sapiens
atgcacagtacaaactggaaac

SEQ ID NO: 8220352 - DNA, 22 bp, Homo sapiens
atgcaaatcttaagtatgtgtg

SEQ ID NO: 8220353 - DNA, 23 bp, Homo sapiens
atgcaaagtgctgtcatgtagac

SEQ ID NO: 8220354 - DNA, 22 bp, Homo sapiens
atgcaaagcaccacactaagat

SEQ ID NO: 8220355 - DNA, 22 bp, Homo sapiens
atgcaaataaagcaactataca

SEQ ID NO: 8220356 - DNA, 22 bp, Homo sapiens
atgcaaaagtagttgcagtttt

SEQ ID NO: 8220357 - DNA, 22 bp, Homo sapiens
atgcaaaataaggcagaaacat

SEQ ID NO: 8220358 - DNA, 22 bp, Homo sapiens
atgcaaaataaggcagaaacat

SEQ ID NO: 8220359 - DNA, 22 bp, Homo sapiens
atgcaaaagtaattgcaatttt

SEQ ID NO: 8220360 - DNA, 22 bp, Homo sapiens
atgcaaaagtaattgcaatttt

SEQ ID NO: 8220361 - DNA, 22 bp, Homo sapiens
atgcaaaagtaattgcaatttt

SEQ ID NO: 8220362 - DNA, 22 bp, Homo sapiens
atgcaaaagtaattgcaatttt

SEQ ID NO: 8220363 - DNA, 20 bp, Homo sapiens
atgcaaactcacaaaatacc

SEQ ID NO: 8220364 - DNA, 22 bp, Homo sapiens
atgcaaacatgtttcctctaag

SEQ ID NO: 8220365 - DNA, 22 bp, Homo sapiens
atgcaaacattcgcttgtctct

SEQ ID NO: 8220366 - DNA, 22 bp, Homo sapiens
atgcaaacatgaagagaaagag

SEQ ID NO: 8220367 - DNA, 22 bp, Homo sapiens
atgcaaaataaggcagaaacat

SEQ ID NO: 8220368 - DNA, 22 bp, Homo sapiens
atgcaaaattaccattctgttc

SEQ ID NO: 8220369 - DNA, 22 bp, Homo sapiens
atgcaaaattaccattctgttc

SEQ ID NO: 8220370 - DNA, 22 bp, Homo sapiens
atgcaaaattaccattctgttc

SEQ ID NO: 8220371 - DNA, 22 bp, Homo sapiens
atggagagagaaggcttgctgt

SEQ ID NO: 8220372 - DNA, 22 bp, Homo sapiens
atggagagagaaggcttgctgt

SEQ ID NO: 8220373 - DNA, 22 bp, Homo sapiens
atggagagagaaggcttgctgt

SEQ ID NO: 8220374 - DNA, 22 bp, Homo sapiens
atggagagtgaaagtctctcta

SEQ ID NO: 8220375 - DNA, 22 bp, Homo sapiens
atggagagtgaaagtctctcta

SEQ ID NO: 8220376 - DNA, 22 bp, Homo sapiens
atggagcaaatggggctgcagg

SEQ ID NO: 8220377 - DNA, 22 bp, Homo sapiens
atggagagttcacttctaagtt

SEQ ID NO: 8220378 - DNA, 22 bp, Homo sapiens
atggagagttcacttctaagtt

SEQ ID NO: 8220379 - DNA, 22 bp, Homo sapiens
atggagagtgaaagtctctcta

SEQ ID NO: 8220380 - DNA, 22 bp, Homo sapiens
atggagctgtagggagcagtgg

SEQ ID NO: 8220381 - DNA, 22 bp, Homo sapiens
atggagctgtagggagcagtgg

SEQ ID NO: 8220382 - DNA, 22 bp, Homo sapiens
atggagccattcctgaagactt

SEQ ID NO: 8220383 - DNA, 22 bp, Homo sapiens
atggagcagcagaaggggcttg

SEQ ID NO: 8220384 - DNA, 22 bp, Homo sapiens
atggagctctgatatatcaatt

SEQ ID NO: 8220385 - DNA, 21 bp, Homo sapiens
atggagcctaagagtggaggt

SEQ ID NO: 8220386 - DNA, 22 bp, Homo sapiens
gagaaatgagtgattcactttt

SEQ ID NO: 8220387 - DNA, 22 bp, Homo sapiens
gagaaataggcaatggtatcta

SEQ ID NO: 8220388 - DNA, 22 bp, Homo sapiens
gagaaatgcatgcatgtcatca

SEQ ID NO: 8220389 - DNA, 22 bp, Homo sapiens
gagaacacatgcagactgggta

SEQ ID NO: 8220390 - DNA, 18 bp, Homo sapiens
gagaaagtttgggcagaa

SEQ ID NO: 8220391 - DNA, 22 bp, Homo sapiens
gagaaatatggctcagttccac

SEQ ID NO: 8220392 - DNA, 18 bp, Homo sapiens
gagaaagtttgggcagaa

SEQ ID NO: 8220393 - DNA, 18 bp, Homo sapiens
gagaaagtttgggcagaa

SEQ ID NO: 8220394 - DNA, 22 bp, Homo sapiens
atggactgggaggtcatcttct

SEQ ID NO: 8220395 - DNA, 22 bp, Homo sapiens
atggactagccataagagaact

SEQ ID NO: 8220396 - DNA, 22 bp, Homo sapiens
atggaataattgtttcacagaa

SEQ ID NO: 8220397 - DNA, 22 bp, Homo sapiens
atggaataattgtttcacagaa

SEQ ID NO: 8220398 - DNA, 22 bp, Homo sapiens
atggaagttggaaccattcata

SEQ ID NO: 8220399 - DNA, 22 bp, Homo sapiens
atggaatatagtcttatatctc

SEQ ID NO: 8220400 - DNA, 22 bp, Homo sapiens
atggaatatagtcttatatctc

SEQ ID NO: 8220401 - DNA, 22 bp, Homo sapiens
atggaatgcggtagtatgtgca

SEQ ID NO: 8220402 - DNA, 22 bp, Homo sapiens
atggaatgccaagttcactgct

SEQ ID NO: 8220403 - DNA, 22 bp, Homo sapiens
atggaatatttgacacataggg

SEQ ID NO: 8220404 - DNA, 22 bp, Homo sapiens
atggaatgggaagagtgtgtga

SEQ ID NO: 8220405 - DNA, 22 bp, Homo sapiens
atggaagacagataaggcagaa

SEQ ID NO: 8220406 - DNA, 22 bp, Homo sapiens
atggaagacagataaggcagaa

SEQ ID NO: 8220407 - DNA, 22 bp, Homo sapiens
atggaagactaacagaaacatg

SEQ ID NO: 8220408 - DNA, 22 bp, Homo sapiens
atggaagactaacagaaacatg

SEQ ID NO: 8220409 - DNA, 22 bp, Homo sapiens
atggaagactaacagaaacatg

SEQ ID NO: 8220410 - DNA, 22 bp, Homo sapiens
atggaagagtccccatggatga

SEQ ID NO: 8220411 - DNA, 19 bp, Homo sapiens
atggaagctgggatcaatg

SEQ ID NO: 8220412 - DNA, 20 bp, Homo sapiens
atggaagctgctcttctcct

SEQ ID NO: 8220413 - DNA, 22 bp, Homo sapiens
atggaagctgaaaaagacacgg

SEQ ID NO: 8220414 - DNA, 22 bp, Homo sapiens
atggaagcagaccggaggaata

SEQ ID NO: 8220415 - DNA, 22 bp, Homo sapiens
atggaagcagacaggtaattcc

SEQ ID NO: 8220416 - DNA, 22 bp, Homo sapiens
atggaagctgaaaaagacacgg

SEQ ID NO: 8220417 - DNA, 22 bp, Homo sapiens
atggaagggacagaagggcaag

SEQ ID NO: 8220418 - DNA, 22 bp, Homo sapiens
atggaaggctttatgactcaaa

SEQ ID NO: 8220419 - DNA, 22 bp, Homo sapiens
atgccacttcattccagcctcg

SEQ ID NO: 8220420 - DNA, 22 bp, Homo sapiens
atgccacttcattccagcctcg

SEQ ID NO: 8220421 - DNA, 22 bp, Homo sapiens
atgccacttcattccagcctcg

SEQ ID NO: 8220422 - DNA, 22 bp, Homo sapiens
atggaaaaggctgatttcatta

SEQ ID NO: 8220423 - DNA, 22 bp, Homo sapiens
atgccacttcattccagcctcg

SEQ ID NO: 8220424 - DNA, 22 bp, Homo sapiens
atgccactgcgctctagcctgg

SEQ ID NO: 8220425 - DNA, 22 bp, Homo sapiens
atgccactgcgctctagcctgg

SEQ ID NO: 8220426 - DNA, 22 bp, Homo sapiens
atgccactgcgctctagcctgg

SEQ ID NO: 8220427 - DNA, 22 bp, Homo sapiens
atgccactgcgctccagcctgg

SEQ ID NO: 8220428 - DNA, 22 bp, Homo sapiens
atgccactgcgctctagcctgg

SEQ ID NO: 8220429 - DNA, 22 bp, Homo sapiens
atgccactgcgctctagcctgg

SEQ ID NO: 8220430 - DNA, 22 bp, Homo sapiens
atgccactgcgctctagcctgg

SEQ ID NO: 8220431 - DNA, 22 bp, Homo sapiens
atggaactgctaataatagttg

SEQ ID NO: 8220432 - DNA, 22 bp, Homo sapiens
atggaaatggagtgtgcttgct

SEQ ID NO: 8220433 - DNA, 22 bp, Homo sapiens
atggaaatgttccatatattga

SEQ ID NO: 8220434 - DNA, 22 bp, Homo sapiens
atggaaattaagatttgtctca

SEQ ID NO: 8220435 - DNA, 22 bp, Homo sapiens
atggaaatgttccatatattga

SEQ ID NO: 8220436 - DNA, 22 bp, Homo sapiens
atgccactgcgctccagcctgg

SEQ ID NO: 8220437 - DNA, 22 bp, Homo sapiens
atgccactgcgctccagcctgg

SEQ ID NO: 8220438 - DNA, 22 bp, Homo sapiens
atgccactgcacttcagcttgg

SEQ ID NO: 8220439 - DNA, 22 bp, Homo sapiens
atgccactgcacttcagcttgg

SEQ ID NO: 8220440 - DNA, 22 bp, Homo sapiens
atgccactgcgctccagcctgg

SEQ ID NO: 8220441 - DNA, 22 bp, Homo sapiens
atgccactgcgctccagcctgg

SEQ ID NO: 8220442 - DNA, 22 bp, Homo sapiens
atgccactgcgctccagcctgg

SEQ ID NO: 8220443 - DNA, 22 bp, Homo sapiens
atgccactgcgctccagcctgg

SEQ ID NO: 8220444 - DNA, 22 bp, Homo sapiens
atgccactgcgctccagcctgg

SEQ ID NO: 8220445 - DNA, 22 bp, Homo sapiens
gacagatgtgggtgacagcagc

SEQ ID NO: 8220446 - DNA, 22 bp, Homo sapiens
gacagcaaagcagagccaaggc

SEQ ID NO: 8220447 - DNA, 22 bp, Homo sapiens
atgccactgcacttcagcttgg

SEQ ID NO: 8220448 - DNA, 22 bp, Homo sapiens
atgccactgcacttcagcttgg

SEQ ID NO: 8220449 - DNA, 22 bp, Homo sapiens
gacagagtgcagggctagaaga

SEQ ID NO: 8220450 - DNA, 22 bp, Homo sapiens
gacagagttgttgatgtatgct

SEQ ID NO: 8220451 - DNA, 23 bp, Homo sapiens
gacagagtgagaccttgtcttac

SEQ ID NO: 8220452 - DNA, 23 bp, Homo sapiens
gacagagtgagaccttgtcttac

SEQ ID NO: 8220453 - DNA, 23 bp, Homo sapiens
gacagagtgagaccttgtcttac

SEQ ID NO: 8220454 - DNA, 23 bp, Homo sapiens
gacagagtgagaccttgtcttac

SEQ ID NO: 8220455 - DNA, 23 bp, Homo sapiens
gacagagtgagaccttgtcttac

SEQ ID NO: 8220456 - DNA, 23 bp, Homo sapiens
gacagagtgagaccttgtcttac

SEQ ID NO: 8220457 - DNA, 22 bp, Homo sapiens
gacagaggcaagaccagaagcc

SEQ ID NO: 8220458 - DNA, 22 bp, Homo sapiens
gacagaggctggagcacctcct

SEQ ID NO: 8220459 - DNA, 22 bp, Homo sapiens
atggccagatgaaataatagag

SEQ ID NO: 8220460 - DNA, 22 bp, Homo sapiens
atggccagcaaggtagggcaat

SEQ ID NO: 8220461 - DNA, 22 bp, Homo sapiens
atggccagcaaggtagggcaat

SEQ ID NO: 8220462 - DNA, 22 bp, Homo sapiens
atggccagattatatggttttt

SEQ ID NO: 8220463 - DNA, 22 bp, Homo sapiens
atggccagtctattcatggtta

SEQ ID NO: 8220464 - DNA, 22 bp, Homo sapiens
atggccagtctattcatggtta

SEQ ID NO: 8220465 - DNA, 22 bp, Homo sapiens
atggccagtcaagcctctggct

SEQ ID NO: 8220466 - DNA, 22 bp, Homo sapiens
atggccagtctgttggacagca

SEQ ID NO: 8220467 - DNA, 22 bp, Homo sapiens
atggccagtctgactagtttcc

SEQ ID NO: 8220468 - DNA, 22 bp, Homo sapiens
gagaggaagccagggggtgttg

SEQ ID NO: 8220469 - DNA, 22 bp, Homo sapiens
gagaggaagccagggggtgttg

SEQ ID NO: 8220470 - DNA, 22 bp, Homo sapiens
gagaggaactcccagtgcctgg

SEQ ID NO: 8220471 - DNA, 22 bp, Homo sapiens
gagaggaactcccagtgcctgg

SEQ ID NO: 8220472 - DNA, 22 bp, Homo sapiens
gagaggaaagatatatacttct

SEQ ID NO: 8220473 - DNA, 22 bp, Homo sapiens
gagaggaaagatatatacttct

SEQ ID NO: 8220474 - DNA, 22 bp, Homo sapiens
gagaggaaagatatatacttct

SEQ ID NO: 8220475 - DNA, 22 bp, Homo sapiens
gagaggaaagaaccaatgaccc

SEQ ID NO: 8220476 - DNA, 22 bp, Homo sapiens
gagaggaaagaaccaatgaccc

SEQ ID NO: 8220477 - DNA, 22 bp, Homo sapiens
gagagctttcatgttgggaatg

SEQ ID NO: 8220478 - DNA, 22 bp, Homo sapiens
gagagctgtgttcattctacca

SEQ ID NO: 8220479 - DNA, 22 bp, Homo sapiens
gagagctgtggtttgaccaggc

SEQ ID NO: 8220480 - DNA, 22 bp, Homo sapiens
gagagctgtggtttgaccaggc

SEQ ID NO: 8220481 - DNA, 22 bp, Homo sapiens
gagagctgtggtttgaccaggc

SEQ ID NO: 8220482 - DNA, 22 bp, Homo sapiens
gagagctgtggtttgaccaggc

SEQ ID NO: 8220483 - DNA, 22 bp, Homo sapiens
gagagctgtggtttgaccaggc

SEQ ID NO: 8220484 - DNA, 22 bp, Homo sapiens
gagagctgtccggctgagcagc

SEQ ID NO: 8220485 - DNA, 22 bp, Homo sapiens
gagagctgtccggctgagcagc

SEQ ID NO: 8220486 - DNA, 22 bp, Homo sapiens
gagagctgtccggctgagcagc

SEQ ID NO: 8220487 - DNA, 22 bp, Homo sapiens
atggcagtttcactctgggatt

SEQ ID NO: 8220488 - DNA, 22 bp, Homo sapiens
atggcagagggattgaacagct

SEQ ID NO: 8220489 - DNA, 22 bp, Homo sapiens
gagaacagatttttctgctgtc

SEQ ID NO: 8220490 - DNA, 23 bp, Homo sapiens
gagaacagccacagagagctgtg

SEQ ID NO: 8220491 - DNA, 22 bp, Homo sapiens
gagaacagatttttctgctgtc

SEQ ID NO: 8220492 - DNA, 22 bp, Homo sapiens
atggcaggcccaggtgttcatt

SEQ ID NO: 8220493 - DNA, 22 bp, Homo sapiens
atggcaggatgagacaacaatt

SEQ ID NO: 8220494 - DNA, 22 bp, Homo sapiens
atggcaggatgagacaacaatt

SEQ ID NO: 8220495 - DNA, 22 bp, Homo sapiens
atggcagggaccaagctgtcat

SEQ ID NO: 8220496 - DNA, 22 bp, Homo sapiens
atggcagggaccaagctgtcat

SEQ ID NO: 8220497 - DNA, 22 bp, Homo sapiens
atggcaggcccaggtgttcatt

SEQ ID NO: 8220498 - DNA, 22 bp, Homo sapiens
atggcaggatacccagtccggc

SEQ ID NO: 8220499 - DNA, 22 bp, Homo sapiens
atggcaggatacccagtccggc

SEQ ID NO: 8220500 - DNA, 22 bp, Homo sapiens
atggcagctggcttgggcacct

SEQ ID NO: 8220501 - DNA, 22 bp, Homo sapiens
atggcagctggcttgggcacct

SEQ ID NO: 8220502 - DNA, 22 bp, Homo sapiens
atggcagctttgaatttcttga

SEQ ID NO: 8220503 - DNA, 22 bp, Homo sapiens
atggcagctttcattgtccaca

SEQ ID NO: 8220504 - DNA, 22 bp, Homo sapiens
atggcagctttcattgtccaca

SEQ ID NO: 8220505 - DNA, 22 bp, Homo sapiens
atggcagtgataggctagtgat

SEQ ID NO: 8220506 - DNA, 22 bp, Homo sapiens
atggcagtgacttgaagggtag

SEQ ID NO: 8220507 - DNA, 22 bp, Homo sapiens
atggcagggtctgtcttcagct

SEQ ID NO: 8220508 - DNA, 22 bp, Homo sapiens
atggcagggtctgtcttcagct

SEQ ID NO: 8220509 - DNA, 22 bp, Homo sapiens
atggcagggtctgtcttcagct

SEQ ID NO: 8220510 - DNA, 22 bp, Homo sapiens
atggcagggcagcctctcagag

SEQ ID NO: 8220511 - DNA, 22 bp, Homo sapiens
atggcagggcccttggctccca

SEQ ID NO: 8220512 - DNA, 22 bp, Homo sapiens
atggcagggcccttggctccca

SEQ ID NO: 8220513 - DNA, 22 bp, Homo sapiens
atggcagggcccttggctccca

SEQ ID NO: 8220514 - DNA, 22 bp, Homo sapiens
atggcagggcagcctctcagag

SEQ ID NO: 8220515 - DNA, 22 bp, Homo sapiens
atggcagggcacagctctagtt

SEQ ID NO: 8220516 - DNA, 22 bp, Homo sapiens
atggcagggcacagctctagtt

SEQ ID NO: 8220517 - DNA, 22 bp, Homo sapiens
atggcagggcacagctctagtt

SEQ ID NO: 8220518 - DNA, 22 bp, Homo sapiens
atggcagggcacagctctagtt

SEQ ID NO: 8220519 - DNA, 22 bp, Homo sapiens
atggcagggcacagctctagtt

SEQ ID NO: 8220520 - DNA, 22 bp, Homo sapiens
atggcagggactgtggcccttg

SEQ ID NO: 8220521 - DNA, 22 bp, Homo sapiens
atggcagggactgtggcccttg

SEQ ID NO: 8220522 - DNA, 22 bp, Homo sapiens
atggcagggactgtggcccttg

SEQ ID NO: 8220523 - DNA, 22 bp, Homo sapiens
gagccagctacatggtctgcaa

SEQ ID NO: 8220524 - DNA, 22 bp, Homo sapiens
gagccagcgccttgcctctggg

SEQ ID NO: 8220525 - DNA, 22 bp, Homo sapiens
gagccagctgagctgcactgtc

SEQ ID NO: 8220526 - DNA, 22 bp, Homo sapiens
gagccagctgagctgcactgtc

SEQ ID NO: 8220527 - DNA, 22 bp, Homo sapiens
gagccagctatgtagcaagagg

SEQ ID NO: 8220528 - DNA, 22 bp, Homo sapiens
gagccagctatgtagcaagagg

SEQ ID NO: 8220529 - DNA, 22 bp, Homo sapiens
gagccaggaggcagagactgca

SEQ ID NO: 8220530 - DNA, 22 bp, Homo sapiens
gagccaggaggcagagactgca

SEQ ID NO: 8220531 - DNA, 22 bp, Homo sapiens
gagccaggaggcagagactgca

SEQ ID NO: 8220532 - DNA, 22 bp, Homo sapiens
gagccaggaagaaggccttact

SEQ ID NO: 8220533 - DNA, 22 bp, Homo sapiens
gagccaggaagaaggccttact

SEQ ID NO: 8220534 - DNA, 22 bp, Homo sapiens
gagccaggaagaaggccttact

SEQ ID NO: 8220535 - DNA, 22 bp, Homo sapiens
gagccaggagatacctaagggg

SEQ ID NO: 8220536 - DNA, 22 bp, Homo sapiens
gagccaggagatacctaagggg

SEQ ID NO: 8220537 - DNA, 22 bp, Homo sapiens
gagccaggagatacctaagggg

SEQ ID NO: 8220538 - DNA, 22 bp, Homo sapiens
atggctgcttcagtaccagttc

SEQ ID NO: 8220539 - DNA, 22 bp, Homo sapiens
atggctgcttacaaaaactgtg

SEQ ID NO: 8220540 - DNA, 22 bp, Homo sapiens
atggctgctgccttcccctgct

SEQ ID NO: 8220541 - DNA, 19 bp, Homo sapiens
atggctgctgattggggat

SEQ ID NO: 8220542 - DNA, 22 bp, Homo sapiens
atggctgctttcccttagcacc

SEQ ID NO: 8220543 - DNA, 22 bp, Homo sapiens
atggctggaagagtcgaagagt

SEQ ID NO: 8220544 - DNA, 22 bp, Homo sapiens
atggctggaagagtcgaagagt

SEQ ID NO: 8220545 - DNA, 19 bp, Homo sapiens
atggctgctgattggggat

SEQ ID NO: 8220546 - DNA, 22 bp, Homo sapiens
atggctgctctggatggagtcc

SEQ ID NO: 8220547 - DNA, 22 bp, Homo sapiens
atggctgccttaattcttcagc

SEQ ID NO: 8220548 - DNA, 22 bp, Homo sapiens
atggctgcctagaggtgagatg

SEQ ID NO: 8220549 - DNA, 22 bp, Homo sapiens
atggctgcctgggcgctggccg

SEQ ID NO: 8220550 - DNA, 22 bp, Homo sapiens
atggctgcctagaggtgagatg

SEQ ID NO: 8220551 - DNA, 22 bp, Homo sapiens
atggctgcctgggcgctggccg

SEQ ID NO: 8220552 - DNA, 22 bp, Homo sapiens
gagccaggcccgtacttgctgt

SEQ ID NO: 8220553 - DNA, 22 bp, Homo sapiens
gagccaggcaccttctgtgttg

SEQ ID NO: 8220554 - DNA, 22 bp, Homo sapiens
gagccaggcaccttctgtgttg

SEQ ID NO: 8220555 - DNA, 22 bp, Homo sapiens
atggctgcccacgttggtgctt

SEQ ID NO: 8220556 - DNA, 22 bp, Homo sapiens
gagccagggctgtgagctgagc

SEQ ID NO: 8220557 - DNA, 22 bp, Homo sapiens
atggctgcccacgttggtgctt

SEQ ID NO: 8220558 - DNA, 22 bp, Homo sapiens
atggctgccccaaattgttgct

SEQ ID NO: 8220559 - DNA, 22 bp, Homo sapiens
gagccagggagggtctggtata

SEQ ID NO: 8220560 - DNA, 22 bp, Homo sapiens
gagccagggagggtctggtata

SEQ ID NO: 8220561 - DNA, 22 bp, Homo sapiens
gagccagccttcttctgaggtc

SEQ ID NO: 8220562 - DNA, 22 bp, Homo sapiens
gagccagcctccgcctctctcc

SEQ ID NO: 8220563 - DNA, 22 bp, Homo sapiens
gagcagtgactggagcatgaga

SEQ ID NO: 8220564 - DNA, 22 bp, Homo sapiens
gagcagtgactggagcatgaga

SEQ ID NO: 8220565 - DNA, 22 bp, Homo sapiens
gagcagtgactggagcatgaga

SEQ ID NO: 8220566 - DNA, 22 bp, Homo sapiens
atggccctatcacctttgcttc

SEQ ID NO: 8220567 - DNA, 22 bp, Homo sapiens
atggccctaatgagttggtgtt

SEQ ID NO: 8220568 - DNA, 22 bp, Homo sapiens
atggccctgaccttgatgacct

SEQ ID NO: 8220569 - DNA, 22 bp, Homo sapiens
atggccctctccttaggtcagc

SEQ ID NO: 8220570 - DNA, 22 bp, Homo sapiens
atggccctcagtccttccttgg

SEQ ID NO: 8220571 - DNA, 22 bp, Homo sapiens
atggccctgccaggaggaacaa

SEQ ID NO: 8220572 - DNA, 22 bp, Homo sapiens
atggccctgctggtttgatcgt

SEQ ID NO: 8220573 - DNA, 22 bp, Homo sapiens
atggccctgctaccacttttct

SEQ ID NO: 8220574 - DNA, 22 bp, Homo sapiens
atggccctggcccagaccccac

SEQ ID NO: 8220575 - DNA, 22 bp, Homo sapiens
atggccctggaaagagcttgag

SEQ ID NO: 8220576 - DNA, 22 bp, Homo sapiens
atggccagtgttgagatcaggc

SEQ ID NO: 8220577 - DNA, 22 bp, Homo sapiens
atggccagtgttgagatcaggc

SEQ ID NO: 8220578 - DNA, 22 bp, Homo sapiens
atggccagtgttgagatcaggc

SEQ ID NO: 8220579 - DNA, 22 bp, Homo sapiens
atggccagtctgttggacagca

SEQ ID NO: 8220580 - DNA, 22 bp, Homo sapiens
atggccagtctgttggacagca

SEQ ID NO: 8220581 - DNA, 19 bp, Homo sapiens
atggccagtttagaggttt

SEQ ID NO: 8220582 - DNA, 19 bp, Homo sapiens
atggccagtttagaggttt

SEQ ID NO: 8220583 - DNA, 22 bp, Homo sapiens
atggccagttagaaatcaaaaa

SEQ ID NO: 8220584 - DNA, 22 bp, Homo sapiens
atggccagtgtttccctcagtt

SEQ ID NO: 8220585 - DNA, 22 bp, Homo sapiens
atggccagtgtttccctcagtt

SEQ ID NO: 8220586 - DNA, 22 bp, Homo sapiens
atggccagtgtttccctcagtt

SEQ ID NO: 8220587 - DNA, 22 bp, Homo sapiens
atgtctttaaacttgagttgtt

SEQ ID NO: 8220588 - DNA, 22 bp, Homo sapiens
atgtctttataaatgtataatg

SEQ ID NO: 8220589 - DNA, 22 bp, Homo sapiens
atgtctttcaaattctgcctag

SEQ ID NO: 8220590 - DNA, 19 bp, Homo sapiens
atgtctgggtaacagctgc

SEQ ID NO: 8220591 - DNA, 22 bp, Homo sapiens
gaggcctgggttacctactcgt

SEQ ID NO: 8220592 - DNA, 22 bp, Homo sapiens
gaggcctgggttacctactcgt

SEQ ID NO: 8220593 - DNA, 22 bp, Homo sapiens
gaggcctgggagcctgtcctcc

SEQ ID NO: 8220594 - DNA, 22 bp, Homo sapiens
gaggcctgggcaagggggtctg

SEQ ID NO: 8220595 - DNA, 22 bp, Homo sapiens
gaggcctgggcaagggggtctg

SEQ ID NO: 8220596 - DNA, 22 bp, Homo sapiens
gaggcctggctgtcagtcccca

SEQ ID NO: 8220597 - DNA, 22 bp, Homo sapiens
gaggcctggctgtcagtcccca

SEQ ID NO: 8220598 - DNA, 22 bp, Homo sapiens
gaggcctggctgtcagtcccca

SEQ ID NO: 8220599 - DNA, 22 bp, Homo sapiens
gaggcctgggagcctgtcctcc

SEQ ID NO: 8220600 - DNA, 22 bp, Homo sapiens
gaggcctggctgggaggaggtg

SEQ ID NO: 8220601 - DNA, 22 bp, Homo sapiens
gaggcctggctgggaggaggtg

SEQ ID NO: 8220602 - DNA, 22 bp, Homo sapiens
gaggcctggctgggaggaggtg

SEQ ID NO: 8220603 - DNA, 22 bp, Homo sapiens
gaggcctggctgggaggaggtg

SEQ ID NO: 8220604 - DNA, 22 bp, Homo sapiens
gaggcctggagccgcctaggcg

SEQ ID NO: 8220605 - DNA, 22 bp, Homo sapiens
gaggcctggagccgcctaggcg

SEQ ID NO: 8220606 - DNA, 22 bp, Homo sapiens
gaggccagggtaccatcaacat

SEQ ID NO: 8220607 - DNA, 22 bp, Homo sapiens
gaggccagggtaccatcaacat

SEQ ID NO: 8220608 - DNA, 22 bp, Homo sapiens
gaggcctggagccgcctaggcg

SEQ ID NO: 8220609 - DNA, 22 bp, Homo sapiens
gaggcctggagccgcctaggcg

SEQ ID NO: 8220610 - DNA, 23 bp, Homo sapiens
gaggcctggccctgccacatctc

SEQ ID NO: 8220611 - DNA, 22 bp, Homo sapiens
gaggcctggctctgccctcctg

SEQ ID NO: 8220612 - DNA, 22 bp, Homo sapiens
gaggcctggctctgccctcctg

SEQ ID NO: 8220613 - DNA, 22 bp, Homo sapiens
gaggcctggctctgccctcctg

SEQ ID NO: 8220614 - DNA, 22 bp, Homo sapiens
gaggcctggctctgccctcctg

SEQ ID NO: 8220615 - DNA, 22 bp, Homo sapiens
gaggcctggctctgccctcctg

SEQ ID NO: 8220616 - DNA, 22 bp, Homo sapiens
atgtctttggctttgacatggc

SEQ ID NO: 8220617 - DNA, 22 bp, Homo sapiens
atgtctttgccatagttcatat

SEQ ID NO: 8220618 - DNA, 22 bp, Homo sapiens
atgtcttttatggagatgtcat

SEQ ID NO: 8220619 - DNA, 22 bp, Homo sapiens
atgtcttttatggagatgtcat

SEQ ID NO: 8220620 - DNA, 22 bp, Homo sapiens
atgtgaaaaatttcttattaca

SEQ ID NO: 8220621 - DNA, 22 bp, Homo sapiens
atgtgaaaaatttcttattaca

SEQ ID NO: 8220622 - DNA, 22 bp, Homo sapiens
atgtctttgccatagttcatat

SEQ ID NO: 8220623 - DNA, 20 bp, Homo sapiens
gaggctgcggactgctggac

SEQ ID NO: 8220624 - DNA, 20 bp, Homo sapiens
gaggctgcggactgctggac

SEQ ID NO: 8220625 - DNA, 20 bp, Homo sapiens
gaggctgcggactgctggac

SEQ ID NO: 8220626 - DNA, 20 bp, Homo sapiens
gaggctgcggactgctggac

SEQ ID NO: 8220627 - DNA, 20 bp, Homo sapiens
gaggctgcggactgctggac

SEQ ID NO: 8220628 - DNA, 22 bp, Homo sapiens
gaggctgccccttcctcagctg

SEQ ID NO: 8220629 - DNA, 22 bp, Homo sapiens
gaggctgccccttcctcagctg

SEQ ID NO: 8220630 - DNA, 22 bp, Homo sapiens
gaggctgccccttcctcagctg

SEQ ID NO: 8220631 - DNA, 22 bp, Homo sapiens
gaggctgccccttcctcagctg

SEQ ID NO: 8220632 - DNA, 22 bp, Homo sapiens
gaggctgctgagagccctgttt

SEQ ID NO: 8220633 - DNA, 22 bp, Homo sapiens
gaggctgctgagagccctgttt

SEQ ID NO: 8220634 - DNA, 22 bp, Homo sapiens
gaggctgctgccatcattaggt

SEQ ID NO: 8220635 - DNA, 22 bp, Homo sapiens
gaggctgcggggaggagcctgc

SEQ ID NO: 8220636 - DNA, 20 bp, Homo sapiens
gaggctgcggactgctggac

SEQ ID NO: 8220637 - DNA, 22 bp, Homo sapiens
gaggctgcggggaggagcctgc

SEQ ID NO: 8220638 - DNA, 22 bp, Homo sapiens
gaggctgcggggaggagcctgc

SEQ ID NO: 8220639 - DNA, 22 bp, Homo sapiens
gaggctgcggggaggagcctgc

SEQ ID NO: 8220640 - DNA, 22 bp, Homo sapiens
gaggggagaggcttatggatca

SEQ ID NO: 8220641 - DNA, 22 bp, Homo sapiens
gaggggagaggcttatggatca

SEQ ID NO: 8220642 - DNA, 22 bp, Homo sapiens
gaggggagacagggaaatcagt

SEQ ID NO: 8220643 - DNA, 22 bp, Homo sapiens
gaggggagcatgatctagattg

SEQ ID NO: 8220644 - DNA, 22 bp, Homo sapiens
gaggggagcatgatctagattg

SEQ ID NO: 8220645 - DNA, 22 bp, Homo sapiens
gaggggagcccccatcctccag

SEQ ID NO: 8220646 - DNA, 22 bp, Homo sapiens
atgtgtgtatatatagtcattt

SEQ ID NO: 8220647 - DNA, 22 bp, Homo sapiens
atgtgtgtatatatagtcattt

SEQ ID NO: 8220648 - DNA, 22 bp, Homo sapiens
atgtgtcttgagggggatggag

SEQ ID NO: 8220649 - DNA, 22 bp, Homo sapiens
atgtgtgtgcatttctctccct

SEQ ID NO: 8220650 - DNA, 22 bp, Homo sapiens
atgtgtgtgatgggcgccgcca

SEQ ID NO: 8220651 - DNA, 22 bp, Homo sapiens
atgtgtgtatgtgcctatatct

SEQ ID NO: 8220652 - DNA, 22 bp, Homo sapiens
atgtgtgtatgtgcctatatct

SEQ ID NO: 8220653 - DNA, 22 bp, Homo sapiens
atgtgtattaccctttcattcc

SEQ ID NO: 8220654 - DNA, 22 bp, Homo sapiens
atgtgtatgtgtatacacacag

SEQ ID NO: 8220655 - DNA, 22 bp, Homo sapiens
atgtgtatgtcttattcaaaga

SEQ ID NO: 8220656 - DNA, 22 bp, Homo sapiens
atgtgtatgtcttattcaaaga

SEQ ID NO: 8220657 - DNA, 22 bp, Homo sapiens
atgtgtattaccctttcattcc

SEQ ID NO: 8220658 - DNA, 22 bp, Homo sapiens
atgtgtattaccctttcattcc

SEQ ID NO: 8220659 - DNA, 22 bp, Homo sapiens
atgtgtattacctcgattgtga

SEQ ID NO: 8220660 - DNA, 22 bp, Homo sapiens
atgtgtattaccctttcattcc

SEQ ID NO: 8220661 - DNA, 22 bp, Homo sapiens
atgtgtatgcatgcactaagat

SEQ ID NO: 8220662 - DNA, 22 bp, Homo sapiens
atgtgtatgatacctttgctga

SEQ ID NO: 8220663 - DNA, 22 bp, Homo sapiens
atgtgtatgatacctttgctga

SEQ ID NO: 8220664 - DNA, 22 bp, Homo sapiens
atgtggcttttcctgggttcct

SEQ ID NO: 8220665 - DNA, 22 bp, Homo sapiens
atgtggctttcatgattaagca

SEQ ID NO: 8220666 - DNA, 22 bp, Homo sapiens
atgtgtatgagtgtgcttcttt

SEQ ID NO: 8220667 - DNA, 22 bp, Homo sapiens
atgtgtatgagtgtgcttcttt

SEQ ID NO: 8220668 - DNA, 22 bp, Homo sapiens
gaggctgctttgatgacaggag

SEQ ID NO: 8220669 - DNA, 22 bp, Homo sapiens
gaggctgctttgatgacaggag

SEQ ID NO: 8220670 - DNA, 22 bp, Homo sapiens
atgtggcttagttaggtgcccc

SEQ ID NO: 8220671 - DNA, 22 bp, Homo sapiens
atgtggcttggcagggaatatg

SEQ ID NO: 8220672 - DNA, 22 bp, Homo sapiens
gaggctgctttgatgacaggag

SEQ ID NO: 8220673 - DNA, 22 bp, Homo sapiens
gaggctgctttgatgacaggag

SEQ ID NO: 8220674 - DNA, 22 bp, Homo sapiens
gaggctgctgttagccctgggc

SEQ ID NO: 8220675 - DNA, 22 bp, Homo sapiens
gaggctgctgttagccctgggc

SEQ ID NO: 8220676 - DNA, 22 bp, Homo sapiens
gaggctgctgttagccctgggc

SEQ ID NO: 8220677 - DNA, 22 bp, Homo sapiens
atgtgtcctgctgtgtcacaca

SEQ ID NO: 8220678 - DNA, 22 bp, Homo sapiens
gaggggaagacttctggacagt

SEQ ID NO: 8220679 - DNA, 22 bp, Homo sapiens
atgtgtcctctggcaggtttag

SEQ ID NO: 8220680 - DNA, 22 bp, Homo sapiens
atgtgtccattatcagttctgg

SEQ ID NO: 8220681 - DNA, 22 bp, Homo sapiens
atgtgtccacaggtgtgagaga

SEQ ID NO: 8220682 - DNA, 22 bp, Homo sapiens
atgtgtccacaggtgtgagaga

SEQ ID NO: 8220683 - DNA, 22 bp, Homo sapiens
atgtgtccaaggccacaatagc

SEQ ID NO: 8220684 - DNA, 22 bp, Homo sapiens
atgtgtcattatccagaataac

SEQ ID NO: 8220685 - DNA, 22 bp, Homo sapiens
atgtgtcatttttctgtgcata

SEQ ID NO: 8220686 - DNA, 22 bp, Homo sapiens
atgtgtattagttagtttaatg

SEQ ID NO: 8220687 - DNA, 22 bp, Homo sapiens
atgtgtattagttagtttaatg

SEQ ID NO: 8220688 - DNA, 22 bp, Homo sapiens
atgtgtattagttagtttaatg

SEQ ID NO: 8220689 - DNA, 22 bp, Homo sapiens
atgtgtattacctcgattgtga

SEQ ID NO: 8220690 - DNA, 22 bp, Homo sapiens
atgtgtatttccatcgatcagc

SEQ ID NO: 8220691 - DNA, 22 bp, Homo sapiens
atgtgtatttccatcgatcagc

SEQ ID NO: 8220692 - DNA, 22 bp, Homo sapiens
atgtgtatttccatcgatcagc

SEQ ID NO: 8220693 - DNA, 22 bp, Homo sapiens
atgtgtattgagcacctactgc

SEQ ID NO: 8220694 - DNA, 22 bp, Homo sapiens
atgtgtcattatccagaataac

SEQ ID NO: 8220695 - DNA, 22 bp, Homo sapiens
atgtgtcaggtacactcattag

SEQ ID NO: 8220696 - DNA, 22 bp, Homo sapiens
atgtgtcaattttcaaatgctt

SEQ ID NO: 8220697 - DNA, 22 bp, Homo sapiens
atgtgtcaggcaatagaagcta

SEQ ID NO: 8220698 - DNA, 22 bp, Homo sapiens
atgtgtcaggcaatagaagcta

SEQ ID NO: 8220699 - DNA, 22 bp, Homo sapiens
atgtgtattttgtactattggg

SEQ ID NO: 8220700 - DNA, 22 bp, Homo sapiens
atgtgtattttgtactattggg

SEQ ID NO: 8220701 - DNA, 22 bp, Homo sapiens
gagctgggctggcttcctccct

SEQ ID NO: 8220702 - DNA, 22 bp, Homo sapiens
gagctgggctggcttcctccct

SEQ ID NO: 8220703 - DNA, 22 bp, Homo sapiens
gagctggggcagcttaggagtg

SEQ ID NO: 8220704 - DNA, 22 bp, Homo sapiens
gagctggggcagcttaggagtg

SEQ ID NO: 8220705 - DNA, 22 bp, Homo sapiens
gagctgggctggcttcctccct

SEQ ID NO: 8220706 - DNA, 21 bp, Homo sapiens
gagctgggcgaggctccgggg

SEQ ID NO: 8220707 - DNA, 21 bp, Homo sapiens
gagctgggcgaggctccgggg

SEQ ID NO: 8220708 - DNA, 22 bp, Homo sapiens
gagctgggcgagccggggaagt

SEQ ID NO: 8220709 - DNA, 22 bp, Homo sapiens
gagctgggcgagccggggaagt

SEQ ID NO: 8220710 - DNA, 22 bp, Homo sapiens
gagctgggcgagccggggaagt

SEQ ID NO: 8220711 - DNA, 21 bp, Homo sapiens
gagctgggcgaggctccgggg

SEQ ID NO: 8220712 - DNA, 22 bp, Homo sapiens
gagctgggcgagccggggaagt

SEQ ID NO: 8220713 - DNA, 22 bp, Homo sapiens
gagctgggcgagccggggaagt

SEQ ID NO: 8220714 - DNA, 22 bp, Homo sapiens
gagctgggcctgcgagtgctgc

SEQ ID NO: 8220715 - DNA, 22 bp, Homo sapiens
gagctgggcctgcgagtgctgc

SEQ ID NO: 8220716 - DNA, 22 bp, Homo sapiens
gagctgggcctgcgagtgctgc

SEQ ID NO: 8220717 - DNA, 22 bp, Homo sapiens
gagctgggcctgcgagtgctgc

SEQ ID NO: 8220718 - DNA, 22 bp, Homo sapiens
gagctgggcctgcgagtgctgc

SEQ ID NO: 8220719 - DNA, 22 bp, Homo sapiens
gagctgggcctgcgagtgctgc

SEQ ID NO: 8220720 - DNA, 22 bp, Homo sapiens
gagctgggcctgcgagtgctgc

SEQ ID NO: 8220721 - DNA, 22 bp, Homo sapiens
atggtcaggcaaggagggctgg

SEQ ID NO: 8220722 - DNA, 22 bp, Homo sapiens
atggtcagggcaccctggcccc

SEQ ID NO: 8220723 - DNA, 22 bp, Homo sapiens
gagctgggcctcagaacacagt

SEQ ID NO: 8220724 - DNA, 22 bp, Homo sapiens
gagctgggcctcagaacacagt

SEQ ID NO: 8220725 - DNA, 23 bp, Homo sapiens
atggtccagccagctgcacagga

SEQ ID NO: 8220726 - DNA, 22 bp, Homo sapiens
atgggtgtgaaaatggtcatct

SEQ ID NO: 8220727 - DNA, 22 bp, Homo sapiens
atggggctgggattctcctcgg

SEQ ID NO: 8220728 - DNA, 22 bp, Homo sapiens
atggggctgaaacatggaagag

SEQ ID NO: 8220729 - DNA, 22 bp, Homo sapiens
atggctggatttgatccatggg

SEQ ID NO: 8220730 - DNA, 22 bp, Homo sapiens
atggctggatagttgaagctct

SEQ ID NO: 8220731 - DNA, 22 bp, Homo sapiens
atggctggatagttgaagctct

SEQ ID NO: 8220732 - DNA, 22 bp, Homo sapiens
atggctggaggccgggcttcct

SEQ ID NO: 8220733 - DNA, 22 bp, Homo sapiens
atggctggaggccgggcttcct

SEQ ID NO: 8220734 - DNA, 22 bp, Homo sapiens
atggctggaggccgggcttcct

SEQ ID NO: 8220735 - DNA, 22 bp, Homo sapiens
atggctggatttgatccatggg

SEQ ID NO: 8220736 - DNA, 22 bp, Homo sapiens
atggctggcactggcctgggtt

SEQ ID NO: 8220737 - DNA, 22 bp, Homo sapiens
atggctggcactggcctgggtt

SEQ ID NO: 8220738 - DNA, 22 bp, Homo sapiens
atggggctctgcggctgctccc

SEQ ID NO: 8220739 - DNA, 19 bp, Homo sapiens
atggtacagtgtacacttg

SEQ ID NO: 8220740 - DNA, 22 bp, Homo sapiens
atggtacagataatacatgctg

SEQ ID NO: 8220741 - DNA, 22 bp, Homo sapiens
atggtacagtgcactgaatgga

SEQ ID NO: 8220742 - DNA, 22 bp, Homo sapiens
atggtacagataatacatgctg

SEQ ID NO: 8220743 - DNA, 22 bp, Homo sapiens
atggtacagataatacatgctg

SEQ ID NO: 8220744 - DNA, 22 bp, Homo sapiens
atggtacaatgtgtgtatcttt

SEQ ID NO: 8220745 - DNA, 22 bp, Homo sapiens
atggtacaatgtgtgtatcttt

SEQ ID NO: 8220746 - DNA, 22 bp, Homo sapiens
atggtacaatgtgtgtatcttt

SEQ ID NO: 8220747 - DNA, 22 bp, Homo sapiens
atggtacaaaatgtataaagtc

SEQ ID NO: 8220748 - DNA, 22 bp, Homo sapiens
atggtcaaggagaaacctggga

SEQ ID NO: 8220749 - DNA, 22 bp, Homo sapiens
atggtcaaggagaaacctggga

SEQ ID NO: 8220750 - DNA, 21 bp, Homo sapiens
atggtcaattcattagaaaga

SEQ ID NO: 8220751 - DNA, 22 bp, Homo sapiens
atggtactggggtcccggagtt

SEQ ID NO: 8220752 - DNA, 22 bp, Homo sapiens
atggtatagagccacatgtatt

SEQ ID NO: 8220753 - DNA, 21 bp, Homo sapiens
atggtaggtggagcaggtgat

SEQ ID NO: 8220754 - DNA, 22 bp, Homo sapiens
atggtatacaattatggactgt

SEQ ID NO: 8220755 - DNA, 22 bp, Homo sapiens
atggtataggccattgggggca

SEQ ID NO: 8220756 - DNA, 22 bp, Homo sapiens
atggtatagagccacatgtatt

SEQ ID NO: 8220757 - DNA, 15 bp, Homo sapiens
gaggccaggcatgtg

SEQ ID NO: 8220758 - DNA, 15 bp, Homo sapiens
gaggccaggcatgtg

SEQ ID NO: 8220759 - DNA, 22 bp, Homo sapiens
gaggccagggatgcaatgagag

SEQ ID NO: 8220760 - DNA, 22 bp, Homo sapiens
gaggccagggatgcaatgagag

SEQ ID NO: 8220761 - DNA, 22 bp, Homo sapiens
gaggccagggatgcaatgagag

SEQ ID NO: 8220762 - DNA, 22 bp, Homo sapiens
gaggccagggatgcaatgagag

SEQ ID NO: 8220763 - DNA, 22 bp, Homo sapiens
gaggccaggggagtcagcgtcc

SEQ ID NO: 8220764 - DNA, 22 bp, Homo sapiens
gaggccaggggagtcagcgtcc

SEQ ID NO: 8220765 - DNA, 22 bp, Homo sapiens
gaggccaggggagtcagcgtcc

SEQ ID NO: 8220766 - DNA, 22 bp, Homo sapiens
gaggccaggggcctggagatga

SEQ ID NO: 8220767 - DNA, 22 bp, Homo sapiens
gaggccaggggagtcagcgtcc

SEQ ID NO: 8220768 - DNA, 22 bp, Homo sapiens
gaggccaggggagtcagcgtcc

SEQ ID NO: 8220769 - DNA, 22 bp, Homo sapiens
gaggccagggtaccatcaacat

SEQ ID NO: 8220770 - DNA, 22 bp, Homo sapiens
gaggccagggtaccatcaacat

SEQ ID NO: 8220771 - DNA, 22 bp, Homo sapiens
gaggccagggtaccatcaacat

SEQ ID NO: 8220772 - DNA, 22 bp, Homo sapiens
gaggccaggggtcagcaattgg

SEQ ID NO: 8220773 - DNA, 22 bp, Homo sapiens
gaggccaggggtcagcaattgg

SEQ ID NO: 8220774 - DNA, 22 bp, Homo sapiens
gaggccaggggtcagcaattgg

SEQ ID NO: 8220775 - DNA, 22 bp, Homo sapiens
gaggccaggggtcagcaattgg

SEQ ID NO: 8220776 - DNA, 22 bp, Homo sapiens
gaggccaggggcctggagatga

SEQ ID NO: 8220777 - DNA, 22 bp, Homo sapiens
gaggccaggggcctggagatga

SEQ ID NO: 8220778 - DNA, 22 bp, Homo sapiens
gaggccaggggcctggagatga

SEQ ID NO: 8220779 - DNA, 22 bp, Homo sapiens
gaggccaggggcctggagatga

SEQ ID NO: 8220780 - DNA, 22 bp, Homo sapiens
gaggccaggggcctggagatga

SEQ ID NO: 8220781 - DNA, 22 bp, Homo sapiens
gaggccaggggcctggagatga

SEQ ID NO: 8220782 - DNA, 22 bp, Homo sapiens
gaggagctgggctgagagggtc

SEQ ID NO: 8220783 - DNA, 22 bp, Homo sapiens
gaggccaggaggatctctctaa

SEQ ID NO: 8220784 - DNA, 22 bp, Homo sapiens
gaggccaccctatgggtcccag

SEQ ID NO: 8220785 - DNA, 22 bp, Homo sapiens
gaggccaggagtgctgtaagtt

SEQ ID NO: 8220786 - DNA, 22 bp, Homo sapiens
gaggccaggagtgctgtaagtt

SEQ ID NO: 8220787 - DNA, 22 bp, Homo sapiens
gaggccaggagtgctgtaagtt

SEQ ID NO: 8220788 - DNA, 22 bp, Homo sapiens
gaggccaggagtgctgtaagtt

SEQ ID NO: 8220789 - DNA, 22 bp, Homo sapiens
gaggccaggagtgctgtaagtt

SEQ ID NO: 8220790 - DNA, 22 bp, Homo sapiens
gaggagctgggctgagagggtc

SEQ ID NO: 8220791 - DNA, 22 bp, Homo sapiens
gaggagctgggctgagagggtc

SEQ ID NO: 8220792 - DNA, 22 bp, Homo sapiens
gaggagctgggctgagagggtc

SEQ ID NO: 8220793 - DNA, 22 bp, Homo sapiens
gaggagctgggctgagagggtc

SEQ ID NO: 8220794 - DNA, 22 bp, Homo sapiens
gaggagctgggctgagagggtc

SEQ ID NO: 8220795 - DNA, 22 bp, Homo sapiens
gaggagctgggaccctgtcatc

SEQ ID NO: 8220796 - DNA, 22 bp, Homo sapiens
gaggagctgcccgtgtgtctgc

SEQ ID NO: 8220797 - DNA, 22 bp, Homo sapiens
gaggagctggcagcgtctccgc

SEQ ID NO: 8220798 - DNA, 22 bp, Homo sapiens
gaggagctggcgctatttatga

SEQ ID NO: 8220799 - DNA, 22 bp, Homo sapiens
gaggagctggctgtcgggaggc

SEQ ID NO: 8220800 - DNA, 22 bp, Homo sapiens
gaggagctggctgtcgggaggc

SEQ ID NO: 8220801 - DNA, 22 bp, Homo sapiens
gaggagctgcagggggagtcta

SEQ ID NO: 8220802 - DNA, 22 bp, Homo sapiens
gaggagctgcagggggagtcta

SEQ ID NO: 8220803 - DNA, 22 bp, Homo sapiens
gaggagctgatatttataatga

SEQ ID NO: 8220804 - DNA, 22 bp, Homo sapiens
gaggagctgaggctgaggcctc

SEQ ID NO: 8220805 - DNA, 22 bp, Homo sapiens
atgtactactacttgagtgagc

SEQ ID NO: 8220806 - DNA, 20 bp, Homo sapiens
atgtactacaggtgataaag

SEQ ID NO: 8220807 - DNA, 22 bp, Homo sapiens
atgtactaaagaaatttgcagg

SEQ ID NO: 8220808 - DNA, 19 bp, Homo sapiens
atgtacccagtgtcaatcc

SEQ ID NO: 8220809 - DNA, 19 bp, Homo sapiens
atgtacccagtgtcaatcc

SEQ ID NO: 8220810 - DNA, 22 bp, Homo sapiens
atgtagaaagttattgtcactg

SEQ ID NO: 8220811 - DNA, 17 bp, Homo sapiens
gaggagctccagtaggt

SEQ ID NO: 8220812 - DNA, 17 bp, Homo sapiens
gaggagctccagtaggt

SEQ ID NO: 8220813 - DNA, 22 bp, Homo sapiens
gaggagctcatgaaagcggtgt

SEQ ID NO: 8220814 - DNA, 17 bp, Homo sapiens
gaggagctccagtaggt

SEQ ID NO: 8220815 - DNA, 22 bp, Homo sapiens
atgtacatttagatcatttctg

SEQ ID NO: 8220816 - DNA, 22 bp, Homo sapiens
atgtacattctaagtatgtgta

SEQ ID NO: 8220817 - DNA, 22 bp, Homo sapiens
atgtacattcttctcaccgaag

SEQ ID NO: 8220818 - DNA, 21 bp, Homo sapiens
atgtacattcggcaacagata

SEQ ID NO: 8220819 - DNA, 21 bp, Homo sapiens
atgtacattcggcaacagata

SEQ ID NO: 8220820 - DNA, 22 bp, Homo sapiens
atgtacattctaagtatgtgta

SEQ ID NO: 8220821 - DNA, 22 bp, Homo sapiens
atgtacattctaagtatgtgta

SEQ ID NO: 8220822 - DNA, 22 bp, Homo sapiens
atgtacatctttataacaagct

SEQ ID NO: 8220823 - DNA, 22 bp, Homo sapiens
atgtacatgtgaatttaggcaa

SEQ ID NO: 8220824 - DNA, 18 bp, Homo sapiens
atgtacatgtactcacac

SEQ ID NO: 8220825 - DNA, 22 bp, Homo sapiens
atgtacatgtttaagtgaagga

SEQ ID NO: 8220826 - DNA, 22 bp, Homo sapiens
atgtacattattcgagtgatgg

SEQ ID NO: 8220827 - DNA, 22 bp, Homo sapiens
atgtacattattcgagtgatgg

SEQ ID NO: 8220828 - DNA, 22 bp, Homo sapiens
atgtacatgtttaagtgaagga

SEQ ID NO: 8220829 - DNA, 22 bp, Homo sapiens
atgtacattattcgagtgatgg

SEQ ID NO: 8220830 - DNA, 18 bp, Homo sapiens
atgtacatttgctaaagc

SEQ ID NO: 8220831 - DNA, 18 bp, Homo sapiens
atgtacatttgctaaagc

SEQ ID NO: 8220832 - DNA, 22 bp, Homo sapiens
atgtacatttagatcatttctg

SEQ ID NO: 8220833 - DNA, 18 bp, Homo sapiens
atgtacatttgctaaagc

SEQ ID NO: 8220834 - DNA, 22 bp, Homo sapiens
atgtacatttgtagtaatatca

SEQ ID NO: 8220835 - DNA, 22 bp, Homo sapiens
atgtacatttgtagtaatatca

SEQ ID NO: 8220836 - DNA, 22 bp, Homo sapiens
atgtacatttgtagtaatatca

SEQ ID NO: 8220837 - DNA, 18 bp, Homo sapiens
atgtacatttgctaaagc

SEQ ID NO: 8220838 - DNA, 22 bp, Homo sapiens
atgtacattttcctaatgtttt

SEQ ID NO: 8220839 - DNA, 22 bp, Homo sapiens
atgtacattttcctaatgtttt

SEQ ID NO: 8220840 - DNA, 22 bp, Homo sapiens
atgtacatttgtagtaatatca

SEQ ID NO: 8220841 - DNA, 22 bp, Homo sapiens
atgtacatttgtagtaatatca

SEQ ID NO: 8220842 - DNA, 22 bp, Homo sapiens
cacccacatggaaattcacagt

SEQ ID NO: 8220843 - DNA, 22 bp, Homo sapiens
cacccacatggaaattcacagt

SEQ ID NO: 8220844 - DNA, 22 bp, Homo sapiens
caccatcttggcaaaggttcgc

SEQ ID NO: 8220845 - DNA, 22 bp, Homo sapiens
caccatgactggttgagagagg

SEQ ID NO: 8220846 - DNA, 22 bp, Homo sapiens
caccatcagcagcaggtgtcaa

SEQ ID NO: 8220847 - DNA, 22 bp, Homo sapiens
caccatctatagaggtatttgg

SEQ ID NO: 8220848 - DNA, 22 bp, Homo sapiens
cacccactgagctcatgtccca

SEQ ID NO: 8220849 - DNA, 22 bp, Homo sapiens
cacccacccagaagatcctggc

SEQ ID NO: 8220850 - DNA, 22 bp, Homo sapiens
cacccacattcctctagtatgt

SEQ ID NO: 8220851 - DNA, 22 bp, Homo sapiens
cacccacattcctctagtatgt

SEQ ID NO: 8220852 - DNA, 22 bp, Homo sapiens
cacccacccactgctcattggc

SEQ ID NO: 8220853 - DNA, 22 bp, Homo sapiens
cacccacattcctctagtatgt

SEQ ID NO: 8220854 - DNA, 22 bp, Homo sapiens
cacccacattccatcactctgc

SEQ ID NO: 8220855 - DNA, 22 bp, Homo sapiens
cacccacattccatcactctgc

SEQ ID NO: 8220856 - DNA, 22 bp, Homo sapiens
cacccacatggaaattcacagt

SEQ ID NO: 8220857 - DNA, 22 bp, Homo sapiens
ggcagttgctgtggatgaggtt

SEQ ID NO: 8220858 - DNA, 22 bp, Homo sapiens
ggcagtgtggcctgagtaagtc

SEQ ID NO: 8220859 - DNA, 22 bp, Homo sapiens
ggcagtggttagaaacatgagc

SEQ ID NO: 8220860 - DNA, 22 bp, Homo sapiens
ggcagtgtcaaaataggcagaa

SEQ ID NO: 8220861 - DNA, 22 bp, Homo sapiens
ggcagtgtccagcttcctggag

SEQ ID NO: 8220862 - DNA, 22 bp, Homo sapiens
caccataaccaacatgtcagtt

SEQ ID NO: 8220863 - DNA, 22 bp, Homo sapiens
caccataaaaataagagatgcc

SEQ ID NO: 8220864 - DNA, 22 bp, Homo sapiens
caccaggctggagtgcagtggc

SEQ ID NO: 8220865 - DNA, 22 bp, Homo sapiens
caccaggctggagtgcagtggc

SEQ ID NO: 8220866 - DNA, 22 bp, Homo sapiens
ggcagctgattagcatcaagga

SEQ ID NO: 8220867 - DNA, 22 bp, Homo sapiens
ggcagctgattagcatcaagga

SEQ ID NO: 8220868 - DNA, 22 bp, Homo sapiens
ggcagctgattagcatcaagga

SEQ ID NO: 8220869 - DNA, 22 bp, Homo sapiens
ggcagctgagcatggctacctt

SEQ ID NO: 8220870 - DNA, 22 bp, Homo sapiens
ggcagctgagcatggctacctt

SEQ ID NO: 8220871 - DNA, 22 bp, Homo sapiens
ggcagctgagcatggctacctt

SEQ ID NO: 8220872 - DNA, 22 bp, Homo sapiens
ggcagctgagcatggctacctt

SEQ ID NO: 8220873 - DNA, 21 bp, Homo sapiens
ggcagctgaccgcgcggtgca

SEQ ID NO: 8220874 - DNA, 21 bp, Homo sapiens
ggcagctgaccgcgcggtgca

SEQ ID NO: 8220875 - DNA, 22 bp, Homo sapiens
ggcagctgaagaggaactttgg

SEQ ID NO: 8220876 - DNA, 21 bp, Homo sapiens
ggcagctgaccgcgcggtgca

SEQ ID NO: 8220877 - DNA, 22 bp, Homo sapiens
ggcagccagagggcagctggat

SEQ ID NO: 8220878 - DNA, 22 bp, Homo sapiens
ggcagccagagggcagctggat

SEQ ID NO: 8220879 - DNA, 22 bp, Homo sapiens
ggcagctgacctagcaccatcc

SEQ ID NO: 8220880 - DNA, 22 bp, Homo sapiens
ggcagctgacctagcaccatcc

SEQ ID NO: 8220881 - DNA, 22 bp, Homo sapiens
ggcagctgacctagcaccatcc

SEQ ID NO: 8220882 - DNA, 22 bp, Homo sapiens
ggcagctgacctagcaccatcc

SEQ ID NO: 8220883 - DNA, 22 bp, Homo sapiens
ggcagctgacctagcaccatcc

SEQ ID NO: 8220884 - DNA, 22 bp, Homo sapiens
ggcagctgagatcatgctgttg

SEQ ID NO: 8220885 - DNA, 22 bp, Homo sapiens
ggcagctgagatcatgctgttg

SEQ ID NO: 8220886 - DNA, 22 bp, Homo sapiens
ggcagctgagcatggctacctt

SEQ ID NO: 8220887 - DNA, 22 bp, Homo sapiens
ggcagctgagatcatgctgttg

SEQ ID NO: 8220888 - DNA, 22 bp, Homo sapiens
cacccaggttggagtgcagtgg

SEQ ID NO: 8220889 - DNA, 22 bp, Homo sapiens
ggcatagatttctttaggttta

SEQ ID NO: 8220890 - DNA, 22 bp, Homo sapiens
ggcatcagaggtgtgttctgct

SEQ ID NO: 8220891 - DNA, 22 bp, Homo sapiens
ggcatcagcccggtcctgggct

SEQ ID NO: 8220892 - DNA, 22 bp, Homo sapiens
ggcatagatgcaggcaaagtgg

SEQ ID NO: 8220893 - DNA, 22 bp, Homo sapiens
ggcatagatttctttaggttta

SEQ ID NO: 8220894 - DNA, 22 bp, Homo sapiens
caccccagcttctcaggataga

SEQ ID NO: 8220895 - DNA, 19 bp, Homo sapiens
caccccagtcctctttccc

SEQ ID NO: 8220896 - DNA, 19 bp, Homo sapiens
caccccagtcctctttccc

SEQ ID NO: 8220897 - DNA, 22 bp, Homo sapiens
caccccagcttctcaggataga

SEQ ID NO: 8220898 - DNA, 22 bp, Homo sapiens
caccccagcttctcaggataga

SEQ ID NO: 8220899 - DNA, 22 bp, Homo sapiens
caccccagtctaaaaccagcct

SEQ ID NO: 8220900 - DNA, 22 bp, Homo sapiens
caccccagtctaaaaccagcct

SEQ ID NO: 8220901 - DNA, 22 bp, Homo sapiens
cacccagtgaaggagcaagagg

SEQ ID NO: 8220902 - DNA, 22 bp, Homo sapiens
cacccagttgactacaaagggg

SEQ ID NO: 8220903 - DNA, 22 bp, Homo sapiens
cacccaggttggagtgcagtgg

SEQ ID NO: 8220904 - DNA, 22 bp, Homo sapiens
cacccaggttggagtgcagtgg

SEQ ID NO: 8220905 - DNA, 22 bp, Homo sapiens
caccctgctacaaagcctcctg

SEQ ID NO: 8220906 - DNA, 22 bp, Homo sapiens
caccctgcccactagcaatctg

SEQ ID NO: 8220907 - DNA, 22 bp, Homo sapiens
caccctgaaggctggccctgac

SEQ ID NO: 8220908 - DNA, 18 bp, Homo sapiens
caccctccgcggctgccc

SEQ ID NO: 8220909 - DNA, 22 bp, Homo sapiens
caccctggaatagccccgggag

SEQ ID NO: 8220910 - DNA, 22 bp, Homo sapiens
caccctggaaagaaggtctggg

SEQ ID NO: 8220911 - DNA, 22 bp, Homo sapiens
caccctggaaagaaggtctggg

SEQ ID NO: 8220912 - DNA, 17 bp, Homo sapiens
caccctggctagtctga

SEQ ID NO: 8220913 - DNA, 22 bp, Homo sapiens
caccctggcctcgctctctgca

SEQ ID NO: 8220914 - DNA, 22 bp, Homo sapiens
caccctggctggaggtgcagtg

SEQ ID NO: 8220915 - DNA, 22 bp, Homo sapiens
cactctgagaaacactaaacca

SEQ ID NO: 8220916 - DNA, 22 bp, Homo sapiens
cactctgagaaacactaaacca

SEQ ID NO: 8220917 - DNA, 22 bp, Homo sapiens
cactctgagaagtacaagctcc

SEQ ID NO: 8220918 - DNA, 22 bp, Homo sapiens
cactctgagaagtacaagctcc

SEQ ID NO: 8220919 - DNA, 20 bp, Homo sapiens
caccctcccagcacctatgc

SEQ ID NO: 8220920 - DNA, 22 bp, Homo sapiens
caccctcccgtcagcccctggg

SEQ ID NO: 8220921 - DNA, 22 bp, Homo sapiens
caccccttgtctttggggtcgt

SEQ ID NO: 8220922 - DNA, 22 bp, Homo sapiens
cacccctgggctgggcacacag

SEQ ID NO: 8220923 - DNA, 22 bp, Homo sapiens
cacccctgtggagcatggtggc

SEQ ID NO: 8220924 - DNA, 22 bp, Homo sapiens
caccccccaattctgccagctg

SEQ ID NO: 8220925 - DNA, 22 bp, Homo sapiens
cacccccagcagggaaaggagg

SEQ ID NO: 8220926 - DNA, 22 bp, Homo sapiens
cacccccagcagggaaaggagg

SEQ ID NO: 8220927 - DNA, 22 bp, Homo sapiens
ggcctctcatgcccagagccaa

SEQ ID NO: 8220928 - DNA, 23 bp, Homo sapiens
ggcctctcaccagggtcctttca

SEQ ID NO: 8220929 - DNA, 22 bp, Homo sapiens
ggcctcggcccactgctgcggt

SEQ ID NO: 8220930 - DNA, 22 bp, Homo sapiens
ggcctcgcggcttctggtggct

SEQ ID NO: 8220931 - DNA, 22 bp, Homo sapiens
ggcctctctccagtcagtgcag

SEQ ID NO: 8220932 - DNA, 22 bp, Homo sapiens
ggcctctctagcatccagcctg

SEQ ID NO: 8220933 - DNA, 22 bp, Homo sapiens
ggcctctctagcatccagcctg

SEQ ID NO: 8220934 - DNA, 22 bp, Homo sapiens
ggcctctctagcatccagcctg

SEQ ID NO: 8220935 - DNA, 22 bp, Homo sapiens
ggcctctctagcatccagcctg

SEQ ID NO: 8220936 - DNA, 22 bp, Homo sapiens
ggcctctctagcatccagcctg

SEQ ID NO: 8220937 - DNA, 22 bp, Homo sapiens
ggcctctcatgtcctgggcttc

SEQ ID NO: 8220938 - DNA, 22 bp, Homo sapiens
ggcctctcatgtcctgggcttc

SEQ ID NO: 8220939 - DNA, 22 bp, Homo sapiens
ggcctctcattctccctggtcc

SEQ ID NO: 8220940 - DNA, 22 bp, Homo sapiens
ggcctctcgaagcttcagtcca

SEQ ID NO: 8220941 - DNA, 22 bp, Homo sapiens
ggcctctcgaagcttcagtcca

SEQ ID NO: 8220942 - DNA, 22 bp, Homo sapiens
cactgcaggtctgagatggggg

SEQ ID NO: 8220943 - DNA, 21 bp, Homo sapiens
cactgcagccttgacctgggc

SEQ ID NO: 8220944 - DNA, 21 bp, Homo sapiens
cactgcagccttgacctgggc

SEQ ID NO: 8220945 - DNA, 22 bp, Homo sapiens
cactgcagcctcgctctcctga

SEQ ID NO: 8220946 - DNA, 23 bp, Homo sapiens
cactgcagcgtggtctggcagga

SEQ ID NO: 8220947 - DNA, 23 bp, Homo sapiens
cactgcagcgtggtctggcagga

SEQ ID NO: 8220948 - DNA, 23 bp, Homo sapiens
cactgcagcgtggtctggcagga

SEQ ID NO: 8220949 - DNA, 22 bp, Homo sapiens
cactgcagcaccatgcagggct

SEQ ID NO: 8220950 - DNA, 22 bp, Homo sapiens
cactgcagcaccatgcagggct

SEQ ID NO: 8220951 - DNA, 22 bp, Homo sapiens
cactgcactccatcctgggaaa

SEQ ID NO: 8220952 - DNA, 22 bp, Homo sapiens
cactgcagatcagaggctgaga

SEQ ID NO: 8220953 - DNA, 22 bp, Homo sapiens
cactctgagccaaaactaattc

SEQ ID NO: 8220954 - DNA, 22 bp, Homo sapiens
cactgacagtatcagagctgtt

SEQ ID NO: 8220955 - DNA, 22 bp, Homo sapiens
cactgactaggtcggtgacctc

SEQ ID NO: 8220956 - DNA, 22 bp, Homo sapiens
cactgactccaaaaataaagaa

SEQ ID NO: 8220957 - DNA, 22 bp, Homo sapiens
cactgagaccagagtccctgac

SEQ ID NO: 8220958 - DNA, 22 bp, Homo sapiens
cactgagaccagagtccctgac

SEQ ID NO: 8220959 - DNA, 22 bp, Homo sapiens
cactgagaaagtgacctgccaa

SEQ ID NO: 8220960 - DNA, 22 bp, Homo sapiens
cactgagaggtctcatttccaa

SEQ ID NO: 8220961 - DNA, 22 bp, Homo sapiens
cactgagagatgtgtcacagca

SEQ ID NO: 8220962 - DNA, 22 bp, Homo sapiens
cactgagacccgaatacttcca

SEQ ID NO: 8220963 - DNA, 22 bp, Homo sapiens
cactgagagatgtgtcacagca

SEQ ID NO: 8220964 - DNA, 22 bp, Homo sapiens
cactgagagatgtgtcacagca

SEQ ID NO: 8220965 - DNA, 22 bp, Homo sapiens
cactgaggactcccacgtaggt

SEQ ID NO: 8220966 - DNA, 22 bp, Homo sapiens
cactgaggactcccacgtaggt

SEQ ID NO: 8220967 - DNA, 22 bp, Homo sapiens
cactgagctgatttcaggtgcc

SEQ ID NO: 8220968 - DNA, 21 bp, Homo sapiens
cactgaggaggaaaaggagct

SEQ ID NO: 8220969 - DNA, 22 bp, Homo sapiens
cactgaggagagaggtaactag

SEQ ID NO: 8220970 - DNA, 22 bp, Homo sapiens
cactgaggagagaggtaactag

SEQ ID NO: 8220971 - DNA, 19 bp, Homo sapiens
cactgagctctgttcacta

SEQ ID NO: 8220972 - DNA, 19 bp, Homo sapiens
cactgagctctgttcacta

SEQ ID NO: 8220973 - DNA, 22 bp, Homo sapiens
cactgagcatgagtgggctgtg

SEQ ID NO: 8220974 - DNA, 22 bp, Homo sapiens
cactgagagtagggcacaagtg

SEQ ID NO: 8220975 - DNA, 22 bp, Homo sapiens
ggcctcctgttggctagtgtga

SEQ ID NO: 8220976 - DNA, 22 bp, Homo sapiens
ggcctcctgttggctagtgtga

SEQ ID NO: 8220977 - DNA, 22 bp, Homo sapiens
ggcctcgcggcttctggtggct

SEQ ID NO: 8220978 - DNA, 23 bp, Homo sapiens
ggcctcctggtctaggctagact

SEQ ID NO: 8220979 - DNA, 23 bp, Homo sapiens
ggcctcctggtctaggctagact

SEQ ID NO: 8220980 - DNA, 23 bp, Homo sapiens
ggcctcctggtctaggctagact

SEQ ID NO: 8220981 - DNA, 22 bp, Homo sapiens
cactgaggctgggggagaaggt

SEQ ID NO: 8220982 - DNA, 22 bp, Homo sapiens
ggcctcctcaccctgctcaggc

SEQ ID NO: 8220983 - DNA, 22 bp, Homo sapiens
cactgaggctgggggagaaggt

SEQ ID NO: 8220984 - DNA, 22 bp, Homo sapiens
cactgctttaaggctgagtaac

SEQ ID NO: 8220985 - DNA, 22 bp, Homo sapiens
cactgcctgctggctgtcactt

SEQ ID NO: 8220986 - DNA, 22 bp, Homo sapiens
cactgcctgctggctgtcactt

SEQ ID NO: 8220987 - DNA, 22 bp, Homo sapiens
cactgcctggaaggagagacat

SEQ ID NO: 8220988 - DNA, 22 bp, Homo sapiens
cactgcttttcagacagttatt

SEQ ID NO: 8220989 - DNA, 22 bp, Homo sapiens
cactgctttcacagtttgttcc

SEQ ID NO: 8220990 - DNA, 22 bp, Homo sapiens
cactgctttgcccaagagggca

SEQ ID NO: 8220991 - DNA, 22 bp, Homo sapiens
cactgcttttcagacagttatt

SEQ ID NO: 8220992 - DNA, 22 bp, Homo sapiens
cactgctttttctcctcactgg

SEQ ID NO: 8220993 - DNA, 22 bp, Homo sapiens
cactgcttttttggctatgtac

SEQ ID NO: 8220994 - DNA, 22 bp, Homo sapiens
cactgcttttttggctatgtac

SEQ ID NO: 8220995 - DNA, 22 bp, Homo sapiens
cactggaagagcatctgagcca

SEQ ID NO: 8220996 - DNA, 22 bp, Homo sapiens
cactggaagagcatctgagcca

SEQ ID NO: 8220997 - DNA, 22 bp, Homo sapiens
cactggaaccaagacccagggc

SEQ ID NO: 8220998 - DNA, 22 bp, Homo sapiens
cactggaatggatagagcagag

SEQ ID NO: 8220999 - DNA, 22 bp, Homo sapiens
cactggaatagcattgattctt

SEQ ID NO: 8221000 - DNA, 22 bp, Homo sapiens
cactggaatggatagagcagag

SEQ ID NO: 8221001 - DNA, 22 bp, Homo sapiens
cactggaagttcattctcagaa

SEQ ID NO: 8221002 - DNA, 22 bp, Homo sapiens
cactggcatctagtgggttgag

SEQ ID NO: 8221003 - DNA, 22 bp, Homo sapiens
cactggcattagtcacgaggca

SEQ ID NO: 8221004 - DNA, 22 bp, Homo sapiens
cactggcagatttgggatctgg

SEQ ID NO: 8221005 - DNA, 22 bp, Homo sapiens
cactggcatctaagggtggtag

SEQ ID NO: 8221006 - DNA, 22 bp, Homo sapiens
cactggaggtcagtggagcact

SEQ ID NO: 8221007 - DNA, 21 bp, Homo sapiens
cactggaattttctgtgacat

SEQ ID NO: 8221008 - DNA, 22 bp, Homo sapiens
cactggaccaaggaaactcttc

SEQ ID NO: 8221009 - DNA, 22 bp, Homo sapiens
cactggaattcaagatactgag

SEQ ID NO: 8221010 - DNA, 22 bp, Homo sapiens
cactggaatgttgaggagacaa

SEQ ID NO: 8221011 - DNA, 22 bp, Homo sapiens
cactggaatgttgaggagacaa

SEQ ID NO: 8221012 - DNA, 22 bp, Homo sapiens
cactggaggtcagtggagcact

SEQ ID NO: 8221013 - DNA, 22 bp, Homo sapiens
cactggaggtcagtggagcact

SEQ ID NO: 8221014 - DNA, 18 bp, Homo sapiens
cactggacctcatgagag

SEQ ID NO: 8221015 - DNA, 18 bp, Homo sapiens
ggctcaagtgatcctcct

SEQ ID NO: 8221016 - DNA, 19 bp, Homo sapiens
ggctcaagcatccaggtag

SEQ ID NO: 8221017 - DNA, 22 bp, Homo sapiens
ggctcaatgcaacttctgcctc

SEQ ID NO: 8221018 - DNA, 22 bp, Homo sapiens
ggctcaagcagtctgcctgcct

SEQ ID NO: 8221019 - DNA, 22 bp, Homo sapiens
ggctatggaaatggcaggacat

SEQ ID NO: 8221020 - DNA, 21 bp, Homo sapiens
ggctatgattaatgactagga

SEQ ID NO: 8221021 - DNA, 22 bp, Homo sapiens
ggctatggaagataaggctgaa

SEQ ID NO: 8221022 - DNA, 22 bp, Homo sapiens
ggctatgggaagatggcagggg

SEQ ID NO: 8221023 - DNA, 22 bp, Homo sapiens
ggctagggatctagaccaggac

SEQ ID NO: 8221024 - DNA, 22 bp, Homo sapiens
ggctagggatctagaccaggac

SEQ ID NO: 8221025 - DNA, 22 bp, Homo sapiens
ggctaggggaataatctgtggt

SEQ ID NO: 8221026 - DNA, 22 bp, Homo sapiens
ggctagggatctagaccaggac

SEQ ID NO: 8221027 - DNA, 22 bp, Homo sapiens
ggctagggatctagaccaggac

SEQ ID NO: 8221028 - DNA, 22 bp, Homo sapiens
ggctagggatctagaccaggac

SEQ ID NO: 8221029 - DNA, 22 bp, Homo sapiens
cactgccacctgcatgccctga

SEQ ID NO: 8221030 - DNA, 20 bp, Homo sapiens
cactgccagaatacactgtc

SEQ ID NO: 8221031 - DNA, 20 bp, Homo sapiens
cactgcattgatggaaacag

SEQ ID NO: 8221032 - DNA, 22 bp, Homo sapiens
cactgcagttccccagtgcgca

SEQ ID NO: 8221033 - DNA, 22 bp, Homo sapiens
cactgcagtaactctaggactg

SEQ ID NO: 8221034 - DNA, 22 bp, Homo sapiens
ggctagggagacagagggcatg

SEQ ID NO: 8221035 - DNA, 22 bp, Homo sapiens
ggctagggagacagagggcatg

SEQ ID NO: 8221036 - DNA, 22 bp, Homo sapiens
cactgcccaccaagtggctggt

SEQ ID NO: 8221037 - DNA, 22 bp, Homo sapiens
cactgcccaccaagtggctggt

SEQ ID NO: 8221038 - DNA, 22 bp, Homo sapiens
cactgccatgttgatagatgtg

SEQ ID NO: 8221039 - DNA, 22 bp, Homo sapiens
cactgcccaccaagtggctggt

SEQ ID NO: 8221040 - DNA, 22 bp, Homo sapiens
ggctagggactcctcctcaggg

SEQ ID NO: 8221041 - DNA, 22 bp, Homo sapiens
ggatgttctggggttctcttgt

SEQ ID NO: 8221042 - DNA, 22 bp, Homo sapiens
ggatgttctggggttctcttgt

SEQ ID NO: 8221043 - DNA, 22 bp, Homo sapiens
ggatgtcgaggatggggtagca

SEQ ID NO: 8221044 - DNA, 23 bp, Homo sapiens
ggatgggcaagcctagtgcctac

SEQ ID NO: 8221045 - DNA, 19 bp, Homo sapiens
ggatggtggggtgcccatc

SEQ ID NO: 8221046 - DNA, 22 bp, Homo sapiens
ggatggtgacggcggcccgctt

SEQ ID NO: 8221047 - DNA, 19 bp, Homo sapiens
ggatggtggggtgcccatc

SEQ ID NO: 8221048 - DNA, 22 bp, Homo sapiens
ggatggtcagaggaccaaatac

SEQ ID NO: 8221049 - DNA, 22 bp, Homo sapiens
cacagggaggacatcaacagtg

SEQ ID NO: 8221050 - DNA, 22 bp, Homo sapiens
cacagggaggcagccatgctcc

SEQ ID NO: 8221051 - DNA, 22 bp, Homo sapiens
cacagggaggcagccatgctcc

SEQ ID NO: 8221052 - DNA, 22 bp, Homo sapiens
cacagggagttacagaagcact

SEQ ID NO: 8221053 - DNA, 22 bp, Homo sapiens
cacagggcaccagttggccatc

SEQ ID NO: 8221054 - DNA, 22 bp, Homo sapiens
cacagggcaccagttggccatc

SEQ ID NO: 8221055 - DNA, 22 bp, Homo sapiens
cacagggcagagacctgggtgc

SEQ ID NO: 8221056 - DNA, 22 bp, Homo sapiens
ggaggcggaggttgcagtgagc

SEQ ID NO: 8221057 - DNA, 22 bp, Homo sapiens
ggaggcggaggctgcagtgagc

SEQ ID NO: 8221058 - DNA, 22 bp, Homo sapiens
ggaggcggaggctgcagtgagc

SEQ ID NO: 8221059 - DNA, 22 bp, Homo sapiens
ggagggagcagagaacccaacc

SEQ ID NO: 8221060 - DNA, 22 bp, Homo sapiens
ggagggagcagagaacccaacc

SEQ ID NO: 8221061 - DNA, 22 bp, Homo sapiens
ggagggagcatccccttgctga

SEQ ID NO: 8221062 - DNA, 22 bp, Homo sapiens
ggagggagggctagaccaaaga

SEQ ID NO: 8221063 - DNA, 22 bp, Homo sapiens
ggagggaggttagattcaagct

SEQ ID NO: 8221064 - DNA, 22 bp, Homo sapiens
ggagggaggttagattcaagct

SEQ ID NO: 8221065 - DNA, 22 bp, Homo sapiens
ggagggagggctagaccaaaga

SEQ ID NO: 8221066 - DNA, 22 bp, Homo sapiens
ggagggagggctagaccaaaga

SEQ ID NO: 8221067 - DNA, 23 bp, Homo sapiens
ggatgggcaagcctagtgcctac

SEQ ID NO: 8221068 - DNA, 22 bp, Homo sapiens
ggatgggagcagaggacgacca

SEQ ID NO: 8221069 - DNA, 22 bp, Homo sapiens
ggatctgggctgcagtctaggc

SEQ ID NO: 8221070 - DNA, 22 bp, Homo sapiens
ggatctcagggttctggtctgg

SEQ ID NO: 8221071 - DNA, 22 bp, Homo sapiens
ggatccttctttgacctcacag

SEQ ID NO: 8221072 - DNA, 22 bp, Homo sapiens
ggagggagtttcattcctgccc

SEQ ID NO: 8221073 - DNA, 22 bp, Homo sapiens
ggagggagtcagctgattagaa

SEQ ID NO: 8221074 - DNA, 22 bp, Homo sapiens
cacagcttgggctctgacaata

SEQ ID NO: 8221075 - DNA, 22 bp, Homo sapiens
cacagcttgggctctgacaata

SEQ ID NO: 8221076 - DNA, 22 bp, Homo sapiens
cacagcttgtttagtgactcac

SEQ ID NO: 8221077 - DNA, 22 bp, Homo sapiens
ggaggccaaggcaggtggatcg

SEQ ID NO: 8221078 - DNA, 22 bp, Homo sapiens
cacagcttgtttagtgactcac

SEQ ID NO: 8221079 - DNA, 22 bp, Homo sapiens
ggaggccaaggcgggcggatca

SEQ ID NO: 8221080 - DNA, 22 bp, Homo sapiens
ggaggccaaggcaggtggatcg

SEQ ID NO: 8221081 - DNA, 22 bp, Homo sapiens
ggaggccttgcctgcaggcaca

SEQ ID NO: 8221082 - DNA, 22 bp, Homo sapiens
ggaggccttgcctgcaggcaca

SEQ ID NO: 8221083 - DNA, 22 bp, Homo sapiens
cacagcttctgagtgaggattt

SEQ ID NO: 8221084 - DNA, 22 bp, Homo sapiens
cacagcttctccttgatatcgc

SEQ ID NO: 8221085 - DNA, 22 bp, Homo sapiens
cacagcttctccccgctgcggc

SEQ ID NO: 8221086 - DNA, 20 bp, Homo sapiens
cacagcttgccttttatgac

SEQ ID NO: 8221087 - DNA, 22 bp, Homo sapiens
cacagcttctgtctgacccatg

SEQ ID NO: 8221088 - DNA, 22 bp, Homo sapiens
cacagcttcttccattccactc

SEQ ID NO: 8221089 - DNA, 22 bp, Homo sapiens
ggaggcgcggctcggctgtgcc

SEQ ID NO: 8221090 - DNA, 22 bp, Homo sapiens
ggaggcggaagttgcagtgagc

SEQ ID NO: 8221091 - DNA, 22 bp, Homo sapiens
ggaggcgcggctcggctgtgcc

SEQ ID NO: 8221092 - DNA, 22 bp, Homo sapiens
ggaggcggacacaggtagtgtt

SEQ ID NO: 8221093 - DNA, 22 bp, Homo sapiens
ggaggcggaagttgcagtgagc

SEQ ID NO: 8221094 - DNA, 22 bp, Homo sapiens
ggaggcggaagttgcagtgagc

SEQ ID NO: 8221095 - DNA, 22 bp, Homo sapiens
ggaggcggaagttgcagtgagc

SEQ ID NO: 8221096 - DNA, 22 bp, Homo sapiens
ggaggcggagcttgcagtgagc

SEQ ID NO: 8221097 - DNA, 22 bp, Homo sapiens
ggaggcggagcttgcagtgagc

SEQ ID NO: 8221098 - DNA, 22 bp, Homo sapiens
ggaggcggacacaggtagtgtt

SEQ ID NO: 8221099 - DNA, 22 bp, Homo sapiens
ggaggcggaggctgcagtgagc

SEQ ID NO: 8221100 - DNA, 22 bp, Homo sapiens
ggaggcggaggctgcagtgagc

SEQ ID NO: 8221101 - DNA, 22 bp, Homo sapiens
ggaggcggagcttgcagtgagc

SEQ ID NO: 8221102 - DNA, 22 bp, Homo sapiens
ggaggcggagcttgcagtgagc

SEQ ID NO: 8221103 - DNA, 22 bp, Homo sapiens
cacactgtcaggtaaataacac

SEQ ID NO: 8221104 - DNA, 22 bp, Homo sapiens
cacactgtccccttctccccag

SEQ ID NO: 8221105 - DNA, 22 bp, Homo sapiens
cacagctgaagtagccatgtgg

SEQ ID NO: 8221106 - DNA, 22 bp, Homo sapiens
cacagctgaagtagccatgtgg

SEQ ID NO: 8221107 - DNA, 22 bp, Homo sapiens
cacagctgaagtagccatgtgg

SEQ ID NO: 8221108 - DNA, 22 bp, Homo sapiens
cacagctggtgcactagctctg

SEQ ID NO: 8221109 - DNA, 22 bp, Homo sapiens
cacagctggtgcactagctctg

SEQ ID NO: 8221110 - DNA, 22 bp, Homo sapiens
cacagctgaccaccctgctccc

SEQ ID NO: 8221111 - DNA, 22 bp, Homo sapiens
cacagctggtgacagagcccag

SEQ ID NO: 8221112 - DNA, 22 bp, Homo sapiens
cacactagcacttcagaggttc

SEQ ID NO: 8221113 - DNA, 22 bp, Homo sapiens
cacactcattagtcatttctct

SEQ ID NO: 8221114 - DNA, 22 bp, Homo sapiens
cacactgataggcttgacaggc

SEQ ID NO: 8221115 - DNA, 22 bp, Homo sapiens
cacactgtcaggtaaataacac

SEQ ID NO: 8221116 - DNA, 22 bp, Homo sapiens
cacagctgtatccaggagatcc

SEQ ID NO: 8221117 - DNA, 22 bp, Homo sapiens
cacagctggtgcactagctctg

SEQ ID NO: 8221118 - DNA, 22 bp, Homo sapiens
cacagctgttttctccaggcag

SEQ ID NO: 8221119 - DNA, 22 bp, Homo sapiens
cacagctgtgagaagggagcct

SEQ ID NO: 8221120 - DNA, 22 bp, Homo sapiens
cacagcttagaaaagaagccat

SEQ ID NO: 8221121 - DNA, 22 bp, Homo sapiens
cacagcttcagtttctgacttg

SEQ ID NO: 8221122 - DNA, 22 bp, Homo sapiens
cacagcttatgccactgattgg

SEQ ID NO: 8221123 - DNA, 22 bp, Homo sapiens
cacagcttccattagaatgaga

SEQ ID NO: 8221124 - DNA, 22 bp, Homo sapiens
cacagcttcccaaagtggacct

SEQ ID NO: 8221125 - DNA, 22 bp, Homo sapiens
cacagcttcccgtgcatggaga

SEQ ID NO: 8221126 - DNA, 22 bp, Homo sapiens
cacagtgtgggcatggtgcctg

SEQ ID NO: 8221127 - DNA, 22 bp, Homo sapiens
cacagtgtgactgaccttcagc

SEQ ID NO: 8221128 - DNA, 22 bp, Homo sapiens
ggcagatggaagaggctgggtc

SEQ ID NO: 8221129 - DNA, 22 bp, Homo sapiens
cacagtggtttccgattcagac

SEQ ID NO: 8221130 - DNA, 22 bp, Homo sapiens
cacagtgtagttaatgtgacat

SEQ ID NO: 8221131 - DNA, 22 bp, Homo sapiens
cacagtgtagttaatgtgacat

SEQ ID NO: 8221132 - DNA, 22 bp, Homo sapiens
cacagtgtgactgaccttcagc

SEQ ID NO: 8221133 - DNA, 22 bp, Homo sapiens
cacagtgtctgtgcttcagtgt

SEQ ID NO: 8221134 - DNA, 22 bp, Homo sapiens
ggcagatggaaggacagacgga

SEQ ID NO: 8221135 - DNA, 22 bp, Homo sapiens
ggcagcagtggctgctattgtc

SEQ ID NO: 8221136 - DNA, 22 bp, Homo sapiens
ggcagcagtggctgctattgtc

SEQ ID NO: 8221137 - DNA, 22 bp, Homo sapiens
ggcagcagtggctgctattgtc

SEQ ID NO: 8221138 - DNA, 20 bp, Homo sapiens
ggcagccaatcagcgtgccg

SEQ ID NO: 8221139 - DNA, 16 bp, Homo sapiens
cacagtgctgctgctc

SEQ ID NO: 8221140 - DNA, 22 bp, Homo sapiens
ggcagagcttgcagtgagccga

SEQ ID NO: 8221141 - DNA, 22 bp, Homo sapiens
cacagtgctcaaacacaagtgc

SEQ ID NO: 8221142 - DNA, 22 bp, Homo sapiens
ggcagagcttgcagtgagccga

SEQ ID NO: 8221143 - DNA, 22 bp, Homo sapiens
ggcagagcttgcagtgagccga

SEQ ID NO: 8221144 - DNA, 22 bp, Homo sapiens
cacagtggattgggtgatgccc

SEQ ID NO: 8221145 - DNA, 22 bp, Homo sapiens
cacagtggaagtccaggatccc

SEQ ID NO: 8221146 - DNA, 22 bp, Homo sapiens
cacagtggaaacagctaagcct

SEQ ID NO: 8221147 - DNA, 22 bp, Homo sapiens
cacagtggaaacagctaagcct

SEQ ID NO: 8221148 - DNA, 22 bp, Homo sapiens
cacagtgctttatgagagatct

SEQ ID NO: 8221149 - DNA, 22 bp, Homo sapiens
cacagtggcaggtgtgggttgt

SEQ ID NO: 8221150 - DNA, 22 bp, Homo sapiens
cacagtgtagactaataataga

SEQ ID NO: 8221151 - DNA, 22 bp, Homo sapiens
cacagtggtttccgattcagac

SEQ ID NO: 8221152 - DNA, 22 bp, Homo sapiens
cacagtggctttgctggtctcg

SEQ ID NO: 8221153 - DNA, 21 bp, Homo sapiens
ggcagagctggggcctccagc

SEQ ID NO: 8221154 - DNA, 21 bp, Homo sapiens
ggcagagctggggcctccagc

SEQ ID NO: 8221155 - DNA, 22 bp, Homo sapiens
ggcagagctgcatgagcactca

SEQ ID NO: 8221156 - DNA, 22 bp, Homo sapiens
ggcagagctgcatgagcactca

SEQ ID NO: 8221157 - DNA, 17 bp, Homo sapiens
ggcagagctgacagggc

SEQ ID NO: 8221158 - DNA, 17 bp, Homo sapiens
ggcagagctgacagggc

SEQ ID NO: 8221159 - DNA, 22 bp, Homo sapiens
ggcagagctctggactgagaac

SEQ ID NO: 8221160 - DNA, 17 bp, Homo sapiens
ggcagagctgacagggc

SEQ ID NO: 8221161 - DNA, 17 bp, Homo sapiens
ggcagagctgacagggc

SEQ ID NO: 8221162 - DNA, 22 bp, Homo sapiens
ggcagagccttctggagctcgc

SEQ ID NO: 8221163 - DNA, 22 bp, Homo sapiens
ggcagagccttctggagctcgc

SEQ ID NO: 8221164 - DNA, 22 bp, Homo sapiens
ggcagagcgcatgcgtcgcaga

SEQ ID NO: 8221165 - DNA, 22 bp, Homo sapiens
ggcagagctagtggcttctctt

SEQ ID NO: 8221166 - DNA, 22 bp, Homo sapiens
ggcagagcgcatgcgtcgcaga

SEQ ID NO: 8221167 - DNA, 20 bp, Homo sapiens
ggcagagctatgtctgttgc

SEQ ID NO: 8221168 - DNA, 22 bp, Homo sapiens
ggcagagctagtggcttctctt

SEQ ID NO: 8221169 - DNA, 22 bp, Homo sapiens
ggcagagctagtggcttctctt

SEQ ID NO: 8221170 - DNA, 20 bp, Homo sapiens
ggcactggaagcacacagga

SEQ ID NO: 8221171 - DNA, 20 bp, Homo sapiens
ggcactggaagcacacagga

SEQ ID NO: 8221172 - DNA, 22 bp, Homo sapiens
ggcacatgtatgtgggagtgtg

SEQ ID NO: 8221173 - DNA, 22 bp, Homo sapiens
ggcacatgtatgtgggagtgtg

SEQ ID NO: 8221174 - DNA, 22 bp, Homo sapiens
ggcacatggagacttggcatca

SEQ ID NO: 8221175 - DNA, 22 bp, Homo sapiens
ggcactggcctggggccaagag

SEQ ID NO: 8221176 - DNA, 22 bp, Homo sapiens
ggcactggcctggggccaagag

SEQ ID NO: 8221177 - DNA, 22 bp, Homo sapiens
ggcactggcctggggccaagag

SEQ ID NO: 8221178 - DNA, 22 bp, Homo sapiens
ggcactggcaaagcaaagtctg

SEQ ID NO: 8221179 - DNA, 22 bp, Homo sapiens
ggcactggcaaagcaaagtctg

SEQ ID NO: 8221180 - DNA, 22 bp, Homo sapiens
ggcactggaaggatcatgtgag

SEQ ID NO: 8221181 - DNA, 22 bp, Homo sapiens
ggcactggaaggatcatgtgag

SEQ ID NO: 8221182 - DNA, 22 bp, Homo sapiens
ggcactgggagaggtgagacgg

SEQ ID NO: 8221183 - DNA, 22 bp, Homo sapiens
ggcactgggagaggtgagacgg

SEQ ID NO: 8221184 - DNA, 22 bp, Homo sapiens
ggcactgggagaggtgagacgg

SEQ ID NO: 8221185 - DNA, 22 bp, Homo sapiens
ggcactgggcaccggctgaggg

SEQ ID NO: 8221186 - DNA, 22 bp, Homo sapiens
ggcagagagttctccacctctc

SEQ ID NO: 8221187 - DNA, 22 bp, Homo sapiens
ggcactgggcaccggctgaggg

SEQ ID NO: 8221188 - DNA, 22 bp, Homo sapiens
ggcactgggcaccggctgaggg

SEQ ID NO: 8221189 - DNA, 22 bp, Homo sapiens
ggcagagcagccccagggtttg

SEQ ID NO: 8221190 - DNA, 22 bp, Homo sapiens
ggcagagatgtgggtcagaatc

SEQ ID NO: 8221191 - DNA, 22 bp, Homo sapiens
ggcagagccttctggagctcgc

SEQ ID NO: 8221192 - DNA, 22 bp, Homo sapiens
ggcagagcctcagccctccacc

SEQ ID NO: 8221193 - DNA, 22 bp, Homo sapiens
ggcagagccttctggagctcgc

SEQ ID NO: 8221194 - DNA, 22 bp, Homo sapiens
ggcagagcctcagccctccacc

SEQ ID NO: 8221195 - DNA, 22 bp, Homo sapiens
ggcagagcctcagccctccacc

SEQ ID NO: 8221196 - DNA, 22 bp, Homo sapiens
ggcacagggggctgaggactag

SEQ ID NO: 8221197 - DNA, 22 bp, Homo sapiens
ggcacagggggctgaggactag

SEQ ID NO: 8221198 - DNA, 22 bp, Homo sapiens
ggcacagggggctgaggactag

SEQ ID NO: 8221199 - DNA, 22 bp, Homo sapiens
ggcacagggggctgaggactag

SEQ ID NO: 8221200 - DNA, 22 bp, Homo sapiens
ggcacagggaggccctggtgtg

SEQ ID NO: 8221201 - DNA, 22 bp, Homo sapiens
ggcacagggaggccctggtgtg

SEQ ID NO: 8221202 - DNA, 22 bp, Homo sapiens
ggcacagtccctggcacagagt

SEQ ID NO: 8221203 - DNA, 22 bp, Homo sapiens
ggcacagtgattaagagccagt

SEQ ID NO: 8221204 - DNA, 22 bp, Homo sapiens
ggcacagggtgatgttgcagtt

SEQ ID NO: 8221205 - DNA, 22 bp, Homo sapiens
ggcacagggtgatgttgcagtt

SEQ ID NO: 8221206 - DNA, 22 bp, Homo sapiens
ggcacagggtgatgttgcagtt

SEQ ID NO: 8221207 - DNA, 22 bp, Homo sapiens
ggcacagggtgatgttgcagtt

SEQ ID NO: 8221208 - DNA, 22 bp, Homo sapiens
ggcacagggggctgaggactag

SEQ ID NO: 8221209 - DNA, 22 bp, Homo sapiens
ggcacagggggctgaggactag

SEQ ID NO: 8221210 - DNA, 22 bp, Homo sapiens
ggcacaaggtttaaataacatc

SEQ ID NO: 8221211 - DNA, 22 bp, Homo sapiens
ggcacaagtttgatgtgagtta

SEQ ID NO: 8221212 - DNA, 22 bp, Homo sapiens
ggcacaaggtttaaataacatc

SEQ ID NO: 8221213 - DNA, 22 bp, Homo sapiens
cacagggcaggccccaggcctc

SEQ ID NO: 8221214 - DNA, 22 bp, Homo sapiens
cacagggcagagacctgggtgc

SEQ ID NO: 8221215 - DNA, 22 bp, Homo sapiens
cacagggcagagggtccgtggc

SEQ ID NO: 8221216 - DNA, 22 bp, Homo sapiens
ggcacaggagtcacagcatttc

SEQ ID NO: 8221217 - DNA, 22 bp, Homo sapiens
ggcacacaaaggcagcatttga

SEQ ID NO: 8221218 - DNA, 22 bp, Homo sapiens
ggcacaattgcagcaataaaca

SEQ ID NO: 8221219 - DNA, 22 bp, Homo sapiens
ggcacagggagccgcagttgca

SEQ ID NO: 8221220 - DNA, 22 bp, Homo sapiens
ggcacagggagccgcagttgca

SEQ ID NO: 8221221 - DNA, 22 bp, Homo sapiens
ggcacagggagaggcggatttt

SEQ ID NO: 8221222 - DNA, 22 bp, Homo sapiens
ggcacagggagccgcagttgca

SEQ ID NO: 8221223 - DNA, 22 bp, Homo sapiens
gcttggccagcagccgggatgc

SEQ ID NO: 8221224 - DNA, 22 bp, Homo sapiens
gcttggcatttgctgggagctg

SEQ ID NO: 8221225 - DNA, 22 bp, Homo sapiens
gcttggcattgaccattatcat

SEQ ID NO: 8221226 - DNA, 20 bp, Homo sapiens
gcttggcataggccacttga

SEQ ID NO: 8221227 - DNA, 22 bp, Homo sapiens
gcttggcagtgggtcctgcctt

SEQ ID NO: 8221228 - DNA, 22 bp, Homo sapiens
gcttctctttctcccctggcgg

SEQ ID NO: 8221229 - DNA, 22 bp, Homo sapiens
gcttctcttgtccaagggcagg

SEQ ID NO: 8221230 - DNA, 22 bp, Homo sapiens
gcttctctttctcccctggcgg

SEQ ID NO: 8221231 - DNA, 22 bp, Homo sapiens
gcttctcttcgcctaggtcctt

SEQ ID NO: 8221232 - DNA, 22 bp, Homo sapiens
gcttggcccattgatcagctgg

SEQ ID NO: 8221233 - DNA, 22 bp, Homo sapiens
gcttggccagcagccgggatgc

SEQ ID NO: 8221234 - DNA, 22 bp, Homo sapiens
gcttggccagcagccgggatgc

SEQ ID NO: 8221235 - DNA, 22 bp, Homo sapiens
gcttggccagcagccgggatgc

SEQ ID NO: 8221236 - DNA, 22 bp, Homo sapiens
gcttggccagcagccgggatgc

SEQ ID NO: 8221237 - DNA, 18 bp, Homo sapiens
gcttggctgcagagagag

SEQ ID NO: 8221238 - DNA, 22 bp, Homo sapiens
gcttggctgcctttggatgttg

SEQ ID NO: 8221239 - DNA, 22 bp, Homo sapiens
gcttggctggaaataggttgag

SEQ ID NO: 8221240 - DNA, 22 bp, Homo sapiens
gcttggctgcctttggatgttg

SEQ ID NO: 8221241 - DNA, 22 bp, Homo sapiens
cacaaaatatcaagcactttta

SEQ ID NO: 8221242 - DNA, 22 bp, Homo sapiens
caatttctctttatatctcaca

SEQ ID NO: 8221243 - DNA, 22 bp, Homo sapiens
caatttctcgaactctaatcca

SEQ ID NO: 8221244 - DNA, 22 bp, Homo sapiens
caatttctctttatatctcaca

SEQ ID NO: 8221245 - DNA, 22 bp, Homo sapiens
caatttctcgaactctaatcca

SEQ ID NO: 8221246 - DNA, 22 bp, Homo sapiens
gcttgggatatgctgatgtaaa

SEQ ID NO: 8221247 - DNA, 22 bp, Homo sapiens
gcttgggaggcaagcattccat

SEQ ID NO: 8221248 - DNA, 22 bp, Homo sapiens
gcttgggagagggtccccagga

SEQ ID NO: 8221249 - DNA, 22 bp, Homo sapiens
gcttgggaaacgtagttcctag

SEQ ID NO: 8221250 - DNA, 22 bp, Homo sapiens
gcttgggactggagaatagggt

SEQ ID NO: 8221251 - DNA, 22 bp, Homo sapiens
gcttgggactggagaatagggt

SEQ ID NO: 8221252 - DNA, 22 bp, Homo sapiens
gcttgggagaggcttcctcttt

SEQ ID NO: 8221253 - DNA, 22 bp, Homo sapiens
gcttgggacaggcttaggtgac

SEQ ID NO: 8221254 - DNA, 22 bp, Homo sapiens
gcttgggaagggccctgtgtac

SEQ ID NO: 8221255 - DNA, 22 bp, Homo sapiens
gctgtggcccttggcatctgcg

SEQ ID NO: 8221256 - DNA, 22 bp, Homo sapiens
gctgtggccgggcccaggccgc

SEQ ID NO: 8221257 - DNA, 22 bp, Homo sapiens
gctgtggcctggcgcagagctg

SEQ ID NO: 8221258 - DNA, 22 bp, Homo sapiens
gcttccaggggctgtgggctga

SEQ ID NO: 8221259 - DNA, 22 bp, Homo sapiens
gcttctcctcccgctcccaggc

SEQ ID NO: 8221260 - DNA, 22 bp, Homo sapiens
gcttctcctcccgctcccaggc

SEQ ID NO: 8221261 - DNA, 22 bp, Homo sapiens
gcttctcctcccgctcccaggc

SEQ ID NO: 8221262 - DNA, 22 bp, Homo sapiens
gcttctcctcccgctcccaggc

SEQ ID NO: 8221263 - DNA, 22 bp, Homo sapiens
gcttctccctacagatgtcagt

SEQ ID NO: 8221264 - DNA, 22 bp, Homo sapiens
gcttctccctacagatgtcagt

SEQ ID NO: 8221265 - DNA, 22 bp, Homo sapiens
gcttctccagaccttcatcccc

SEQ ID NO: 8221266 - DNA, 15 bp, Homo sapiens
gcttctccagatgac

SEQ ID NO: 8221267 - DNA, 22 bp, Homo sapiens
gcttctccagaccttcatcccc

SEQ ID NO: 8221268 - DNA, 22 bp, Homo sapiens
gcttctccagaccttcatcccc

SEQ ID NO: 8221269 - DNA, 22 bp, Homo sapiens
gcttctcttaatgcctggcttt

SEQ ID NO: 8221270 - DNA, 22 bp, Homo sapiens
gcttctctggctggtctgccac

SEQ ID NO: 8221271 - DNA, 22 bp, Homo sapiens
gcttctctggctggtctgccac

SEQ ID NO: 8221272 - DNA, 22 bp, Homo sapiens
gcttctcttaatgcctggcttt

SEQ ID NO: 8221273 - DNA, 22 bp, Homo sapiens
gcttctcttaatgcctggcttt

SEQ ID NO: 8221274 - DNA, 22 bp, Homo sapiens
gcttctctctcagactgcaagc

SEQ ID NO: 8221275 - DNA, 22 bp, Homo sapiens
gcttctctcaggagcatcagcc

SEQ ID NO: 8221276 - DNA, 22 bp, Homo sapiens
gcttctctcaggagcatcagcc

SEQ ID NO: 8221277 - DNA, 22 bp, Homo sapiens
gcttctctcaggagcatcagcc

SEQ ID NO: 8221278 - DNA, 22 bp, Homo sapiens
gcttctctggcctgcagggcat

SEQ ID NO: 8221279 - DNA, 22 bp, Homo sapiens
gcttctctggctggtctgccac

SEQ ID NO: 8221280 - DNA, 22 bp, Homo sapiens
gctgtgctgattcattccctgc

SEQ ID NO: 8221281 - DNA, 22 bp, Homo sapiens
gctgtgcttgggaagaatctct

SEQ ID NO: 8221282 - DNA, 18 bp, Homo sapiens
gctgtggaagtctttata

SEQ ID NO: 8221283 - DNA, 22 bp, Homo sapiens
gctgtgctggaaggggacctgc

SEQ ID NO: 8221284 - DNA, 20 bp, Homo sapiens
gctgtggcaagtgctcactg

SEQ ID NO: 8221285 - DNA, 22 bp, Homo sapiens
gctgtggatgctatggatcatc

SEQ ID NO: 8221286 - DNA, 22 bp, Homo sapiens
gctgtctgagaacatggtggaa

SEQ ID NO: 8221287 - DNA, 21 bp, Homo sapiens
gctgtctctggctcctgggaa

SEQ ID NO: 8221288 - DNA, 20 bp, Homo sapiens
gctgtctgacagttcccaga

SEQ ID NO: 8221289 - DNA, 22 bp, Homo sapiens
gctgtctctcccaggatccatg

SEQ ID NO: 8221290 - DNA, 22 bp, Homo sapiens
gctgtctgcatctctagagctt

SEQ ID NO: 8221291 - DNA, 22 bp, Homo sapiens
gctgtctgccgcaggctgccac

SEQ ID NO: 8221292 - DNA, 19 bp, Homo sapiens
gctgtctgatgctgaggtc

SEQ ID NO: 8221293 - DNA, 19 bp, Homo sapiens
gctgtctgatgctgaggtc

SEQ ID NO: 8221294 - DNA, 19 bp, Homo sapiens
gctgtctgatgctgaggtc

SEQ ID NO: 8221295 - DNA, 19 bp, Homo sapiens
gctgtctgatgctgaggtc

SEQ ID NO: 8221296 - DNA, 22 bp, Homo sapiens
caaggattaatagaatgaatca

SEQ ID NO: 8221297 - DNA, 22 bp, Homo sapiens
caaggattctcactagactaga

SEQ ID NO: 8221298 - DNA, 22 bp, Homo sapiens
caaggattctcactagactaga

SEQ ID NO: 8221299 - DNA, 22 bp, Homo sapiens
caaggatttcactggaaagcct

SEQ ID NO: 8221300 - DNA, 21 bp, Homo sapiens
caaggatttgagccaggagag

SEQ ID NO: 8221301 - DNA, 22 bp, Homo sapiens
caaggcagaattcagactcagg

SEQ ID NO: 8221302 - DNA, 20 bp, Homo sapiens
caaggcagaccagagtgagt

SEQ ID NO: 8221303 - DNA, 22 bp, Homo sapiens
caaggcagcgttcctttctgga

SEQ ID NO: 8221304 - DNA, 22 bp, Homo sapiens
caaggcagaattcagactcagg

SEQ ID NO: 8221305 - DNA, 22 bp, Homo sapiens
gctgtaactttttcattttcaa

SEQ ID NO: 8221306 - DNA, 22 bp, Homo sapiens
caaggcagctattgtctccata

SEQ ID NO: 8221307 - DNA, 22 bp, Homo sapiens
caaggcagcccgctgaaccaca

SEQ ID NO: 8221308 - DNA, 22 bp, Homo sapiens
caaggcagcgttcctttctgga

SEQ ID NO: 8221309 - DNA, 22 bp, Homo sapiens
gctgtctccatagctgtgtgtc

SEQ ID NO: 8221310 - DNA, 22 bp, Homo sapiens
gctgtctccccgcacccgaccg

SEQ ID NO: 8221311 - DNA, 22 bp, Homo sapiens
gctgtctcgcctgacactggct

SEQ ID NO: 8221312 - DNA, 21 bp, Homo sapiens
gctgtctcctccttgcaccag

SEQ ID NO: 8221313 - DNA, 22 bp, Homo sapiens
gctgtctccatagctgtgtgtc

SEQ ID NO: 8221314 - DNA, 22 bp, Homo sapiens
gctgtacaaggcctctgccatc

SEQ ID NO: 8221315 - DNA, 22 bp, Homo sapiens
ggaaaactgaggctctcagcag

SEQ ID NO: 8221316 - DNA, 21 bp, Homo sapiens
ggaaaactttccttgtctgaa

SEQ ID NO: 8221317 - DNA, 22 bp, Homo sapiens
ggaaaagaattgcagtgaagta

SEQ ID NO: 8221318 - DNA, 17 bp, Homo sapiens
ggaaaagaagagtagga

SEQ ID NO: 8221319 - DNA, 22 bp, Homo sapiens
cacaaaatctttctcgattatt

SEQ ID NO: 8221320 - DNA, 22 bp, Homo sapiens
cacaaaatctttctcgattatt

SEQ ID NO: 8221321 - DNA, 22 bp, Homo sapiens
cacaaaatctttctcgattatt

SEQ ID NO: 8221322 - DNA, 22 bp, Homo sapiens
cacaaaatatcaagcactttta

SEQ ID NO: 8221323 - DNA, 22 bp, Homo sapiens
cacaaaatatcaagcactttta

SEQ ID NO: 8221324 - DNA, 22 bp, Homo sapiens
cacaaaatatcaagcactttta

SEQ ID NO: 8221325 - DNA, 22 bp, Homo sapiens
cacaaacatcaatcctgttttc

SEQ ID NO: 8221326 - DNA, 22 bp, Homo sapiens
cacaaaggagaatgtcagcata

SEQ ID NO: 8221327 - DNA, 22 bp, Homo sapiens
cacaaaggagaatgtcagcata

SEQ ID NO: 8221328 - DNA, 22 bp, Homo sapiens
cacaaaggagaatgtcagcata

SEQ ID NO: 8221329 - DNA, 22 bp, Homo sapiens
cacaaaggagaatgtcagcata

SEQ ID NO: 8221330 - DNA, 23 bp, Homo sapiens
cacaaaggttccattctctcacc

SEQ ID NO: 8221331 - DNA, 23 bp, Homo sapiens
cacaaaggttccattctctcacc

SEQ ID NO: 8221332 - DNA, 23 bp, Homo sapiens
cacaaaggttccattctctcacc

SEQ ID NO: 8221333 - DNA, 19 bp, Homo sapiens
cacaacttcgcttgattcc

SEQ ID NO: 8221334 - DNA, 22 bp, Homo sapiens
ggaaaagtgttaaggtgttgat

SEQ ID NO: 8221335 - DNA, 22 bp, Homo sapiens
ggaaaatactgattcatgccat

SEQ ID NO: 8221336 - DNA, 22 bp, Homo sapiens
ggaaaatactgattcatgccat

SEQ ID NO: 8221337 - DNA, 22 bp, Homo sapiens
ggaaaaggccacagggacacat

SEQ ID NO: 8221338 - DNA, 22 bp, Homo sapiens
ggaaaaggccacagggacacat

SEQ ID NO: 8221339 - DNA, 22 bp, Homo sapiens
cacaattagcagctctttattt

SEQ ID NO: 8221340 - DNA, 22 bp, Homo sapiens
cacaattacttttgcaccaaca

SEQ ID NO: 8221341 - DNA, 22 bp, Homo sapiens
cacaattagcagctctttattt

SEQ ID NO: 8221342 - DNA, 22 bp, Homo sapiens
cacaattacttttgcaccaaca

SEQ ID NO: 8221343 - DNA, 22 bp, Homo sapiens
cacaatgtatatgtatatcaaa

SEQ ID NO: 8221344 - DNA, 22 bp, Homo sapiens
cacaagtcattttcagcaggct

SEQ ID NO: 8221345 - DNA, 22 bp, Homo sapiens
cacaagtctgtggtctccaaca

SEQ ID NO: 8221346 - DNA, 22 bp, Homo sapiens
cacaagtgaaccatgtgtcctt

SEQ ID NO: 8221347 - DNA, 22 bp, Homo sapiens
cacaagtggctggggaaaggga

SEQ ID NO: 8221348 - DNA, 22 bp, Homo sapiens
cacaataaatgtttgctgatga

SEQ ID NO: 8221349 - DNA, 22 bp, Homo sapiens
cacaatgatttggttcaaaaat

SEQ ID NO: 8221350 - DNA, 22 bp, Homo sapiens
cacaatattggccgggctggtc

SEQ ID NO: 8221351 - DNA, 22 bp, Homo sapiens
cacaatattggccgggctggtc

SEQ ID NO: 8221352 - DNA, 22 bp, Homo sapiens
cacacctgtaatcctagcactt

SEQ ID NO: 8221353 - DNA, 22 bp, Homo sapiens
cacacgagccctggagccagca

SEQ ID NO: 8221354 - DNA, 22 bp, Homo sapiens
cacacctcacacctcgcatgct

SEQ ID NO: 8221355 - DNA, 22 bp, Homo sapiens
cacacccaaatttctctctcag

SEQ ID NO: 8221356 - DNA, 23 bp, Homo sapiens
cacacccatcactaagagctcct

SEQ ID NO: 8221357 - DNA, 22 bp, Homo sapiens
cacacccaaattctaacagtag

SEQ ID NO: 8221358 - DNA, 23 bp, Homo sapiens
cacacccatcactaagagctcct

SEQ ID NO: 8221359 - DNA, 22 bp, Homo sapiens
cacaccagatggcagcgtggga

SEQ ID NO: 8221360 - DNA, 22 bp, Homo sapiens
cacaccagaggttacctgcaaa

SEQ ID NO: 8221361 - DNA, 22 bp, Homo sapiens
cacaccagaggttacctgcaaa

SEQ ID NO: 8221362 - DNA, 22 bp, Homo sapiens
cacaccagcatggtctcagtgt

SEQ ID NO: 8221363 - DNA, 23 bp, Homo sapiens
cacaccaggagccgtctgggcca

SEQ ID NO: 8221364 - DNA, 21 bp, Homo sapiens
cacaccaggcatgtcttgagc

SEQ ID NO: 8221365 - DNA, 23 bp, Homo sapiens
cacaccaggagccgtctgggcca

SEQ ID NO: 8221366 - DNA, 21 bp, Homo sapiens
cacaccaggcatgtcttgagc

SEQ ID NO: 8221367 - DNA, 22 bp, Homo sapiens
cacacattcaccatgactgaaa

SEQ ID NO: 8221368 - DNA, 22 bp, Homo sapiens
cacacattgaattcattcttgt

SEQ ID NO: 8221369 - DNA, 22 bp, Homo sapiens
cacacattggttttactccttt

SEQ ID NO: 8221370 - DNA, 22 bp, Homo sapiens
cacacattgagcagctgtttgt

SEQ ID NO: 8221371 - DNA, 22 bp, Homo sapiens
cacacatttcagatgctacaat

SEQ ID NO: 8221372 - DNA, 22 bp, Homo sapiens
cacacattgagcagctgtttgt

SEQ ID NO: 8221373 - DNA, 22 bp, Homo sapiens
cacacattggttttactccttt

SEQ ID NO: 8221374 - DNA, 22 bp, Homo sapiens
cacacatttcagatgctacaat

SEQ ID NO: 8221375 - DNA, 21 bp, Homo sapiens
cacaccaaacaggaacaggga

SEQ ID NO: 8221376 - DNA, 22 bp, Homo sapiens
cacacatttcagatgctacaat

SEQ ID NO: 8221377 - DNA, 22 bp, Homo sapiens
cacaatttgttttatcagtatt

SEQ ID NO: 8221378 - DNA, 22 bp, Homo sapiens
cacaatttgttttatcagtatt

SEQ ID NO: 8221379 - DNA, 22 bp, Homo sapiens
cacacatattgtccctagtgtg

SEQ ID NO: 8221380 - DNA, 22 bp, Homo sapiens
cacacatattgtccctagtgtg

SEQ ID NO: 8221381 - DNA, 22 bp, Homo sapiens
cacacatattgtccctagtgtg

SEQ ID NO: 8221382 - DNA, 22 bp, Homo sapiens
cacacatattgtccctagtgtg

SEQ ID NO: 8221383 - DNA, 22 bp, Homo sapiens
cacacatcaacctagacattgt

SEQ ID NO: 8221384 - DNA, 22 bp, Homo sapiens
cacacattagagccaatgtcag

SEQ ID NO: 8221385 - DNA, 22 bp, Homo sapiens
cacaatttgtttgctcttagtc

SEQ ID NO: 8221386 - DNA, 22 bp, Homo sapiens
cacaatttgtattttgcatcca

SEQ ID NO: 8221387 - DNA, 22 bp, Homo sapiens
cacaatttggtgctaaagaaag

SEQ ID NO: 8221388 - DNA, 22 bp, Homo sapiens
cacaatttggacttcactggtt

SEQ ID NO: 8221389 - DNA, 22 bp, Homo sapiens
cacaatttggggtgcccactgt

SEQ ID NO: 8221390 - DNA, 22 bp, Homo sapiens
cacaatttccttgcttcacttt

SEQ ID NO: 8221391 - DNA, 18 bp, Homo sapiens
cacaatttacagatgaca

SEQ ID NO: 8221392 - DNA, 22 bp, Homo sapiens
cacaattgtatcagaaaatagt

SEQ ID NO: 8221393 - DNA, 22 bp, Homo sapiens
cacaatttccaagtcatgttat

SEQ ID NO: 8221394 - DNA, 22 bp, Homo sapiens
cacaatttccattgagcagcag

SEQ ID NO: 8221395 - DNA, 22 bp, Homo sapiens
cacaatttcagttgcatgcaac

SEQ ID NO: 8221396 - DNA, 22 bp, Homo sapiens
cacaatttcagttgcatgcaac

SEQ ID NO: 8221397 - DNA, 19 bp, Homo sapiens
cacaattatgagacactta

SEQ ID NO: 8221398 - DNA, 22 bp, Homo sapiens
cacaattatagaagaaagcata

SEQ ID NO: 8221399 - DNA, 22 bp, Homo sapiens
cacaattagcagctctttattt

SEQ ID NO: 8221400 - DNA, 22 bp, Homo sapiens
cacaattagcagctctttattt

SEQ ID NO: 8221401 - DNA, 22 bp, Homo sapiens
cacaattattatctctttctac

SEQ ID NO: 8221402 - DNA, 22 bp, Homo sapiens
cacaattattatctctttctac

SEQ ID NO: 8221403 - DNA, 22 bp, Homo sapiens
caagagtgaaactctgtctcaa

SEQ ID NO: 8221404 - DNA, 22 bp, Homo sapiens
caagagttatcaatctatgtgc

SEQ ID NO: 8221405 - DNA, 22 bp, Homo sapiens
caagaggctaaactgggctatt

SEQ ID NO: 8221406 - DNA, 22 bp, Homo sapiens
caagaggctaaactgggctatt

SEQ ID NO: 8221407 - DNA, 22 bp, Homo sapiens
caagaggcaaattgtctagaag

SEQ ID NO: 8221408 - DNA, 22 bp, Homo sapiens
caagagcttctgctcttcatgg

SEQ ID NO: 8221409 - DNA, 22 bp, Homo sapiens
caagagctggagaggcagtcta

SEQ ID NO: 8221410 - DNA, 22 bp, Homo sapiens
caagagctggagaggcagtcta

SEQ ID NO: 8221411 - DNA, 18 bp, Homo sapiens
caagagctgctcctggcc

SEQ ID NO: 8221412 - DNA, 22 bp, Homo sapiens
caagatatcaatgacatagtat

SEQ ID NO: 8221413 - DNA, 22 bp, Homo sapiens
caagatcaatcaatactcctta

SEQ ID NO: 8221414 - DNA, 22 bp, Homo sapiens
caagatgaagtgaagattagaa

SEQ ID NO: 8221415 - DNA, 22 bp, Homo sapiens
caagatgaaactacagggagga

SEQ ID NO: 8221416 - DNA, 21 bp, Homo sapiens
caagatctcggcttgcttcct

SEQ ID NO: 8221417 - DNA, 22 bp, Homo sapiens
caagatcttggctgaagtacag

SEQ ID NO: 8221418 - DNA, 22 bp, Homo sapiens
caaggacactccctgctgggca

SEQ ID NO: 8221419 - DNA, 22 bp, Homo sapiens
caagctgctataggttgctggg

SEQ ID NO: 8221420 - DNA, 22 bp, Homo sapiens
caagctgctataggttgctggg

SEQ ID NO: 8221421 - DNA, 22 bp, Homo sapiens
caaggaatatttaagaacgtca

SEQ ID NO: 8221422 - DNA, 22 bp, Homo sapiens
caaggaagttttaggagaggaa

SEQ ID NO: 8221423 - DNA, 22 bp, Homo sapiens
caagatggagaagcagcaaggg

SEQ ID NO: 8221424 - DNA, 22 bp, Homo sapiens
caagatggagtccgggaatgtg

SEQ ID NO: 8221425 - DNA, 22 bp, Homo sapiens
caagatgatccctgaaggcagc

SEQ ID NO: 8221426 - DNA, 22 bp, Homo sapiens
caagattactatccactgctgg

SEQ ID NO: 8221427 - DNA, 21 bp, Homo sapiens
caagctgcctgagggtggttg

SEQ ID NO: 8221428 - DNA, 21 bp, Homo sapiens
caagctgcctgagggtggttg

SEQ ID NO: 8221429 - DNA, 22 bp, Homo sapiens
caaggagaaaacggcttctgaa

SEQ ID NO: 8221430 - DNA, 22 bp, Homo sapiens
caaggagaaaacggcttctgaa

SEQ ID NO: 8221431 - DNA, 22 bp, Homo sapiens
caaggagaaaacggcttctgaa

SEQ ID NO: 8221432 - DNA, 22 bp, Homo sapiens
caaggacagcgtcaggtgcaac

SEQ ID NO: 8221433 - DNA, 22 bp, Homo sapiens
caaggaggaagatgcaggggac

SEQ ID NO: 8221434 - DNA, 22 bp, Homo sapiens
caaggaggaagatgcaggggac

SEQ ID NO: 8221435 - DNA, 22 bp, Homo sapiens
caaggaggcagtgggacttgaa

SEQ ID NO: 8221436 - DNA, 22 bp, Homo sapiens
caaggaggaagatgcaggggac

SEQ ID NO: 8221437 - DNA, 22 bp, Homo sapiens
caaggagataaaatgttgagct

SEQ ID NO: 8221438 - DNA, 22 bp, Homo sapiens
caaggagataaaatgttgagct

SEQ ID NO: 8221439 - DNA, 22 bp, Homo sapiens
caaggagagtaattgaatgaga

SEQ ID NO: 8221440 - DNA, 22 bp, Homo sapiens
caaggagagtaattgaatgaga

SEQ ID NO: 8221441 - DNA, 22 bp, Homo sapiens
caaccctctcgcctcaattctg

SEQ ID NO: 8221442 - DNA, 22 bp, Homo sapiens
caaccgcggggcccagcggttc

SEQ ID NO: 8221443 - DNA, 22 bp, Homo sapiens
caaccccactacacgttggaga

SEQ ID NO: 8221444 - DNA, 22 bp, Homo sapiens
caaccccactacacgttggaga

SEQ ID NO: 8221445 - DNA, 22 bp, Homo sapiens
caacctcatagaaagaaaatgt

SEQ ID NO: 8221446 - DNA, 22 bp, Homo sapiens
caactacaggaaaagtcattca

SEQ ID NO: 8221447 - DNA, 22 bp, Homo sapiens
caactacatccacactttgtta

SEQ ID NO: 8221448 - DNA, 22 bp, Homo sapiens
gctgcctgccttgcctggagga

SEQ ID NO: 8221449 - DNA, 22 bp, Homo sapiens
gctgcctgccttgcctggagga

SEQ ID NO: 8221450 - DNA, 22 bp, Homo sapiens
gctgccttccataatgtacgta

SEQ ID NO: 8221451 - DNA, 22 bp, Homo sapiens
gctgccttccaaagagttttat

SEQ ID NO: 8221452 - DNA, 22 bp, Homo sapiens
gctgccttcccaggcctttgct

SEQ ID NO: 8221453 - DNA, 22 bp, Homo sapiens
gctgccttgaacttggcctggg

SEQ ID NO: 8221454 - DNA, 22 bp, Homo sapiens
gctgccttgaacttggcctggg

SEQ ID NO: 8221455 - DNA, 22 bp, Homo sapiens
gctgccttgaacatcctaagta

SEQ ID NO: 8221456 - DNA, 22 bp, Homo sapiens
gctgccttctggaggaagtgaa

SEQ ID NO: 8221457 - DNA, 22 bp, Homo sapiens
gctgccttctgagaagttaaat

SEQ ID NO: 8221458 - DNA, 22 bp, Homo sapiens
gctgccttcttctgactctatt

SEQ ID NO: 8221459 - DNA, 22 bp, Homo sapiens
gctgccttccctgttctttcag

SEQ ID NO: 8221460 - DNA, 22 bp, Homo sapiens
gctgccttccctgttctttcag

SEQ ID NO: 8221461 - DNA, 22 bp, Homo sapiens
gctgccttcccggaatgtcatc

SEQ ID NO: 8221462 - DNA, 18 bp, Homo sapiens
gctgccttcccagtcaag

SEQ ID NO: 8221463 - DNA, 22 bp, Homo sapiens
gctgccttcccggaatgtcatc

SEQ ID NO: 8221464 - DNA, 22 bp, Homo sapiens
gctgcctttagggggtgctcag

SEQ ID NO: 8221465 - DNA, 22 bp, Homo sapiens
gctgcctttagggggtgctcag

SEQ ID NO: 8221466 - DNA, 22 bp, Homo sapiens
gctgcctttgtgagccaagggg

SEQ ID NO: 8221467 - DNA, 20 bp, Homo sapiens
gctgccttgtcctgcttggt

SEQ ID NO: 8221468 - DNA, 22 bp, Homo sapiens
gctgccttgccaggggcagaaa

SEQ ID NO: 8221469 - DNA, 22 bp, Homo sapiens
gctgccttgccctcttcccata

SEQ ID NO: 8221470 - DNA, 22 bp, Homo sapiens
gctgccttgcttactccactgc

SEQ ID NO: 8221471 - DNA, 22 bp, Homo sapiens
gctgccttgcttactccactgc

SEQ ID NO: 8221472 - DNA, 22 bp, Homo sapiens
gctgccttggtagtgaccatct

SEQ ID NO: 8221473 - DNA, 22 bp, Homo sapiens
caagagctgaggctggagaggt

SEQ ID NO: 8221474 - DNA, 22 bp, Homo sapiens
caagagctcaccggagagcatt

SEQ ID NO: 8221475 - DNA, 22 bp, Homo sapiens
caagagctgcaaatagcgtgac

SEQ ID NO: 8221476 - DNA, 22 bp, Homo sapiens
caagagctgaggctggagaggt

SEQ ID NO: 8221477 - DNA, 22 bp, Homo sapiens
caagagctgaggctggagaggt

SEQ ID NO: 8221478 - DNA, 22 bp, Homo sapiens
gctgctggccccacatgctcca

SEQ ID NO: 8221479 - DNA, 22 bp, Homo sapiens
gctgctggcatctagggggtgg

SEQ ID NO: 8221480 - DNA, 22 bp, Homo sapiens
gctgctggcactggagtgagcc

SEQ ID NO: 8221481 - DNA, 22 bp, Homo sapiens
gctgctggccccacatgctcca

SEQ ID NO: 8221482 - DNA, 22 bp, Homo sapiens
caagacaagatctaagcatgct

SEQ ID NO: 8221483 - DNA, 22 bp, Homo sapiens
caagacaagatctaagcatgct

SEQ ID NO: 8221484 - DNA, 22 bp, Homo sapiens
gctgctggagagcgagactgtt

SEQ ID NO: 8221485 - DNA, 22 bp, Homo sapiens
gctgctggaagcatgcgatgaa

SEQ ID NO: 8221486 - DNA, 22 bp, Homo sapiens
gctgccttttgctcctcccacc

SEQ ID NO: 8221487 - DNA, 22 bp, Homo sapiens
gctgctggagagcgagactgtt

SEQ ID NO: 8221488 - DNA, 22 bp, Homo sapiens
gctgctggagagcgagactgtt

SEQ ID NO: 8221489 - DNA, 22 bp, Homo sapiens
gctgctggatgcgcttgatggt

SEQ ID NO: 8221490 - DNA, 22 bp, Homo sapiens
gctgctggatgcgcttgatggt

SEQ ID NO: 8221491 - DNA, 22 bp, Homo sapiens
gctgctggagctttgcagaagg

SEQ ID NO: 8221492 - DNA, 22 bp, Homo sapiens
gctgctggagctttgcagaagg

SEQ ID NO: 8221493 - DNA, 22 bp, Homo sapiens
gctgctggcactggagtgagcc

SEQ ID NO: 8221494 - DNA, 22 bp, Homo sapiens
gctgctggcactggagtgagcc

SEQ ID NO: 8221495 - DNA, 22 bp, Homo sapiens
gctgctggcactggagtgagcc

SEQ ID NO: 8221496 - DNA, 22 bp, Homo sapiens
gctgctggcactggagtgagcc

SEQ ID NO: 8221497 - DNA, 22 bp, Homo sapiens
gctgctggcactggagtgagcc

SEQ ID NO: 8221498 - DNA, 22 bp, Homo sapiens
caacatatataaggatttacta

SEQ ID NO: 8221499 - DNA, 22 bp, Homo sapiens
caacatatataaggatttacta

SEQ ID NO: 8221500 - DNA, 22 bp, Homo sapiens
caacatatgattttgtatataa

SEQ ID NO: 8221501 - DNA, 22 bp, Homo sapiens
caacatatgattttgtatataa

SEQ ID NO: 8221502 - DNA, 22 bp, Homo sapiens
caacatcagtcctcatgagaca

SEQ ID NO: 8221503 - DNA, 22 bp, Homo sapiens
caacatattttccaagagtgaa

SEQ ID NO: 8221504 - DNA, 22 bp, Homo sapiens
caacatattgtgggatgagaga

SEQ ID NO: 8221505 - DNA, 22 bp, Homo sapiens
caacatataatatttgagttct

SEQ ID NO: 8221506 - DNA, 22 bp, Homo sapiens
caacagtgattctgcatgagga

SEQ ID NO: 8221507 - DNA, 22 bp, Homo sapiens
caacagttctcatagcagattc

SEQ ID NO: 8221508 - DNA, 22 bp, Homo sapiens
caacatggcgaaaccccatctc

SEQ ID NO: 8221509 - DNA, 22 bp, Homo sapiens
caacatgccagacattagtttg

SEQ ID NO: 8221510 - DNA, 20 bp, Homo sapiens
caacatgagcaagtgaactg

SEQ ID NO: 8221511 - DNA, 22 bp, Homo sapiens
caacatggtgaaaccccgtctc

SEQ ID NO: 8221512 - DNA, 22 bp, Homo sapiens
caacatggtaaaaccccgtctc

SEQ ID NO: 8221513 - DNA, 22 bp, Homo sapiens
caacatttcaaggtctttagga

SEQ ID NO: 8221514 - DNA, 22 bp, Homo sapiens
caacatttcaaggtctttagga

SEQ ID NO: 8221515 - DNA, 22 bp, Homo sapiens
caacattatatagccacatgcc

SEQ ID NO: 8221516 - DNA, 22 bp, Homo sapiens
caacattatatagccacatgcc

SEQ ID NO: 8221517 - DNA, 22 bp, Homo sapiens
caacatttgagtaaagaaatgg

SEQ ID NO: 8221518 - DNA, 22 bp, Homo sapiens
caacatttgagtaaagaaatgg

SEQ ID NO: 8221519 - DNA, 22 bp, Homo sapiens
caacatttgagtaaagaaatgg

SEQ ID NO: 8221520 - DNA, 22 bp, Homo sapiens
caacatttcaaggtctttagga

SEQ ID NO: 8221521 - DNA, 22 bp, Homo sapiens
caacatttgtgatgagcaaact

SEQ ID NO: 8221522 - DNA, 22 bp, Homo sapiens
caacatttgtgatgagcaaact

SEQ ID NO: 8221523 - DNA, 22 bp, Homo sapiens
caacattttcatggccagggag

SEQ ID NO: 8221524 - DNA, 22 bp, Homo sapiens
caaccccactacacgttggaga

SEQ ID NO: 8221525 - DNA, 22 bp, Homo sapiens
caaccccactacacgttggaga

SEQ ID NO: 8221526 - DNA, 22 bp, Homo sapiens
gctgccacattttcaggactaa

SEQ ID NO: 8221527 - DNA, 23 bp, Homo sapiens
gctgccacagggctcaggcaggt

SEQ ID NO: 8221528 - DNA, 22 bp, Homo sapiens
gctgcattgctataaaatacaa

SEQ ID NO: 8221529 - DNA, 22 bp, Homo sapiens
gctgccaatccagctgtgggag

SEQ ID NO: 8221530 - DNA, 21 bp, Homo sapiens
gctgccaccgcgtgctccagg

SEQ ID NO: 8221531 - DNA, 22 bp, Homo sapiens
gctgccacattttcaggactaa

SEQ ID NO: 8221532 - DNA, 22 bp, Homo sapiens
gctgccacattttcaggactaa

SEQ ID NO: 8221533 - DNA, 19 bp, Homo sapiens
caacagtactggtttgtcc

SEQ ID NO: 8221534 - DNA, 22 bp, Homo sapiens
caacagtatagcttttgactgc

SEQ ID NO: 8221535 - DNA, 22 bp, Homo sapiens
caacagtcagaatgaagctgag

SEQ ID NO: 8221536 - DNA, 22 bp, Homo sapiens
caacactgacaatggactgatt

SEQ ID NO: 8221537 - DNA, 22 bp, Homo sapiens
gctgccaccgtggagatgagtg

SEQ ID NO: 8221538 - DNA, 22 bp, Homo sapiens
caacactgattatggctgagct

SEQ ID NO: 8221539 - DNA, 22 bp, Homo sapiens
caacactgattatggctgagct

SEQ ID NO: 8221540 - DNA, 22 bp, Homo sapiens
gctgcagccctgcggatcactt

SEQ ID NO: 8221541 - DNA, 22 bp, Homo sapiens
gctgcagccctgcggatcactt

SEQ ID NO: 8221542 - DNA, 22 bp, Homo sapiens
gctgcagcctttgggaaggaca

SEQ ID NO: 8221543 - DNA, 22 bp, Homo sapiens
gctgcagccttcttgccattaa

SEQ ID NO: 8221544 - DNA, 22 bp, Homo sapiens
gctgcagcctttgggaaggaca

SEQ ID NO: 8221545 - DNA, 22 bp, Homo sapiens
gctgcaggtttgtctagtctgg

SEQ ID NO: 8221546 - DNA, 22 bp, Homo sapiens
gctgcaggtttgtctagtctgg

SEQ ID NO: 8221547 - DNA, 22 bp, Homo sapiens
gctgcaggtttgtctagtctgg

SEQ ID NO: 8221548 - DNA, 17 bp, Homo sapiens
gctgcagcggtaggcag

SEQ ID NO: 8221549 - DNA, 22 bp, Homo sapiens
gctgcaggtttgtctagtctgg

SEQ ID NO: 8221550 - DNA, 17 bp, Homo sapiens
gctgcagcggtaggcag

SEQ ID NO: 8221551 - DNA, 22 bp, Homo sapiens
gctgcagtgagccaagatcgtg

SEQ ID NO: 8221552 - DNA, 22 bp, Homo sapiens
gctgcagtgagccaagatcgtg

SEQ ID NO: 8221553 - DNA, 22 bp, Homo sapiens
gctgcagtgagccaagatcgtg

SEQ ID NO: 8221554 - DNA, 22 bp, Homo sapiens
gctgcagtgagccaagatcgtg

SEQ ID NO: 8221555 - DNA, 22 bp, Homo sapiens
gctcctgcagagatgttccatg

SEQ ID NO: 8221556 - DNA, 22 bp, Homo sapiens
gctcctgcaggacccaggagac

SEQ ID NO: 8221557 - DNA, 17 bp, Homo sapiens
gctcctgcaggtcagga

SEQ ID NO: 8221558 - DNA, 18 bp, Homo sapiens
gctcctggaccaggtcac

SEQ ID NO: 8221559 - DNA, 22 bp, Homo sapiens
gctcctcttctcccactgaatg

SEQ ID NO: 8221560 - DNA, 22 bp, Homo sapiens
caaagtatatttcatagtctca

SEQ ID NO: 8221561 - DNA, 19 bp, Homo sapiens
caaagtacctggcacagtg

SEQ ID NO: 8221562 - DNA, 22 bp, Homo sapiens
caaagtaattacggttttggcc

SEQ ID NO: 8221563 - DNA, 22 bp, Homo sapiens
caaagtaatttggagatatata

SEQ ID NO: 8221564 - DNA, 22 bp, Homo sapiens
caaaggttgttgagagtgcagg

SEQ ID NO: 8221565 - DNA, 22 bp, Homo sapiens
caaaggttggaaatgtttacca

SEQ ID NO: 8221566 - DNA, 22 bp, Homo sapiens
caaaggttatgaaccacttgta

SEQ ID NO: 8221567 - DNA, 22 bp, Homo sapiens
caaaggtttcacagtagcccat

SEQ ID NO: 8221568 - DNA, 22 bp, Homo sapiens
gctgcagcaagccctccagggg

SEQ ID NO: 8221569 - DNA, 22 bp, Homo sapiens
gctgcagcaagccctccagggg

SEQ ID NO: 8221570 - DNA, 22 bp, Homo sapiens
gctgcagcaagccctccagggg

SEQ ID NO: 8221571 - DNA, 22 bp, Homo sapiens
gctgcagcagaagttctcagag

SEQ ID NO: 8221572 - DNA, 22 bp, Homo sapiens
gctgcagcccggcgcgcctgag

SEQ ID NO: 8221573 - DNA, 22 bp, Homo sapiens
gctgcagcccggcgcgcctgag

SEQ ID NO: 8221574 - DNA, 22 bp, Homo sapiens
gctgcagccaaattcattgtca

SEQ ID NO: 8221575 - DNA, 22 bp, Homo sapiens
gctgcagcagctgcagggttgt

SEQ ID NO: 8221576 - DNA, 19 bp, Homo sapiens
gctgcagcagagaaactgg

SEQ ID NO: 8221577 - DNA, 22 bp, Homo sapiens
gctgcagagggaggggctcgca

SEQ ID NO: 8221578 - DNA, 22 bp, Homo sapiens
gctgcagagatgggtgcccttt

SEQ ID NO: 8221579 - DNA, 22 bp, Homo sapiens
gctgcagagggaggggctcgca

SEQ ID NO: 8221580 - DNA, 22 bp, Homo sapiens
gctgcagagtgatgaagtgggg

SEQ ID NO: 8221581 - DNA, 22 bp, Homo sapiens
gctgcagatcccacccattccc

SEQ ID NO: 8221582 - DNA, 22 bp, Homo sapiens
gctgcagagtgatgaagtgggg

SEQ ID NO: 8221583 - DNA, 19 bp, Homo sapiens
gctgcagagtattcttggg

SEQ ID NO: 8221584 - DNA, 22 bp, Homo sapiens
gctgcagacttctcatctcatt

SEQ ID NO: 8221585 - DNA, 22 bp, Homo sapiens
gctgaggtggaggaaggagacc

SEQ ID NO: 8221586 - DNA, 22 bp, Homo sapiens
gctgcagagacagctgccgatg

SEQ ID NO: 8221587 - DNA, 20 bp, Homo sapiens
gctgaggtggaggaaggaga

SEQ ID NO: 8221588 - DNA, 19 bp, Homo sapiens
gctcctggatgacctgtgg

SEQ ID NO: 8221589 - DNA, 19 bp, Homo sapiens
gctcctggatgacctgtgg

SEQ ID NO: 8221590 - DNA, 22 bp, Homo sapiens
gctgaggtggaggaaggagacc

SEQ ID NO: 8221591 - DNA, 22 bp, Homo sapiens
gctgaggtggaggaaggagacc

SEQ ID NO: 8221592 - DNA, 20 bp, Homo sapiens
gctgaggtggaggaaggaga

SEQ ID NO: 8221593 - DNA, 20 bp, Homo sapiens
gctgaggtggaggaaggaga

SEQ ID NO: 8221594 - DNA, 19 bp, Homo sapiens
gctcctggatgacctgtgg

SEQ ID NO: 8221595 - DNA, 19 bp, Homo sapiens
gctcctggatgacctgtgg

SEQ ID NO: 8221596 - DNA, 19 bp, Homo sapiens
gctcctggatgacctgtgg

SEQ ID NO: 8221597 - DNA, 22 bp, Homo sapiens
gctcctggagagattgagaaag

SEQ ID NO: 8221598 - DNA, 22 bp, Homo sapiens
gctcctggagagattgagaaag

SEQ ID NO: 8221599 - DNA, 18 bp, Homo sapiens
gctcctggaccaggtcac

SEQ ID NO: 8221600 - DNA, 18 bp, Homo sapiens
gctcctggagtctgactc

SEQ ID NO: 8221601 - DNA, 18 bp, Homo sapiens
gctcctggagtctgactc

SEQ ID NO: 8221602 - DNA, 18 bp, Homo sapiens
gctcctggagtctgactc

SEQ ID NO: 8221603 - DNA, 22 bp, Homo sapiens
cagaggtttgatcgagtaggtc

SEQ ID NO: 8221604 - DNA, 22 bp, Homo sapiens
cagagtaaacctgtcatcaaga

SEQ ID NO: 8221605 - DNA, 22 bp, Homo sapiens
cagagtaaacctgtcatcaaga

SEQ ID NO: 8221606 - DNA, 22 bp, Homo sapiens
cagaggttacctagagcaagaa

SEQ ID NO: 8221607 - DNA, 22 bp, Homo sapiens
cagaggtgtacagagggaggcc

SEQ ID NO: 8221608 - DNA, 23 bp, Homo sapiens
cagaggtgtcagtgcccagtgtc

SEQ ID NO: 8221609 - DNA, 22 bp, Homo sapiens
cagaggtgtacagagggaggcc

SEQ ID NO: 8221610 - DNA, 22 bp, Homo sapiens
cagaggtggggagtatttcaag

SEQ ID NO: 8221611 - DNA, 22 bp, Homo sapiens
cagaggtagggagctatgttat

SEQ ID NO: 8221612 - DNA, 21 bp, Homo sapiens
cagaggtggcctgacctctga

SEQ ID NO: 8221613 - DNA, 22 bp, Homo sapiens
cagaggctggcggccgccccga

SEQ ID NO: 8221614 - DNA, 22 bp, Homo sapiens
cagaggctgggacctcaggcat

SEQ ID NO: 8221615 - DNA, 22 bp, Homo sapiens
cagaggctgggacctcaggcat

SEQ ID NO: 8221616 - DNA, 22 bp, Homo sapiens
cagaggctgggacctcaggcat

SEQ ID NO: 8221617 - DNA, 22 bp, Homo sapiens
cagaggctgggacctcaggcat

SEQ ID NO: 8221618 - DNA, 22 bp, Homo sapiens
cagaggctgtgtaggcagactg

SEQ ID NO: 8221619 - DNA, 22 bp, Homo sapiens
cagaggctgtgtaggcagactg

SEQ ID NO: 8221620 - DNA, 22 bp, Homo sapiens
cagaggctttgccctggaaacc

SEQ ID NO: 8221621 - DNA, 22 bp, Homo sapiens
cagaggtagccgagtgcaatcg

SEQ ID NO: 8221622 - DNA, 22 bp, Homo sapiens
cagaggctttgccctggaaacc

SEQ ID NO: 8221623 - DNA, 22 bp, Homo sapiens
cagaggcttcaagtcattctcc

SEQ ID NO: 8221624 - DNA, 22 bp, Homo sapiens
cagaggcttggcattatcatgc

SEQ ID NO: 8221625 - DNA, 22 bp, Homo sapiens
cagaggcttatacctgattagg

SEQ ID NO: 8221626 - DNA, 22 bp, Homo sapiens
cagaggcttcaagtcattctcc

SEQ ID NO: 8221627 - DNA, 22 bp, Homo sapiens
cagaggctgtgtaggcagactg

SEQ ID NO: 8221628 - DNA, 22 bp, Homo sapiens
gggtgctgactggggcctgaaa

SEQ ID NO: 8221629 - DNA, 22 bp, Homo sapiens
gggtgctgaggaagacagcagg

SEQ ID NO: 8221630 - DNA, 22 bp, Homo sapiens
gggtgctgaggaagacagcagg

SEQ ID NO: 8221631 - DNA, 22 bp, Homo sapiens
gggtgctgactggggcctgaaa

SEQ ID NO: 8221632 - DNA, 22 bp, Homo sapiens
gggtgctgactggggcctgaaa

SEQ ID NO: 8221633 - DNA, 22 bp, Homo sapiens
gggtgctgaggaagacagcagg

SEQ ID NO: 8221634 - DNA, 23 bp, Homo sapiens
gggtgctgcctgtagtcatgctg

SEQ ID NO: 8221635 - DNA, 23 bp, Homo sapiens
gggtgctgcctgtagtcatgctg

SEQ ID NO: 8221636 - DNA, 22 bp, Homo sapiens
cagaggctggatggacttgcct

SEQ ID NO: 8221637 - DNA, 22 bp, Homo sapiens
gggtgctcctggcggcctcttt

SEQ ID NO: 8221638 - DNA, 22 bp, Homo sapiens
gggtgctcctggcggcctcttt

SEQ ID NO: 8221639 - DNA, 22 bp, Homo sapiens
gggtgctcatggataaggcgaa

SEQ ID NO: 8221640 - DNA, 22 bp, Homo sapiens
gggtgcctgagttagggcagaa

SEQ ID NO: 8221641 - DNA, 22 bp, Homo sapiens
gggtgcctgagttagggcagaa

SEQ ID NO: 8221642 - DNA, 22 bp, Homo sapiens
gggtgcctgcctcaggcagtgt

SEQ ID NO: 8221643 - DNA, 22 bp, Homo sapiens
gggtgccctgggtaggtcagtt

SEQ ID NO: 8221644 - DNA, 22 bp, Homo sapiens
gggtgcagtggttcacgcctgt

SEQ ID NO: 8221645 - DNA, 22 bp, Homo sapiens
gggtgcagggtctccagcagct

SEQ ID NO: 8221646 - DNA, 22 bp, Homo sapiens
gggtgcagggtctccagcagct

SEQ ID NO: 8221647 - DNA, 22 bp, Homo sapiens
gggtgcagggtctccagcagct

SEQ ID NO: 8221648 - DNA, 22 bp, Homo sapiens
gggtgcagtggttcacgcctgt

SEQ ID NO: 8221649 - DNA, 22 bp, Homo sapiens
gggtgcagggtctccagcagct

SEQ ID NO: 8221650 - DNA, 22 bp, Homo sapiens
gggtgcaggggaccctagggac

SEQ ID NO: 8221651 - DNA, 22 bp, Homo sapiens
gggtgcaggggaccctagggac

SEQ ID NO: 8221652 - DNA, 22 bp, Homo sapiens
cagaggcctggcttggacacct

SEQ ID NO: 8221653 - DNA, 22 bp, Homo sapiens
cagaggcctggcttggacacct

SEQ ID NO: 8221654 - DNA, 22 bp, Homo sapiens
cagaggcctggcttggacacct

SEQ ID NO: 8221655 - DNA, 22 bp, Homo sapiens
gggtcgggcaggcgccctcgtc

SEQ ID NO: 8221656 - DNA, 22 bp, Homo sapiens
gggtctaggagacatgggcaag

SEQ ID NO: 8221657 - DNA, 22 bp, Homo sapiens
ggggaagaaatctgggttcttc

SEQ ID NO: 8221658 - DNA, 20 bp, Homo sapiens
ggggaagaaaaggatgtgat

SEQ ID NO: 8221659 - DNA, 22 bp, Homo sapiens
ggggaagaaatctgggttcttc

SEQ ID NO: 8221660 - DNA, 22 bp, Homo sapiens
ggggaagaatgctctctagaga

SEQ ID NO: 8221661 - DNA, 22 bp, Homo sapiens
cagagctggtaagtggtagagg

SEQ ID NO: 8221662 - DNA, 22 bp, Homo sapiens
cagagctggtaagtggtagagg

SEQ ID NO: 8221663 - DNA, 22 bp, Homo sapiens
cagagctggtaagtggtagagg

SEQ ID NO: 8221664 - DNA, 22 bp, Homo sapiens
cagagctggtgtgtcctggcat

SEQ ID NO: 8221665 - DNA, 22 bp, Homo sapiens
cagagctggtgtgtcctggcat

SEQ ID NO: 8221666 - DNA, 22 bp, Homo sapiens
cagagctggtgtgtcctggcat

SEQ ID NO: 8221667 - DNA, 22 bp, Homo sapiens
cagagctggtgtgtcctggcat

SEQ ID NO: 8221668 - DNA, 22 bp, Homo sapiens
cagagctggtgtgtcctggcat

SEQ ID NO: 8221669 - DNA, 21 bp, Homo sapiens
cagaggcaggctctgtgtgtg

SEQ ID NO: 8221670 - DNA, 21 bp, Homo sapiens
cagaggcaggctctgtgtgtg

SEQ ID NO: 8221671 - DNA, 20 bp, Homo sapiens
cagaggcattttcagactct

SEQ ID NO: 8221672 - DNA, 22 bp, Homo sapiens
cagaggcaggataagaactgcg

SEQ ID NO: 8221673 - DNA, 22 bp, Homo sapiens
cagaggccacctgtggccactg

SEQ ID NO: 8221674 - DNA, 22 bp, Homo sapiens
cagaggccacctgtggccactg

SEQ ID NO: 8221675 - DNA, 20 bp, Homo sapiens
cagaggcattttcagactct

SEQ ID NO: 8221676 - DNA, 22 bp, Homo sapiens
cagagctggtgttacaagtcca

SEQ ID NO: 8221677 - DNA, 22 bp, Homo sapiens
cagagctggtgtgtcctggcat

SEQ ID NO: 8221678 - DNA, 22 bp, Homo sapiens
cagagctggtgttacaagtcca

SEQ ID NO: 8221679 - DNA, 22 bp, Homo sapiens
cagagctggtgttacaagtcca

SEQ ID NO: 8221680 - DNA, 22 bp, Homo sapiens
cagagctggtgttacaagtcca

SEQ ID NO: 8221681 - DNA, 22 bp, Homo sapiens
cagagctggtgttacaagtcca

SEQ ID NO: 8221682 - DNA, 22 bp, Homo sapiens
cagagctgtcatttgccagtga

SEQ ID NO: 8221683 - DNA, 22 bp, Homo sapiens
cagagctgtcatttgccagtga

SEQ ID NO: 8221684 - DNA, 22 bp, Homo sapiens
cagagctgtatttatctttcca

SEQ ID NO: 8221685 - DNA, 21 bp, Homo sapiens
cagaggcctcatgctctgtgc

SEQ ID NO: 8221686 - DNA, 21 bp, Homo sapiens
cagaggcctcatgctctgtgc

SEQ ID NO: 8221687 - DNA, 22 bp, Homo sapiens
cagaggcctatccagtgtccat

SEQ ID NO: 8221688 - DNA, 22 bp, Homo sapiens
cagaggcctcacttccagccag

SEQ ID NO: 8221689 - DNA, 22 bp, Homo sapiens
cagaggcctcacttccagccag

SEQ ID NO: 8221690 - DNA, 21 bp, Homo sapiens
cagaggcctatcacagactcc

SEQ ID NO: 8221691 - DNA, 21 bp, Homo sapiens
cagaggcctatcacagactcc

SEQ ID NO: 8221692 - DNA, 21 bp, Homo sapiens
cagaggcctatcacagactcc

SEQ ID NO: 8221693 - DNA, 22 bp, Homo sapiens
cagaggcctatccagtgtccat

SEQ ID NO: 8221694 - DNA, 22 bp, Homo sapiens
cagaggcctatccagtgtccat

SEQ ID NO: 8221695 - DNA, 22 bp, Homo sapiens
cagaggcctatccagtgtccat

SEQ ID NO: 8221696 - DNA, 21 bp, Homo sapiens
cagaggcctatcacagactcc

SEQ ID NO: 8221697 - DNA, 22 bp, Homo sapiens
cagaggccccagaactagctct

SEQ ID NO: 8221698 - DNA, 22 bp, Homo sapiens
cagaggccccagaactagctct

SEQ ID NO: 8221699 - DNA, 19 bp, Homo sapiens
cagaggccagaagcacagg

SEQ ID NO: 8221700 - DNA, 22 bp, Homo sapiens
cagaggccaggctgcctgactg

SEQ ID NO: 8221701 - DNA, 22 bp, Homo sapiens
cagaggccagggggctcacaaa

SEQ ID NO: 8221702 - DNA, 22 bp, Homo sapiens
cagaggccagggggctcacaaa

SEQ ID NO: 8221703 - DNA, 22 bp, Homo sapiens
cagaggccagggggctcacaaa

SEQ ID NO: 8221704 - DNA, 22 bp, Homo sapiens
cagaggccaggctgcctgactg

SEQ ID NO: 8221705 - DNA, 22 bp, Homo sapiens
cagaggccaggctgcctgactg

SEQ ID NO: 8221706 - DNA, 22 bp, Homo sapiens
cagaggcccagtgagagggctg

SEQ ID NO: 8221707 - DNA, 22 bp, Homo sapiens
cagaggccagtggacaagggcc

SEQ ID NO: 8221708 - DNA, 22 bp, Homo sapiens
cagaggccatatttcttcactc

SEQ ID NO: 8221709 - DNA, 22 bp, Homo sapiens
cagaggccagtggacaagggcc

SEQ ID NO: 8221710 - DNA, 22 bp, Homo sapiens
cagaggccagtggacaagggcc

SEQ ID NO: 8221711 - DNA, 22 bp, Homo sapiens
cagaggccagggggctcacaaa

SEQ ID NO: 8221712 - DNA, 22 bp, Homo sapiens
cagagctgcagattgaaggcat

SEQ ID NO: 8221713 - DNA, 22 bp, Homo sapiens
cagagctgcagattgaaggcat

SEQ ID NO: 8221714 - DNA, 22 bp, Homo sapiens
cagagctgcagattgaaggcat

SEQ ID NO: 8221715 - DNA, 22 bp, Homo sapiens
cagagctgcgctttttcctggt

SEQ ID NO: 8221716 - DNA, 22 bp, Homo sapiens
cagagctgcgctttttcctggt

SEQ ID NO: 8221717 - DNA, 22 bp, Homo sapiens
cagagctgcgctttttcctggt

SEQ ID NO: 8221718 - DNA, 22 bp, Homo sapiens
cagagctgcgctttttcctggt

SEQ ID NO: 8221719 - DNA, 19 bp, Homo sapiens
cagagctgctggcctcgtc

SEQ ID NO: 8221720 - DNA, 22 bp, Homo sapiens
cagagctgctcatggtggccag

SEQ ID NO: 8221721 - DNA, 22 bp, Homo sapiens
cagagctgctcatggtggccag

SEQ ID NO: 8221722 - DNA, 22 bp, Homo sapiens
cagagctgctcatggtggccag

SEQ ID NO: 8221723 - DNA, 19 bp, Homo sapiens
cagagctgctggcctcgtc

SEQ ID NO: 8221724 - DNA, 19 bp, Homo sapiens
cagagctgctggcctcgtc

SEQ ID NO: 8221725 - DNA, 19 bp, Homo sapiens
cagagctgctggcctcgtc

SEQ ID NO: 8221726 - DNA, 22 bp, Homo sapiens
gggctgtgtactatgaggaggg

SEQ ID NO: 8221727 - DNA, 22 bp, Homo sapiens
gggctgtgtactatgaggaggg

SEQ ID NO: 8221728 - DNA, 22 bp, Homo sapiens
ggggaaacatgttgttcagacc

SEQ ID NO: 8221729 - DNA, 22 bp, Homo sapiens
gggctgtgtactatgaggaggg

SEQ ID NO: 8221730 - DNA, 22 bp, Homo sapiens
gggctgtgtactatgaggaggg

SEQ ID NO: 8221731 - DNA, 22 bp, Homo sapiens
gggctgtgtactatgaggaggg

SEQ ID NO: 8221732 - DNA, 22 bp, Homo sapiens
ggggaaactgaggcacagacag

SEQ ID NO: 8221733 - DNA, 23 bp, Homo sapiens
ggggaaagaccatgcttgaggac

SEQ ID NO: 8221734 - DNA, 23 bp, Homo sapiens
ggggaaagaccatgcttgaggac

SEQ ID NO: 8221735 - DNA, 20 bp, Homo sapiens
ggggaagaaaaggatgtgat

SEQ ID NO: 8221736 - DNA, 20 bp, Homo sapiens
ggggaagaaaaggatgtgat

SEQ ID NO: 8221737 - DNA, 22 bp, Homo sapiens
ggggaaattgtggctgacagtg

SEQ ID NO: 8221738 - DNA, 22 bp, Homo sapiens
ggggaaagtgaattgtgtagtg

SEQ ID NO: 8221739 - DNA, 22 bp, Homo sapiens
ggggaaaggccatggcaagaac

SEQ ID NO: 8221740 - DNA, 22 bp, Homo sapiens
ggggaaagccagccctgcttcc

SEQ ID NO: 8221741 - DNA, 22 bp, Homo sapiens
gggcgcagccaatcctggccct

SEQ ID NO: 8221742 - DNA, 22 bp, Homo sapiens
gggcgcagccaatcctggccct

SEQ ID NO: 8221743 - DNA, 22 bp, Homo sapiens
gggcgcagccaatcctggccct

SEQ ID NO: 8221744 - DNA, 22 bp, Homo sapiens
gggcgccgtgggaaacagccgg

SEQ ID NO: 8221745 - DNA, 22 bp, Homo sapiens
cagagcctggcgatgtcatgga

SEQ ID NO: 8221746 - DNA, 22 bp, Homo sapiens
cagagcctggcgatgtcatgga

SEQ ID NO: 8221747 - DNA, 22 bp, Homo sapiens
cagagcctgctgccttctgaag

SEQ ID NO: 8221748 - DNA, 22 bp, Homo sapiens
cagagctgacccaaggattgaa

SEQ ID NO: 8221749 - DNA, 22 bp, Homo sapiens
cagagctgacccaaggattgaa

SEQ ID NO: 8221750 - DNA, 22 bp, Homo sapiens
cagagctgagaatgttgatgct

SEQ ID NO: 8221751 - DNA, 22 bp, Homo sapiens
cagagctgacccaaggattgaa

SEQ ID NO: 8221752 - DNA, 21 bp, Homo sapiens
cagagctctttctgcttgctg

SEQ ID NO: 8221753 - DNA, 21 bp, Homo sapiens
cagagctctttctgcttgctg

SEQ ID NO: 8221754 - DNA, 21 bp, Homo sapiens
cagagctgaagggtgtagtgt

SEQ ID NO: 8221755 - DNA, 22 bp, Homo sapiens
cagagctgattggatccagaga

SEQ ID NO: 8221756 - DNA, 22 bp, Homo sapiens
cagagctgattggatccagaga

SEQ ID NO: 8221757 - DNA, 22 bp, Homo sapiens
cagagctgattggatccagaga

SEQ ID NO: 8221758 - DNA, 23 bp, Homo sapiens
cagagctgattaaacttaatctc

SEQ ID NO: 8221759 - DNA, 23 bp, Homo sapiens
cagagctgattaaacttaatctc

SEQ ID NO: 8221760 - DNA, 22 bp, Homo sapiens
cagagctgagtcttcaaggttg

SEQ ID NO: 8221761 - DNA, 22 bp, Homo sapiens
cagagctgagtcttcaaggttg

SEQ ID NO: 8221762 - DNA, 22 bp, Homo sapiens
cagagctgagaatgttgatgct

SEQ ID NO: 8221763 - DNA, 22 bp, Homo sapiens
cagagctgagaatgttgatgct

SEQ ID NO: 8221764 - DNA, 22 bp, Homo sapiens
cagagctgagtcttcaaggttg

SEQ ID NO: 8221765 - DNA, 22 bp, Homo sapiens
cagagctgcagattgaaggcat

SEQ ID NO: 8221766 - DNA, 22 bp, Homo sapiens
cagagctgcacattctatgatg

SEQ ID NO: 8221767 - DNA, 22 bp, Homo sapiens
cagagctgcacattctatgatg

SEQ ID NO: 8221768 - DNA, 22 bp, Homo sapiens
cagagctgcacattctatgatg

SEQ ID NO: 8221769 - DNA, 22 bp, Homo sapiens
cagagctgcacattctatgatg

SEQ ID NO: 8221770 - DNA, 22 bp, Homo sapiens
cagagctgcacattctatgatg

SEQ ID NO: 8221771 - DNA, 22 bp, Homo sapiens
cagagctgattggatccagaga

SEQ ID NO: 8221772 - DNA, 22 bp, Homo sapiens
cagagctgcaaatgcccctccg

SEQ ID NO: 8221773 - DNA, 22 bp, Homo sapiens
cagagctgcaaatgcccctccg

SEQ ID NO: 8221774 - DNA, 22 bp, Homo sapiens
cagagctgcaaatgcccctccg

SEQ ID NO: 8221775 - DNA, 22 bp, Homo sapiens
cagagcccttcctcccacgggg

SEQ ID NO: 8221776 - DNA, 22 bp, Homo sapiens
gggccttgccatggagcctgag

SEQ ID NO: 8221777 - DNA, 22 bp, Homo sapiens
gggcgagggcgaaagcgagagc

SEQ ID NO: 8221778 - DNA, 21 bp, Homo sapiens
gggcgaggcctgatgtggctc

SEQ ID NO: 8221779 - DNA, 22 bp, Homo sapiens
gggcgagggcgaaagcgagagc

SEQ ID NO: 8221780 - DNA, 22 bp, Homo sapiens
cagagcccctgggttgggagct

SEQ ID NO: 8221781 - DNA, 22 bp, Homo sapiens
cagagcccctcgtctccaccac

SEQ ID NO: 8221782 - DNA, 22 bp, Homo sapiens
cagagcccctcgtctccaccac

SEQ ID NO: 8221783 - DNA, 22 bp, Homo sapiens
cagagccctagtcctgatggcc

SEQ ID NO: 8221784 - DNA, 22 bp, Homo sapiens
cagagccctagtcctgatggcc

SEQ ID NO: 8221785 - DNA, 22 bp, Homo sapiens
cagagcccctcagctctctccc

SEQ ID NO: 8221786 - DNA, 22 bp, Homo sapiens
cagagccccccttctgatcaca

SEQ ID NO: 8221787 - DNA, 22 bp, Homo sapiens
cagagccccccttctgatcaca

SEQ ID NO: 8221788 - DNA, 22 bp, Homo sapiens
cagagccccccttctgatcaca

SEQ ID NO: 8221789 - DNA, 22 bp, Homo sapiens
cagagcccctcagctctctccc

SEQ ID NO: 8221790 - DNA, 22 bp, Homo sapiens
cagagcccctcagctctctccc

SEQ ID NO: 8221791 - DNA, 22 bp, Homo sapiens
cagagccctgcatgctccatct

SEQ ID NO: 8221792 - DNA, 22 bp, Homo sapiens
cagagccctgggcacatggtag

SEQ ID NO: 8221793 - DNA, 22 bp, Homo sapiens
cagagccctgtgtgccatgtga

SEQ ID NO: 8221794 - DNA, 22 bp, Homo sapiens
cagagccctcaaggccgatgca

SEQ ID NO: 8221795 - DNA, 22 bp, Homo sapiens
cagagccctcaaggccgatgca

SEQ ID NO: 8221796 - DNA, 22 bp, Homo sapiens
cagagccctgcatgctccatct

SEQ ID NO: 8221797 - DNA, 22 bp, Homo sapiens
cagagccctgcatgctccatct

SEQ ID NO: 8221798 - DNA, 22 bp, Homo sapiens
cagagccctccgctccccggct

SEQ ID NO: 8221799 - DNA, 22 bp, Homo sapiens
gggcactgtgctgggtgcttta

SEQ ID NO: 8221800 - DNA, 22 bp, Homo sapiens
gggcactgtggggcccatgctg

SEQ ID NO: 8221801 - DNA, 22 bp, Homo sapiens
gggcactgtgttcagagtgcag

SEQ ID NO: 8221802 - DNA, 22 bp, Homo sapiens
gggcactgtgttcagagtgcag

SEQ ID NO: 8221803 - DNA, 22 bp, Homo sapiens
gggcactgtggggcccatgctg

SEQ ID NO: 8221804 - DNA, 22 bp, Homo sapiens
gggcactgtgttcagagtgcag

SEQ ID NO: 8221805 - DNA, 22 bp, Homo sapiens
gggcactgtgttcagagtgcag

SEQ ID NO: 8221806 - DNA, 22 bp, Homo sapiens
gggcacagaagtctaagacatc

SEQ ID NO: 8221807 - DNA, 22 bp, Homo sapiens
gggcacagagggtcttgaagaa

SEQ ID NO: 8221808 - DNA, 22 bp, Homo sapiens
gggcacagagggtcttgaagaa

SEQ ID NO: 8221809 - DNA, 22 bp, Homo sapiens
gggcacagagggtcttgaagaa

SEQ ID NO: 8221810 - DNA, 22 bp, Homo sapiens
gggcacagagggtcttgaagaa

SEQ ID NO: 8221811 - DNA, 22 bp, Homo sapiens
gggcacagcccagtggggtccc

SEQ ID NO: 8221812 - DNA, 22 bp, Homo sapiens
gggcactgtgctaggtgctgag

SEQ ID NO: 8221813 - DNA, 22 bp, Homo sapiens
cagagcccatcctatactctcc

SEQ ID NO: 8221814 - DNA, 22 bp, Homo sapiens
cagagccccccttctgatcaca

SEQ ID NO: 8221815 - DNA, 22 bp, Homo sapiens
cagagcccatggcacatgtgga

SEQ ID NO: 8221816 - DNA, 22 bp, Homo sapiens
cagagccagctgtccttggcat

SEQ ID NO: 8221817 - DNA, 22 bp, Homo sapiens
cagagcccagggcctacgtccc

SEQ ID NO: 8221818 - DNA, 22 bp, Homo sapiens
gggcagagaaatggacagttgg

SEQ ID NO: 8221819 - DNA, 22 bp, Homo sapiens
gggcagagaaatggacagttgg

SEQ ID NO: 8221820 - DNA, 22 bp, Homo sapiens
gggcagagaaatggacagttgg

SEQ ID NO: 8221821 - DNA, 22 bp, Homo sapiens
gggcacttctaagcatggggct

SEQ ID NO: 8221822 - DNA, 22 bp, Homo sapiens
gggcactttgtgcctcactgtg

SEQ ID NO: 8221823 - DNA, 22 bp, Homo sapiens
gggcacttgtgttcttcacttt

SEQ ID NO: 8221824 - DNA, 19 bp, Homo sapiens
gggcagaatggcatctcag

SEQ ID NO: 8221825 - DNA, 22 bp, Homo sapiens
gggcacttactgccaaggcgag

SEQ ID NO: 8221826 - DNA, 22 bp, Homo sapiens
gggcacttaatgggcacagaga

SEQ ID NO: 8221827 - DNA, 22 bp, Homo sapiens
gggcacttctaagcatggggct

SEQ ID NO: 8221828 - DNA, 22 bp, Homo sapiens
gggcacttactgccaaggcgag

SEQ ID NO: 8221829 - DNA, 22 bp, Homo sapiens
cagacaggaagttcagaagaaa

SEQ ID NO: 8221830 - DNA, 22 bp, Homo sapiens
cagacaggaattctggcgtggt

SEQ ID NO: 8221831 - DNA, 22 bp, Homo sapiens
cagacagaaggctccttgaggt

SEQ ID NO: 8221832 - DNA, 22 bp, Homo sapiens
cagacagaaggctccttgaggt

SEQ ID NO: 8221833 - DNA, 22 bp, Homo sapiens
cagacagaaggctccttgaggt

SEQ ID NO: 8221834 - DNA, 22 bp, Homo sapiens
cagaagttgccacatgaccctt

SEQ ID NO: 8221835 - DNA, 22 bp, Homo sapiens
cagaagttagtcttaattataa

SEQ ID NO: 8221836 - DNA, 22 bp, Homo sapiens
cagaagtggcctcagagggagt

SEQ ID NO: 8221837 - DNA, 22 bp, Homo sapiens
cagaagtggcctcagagggagt

SEQ ID NO: 8221838 - DNA, 22 bp, Homo sapiens
gggactgggagatcctcctggc

SEQ ID NO: 8221839 - DNA, 22 bp, Homo sapiens
gggactgtccggcagaaggtac

SEQ ID NO: 8221840 - DNA, 22 bp, Homo sapiens
gggactgtcctacatggagagg

SEQ ID NO: 8221841 - DNA, 22 bp, Homo sapiens
cagaagtgatgttgagctagtc

SEQ ID NO: 8221842 - DNA, 22 bp, Homo sapiens
gggactgtgaggcctaactggg

SEQ ID NO: 8221843 - DNA, 22 bp, Homo sapiens
gggacttcatagctaggcactt

SEQ ID NO: 8221844 - DNA, 22 bp, Homo sapiens
cagacaggcaggtgagagctcc

SEQ ID NO: 8221845 - DNA, 22 bp, Homo sapiens
cagacaggcaggtgagagctcc

SEQ ID NO: 8221846 - DNA, 22 bp, Homo sapiens
cagacaggcaggtgctgctttg

SEQ ID NO: 8221847 - DNA, 22 bp, Homo sapiens
cagacaggcaggtgctgctttg

SEQ ID NO: 8221848 - DNA, 22 bp, Homo sapiens
cagacaggcaggtgctgctttg

SEQ ID NO: 8221849 - DNA, 22 bp, Homo sapiens
cagacaggctagccagactcac

SEQ ID NO: 8221850 - DNA, 22 bp, Homo sapiens
gggagcaagccggaggtactgt

SEQ ID NO: 8221851 - DNA, 22 bp, Homo sapiens
cagacaggcaggtgagagctcc

SEQ ID NO: 8221852 - DNA, 22 bp, Homo sapiens
cagacaggcaggtgagagctcc

SEQ ID NO: 8221853 - DNA, 22 bp, Homo sapiens
cagacaggagactggatcatgg

SEQ ID NO: 8221854 - DNA, 22 bp, Homo sapiens
cagacaggagactggatcatgg

SEQ ID NO: 8221855 - DNA, 22 bp, Homo sapiens
cagacaggaattctggcgtggt

SEQ ID NO: 8221856 - DNA, 22 bp, Homo sapiens
cagacaggaattctggcgtggt

SEQ ID NO: 8221857 - DNA, 19 bp, Homo sapiens
gggagcaggaaagctgtgg

SEQ ID NO: 8221858 - DNA, 19 bp, Homo sapiens
gggagcaggaaagctgtgg

SEQ ID NO: 8221859 - DNA, 22 bp, Homo sapiens
gggagcagcctgcctcccacct

SEQ ID NO: 8221860 - DNA, 22 bp, Homo sapiens
gggagcactgagaggcaggtag

SEQ ID NO: 8221861 - DNA, 22 bp, Homo sapiens
gggagcaggagcctgcctgcca

SEQ ID NO: 8221862 - DNA, 22 bp, Homo sapiens
gggagcaggagcctgcctgcca

SEQ ID NO: 8221863 - DNA, 22 bp, Homo sapiens
gggagcaggacataatagcaat

SEQ ID NO: 8221864 - DNA, 22 bp, Homo sapiens
gggagcaggacataatagcaat

SEQ ID NO: 8221865 - DNA, 22 bp, Homo sapiens
gggagggtgttctcccaagaac

SEQ ID NO: 8221866 - DNA, 22 bp, Homo sapiens
gggaggtaaagatgagctcagt

SEQ ID NO: 8221867 - DNA, 22 bp, Homo sapiens
gggaggtagcaagcctgcagct

SEQ ID NO: 8221868 - DNA, 22 bp, Homo sapiens
gggagggtctgccatgctccct

SEQ ID NO: 8221869 - DNA, 22 bp, Homo sapiens
gggagggtctgagagctgcacc

SEQ ID NO: 8221870 - DNA, 22 bp, Homo sapiens
gggagggtctgagagctgcacc

SEQ ID NO: 8221871 - DNA, 22 bp, Homo sapiens
gggagggtctgagagctgcacc

SEQ ID NO: 8221872 - DNA, 22 bp, Homo sapiens
gggagggtctgagagctgcacc

SEQ ID NO: 8221873 - DNA, 22 bp, Homo sapiens
gggaggtcctaaaggggaccag

SEQ ID NO: 8221874 - DNA, 22 bp, Homo sapiens
gggaggtcagggtgcctgctgg

SEQ ID NO: 8221875 - DNA, 22 bp, Homo sapiens
gggaggtcagggtgcctgctgg

SEQ ID NO: 8221876 - DNA, 22 bp, Homo sapiens
gggaggtgaaaggtcatgtgtg

SEQ ID NO: 8221877 - DNA, 22 bp, Homo sapiens
gggaggtgaaaggtcatgtgtg

SEQ ID NO: 8221878 - DNA, 22 bp, Homo sapiens
cagacaggctagccagactcac

SEQ ID NO: 8221879 - DNA, 22 bp, Homo sapiens
gggaggtgaaaggttgctgcag

SEQ ID NO: 8221880 - DNA, 22 bp, Homo sapiens
gggaggtgaaaggttgctgcag

SEQ ID NO: 8221881 - DNA, 22 bp, Homo sapiens
gggagggccaggctcacccagg

SEQ ID NO: 8221882 - DNA, 20 bp, Homo sapiens
gggaggccccagagtccagg

SEQ ID NO: 8221883 - DNA, 20 bp, Homo sapiens
gggaggccagcctcagagaa

SEQ ID NO: 8221884 - DNA, 22 bp, Homo sapiens
gggagcagttaaaatgattcct

SEQ ID NO: 8221885 - DNA, 22 bp, Homo sapiens
gggagggcttggacccagatgt

SEQ ID NO: 8221886 - DNA, 22 bp, Homo sapiens
gggaggggttgcatgtttgagt

SEQ ID NO: 8221887 - DNA, 22 bp, Homo sapiens
gggcaagcagtgaggacagcac

SEQ ID NO: 8221888 - DNA, 20 bp, Homo sapiens
gggatgagagtcctagctct

SEQ ID NO: 8221889 - DNA, 22 bp, Homo sapiens
cagacaggggtaaccttcctca

SEQ ID NO: 8221890 - DNA, 22 bp, Homo sapiens
cagacaggggtaaccttcctca

SEQ ID NO: 8221891 - DNA, 22 bp, Homo sapiens
cagacagggccctgtgatggta

SEQ ID NO: 8221892 - DNA, 22 bp, Homo sapiens
cagacagggccctgtgatggta

SEQ ID NO: 8221893 - DNA, 22 bp, Homo sapiens
cagacagggacctcgctccaga

SEQ ID NO: 8221894 - DNA, 17 bp, Homo sapiens
cagacaggctgtcaccc

SEQ ID NO: 8221895 - DNA, 22 bp, Homo sapiens
cagacaggctagccagactcac

SEQ ID NO: 8221896 - DNA, 17 bp, Homo sapiens
cagacaggctgtcaccc

SEQ ID NO: 8221897 - DNA, 22 bp, Homo sapiens
gggcaaggcagaagagttggag

SEQ ID NO: 8221898 - DNA, 22 bp, Homo sapiens
gggcaaggcagaagagttggag

SEQ ID NO: 8221899 - DNA, 22 bp, Homo sapiens
gggcaagcagtggctaccagta

SEQ ID NO: 8221900 - DNA, 18 bp, Homo sapiens
gggcaagcggctgtcacc

SEQ ID NO: 8221901 - DNA, 22 bp, Homo sapiens
gggcaagctcttcagaagctct

SEQ ID NO: 8221902 - DNA, 22 bp, Homo sapiens
gggcaagctcttcagaagctct

SEQ ID NO: 8221903 - DNA, 20 bp, Homo sapiens
gggcaaggaaacagccccca

SEQ ID NO: 8221904 - DNA, 22 bp, Homo sapiens
gggcacaccttgtctgagcaca

SEQ ID NO: 8221905 - DNA, 22 bp, Homo sapiens
cagaaggtattgtaattatgac

SEQ ID NO: 8221906 - DNA, 22 bp, Homo sapiens
cagaaggtattgtaattatgac

SEQ ID NO: 8221907 - DNA, 22 bp, Homo sapiens
cagaaggtttacactggactgt

SEQ ID NO: 8221908 - DNA, 22 bp, Homo sapiens
cagaaggtttgaaagatgtctt

SEQ ID NO: 8221909 - DNA, 22 bp, Homo sapiens
cagaagtaagattactgtgagt

SEQ ID NO: 8221910 - DNA, 22 bp, Homo sapiens
cagaagtaagattactgtgaga

SEQ ID NO: 8221911 - DNA, 22 bp, Homo sapiens
gggaaactcacaggtgcagggg

SEQ ID NO: 8221912 - DNA, 22 bp, Homo sapiens
gggaaactagaagcagggttat

SEQ ID NO: 8221913 - DNA, 22 bp, Homo sapiens
ggcttttgctgtgttttccaga

SEQ ID NO: 8221914 - DNA, 22 bp, Homo sapiens
gggaaagagaggtggacgcagg

SEQ ID NO: 8221915 - DNA, 22 bp, Homo sapiens
gggaaagagtgcttgtccagag

SEQ ID NO: 8221916 - DNA, 22 bp, Homo sapiens
gggaaagagaggtggacgcagg

SEQ ID NO: 8221917 - DNA, 22 bp, Homo sapiens
gggaaagagaggtggacgcagg

SEQ ID NO: 8221918 - DNA, 22 bp, Homo sapiens
gggaaagagaggtggacgcagg

SEQ ID NO: 8221919 - DNA, 22 bp, Homo sapiens
gggaaactgcaactcagagagg

SEQ ID NO: 8221920 - DNA, 22 bp, Homo sapiens
gggaaactgaattcaggactct

SEQ ID NO: 8221921 - DNA, 22 bp, Homo sapiens
gggaaactggggactgaatctg

SEQ ID NO: 8221922 - DNA, 22 bp, Homo sapiens
gggaaactcaggcatttccact

SEQ ID NO: 8221923 - DNA, 21 bp, Homo sapiens
gggaaactctgcttaacagag

SEQ ID NO: 8221924 - DNA, 22 bp, Homo sapiens
gggaaactgtccagttctcccc

SEQ ID NO: 8221925 - DNA, 22 bp, Homo sapiens
gggaaacttctgctaaaaccag

SEQ ID NO: 8221926 - DNA, 22 bp, Homo sapiens
gggaaactttcacaatgtccag

SEQ ID NO: 8221927 - DNA, 22 bp, Homo sapiens
cactggctccctgatttgaagc

SEQ ID NO: 8221928 - DNA, 22 bp, Homo sapiens
cactggctgagcttctctaggg

SEQ ID NO: 8221929 - DNA, 22 bp, Homo sapiens
cactggctatgagggagatggg

SEQ ID NO: 8221930 - DNA, 22 bp, Homo sapiens
cactggctgagcttctctaggg

SEQ ID NO: 8221931 - DNA, 22 bp, Homo sapiens
cactggctgggccagcactcct

SEQ ID NO: 8221932 - DNA, 22 bp, Homo sapiens
cactggcttgatgggtaatgcc

SEQ ID NO: 8221933 - DNA, 22 bp, Homo sapiens
cactggctaaagataagctcaa

SEQ ID NO: 8221934 - DNA, 22 bp, Homo sapiens
cactggctaaaaaagaggcaga

SEQ ID NO: 8221935 - DNA, 22 bp, Homo sapiens
cactggcccattcctgtctggc

SEQ ID NO: 8221936 - DNA, 22 bp, Homo sapiens
cactggcctaagcgcctcagcc

SEQ ID NO: 8221937 - DNA, 22 bp, Homo sapiens
cactggcccataaaggcctggg

SEQ ID NO: 8221938 - DNA, 22 bp, Homo sapiens
cactggcccagccaggcctgtt

SEQ ID NO: 8221939 - DNA, 22 bp, Homo sapiens
cactggcccagccaggcctgtt

SEQ ID NO: 8221940 - DNA, 22 bp, Homo sapiens
cactggcccagccaggcctgtt

SEQ ID NO: 8221941 - DNA, 22 bp, Homo sapiens
cactggcccagccaggcctgtt

SEQ ID NO: 8221942 - DNA, 22 bp, Homo sapiens
cactggcccataaaggcctggg

SEQ ID NO: 8221943 - DNA, 22 bp, Homo sapiens
cactggcccataaaggcctggg

SEQ ID NO: 8221944 - DNA, 22 bp, Homo sapiens
cactggcccataaaggcctggg

SEQ ID NO: 8221945 - DNA, 22 bp, Homo sapiens
cagaaggcaaacaaaaggattt

SEQ ID NO: 8221946 - DNA, 22 bp, Homo sapiens
cagaagcagtgagagatgtgca

SEQ ID NO: 8221947 - DNA, 22 bp, Homo sapiens
cagaagcagtgagagatgtgca

SEQ ID NO: 8221948 - DNA, 22 bp, Homo sapiens
cagaaggcatagatgaaggcct

SEQ ID NO: 8221949 - DNA, 22 bp, Homo sapiens
cagaaggcatagatgaaggcct

SEQ ID NO: 8221950 - DNA, 22 bp, Homo sapiens
cagaaggctttgtggagtagac

SEQ ID NO: 8221951 - DNA, 22 bp, Homo sapiens
cagaaggcatagatgaaggcct

SEQ ID NO: 8221952 - DNA, 22 bp, Homo sapiens
cagaaggcctgaatctttgttc

SEQ ID NO: 8221953 - DNA, 22 bp, Homo sapiens
cagaagggcagcactgggaagg

SEQ ID NO: 8221954 - DNA, 22 bp, Homo sapiens
cagaaggctttgtggagtagac

SEQ ID NO: 8221955 - DNA, 18 bp, Homo sapiens
gggaagccgggaagccgg

SEQ ID NO: 8221956 - DNA, 18 bp, Homo sapiens
gggaagccgggaagccgg

SEQ ID NO: 8221957 - DNA, 22 bp, Homo sapiens
gggaaaggatcagtgggaggct

SEQ ID NO: 8221958 - DNA, 23 bp, Homo sapiens
gggaaaggatatgatcctagggg

SEQ ID NO: 8221959 - DNA, 23 bp, Homo sapiens
gggaaaggatatgatcctagggg

SEQ ID NO: 8221960 - DNA, 23 bp, Homo sapiens
gggaaaggatatgatcctagggg

SEQ ID NO: 8221961 - DNA, 22 bp, Homo sapiens
gggaagctgcgtggtctagggc

SEQ ID NO: 8221962 - DNA, 22 bp, Homo sapiens
gggaaggaaagttattagcaga

SEQ ID NO: 8221963 - DNA, 22 bp, Homo sapiens
gggaaggacacagccatgactg

SEQ ID NO: 8221964 - DNA, 22 bp, Homo sapiens
gggaaggaaatcttgcttgtga

SEQ ID NO: 8221965 - DNA, 22 bp, Homo sapiens
gggaaggacattctgggctcag

SEQ ID NO: 8221966 - DNA, 22 bp, Homo sapiens
gggaaggacacagccatgactg

SEQ ID NO: 8221967 - DNA, 22 bp, Homo sapiens
gggaaggacacagccatgactg

SEQ ID NO: 8221968 - DNA, 22 bp, Homo sapiens
gggaaggacacagccatgactg

SEQ ID NO: 8221969 - DNA, 22 bp, Homo sapiens
gggacaatggaggcctctctcc

SEQ ID NO: 8221970 - DNA, 22 bp, Homo sapiens
gggaattgaggtatgctgggct

SEQ ID NO: 8221971 - DNA, 22 bp, Homo sapiens
gggaattgaggtatgctgggct

SEQ ID NO: 8221972 - DNA, 22 bp, Homo sapiens
gggacaatggaggcctctctcc

SEQ ID NO: 8221973 - DNA, 22 bp, Homo sapiens
gggacaatggaggcctctctcc

SEQ ID NO: 8221974 - DNA, 15 bp, Homo sapiens
gggaatgttttacaa

SEQ ID NO: 8221975 - DNA, 22 bp, Homo sapiens
gggaattatagctgtcacaggc

SEQ ID NO: 8221976 - DNA, 22 bp, Homo sapiens
gggaatgttgactgagagcagg

SEQ ID NO: 8221977 - DNA, 16 bp, Homo sapiens
gggaatgtgtcttctc

SEQ ID NO: 8221978 - DNA, 22 bp, Homo sapiens
gggaatgtgtctgatggaaaga

SEQ ID NO: 8221979 - DNA, 22 bp, Homo sapiens
gggaatgtggtgatagtctata

SEQ ID NO: 8221980 - DNA, 22 bp, Homo sapiens
gggaatgtggccctggggctcc

SEQ ID NO: 8221981 - DNA, 22 bp, Homo sapiens
gggaatgtggcaggcagcagtt

SEQ ID NO: 8221982 - DNA, 22 bp, Homo sapiens
gggaaggaggtggcttgaagtg

SEQ ID NO: 8221983 - DNA, 22 bp, Homo sapiens
gggaaggaggtggcttgaagtg

SEQ ID NO: 8221984 - DNA, 22 bp, Homo sapiens
gggaaggaggtggacctgcccc

SEQ ID NO: 8221985 - DNA, 22 bp, Homo sapiens
gggaaggaggtggacctgcccc

SEQ ID NO: 8221986 - DNA, 22 bp, Homo sapiens
gggaaggagcctgcttgctaga

SEQ ID NO: 8221987 - DNA, 22 bp, Homo sapiens
gggaaggagcctgcttgctaga

SEQ ID NO: 8221988 - DNA, 22 bp, Homo sapiens
gggaaggacattctgggctcag

SEQ ID NO: 8221989 - DNA, 22 bp, Homo sapiens
gggaaggacattctgggctcag

SEQ ID NO: 8221990 - DNA, 22 bp, Homo sapiens
gggaaggacattctgggctcag

SEQ ID NO: 8221991 - DNA, 22 bp, Homo sapiens
gggaaggacattctgggctcag

SEQ ID NO: 8221992 - DNA, 22 bp, Homo sapiens
gggactggaactactggtgcag

SEQ ID NO: 8221993 - DNA, 22 bp, Homo sapiens
gggactggaactactggtgcag

SEQ ID NO: 8221994 - DNA, 19 bp, Homo sapiens
gggactggaggatgtggag

SEQ ID NO: 8221995 - DNA, 22 bp, Homo sapiens
gggactggccagggtttggaat

SEQ ID NO: 8221996 - DNA, 22 bp, Homo sapiens
gggactgggagatcctcctggc

SEQ ID NO: 8221997 - DNA, 22 bp, Homo sapiens
gggactggcacagggctgggag

SEQ ID NO: 8221998 - DNA, 22 bp, Homo sapiens
gggactggagtagaggccggtg

SEQ ID NO: 8221999 - DNA, 22 bp, Homo sapiens
gggactggatagatgtgggtga

SEQ ID NO: 8222000 - DNA, 22 bp, Homo sapiens
gggactcctgcatttcaagtcc

SEQ ID NO: 8222001 - DNA, 22 bp, Homo sapiens
gggactcctttaaggagggtga

SEQ ID NO: 8222002 - DNA, 22 bp, Homo sapiens
gggacagaggcaaactagcaga

SEQ ID NO: 8222003 - DNA, 22 bp, Homo sapiens
gggacagacccatgggccaggt

SEQ ID NO: 8222004 - DNA, 22 bp, Homo sapiens
gggacagacccatgggccaggt

SEQ ID NO: 8222005 - DNA, 22 bp, Homo sapiens
gggacagaaggaagtgagcaca

SEQ ID NO: 8222006 - DNA, 22 bp, Homo sapiens
gggacagaaggaagtgagcaca

SEQ ID NO: 8222007 - DNA, 22 bp, Homo sapiens
gggacagaaggaagtgagcaca

SEQ ID NO: 8222008 - DNA, 22 bp, Homo sapiens
gggacactggacccagtgtcca

SEQ ID NO: 8222009 - DNA, 22 bp, Homo sapiens
gggacacagccatctgtgtttt

SEQ ID NO: 8222010 - DNA, 22 bp, Homo sapiens
gggacacaggtatctcaaatga

SEQ ID NO: 8222011 - DNA, 22 bp, Homo sapiens
cagcagcaaatctagaagagga

SEQ ID NO: 8222012 - DNA, 22 bp, Homo sapiens
cagcagcaaatctagaagagga

SEQ ID NO: 8222013 - DNA, 22 bp, Homo sapiens
cagcagatcaatgtagaatatt

SEQ ID NO: 8222014 - DNA, 22 bp, Homo sapiens
cagcagagtttggcttctaatg

SEQ ID NO: 8222015 - DNA, 22 bp, Homo sapiens
cagcagcaacaacggaagcctt

SEQ ID NO: 8222016 - DNA, 22 bp, Homo sapiens
cagcagcaacaacggaagcctt

SEQ ID NO: 8222017 - DNA, 22 bp, Homo sapiens
cagcagcaaatctagaagagga

SEQ ID NO: 8222018 - DNA, 22 bp, Homo sapiens
cagcagcaaatctagaagagga

SEQ ID NO: 8222019 - DNA, 22 bp, Homo sapiens
cagcagcaaggtgagggtggag

SEQ ID NO: 8222020 - DNA, 22 bp, Homo sapiens
cagcagcaacaatagcggtcac

SEQ ID NO: 8222021 - DNA, 22 bp, Homo sapiens
cagcagcaacaatagcggtcac

SEQ ID NO: 8222022 - DNA, 22 bp, Homo sapiens
cagcagcaacaatagcggtcac

SEQ ID NO: 8222023 - DNA, 22 bp, Homo sapiens
cagcagcaacaacggaagcctt

SEQ ID NO: 8222024 - DNA, 22 bp, Homo sapiens
cagcagcaacaacggaagcctt

SEQ ID NO: 8222025 - DNA, 22 bp, Homo sapiens
cagcagcaacaacggaagcctt

SEQ ID NO: 8222026 - DNA, 22 bp, Homo sapiens
cagcagagcttatgttgggtca

SEQ ID NO: 8222027 - DNA, 22 bp, Homo sapiens
cagcagagctgtgtgggaaggg

SEQ ID NO: 8222028 - DNA, 21 bp, Homo sapiens
cagcagagtaatgcattcgta

SEQ ID NO: 8222029 - DNA, 22 bp, Homo sapiens
cagcagagtaattctcacctct

SEQ ID NO: 8222030 - DNA, 22 bp, Homo sapiens
cagcagagtaattctcacctct

SEQ ID NO: 8222031 - DNA, 22 bp, Homo sapiens
cagcagagtatggcactcaact

SEQ ID NO: 8222032 - DNA, 22 bp, Homo sapiens
cagcagagtaggtgctacttct

SEQ ID NO: 8222033 - DNA, 22 bp, Homo sapiens
gtagggcaacatgggcactagg

SEQ ID NO: 8222034 - DNA, 22 bp, Homo sapiens
gtagggcaacatgggcactagg

SEQ ID NO: 8222035 - DNA, 22 bp, Homo sapiens
gtagggataggtgtccagagac

SEQ ID NO: 8222036 - DNA, 22 bp, Homo sapiens
gtagggagcccagagcccagtg

SEQ ID NO: 8222037 - DNA, 22 bp, Homo sapiens
cagcagcagagatactggtttc

SEQ ID NO: 8222038 - DNA, 22 bp, Homo sapiens
cagcagcagagatactggtttc

SEQ ID NO: 8222039 - DNA, 22 bp, Homo sapiens
cagcagcagacatttgatcttc

SEQ ID NO: 8222040 - DNA, 22 bp, Homo sapiens
cagcagcactctgcgggtcccc

SEQ ID NO: 8222041 - DNA, 22 bp, Homo sapiens
cagcagcacctattatagtgtt

SEQ ID NO: 8222042 - DNA, 22 bp, Homo sapiens
cagcagcagacatttgatcttc

SEQ ID NO: 8222043 - DNA, 22 bp, Homo sapiens
cagcagcactctgcgggtcccc

SEQ ID NO: 8222044 - DNA, 22 bp, Homo sapiens
cagcagcaaggtgagggtggag

SEQ ID NO: 8222045 - DNA, 22 bp, Homo sapiens
cagcagcacctattatagtgtt

SEQ ID NO: 8222046 - DNA, 22 bp, Homo sapiens
cagcagcaaggtgagggtggag

SEQ ID NO: 8222047 - DNA, 19 bp, Homo sapiens
gtatatttatatggctgta

SEQ ID NO: 8222048 - DNA, 22 bp, Homo sapiens
gtatattttgatcaccctctat

SEQ ID NO: 8222049 - DNA, 22 bp, Homo sapiens
gtatattttgatcaccctctat

SEQ ID NO: 8222050 - DNA, 22 bp, Homo sapiens
gtatcacttttgagagtgagaa

SEQ ID NO: 8222051 - DNA, 19 bp, Homo sapiens
gtatatttatatggctgta

SEQ ID NO: 8222052 - DNA, 22 bp, Homo sapiens
gtatatgtgtgggcctgcatat

SEQ ID NO: 8222053 - DNA, 19 bp, Homo sapiens
gtatatttatatggctgta

SEQ ID NO: 8222054 - DNA, 22 bp, Homo sapiens
gtatatgtgtgcaagtgcatgg

SEQ ID NO: 8222055 - DNA, 22 bp, Homo sapiens
gtatatgtatgcgtatacacac

SEQ ID NO: 8222056 - DNA, 22 bp, Homo sapiens
gtatatgtatgcgtatacacac

SEQ ID NO: 8222057 - DNA, 22 bp, Homo sapiens
gtatatgagctctatgtaatgg

SEQ ID NO: 8222058 - DNA, 22 bp, Homo sapiens
gtatcacttttgagagtgagaa

SEQ ID NO: 8222059 - DNA, 22 bp, Homo sapiens
gtatcacttttgagagtgagaa

SEQ ID NO: 8222060 - DNA, 22 bp, Homo sapiens
gtatctgtggattttggtatcc

SEQ ID NO: 8222061 - DNA, 22 bp, Homo sapiens
gtatctgtagctagagggagag

SEQ ID NO: 8222062 - DNA, 22 bp, Homo sapiens
gtatctgtggattttggtatcc

SEQ ID NO: 8222063 - DNA, 22 bp, Homo sapiens
cagcaggccatgctgcttttca

SEQ ID NO: 8222064 - DNA, 22 bp, Homo sapiens
cagcaggcccagagtttcatgg

SEQ ID NO: 8222065 - DNA, 22 bp, Homo sapiens
cagcaggcccagagtttcatgg

SEQ ID NO: 8222066 - DNA, 22 bp, Homo sapiens
cagcaggcccagagtttcatgg

SEQ ID NO: 8222067 - DNA, 22 bp, Homo sapiens
cagcaggcaggtgggccaagtc

SEQ ID NO: 8222068 - DNA, 22 bp, Homo sapiens
cagcaggcaggtgggccaagtc

SEQ ID NO: 8222069 - DNA, 22 bp, Homo sapiens
cagcaggcaggtgggccaagtc

SEQ ID NO: 8222070 - DNA, 22 bp, Homo sapiens
cagcaggcaggtgggccaagtc

SEQ ID NO: 8222071 - DNA, 22 bp, Homo sapiens
cagcaggcagccatttcactgt

SEQ ID NO: 8222072 - DNA, 22 bp, Homo sapiens
cagcaggcagccatttcactgt

SEQ ID NO: 8222073 - DNA, 22 bp, Homo sapiens
cagcaggcagccatttcactgt

SEQ ID NO: 8222074 - DNA, 22 bp, Homo sapiens
cagcaggcagccatttcactgt

SEQ ID NO: 8222075 - DNA, 22 bp, Homo sapiens
cagcaggattggatacatctca

SEQ ID NO: 8222076 - DNA, 22 bp, Homo sapiens
cagcaggattggatacatctca

SEQ ID NO: 8222077 - DNA, 22 bp, Homo sapiens
gtatttctagaatggtagcact

SEQ ID NO: 8222078 - DNA, 22 bp, Homo sapiens
gtatttctagtttcttccacag

SEQ ID NO: 8222079 - DNA, 22 bp, Homo sapiens
gtatttctgcaaagtgtgtgac

SEQ ID NO: 8222080 - DNA, 22 bp, Homo sapiens
gtatttctggttaaatgtgcta

SEQ ID NO: 8222081 - DNA, 22 bp, Homo sapiens
gtatttctggtaactgctgcta

SEQ ID NO: 8222082 - DNA, 16 bp, Homo sapiens
gtatttcttagacttt

SEQ ID NO: 8222083 - DNA, 22 bp, Homo sapiens
gtatttcttggaaatcctttta

SEQ ID NO: 8222084 - DNA, 22 bp, Homo sapiens
gtatttcttccacggtggattt

SEQ ID NO: 8222085 - DNA, 22 bp, Homo sapiens
gtatttctggttaaatgtgcta

SEQ ID NO: 8222086 - DNA, 22 bp, Homo sapiens
gtatttctggttaaatgtgcta

SEQ ID NO: 8222087 - DNA, 22 bp, Homo sapiens
gtatttctttccattatagtca

SEQ ID NO: 8222088 - DNA, 22 bp, Homo sapiens
gtatttctttccattatagtca

SEQ ID NO: 8222089 - DNA, 15 bp, Homo sapiens
gtatttcttttatat

SEQ ID NO: 8222090 - DNA, 22 bp, Homo sapiens
gtatttctttccattatagtca

SEQ ID NO: 8222091 - DNA, 22 bp, Homo sapiens
gtatttctttatctggtcagaa

SEQ ID NO: 8222092 - DNA, 22 bp, Homo sapiens
gtatttctttacatatgctcat

SEQ ID NO: 8222093 - DNA, 22 bp, Homo sapiens
gtatttcttgtacttccttgtc

SEQ ID NO: 8222094 - DNA, 22 bp, Homo sapiens
gtatttcttggaaatcctttta

SEQ ID NO: 8222095 - DNA, 22 bp, Homo sapiens
gtatttctagaaccaaaagcca

SEQ ID NO: 8222096 - DNA, 22 bp, Homo sapiens
gtatttctagaaccaaaagcca

SEQ ID NO: 8222097 - DNA, 22 bp, Homo sapiens
gtatttctagaaaatgcagatt

SEQ ID NO: 8222098 - DNA, 22 bp, Homo sapiens
cagcaggcggcccgcgggcccg

SEQ ID NO: 8222099 - DNA, 22 bp, Homo sapiens
gtatttctagaaaatgcagatt

SEQ ID NO: 8222100 - DNA, 22 bp, Homo sapiens
cagcaggcggcccgcgggcccg

SEQ ID NO: 8222101 - DNA, 22 bp, Homo sapiens
cagcaggcggcccgcgggcccg

SEQ ID NO: 8222102 - DNA, 22 bp, Homo sapiens
cagcaggcccaggtgctggtga

SEQ ID NO: 8222103 - DNA, 22 bp, Homo sapiens
cagcaggcccaggtgctggtga

SEQ ID NO: 8222104 - DNA, 22 bp, Homo sapiens
cagcaggcccaggtgctggtga

SEQ ID NO: 8222105 - DNA, 22 bp, Homo sapiens
cagcaggcccaggtgctggtga

SEQ ID NO: 8222106 - DNA, 22 bp, Homo sapiens
cagcagcctccactcgccccac

SEQ ID NO: 8222107 - DNA, 22 bp, Homo sapiens
cagcagcctccactcgccccac

SEQ ID NO: 8222108 - DNA, 22 bp, Homo sapiens
cagcagcctagggttccatcat

SEQ ID NO: 8222109 - DNA, 22 bp, Homo sapiens
gtatgcatttggcatattgtcc

SEQ ID NO: 8222110 - DNA, 22 bp, Homo sapiens
gtatgcatgcatgtgtatgtac

SEQ ID NO: 8222111 - DNA, 22 bp, Homo sapiens
cagcagcctcttgtgcctgtgg

SEQ ID NO: 8222112 - DNA, 22 bp, Homo sapiens
cagcagcctcttgtgcctgtgg

SEQ ID NO: 8222113 - DNA, 22 bp, Homo sapiens
cagcagcctcttgtgcctgtgg

SEQ ID NO: 8222114 - DNA, 22 bp, Homo sapiens
cagcagcctgccttgggagctt

SEQ ID NO: 8222115 - DNA, 22 bp, Homo sapiens
gtatgaaagcatcattcctgct

SEQ ID NO: 8222116 - DNA, 22 bp, Homo sapiens
gtatgaaagcatcattcctgct

SEQ ID NO: 8222117 - DNA, 22 bp, Homo sapiens
gtatgaaagcatcattcctgct

SEQ ID NO: 8222118 - DNA, 22 bp, Homo sapiens
gtatctttccacatcttcagta

SEQ ID NO: 8222119 - DNA, 22 bp, Homo sapiens
cagcagcctggcccctcctcgg

SEQ ID NO: 8222120 - DNA, 22 bp, Homo sapiens
cagcagcctggcccctcctcgg

SEQ ID NO: 8222121 - DNA, 22 bp, Homo sapiens
cagcagcctggcccctcctcgg

SEQ ID NO: 8222122 - DNA, 22 bp, Homo sapiens
cagcagcctggcccctcctcgg

SEQ ID NO: 8222123 - DNA, 22 bp, Homo sapiens
cagcagctaaggcatgttcctg

SEQ ID NO: 8222124 - DNA, 22 bp, Homo sapiens
cagcagctaaggcatgttcctg

SEQ ID NO: 8222125 - DNA, 22 bp, Homo sapiens
cagcagcctggcccctcctcgg

SEQ ID NO: 8222126 - DNA, 22 bp, Homo sapiens
cagcagcctggagggggccacg

SEQ ID NO: 8222127 - DNA, 22 bp, Homo sapiens
cagcagcctggagggggccacg

SEQ ID NO: 8222128 - DNA, 22 bp, Homo sapiens
cagcagcctggagggggccacg

SEQ ID NO: 8222129 - DNA, 22 bp, Homo sapiens
cagcagcctgccttgggagctt

SEQ ID NO: 8222130 - DNA, 22 bp, Homo sapiens
cagcagctacttggagcagcag

SEQ ID NO: 8222131 - DNA, 22 bp, Homo sapiens
cagcagctacttggagcagcag

SEQ ID NO: 8222132 - DNA, 22 bp, Homo sapiens
cagcagctacttggagcagcag

SEQ ID NO: 8222133 - DNA, 22 bp, Homo sapiens
cagcagctacttggagcagcag

SEQ ID NO: 8222134 - DNA, 22 bp, Homo sapiens
cagcagctacctgctcttgtgg

SEQ ID NO: 8222135 - DNA, 22 bp, Homo sapiens
cagcagctacctgctcttgtgg

SEQ ID NO: 8222136 - DNA, 22 bp, Homo sapiens
cagcagctacctgctcttgtgg

SEQ ID NO: 8222137 - DNA, 22 bp, Homo sapiens
cagcagctacctgctcttgtgg

SEQ ID NO: 8222138 - DNA, 22 bp, Homo sapiens
ggtgggtatagttagggcctct

SEQ ID NO: 8222139 - DNA, 22 bp, Homo sapiens
cagcaaggccattggatgcagt

SEQ ID NO: 8222140 - DNA, 22 bp, Homo sapiens
ggtgggtgaaatctaggtgtgt

SEQ ID NO: 8222141 - DNA, 22 bp, Homo sapiens
ggtgggtgaaatctaggtgtgt

SEQ ID NO: 8222142 - DNA, 22 bp, Homo sapiens
cagcaaggccattggatgcagt

SEQ ID NO: 8222143 - DNA, 22 bp, Homo sapiens
cagcaaggccattggatgcagt

SEQ ID NO: 8222144 - DNA, 22 bp, Homo sapiens
cagcaagggataaacaaggacg

SEQ ID NO: 8222145 - DNA, 22 bp, Homo sapiens
cagcaaggccattggatgcagt

SEQ ID NO: 8222146 - DNA, 22 bp, Homo sapiens
cagcaagggttatatcaaagat

SEQ ID NO: 8222147 - DNA, 22 bp, Homo sapiens
ggtggggtcacgacagagggaa

SEQ ID NO: 8222148 - DNA, 22 bp, Homo sapiens
ggtggggtcacgacagagggaa

SEQ ID NO: 8222149 - DNA, 22 bp, Homo sapiens
ggtgggtaaaactgctggcact

SEQ ID NO: 8222150 - DNA, 22 bp, Homo sapiens
ggtgggtaaaactgctggcact

SEQ ID NO: 8222151 - DNA, 22 bp, Homo sapiens
ggtggggttttaggctgctgca

SEQ ID NO: 8222152 - DNA, 22 bp, Homo sapiens
ggtggggttttaggctgctgca

SEQ ID NO: 8222153 - DNA, 22 bp, Homo sapiens
ggtggggctcagcaatctgtgt

SEQ ID NO: 8222154 - DNA, 22 bp, Homo sapiens
ggtggggctgcaagcagttcgg

SEQ ID NO: 8222155 - DNA, 22 bp, Homo sapiens
ggtggggctcagcaatctgtgt

SEQ ID NO: 8222156 - DNA, 22 bp, Homo sapiens
ggtgggggagacttggtcaaga

SEQ ID NO: 8222157 - DNA, 22 bp, Homo sapiens
gggtgggactctttggcctgag

SEQ ID NO: 8222158 - DNA, 22 bp, Homo sapiens
gggtgggactctttggcctgag

SEQ ID NO: 8222159 - DNA, 22 bp, Homo sapiens
gggtgggaaggctaagggattg

SEQ ID NO: 8222160 - DNA, 22 bp, Homo sapiens
gggtgggactgaagtctgaggg

SEQ ID NO: 8222161 - DNA, 22 bp, Homo sapiens
gggtgggactgaagtctgaggg

SEQ ID NO: 8222162 - DNA, 22 bp, Homo sapiens
gggtgggagaaatgagtatcta

SEQ ID NO: 8222163 - DNA, 22 bp, Homo sapiens
gggtgggagaaatgagtatcta

SEQ ID NO: 8222164 - DNA, 19 bp, Homo sapiens
cagagtacaccagatagga

SEQ ID NO: 8222165 - DNA, 22 bp, Homo sapiens
cagagtactgggagaacagaag

SEQ ID NO: 8222166 - DNA, 22 bp, Homo sapiens
cagagtcaatgtccaagaagct

SEQ ID NO: 8222167 - DNA, 22 bp, Homo sapiens
gggtgggaaggctaagggattg

SEQ ID NO: 8222168 - DNA, 22 bp, Homo sapiens
gggtgggatctgtggagcctca

SEQ ID NO: 8222169 - DNA, 22 bp, Homo sapiens
gggtgggagtctggccctcaaa

SEQ ID NO: 8222170 - DNA, 22 bp, Homo sapiens
gggtgggagtctggccctcaaa

SEQ ID NO: 8222171 - DNA, 22 bp, Homo sapiens
ggtgggagagctctgtctccag

SEQ ID NO: 8222172 - DNA, 22 bp, Homo sapiens
ggtgggagagctctgtctccag

SEQ ID NO: 8222173 - DNA, 21 bp, Homo sapiens
gggtgggaggacacagcaggc

SEQ ID NO: 8222174 - DNA, 20 bp, Homo sapiens
gggtgggagagtctgagggt

SEQ ID NO: 8222175 - DNA, 20 bp, Homo sapiens
gggtgggagagtctgagggt

SEQ ID NO: 8222176 - DNA, 22 bp, Homo sapiens
cagcaataactcaaagccattt

SEQ ID NO: 8222177 - DNA, 22 bp, Homo sapiens
cagcacaattttcaggagtcca

SEQ ID NO: 8222178 - DNA, 22 bp, Homo sapiens
ggtgtgcctggggcttagctgc

SEQ ID NO: 8222179 - DNA, 22 bp, Homo sapiens
ggtgtggatcatctgaggtcag

SEQ ID NO: 8222180 - DNA, 22 bp, Homo sapiens
ggttccccaggcggcccttgga

SEQ ID NO: 8222181 - DNA, 23 bp, Homo sapiens
ggttcctgagcagggatctggaa

SEQ ID NO: 8222182 - DNA, 22 bp, Homo sapiens
ggttcccggatctccgagtccc

SEQ ID NO: 8222183 - DNA, 22 bp, Homo sapiens
ggttcccggatctccgagtccc

SEQ ID NO: 8222184 - DNA, 22 bp, Homo sapiens
ggttctccttgagtgtcccagg

SEQ ID NO: 8222185 - DNA, 22 bp, Homo sapiens
ggttctaggattaggaggccca

SEQ ID NO: 8222186 - DNA, 22 bp, Homo sapiens
ggttgcaaactcctgggatcaa

SEQ ID NO: 8222187 - DNA, 22 bp, Homo sapiens
ggttctttgtatatatcacttt

SEQ ID NO: 8222188 - DNA, 17 bp, Homo sapiens
ggttgagtaatctgagg

SEQ ID NO: 8222189 - DNA, 22 bp, Homo sapiens
gtaaaatagaataacgtggcta

SEQ ID NO: 8222190 - DNA, 19 bp, Homo sapiens
ggttggagaagagcggccc

SEQ ID NO: 8222191 - DNA, 22 bp, Homo sapiens
gtaaaatagaataacgtggcta

SEQ ID NO: 8222192 - DNA, 19 bp, Homo sapiens
ggttggagaagagcggccc

SEQ ID NO: 8222193 - DNA, 20 bp, Homo sapiens
gtaaaatatggtctttgggt

SEQ ID NO: 8222194 - DNA, 20 bp, Homo sapiens
gtaaaatatggtctttgggt

SEQ ID NO: 8222195 - DNA, 20 bp, Homo sapiens
gtaaaatatggtctttgggt

SEQ ID NO: 8222196 - DNA, 20 bp, Homo sapiens
gtaaaatatggtctttgggt

SEQ ID NO: 8222197 - DNA, 20 bp, Homo sapiens
gtaaaatatggtctttgggt

SEQ ID NO: 8222198 - DNA, 20 bp, Homo sapiens
gtaaaatatggtctttgggt

SEQ ID NO: 8222199 - DNA, 22 bp, Homo sapiens
gtaaaatcatttagttacttaa

SEQ ID NO: 8222200 - DNA, 22 bp, Homo sapiens
gtaaaatcatttagttacttaa

SEQ ID NO: 8222201 - DNA, 22 bp, Homo sapiens
gtaaaattctagcatctgaaag

SEQ ID NO: 8222202 - DNA, 22 bp, Homo sapiens
gtaaaattctagcatctgaaag

SEQ ID NO: 8222203 - DNA, 22 bp, Homo sapiens
gtaaaattgcaattacttttgc

SEQ ID NO: 8222204 - DNA, 22 bp, Homo sapiens
gtaaaattgcaattacttttgc

SEQ ID NO: 8222205 - DNA, 22 bp, Homo sapiens
gtaaaatctttcctatttgcct

SEQ ID NO: 8222206 - DNA, 22 bp, Homo sapiens
gtaaaatctttattgctggtga

SEQ ID NO: 8222207 - DNA, 22 bp, Homo sapiens
gtaaaattctagcatctgaaag

SEQ ID NO: 8222208 - DNA, 22 bp, Homo sapiens
gtaaacaacacaaatcatttga

SEQ ID NO: 8222209 - DNA, 22 bp, Homo sapiens
gtaaacaacacaaatcatttga

SEQ ID NO: 8222210 - DNA, 22 bp, Homo sapiens
gtaaacacctgttaaattcaga

SEQ ID NO: 8222211 - DNA, 22 bp, Homo sapiens
cagcatttatcttgtagcagga

SEQ ID NO: 8222212 - DNA, 22 bp, Homo sapiens
cagcattttccatagaaagaag

SEQ ID NO: 8222213 - DNA, 22 bp, Homo sapiens
cagcattttccatagaaagaag

SEQ ID NO: 8222214 - DNA, 22 bp, Homo sapiens
cagcatttggtgatcatcttaa

SEQ ID NO: 8222215 - DNA, 18 bp, Homo sapiens
cagcattagcagcttcca

SEQ ID NO: 8222216 - DNA, 22 bp, Homo sapiens
cagcatgcctgggctgcctgcc

SEQ ID NO: 8222217 - DNA, 22 bp, Homo sapiens
cagcatgcctgggctgcctgcc

SEQ ID NO: 8222218 - DNA, 22 bp, Homo sapiens
cagcattgccctttttctcaga

SEQ ID NO: 8222219 - DNA, 22 bp, Homo sapiens
cagcatttagaatttgaagtgt

SEQ ID NO: 8222220 - DNA, 22 bp, Homo sapiens
cagcatttagaatttgaagtgt

SEQ ID NO: 8222221 - DNA, 22 bp, Homo sapiens
cagcatgcccagactgagctaa

SEQ ID NO: 8222222 - DNA, 22 bp, Homo sapiens
cagcatgcctgggctgcctgcc

SEQ ID NO: 8222223 - DNA, 22 bp, Homo sapiens
cagcatgcccagactgagctaa

SEQ ID NO: 8222224 - DNA, 22 bp, Homo sapiens
gtattttactgctcaaagctct

SEQ ID NO: 8222225 - DNA, 22 bp, Homo sapiens
gtattttactgctcaaagctct

SEQ ID NO: 8222226 - DNA, 22 bp, Homo sapiens
gtattttaagtgactactaggt

SEQ ID NO: 8222227 - DNA, 22 bp, Homo sapiens
gtattttaagtgactactaggt

SEQ ID NO: 8222228 - DNA, 22 bp, Homo sapiens
gtattttactgctcaaagctct

SEQ ID NO: 8222229 - DNA, 22 bp, Homo sapiens
gtattttaagtgactactaggt

SEQ ID NO: 8222230 - DNA, 22 bp, Homo sapiens
cagcattttcttaatgtaggtg

SEQ ID NO: 8222231 - DNA, 22 bp, Homo sapiens
cagccaagaaagcagtgctcca

SEQ ID NO: 8222232 - DNA, 22 bp, Homo sapiens
cagccaatagcaagggaagctg

SEQ ID NO: 8222233 - DNA, 22 bp, Homo sapiens
cagccaagaaccacagacccag

SEQ ID NO: 8222234 - DNA, 22 bp, Homo sapiens
cagccactgaactcctggctat

SEQ ID NO: 8222235 - DNA, 22 bp, Homo sapiens
cagccactctcagacagtccca

SEQ ID NO: 8222236 - DNA, 22 bp, Homo sapiens
cagccactgacaggaatggtcc

SEQ ID NO: 8222237 - DNA, 22 bp, Homo sapiens
cagccaccatacagcagaagct

SEQ ID NO: 8222238 - DNA, 22 bp, Homo sapiens
cagccacagctgggtgcctgac

SEQ ID NO: 8222239 - DNA, 22 bp, Homo sapiens
cagccactctcagacagtccca

SEQ ID NO: 8222240 - DNA, 22 bp, Homo sapiens
cagccagtggttgaagatgcag

SEQ ID NO: 8222241 - DNA, 17 bp, Homo sapiens
cagccagtcccttcatt

SEQ ID NO: 8222242 - DNA, 22 bp, Homo sapiens
cagccagtcccatttcaaatag

SEQ ID NO: 8222243 - DNA, 22 bp, Homo sapiens
cagccacttgtgatgctgggga

SEQ ID NO: 8222244 - DNA, 22 bp, Homo sapiens
cagccacttcgagcttcctgat

SEQ ID NO: 8222245 - DNA, 22 bp, Homo sapiens
cagccaggttcaagtccttata

SEQ ID NO: 8222246 - DNA, 22 bp, Homo sapiens
cagccaggttcaagtccttata

SEQ ID NO: 8222247 - DNA, 22 bp, Homo sapiens
cagccactggtgccaggctgtt

SEQ ID NO: 8222248 - DNA, 22 bp, Homo sapiens
cagccacttcgagcttcctgat

SEQ ID NO: 8222249 - DNA, 22 bp, Homo sapiens
cagccacttcgagcttcctgat

SEQ ID NO: 8222250 - DNA, 22 bp, Homo sapiens
cagccacttcccctctatgggt

SEQ ID NO: 8222251 - DNA, 22 bp, Homo sapiens
cagccactgtggaatagccccc

SEQ ID NO: 8222252 - DNA, 22 bp, Homo sapiens
cagcccagcagactgttaccac

SEQ ID NO: 8222253 - DNA, 22 bp, Homo sapiens
cagcccagcagggtctggccct

SEQ ID NO: 8222254 - DNA, 22 bp, Homo sapiens
cagcccagcagtcttagcctgc

SEQ ID NO: 8222255 - DNA, 22 bp, Homo sapiens
cagcccagcagtcttagcctgc

SEQ ID NO: 8222256 - DNA, 21 bp, Homo sapiens
cagcccagcccattgacagtg

SEQ ID NO: 8222257 - DNA, 22 bp, Homo sapiens
cagcccagcagggtctggccct

SEQ ID NO: 8222258 - DNA, 22 bp, Homo sapiens
cagcccagcagggtctggccct

SEQ ID NO: 8222259 - DNA, 22 bp, Homo sapiens
cagcccagcagggtctggccct

SEQ ID NO: 8222260 - DNA, 22 bp, Homo sapiens
atcacatcacaggttgagctag

SEQ ID NO: 8222261 - DNA, 22 bp, Homo sapiens
atcacatatttaagaaacatgt

SEQ ID NO: 8222262 - DNA, 22 bp, Homo sapiens
atcacatatttaagaaacatgt

SEQ ID NO: 8222263 - DNA, 22 bp, Homo sapiens
ctgtcctctgtcctcagcagga

SEQ ID NO: 8222264 - DNA, 22 bp, Homo sapiens
ctgtcctctgtcctcagcagga

SEQ ID NO: 8222265 - DNA, 22 bp, Homo sapiens
ctgtcctccggccacctacagt

SEQ ID NO: 8222266 - DNA, 22 bp, Homo sapiens
ctgtcctccagacgacagtccc

SEQ ID NO: 8222267 - DNA, 22 bp, Homo sapiens
ctgtcctccggccacctacagt

SEQ ID NO: 8222268 - DNA, 22 bp, Homo sapiens
ctgtcctccggccacctacagt

SEQ ID NO: 8222269 - DNA, 22 bp, Homo sapiens
ctgtcctccggccacctacagt

SEQ ID NO: 8222270 - DNA, 22 bp, Homo sapiens
ctgtcctcatctgccccaaggg

SEQ ID NO: 8222271 - DNA, 22 bp, Homo sapiens
ctgtcctccagacgacagtccc

SEQ ID NO: 8222272 - DNA, 22 bp, Homo sapiens
ctgtcctcatctgccccaaggg

SEQ ID NO: 8222273 - DNA, 21 bp, Homo sapiens
ctgtcctcagatgtggacgag

SEQ ID NO: 8222274 - DNA, 22 bp, Homo sapiens
ctgtcctcatctgccccaaggg

SEQ ID NO: 8222275 - DNA, 21 bp, Homo sapiens
ctgtcctcagatgtggacgag

SEQ ID NO: 8222276 - DNA, 22 bp, Homo sapiens
ctgtcctcaacccatccttctc

SEQ ID NO: 8222277 - DNA, 22 bp, Homo sapiens
ctgtcctcaacccatccttctc

SEQ ID NO: 8222278 - DNA, 22 bp, Homo sapiens
ctgtcctcaacccatccttctc

SEQ ID NO: 8222279 - DNA, 22 bp, Homo sapiens
ctgtcctcaacccatccttctc

SEQ ID NO: 8222280 - DNA, 22 bp, Homo sapiens
ctgtcctcaccttggcaggggg

SEQ ID NO: 8222281 - DNA, 22 bp, Homo sapiens
ctgtcctcaccttggcaggggg

SEQ ID NO: 8222282 - DNA, 22 bp, Homo sapiens
ctgtcctcaccttggcaggggg

SEQ ID NO: 8222283 - DNA, 22 bp, Homo sapiens
ctgtcctatgagtactcactag

SEQ ID NO: 8222284 - DNA, 22 bp, Homo sapiens
ctgtcctcaacccatccttctc

SEQ ID NO: 8222285 - DNA, 18 bp, Homo sapiens
ctgggtctccaggctgcc

SEQ ID NO: 8222286 - DNA, 18 bp, Homo sapiens
ctgggtctccaggctgcc

SEQ ID NO: 8222287 - DNA, 22 bp, Homo sapiens
ctgtccagtctttagcaagctg

SEQ ID NO: 8222288 - DNA, 22 bp, Homo sapiens
ctgtccagtctttagcaagctg

SEQ ID NO: 8222289 - DNA, 22 bp, Homo sapiens
ctgggtcccacagcctgctggg

SEQ ID NO: 8222290 - DNA, 22 bp, Homo sapiens
ctgggtcccacagcctgctggg

SEQ ID NO: 8222291 - DNA, 22 bp, Homo sapiens
ctgggtcctggtgctgagttct

SEQ ID NO: 8222292 - DNA, 22 bp, Homo sapiens
atatttgtcaattcactgttca

SEQ ID NO: 8222293 - DNA, 22 bp, Homo sapiens
ctgggtacctcaccgctgctgc

SEQ ID NO: 8222294 - DNA, 22 bp, Homo sapiens
ctgggtagaagattcctcagga

SEQ ID NO: 8222295 - DNA, 22 bp, Homo sapiens
ctgggtagaagattcctcagga

SEQ ID NO: 8222296 - DNA, 22 bp, Homo sapiens
ctgggtagctgctgctccttca

SEQ ID NO: 8222297 - DNA, 22 bp, Homo sapiens
ctgggtagctgctgctccttca

SEQ ID NO: 8222298 - DNA, 22 bp, Homo sapiens
ctgggtagctgctgctccttca

SEQ ID NO: 8222299 - DNA, 22 bp, Homo sapiens
ctgggtagggcaaggaactggc

SEQ ID NO: 8222300 - DNA, 22 bp, Homo sapiens
ctgggtcccacagcctgctggg

SEQ ID NO: 8222301 - DNA, 22 bp, Homo sapiens
ctgggtcacccaaaagggccag

SEQ ID NO: 8222302 - DNA, 22 bp, Homo sapiens
ctgggtcaggagcggctgcccg

SEQ ID NO: 8222303 - DNA, 22 bp, Homo sapiens
ctgggtagggtgatatcccaca

SEQ ID NO: 8222304 - DNA, 22 bp, Homo sapiens
atcatgtgtaatttcaagctac

SEQ ID NO: 8222305 - DNA, 22 bp, Homo sapiens
atcatgtgaagtggggggttga

SEQ ID NO: 8222306 - DNA, 22 bp, Homo sapiens
atcatgttcatcgtatttaggc

SEQ ID NO: 8222307 - DNA, 22 bp, Homo sapiens
atcatgtacttgacaaatatgt

SEQ ID NO: 8222308 - DNA, 22 bp, Homo sapiens
atcatggaagcctatcttgaga

SEQ ID NO: 8222309 - DNA, 22 bp, Homo sapiens
atcatgcatggtactcttgtgc

SEQ ID NO: 8222310 - DNA, 22 bp, Homo sapiens
atcatgcagcaacaagcaaggc

SEQ ID NO: 8222311 - DNA, 22 bp, Homo sapiens
atcatcatgcactctcaggttt

SEQ ID NO: 8222312 - DNA, 22 bp, Homo sapiens
atcatcatgcactctcaggttt

SEQ ID NO: 8222313 - DNA, 22 bp, Homo sapiens
atcatcatgcccacttgagact

SEQ ID NO: 8222314 - DNA, 22 bp, Homo sapiens
atcatcatgcccacttgagact

SEQ ID NO: 8222315 - DNA, 22 bp, Homo sapiens
atcatcattcttggataaagca

SEQ ID NO: 8222316 - DNA, 22 bp, Homo sapiens
atcatcatgctacaatcagcaa

SEQ ID NO: 8222317 - DNA, 22 bp, Homo sapiens
atcatgacagagtctgccatcc

SEQ ID NO: 8222318 - DNA, 22 bp, Homo sapiens
ctgtgatgatggaaactttctt

SEQ ID NO: 8222319 - DNA, 22 bp, Homo sapiens
ctgtgatggtcaggccctatct

SEQ ID NO: 8222320 - DNA, 22 bp, Homo sapiens
ctgtgatgttagctctgtgtta

SEQ ID NO: 8222321 - DNA, 22 bp, Homo sapiens
ctgtgcaaaggccttatgtttt

SEQ ID NO: 8222322 - DNA, 22 bp, Homo sapiens
ctgtgcaaaggccttatgtttt

SEQ ID NO: 8222323 - DNA, 22 bp, Homo sapiens
ctgtgattgttagttcctatac

SEQ ID NO: 8222324 - DNA, 22 bp, Homo sapiens
ctgtgcaagcccaagataaaac

SEQ ID NO: 8222325 - DNA, 22 bp, Homo sapiens
ctgtgcaagacttactttaata

SEQ ID NO: 8222326 - DNA, 22 bp, Homo sapiens
ctgtgcaagacttactttaata

SEQ ID NO: 8222327 - DNA, 22 bp, Homo sapiens
ctgtgcaaataaagagcaacat

SEQ ID NO: 8222328 - DNA, 22 bp, Homo sapiens
ctgtgcaaaggccttatgtttt

SEQ ID NO: 8222329 - DNA, 22 bp, Homo sapiens
ctgtgcaaataaagagcaacat

SEQ ID NO: 8222330 - DNA, 22 bp, Homo sapiens
ctgtgcaaggcccatgctcaga

SEQ ID NO: 8222331 - DNA, 22 bp, Homo sapiens
ctgtgcaagcccaagataaaac

SEQ ID NO: 8222332 - DNA, 22 bp, Homo sapiens
ctgtgcaagcccaagataaaac

SEQ ID NO: 8222333 - DNA, 23 bp, Homo sapiens
ctgtgcaatatcccatggtatga

SEQ ID NO: 8222334 - DNA, 22 bp, Homo sapiens
ctgtgcaatattataaaggcca

SEQ ID NO: 8222335 - DNA, 23 bp, Homo sapiens
ctgtgcaatatcccatggtatga

SEQ ID NO: 8222336 - DNA, 18 bp, Homo sapiens
ctgtgcagcaaactgagc

SEQ ID NO: 8222337 - DNA, 22 bp, Homo sapiens
ctgtgcacacgtgcccaacagt

SEQ ID NO: 8222338 - DNA, 22 bp, Homo sapiens
ctgtgcactaaccacacccacg

SEQ ID NO: 8222339 - DNA, 22 bp, Homo sapiens
ctgtgcacttctctttatttgt

SEQ ID NO: 8222340 - DNA, 22 bp, Homo sapiens
ctgtgcaatgcctaatcacaaa

SEQ ID NO: 8222341 - DNA, 19 bp, Homo sapiens
ctgtgcaggccgggctgag

SEQ ID NO: 8222342 - DNA, 19 bp, Homo sapiens
ctgtgcaggccgggctgag

SEQ ID NO: 8222343 - DNA, 19 bp, Homo sapiens
ctgtgcaggccgggctgag

SEQ ID NO: 8222344 - DNA, 22 bp, Homo sapiens
atcatcatctaaattgtgtcgc

SEQ ID NO: 8222345 - DNA, 22 bp, Homo sapiens
atcatcatcattgctaacatct

SEQ ID NO: 8222346 - DNA, 22 bp, Homo sapiens
ctgtctctgttgcctgtaggtg

SEQ ID NO: 8222347 - DNA, 22 bp, Homo sapiens
ctgtctgtttctgattcaacct

SEQ ID NO: 8222348 - DNA, 22 bp, Homo sapiens
ctgtctctgttgcctgtaggtg

SEQ ID NO: 8222349 - DNA, 22 bp, Homo sapiens
ctgtctctgtcttaactcccag

SEQ ID NO: 8222350 - DNA, 22 bp, Homo sapiens
atcacattatgtagtgaaaagg

SEQ ID NO: 8222351 - DNA, 22 bp, Homo sapiens
ctgtcttctaccttcaacctcc

SEQ ID NO: 8222352 - DNA, 22 bp, Homo sapiens
ctgtctgttttgtatacaggcc

SEQ ID NO: 8222353 - DNA, 22 bp, Homo sapiens
ctgtctgttttaccttctccag

SEQ ID NO: 8222354 - DNA, 22 bp, Homo sapiens
ctgtcttctcctttgtttcagg

SEQ ID NO: 8222355 - DNA, 22 bp, Homo sapiens
ctgtctttagtacaaaaaatgt

SEQ ID NO: 8222356 - DNA, 22 bp, Homo sapiens
ctgtgagttcattgtgccacct

SEQ ID NO: 8222357 - DNA, 22 bp, Homo sapiens
ctgtgagtgaccctggtcagca

SEQ ID NO: 8222358 - DNA, 22 bp, Homo sapiens
ctgtgagttcattgtgccacct

SEQ ID NO: 8222359 - DNA, 22 bp, Homo sapiens
ctgtgatgacaggcagggccaa

SEQ ID NO: 8222360 - DNA, 18 bp, Homo sapiens
ctgtcttttttctctcca

SEQ ID NO: 8222361 - DNA, 22 bp, Homo sapiens
ctgtcttttactatcatttact

SEQ ID NO: 8222362 - DNA, 22 bp, Homo sapiens
ctgtcttttactatcatttact

SEQ ID NO: 8222363 - DNA, 22 bp, Homo sapiens
ctgtctttggtcctgtctgtta

SEQ ID NO: 8222364 - DNA, 22 bp, Homo sapiens
ctgtcttttcttctcattgatg

SEQ ID NO: 8222365 - DNA, 22 bp, Homo sapiens
atcctcagacctcagcaaagcc

SEQ ID NO: 8222366 - DNA, 22 bp, Homo sapiens
atcctagaatcagcccttgctg

SEQ ID NO: 8222367 - DNA, 23 bp, Homo sapiens
atcctatataaccttggaggctg

SEQ ID NO: 8222368 - DNA, 22 bp, Homo sapiens
atccctgccctcatggagctta

SEQ ID NO: 8222369 - DNA, 23 bp, Homo sapiens
atcccttctccagtgtggtgagg

SEQ ID NO: 8222370 - DNA, 22 bp, Homo sapiens
atccctgtctcaaagccagcaa

SEQ ID NO: 8222371 - DNA, 22 bp, Homo sapiens
atcctctctcccataccagtct

SEQ ID NO: 8222372 - DNA, 22 bp, Homo sapiens
atcctctctgtgacagggaacg

SEQ ID NO: 8222373 - DNA, 23 bp, Homo sapiens
atcctctctccatcccactgtgc

SEQ ID NO: 8222374 - DNA, 23 bp, Homo sapiens
atcctctctccatcccactgtgc

SEQ ID NO: 8222375 - DNA, 22 bp, Homo sapiens
atcctcagtgtttctgacatct

SEQ ID NO: 8222376 - DNA, 20 bp, Homo sapiens
atcctctcctgattaattca

SEQ ID NO: 8222377 - DNA, 18 bp, Homo sapiens
atcctctagcttctcaga

SEQ ID NO: 8222378 - DNA, 22 bp, Homo sapiens
atcctccagctcctgcttctgc

SEQ ID NO: 8222379 - DNA, 22 bp, Homo sapiens
atctaattttcactcatttgct

SEQ ID NO: 8222380 - DNA, 22 bp, Homo sapiens
atctaattttcactcatttgct

SEQ ID NO: 8222381 - DNA, 22 bp, Homo sapiens
atctacaacgggtggagtaggg

SEQ ID NO: 8222382 - DNA, 22 bp, Homo sapiens
atctacaacatcacatggcatt

SEQ ID NO: 8222383 - DNA, 22 bp, Homo sapiens
atcctctgaccgctgcagggag

SEQ ID NO: 8222384 - DNA, 22 bp, Homo sapiens
atcctttaagttaataaaattc

SEQ ID NO: 8222385 - DNA, 22 bp, Homo sapiens
atcctttaagttaataaaattc

SEQ ID NO: 8222386 - DNA, 22 bp, Homo sapiens
atccacagaaggaacttgaaag

SEQ ID NO: 8222387 - DNA, 22 bp, Homo sapiens
atccacagagaggaagaatagt

SEQ ID NO: 8222388 - DNA, 22 bp, Homo sapiens
atccccagactttagatttctc

SEQ ID NO: 8222389 - DNA, 22 bp, Homo sapiens
atccatttgtaaatgttagagt

SEQ ID NO: 8222390 - DNA, 22 bp, Homo sapiens
atccatttgacataatttcagc

SEQ ID NO: 8222391 - DNA, 22 bp, Homo sapiens
atccatttgtaaatgttagagt

SEQ ID NO: 8222392 - DNA, 22 bp, Homo sapiens
atccatttgccgtgctatgtgc

SEQ ID NO: 8222393 - DNA, 23 bp, Homo sapiens
atccacattacagtatcatacaa

SEQ ID NO: 8222394 - DNA, 22 bp, Homo sapiens
atccctgccctcatggagctta

SEQ ID NO: 8222395 - DNA, 22 bp, Homo sapiens
atccctcagccacctttgagga

SEQ ID NO: 8222396 - DNA, 22 bp, Homo sapiens
atccccttcacaccctctgcat

SEQ ID NO: 8222397 - DNA, 22 bp, Homo sapiens
atccccttgtgggctggcagca

SEQ ID NO: 8222398 - DNA, 22 bp, Homo sapiens
atccctcagcagacagcaaaat

SEQ ID NO: 8222399 - DNA, 21 bp, Homo sapiens
atcccggctttgaggcagatg

SEQ ID NO: 8222400 - DNA, 22 bp, Homo sapiens
atccccctgtatctggaagaat

SEQ ID NO: 8222401 - DNA, 22 bp, Homo sapiens
atccccctcttggatggcggca

SEQ ID NO: 8222402 - DNA, 23 bp, Homo sapiens
atcccctgccttgggtgagtccc

SEQ ID NO: 8222403 - DNA, 22 bp, Homo sapiens
atccccttatcccaggctgagc

SEQ ID NO: 8222404 - DNA, 22 bp, Homo sapiens
atccccagggagtgagctgtct

SEQ ID NO: 8222405 - DNA, 22 bp, Homo sapiens
atccccagggaggcctgacctg

SEQ ID NO: 8222406 - DNA, 22 bp, Homo sapiens
atccccaggggcattcaagctt

SEQ ID NO: 8222407 - DNA, 22 bp, Homo sapiens
atcattttgtgacaatgcctgt

SEQ ID NO: 8222408 - DNA, 22 bp, Homo sapiens
atcatttttaagagactcttct

SEQ ID NO: 8222409 - DNA, 22 bp, Homo sapiens
atcatttttaagagactcttct

SEQ ID NO: 8222410 - DNA, 22 bp, Homo sapiens
atcatttttaagagactcttct

SEQ ID NO: 8222411 - DNA, 22 bp, Homo sapiens
atcattctagtccttatggtct

SEQ ID NO: 8222412 - DNA, 22 bp, Homo sapiens
atcattttatggctgagaggac

SEQ ID NO: 8222413 - DNA, 22 bp, Homo sapiens
atcattttatggctgagaggac

SEQ ID NO: 8222414 - DNA, 22 bp, Homo sapiens
atcattttgtgacaatgcctgt

SEQ ID NO: 8222415 - DNA, 22 bp, Homo sapiens
atccaaacatgtaccacactaa

SEQ ID NO: 8222416 - DNA, 22 bp, Homo sapiens
atcatttttaagagactcttct

SEQ ID NO: 8222417 - DNA, 22 bp, Homo sapiens
atccaacaggacaaagaaagga

SEQ ID NO: 8222418 - DNA, 22 bp, Homo sapiens
atccaacacgtatttgctggcc

SEQ ID NO: 8222419 - DNA, 22 bp, Homo sapiens
atccaagaatttgcactcctaa

SEQ ID NO: 8222420 - DNA, 22 bp, Homo sapiens
atccacaagaccccttttcact

SEQ ID NO: 8222421 - DNA, 22 bp, Homo sapiens
atccaacacgtatttgctggcc

SEQ ID NO: 8222422 - DNA, 22 bp, Homo sapiens
ctgtggagtggggagtactggt

SEQ ID NO: 8222423 - DNA, 22 bp, Homo sapiens
ctgtggagtggggagtactggt

SEQ ID NO: 8222424 - DNA, 22 bp, Homo sapiens
ctgtggagtggggagtactggt

SEQ ID NO: 8222425 - DNA, 22 bp, Homo sapiens
atcattctagctgttgtgttga

SEQ ID NO: 8222426 - DNA, 22 bp, Homo sapiens
ctgtggagtgcttggctcagtg

SEQ ID NO: 8222427 - DNA, 22 bp, Homo sapiens
ctgtggagtgcttggctcagtg

SEQ ID NO: 8222428 - DNA, 22 bp, Homo sapiens
ctgtggagcttgtggcagtggg

SEQ ID NO: 8222429 - DNA, 22 bp, Homo sapiens
ctgtggagcttgtggcagtggg

SEQ ID NO: 8222430 - DNA, 22 bp, Homo sapiens
ctgtggaggtaggagcaggaca

SEQ ID NO: 8222431 - DNA, 22 bp, Homo sapiens
ctgtggagcttgtggcagtggg

SEQ ID NO: 8222432 - DNA, 22 bp, Homo sapiens
ctgtggagcttgtggcagtggg

SEQ ID NO: 8222433 - DNA, 22 bp, Homo sapiens
ctgtggagtcctggggaatgga

SEQ ID NO: 8222434 - DNA, 22 bp, Homo sapiens
ctgtggagtcctggggaatgga

SEQ ID NO: 8222435 - DNA, 22 bp, Homo sapiens
ctgtggaggtaggagcaggaca

SEQ ID NO: 8222436 - DNA, 22 bp, Homo sapiens
ctgtggaggtaggagcaggaca

SEQ ID NO: 8222437 - DNA, 22 bp, Homo sapiens
ctgtggagatgcagaccaggcc

SEQ ID NO: 8222438 - DNA, 22 bp, Homo sapiens
ctgtggagcagggcagggtcac

SEQ ID NO: 8222439 - DNA, 22 bp, Homo sapiens
ctgtggagatgcagaccaggcc

SEQ ID NO: 8222440 - DNA, 22 bp, Homo sapiens
atcattaaatataagcttcaca

SEQ ID NO: 8222441 - DNA, 22 bp, Homo sapiens
ctgtggagcagggcagggtcac

SEQ ID NO: 8222442 - DNA, 22 bp, Homo sapiens
ctgtggagcttgtggcagtggg

SEQ ID NO: 8222443 - DNA, 23 bp, Homo sapiens
ctgtggagccctttgttgggaga

SEQ ID NO: 8222444 - DNA, 22 bp, Homo sapiens
atcatgttccagaaacagtgat

SEQ ID NO: 8222445 - DNA, 22 bp, Homo sapiens
atcatgttgctcaaaattaaac

SEQ ID NO: 8222446 - DNA, 22 bp, Homo sapiens
atcatgttggctctgacaaaaa

SEQ ID NO: 8222447 - DNA, 22 bp, Homo sapiens
atcatgttgtatgtaatctttt

SEQ ID NO: 8222448 - DNA, 22 bp, Homo sapiens
atcatgtttagttttaagggct

SEQ ID NO: 8222449 - DNA, 22 bp, Homo sapiens
atcatgttttaattagcaaact

SEQ ID NO: 8222450 - DNA, 22 bp, Homo sapiens
atatatatgctgatggctgcca

SEQ ID NO: 8222451 - DNA, 22 bp, Homo sapiens
atatatatgctgatggctgcca

SEQ ID NO: 8222452 - DNA, 22 bp, Homo sapiens
atatatatcgagttcatgtctc

SEQ ID NO: 8222453 - DNA, 22 bp, Homo sapiens
atatatatgctgatggctgcca

SEQ ID NO: 8222454 - DNA, 20 bp, Homo sapiens
ctgggcacctgtctgcagtt

SEQ ID NO: 8222455 - DNA, 20 bp, Homo sapiens
ctgggcacctgtctgcagtt

SEQ ID NO: 8222456 - DNA, 22 bp, Homo sapiens
atatatatcgagttcatgtctc

SEQ ID NO: 8222457 - DNA, 22 bp, Homo sapiens
atatatatcgagttcatgtctc

SEQ ID NO: 8222458 - DNA, 22 bp, Homo sapiens
ctgggcacaggggagcagagtc

SEQ ID NO: 8222459 - DNA, 22 bp, Homo sapiens
ctgggcacaggggagcagagtc

SEQ ID NO: 8222460 - DNA, 22 bp, Homo sapiens
ctgggcacattttgactagtgt

SEQ ID NO: 8222461 - DNA, 22 bp, Homo sapiens
ctgggcacagtggctcacgcct

SEQ ID NO: 8222462 - DNA, 20 bp, Homo sapiens
ctgggcacctgtctgcagtt

SEQ ID NO: 8222463 - DNA, 20 bp, Homo sapiens
ctgggcacctgtctgcagtt

SEQ ID NO: 8222464 - DNA, 22 bp, Homo sapiens
ctgggagtactgggggatgtca

SEQ ID NO: 8222465 - DNA, 22 bp, Homo sapiens
ctgggcacaagtggccctggat

SEQ ID NO: 8222466 - DNA, 19 bp, Homo sapiens
ctgggaggtgttcagagaa

SEQ ID NO: 8222467 - DNA, 19 bp, Homo sapiens
ctgggaggtgttcagagaa

SEQ ID NO: 8222468 - DNA, 22 bp, Homo sapiens
ctgggcacaagtggccctggat

SEQ ID NO: 8222469 - DNA, 22 bp, Homo sapiens
ctgggcacaagtggccctggat

SEQ ID NO: 8222470 - DNA, 22 bp, Homo sapiens
ctgggcacacagtgactctgca

SEQ ID NO: 8222471 - DNA, 22 bp, Homo sapiens
ctgggcacacagtgactctgca

SEQ ID NO: 8222472 - DNA, 22 bp, Homo sapiens
ctgggcacactctgctccagct

SEQ ID NO: 8222473 - DNA, 22 bp, Homo sapiens
ctgggcacagaccccctgggcc

SEQ ID NO: 8222474 - DNA, 22 bp, Homo sapiens
ctgggcacagcgttgggctctt

SEQ ID NO: 8222475 - DNA, 22 bp, Homo sapiens
ctgggcacagcgttgggctctt

SEQ ID NO: 8222476 - DNA, 22 bp, Homo sapiens
ctgggcacaggggagcagagtc

SEQ ID NO: 8222477 - DNA, 22 bp, Homo sapiens
ctgggagacgcagctggggatc

SEQ ID NO: 8222478 - DNA, 22 bp, Homo sapiens
ctgggagacaagagagggctga

SEQ ID NO: 8222479 - DNA, 22 bp, Homo sapiens
ctgggagacgcagctggggatc

SEQ ID NO: 8222480 - DNA, 22 bp, Homo sapiens
ctgggagacgcagctggggatc

SEQ ID NO: 8222481 - DNA, 22 bp, Homo sapiens
ctgggagacaagagagggctga

SEQ ID NO: 8222482 - DNA, 22 bp, Homo sapiens
ctgggagagaagcgaagctggg

SEQ ID NO: 8222483 - DNA, 22 bp, Homo sapiens
ctgggagagaagcgaagctggg

SEQ ID NO: 8222484 - DNA, 22 bp, Homo sapiens
ctgggagagaagcgaagctggg

SEQ ID NO: 8222485 - DNA, 22 bp, Homo sapiens
ctgggagaggaacctcgagggt

SEQ ID NO: 8222486 - DNA, 22 bp, Homo sapiens
ctgggagagcctttcctgagtc

SEQ ID NO: 8222487 - DNA, 22 bp, Homo sapiens
ctgggagagacacttctgatta

SEQ ID NO: 8222488 - DNA, 22 bp, Homo sapiens
atatatactttgacacattctg

SEQ ID NO: 8222489 - DNA, 22 bp, Homo sapiens
atatatactttgacacattctg

SEQ ID NO: 8222490 - DNA, 22 bp, Homo sapiens
atatatactttgacacattctg

SEQ ID NO: 8222491 - DNA, 22 bp, Homo sapiens
atatatactttgacacattctg

SEQ ID NO: 8222492 - DNA, 22 bp, Homo sapiens
atatatactttgacacattctg

SEQ ID NO: 8222493 - DNA, 22 bp, Homo sapiens
atatatacaactagattaaaag

SEQ ID NO: 8222494 - DNA, 22 bp, Homo sapiens
atatatacaactagattaaaag

SEQ ID NO: 8222495 - DNA, 22 bp, Homo sapiens
atatatacaactagattaaaag

SEQ ID NO: 8222496 - DNA, 22 bp, Homo sapiens
atatatacaactagattaaaag

SEQ ID NO: 8222497 - DNA, 22 bp, Homo sapiens
atatatatcgagttcatgtctc

SEQ ID NO: 8222498 - DNA, 22 bp, Homo sapiens
atatatagagctagatgttaaa

SEQ ID NO: 8222499 - DNA, 22 bp, Homo sapiens
atatatagagctagatgttaaa

SEQ ID NO: 8222500 - DNA, 22 bp, Homo sapiens
atatatagagctagatgttaaa

SEQ ID NO: 8222501 - DNA, 22 bp, Homo sapiens
atatatatcgagttcatgtctc

SEQ ID NO: 8222502 - DNA, 22 bp, Homo sapiens
ctgggactttaccctgtggccc

SEQ ID NO: 8222503 - DNA, 22 bp, Homo sapiens
ctgggactttaccctgtggccc

SEQ ID NO: 8222504 - DNA, 22 bp, Homo sapiens
ctgggactttgtaggccagttg

SEQ ID NO: 8222505 - DNA, 22 bp, Homo sapiens
ctgggactttgtaggccagttg

SEQ ID NO: 8222506 - DNA, 22 bp, Homo sapiens
ctgggaaggggaaggtcctctc

SEQ ID NO: 8222507 - DNA, 22 bp, Homo sapiens
ctgggaagtagaatcagatgag

SEQ ID NO: 8222508 - DNA, 22 bp, Homo sapiens
ctgggaagtagaatcagatgag

SEQ ID NO: 8222509 - DNA, 22 bp, Homo sapiens
ctgggaagtagaatcagatgag

SEQ ID NO: 8222510 - DNA, 22 bp, Homo sapiens
ctgggacaagctctgtctagct

SEQ ID NO: 8222511 - DNA, 22 bp, Homo sapiens
ctgggaagcttcgagcaggaaa

SEQ ID NO: 8222512 - DNA, 22 bp, Homo sapiens
ctgggaagcttcgagcaggaaa

SEQ ID NO: 8222513 - DNA, 22 bp, Homo sapiens
ctgggaagggacgccagtgcct

SEQ ID NO: 8222514 - DNA, 22 bp, Homo sapiens
ctgggaagggacgccagtgcct

SEQ ID NO: 8222515 - DNA, 22 bp, Homo sapiens
ctgggaagggacgccagtgcct

SEQ ID NO: 8222516 - DNA, 22 bp, Homo sapiens
ctgggaagcatggtgatggtat

SEQ ID NO: 8222517 - DNA, 22 bp, Homo sapiens
ctgggaagccacagggtgtggg

SEQ ID NO: 8222518 - DNA, 22 bp, Homo sapiens
ctgggaagccacagggtgtggg

SEQ ID NO: 8222519 - DNA, 22 bp, Homo sapiens
ctggcttctgggccagggcaga

SEQ ID NO: 8222520 - DNA, 23 bp, Homo sapiens
ctggcttctggggcctctgtttc

SEQ ID NO: 8222521 - DNA, 22 bp, Homo sapiens
ctgggaagcatggtgatggtat

SEQ ID NO: 8222522 - DNA, 22 bp, Homo sapiens
ctgggaagatggtgacagaatt

SEQ ID NO: 8222523 - DNA, 22 bp, Homo sapiens
ctggcagctgtgtgaagaactg

SEQ ID NO: 8222524 - DNA, 22 bp, Homo sapiens
ctggcagctgtgtgaagaactg

SEQ ID NO: 8222525 - DNA, 22 bp, Homo sapiens
ctggcagcttagcactctggtt

SEQ ID NO: 8222526 - DNA, 22 bp, Homo sapiens
ctggcagcttagcactctggtt

SEQ ID NO: 8222527 - DNA, 22 bp, Homo sapiens
ctggcagctgcccgagatgccc

SEQ ID NO: 8222528 - DNA, 22 bp, Homo sapiens
ctggcagctggaggctagaggc

SEQ ID NO: 8222529 - DNA, 22 bp, Homo sapiens
ctggcagctggaggctagaggc

SEQ ID NO: 8222530 - DNA, 22 bp, Homo sapiens
ctggcagctggaggctagaggc

SEQ ID NO: 8222531 - DNA, 22 bp, Homo sapiens
ctggcagctggaggctagaggc

SEQ ID NO: 8222532 - DNA, 22 bp, Homo sapiens
atatatacaactagattaaaag

SEQ ID NO: 8222533 - DNA, 22 bp, Homo sapiens
atatataatacttgctgtgggc

SEQ ID NO: 8222534 - DNA, 22 bp, Homo sapiens
atatataatacttgctgtgggc

SEQ ID NO: 8222535 - DNA, 22 bp, Homo sapiens
atatataatacttgctgtgggc

SEQ ID NO: 8222536 - DNA, 22 bp, Homo sapiens
atatataagctgatgagccaca

SEQ ID NO: 8222537 - DNA, 22 bp, Homo sapiens
atatataagctgatgagccaca

SEQ ID NO: 8222538 - DNA, 22 bp, Homo sapiens
atatataagctgatgagccaca

SEQ ID NO: 8222539 - DNA, 22 bp, Homo sapiens
atatataagctgatgagccaca

SEQ ID NO: 8222540 - DNA, 22 bp, Homo sapiens
atatataagctgatgagccaca

SEQ ID NO: 8222541 - DNA, 22 bp, Homo sapiens
atatataacctggataaggctt

SEQ ID NO: 8222542 - DNA, 22 bp, Homo sapiens
atatataacctggataaggctt

SEQ ID NO: 8222543 - DNA, 22 bp, Homo sapiens
atatataacctggataaggctt

SEQ ID NO: 8222544 - DNA, 22 bp, Homo sapiens
atatataagctgatgagccaca

SEQ ID NO: 8222545 - DNA, 22 bp, Homo sapiens
atataatacaacctgctaagtg

SEQ ID NO: 8222546 - DNA, 22 bp, Homo sapiens
atataatacaacctgctaagtg

SEQ ID NO: 8222547 - DNA, 20 bp, Homo sapiens
atataataaattttggttac

SEQ ID NO: 8222548 - DNA, 22 bp, Homo sapiens
atatataacctggataaggctt

SEQ ID NO: 8222549 - DNA, 22 bp, Homo sapiens
atatataacctggataaggctt

SEQ ID NO: 8222550 - DNA, 22 bp, Homo sapiens
atatataacctggataaggctt

SEQ ID NO: 8222551 - DNA, 22 bp, Homo sapiens
atataacatacatacagaaaag

SEQ ID NO: 8222552 - DNA, 22 bp, Homo sapiens
atataacatacatacagaaaag

SEQ ID NO: 8222553 - DNA, 22 bp, Homo sapiens
ctgggacaagctctgtctagct

SEQ ID NO: 8222554 - DNA, 22 bp, Homo sapiens
atataactcttgttcttatagt

SEQ ID NO: 8222555 - DNA, 22 bp, Homo sapiens
atataactcttgttcttatagt

SEQ ID NO: 8222556 - DNA, 22 bp, Homo sapiens
atataactcttgttcttatagt

SEQ ID NO: 8222557 - DNA, 22 bp, Homo sapiens
atataacatacatacagaaaag

SEQ ID NO: 8222558 - DNA, 22 bp, Homo sapiens
atataactcttgttcttatagt

SEQ ID NO: 8222559 - DNA, 22 bp, Homo sapiens
atataactcttgttcttatagt

SEQ ID NO: 8222560 - DNA, 22 bp, Homo sapiens
atataagttagtggtcatgttt

SEQ ID NO: 8222561 - DNA, 20 bp, Homo sapiens
atataataaattttggttac

SEQ ID NO: 8222562 - DNA, 22 bp, Homo sapiens
atatgggggggcgtgcagagga

SEQ ID NO: 8222563 - DNA, 22 bp, Homo sapiens
atatgtacacttacgttacaaa

SEQ ID NO: 8222564 - DNA, 22 bp, Homo sapiens
atatgggggggcgtgcagagga

SEQ ID NO: 8222565 - DNA, 22 bp, Homo sapiens
atatgggggggcgtgcagagga

SEQ ID NO: 8222566 - DNA, 22 bp, Homo sapiens
atatgtatgtacgcacatattc

SEQ ID NO: 8222567 - DNA, 22 bp, Homo sapiens
atatgtatagccagtctttagg

SEQ ID NO: 8222568 - DNA, 22 bp, Homo sapiens
atatgtatagccagtctttagg

SEQ ID NO: 8222569 - DNA, 22 bp, Homo sapiens
atatgtactgaaactgcttttc

SEQ ID NO: 8222570 - DNA, 22 bp, Homo sapiens
atatgtatagccagtctttagg

SEQ ID NO: 8222571 - DNA, 22 bp, Homo sapiens
atatgtatagccagtctttagg

SEQ ID NO: 8222572 - DNA, 22 bp, Homo sapiens
atatgtatgtacgcacatattc

SEQ ID NO: 8222573 - DNA, 22 bp, Homo sapiens
atatgtatgtacgcacatattc

SEQ ID NO: 8222574 - DNA, 22 bp, Homo sapiens
atatgtatgtgttttctttgga

SEQ ID NO: 8222575 - DNA, 22 bp, Homo sapiens
atatgtattgagtgccaactgt

SEQ ID NO: 8222576 - DNA, 22 bp, Homo sapiens
atatgtattttaacgtgtaagg

SEQ ID NO: 8222577 - DNA, 22 bp, Homo sapiens
atatgtattttaacgtgtaagg

SEQ ID NO: 8222578 - DNA, 22 bp, Homo sapiens
atatgtattgagtgccaactgt

SEQ ID NO: 8222579 - DNA, 22 bp, Homo sapiens
atatgtatgtgttttctttgga

SEQ ID NO: 8222580 - DNA, 22 bp, Homo sapiens
atatgtatgtgttttctttgga

SEQ ID NO: 8222581 - DNA, 23 bp, Homo sapiens
atatgtcatgcaccagcacttta

SEQ ID NO: 8222582 - DNA, 22 bp, Homo sapiens
atatgtcaagattttgagcaga

SEQ ID NO: 8222583 - DNA, 22 bp, Homo sapiens
atatgtattttaacgtgtaagg

SEQ ID NO: 8222584 - DNA, 23 bp, Homo sapiens
atatgtcatgcaccagcacttta

SEQ ID NO: 8222585 - DNA, 22 bp, Homo sapiens
atatgtgtaaatgcatttgttt

SEQ ID NO: 8222586 - DNA, 22 bp, Homo sapiens
atatgtgtacgtgcagtatata

SEQ ID NO: 8222587 - DNA, 22 bp, Homo sapiens
atatgtgtaaatgcatttgttt

SEQ ID NO: 8222588 - DNA, 22 bp, Homo sapiens
atatgtgtaaatgcatttgttt

SEQ ID NO: 8222589 - DNA, 22 bp, Homo sapiens
atatgtctctgtacaacagtct

SEQ ID NO: 8222590 - DNA, 22 bp, Homo sapiens
atatgtgaagtgggttattttg

SEQ ID NO: 8222591 - DNA, 22 bp, Homo sapiens
atatgtgatttgacttctggca

SEQ ID NO: 8222592 - DNA, 22 bp, Homo sapiens
atatgtgaatgatatcactttg

SEQ ID NO: 8222593 - DNA, 22 bp, Homo sapiens
atatgtgtgatgcatggactaa

SEQ ID NO: 8222594 - DNA, 22 bp, Homo sapiens
atatgtgtgatgcatggactaa

SEQ ID NO: 8222595 - DNA, 22 bp, Homo sapiens
atatgtgtatggatttctatct

SEQ ID NO: 8222596 - DNA, 22 bp, Homo sapiens
atatgtgtatggatttctatct

SEQ ID NO: 8222597 - DNA, 20 bp, Homo sapiens
atatgtgtacgtgtatacat

SEQ ID NO: 8222598 - DNA, 20 bp, Homo sapiens
atatgtgtacgtgtatacat

SEQ ID NO: 8222599 - DNA, 22 bp, Homo sapiens
atatgtgtgtatttcttactag

SEQ ID NO: 8222600 - DNA, 22 bp, Homo sapiens
atatgtgtgcacatatgtattt

SEQ ID NO: 8222601 - DNA, 22 bp, Homo sapiens
atatgtgtgatgcatggactaa

SEQ ID NO: 8222602 - DNA, 22 bp, Homo sapiens
atatttcttgagcacctggtat

SEQ ID NO: 8222603 - DNA, 22 bp, Homo sapiens
atatttgcaggaaactagtttt

SEQ ID NO: 8222604 - DNA, 22 bp, Homo sapiens
atatttggaaagaaaatcattg

SEQ ID NO: 8222605 - DNA, 22 bp, Homo sapiens
atatttcttgagcacctggtat

SEQ ID NO: 8222606 - DNA, 22 bp, Homo sapiens
atatttggaaagaaaatcattg

SEQ ID NO: 8222607 - DNA, 22 bp, Homo sapiens
atatttgtagtgggtaagaagt

SEQ ID NO: 8222608 - DNA, 20 bp, Homo sapiens
atatttcttaagaactttca

SEQ ID NO: 8222609 - DNA, 20 bp, Homo sapiens
atatttcttaagaactttca

SEQ ID NO: 8222610 - DNA, 20 bp, Homo sapiens
atatttcttaagaactttca

SEQ ID NO: 8222611 - DNA, 20 bp, Homo sapiens
atatttcttaagaactttca

SEQ ID NO: 8222612 - DNA, 20 bp, Homo sapiens
atatttcttaagaactttca

SEQ ID NO: 8222613 - DNA, 20 bp, Homo sapiens
atatttcttaagaactttca

SEQ ID NO: 8222614 - DNA, 22 bp, Homo sapiens
atatttctgggggtgtgtttct

SEQ ID NO: 8222615 - DNA, 22 bp, Homo sapiens
atatttctctcagacatggaag

SEQ ID NO: 8222616 - DNA, 22 bp, Homo sapiens
atatttctctcagacatggaag

SEQ ID NO: 8222617 - DNA, 22 bp, Homo sapiens
atatttctgggggtgtgtttct

SEQ ID NO: 8222618 - DNA, 22 bp, Homo sapiens
atatttctgggggtgtgtttct

SEQ ID NO: 8222619 - DNA, 22 bp, Homo sapiens
atatttctgggggtgtgtttct

SEQ ID NO: 8222620 - DNA, 22 bp, Homo sapiens
atatttctgggggtgtgtttct

SEQ ID NO: 8222621 - DNA, 22 bp, Homo sapiens
atatttctgggggtgtgtttct

SEQ ID NO: 8222622 - DNA, 22 bp, Homo sapiens
atatgttagggaacaatttgag

SEQ ID NO: 8222623 - DNA, 22 bp, Homo sapiens
atatgttgagcaagcatgatta

SEQ ID NO: 8222624 - DNA, 23 bp, Homo sapiens
atatgttgtgaaattttagtagc

SEQ ID NO: 8222625 - DNA, 22 bp, Homo sapiens
atatgttgttttagtctgcttg

SEQ ID NO: 8222626 - DNA, 22 bp, Homo sapiens
atatgtttcagtattcaagtca

SEQ ID NO: 8222627 - DNA, 22 bp, Homo sapiens
atatgttttgtgcttcattggt

SEQ ID NO: 8222628 - DNA, 22 bp, Homo sapiens
atatgttttgtgcttcattggt

SEQ ID NO: 8222629 - DNA, 22 bp, Homo sapiens
atatgttttgtgcttcattggt

SEQ ID NO: 8222630 - DNA, 22 bp, Homo sapiens
atatgtttcagtattcaagtca

SEQ ID NO: 8222631 - DNA, 22 bp, Homo sapiens
atatttctctcagacatggaag

SEQ ID NO: 8222632 - DNA, 22 bp, Homo sapiens
atatttctccaaatgttttcaa

SEQ ID NO: 8222633 - DNA, 22 bp, Homo sapiens
atatttctccaaatgttttcaa

SEQ ID NO: 8222634 - DNA, 22 bp, Homo sapiens
atatttataagcaagcaggact

SEQ ID NO: 8222635 - DNA, 22 bp, Homo sapiens
atatttactgctgtggtgaagg

SEQ ID NO: 8222636 - DNA, 22 bp, Homo sapiens
atatttactgctgtggtgaagg

SEQ ID NO: 8222637 - DNA, 22 bp, Homo sapiens
atatggcagaccaattagaagc

SEQ ID NO: 8222638 - DNA, 22 bp, Homo sapiens
atatggcaaaggggaattaagg

SEQ ID NO: 8222639 - DNA, 22 bp, Homo sapiens
atatggcagaccaattagaagc

SEQ ID NO: 8222640 - DNA, 22 bp, Homo sapiens
atatgctggagtacaggaaata

SEQ ID NO: 8222641 - DNA, 22 bp, Homo sapiens
ctgggcaggatacttcatggga

SEQ ID NO: 8222642 - DNA, 22 bp, Homo sapiens
atatgcaagcacatagaatact

SEQ ID NO: 8222643 - DNA, 22 bp, Homo sapiens
atatgattgtccttagcaaatt

SEQ ID NO: 8222644 - DNA, 22 bp, Homo sapiens
atatgatgtgctatgtcactag

SEQ ID NO: 8222645 - DNA, 22 bp, Homo sapiens
atatgattccactattgtatgg

SEQ ID NO: 8222646 - DNA, 22 bp, Homo sapiens
ctgggcagtatgaatattcaaa

SEQ ID NO: 8222647 - DNA, 22 bp, Homo sapiens
ctgggcagtatgaatattcaaa

SEQ ID NO: 8222648 - DNA, 22 bp, Homo sapiens
ctgggcaggtatacaaaaaatg

SEQ ID NO: 8222649 - DNA, 19 bp, Homo sapiens
atatatgtatacaatgtgg

SEQ ID NO: 8222650 - DNA, 22 bp, Homo sapiens
atatcattctgatgtatatctt

SEQ ID NO: 8222651 - DNA, 22 bp, Homo sapiens
atatatgcatgtgtacttatgt

SEQ ID NO: 8222652 - DNA, 22 bp, Homo sapiens
atatatgaagaagtcttgatta

SEQ ID NO: 8222653 - DNA, 22 bp, Homo sapiens
atatatcatgagtaaaacttga

SEQ ID NO: 8222654 - DNA, 22 bp, Homo sapiens
atatatattgcccaggctggtt

SEQ ID NO: 8222655 - DNA, 22 bp, Homo sapiens
atatatattgcccaggctggtt

SEQ ID NO: 8222656 - DNA, 22 bp, Homo sapiens
atatatattgcccaggctggtt

SEQ ID NO: 8222657 - DNA, 22 bp, Homo sapiens
atatatattgcccaggctggtt

SEQ ID NO: 8222658 - DNA, 22 bp, Homo sapiens
atatatcatgagtaaaacttga

SEQ ID NO: 8222659 - DNA, 22 bp, Homo sapiens
atatatcatgagtaaaacttga

SEQ ID NO: 8222660 - DNA, 22 bp, Homo sapiens
atatatcatgagtaaaacttga

SEQ ID NO: 8222661 - DNA, 22 bp, Homo sapiens
atatatctgcagtactgaagaa

SEQ ID NO: 8222662 - DNA, 22 bp, Homo sapiens
atatatctgcagtactgaagaa

SEQ ID NO: 8222663 - DNA, 22 bp, Homo sapiens
atatatcatgagtaaaacttga

SEQ ID NO: 8222664 - DNA, 22 bp, Homo sapiens
atatatcatgagtaaaacttga

SEQ ID NO: 8222665 - DNA, 22 bp, Homo sapiens
atatgacataaaatcatttttg

SEQ ID NO: 8222666 - DNA, 22 bp, Homo sapiens
atatgacagcggattcacatat

SEQ ID NO: 8222667 - DNA, 22 bp, Homo sapiens
atatgacagcggattcacatat

SEQ ID NO: 8222668 - DNA, 22 bp, Homo sapiens
atatgacataaaatcatttttg

SEQ ID NO: 8222669 - DNA, 22 bp, Homo sapiens
atatgagagaggaaagatttta

SEQ ID NO: 8222670 - DNA, 22 bp, Homo sapiens
atatgagagtaaatgccgatct

SEQ ID NO: 8222671 - DNA, 22 bp, Homo sapiens
atatgagagaggaaagatttta

SEQ ID NO: 8222672 - DNA, 22 bp, Homo sapiens
atatgacagcggattcacatat

SEQ ID NO: 8222673 - DNA, 22 bp, Homo sapiens
atatgacagcggattcacatat

SEQ ID NO: 8222674 - DNA, 22 bp, Homo sapiens
atatgaatttggctggaaaggt

SEQ ID NO: 8222675 - DNA, 22 bp, Homo sapiens
atatgaatttggggaggacaca

SEQ ID NO: 8222676 - DNA, 22 bp, Homo sapiens
agttgttgatgttgcagtcctg

SEQ ID NO: 8222677 - DNA, 22 bp, Homo sapiens
agtttaaatcatgttttgtaac

SEQ ID NO: 8222678 - DNA, 22 bp, Homo sapiens
agtttaaatcatgttttgtaac

SEQ ID NO: 8222679 - DNA, 22 bp, Homo sapiens
agtttaactttggaaaactata

SEQ ID NO: 8222680 - DNA, 22 bp, Homo sapiens
agtttaaatcatgttttgtaac

SEQ ID NO: 8222681 - DNA, 22 bp, Homo sapiens
agttgtgagaaacagaatgagc

SEQ ID NO: 8222682 - DNA, 22 bp, Homo sapiens
agttgtcacctctattcaaatc

SEQ ID NO: 8222683 - DNA, 22 bp, Homo sapiens
agttgtcccggtctagccactt

SEQ ID NO: 8222684 - DNA, 22 bp, Homo sapiens
agtttaatcctccagcccaact

SEQ ID NO: 8222685 - DNA, 22 bp, Homo sapiens
agtttaatatccttcaactttc

SEQ ID NO: 8222686 - DNA, 22 bp, Homo sapiens
agtttacaaagtttcactgttc

SEQ ID NO: 8222687 - DNA, 22 bp, Homo sapiens
agtttacaacagtagctatgga

SEQ ID NO: 8222688 - DNA, 22 bp, Homo sapiens
agtttacaaagtttcactgttc

SEQ ID NO: 8222689 - DNA, 22 bp, Homo sapiens
agtttacaaagtttcactgttc

SEQ ID NO: 8222690 - DNA, 22 bp, Homo sapiens
agtttaattggaggcgtggctc

SEQ ID NO: 8222691 - DNA, 22 bp, Homo sapiens
ctgcagcctccaccttttgggt

SEQ ID NO: 8222692 - DNA, 22 bp, Homo sapiens
ctgcagcgagacatagaggatg

SEQ ID NO: 8222693 - DNA, 22 bp, Homo sapiens
ctgcagcctcctggggtacatg

SEQ ID NO: 8222694 - DNA, 22 bp, Homo sapiens
ctgcagcctcctggggtacatg

SEQ ID NO: 8222695 - DNA, 22 bp, Homo sapiens
ctgcagcctcctggggtacatg

SEQ ID NO: 8222696 - DNA, 22 bp, Homo sapiens
ctgcagctcctctctgtgcccc

SEQ ID NO: 8222697 - DNA, 22 bp, Homo sapiens
ctgcagctcctctctgtgcccc

SEQ ID NO: 8222698 - DNA, 22 bp, Homo sapiens
ctgcagctcccctgagatcaag

SEQ ID NO: 8222699 - DNA, 22 bp, Homo sapiens
ctgcagctaaggaatgtggttg

SEQ ID NO: 8222700 - DNA, 22 bp, Homo sapiens
ctgcagctcccctgagatcaag

SEQ ID NO: 8222701 - DNA, 22 bp, Homo sapiens
ctgcagctatattttcccacag

SEQ ID NO: 8222702 - DNA, 22 bp, Homo sapiens
ctgcagctccttctggcatgtg

SEQ ID NO: 8222703 - DNA, 22 bp, Homo sapiens
ctgcagctccttctggcatgtg

SEQ ID NO: 8222704 - DNA, 22 bp, Homo sapiens
ctgcagctcctgagctcagaga

SEQ ID NO: 8222705 - DNA, 22 bp, Homo sapiens
ctgcagctcctgagctcagaga

SEQ ID NO: 8222706 - DNA, 22 bp, Homo sapiens
agtttgattgtatgggttttaa

SEQ ID NO: 8222707 - DNA, 22 bp, Homo sapiens
agtttgatggcttaatagtaga

SEQ ID NO: 8222708 - DNA, 21 bp, Homo sapiens
agtttgatgcaatttctgaga

SEQ ID NO: 8222709 - DNA, 22 bp, Homo sapiens
agtttgatgattacagagaaaa

SEQ ID NO: 8222710 - DNA, 22 bp, Homo sapiens
agtttgatctgacagattttaa

SEQ ID NO: 8222711 - DNA, 19 bp, Homo sapiens
agtttgaggaagttaagaa

SEQ ID NO: 8222712 - DNA, 22 bp, Homo sapiens
agtttgtaaacttgagctagcc

SEQ ID NO: 8222713 - DNA, 22 bp, Homo sapiens
agtttgtaaaatgtggcctgga

SEQ ID NO: 8222714 - DNA, 20 bp, Homo sapiens
agtttgagaggaagtcagtg

SEQ ID NO: 8222715 - DNA, 23 bp, Homo sapiens
agtttctttgagacttgccctgt

SEQ ID NO: 8222716 - DNA, 22 bp, Homo sapiens
ctgcagctggctcatgggatat

SEQ ID NO: 8222717 - DNA, 22 bp, Homo sapiens
ctgcagctgcagttctgagaga

SEQ ID NO: 8222718 - DNA, 19 bp, Homo sapiens
ctgcagctgcaccatccca

SEQ ID NO: 8222719 - DNA, 22 bp, Homo sapiens
ctgcagctctagcttttgacct

SEQ ID NO: 8222720 - DNA, 22 bp, Homo sapiens
ctgcagctgcagttctgagaga

SEQ ID NO: 8222721 - DNA, 22 bp, Homo sapiens
ctgcagctgcagttctgagaga

SEQ ID NO: 8222722 - DNA, 22 bp, Homo sapiens
ctgcagctgcagttctgagaga

SEQ ID NO: 8222723 - DNA, 22 bp, Homo sapiens
ctgcagctgccagtgatttcag

SEQ ID NO: 8222724 - DNA, 22 bp, Homo sapiens
ctgcagctgctcatgttacttg

SEQ ID NO: 8222725 - DNA, 22 bp, Homo sapiens
ctgcagctgctcatgttacttg

SEQ ID NO: 8222726 - DNA, 22 bp, Homo sapiens
ctgcagctgctcatgttacttg

SEQ ID NO: 8222727 - DNA, 22 bp, Homo sapiens
ctgcagctgcgggaccggagcg

SEQ ID NO: 8222728 - DNA, 17 bp, Homo sapiens
ctgcagctggagggcca

SEQ ID NO: 8222729 - DNA, 22 bp, Homo sapiens
ctgcagctggagcatcttctca

SEQ ID NO: 8222730 - DNA, 20 bp, Homo sapiens
ataaaataactgccacaaga

SEQ ID NO: 8222731 - DNA, 20 bp, Homo sapiens
ataaaataactgccacaaga

SEQ ID NO: 8222732 - DNA, 20 bp, Homo sapiens
ataaaataactgccacaaga

SEQ ID NO: 8222733 - DNA, 20 bp, Homo sapiens
ataaaataactgccacaaga

SEQ ID NO: 8222734 - DNA, 20 bp, Homo sapiens
ataaaataactgccacaaga

SEQ ID NO: 8222735 - DNA, 20 bp, Homo sapiens
ataaaataactgccacaaga

SEQ ID NO: 8222736 - DNA, 20 bp, Homo sapiens
ataaaataactgccacaaga

SEQ ID NO: 8222737 - DNA, 22 bp, Homo sapiens
ataaaagttcaagagagtacag

SEQ ID NO: 8222738 - DNA, 22 bp, Homo sapiens
ataaaagttcaagagagtacag

SEQ ID NO: 8222739 - DNA, 22 bp, Homo sapiens
ataaaagtttccaatcatgcct

SEQ ID NO: 8222740 - DNA, 22 bp, Homo sapiens
ataaatatcactgttgtccctc

SEQ ID NO: 8222741 - DNA, 22 bp, Homo sapiens
ataaatatcactgttgtccctc

SEQ ID NO: 8222742 - DNA, 22 bp, Homo sapiens
ataaatatcactgttgtccctc

SEQ ID NO: 8222743 - DNA, 22 bp, Homo sapiens
ataaatatcactgttgtccctc

SEQ ID NO: 8222744 - DNA, 22 bp, Homo sapiens
ataaatagtgtgtcataaagtc

SEQ ID NO: 8222745 - DNA, 22 bp, Homo sapiens
ataaatagtgtgtcataaagtc

SEQ ID NO: 8222746 - DNA, 22 bp, Homo sapiens
ataaatagtgtgtcataaagtc

SEQ ID NO: 8222747 - DNA, 22 bp, Homo sapiens
ataaaggataatccattagact

SEQ ID NO: 8222748 - DNA, 22 bp, Homo sapiens
ataaaggataatccattagact

SEQ ID NO: 8222749 - DNA, 22 bp, Homo sapiens
ataaatagtgctgccatgagta

SEQ ID NO: 8222750 - DNA, 22 bp, Homo sapiens
ataaatagtgaagggagccggt

SEQ ID NO: 8222751 - DNA, 22 bp, Homo sapiens
ataaatagtgctgccatgagta

SEQ ID NO: 8222752 - DNA, 22 bp, Homo sapiens
ctgccaggcctcatcccagcca

SEQ ID NO: 8222753 - DNA, 22 bp, Homo sapiens
ctgccaggcagggagatggctg

SEQ ID NO: 8222754 - DNA, 22 bp, Homo sapiens
ctgccaggcagggagatggctg

SEQ ID NO: 8222755 - DNA, 22 bp, Homo sapiens
ctgccaggcagggagatggctg

SEQ ID NO: 8222756 - DNA, 22 bp, Homo sapiens
ctgccaggcagcagagggagaa

SEQ ID NO: 8222757 - DNA, 22 bp, Homo sapiens
ctgccaggcagggagatggctg

SEQ ID NO: 8222758 - DNA, 22 bp, Homo sapiens
ctgccaggcctccgctgtcccc

SEQ ID NO: 8222759 - DNA, 22 bp, Homo sapiens
ctgccaggcctcatcccagcca

SEQ ID NO: 8222760 - DNA, 22 bp, Homo sapiens
ataaaaggaaagcctgttgtga

SEQ ID NO: 8222761 - DNA, 22 bp, Homo sapiens
ataaaagtaggaccaacttaca

SEQ ID NO: 8222762 - DNA, 22 bp, Homo sapiens
ataaaagtaggaccaacttaca

SEQ ID NO: 8222763 - DNA, 22 bp, Homo sapiens
ctgccaggcacgtgcagcatca

SEQ ID NO: 8222764 - DNA, 22 bp, Homo sapiens
ctgccaggattctgtgaacccc

SEQ ID NO: 8222765 - DNA, 22 bp, Homo sapiens
ctgccaggcacgtgcagcatca

SEQ ID NO: 8222766 - DNA, 22 bp, Homo sapiens
ctgccaggcactgggctctgca

SEQ ID NO: 8222767 - DNA, 22 bp, Homo sapiens
ctgccaggcacgtgcagcatca

SEQ ID NO: 8222768 - DNA, 22 bp, Homo sapiens
ctgccaggcagcagagggagaa

SEQ ID NO: 8222769 - DNA, 22 bp, Homo sapiens
ctgccaggcactgggctctgca

SEQ ID NO: 8222770 - DNA, 22 bp, Homo sapiens
ctgccaggcactgggctctgca

SEQ ID NO: 8222771 - DNA, 22 bp, Homo sapiens
ctgccaggcactgggctctgca

SEQ ID NO: 8222772 - DNA, 22 bp, Homo sapiens
ctgccaggactgacgtcttcag

SEQ ID NO: 8222773 - DNA, 21 bp, Homo sapiens
ctgccaggatagcatgcaggc

SEQ ID NO: 8222774 - DNA, 22 bp, Homo sapiens
ctgcatttcacatttaaacttt

SEQ ID NO: 8222775 - DNA, 22 bp, Homo sapiens
ctgcatttccacctggccacag

SEQ ID NO: 8222776 - DNA, 23 bp, Homo sapiens
agttggcatattcaagcacagtc

SEQ ID NO: 8222777 - DNA, 22 bp, Homo sapiens
agttgggacatgttctttcccc

SEQ ID NO: 8222778 - DNA, 22 bp, Homo sapiens
agttgggaagtatttttagtgg

SEQ ID NO: 8222779 - DNA, 22 bp, Homo sapiens
agttgggagttatagactctat

SEQ ID NO: 8222780 - DNA, 19 bp, Homo sapiens
agttggggcagggaagaga

SEQ ID NO: 8222781 - DNA, 22 bp, Homo sapiens
agttgggattcttggttctggg

SEQ ID NO: 8222782 - DNA, 19 bp, Homo sapiens
agttggggcagggaagaga

SEQ ID NO: 8222783 - DNA, 19 bp, Homo sapiens
agttggggcagggaagaga

SEQ ID NO: 8222784 - DNA, 22 bp, Homo sapiens
agttggaagacaccctgaaatc

SEQ ID NO: 8222785 - DNA, 22 bp, Homo sapiens
agttgcttctcaggaaaggagc

SEQ ID NO: 8222786 - DNA, 22 bp, Homo sapiens
agttggcaaggtctggccagcg

SEQ ID NO: 8222787 - DNA, 22 bp, Homo sapiens
agttgctgcttctctctagaga

SEQ ID NO: 8222788 - DNA, 21 bp, Homo sapiens
agttgctgctgctgcaggtga

SEQ ID NO: 8222789 - DNA, 22 bp, Homo sapiens
agttgctctaggtgaggtcttt

SEQ ID NO: 8222790 - DNA, 22 bp, Homo sapiens
agttctttatatattagggata

SEQ ID NO: 8222791 - DNA, 21 bp, Homo sapiens
ctctttgggatctttggaaag

SEQ ID NO: 8222792 - DNA, 22 bp, Homo sapiens
ctgaggcaggggcagctggaga

SEQ ID NO: 8222793 - DNA, 22 bp, Homo sapiens
ctgaggcaggggcagctggaga

SEQ ID NO: 8222794 - DNA, 22 bp, Homo sapiens
ctgaggcaggggcagctggaga

SEQ ID NO: 8222795 - DNA, 22 bp, Homo sapiens
ctgaggcaggatggcctggctg

SEQ ID NO: 8222796 - DNA, 22 bp, Homo sapiens
ctgaggcaggatggcctggctg

SEQ ID NO: 8222797 - DNA, 22 bp, Homo sapiens
ctgaggcaggcagatcacttga

SEQ ID NO: 8222798 - DNA, 22 bp, Homo sapiens
ctgaggcaggcagatcacttga

SEQ ID NO: 8222799 - DNA, 22 bp, Homo sapiens
ctgaggcaggcagatcacttga

SEQ ID NO: 8222800 - DNA, 22 bp, Homo sapiens
ctgaggcaggagaattgctgga

SEQ ID NO: 8222801 - DNA, 22 bp, Homo sapiens
ctgaggcaggagaattgctgga

SEQ ID NO: 8222802 - DNA, 22 bp, Homo sapiens
ctgaggcaggagagttgcttga

SEQ ID NO: 8222803 - DNA, 22 bp, Homo sapiens
ctgaggcaggagagttgcttga

SEQ ID NO: 8222804 - DNA, 22 bp, Homo sapiens
ctgaggcaggagagttgcttga

SEQ ID NO: 8222805 - DNA, 22 bp, Homo sapiens
ctgaggcaggatggcctggctg

SEQ ID NO: 8222806 - DNA, 22 bp, Homo sapiens
ctgaggcaggagaattgctgga

SEQ ID NO: 8222807 - DNA, 21 bp, Homo sapiens
ctgaggcagcacagctagtca

SEQ ID NO: 8222808 - DNA, 22 bp, Homo sapiens
agttgtaagagacagatataaa

SEQ ID NO: 8222809 - DNA, 21 bp, Homo sapiens
ctgaggcatgcaggcctgggc

SEQ ID NO: 8222810 - DNA, 22 bp, Homo sapiens
ctgaggcctaagacatgaatga

SEQ ID NO: 8222811 - DNA, 22 bp, Homo sapiens
ctgaggccgttggtgggcctta

SEQ ID NO: 8222812 - DNA, 22 bp, Homo sapiens
ctgaggcatgaatgtgggcttt

SEQ ID NO: 8222813 - DNA, 21 bp, Homo sapiens
ctgaggcatgcaggcctgggc

SEQ ID NO: 8222814 - DNA, 22 bp, Homo sapiens
ctgaggcctaagacatgaatga

SEQ ID NO: 8222815 - DNA, 21 bp, Homo sapiens
ctgaggcatgcaggcctgggc

SEQ ID NO: 8222816 - DNA, 22 bp, Homo sapiens
ctgaggcctaagacatgaatga

SEQ ID NO: 8222817 - DNA, 22 bp, Homo sapiens
ctgaggcctcactgtagtccct

SEQ ID NO: 8222818 - DNA, 22 bp, Homo sapiens
ctgaggcctcactgtagtccct

SEQ ID NO: 8222819 - DNA, 22 bp, Homo sapiens
ctgaggcagtttaatttttgaa

SEQ ID NO: 8222820 - DNA, 22 bp, Homo sapiens
ctgaggcatcatggagaacagt

SEQ ID NO: 8222821 - DNA, 22 bp, Homo sapiens
ctgaggcatcatggagaacagt

SEQ ID NO: 8222822 - DNA, 22 bp, Homo sapiens
ctgaggcagtttaatttttgaa

SEQ ID NO: 8222823 - DNA, 22 bp, Homo sapiens
ctgaggcagtttaatttttgaa

SEQ ID NO: 8222824 - DNA, 22 bp, Homo sapiens
ctgaggcatgaatgtgggcttt

SEQ ID NO: 8222825 - DNA, 22 bp, Homo sapiens
ctgaggcatcatggagaacagt

SEQ ID NO: 8222826 - DNA, 22 bp, Homo sapiens
ctgaggcatcatggagaacagt

SEQ ID NO: 8222827 - DNA, 22 bp, Homo sapiens
ctgaggcatgaatgtgggcttt

SEQ ID NO: 8222828 - DNA, 22 bp, Homo sapiens
ctgaggcatgaatgtgggcttt

SEQ ID NO: 8222829 - DNA, 22 bp, Homo sapiens
ctgaggcatgaatgtgggcttt

SEQ ID NO: 8222830 - DNA, 22 bp, Homo sapiens
ctgaggcatgaatgtgggcttt

SEQ ID NO: 8222831 - DNA, 22 bp, Homo sapiens
ctgaggcatgaatgtgggcttt

SEQ ID NO: 8222832 - DNA, 22 bp, Homo sapiens
ctgagggtcaacttgattgtat

SEQ ID NO: 8222833 - DNA, 22 bp, Homo sapiens
ctgagggtcaacttgattgtat

SEQ ID NO: 8222834 - DNA, 22 bp, Homo sapiens
ctgagggtcaacttgattgtat

SEQ ID NO: 8222835 - DNA, 22 bp, Homo sapiens
ctgagggtcaacttgattgtat

SEQ ID NO: 8222836 - DNA, 22 bp, Homo sapiens
ctgaggcttgtcctctcagctt

SEQ ID NO: 8222837 - DNA, 22 bp, Homo sapiens
ctgaggcttgtcctctcagctt

SEQ ID NO: 8222838 - DNA, 22 bp, Homo sapiens
ctgaggctttgtgtgcatgcct

SEQ ID NO: 8222839 - DNA, 22 bp, Homo sapiens
ctgagggaacttgggcaagtct

SEQ ID NO: 8222840 - DNA, 22 bp, Homo sapiens
ctgaggctttgtgtgcatgcct

SEQ ID NO: 8222841 - DNA, 22 bp, Homo sapiens
ctgaggctttgtgtgcatgcct

SEQ ID NO: 8222842 - DNA, 22 bp, Homo sapiens
ctgagggaacttgggcaagtct

SEQ ID NO: 8222843 - DNA, 22 bp, Homo sapiens
ctgagggaacttgggcaagtct

SEQ ID NO: 8222844 - DNA, 22 bp, Homo sapiens
ctgaggggtatccaaggggtaa

SEQ ID NO: 8222845 - DNA, 22 bp, Homo sapiens
ctgaggggtatccaaggggtaa

SEQ ID NO: 8222846 - DNA, 22 bp, Homo sapiens
ctgaggtcagagtttagtctgg

SEQ ID NO: 8222847 - DNA, 22 bp, Homo sapiens
ctgaggtcagagtttagtctgg

SEQ ID NO: 8222848 - DNA, 22 bp, Homo sapiens
ctgaggtcaccccactggctgt

SEQ ID NO: 8222849 - DNA, 22 bp, Homo sapiens
ctgaggtcaccccactggctgt

SEQ ID NO: 8222850 - DNA, 22 bp, Homo sapiens
ctgaggtcaccccactggctgt

SEQ ID NO: 8222851 - DNA, 22 bp, Homo sapiens
ctgaggtcaattaatcaacaac

SEQ ID NO: 8222852 - DNA, 22 bp, Homo sapiens
ctgaggtcaattaatcaacaac

SEQ ID NO: 8222853 - DNA, 22 bp, Homo sapiens
ctgaggtcaattaatcaacaac

SEQ ID NO: 8222854 - DNA, 22 bp, Homo sapiens
ctgaggtcaattaatcaacaac

SEQ ID NO: 8222855 - DNA, 22 bp, Homo sapiens
ctgaggtcagagtttagtctgg

SEQ ID NO: 8222856 - DNA, 22 bp, Homo sapiens
agttgtatctgaatgcatgtag

SEQ ID NO: 8222857 - DNA, 22 bp, Homo sapiens
agttgtattagagaacacaaac

SEQ ID NO: 8222858 - DNA, 22 bp, Homo sapiens
agttgtatctgaatgcatgtag

SEQ ID NO: 8222859 - DNA, 22 bp, Homo sapiens
agttgtattagagaacacaaac

SEQ ID NO: 8222860 - DNA, 23 bp, Homo sapiens
ctgaggtaaaatattctgaagga

SEQ ID NO: 8222861 - DNA, 22 bp, Homo sapiens
ctgaggtaaaatttctattttg

SEQ ID NO: 8222862 - DNA, 22 bp, Homo sapiens
ctgaggtacctggagcaggtcc

SEQ ID NO: 8222863 - DNA, 22 bp, Homo sapiens
ctgaggtagaggaaatgtagct

SEQ ID NO: 8222864 - DNA, 22 bp, Homo sapiens
ctgaggtatgtgggactagcct

SEQ ID NO: 8222865 - DNA, 22 bp, Homo sapiens
ctgaggtatgtgggactagcct

SEQ ID NO: 8222866 - DNA, 22 bp, Homo sapiens
ctgaggtagctgtgaatgttct

SEQ ID NO: 8222867 - DNA, 22 bp, Homo sapiens
ctgaggctgggcttgccttctt

SEQ ID NO: 8222868 - DNA, 22 bp, Homo sapiens
ctgaggctgggctgagggtata

SEQ ID NO: 8222869 - DNA, 22 bp, Homo sapiens
ctgaggctggggaagggaagtg

SEQ ID NO: 8222870 - DNA, 22 bp, Homo sapiens
ctgaggctgggcttgccttctt

SEQ ID NO: 8222871 - DNA, 22 bp, Homo sapiens
ctgaggctgggcttgccttctt

SEQ ID NO: 8222872 - DNA, 18 bp, Homo sapiens
ctgaggcttagagaggtt

SEQ ID NO: 8222873 - DNA, 18 bp, Homo sapiens
ctgaggcttagagaggtt

SEQ ID NO: 8222874 - DNA, 18 bp, Homo sapiens
ctgaggcttagagaggtt

SEQ ID NO: 8222875 - DNA, 22 bp, Homo sapiens
ctgaggctggggaagggaagtg

SEQ ID NO: 8222876 - DNA, 22 bp, Homo sapiens
ctgaggctggggaagggaagtg

SEQ ID NO: 8222877 - DNA, 22 bp, Homo sapiens
ctgaggcttgtcctctcagctt

SEQ ID NO: 8222878 - DNA, 22 bp, Homo sapiens
ctgaggcttgtcctctcagctt

SEQ ID NO: 8222879 - DNA, 22 bp, Homo sapiens
ctgaggcttctctagttcagct

SEQ ID NO: 8222880 - DNA, 22 bp, Homo sapiens
ctgaggcttctctagttcagct

SEQ ID NO: 8222881 - DNA, 22 bp, Homo sapiens
ctgaggcttggaggggtctggt

SEQ ID NO: 8222882 - DNA, 22 bp, Homo sapiens
ctgaggcttggaggggtctggt

SEQ ID NO: 8222883 - DNA, 22 bp, Homo sapiens
ctgaggcctctgttcaccagaa

SEQ ID NO: 8222884 - DNA, 22 bp, Homo sapiens
ctgaggcctctgttcaccagaa

SEQ ID NO: 8222885 - DNA, 22 bp, Homo sapiens
ctgaggcctctgttcaccagaa

SEQ ID NO: 8222886 - DNA, 22 bp, Homo sapiens
ctgaggcctctctccttggctt

SEQ ID NO: 8222887 - DNA, 22 bp, Homo sapiens
ctgaggcctctgttcaccagaa

SEQ ID NO: 8222888 - DNA, 22 bp, Homo sapiens
ctgaggcctctttccttggctt

SEQ ID NO: 8222889 - DNA, 23 bp, Homo sapiens
ctgaggcctgctgcgttcaggtt

SEQ ID NO: 8222890 - DNA, 23 bp, Homo sapiens
ctgaggcctgctgcgttcaggtt

SEQ ID NO: 8222891 - DNA, 22 bp, Homo sapiens
ctgaggctgggctgagggtata

SEQ ID NO: 8222892 - DNA, 22 bp, Homo sapiens
ctgaggctgggctgagggtata

SEQ ID NO: 8222893 - DNA, 22 bp, Homo sapiens
ctgaggcctctcccactccagc

SEQ ID NO: 8222894 - DNA, 22 bp, Homo sapiens
ctgaggcctctcccactccagc

SEQ ID NO: 8222895 - DNA, 22 bp, Homo sapiens
ctgaggcctcgttggctggaac

SEQ ID NO: 8222896 - DNA, 22 bp, Homo sapiens
ctgaggcctcgttggctggaac

SEQ ID NO: 8222897 - DNA, 22 bp, Homo sapiens
ctgaggcctcgttggctggaac

SEQ ID NO: 8222898 - DNA, 22 bp, Homo sapiens
ctgaggcctctctcctgggctt

SEQ ID NO: 8222899 - DNA, 22 bp, Homo sapiens
ctgaggcctctctcctgggctt

SEQ ID NO: 8222900 - DNA, 22 bp, Homo sapiens
ctgaggcctctctcctgggctt

SEQ ID NO: 8222901 - DNA, 22 bp, Homo sapiens
ctgaggcctctccttggcttgt

SEQ ID NO: 8222902 - DNA, 22 bp, Homo sapiens
ctgaggcctctctcctgggctt

SEQ ID NO: 8222903 - DNA, 22 bp, Homo sapiens
ctgctttaatccctgcctggaa

SEQ ID NO: 8222904 - DNA, 22 bp, Homo sapiens
ctgctttaactctgggaagcca

SEQ ID NO: 8222905 - DNA, 22 bp, Homo sapiens
ctgcttgtcttcgaggggtgca

SEQ ID NO: 8222906 - DNA, 22 bp, Homo sapiens
ctgctttaacaaggctgatcag

SEQ ID NO: 8222907 - DNA, 19 bp, Homo sapiens
atacaagactagcatttac

SEQ ID NO: 8222908 - DNA, 19 bp, Homo sapiens
atacaagactagcatttac

SEQ ID NO: 8222909 - DNA, 22 bp, Homo sapiens
ctgctttaatgtaagatatacc

SEQ ID NO: 8222910 - DNA, 18 bp, Homo sapiens
atacaagatcaagtgttc

SEQ ID NO: 8222911 - DNA, 18 bp, Homo sapiens
atacaagatcaagtgttc

SEQ ID NO: 8222912 - DNA, 19 bp, Homo sapiens
atacaagagagcagttgag

SEQ ID NO: 8222913 - DNA, 22 bp, Homo sapiens
atacaagactcagcacagacgg

SEQ ID NO: 8222914 - DNA, 19 bp, Homo sapiens
atacaagactagcatttac

SEQ ID NO: 8222915 - DNA, 22 bp, Homo sapiens
atacaagtgagaaaactgaaga

SEQ ID NO: 8222916 - DNA, 22 bp, Homo sapiens
atacaagtcaatccatgtgatt

SEQ ID NO: 8222917 - DNA, 22 bp, Homo sapiens
atacaagtgatataattgtttc

SEQ ID NO: 8222918 - DNA, 22 bp, Homo sapiens
atacaagtgatataattgtttc

SEQ ID NO: 8222919 - DNA, 22 bp, Homo sapiens
atacaagtgatataattgtttc

SEQ ID NO: 8222920 - DNA, 22 bp, Homo sapiens
atacaagtgagaaaactgaaga

SEQ ID NO: 8222921 - DNA, 18 bp, Homo sapiens
atacaagctctgttactt

SEQ ID NO: 8222922 - DNA, 20 bp, Homo sapiens
atacaagatgagtaatttct

SEQ ID NO: 8222923 - DNA, 22 bp, Homo sapiens
ctgcttctccaaagtaggactt

SEQ ID NO: 8222924 - DNA, 18 bp, Homo sapiens
ctgcttctgtctgccagt

SEQ ID NO: 8222925 - DNA, 22 bp, Homo sapiens
ctgcttctagcaccaagtccct

SEQ ID NO: 8222926 - DNA, 22 bp, Homo sapiens
ctgctgtgtgcttacttgggtt

SEQ ID NO: 8222927 - DNA, 22 bp, Homo sapiens
ctgctgtgtgaccatggacagg

SEQ ID NO: 8222928 - DNA, 22 bp, Homo sapiens
ctgcttctccaaagtaggactt

SEQ ID NO: 8222929 - DNA, 22 bp, Homo sapiens
ctgcttggcattggtaaagaat

SEQ ID NO: 8222930 - DNA, 17 bp, Homo sapiens
ctgcttggcctctgggg

SEQ ID NO: 8222931 - DNA, 20 bp, Homo sapiens
ctgcttgggacactgccaga

SEQ ID NO: 8222932 - DNA, 18 bp, Homo sapiens
ctgcttgggagacgtcag

SEQ ID NO: 8222933 - DNA, 20 bp, Homo sapiens
ctgcttgggcccctctggcc

SEQ ID NO: 8222934 - DNA, 22 bp, Homo sapiens
ctgcttgggtcctggcatgggt

SEQ ID NO: 8222935 - DNA, 22 bp, Homo sapiens
ataatattgaagagccttggcc

SEQ ID NO: 8222936 - DNA, 22 bp, Homo sapiens
ataatataatcctacttcccat

SEQ ID NO: 8222937 - DNA, 22 bp, Homo sapiens
ataatatttgcattactgtgat

SEQ ID NO: 8222938 - DNA, 22 bp, Homo sapiens
ataatatttgcattactgtgat

SEQ ID NO: 8222939 - DNA, 22 bp, Homo sapiens
ataatatttgcattactgtgat

SEQ ID NO: 8222940 - DNA, 22 bp, Homo sapiens
ctgctgtgtgaccatggacagg

SEQ ID NO: 8222941 - DNA, 22 bp, Homo sapiens
ataatatttggataggacagta

SEQ ID NO: 8222942 - DNA, 22 bp, Homo sapiens
ctgctcatcagccgagcagggc

SEQ ID NO: 8222943 - DNA, 22 bp, Homo sapiens
ctgctcagtcatgttggattgt

SEQ ID NO: 8222944 - DNA, 18 bp, Homo sapiens
ctgcccagagcacttgtg

SEQ ID NO: 8222945 - DNA, 22 bp, Homo sapiens
ctgcccagaagcttagagctta

SEQ ID NO: 8222946 - DNA, 22 bp, Homo sapiens
ctgcccagaagccagatgggca

SEQ ID NO: 8222947 - DNA, 22 bp, Homo sapiens
ctgcccacttggccaccttcta

SEQ ID NO: 8222948 - DNA, 22 bp, Homo sapiens
ctgcccaccgtgtgcacgtgcg

SEQ ID NO: 8222949 - DNA, 22 bp, Homo sapiens
ctgcccaccgtgtgcacgtgcg

SEQ ID NO: 8222950 - DNA, 22 bp, Homo sapiens
ctgcccactatgttgtcatggg

SEQ ID NO: 8222951 - DNA, 20 bp, Homo sapiens
ctgcccactagaactacctg

SEQ ID NO: 8222952 - DNA, 22 bp, Homo sapiens
ctgcccaccacacctgctcctg

SEQ ID NO: 8222953 - DNA, 22 bp, Homo sapiens
ctgcccaccccgaggcaggaag

SEQ ID NO: 8222954 - DNA, 22 bp, Homo sapiens
ctgcccaccccgaggcaggaag

SEQ ID NO: 8222955 - DNA, 22 bp, Homo sapiens
ctgcccacagttctctgccatg

SEQ ID NO: 8222956 - DNA, 22 bp, Homo sapiens
ataaatctattggacatgtgtg

SEQ ID NO: 8222957 - DNA, 22 bp, Homo sapiens
ctgcccacagttctctgccatg

SEQ ID NO: 8222958 - DNA, 22 bp, Homo sapiens
ataaatatcactgttgtccctc

SEQ ID NO: 8222959 - DNA, 22 bp, Homo sapiens
ataaatatcactgttgtccctc

SEQ ID NO: 8222960 - DNA, 22 bp, Homo sapiens
ataaatatcactgttgtccctc

SEQ ID NO: 8222961 - DNA, 22 bp, Homo sapiens
ataaatcagttagtgccccact

SEQ ID NO: 8222962 - DNA, 22 bp, Homo sapiens
ataaatcagttagtgccccact

SEQ ID NO: 8222963 - DNA, 22 bp, Homo sapiens
ataaatatcactgttgtccctc

SEQ ID NO: 8222964 - DNA, 22 bp, Homo sapiens
ataaatatcactgttgtccctc

SEQ ID NO: 8222965 - DNA, 22 bp, Homo sapiens
ctgctctggcgtactcggcatc

SEQ ID NO: 8222966 - DNA, 22 bp, Homo sapiens
ctgctctggggaagccagatgt

SEQ ID NO: 8222967 - DNA, 22 bp, Homo sapiens
ataatacatggttaacctcttt

SEQ ID NO: 8222968 - DNA, 22 bp, Homo sapiens
ataatacatggttgatcttttc

SEQ ID NO: 8222969 - DNA, 22 bp, Homo sapiens
ataatacatggttgatcttttc

SEQ ID NO: 8222970 - DNA, 20 bp, Homo sapiens
ctgctctgctttgcaggtgg

SEQ ID NO: 8222971 - DNA, 20 bp, Homo sapiens
ctgctctgctttgcaggtgg

SEQ ID NO: 8222972 - DNA, 22 bp, Homo sapiens
ctgctctggcgtactcggcatc

SEQ ID NO: 8222973 - DNA, 22 bp, Homo sapiens
ctgctctgctgatcagtgtctc

SEQ ID NO: 8222974 - DNA, 22 bp, Homo sapiens
ctgctctgctgatcagtgtctc

SEQ ID NO: 8222975 - DNA, 22 bp, Homo sapiens
ctgctctgcagcttggactccc

SEQ ID NO: 8222976 - DNA, 22 bp, Homo sapiens
ctgctctgcagcttggactccc

SEQ ID NO: 8222977 - DNA, 22 bp, Homo sapiens
ctgctctgagaggctcttccta

SEQ ID NO: 8222978 - DNA, 22 bp, Homo sapiens
ctgctctgcaaggcacagtgat

SEQ ID NO: 8222979 - DNA, 22 bp, Homo sapiens
atacagaattcactacagtttc

SEQ ID NO: 8222980 - DNA, 22 bp, Homo sapiens
atacagaatactaattcctgag

SEQ ID NO: 8222981 - DNA, 22 bp, Homo sapiens
atacagaatactaattcctgag

SEQ ID NO: 8222982 - DNA, 22 bp, Homo sapiens
atacagaatactaattcctgag

SEQ ID NO: 8222983 - DNA, 22 bp, Homo sapiens
ctggagccccagacagggagag

SEQ ID NO: 8222984 - DNA, 22 bp, Homo sapiens
ctggagccccaggctgtgcaga

SEQ ID NO: 8222985 - DNA, 22 bp, Homo sapiens
ctggagccccagacagggagag

SEQ ID NO: 8222986 - DNA, 22 bp, Homo sapiens
ctggagcccaggcctggtgtct

SEQ ID NO: 8222987 - DNA, 22 bp, Homo sapiens
ctggagcccaggcctggtgtct

SEQ ID NO: 8222988 - DNA, 22 bp, Homo sapiens
ctggagcccaggcctggtgtct

SEQ ID NO: 8222989 - DNA, 22 bp, Homo sapiens
ctggagccatgtatagcctatg

SEQ ID NO: 8222990 - DNA, 22 bp, Homo sapiens
ctggagccatgtatagcctatg

SEQ ID NO: 8222991 - DNA, 22 bp, Homo sapiens
ctggagccagccagggccctct

SEQ ID NO: 8222992 - DNA, 22 bp, Homo sapiens
ctggagccatgtcttgactgct

SEQ ID NO: 8222993 - DNA, 22 bp, Homo sapiens
ctggagcccaggcctggtgtct

SEQ ID NO: 8222994 - DNA, 22 bp, Homo sapiens
ctggagccatgtcttgactgct

SEQ ID NO: 8222995 - DNA, 22 bp, Homo sapiens
ctggagcatccatgcccagggt

SEQ ID NO: 8222996 - DNA, 17 bp, Homo sapiens
ctggagccaagagggcc

SEQ ID NO: 8222997 - DNA, 17 bp, Homo sapiens
ctggagccaagagggcc

SEQ ID NO: 8222998 - DNA, 22 bp, Homo sapiens
ctggagccactgggtcttgtat

SEQ ID NO: 8222999 - DNA, 22 bp, Homo sapiens
ctggagccagccagggccctct

SEQ ID NO: 8223000 - DNA, 22 bp, Homo sapiens
ctggagccactgggtcttgtat

SEQ ID NO: 8223001 - DNA, 22 bp, Homo sapiens
ctggagccactttttatccttt

SEQ ID NO: 8223002 - DNA, 22 bp, Homo sapiens
atacaagtggccacttgaattc

SEQ ID NO: 8223003 - DNA, 22 bp, Homo sapiens
atacaagtgctgaccctgggat

SEQ ID NO: 8223004 - DNA, 22 bp, Homo sapiens
atacaagtgttgtgcctcatca

SEQ ID NO: 8223005 - DNA, 22 bp, Homo sapiens
atacaagttaaatgcagtgccc

SEQ ID NO: 8223006 - DNA, 22 bp, Homo sapiens
ctggagagaccgaaagaggctg

SEQ ID NO: 8223007 - DNA, 22 bp, Homo sapiens
ctggagagaccgaaagaggctg

SEQ ID NO: 8223008 - DNA, 22 bp, Homo sapiens
atacagagcagtaatagaggag

SEQ ID NO: 8223009 - DNA, 22 bp, Homo sapiens
atacagaattcactacagtttc

SEQ ID NO: 8223010 - DNA, 22 bp, Homo sapiens
atacagaattcactacagtttc

SEQ ID NO: 8223011 - DNA, 22 bp, Homo sapiens
atacagagggtttcatgggcag

SEQ ID NO: 8223012 - DNA, 22 bp, Homo sapiens
atacagatcccacagcatgtga

SEQ ID NO: 8223013 - DNA, 22 bp, Homo sapiens
atacagatcccacagcatgtga

SEQ ID NO: 8223014 - DNA, 22 bp, Homo sapiens
atacagatgagatcaggcataa

SEQ ID NO: 8223015 - DNA, 22 bp, Homo sapiens
atacagatgcttgctcgtgact

SEQ ID NO: 8223016 - DNA, 22 bp, Homo sapiens
atacagatcccacagcatgtga

SEQ ID NO: 8223017 - DNA, 22 bp, Homo sapiens
ctggaggaaaacaactgcagac

SEQ ID NO: 8223018 - DNA, 22 bp, Homo sapiens
ctggaggaaaacaactgcagac

SEQ ID NO: 8223019 - DNA, 22 bp, Homo sapiens
ctggaggaaaacaactgcagac

SEQ ID NO: 8223020 - DNA, 22 bp, Homo sapiens
ctggagggagattcaaaggagg

SEQ ID NO: 8223021 - DNA, 22 bp, Homo sapiens
ctggagggagattcaaaggagg

SEQ ID NO: 8223022 - DNA, 22 bp, Homo sapiens
ctggagggagattcaaaggagg

SEQ ID NO: 8223023 - DNA, 22 bp, Homo sapiens
ctggagggagattcaaaggagg

SEQ ID NO: 8223024 - DNA, 22 bp, Homo sapiens
ctggaggaaaacaactgcagac

SEQ ID NO: 8223025 - DNA, 22 bp, Homo sapiens
ctggagggagttaggacccgga

SEQ ID NO: 8223026 - DNA, 22 bp, Homo sapiens
ctggagggagttaggacccgga

SEQ ID NO: 8223027 - DNA, 22 bp, Homo sapiens
ctggagggatgtagggtgtatt

SEQ ID NO: 8223028 - DNA, 22 bp, Homo sapiens
ctggagggatgtagggtgtatt

SEQ ID NO: 8223029 - DNA, 22 bp, Homo sapiens
ctggagggatgtagggtgtatt

SEQ ID NO: 8223030 - DNA, 22 bp, Homo sapiens
ctggagggatgtagggtgtatt

SEQ ID NO: 8223031 - DNA, 22 bp, Homo sapiens
ctggagggaggaggctgctatt

SEQ ID NO: 8223032 - DNA, 22 bp, Homo sapiens
ctggagggaggaggctgctatt

SEQ ID NO: 8223033 - DNA, 22 bp, Homo sapiens
ctggagggaggaggctgctatt

SEQ ID NO: 8223034 - DNA, 22 bp, Homo sapiens
ctggagtctcttctgtagctac

SEQ ID NO: 8223035 - DNA, 22 bp, Homo sapiens
ctggagggctggactaaggaaa

SEQ ID NO: 8223036 - DNA, 22 bp, Homo sapiens
ctggagggctgcagcgaggctg

SEQ ID NO: 8223037 - DNA, 22 bp, Homo sapiens
ctggagggctgcagcgaggctg

SEQ ID NO: 8223038 - DNA, 22 bp, Homo sapiens
ctggagggctgcagcgaggctg

SEQ ID NO: 8223039 - DNA, 22 bp, Homo sapiens
ctggagggctgcagcgaggctg

SEQ ID NO: 8223040 - DNA, 22 bp, Homo sapiens
ctggagggctgcagcgaggctg

SEQ ID NO: 8223041 - DNA, 22 bp, Homo sapiens
ctggagggctgcagcgaggctg

SEQ ID NO: 8223042 - DNA, 22 bp, Homo sapiens
ctggagggctgcagcgaggctg

SEQ ID NO: 8223043 - DNA, 22 bp, Homo sapiens
ctggagtgaggtctgggagcct

SEQ ID NO: 8223044 - DNA, 22 bp, Homo sapiens
ctggagtgaggtctgggagcct

SEQ ID NO: 8223045 - DNA, 22 bp, Homo sapiens
ctggagtgaagtctggcagctt

SEQ ID NO: 8223046 - DNA, 22 bp, Homo sapiens
ctggagtgaagtctggcagctt

SEQ ID NO: 8223047 - DNA, 22 bp, Homo sapiens
ctggagtgaagtctggcagctt

SEQ ID NO: 8223048 - DNA, 22 bp, Homo sapiens
ctggagtgaagtctggcagctt

SEQ ID NO: 8223049 - DNA, 22 bp, Homo sapiens
ctggagtgaagtctggcagctt

SEQ ID NO: 8223050 - DNA, 22 bp, Homo sapiens
ctggagtgaagtctggcagctt

SEQ ID NO: 8223051 - DNA, 22 bp, Homo sapiens
ctggagtgaagcttatttttca

SEQ ID NO: 8223052 - DNA, 22 bp, Homo sapiens
ctggagtcttcagcttgctgcc

SEQ ID NO: 8223053 - DNA, 22 bp, Homo sapiens
ctggagtcttcagcttgctgcc

SEQ ID NO: 8223054 - DNA, 21 bp, Homo sapiens
ctggagtctgggggtggcagt

SEQ ID NO: 8223055 - DNA, 21 bp, Homo sapiens
ctggagtctgggggtggcagt

SEQ ID NO: 8223056 - DNA, 22 bp, Homo sapiens
ctggagtgcaatgaacaaggtc

SEQ ID NO: 8223057 - DNA, 22 bp, Homo sapiens
ctggagtgatactcagaatgtg

SEQ ID NO: 8223058 - DNA, 22 bp, Homo sapiens
ctggagtgatactcagaatgtg

SEQ ID NO: 8223059 - DNA, 22 bp, Homo sapiens
ctggagtgcaacctctgcctcc

SEQ ID NO: 8223060 - DNA, 22 bp, Homo sapiens
ctggagtgcaacctctgcctcc

SEQ ID NO: 8223061 - DNA, 22 bp, Homo sapiens
ctggagtgactttgttcctttt

SEQ ID NO: 8223062 - DNA, 22 bp, Homo sapiens
ctggagtgactttgttcctttt

SEQ ID NO: 8223063 - DNA, 22 bp, Homo sapiens
ctggagtgaggtctgggagcct

SEQ ID NO: 8223064 - DNA, 22 bp, Homo sapiens
ctggagtgaggtctgggagcct

SEQ ID NO: 8223065 - DNA, 22 bp, Homo sapiens
ctggagtgaggtctgggagcct

SEQ ID NO: 8223066 - DNA, 22 bp, Homo sapiens
ctggagtgaggtctgggagcct

SEQ ID NO: 8223067 - DNA, 22 bp, Homo sapiens
ctggagtgaggtctgggagcct

SEQ ID NO: 8223068 - DNA, 22 bp, Homo sapiens
ctggagtgatactcagaatgtg

SEQ ID NO: 8223069 - DNA, 22 bp, Homo sapiens
atacttatgataaataattgct

SEQ ID NO: 8223070 - DNA, 22 bp, Homo sapiens
atacttatactaagaatgtact

SEQ ID NO: 8223071 - DNA, 22 bp, Homo sapiens
atacttatgataaataattgct

SEQ ID NO: 8223072 - DNA, 22 bp, Homo sapiens
atacttatgataaataattgct

SEQ ID NO: 8223073 - DNA, 22 bp, Homo sapiens
atactctttatgacattccagc

SEQ ID NO: 8223074 - DNA, 22 bp, Homo sapiens
atactcttcctagcgctgaaat

SEQ ID NO: 8223075 - DNA, 22 bp, Homo sapiens
atacttctttgatgttcacagg

SEQ ID NO: 8223076 - DNA, 22 bp, Homo sapiens
atacttctttgatgttcacagg

SEQ ID NO: 8223077 - DNA, 22 bp, Homo sapiens
atacttctttgatgttcacagg

SEQ ID NO: 8223078 - DNA, 22 bp, Homo sapiens
atacttgaggttgtataaatat

SEQ ID NO: 8223079 - DNA, 22 bp, Homo sapiens
atactttaacgtggcgaacctt

SEQ ID NO: 8223080 - DNA, 22 bp, Homo sapiens
atactttaacgtggcgaacctt

SEQ ID NO: 8223081 - DNA, 22 bp, Homo sapiens
atactttagagctagattgcct

SEQ ID NO: 8223082 - DNA, 22 bp, Homo sapiens
atactttagagctagattgcct

SEQ ID NO: 8223083 - DNA, 22 bp, Homo sapiens
atactttagagctagattgcct

SEQ ID NO: 8223084 - DNA, 22 bp, Homo sapiens
atactttagagctagattgcct

SEQ ID NO: 8223085 - DNA, 22 bp, Homo sapiens
atactttagagctagattgcct

SEQ ID NO: 8223086 - DNA, 22 bp, Homo sapiens
atacttcatgcttcatgtctgt

SEQ ID NO: 8223087 - DNA, 22 bp, Homo sapiens
atacttctagaaatactatgca

SEQ ID NO: 8223088 - DNA, 22 bp, Homo sapiens
atacttctagaaatactatgca

SEQ ID NO: 8223089 - DNA, 22 bp, Homo sapiens
atacttctagaaatactatgca

SEQ ID NO: 8223090 - DNA, 22 bp, Homo sapiens
atacttctcatgggctctgagc

SEQ ID NO: 8223091 - DNA, 22 bp, Homo sapiens
atacttctttagcatattgaac

SEQ ID NO: 8223092 - DNA, 22 bp, Homo sapiens
atacttctttagcatattgaac

SEQ ID NO: 8223093 - DNA, 22 bp, Homo sapiens
atacttctttaagagtaagtct

SEQ ID NO: 8223094 - DNA, 22 bp, Homo sapiens
atacttctctgaggtaggtaaa

SEQ ID NO: 8223095 - DNA, 22 bp, Homo sapiens
atacttctggtgacaaagtctt

SEQ ID NO: 8223096 - DNA, 22 bp, Homo sapiens
ctggcagcgcagcatgaagtcg

SEQ ID NO: 8223097 - DNA, 19 bp, Homo sapiens
ctggcagcctgtctgtgtc

SEQ ID NO: 8223098 - DNA, 19 bp, Homo sapiens
ctggcagcctgtctgtgtc

SEQ ID NO: 8223099 - DNA, 22 bp, Homo sapiens
atactttagagctagattgcct

SEQ ID NO: 8223100 - DNA, 22 bp, Homo sapiens
ctggcagcgtgagcagcatcca

SEQ ID NO: 8223101 - DNA, 22 bp, Homo sapiens
ctggcagcggtttgcagcctgg

SEQ ID NO: 8223102 - DNA, 22 bp, Homo sapiens
ctggcagcggtttgcagcctgg

SEQ ID NO: 8223103 - DNA, 22 bp, Homo sapiens
ctggcagcggtttgcagcctgg

SEQ ID NO: 8223104 - DNA, 22 bp, Homo sapiens
ctggcagctgcccgagatgccc

SEQ ID NO: 8223105 - DNA, 22 bp, Homo sapiens
ctggcagctctgagtcccttct

SEQ ID NO: 8223106 - DNA, 22 bp, Homo sapiens
ctggcagctctactcagagcct

SEQ ID NO: 8223107 - DNA, 22 bp, Homo sapiens
ctggcagctctactcagagcct

SEQ ID NO: 8223108 - DNA, 22 bp, Homo sapiens
ctggcagctctactcagagcct

SEQ ID NO: 8223109 - DNA, 22 bp, Homo sapiens
ctggcagcgtgtttatgaacat

SEQ ID NO: 8223110 - DNA, 22 bp, Homo sapiens
ctggcagcgtgagcagcatcca

SEQ ID NO: 8223111 - DNA, 22 bp, Homo sapiens
ctcagtggtggtcacttggtgg

SEQ ID NO: 8223112 - DNA, 22 bp, Homo sapiens
ctcagtggttgagagcctgggc

SEQ ID NO: 8223113 - DNA, 22 bp, Homo sapiens
ctcagtggagagcggtcctggg

SEQ ID NO: 8223114 - DNA, 22 bp, Homo sapiens
ctcagtggggcgacagggtgct

SEQ ID NO: 8223115 - DNA, 22 bp, Homo sapiens
ctcagtgctttggatcctggat

SEQ ID NO: 8223116 - DNA, 22 bp, Homo sapiens
ctcagggagtagcacatgtgga

SEQ ID NO: 8223117 - DNA, 22 bp, Homo sapiens
ctcagtgggaggagtcagttgc

SEQ ID NO: 8223118 - DNA, 20 bp, Homo sapiens
ctcagtgtattctgggtgct

SEQ ID NO: 8223119 - DNA, 22 bp, Homo sapiens
ctcagtggttgagagcctgggc

SEQ ID NO: 8223120 - DNA, 20 bp, Homo sapiens
ctcagtgtggcctgagtgtt

SEQ ID NO: 8223121 - DNA, 23 bp, Homo sapiens
ctcagtgtgtgacccatggcctc

SEQ ID NO: 8223122 - DNA, 23 bp, Homo sapiens
ctcagtgtgtgacccatggcctc

SEQ ID NO: 8223123 - DNA, 22 bp, Homo sapiens
ctcagtgtgagtgagaagtgca

SEQ ID NO: 8223124 - DNA, 20 bp, Homo sapiens
ctcagtgtggcctgagtgtt

SEQ ID NO: 8223125 - DNA, 22 bp, Homo sapiens
ctcagtgtgaatgctcagtaaa

SEQ ID NO: 8223126 - DNA, 22 bp, Homo sapiens
ctcagtgtcttatttgagttct

SEQ ID NO: 8223127 - DNA, 22 bp, Homo sapiens
agtgacacacctgttagcattg

SEQ ID NO: 8223128 - DNA, 23 bp, Homo sapiens
agtgacaatgggccagaggtggc

SEQ ID NO: 8223129 - DNA, 22 bp, Homo sapiens
agtgacacggagagacagcatg

SEQ ID NO: 8223130 - DNA, 22 bp, Homo sapiens
agtgacaaggtggtaatgaagc

SEQ ID NO: 8223131 - DNA, 22 bp, Homo sapiens
agtgacaaaacggaacatacag

SEQ ID NO: 8223132 - DNA, 22 bp, Homo sapiens
agtgacaaggcctgaagctcct

SEQ ID NO: 8223133 - DNA, 22 bp, Homo sapiens
agtgacaacatcaattggggct

SEQ ID NO: 8223134 - DNA, 22 bp, Homo sapiens
ctcagtgttaaatataaggtat

SEQ ID NO: 8223135 - DNA, 17 bp, Homo sapiens
agtgaaatttacattgc

SEQ ID NO: 8223136 - DNA, 17 bp, Homo sapiens
agtgaaatttacattgc

SEQ ID NO: 8223137 - DNA, 22 bp, Homo sapiens
agtgaatttcatgtaagtgtgt

SEQ ID NO: 8223138 - DNA, 22 bp, Homo sapiens
agtgaatttaaaacactgagga

SEQ ID NO: 8223139 - DNA, 22 bp, Homo sapiens
agtgacagctgggaaggtgaaa

SEQ ID NO: 8223140 - DNA, 22 bp, Homo sapiens
agtgacagattaccggcagagc

SEQ ID NO: 8223141 - DNA, 22 bp, Homo sapiens
agtgacagccaaatccatccat

SEQ ID NO: 8223142 - DNA, 21 bp, Homo sapiens
agtgacagaggaaggtgcata

SEQ ID NO: 8223143 - DNA, 20 bp, Homo sapiens
agtgacagagactgtgtggc

SEQ ID NO: 8223144 - DNA, 22 bp, Homo sapiens
agtgacagggaaaatgacactg

SEQ ID NO: 8223145 - DNA, 22 bp, Homo sapiens
ctccagaaattcaacagcaaat

SEQ ID NO: 8223146 - DNA, 22 bp, Homo sapiens
ctccagaaattcaacagcaaat

SEQ ID NO: 8223147 - DNA, 22 bp, Homo sapiens
ctccagaaatttggatgcagca

SEQ ID NO: 8223148 - DNA, 22 bp, Homo sapiens
ctccagaaattcaacagcaaat

SEQ ID NO: 8223149 - DNA, 22 bp, Homo sapiens
ctccagaaattcaacagcaaat

SEQ ID NO: 8223150 - DNA, 22 bp, Homo sapiens
ctccagaaatttggatgcagca

SEQ ID NO: 8223151 - DNA, 22 bp, Homo sapiens
ctccagaaggtgggggagccac

SEQ ID NO: 8223152 - DNA, 19 bp, Homo sapiens
ctccagaatacatgttcct

SEQ ID NO: 8223153 - DNA, 22 bp, Homo sapiens
ctccagaactgggagagaataa

SEQ ID NO: 8223154 - DNA, 22 bp, Homo sapiens
ctccagaactgggagagaataa

SEQ ID NO: 8223155 - DNA, 22 bp, Homo sapiens
ctccagaattgtccattggaaa

SEQ ID NO: 8223156 - DNA, 22 bp, Homo sapiens
ctccagagacacttctcatgat

SEQ ID NO: 8223157 - DNA, 22 bp, Homo sapiens
ctccagagacacttctcatgat

SEQ ID NO: 8223158 - DNA, 22 bp, Homo sapiens
ctccagagacacttctcatgat

SEQ ID NO: 8223159 - DNA, 22 bp, Homo sapiens
ctccagagagaaaggaggccgc

SEQ ID NO: 8223160 - DNA, 22 bp, Homo sapiens
ctccagagagaaaggaggccgc

SEQ ID NO: 8223161 - DNA, 22 bp, Homo sapiens
ctccagagagaaaggaggccgc

SEQ ID NO: 8223162 - DNA, 22 bp, Homo sapiens
ctccagagagaaaggaggccgc

SEQ ID NO: 8223163 - DNA, 21 bp, Homo sapiens
ctcaggcatttgaggagagtc

SEQ ID NO: 8223164 - DNA, 22 bp, Homo sapiens
ctcaggccaataagctccagcc

SEQ ID NO: 8223165 - DNA, 22 bp, Homo sapiens
agtctccagaaatatagcagtg

SEQ ID NO: 8223166 - DNA, 22 bp, Homo sapiens
agtctccacttgacatcagcag

SEQ ID NO: 8223167 - DNA, 22 bp, Homo sapiens
agtctcatcaggcatgtagtca

SEQ ID NO: 8223168 - DNA, 19 bp, Homo sapiens
agtctcagtgtacagaggc

SEQ ID NO: 8223169 - DNA, 22 bp, Homo sapiens
agtctccacactggcagatgcc

SEQ ID NO: 8223170 - DNA, 22 bp, Homo sapiens
agtctccacaacagccctgata

SEQ ID NO: 8223171 - DNA, 22 bp, Homo sapiens
agtctccacccatgacagtaca

SEQ ID NO: 8223172 - DNA, 22 bp, Homo sapiens
ctcagggacggaggcttgcgga

SEQ ID NO: 8223173 - DNA, 22 bp, Homo sapiens
ctcagggacgttagaggacagg

SEQ ID NO: 8223174 - DNA, 22 bp, Homo sapiens
ctcagggacaaggggagacccc

SEQ ID NO: 8223175 - DNA, 22 bp, Homo sapiens
ctcagggacttggatcctggcc

SEQ ID NO: 8223176 - DNA, 22 bp, Homo sapiens
ctcagggacgttagaggacagg

SEQ ID NO: 8223177 - DNA, 22 bp, Homo sapiens
ctcagggaggagcttctgggcc

SEQ ID NO: 8223178 - DNA, 22 bp, Homo sapiens
ctcagggagagccaagagttcc

SEQ ID NO: 8223179 - DNA, 22 bp, Homo sapiens
ctcagggaggccctgggaccct

SEQ ID NO: 8223180 - DNA, 22 bp, Homo sapiens
ctcagggaggcctctgctggtt

SEQ ID NO: 8223181 - DNA, 22 bp, Homo sapiens
ctcagggaggcctctgctggtt

SEQ ID NO: 8223182 - DNA, 22 bp, Homo sapiens
ctcagggaggtcctgtgctgaa

SEQ ID NO: 8223183 - DNA, 22 bp, Homo sapiens
ctcagggaggtcctgtgctgaa

SEQ ID NO: 8223184 - DNA, 22 bp, Homo sapiens
ctcagccccagcccagatagca

SEQ ID NO: 8223185 - DNA, 22 bp, Homo sapiens
ctcagccccagcccagatagca

SEQ ID NO: 8223186 - DNA, 22 bp, Homo sapiens
ctcagcacattcctaagggatg

SEQ ID NO: 8223187 - DNA, 22 bp, Homo sapiens
ctcagccctccccggggaataa

SEQ ID NO: 8223188 - DNA, 22 bp, Homo sapiens
ctcagcccggtgctcgtgccac

SEQ ID NO: 8223189 - DNA, 22 bp, Homo sapiens
ctcagcctgtgaagagcagagg

SEQ ID NO: 8223190 - DNA, 22 bp, Homo sapiens
ctcagctcaaaattcacctttg

SEQ ID NO: 8223191 - DNA, 22 bp, Homo sapiens
ctcagctagtaacgtacatgtc

SEQ ID NO: 8223192 - DNA, 22 bp, Homo sapiens
ctcagctccagccctcagcagc

SEQ ID NO: 8223193 - DNA, 22 bp, Homo sapiens
ctcagctccagccctcagcagc

SEQ ID NO: 8223194 - DNA, 22 bp, Homo sapiens
ctcagctccagccctcagcagc

SEQ ID NO: 8223195 - DNA, 22 bp, Homo sapiens
ctcagctccagccctcagcagc

SEQ ID NO: 8223196 - DNA, 22 bp, Homo sapiens
ctcagctccaggtgtgcatctt

SEQ ID NO: 8223197 - DNA, 22 bp, Homo sapiens
ctcagctccctccacccagacc

SEQ ID NO: 8223198 - DNA, 22 bp, Homo sapiens
ctcagctctttatactagctgt

SEQ ID NO: 8223199 - DNA, 22 bp, Homo sapiens
ctcagctctttatactagctgt

SEQ ID NO: 8223200 - DNA, 22 bp, Homo sapiens
ctcagctctttatactagctgt

SEQ ID NO: 8223201 - DNA, 22 bp, Homo sapiens
ctcagctctttatactagctgt

SEQ ID NO: 8223202 - DNA, 22 bp, Homo sapiens
ctcagctctttatactagctgt

SEQ ID NO: 8223203 - DNA, 22 bp, Homo sapiens
ctcagctgcagcctggctggca

SEQ ID NO: 8223204 - DNA, 22 bp, Homo sapiens
agtctcagagtacctgagggac

SEQ ID NO: 8223205 - DNA, 22 bp, Homo sapiens
agtctcagcaagcatggctagt

SEQ ID NO: 8223206 - DNA, 22 bp, Homo sapiens
agtctcagccacacagacctat

SEQ ID NO: 8223207 - DNA, 22 bp, Homo sapiens
agtctcagccacacagacctat

SEQ ID NO: 8223208 - DNA, 22 bp, Homo sapiens
agtctcagccacacagacctat

SEQ ID NO: 8223209 - DNA, 22 bp, Homo sapiens
agtctcagctacttgggaggct

SEQ ID NO: 8223210 - DNA, 22 bp, Homo sapiens
ctcaacacgtcctcgagaagcg

SEQ ID NO: 8223211 - DNA, 23 bp, Homo sapiens
ctcaacatccattcttgcccttc

SEQ ID NO: 8223212 - DNA, 22 bp, Homo sapiens
ctcaaatccccgttcctcattc

SEQ ID NO: 8223213 - DNA, 22 bp, Homo sapiens
ctcaaatatgtggtcagaaagc

SEQ ID NO: 8223214 - DNA, 22 bp, Homo sapiens
ctcaaatatgtggtcagaaagc

SEQ ID NO: 8223215 - DNA, 22 bp, Homo sapiens
agtcccagagaggtcggggcca

SEQ ID NO: 8223216 - DNA, 22 bp, Homo sapiens
agtcccagactccagttttctg

SEQ ID NO: 8223217 - DNA, 20 bp, Homo sapiens
agtcccaacattcagctctg

SEQ ID NO: 8223218 - DNA, 22 bp, Homo sapiens
ctatttatgtccaagtgtttta

SEQ ID NO: 8223219 - DNA, 22 bp, Homo sapiens
ctcaaaatggttaattttaata

SEQ ID NO: 8223220 - DNA, 22 bp, Homo sapiens
ctatttatgtccaagtgtttta

SEQ ID NO: 8223221 - DNA, 21 bp, Homo sapiens
ctcaaaattctttctgttgga

SEQ ID NO: 8223222 - DNA, 22 bp, Homo sapiens
ctcaaactgtgcttgtaaattc

SEQ ID NO: 8223223 - DNA, 22 bp, Homo sapiens
ctatttatgtgctattttgtat

SEQ ID NO: 8223224 - DNA, 22 bp, Homo sapiens
ctcaaactgtgcttgtaaattc

SEQ ID NO: 8223225 - DNA, 22 bp, Homo sapiens
ctcaaagaagggaggtatttgg

SEQ ID NO: 8223226 - DNA, 22 bp, Homo sapiens
ctcaaagacaaaaatctgaggt

SEQ ID NO: 8223227 - DNA, 21 bp, Homo sapiens
ctcaaagaccaaaagtgtaga

SEQ ID NO: 8223228 - DNA, 21 bp, Homo sapiens
ctcaaagaccaaaagtgtaga

SEQ ID NO: 8223229 - DNA, 22 bp, Homo sapiens
ctcaaatataagctaaatgtgg

SEQ ID NO: 8223230 - DNA, 22 bp, Homo sapiens
ctcaaatagaactgatctataa

SEQ ID NO: 8223231 - DNA, 22 bp, Homo sapiens
ctcaaatagaactgatctataa

SEQ ID NO: 8223232 - DNA, 22 bp, Homo sapiens
ctcaaatataagctaaatgtgg

SEQ ID NO: 8223233 - DNA, 22 bp, Homo sapiens
ctcaaatatgtggtcagaaagc

SEQ ID NO: 8223234 - DNA, 22 bp, Homo sapiens
ctcaaagataatcctatgtctc

SEQ ID NO: 8223235 - DNA, 22 bp, Homo sapiens
ctcaaagagccaggtaatcacc

SEQ ID NO: 8223236 - DNA, 22 bp, Homo sapiens
ctcaaatacctctccatgtgac

SEQ ID NO: 8223237 - DNA, 22 bp, Homo sapiens
ctcaaatagaactgatctataa

SEQ ID NO: 8223238 - DNA, 22 bp, Homo sapiens
agtatgaatggaaactacctat

SEQ ID NO: 8223239 - DNA, 22 bp, Homo sapiens
agtatgaatctctttattctgc

SEQ ID NO: 8223240 - DNA, 22 bp, Homo sapiens
agtatgaatacagattttctct

SEQ ID NO: 8223241 - DNA, 22 bp, Homo sapiens
agtatgaagaatacatagatga

SEQ ID NO: 8223242 - DNA, 22 bp, Homo sapiens
agtatgaagaatacatagatga

SEQ ID NO: 8223243 - DNA, 22 bp, Homo sapiens
agtatcatgttggaattaatca

SEQ ID NO: 8223244 - DNA, 22 bp, Homo sapiens
agtatcaatcaccctttgaagt

SEQ ID NO: 8223245 - DNA, 22 bp, Homo sapiens
agtatcttcaagtttcttctag

SEQ ID NO: 8223246 - DNA, 22 bp, Homo sapiens
agtatctgcatgattttgagaa

SEQ ID NO: 8223247 - DNA, 23 bp, Homo sapiens
cgggtaggaacatcaggatgtga

SEQ ID NO: 8223248 - DNA, 22 bp, Homo sapiens
cgggtaggaacaaagagctgca

SEQ ID NO: 8223249 - DNA, 22 bp, Homo sapiens
cgggttcacgccattctcctgc

SEQ ID NO: 8223250 - DNA, 22 bp, Homo sapiens
cgggttcacgccattctcctgc

SEQ ID NO: 8223251 - DNA, 22 bp, Homo sapiens
cgggttcacgccattctcctgc

SEQ ID NO: 8223252 - DNA, 22 bp, Homo sapiens
cggggttcatccatgctgtggc

SEQ ID NO: 8223253 - DNA, 22 bp, Homo sapiens
cgggtaggaacaaagagctgca

SEQ ID NO: 8223254 - DNA, 22 bp, Homo sapiens
cggggtggcactctaaatagaa

SEQ ID NO: 8223255 - DNA, 22 bp, Homo sapiens
cggggtgggaatagacctgtct

SEQ ID NO: 8223256 - DNA, 22 bp, Homo sapiens
cggggtgggaatagacctgtct

SEQ ID NO: 8223257 - DNA, 21 bp, Homo sapiens
ctcagaccacagctcacaccc

SEQ ID NO: 8223258 - DNA, 18 bp, Homo sapiens
ctcagacaggctgtgcta

SEQ ID NO: 8223259 - DNA, 21 bp, Homo sapiens
ctcagacagggaggctctggg

SEQ ID NO: 8223260 - DNA, 22 bp, Homo sapiens
ctcagactggagccccaaggac

SEQ ID NO: 8223261 - DNA, 22 bp, Homo sapiens
ctcagactagcctgtaccgaca

SEQ ID NO: 8223262 - DNA, 22 bp, Homo sapiens
ctcagactggagccccaaggac

SEQ ID NO: 8223263 - DNA, 22 bp, Homo sapiens
ctcagactaaaatgggaatgta

SEQ ID NO: 8223264 - DNA, 22 bp, Homo sapiens
ctcagactaaaatgggaatgta

SEQ ID NO: 8223265 - DNA, 22 bp, Homo sapiens
ctcagactaaaatgggaatgta

SEQ ID NO: 8223266 - DNA, 22 bp, Homo sapiens
ctcagaggtcaagagcagagct

SEQ ID NO: 8223267 - DNA, 22 bp, Homo sapiens
ctcagacttttgttcaacgagt

SEQ ID NO: 8223268 - DNA, 22 bp, Homo sapiens
ctcagaggggatgcttggagaa

SEQ ID NO: 8223269 - DNA, 22 bp, Homo sapiens
ctcagagggtacaggtgaaccc

SEQ ID NO: 8223270 - DNA, 22 bp, Homo sapiens
ctcagatgtagaaagattgtga

SEQ ID NO: 8223271 - DNA, 22 bp, Homo sapiens
ctcagatgtgttggatggaaaa

SEQ ID NO: 8223272 - DNA, 22 bp, Homo sapiens
ctcagattctgaataataaaca

SEQ ID NO: 8223273 - DNA, 22 bp, Homo sapiens
ctcagcaagattaagcagcttg

SEQ ID NO: 8223274 - DNA, 23 bp, Homo sapiens
ctcagaggtgtttttcacttact

SEQ ID NO: 8223275 - DNA, 23 bp, Homo sapiens
ctcagaggtgtttttcacttact

SEQ ID NO: 8223276 - DNA, 22 bp, Homo sapiens
ctcagataatctttgagtcttc

SEQ ID NO: 8223277 - DNA, 22 bp, Homo sapiens
ctcaccagatgtcgggctgagt

SEQ ID NO: 8223278 - DNA, 22 bp, Homo sapiens
ctcaccaggaacagctgcggag

SEQ ID NO: 8223279 - DNA, 22 bp, Homo sapiens
agtcccagcctaggctgtgctg

SEQ ID NO: 8223280 - DNA, 22 bp, Homo sapiens
agtcccagcccagtcctgtaag

SEQ ID NO: 8223281 - DNA, 22 bp, Homo sapiens
agtcccagcccagtcctgtaag

SEQ ID NO: 8223282 - DNA, 22 bp, Homo sapiens
agtcccagatgacccagctact

SEQ ID NO: 8223283 - DNA, 22 bp, Homo sapiens
agtcccagcctaggctgtgctg

SEQ ID NO: 8223284 - DNA, 22 bp, Homo sapiens
agtcccagatctacaggaggga

SEQ ID NO: 8223285 - DNA, 22 bp, Homo sapiens
agtcccagatctacaggaggga

SEQ ID NO: 8223286 - DNA, 22 bp, Homo sapiens
agtcccagatctacaggaggga

SEQ ID NO: 8223287 - DNA, 22 bp, Homo sapiens
agtcccagatctacaggaggga

SEQ ID NO: 8223288 - DNA, 22 bp, Homo sapiens
agtcccagatgacccagctact

SEQ ID NO: 8223289 - DNA, 22 bp, Homo sapiens
agtcccagatgacccagctact

SEQ ID NO: 8223290 - DNA, 22 bp, Homo sapiens
ctcagacaaatgattaaggtta

SEQ ID NO: 8223291 - DNA, 22 bp, Homo sapiens
ctcagaagccttcagtcttggc

SEQ ID NO: 8223292 - DNA, 22 bp, Homo sapiens
ctcagaaatcccactctgtgta

SEQ ID NO: 8223293 - DNA, 22 bp, Homo sapiens
ctcagaaagtgacaggggggtg

SEQ ID NO: 8223294 - DNA, 22 bp, Homo sapiens
ctcagaaattacaaaagggaca

SEQ ID NO: 8223295 - DNA, 22 bp, Homo sapiens
ctcagaagaacaaaggctctac

SEQ ID NO: 8223296 - DNA, 22 bp, Homo sapiens
ctcagaagaacaaaggctctac

SEQ ID NO: 8223297 - DNA, 22 bp, Homo sapiens
ctcagaagaatcagcagctatt

SEQ ID NO: 8223298 - DNA, 22 bp, Homo sapiens
ctcagaagaacccagggtccca

SEQ ID NO: 8223299 - DNA, 22 bp, Homo sapiens
ctccttttcctactcatactat

SEQ ID NO: 8223300 - DNA, 22 bp, Homo sapiens
ctcgcaggacagtgctaggact

SEQ ID NO: 8223301 - DNA, 22 bp, Homo sapiens
ctcgcatccaggataccctgag

SEQ ID NO: 8223302 - DNA, 22 bp, Homo sapiens
ctcggagatgctggctgagatc

SEQ ID NO: 8223303 - DNA, 22 bp, Homo sapiens
ctcgcgttccagctgcgggccg

SEQ ID NO: 8223304 - DNA, 22 bp, Homo sapiens
ctcggaagaagcgttctcagag

SEQ ID NO: 8223305 - DNA, 22 bp, Homo sapiens
ctcgcctgcctgtgtctctccc

SEQ ID NO: 8223306 - DNA, 22 bp, Homo sapiens
ctccttggtgtagtactgagca

SEQ ID NO: 8223307 - DNA, 22 bp, Homo sapiens
ctccttggtgtagtactgagca

SEQ ID NO: 8223308 - DNA, 22 bp, Homo sapiens
ctccttggtgtagtactgagca

SEQ ID NO: 8223309 - DNA, 23 bp, Homo sapiens
ctccttggtatgccatgcccagc

SEQ ID NO: 8223310 - DNA, 18 bp, Homo sapiens
ctccttggagaagaggcc

SEQ ID NO: 8223311 - DNA, 22 bp, Homo sapiens
ctccttctgggcctggcagtgg

SEQ ID NO: 8223312 - DNA, 18 bp, Homo sapiens
ctccttggagaagaggcc

SEQ ID NO: 8223313 - DNA, 22 bp, Homo sapiens
ctcctgagtagtagcattgtca

SEQ ID NO: 8223314 - DNA, 22 bp, Homo sapiens
ctcctgagtagtagcattgtca

SEQ ID NO: 8223315 - DNA, 22 bp, Homo sapiens
ctcctgaggggacaggactcat

SEQ ID NO: 8223316 - DNA, 22 bp, Homo sapiens
ctcctgaggggacaggactcat

SEQ ID NO: 8223317 - DNA, 22 bp, Homo sapiens
ctcctgaggggacaggactcat

SEQ ID NO: 8223318 - DNA, 22 bp, Homo sapiens
ctcctgaggggacaggactcat

SEQ ID NO: 8223319 - DNA, 22 bp, Homo sapiens
ctcctgcatgctcacatatgcc

SEQ ID NO: 8223320 - DNA, 22 bp, Homo sapiens
ctcctgccaccgcggtgtcctg

SEQ ID NO: 8223321 - DNA, 22 bp, Homo sapiens
ctccttctgggcctggcagtgg

SEQ ID NO: 8223322 - DNA, 22 bp, Homo sapiens
ctccttctgaggctctgggttc

SEQ ID NO: 8223323 - DNA, 22 bp, Homo sapiens
ctccttctgaggctctgggttc

SEQ ID NO: 8223324 - DNA, 22 bp, Homo sapiens
ctccttctgggcctggcagtgg

SEQ ID NO: 8223325 - DNA, 22 bp, Homo sapiens
ctcctgaggaaaagcttggtca

SEQ ID NO: 8223326 - DNA, 22 bp, Homo sapiens
ctcctgaggaaaagcttggtca

SEQ ID NO: 8223327 - DNA, 22 bp, Homo sapiens
ctcctgaggaaaagcttggtca

SEQ ID NO: 8223328 - DNA, 22 bp, Homo sapiens
ctcctgaggaaaagcttggtca

SEQ ID NO: 8223329 - DNA, 22 bp, Homo sapiens
ctcctgagggatgcttaggctt

SEQ ID NO: 8223330 - DNA, 22 bp, Homo sapiens
ctcctgagggatgcttaggctt

SEQ ID NO: 8223331 - DNA, 22 bp, Homo sapiens
ctcctgagggatgcttaggctt

SEQ ID NO: 8223332 - DNA, 22 bp, Homo sapiens
ctcctgagggatgcttaggctt

SEQ ID NO: 8223333 - DNA, 22 bp, Homo sapiens
ctcctgagggatgcttaggctt

SEQ ID NO: 8223334 - DNA, 22 bp, Homo sapiens
ctcctgaggacttctattgggt

SEQ ID NO: 8223335 - DNA, 22 bp, Homo sapiens
agtgctggagggaggcaggttc

SEQ ID NO: 8223336 - DNA, 22 bp, Homo sapiens
agtgctggagggaggcaggttc

SEQ ID NO: 8223337 - DNA, 22 bp, Homo sapiens
agtgctggagggaggcaggttc

SEQ ID NO: 8223338 - DNA, 22 bp, Homo sapiens
agtgctggagggaggcaggttc

SEQ ID NO: 8223339 - DNA, 22 bp, Homo sapiens
agtgctggagggaggcaggttc

SEQ ID NO: 8223340 - DNA, 22 bp, Homo sapiens
agtgctggagggaggcaggttc

SEQ ID NO: 8223341 - DNA, 22 bp, Homo sapiens
agtgctggagggaggcaggttc

SEQ ID NO: 8223342 - DNA, 22 bp, Homo sapiens
agtgctggattacaggcgtgag

SEQ ID NO: 8223343 - DNA, 22 bp, Homo sapiens
agtgctggattacaggcgtgag

SEQ ID NO: 8223344 - DNA, 22 bp, Homo sapiens
agtgctggattacaggcgtgag

SEQ ID NO: 8223345 - DNA, 22 bp, Homo sapiens
agtgctggattacaggcgtgag

SEQ ID NO: 8223346 - DNA, 22 bp, Homo sapiens
agtgctggattacaggcgtgag

SEQ ID NO: 8223347 - DNA, 22 bp, Homo sapiens
agtgctggattacaggcgtgag

SEQ ID NO: 8223348 - DNA, 22 bp, Homo sapiens
agtgctggattacaggcgtgag

SEQ ID NO: 8223349 - DNA, 22 bp, Homo sapiens
agtgctggattacaggcgtgag

SEQ ID NO: 8223350 - DNA, 22 bp, Homo sapiens
agtgctggattacaggcgtgag

SEQ ID NO: 8223351 - DNA, 22 bp, Homo sapiens
agtgctgactctgggcacagtg

SEQ ID NO: 8223352 - DNA, 23 bp, Homo sapiens
agtgctgaattgaaagctccagg

SEQ ID NO: 8223353 - DNA, 22 bp, Homo sapiens
agtgctatcgagttctaatgct

SEQ ID NO: 8223354 - DNA, 22 bp, Homo sapiens
ctccagagagtccagctctggg

SEQ ID NO: 8223355 - DNA, 22 bp, Homo sapiens
ctccagagagtccagctctggg

SEQ ID NO: 8223356 - DNA, 22 bp, Homo sapiens
ctccagagagtccagctctggg

SEQ ID NO: 8223357 - DNA, 22 bp, Homo sapiens
ctccagagagtccagctctggg

SEQ ID NO: 8223358 - DNA, 22 bp, Homo sapiens
agtgctaccctgggaggagctc

SEQ ID NO: 8223359 - DNA, 22 bp, Homo sapiens
agtgctgactctgggcacagtg

SEQ ID NO: 8223360 - DNA, 22 bp, Homo sapiens
agtgctgaggagaggtactcca

SEQ ID NO: 8223361 - DNA, 22 bp, Homo sapiens
agtgctgaggccatactccata

SEQ ID NO: 8223362 - DNA, 22 bp, Homo sapiens
agtgctgagtgattgcaaagga

SEQ ID NO: 8223363 - DNA, 22 bp, Homo sapiens
agtgctggaaagggacggagga

SEQ ID NO: 8223364 - DNA, 22 bp, Homo sapiens
agtgctggagggaggcaggttc

SEQ ID NO: 8223365 - DNA, 23 bp, Homo sapiens
agtgctggagaagcttctggctt

SEQ ID NO: 8223366 - DNA, 23 bp, Homo sapiens
agtgctggagaagcttctggctt

SEQ ID NO: 8223367 - DNA, 23 bp, Homo sapiens
agtgctggagaagcttctggctt

SEQ ID NO: 8223368 - DNA, 23 bp, Homo sapiens
agtgctggagaagcttctggctt

SEQ ID NO: 8223369 - DNA, 22 bp, Homo sapiens
agtgctgggattacaggcataa

SEQ ID NO: 8223370 - DNA, 22 bp, Homo sapiens
agtgctggcccatagctgctgg

SEQ ID NO: 8223371 - DNA, 22 bp, Homo sapiens
agtgctgggattacaggcataa

SEQ ID NO: 8223372 - DNA, 22 bp, Homo sapiens
agtgctgggattacaggcataa

SEQ ID NO: 8223373 - DNA, 22 bp, Homo sapiens
agtgctgggattacaggcataa

SEQ ID NO: 8223374 - DNA, 22 bp, Homo sapiens
agtgctgggattgcaggcatga

SEQ ID NO: 8223375 - DNA, 22 bp, Homo sapiens
agtgctgggattgcaggcatga

SEQ ID NO: 8223376 - DNA, 22 bp, Homo sapiens
agtgctgggattacaggcataa

SEQ ID NO: 8223377 - DNA, 22 bp, Homo sapiens
agtgctgggattacaggcataa

SEQ ID NO: 8223378 - DNA, 22 bp, Homo sapiens
agtgctggcccatagctgctgg

SEQ ID NO: 8223379 - DNA, 22 bp, Homo sapiens
ctcgggcaggagggccctctcc

SEQ ID NO: 8223380 - DNA, 22 bp, Homo sapiens
agtgctggcccatagctgctgg

SEQ ID NO: 8223381 - DNA, 22 bp, Homo sapiens
agtgctggcccatagctgctgg

SEQ ID NO: 8223382 - DNA, 22 bp, Homo sapiens
agtgctggcccatagctgctgg

SEQ ID NO: 8223383 - DNA, 22 bp, Homo sapiens
ctcggctctccatttttgtttg

SEQ ID NO: 8223384 - DNA, 22 bp, Homo sapiens
ctcgggcaccctggttctggtg

SEQ ID NO: 8223385 - DNA, 22 bp, Homo sapiens
ctcggcaggtggaggttgtagt

SEQ ID NO: 8223386 - DNA, 22 bp, Homo sapiens
ctcggcaggtggaggttgtagt

SEQ ID NO: 8223387 - DNA, 22 bp, Homo sapiens
ctcggcaggtggaggttgtagt

SEQ ID NO: 8223388 - DNA, 22 bp, Homo sapiens
agtgctgggctatctactgcta

SEQ ID NO: 8223389 - DNA, 22 bp, Homo sapiens
agtgctgggctatctactgcta

SEQ ID NO: 8223390 - DNA, 22 bp, Homo sapiens
ctctccaagttatcaagatgaa

SEQ ID NO: 8223391 - DNA, 19 bp, Homo sapiens
ctctccacctaacaggtat

SEQ ID NO: 8223392 - DNA, 23 bp, Homo sapiens
ctctccaccttcccacccaggga

SEQ ID NO: 8223393 - DNA, 22 bp, Homo sapiens
agtgctgggctatctactgcta

SEQ ID NO: 8223394 - DNA, 22 bp, Homo sapiens
agtgctgggattgcaggcatga

SEQ ID NO: 8223395 - DNA, 22 bp, Homo sapiens
agtgctgggattgcaggcatga

SEQ ID NO: 8223396 - DNA, 22 bp, Homo sapiens
agtgctgggattgcaggcatga

SEQ ID NO: 8223397 - DNA, 22 bp, Homo sapiens
agtgctgggattgcaggcatga

SEQ ID NO: 8223398 - DNA, 22 bp, Homo sapiens
ctctccattccctacagttttc

SEQ ID NO: 8223399 - DNA, 22 bp, Homo sapiens
ctctccattccctacagttttc

SEQ ID NO: 8223400 - DNA, 20 bp, Homo sapiens
ctctcccagcacagcttcct

SEQ ID NO: 8223401 - DNA, 22 bp, Homo sapiens
ctctccattccctacagttttc

SEQ ID NO: 8223402 - DNA, 22 bp, Homo sapiens
ctctccatctgtgtgacctccc

SEQ ID NO: 8223403 - DNA, 22 bp, Homo sapiens
ctctccatctgtgtgacctccc

SEQ ID NO: 8223404 - DNA, 22 bp, Homo sapiens
ctctccagttatagctgatttg

SEQ ID NO: 8223405 - DNA, 22 bp, Homo sapiens
ctctccatctgtgtgacctccc

SEQ ID NO: 8223406 - DNA, 22 bp, Homo sapiens
ctctcccagtcaggctcaggat

SEQ ID NO: 8223407 - DNA, 22 bp, Homo sapiens
ctctcccagtcaggctcaggat

SEQ ID NO: 8223408 - DNA, 22 bp, Homo sapiens
ctctcccagtcaggctcaggat

SEQ ID NO: 8223409 - DNA, 22 bp, Homo sapiens
ctctcccagtcaggctcaggat

SEQ ID NO: 8223410 - DNA, 22 bp, Homo sapiens
ctctccccacaccctctgcatg

SEQ ID NO: 8223411 - DNA, 22 bp, Homo sapiens
ctctccccacaccctctgcatg

SEQ ID NO: 8223412 - DNA, 22 bp, Homo sapiens
ctctccccacaccctctgcatg

SEQ ID NO: 8223413 - DNA, 22 bp, Homo sapiens
ctctccccacaccctctgcatg

SEQ ID NO: 8223414 - DNA, 20 bp, Homo sapiens
ctctcccagcacagcttcct

SEQ ID NO: 8223415 - DNA, 22 bp, Homo sapiens
ctctcccagtcaggctcaggat

SEQ ID NO: 8223416 - DNA, 22 bp, Homo sapiens
ctctcccagtcaggctcaggat

SEQ ID NO: 8223417 - DNA, 20 bp, Homo sapiens
ctctcccagcacagcttcct

SEQ ID NO: 8223418 - DNA, 20 bp, Homo sapiens
ctctcccagcacagcttcct

SEQ ID NO: 8223419 - DNA, 20 bp, Homo sapiens
ctctcccagcacagcttcct

SEQ ID NO: 8223420 - DNA, 22 bp, Homo sapiens
ctctcctttgaagcaactgtat

SEQ ID NO: 8223421 - DNA, 22 bp, Homo sapiens
ctctcgaagagacttcccagct

SEQ ID NO: 8223422 - DNA, 22 bp, Homo sapiens
ctctcctttactgcagagagcg

SEQ ID NO: 8223423 - DNA, 22 bp, Homo sapiens
ctctcctttactgcagagagcg

SEQ ID NO: 8223424 - DNA, 22 bp, Homo sapiens
ctctccttgcagatggctgcct

SEQ ID NO: 8223425 - DNA, 22 bp, Homo sapiens
ctctccttgcagatggctgcct

SEQ ID NO: 8223426 - DNA, 22 bp, Homo sapiens
ctctccttgcagatggctgcct

SEQ ID NO: 8223427 - DNA, 22 bp, Homo sapiens
ctctccttgaggcttggacttc

SEQ ID NO: 8223428 - DNA, 17 bp, Homo sapiens
ctctccttcctctgagg

SEQ ID NO: 8223429 - DNA, 17 bp, Homo sapiens
ctctccttcctctgagg

SEQ ID NO: 8223430 - DNA, 22 bp, Homo sapiens
ctctccccacaccctctgcatg

SEQ ID NO: 8223431 - DNA, 22 bp, Homo sapiens
ctctccttgcagatggctgcct

SEQ ID NO: 8223432 - DNA, 22 bp, Homo sapiens
ctctctatggatgcagtttttc

SEQ ID NO: 8223433 - DNA, 21 bp, Homo sapiens
ctctctagatggcttccagcc

SEQ ID NO: 8223434 - DNA, 19 bp, Homo sapiens
ctctctccagtggctggct

SEQ ID NO: 8223435 - DNA, 19 bp, Homo sapiens
ctctctccagtggctggct

SEQ ID NO: 8223436 - DNA, 22 bp, Homo sapiens
ctctctaagaacttgatcttgt

SEQ ID NO: 8223437 - DNA, 22 bp, Homo sapiens
ctctctaagctccacatttcct

SEQ ID NO: 8223438 - DNA, 22 bp, Homo sapiens
ctctcgccagcggggctgcgct

SEQ ID NO: 8223439 - DNA, 22 bp, Homo sapiens
ctctcgccagcggggctgcgct

SEQ ID NO: 8223440 - DNA, 22 bp, Homo sapiens
ctctgtgaacccctcctttctt

SEQ ID NO: 8223441 - DNA, 22 bp, Homo sapiens
ctctgtctatcccattctgtgc

SEQ ID NO: 8223442 - DNA, 22 bp, Homo sapiens
ctctgtgagggtctgtacagaa

SEQ ID NO: 8223443 - DNA, 22 bp, Homo sapiens
ctctgtgagggtctgtacagaa

SEQ ID NO: 8223444 - DNA, 22 bp, Homo sapiens
agtggtctccccagtagaataa

SEQ ID NO: 8223445 - DNA, 22 bp, Homo sapiens
agtggtctctaaatgtttaaat

SEQ ID NO: 8223446 - DNA, 22 bp, Homo sapiens
agtggtctccccagtagaataa

SEQ ID NO: 8223447 - DNA, 18 bp, Homo sapiens
agtggtctgttatatcat

SEQ ID NO: 8223448 - DNA, 22 bp, Homo sapiens
agtggtctgggctaaatgaggt

SEQ ID NO: 8223449 - DNA, 22 bp, Homo sapiens
agtggtctgcctgcctcagcct

SEQ ID NO: 8223450 - DNA, 22 bp, Homo sapiens
agtggtctgggctaaatgaggt

SEQ ID NO: 8223451 - DNA, 22 bp, Homo sapiens
ctctgtcctccacctgctttca

SEQ ID NO: 8223452 - DNA, 22 bp, Homo sapiens
ctctgtcctccacctgctttca

SEQ ID NO: 8223453 - DNA, 22 bp, Homo sapiens
ctctgtcctccacctgctttca

SEQ ID NO: 8223454 - DNA, 22 bp, Homo sapiens
ctctgtcccagacccacctctc

SEQ ID NO: 8223455 - DNA, 22 bp, Homo sapiens
agtgtaaacttaagagaatatc

SEQ ID NO: 8223456 - DNA, 22 bp, Homo sapiens
agtgtaaagctgtatatgtgcc

SEQ ID NO: 8223457 - DNA, 22 bp, Homo sapiens
agtgtacaaaatgatagataaa

SEQ ID NO: 8223458 - DNA, 22 bp, Homo sapiens
agtggtggagccaggaaatgtg

SEQ ID NO: 8223459 - DNA, 22 bp, Homo sapiens
agtggtggagccaggaaatgtg

SEQ ID NO: 8223460 - DNA, 22 bp, Homo sapiens
agtggtggagccaggaaatgtg

SEQ ID NO: 8223461 - DNA, 22 bp, Homo sapiens
agtggtgtcgtgggagtggaag

SEQ ID NO: 8223462 - DNA, 22 bp, Homo sapiens
agtggtgtcgtgggagtggaag

SEQ ID NO: 8223463 - DNA, 22 bp, Homo sapiens
agtggtgctgcgcgcggagctc

SEQ ID NO: 8223464 - DNA, 22 bp, Homo sapiens
agtggtggagagatgaggacac

SEQ ID NO: 8223465 - DNA, 22 bp, Homo sapiens
agtggtggagagatgaggacac

SEQ ID NO: 8223466 - DNA, 22 bp, Homo sapiens
agtggtgcaaactggggcagct

SEQ ID NO: 8223467 - DNA, 22 bp, Homo sapiens
agtggtcttagcttgctgggct

SEQ ID NO: 8223468 - DNA, 21 bp, Homo sapiens
agtggtctttttcacccagtg

SEQ ID NO: 8223469 - DNA, 22 bp, Homo sapiens
agtggtcttcaattccctttgt

SEQ ID NO: 8223470 - DNA, 22 bp, Homo sapiens
ctcttgggagtgctctggagaa

SEQ ID NO: 8223471 - DNA, 22 bp, Homo sapiens
ctcttgggagtgctctggagaa

SEQ ID NO: 8223472 - DNA, 22 bp, Homo sapiens
ctcttggccagacacagaggca

SEQ ID NO: 8223473 - DNA, 22 bp, Homo sapiens
ctcttgggatttgcaggctcag

SEQ ID NO: 8223474 - DNA, 22 bp, Homo sapiens
ctcttgggatttgcaggctcag

SEQ ID NO: 8223475 - DNA, 22 bp, Homo sapiens
ctcttgggatttgcaggctcag

SEQ ID NO: 8223476 - DNA, 19 bp, Homo sapiens
ctcttgggtggcagaggcc

SEQ ID NO: 8223477 - DNA, 20 bp, Homo sapiens
ctcttgggcccaaagggcct

SEQ ID NO: 8223478 - DNA, 19 bp, Homo sapiens
ctcttgggtggcagaggcc

SEQ ID NO: 8223479 - DNA, 19 bp, Homo sapiens
ctcttgggtggcagaggcc

SEQ ID NO: 8223480 - DNA, 19 bp, Homo sapiens
ctcttgggtggcagaggcc

SEQ ID NO: 8223481 - DNA, 22 bp, Homo sapiens
ctcttgggtgggcagtgggcct

SEQ ID NO: 8223482 - DNA, 19 bp, Homo sapiens
ctcttgggtggcagaggcc

SEQ ID NO: 8223483 - DNA, 21 bp, Homo sapiens
ctcttggtcctccctgtgacc

SEQ ID NO: 8223484 - DNA, 21 bp, Homo sapiens
ctcttgtctttgctcagtagc

SEQ ID NO: 8223485 - DNA, 22 bp, Homo sapiens
ctcttcttggcccccatgaggg

SEQ ID NO: 8223486 - DNA, 22 bp, Homo sapiens
ctcttagtaatgccatgaagca

SEQ ID NO: 8223487 - DNA, 22 bp, Homo sapiens
ctcttagtaatgccatgaagca

SEQ ID NO: 8223488 - DNA, 22 bp, Homo sapiens
ctcttctttagtccagaccatc

SEQ ID NO: 8223489 - DNA, 22 bp, Homo sapiens
ctcttctttccatccctagcca

SEQ ID NO: 8223490 - DNA, 22 bp, Homo sapiens
ctcttcttggcccccatgaggg

SEQ ID NO: 8223491 - DNA, 22 bp, Homo sapiens
ctcttgcatgagatccaggagt

SEQ ID NO: 8223492 - DNA, 22 bp, Homo sapiens
ctcttgccagagatgagactct

SEQ ID NO: 8223493 - DNA, 22 bp, Homo sapiens
ctcttgcttgcaagtggggata

SEQ ID NO: 8223494 - DNA, 22 bp, Homo sapiens
ctcttgctgtcaaagcagggta

SEQ ID NO: 8223495 - DNA, 21 bp, Homo sapiens
ctcttgctgatgtctccttta

SEQ ID NO: 8223496 - DNA, 22 bp, Homo sapiens
ctcttgaagggcatctgagtta

SEQ ID NO: 8223497 - DNA, 22 bp, Homo sapiens
ctcttgaactttctagtttcat

SEQ ID NO: 8223498 - DNA, 22 bp, Homo sapiens
ctcttgaagggcatctgagtta

SEQ ID NO: 8223499 - DNA, 22 bp, Homo sapiens
ctcttgatgactgttgctggtt

SEQ ID NO: 8223500 - DNA, 22 bp, Homo sapiens
ctcttgcagataccttgaagga

SEQ ID NO: 8223501 - DNA, 22 bp, Homo sapiens
ctctgtagaaacagggcagaag

SEQ ID NO: 8223502 - DNA, 22 bp, Homo sapiens
ctctgtagaaagagcccaggtg

SEQ ID NO: 8223503 - DNA, 22 bp, Homo sapiens
ctctggtttttcttccattaag

SEQ ID NO: 8223504 - DNA, 22 bp, Homo sapiens
ctctgtacaggagacatctcta

SEQ ID NO: 8223505 - DNA, 22 bp, Homo sapiens
ctctgtcaggctgcagatgctc

SEQ ID NO: 8223506 - DNA, 22 bp, Homo sapiens
ctctgtcaggctgcagatgctc

SEQ ID NO: 8223507 - DNA, 22 bp, Homo sapiens
ctctgtcagagtgttgtcccca

SEQ ID NO: 8223508 - DNA, 22 bp, Homo sapiens
ctctgtatagaaaggaaacatt

SEQ ID NO: 8223509 - DNA, 22 bp, Homo sapiens
ctctgtcacttctccagctgag

SEQ ID NO: 8223510 - DNA, 22 bp, Homo sapiens
ctctggtttctgacctgaattt

SEQ ID NO: 8223511 - DNA, 21 bp, Homo sapiens
ctctggtttgcattggattat

SEQ ID NO: 8223512 - DNA, 15 bp, Homo sapiens
ctctggtttttcttc

SEQ ID NO: 8223513 - DNA, 22 bp, Homo sapiens
ctctggggttagatctgatgct

SEQ ID NO: 8223514 - DNA, 22 bp, Homo sapiens
ctctggggttagatctgatgct

SEQ ID NO: 8223515 - DNA, 22 bp, Homo sapiens
ctctggggttagatctgatgct

SEQ ID NO: 8223516 - DNA, 22 bp, Homo sapiens
agtgggagagaagcaagtagta

SEQ ID NO: 8223517 - DNA, 22 bp, Homo sapiens
agtgggaaactggagagacttc

SEQ ID NO: 8223518 - DNA, 22 bp, Homo sapiens
agtggcttgctctgcctcagcc

SEQ ID NO: 8223519 - DNA, 22 bp, Homo sapiens
agtggcttggctgcactacagg

SEQ ID NO: 8223520 - DNA, 22 bp, Homo sapiens
agtggctgtgaaatacatggga

SEQ ID NO: 8223521 - DNA, 22 bp, Homo sapiens
agtggctgttccaggtgaggac

SEQ ID NO: 8223522 - DNA, 22 bp, Homo sapiens
agtggctgttccaggtgaggac

SEQ ID NO: 8223523 - DNA, 22 bp, Homo sapiens
agtggctgttcattttacacaa

SEQ ID NO: 8223524 - DNA, 22 bp, Homo sapiens
agtggctgttccaggtgaggac

SEQ ID NO: 8223525 - DNA, 22 bp, Homo sapiens
agtggctgtttataggtgggta

SEQ ID NO: 8223526 - DNA, 22 bp, Homo sapiens
agtggctgtttataggtgggta

SEQ ID NO: 8223527 - DNA, 22 bp, Homo sapiens
agtggctgtttataggtgggta

SEQ ID NO: 8223528 - DNA, 22 bp, Homo sapiens
agtggctgtttataggtgggta

SEQ ID NO: 8223529 - DNA, 22 bp, Homo sapiens
agtggctgtttataggtgggta

SEQ ID NO: 8223530 - DNA, 23 bp, Homo sapiens
ctctggagatcctctgcctgggt

SEQ ID NO: 8223531 - DNA, 22 bp, Homo sapiens
ctctggagaggttcccatggga

SEQ ID NO: 8223532 - DNA, 22 bp, Homo sapiens
ctctggagaggttcccatggga

SEQ ID NO: 8223533 - DNA, 22 bp, Homo sapiens
ctctggagaggttcccatggga

SEQ ID NO: 8223534 - DNA, 19 bp, Homo sapiens
ctctggagaacaatagtgc

SEQ ID NO: 8223535 - DNA, 22 bp, Homo sapiens
ctctggagaactccttgtgtct

SEQ ID NO: 8223536 - DNA, 22 bp, Homo sapiens
ctctggagatggttctcaattg

SEQ ID NO: 8223537 - DNA, 23 bp, Homo sapiens
ctctggagatcctctgcctgggt

SEQ ID NO: 8223538 - DNA, 22 bp, Homo sapiens
ctctggagatggttctcaattg

SEQ ID NO: 8223539 - DNA, 23 bp, Homo sapiens
ctctggagatcctctgcctgggt

SEQ ID NO: 8223540 - DNA, 22 bp, Homo sapiens
ctctggagcaccgggctatcca

SEQ ID NO: 8223541 - DNA, 22 bp, Homo sapiens
ctctggagcaccgggctatcca

SEQ ID NO: 8223542 - DNA, 19 bp, Homo sapiens
ctctggagcagacactgga

SEQ ID NO: 8223543 - DNA, 22 bp, Homo sapiens
agtggctgtgaaatacatggga

SEQ ID NO: 8223544 - DNA, 22 bp, Homo sapiens
ctctggacactggcatggggtc

SEQ ID NO: 8223545 - DNA, 22 bp, Homo sapiens
ctctggacccagacaaacctgg

SEQ ID NO: 8223546 - DNA, 22 bp, Homo sapiens
ctctggacccagacaaacctgg

SEQ ID NO: 8223547 - DNA, 22 bp, Homo sapiens
ctctggacccagacaaacctgg

SEQ ID NO: 8223548 - DNA, 22 bp, Homo sapiens
ctctggacctcagtctactaat

SEQ ID NO: 8223549 - DNA, 22 bp, Homo sapiens
ctctggacttgtacatactcag

SEQ ID NO: 8223550 - DNA, 22 bp, Homo sapiens
ctctggactttttgtggattct

SEQ ID NO: 8223551 - DNA, 22 bp, Homo sapiens
ctctggacctcagctacagact

SEQ ID NO: 8223552 - DNA, 22 bp, Homo sapiens
ctctggaccctcctgctgagag

SEQ ID NO: 8223553 - DNA, 19 bp, Homo sapiens
ctctctccagtggctggct

SEQ ID NO: 8223554 - DNA, 20 bp, Homo sapiens
ctctctccatctcagtggcc

SEQ ID NO: 8223555 - DNA, 20 bp, Homo sapiens
ctctctccatctcagtggcc

SEQ ID NO: 8223556 - DNA, 22 bp, Homo sapiens
ctctgctgcaggaaggcgtgca

SEQ ID NO: 8223557 - DNA, 22 bp, Homo sapiens
ctctgctgcaggaaggcgtgca

SEQ ID NO: 8223558 - DNA, 22 bp, Homo sapiens
ctctctccttagctgcagacca

SEQ ID NO: 8223559 - DNA, 17 bp, Homo sapiens
ctctggaattggtgaag

SEQ ID NO: 8223560 - DNA, 17 bp, Homo sapiens
ctctggaattggtgaag

SEQ ID NO: 8223561 - DNA, 17 bp, Homo sapiens
ctctggaattggtgaag

SEQ ID NO: 8223562 - DNA, 17 bp, Homo sapiens
ctctggaattggtgaag

SEQ ID NO: 8223563 - DNA, 22 bp, Homo sapiens
cctgcccctcaaggcctggtgc

SEQ ID NO: 8223564 - DNA, 22 bp, Homo sapiens
cctgcccccgtcagaggtgatg

SEQ ID NO: 8223565 - DNA, 22 bp, Homo sapiens
cctgcccatactgacctctaat

SEQ ID NO: 8223566 - DNA, 22 bp, Homo sapiens
cctgcccatactgacctctaat

SEQ ID NO: 8223567 - DNA, 22 bp, Homo sapiens
cctgcccatcccgtccttggcc

SEQ ID NO: 8223568 - DNA, 22 bp, Homo sapiens
cctgcccatcccgtccttggcc

SEQ ID NO: 8223569 - DNA, 22 bp, Homo sapiens
cctgcccagggtcaccacagag

SEQ ID NO: 8223570 - DNA, 22 bp, Homo sapiens
cctgcccagggtcaccacagag

SEQ ID NO: 8223571 - DNA, 22 bp, Homo sapiens
cctgcccagggtcaccacagag

SEQ ID NO: 8223572 - DNA, 22 bp, Homo sapiens
cctgccctagagatgacacaat

SEQ ID NO: 8223573 - DNA, 22 bp, Homo sapiens
cctgccctatgaccagcttcac

SEQ ID NO: 8223574 - DNA, 22 bp, Homo sapiens
cctgccctatgaccagcttcac

SEQ ID NO: 8223575 - DNA, 22 bp, Homo sapiens
cctgccctatgaccagcttcac

SEQ ID NO: 8223576 - DNA, 19 bp, Homo sapiens
cctctgccagcccgcctct

SEQ ID NO: 8223577 - DNA, 22 bp, Homo sapiens
cctctgccacctcccacgaggc

SEQ ID NO: 8223578 - DNA, 22 bp, Homo sapiens
cctgccaggacattgcttgaag

SEQ ID NO: 8223579 - DNA, 22 bp, Homo sapiens
cctgccaggacattgcttgaag

SEQ ID NO: 8223580 - DNA, 22 bp, Homo sapiens
cctgcccagcttcacctcaggc

SEQ ID NO: 8223581 - DNA, 23 bp, Homo sapiens
cctgcccaggaatccggcggcgt

SEQ ID NO: 8223582 - DNA, 22 bp, Homo sapiens
cctgcccagcttcccgagtgca

SEQ ID NO: 8223583 - DNA, 22 bp, Homo sapiens
cctgcccagcttcccgagtgca

SEQ ID NO: 8223584 - DNA, 22 bp, Homo sapiens
cctgcccaggagtctctctgtg

SEQ ID NO: 8223585 - DNA, 22 bp, Homo sapiens
cctgcccaggagtctctctgtg

SEQ ID NO: 8223586 - DNA, 22 bp, Homo sapiens
cctgcccaggccctaagttagg

SEQ ID NO: 8223587 - DNA, 22 bp, Homo sapiens
cctgcccaggagtctctctgtg

SEQ ID NO: 8223588 - DNA, 22 bp, Homo sapiens
cctctgcaccatagccttcagc

SEQ ID NO: 8223589 - DNA, 22 bp, Homo sapiens
cctctgcaccatagccttcagc

SEQ ID NO: 8223590 - DNA, 22 bp, Homo sapiens
cctctgagttggcctgtcttgt

SEQ ID NO: 8223591 - DNA, 22 bp, Homo sapiens
cctctgagttagagatctagat

SEQ ID NO: 8223592 - DNA, 22 bp, Homo sapiens
cctctgagtgacagcctcctct

SEQ ID NO: 8223593 - DNA, 22 bp, Homo sapiens
cctctgagtgacagcctcctct

SEQ ID NO: 8223594 - DNA, 22 bp, Homo sapiens
cctctgagtgctttgagggaga

SEQ ID NO: 8223595 - DNA, 22 bp, Homo sapiens
cctctgcacttcaccttagctc

SEQ ID NO: 8223596 - DNA, 22 bp, Homo sapiens
cctctgcagcagagagccagag

SEQ ID NO: 8223597 - DNA, 22 bp, Homo sapiens
cctctgcagcagagagccagag

SEQ ID NO: 8223598 - DNA, 22 bp, Homo sapiens
cctctgcagcagagagccagag

SEQ ID NO: 8223599 - DNA, 22 bp, Homo sapiens
cctctgccacctcccacgaggc

SEQ ID NO: 8223600 - DNA, 22 bp, Homo sapiens
cctctgcatctggctgctgcag

SEQ ID NO: 8223601 - DNA, 22 bp, Homo sapiens
cctctctccaattttcacctca

SEQ ID NO: 8223602 - DNA, 22 bp, Homo sapiens
cctctctccaattttcacctca

SEQ ID NO: 8223603 - DNA, 22 bp, Homo sapiens
cctctctccaattttcacctca

SEQ ID NO: 8223604 - DNA, 22 bp, Homo sapiens
cctctctccaattttcacctca

SEQ ID NO: 8223605 - DNA, 22 bp, Homo sapiens
cctctctccttcctttgccaaa

SEQ ID NO: 8223606 - DNA, 22 bp, Homo sapiens
cctctctccttcctttgccaaa

SEQ ID NO: 8223607 - DNA, 23 bp, Homo sapiens
cctctctccctgtttggcaaata

SEQ ID NO: 8223608 - DNA, 23 bp, Homo sapiens
cctctctccctgtttggcaaata

SEQ ID NO: 8223609 - DNA, 22 bp, Homo sapiens
cctctctctcctgcacacacac

SEQ ID NO: 8223610 - DNA, 22 bp, Homo sapiens
cctctctctcctgcacacacac

SEQ ID NO: 8223611 - DNA, 22 bp, Homo sapiens
cctctctccttcctttgccaaa

SEQ ID NO: 8223612 - DNA, 22 bp, Homo sapiens
cctctctctcctgcacacacac

SEQ ID NO: 8223613 - DNA, 22 bp, Homo sapiens
cctctctctcctgcacacacac

SEQ ID NO: 8223614 - DNA, 22 bp, Homo sapiens
cctctctctcctgcacacacac

SEQ ID NO: 8223615 - DNA, 22 bp, Homo sapiens
cctctctctgcatctggagggc

SEQ ID NO: 8223616 - DNA, 22 bp, Homo sapiens
cctctctctgcatctggagggc

SEQ ID NO: 8223617 - DNA, 22 bp, Homo sapiens
cctctctcttgtagtccctgcc

SEQ ID NO: 8223618 - DNA, 22 bp, Homo sapiens
cctctctcttgtagtccctgcc

SEQ ID NO: 8223619 - DNA, 22 bp, Homo sapiens
cctctctcttgtagtccctgcc

SEQ ID NO: 8223620 - DNA, 20 bp, Homo sapiens
agggtcagagagcgtgagtg

SEQ ID NO: 8223621 - DNA, 22 bp, Homo sapiens
agggtcagagatcggccatgtg

SEQ ID NO: 8223622 - DNA, 22 bp, Homo sapiens
agggtcagagatcggccatgtg

SEQ ID NO: 8223623 - DNA, 22 bp, Homo sapiens
agggtcagagatcggccatgtg

SEQ ID NO: 8223624 - DNA, 20 bp, Homo sapiens
agggtcagagagcgtgagtg

SEQ ID NO: 8223625 - DNA, 22 bp, Homo sapiens
agggtcagagtcaggtgcagta

SEQ ID NO: 8223626 - DNA, 22 bp, Homo sapiens
agggtcagagtcaggtgcagta

SEQ ID NO: 8223627 - DNA, 22 bp, Homo sapiens
agggtcagctggctgtcagggg

SEQ ID NO: 8223628 - DNA, 19 bp, Homo sapiens
agggtcaggacaaggactt

SEQ ID NO: 8223629 - DNA, 21 bp, Homo sapiens
agggtcaggaaccagggtacc

SEQ ID NO: 8223630 - DNA, 21 bp, Homo sapiens
agggtcaggaaccagggtacc

SEQ ID NO: 8223631 - DNA, 20 bp, Homo sapiens
agggtcagtagcacagagct

SEQ ID NO: 8223632 - DNA, 22 bp, Homo sapiens
agggtcaggagacactggcaac

SEQ ID NO: 8223633 - DNA, 19 bp, Homo sapiens
agggtcaggacaaggactt

SEQ ID NO: 8223634 - DNA, 22 bp, Homo sapiens
agggtcaggagacactggcaac

SEQ ID NO: 8223635 - DNA, 19 bp, Homo sapiens
agggtcaggacaaggactt

SEQ ID NO: 8223636 - DNA, 19 bp, Homo sapiens
agggtcaggacaaggactt

SEQ ID NO: 8223637 - DNA, 17 bp, Homo sapiens
agggtcaggtgaagttc

SEQ ID NO: 8223638 - DNA, 22 bp, Homo sapiens
agggtcagggagtgagtattta

SEQ ID NO: 8223639 - DNA, 22 bp, Homo sapiens
agggtctcagagcctgagaacc

SEQ ID NO: 8223640 - DNA, 22 bp, Homo sapiens
agggtccttctgttcctgagca

SEQ ID NO: 8223641 - DNA, 22 bp, Homo sapiens
agggtccttctgttcctgagca

SEQ ID NO: 8223642 - DNA, 22 bp, Homo sapiens
agggtccttctgttcctgagca

SEQ ID NO: 8223643 - DNA, 22 bp, Homo sapiens
agggtccttctgttcctgagca

SEQ ID NO: 8223644 - DNA, 22 bp, Homo sapiens
agggtcctgggtgcagttgctt

SEQ ID NO: 8223645 - DNA, 22 bp, Homo sapiens
agggtcctgagcctggggcgca

SEQ ID NO: 8223646 - DNA, 21 bp, Homo sapiens
agggtcctacagggctcagga

SEQ ID NO: 8223647 - DNA, 21 bp, Homo sapiens
agggtcctacagggctcagga

SEQ ID NO: 8223648 - DNA, 22 bp, Homo sapiens
agggtctgtggatgcatctggg

SEQ ID NO: 8223649 - DNA, 22 bp, Homo sapiens
agggtctgtggatgcatctggg

SEQ ID NO: 8223650 - DNA, 22 bp, Homo sapiens
agggtctttcctgggagccagc

SEQ ID NO: 8223651 - DNA, 22 bp, Homo sapiens
agggtgaatctcacaactctta

SEQ ID NO: 8223652 - DNA, 22 bp, Homo sapiens
agggtgaatctcacaactctta

SEQ ID NO: 8223653 - DNA, 22 bp, Homo sapiens
agggtgaatctcacaactctta

SEQ ID NO: 8223654 - DNA, 20 bp, Homo sapiens
agggtgagacatgagcctcc

SEQ ID NO: 8223655 - DNA, 20 bp, Homo sapiens
agggtgagacatgagcctcc

SEQ ID NO: 8223656 - DNA, 20 bp, Homo sapiens
agggtgagacatgagcctcc

SEQ ID NO: 8223657 - DNA, 23 bp, Homo sapiens
agggtgagcaagctatggagacc

SEQ ID NO: 8223658 - DNA, 22 bp, Homo sapiens
agggtctctacgcactagaggg

SEQ ID NO: 8223659 - DNA, 22 bp, Homo sapiens
agggtctctggagagctgagga

SEQ ID NO: 8223660 - DNA, 22 bp, Homo sapiens
agggtctctggagagctgagga

SEQ ID NO: 8223661 - DNA, 22 bp, Homo sapiens
agggtctcttgccatgcctcag

SEQ ID NO: 8223662 - DNA, 22 bp, Homo sapiens
agggtctcttgccatgcctcag

SEQ ID NO: 8223663 - DNA, 22 bp, Homo sapiens
agggtctgaccaccagtaggga

SEQ ID NO: 8223664 - DNA, 22 bp, Homo sapiens
agggtctcttgccatgcctcag

SEQ ID NO: 8223665 - DNA, 22 bp, Homo sapiens
agggtctgaccaccagtaggga

SEQ ID NO: 8223666 - DNA, 20 bp, Homo sapiens
agggtctggccctgttcctt

SEQ ID NO: 8223667 - DNA, 20 bp, Homo sapiens
agggtctgctgggtaggaca

SEQ ID NO: 8223668 - DNA, 22 bp, Homo sapiens
agggtctgactgaatggaaaag

SEQ ID NO: 8223669 - DNA, 22 bp, Homo sapiens
cctggccacagggctctgcatt

SEQ ID NO: 8223670 - DNA, 22 bp, Homo sapiens
cctggccacagggctctgcatt

SEQ ID NO: 8223671 - DNA, 22 bp, Homo sapiens
cctggccacagggctctgcatt

SEQ ID NO: 8223672 - DNA, 20 bp, Homo sapiens
cctggccaatgagataggaa

SEQ ID NO: 8223673 - DNA, 20 bp, Homo sapiens
cctggccaatgagataggaa

SEQ ID NO: 8223674 - DNA, 20 bp, Homo sapiens
cctggccaatgagataggaa

SEQ ID NO: 8223675 - DNA, 22 bp, Homo sapiens
cctggccacccagccttggcca

SEQ ID NO: 8223676 - DNA, 22 bp, Homo sapiens
cctggccactcaggtgtggggc

SEQ ID NO: 8223677 - DNA, 19 bp, Homo sapiens
cctggccagacttctgccc

SEQ ID NO: 8223678 - DNA, 22 bp, Homo sapiens
cctggccagaggcgtgcctgtg

SEQ ID NO: 8223679 - DNA, 22 bp, Homo sapiens
cctggccagaggcgtgcctgtg

SEQ ID NO: 8223680 - DNA, 22 bp, Homo sapiens
cctggcagctccgtggccttcc

SEQ ID NO: 8223681 - DNA, 22 bp, Homo sapiens
cctggcagctcctccccggcgg

SEQ ID NO: 8223682 - DNA, 22 bp, Homo sapiens
cctggcagctcctccccggcgg

SEQ ID NO: 8223683 - DNA, 22 bp, Homo sapiens
cctggcagctccgtggccttcc

SEQ ID NO: 8223684 - DNA, 22 bp, Homo sapiens
cctggcagctaagtgctttgag

SEQ ID NO: 8223685 - DNA, 22 bp, Homo sapiens
cctggcagctccgtggccttcc

SEQ ID NO: 8223686 - DNA, 22 bp, Homo sapiens
cctggcagctccgtggccttcc

SEQ ID NO: 8223687 - DNA, 22 bp, Homo sapiens
cctggcagctcctccccggcgg

SEQ ID NO: 8223688 - DNA, 22 bp, Homo sapiens
cctggcagctgtttggcttggc

SEQ ID NO: 8223689 - DNA, 22 bp, Homo sapiens
cctggcagctgtttggcttggc

SEQ ID NO: 8223690 - DNA, 22 bp, Homo sapiens
cctggcagctgtttggcttggc

SEQ ID NO: 8223691 - DNA, 22 bp, Homo sapiens
cctggcagctgtttggcttggc

SEQ ID NO: 8223692 - DNA, 22 bp, Homo sapiens
cctggcagctgtttggcttggc

SEQ ID NO: 8223693 - DNA, 22 bp, Homo sapiens
cctggccaatctagggctgtta

SEQ ID NO: 8223694 - DNA, 21 bp, Homo sapiens
cctggccaatctgatagggtt

SEQ ID NO: 8223695 - DNA, 21 bp, Homo sapiens
cctggccaatctgatagggtt

SEQ ID NO: 8223696 - DNA, 22 bp, Homo sapiens
cctggctgcttcctctgccatg

SEQ ID NO: 8223697 - DNA, 22 bp, Homo sapiens
cctggctgctttcactatggag

SEQ ID NO: 8223698 - DNA, 22 bp, Homo sapiens
cctggctgctttcactatggag

SEQ ID NO: 8223699 - DNA, 22 bp, Homo sapiens
cctggctgctttcactatggag

SEQ ID NO: 8223700 - DNA, 22 bp, Homo sapiens
cctggctggatggagcccctgg

SEQ ID NO: 8223701 - DNA, 22 bp, Homo sapiens
cctggctggatggagcccctgg

SEQ ID NO: 8223702 - DNA, 22 bp, Homo sapiens
cctggctggatggagcccctgg

SEQ ID NO: 8223703 - DNA, 22 bp, Homo sapiens
cctggctggactggaccgtggc

SEQ ID NO: 8223704 - DNA, 22 bp, Homo sapiens
cctggctggactggaccgtggc

SEQ ID NO: 8223705 - DNA, 22 bp, Homo sapiens
cctggctggactggaccgtggc

SEQ ID NO: 8223706 - DNA, 22 bp, Homo sapiens
cctggctggactggaccgtggc

SEQ ID NO: 8223707 - DNA, 19 bp, Homo sapiens
cctggctgctgtgggatgc

SEQ ID NO: 8223708 - DNA, 19 bp, Homo sapiens
cctggctgctgtgggatgc

SEQ ID NO: 8223709 - DNA, 19 bp, Homo sapiens
cctggctgctgtgggatgc

SEQ ID NO: 8223710 - DNA, 22 bp, Homo sapiens
cctggctgctgtcactgaccat

SEQ ID NO: 8223711 - DNA, 22 bp, Homo sapiens
cctggctctgtcctcgcgcaaa

SEQ ID NO: 8223712 - DNA, 22 bp, Homo sapiens
cctgggaaggtgaggccctgga

SEQ ID NO: 8223713 - DNA, 22 bp, Homo sapiens
cctgggaagtcagccaaggacg

SEQ ID NO: 8223714 - DNA, 22 bp, Homo sapiens
cctgggaaggtgaggccctgga

SEQ ID NO: 8223715 - DNA, 22 bp, Homo sapiens
cctggctggtggcagcgacaag

SEQ ID NO: 8223716 - DNA, 20 bp, Homo sapiens
cctggctggtggaggaaagg

SEQ ID NO: 8223717 - DNA, 22 bp, Homo sapiens
cctggctggtggcagcgacaag

SEQ ID NO: 8223718 - DNA, 22 bp, Homo sapiens
cctggctggtggcagcgacaag

SEQ ID NO: 8223719 - DNA, 22 bp, Homo sapiens
cctgggaaggggaagagaattc

SEQ ID NO: 8223720 - DNA, 22 bp, Homo sapiens
cctggctggttgtctgattcta

SEQ ID NO: 8223721 - DNA, 22 bp, Homo sapiens
cctgggaaggggaagagaattc

SEQ ID NO: 8223722 - DNA, 17 bp, Homo sapiens
cctggctgggaatctga

SEQ ID NO: 8223723 - DNA, 17 bp, Homo sapiens
cctggctgggaatctga

SEQ ID NO: 8223724 - DNA, 22 bp, Homo sapiens
cctggctgggcctgatttctca

SEQ ID NO: 8223725 - DNA, 22 bp, Homo sapiens
cctggctgggcctgatttctca

SEQ ID NO: 8223726 - DNA, 22 bp, Homo sapiens
cctggctggggtagaagtgagg

SEQ ID NO: 8223727 - DNA, 22 bp, Homo sapiens
cctggctggtggcagcgacaag

SEQ ID NO: 8223728 - DNA, 22 bp, Homo sapiens
cctggctggatggagcccctgg

SEQ ID NO: 8223729 - DNA, 23 bp, Homo sapiens
cctggctggattctctgcattca

SEQ ID NO: 8223730 - DNA, 23 bp, Homo sapiens
cctggctggattctctgcattca

SEQ ID NO: 8223731 - DNA, 23 bp, Homo sapiens
cctggctggattctctgcattca

SEQ ID NO: 8223732 - DNA, 22 bp, Homo sapiens
cctggctggcaagatcgtgaag

SEQ ID NO: 8223733 - DNA, 17 bp, Homo sapiens
cctggctgggaatctga

SEQ ID NO: 8223734 - DNA, 22 bp, Homo sapiens
cctggacaagtggcttacttgg

SEQ ID NO: 8223735 - DNA, 22 bp, Homo sapiens
cctggacaatgagatgtcaggg

SEQ ID NO: 8223736 - DNA, 22 bp, Homo sapiens
cctggacacccattccttggct

SEQ ID NO: 8223737 - DNA, 22 bp, Homo sapiens
cctggacaatgagatgtcaggg

SEQ ID NO: 8223738 - DNA, 22 bp, Homo sapiens
cctggacagagggcagcggcca

SEQ ID NO: 8223739 - DNA, 22 bp, Homo sapiens
cctggacagggccaggccatgc

SEQ ID NO: 8223740 - DNA, 22 bp, Homo sapiens
cctggacagggccaggccatgc

SEQ ID NO: 8223741 - DNA, 22 bp, Homo sapiens
cctggaagagctgaatcaggca

SEQ ID NO: 8223742 - DNA, 22 bp, Homo sapiens
cctggaagagctgaatcaggca

SEQ ID NO: 8223743 - DNA, 22 bp, Homo sapiens
cctggaagagctgaatcaggca

SEQ ID NO: 8223744 - DNA, 20 bp, Homo sapiens
cctggaagagctccccaggc

SEQ ID NO: 8223745 - DNA, 22 bp, Homo sapiens
cctggaagattcaccactacca

SEQ ID NO: 8223746 - DNA, 22 bp, Homo sapiens
cctggaaggacaatagatagtg

SEQ ID NO: 8223747 - DNA, 22 bp, Homo sapiens
cctggaagctgatgtttaggac

SEQ ID NO: 8223748 - DNA, 22 bp, Homo sapiens
cctggaagtcattcctcgttcc

SEQ ID NO: 8223749 - DNA, 22 bp, Homo sapiens
cctggaagttggaggttgcagt

SEQ ID NO: 8223750 - DNA, 22 bp, Homo sapiens
cctggaaggcaggcatggattg

SEQ ID NO: 8223751 - DNA, 22 bp, Homo sapiens
cctggaaggtgatggtacagca

SEQ ID NO: 8223752 - DNA, 22 bp, Homo sapiens
cctggaaggcaggcatggattg

SEQ ID NO: 8223753 - DNA, 22 bp, Homo sapiens
cctggaaggcaggcatggattg

SEQ ID NO: 8223754 - DNA, 22 bp, Homo sapiens
cctggaaggcaggcatggattg

SEQ ID NO: 8223755 - DNA, 22 bp, Homo sapiens
cctggaaggtgatggtacagca

SEQ ID NO: 8223756 - DNA, 22 bp, Homo sapiens
cctggcagcgccgaagctggcc

SEQ ID NO: 8223757 - DNA, 22 bp, Homo sapiens
cctggcagcgccgaagctggcc

SEQ ID NO: 8223758 - DNA, 22 bp, Homo sapiens
cctggcagcgccgaagctggcc

SEQ ID NO: 8223759 - DNA, 22 bp, Homo sapiens
cctggcagcgccgaagctggcc

SEQ ID NO: 8223760 - DNA, 22 bp, Homo sapiens
cctggcagcgtgccgagctgcg

SEQ ID NO: 8223761 - DNA, 22 bp, Homo sapiens
cctggcagcgtgccgagctgcg

SEQ ID NO: 8223762 - DNA, 22 bp, Homo sapiens
cctggcagcgtgccgagctgcg

SEQ ID NO: 8223763 - DNA, 22 bp, Homo sapiens
cctggcagcgtgccgagctgcg

SEQ ID NO: 8223764 - DNA, 22 bp, Homo sapiens
cctggcagctaagtgctttgag

SEQ ID NO: 8223765 - DNA, 22 bp, Homo sapiens
cctggcagcgtgccgagctgcg

SEQ ID NO: 8223766 - DNA, 22 bp, Homo sapiens
cctggcagcgccgaagctggcc

SEQ ID NO: 8223767 - DNA, 22 bp, Homo sapiens
cctggcagcctcagccaattct

SEQ ID NO: 8223768 - DNA, 22 bp, Homo sapiens
cctggcagcctcagccaattct

SEQ ID NO: 8223769 - DNA, 22 bp, Homo sapiens
cctggcagcctcagccaattct

SEQ ID NO: 8223770 - DNA, 22 bp, Homo sapiens
cctggcagcccagagcgccgct

SEQ ID NO: 8223771 - DNA, 22 bp, Homo sapiens
cctggcagcccagagcgccgct

SEQ ID NO: 8223772 - DNA, 22 bp, Homo sapiens
cctggcagcccagagcgccgct

SEQ ID NO: 8223773 - DNA, 22 bp, Homo sapiens
cctggcagcccagagcgccgct

SEQ ID NO: 8223774 - DNA, 22 bp, Homo sapiens
cctggcacataatagtggctca

SEQ ID NO: 8223775 - DNA, 22 bp, Homo sapiens
cctggcacataatagtggctca

SEQ ID NO: 8223776 - DNA, 22 bp, Homo sapiens
cctggcacataatagtggctca

SEQ ID NO: 8223777 - DNA, 22 bp, Homo sapiens
cctgctctgccaagtcctcttt

SEQ ID NO: 8223778 - DNA, 22 bp, Homo sapiens
cctgctctgccaagtcctcttt

SEQ ID NO: 8223779 - DNA, 22 bp, Homo sapiens
cctgctctgccaagtcctcttt

SEQ ID NO: 8223780 - DNA, 22 bp, Homo sapiens
cctgctctggtttagtcagtct

SEQ ID NO: 8223781 - DNA, 22 bp, Homo sapiens
cctgcctggcttccagaagaga

SEQ ID NO: 8223782 - DNA, 22 bp, Homo sapiens
cctgcctggcttccagaagaga

SEQ ID NO: 8223783 - DNA, 22 bp, Homo sapiens
cctgctctagactctgggaagg

SEQ ID NO: 8223784 - DNA, 22 bp, Homo sapiens
cctgctctaaatctcatggaac

SEQ ID NO: 8223785 - DNA, 22 bp, Homo sapiens
cctgctctccatacactttcta

SEQ ID NO: 8223786 - DNA, 22 bp, Homo sapiens
cctgctctccatacactttcta

SEQ ID NO: 8223787 - DNA, 22 bp, Homo sapiens
cctgctctccatacactttcta

SEQ ID NO: 8223788 - DNA, 22 bp, Homo sapiens
cctgctctccatacactttcta

SEQ ID NO: 8223789 - DNA, 22 bp, Homo sapiens
cctgctctccatacactttcta

SEQ ID NO: 8223790 - DNA, 22 bp, Homo sapiens
cctgctctagactctgggaagg

SEQ ID NO: 8223791 - DNA, 19 bp, Homo sapiens
cctgctgaagtgatgcagc

SEQ ID NO: 8223792 - DNA, 22 bp, Homo sapiens
cctgctcttatagctgtttcca

SEQ ID NO: 8223793 - DNA, 22 bp, Homo sapiens
cctgctcttatagctgtttcca

SEQ ID NO: 8223794 - DNA, 22 bp, Homo sapiens
cctgctcttatagctgtttcca

SEQ ID NO: 8223795 - DNA, 22 bp, Homo sapiens
cctgctgagaccctgaggtggg

SEQ ID NO: 8223796 - DNA, 22 bp, Homo sapiens
cctgctgctatgaaggtgacag

SEQ ID NO: 8223797 - DNA, 22 bp, Homo sapiens
cctggaaagaggaaggaagcct

SEQ ID NO: 8223798 - DNA, 22 bp, Homo sapiens
cctggaaatgtcgcgtgtagaa

SEQ ID NO: 8223799 - DNA, 22 bp, Homo sapiens
cctggaaatgcaaaagccatga

SEQ ID NO: 8223800 - DNA, 22 bp, Homo sapiens
cctggaaatgcaaaagccatga

SEQ ID NO: 8223801 - DNA, 22 bp, Homo sapiens
cctggaaagattgcagttgctg

SEQ ID NO: 8223802 - DNA, 22 bp, Homo sapiens
cggccgcagcagtgtcggccca

SEQ ID NO: 8223803 - DNA, 22 bp, Homo sapiens
cggctcactgcagctccgcctc

SEQ ID NO: 8223804 - DNA, 20 bp, Homo sapiens
cggctcagcctctccctccc

SEQ ID NO: 8223805 - DNA, 22 bp, Homo sapiens
cggctcagacttcccaagaaca

SEQ ID NO: 8223806 - DNA, 22 bp, Homo sapiens
cggctcactgcagctccgcctc

SEQ ID NO: 8223807 - DNA, 22 bp, Homo sapiens
cggctcactgcagctccgcctc

SEQ ID NO: 8223808 - DNA, 22 bp, Homo sapiens
cggctcactgcagctccgcctc

SEQ ID NO: 8223809 - DNA, 22 bp, Homo sapiens
cggctcactgcagctccgcctc

SEQ ID NO: 8223810 - DNA, 22 bp, Homo sapiens
cggctcactgcagctccgcctc

SEQ ID NO: 8223811 - DNA, 22 bp, Homo sapiens
cggctcactgcagctccgcctc

SEQ ID NO: 8223812 - DNA, 22 bp, Homo sapiens
agtatatttgttaagattattc

SEQ ID NO: 8223813 - DNA, 22 bp, Homo sapiens
agtatatttgttaagattattc

SEQ ID NO: 8223814 - DNA, 22 bp, Homo sapiens
agtatattgctcttaatcatag

SEQ ID NO: 8223815 - DNA, 22 bp, Homo sapiens
agtatattggtgttattcctca

SEQ ID NO: 8223816 - DNA, 22 bp, Homo sapiens
agtatatatgaggaaccacaaa

SEQ ID NO: 8223817 - DNA, 22 bp, Homo sapiens
agtatatagtggcgctgtatgc

SEQ ID NO: 8223818 - DNA, 22 bp, Homo sapiens
agtatatagtggcgctgtatgc

SEQ ID NO: 8223819 - DNA, 22 bp, Homo sapiens
agtatatagtggcgctgtatgc

SEQ ID NO: 8223820 - DNA, 22 bp, Homo sapiens
agtatatggggaattgcataat

SEQ ID NO: 8223821 - DNA, 22 bp, Homo sapiens
agtatatgtgcacatatgcatg

SEQ ID NO: 8223822 - DNA, 22 bp, Homo sapiens
agtatattgctcttaatcatag

SEQ ID NO: 8223823 - DNA, 22 bp, Homo sapiens
agtatattgctcttaatcatag

SEQ ID NO: 8223824 - DNA, 22 bp, Homo sapiens
agtatatgtgcacatatgcatg

SEQ ID NO: 8223825 - DNA, 22 bp, Homo sapiens
cggaggggtttgaacagaggag

SEQ ID NO: 8223826 - DNA, 22 bp, Homo sapiens
cggaggggtttgaacagaggag

SEQ ID NO: 8223827 - DNA, 22 bp, Homo sapiens
cggaggggtttgaacagaggag

SEQ ID NO: 8223828 - DNA, 22 bp, Homo sapiens
cggccaagccggggccccgaag

SEQ ID NO: 8223829 - DNA, 22 bp, Homo sapiens
cggccaagccggggccccgaag

SEQ ID NO: 8223830 - DNA, 22 bp, Homo sapiens
cggccaagccggggccccgaag

SEQ ID NO: 8223831 - DNA, 22 bp, Homo sapiens
cggccagtgccgctctcgcctc

SEQ ID NO: 8223832 - DNA, 22 bp, Homo sapiens
cggcccgctgcgagtgcaccgt

SEQ ID NO: 8223833 - DNA, 22 bp, Homo sapiens
cggagcagagccactcgggccg

SEQ ID NO: 8223834 - DNA, 22 bp, Homo sapiens
cggagcagagccactcgggccg

SEQ ID NO: 8223835 - DNA, 22 bp, Homo sapiens
cggagcctgcttgttgcagctg

SEQ ID NO: 8223836 - DNA, 22 bp, Homo sapiens
cgctccaagcttgatgggacca

SEQ ID NO: 8223837 - DNA, 20 bp, Homo sapiens
cgctccagtcgctggtgtgt

SEQ ID NO: 8223838 - DNA, 22 bp, Homo sapiens
cggagaggtgggggcagcatct

SEQ ID NO: 8223839 - DNA, 22 bp, Homo sapiens
cggagcagaaggcgccgccggc

SEQ ID NO: 8223840 - DNA, 22 bp, Homo sapiens
cggagaggtgggggcagcatct

SEQ ID NO: 8223841 - DNA, 22 bp, Homo sapiens
cggagaggtgggggcagcatct

SEQ ID NO: 8223842 - DNA, 22 bp, Homo sapiens
cggagctgcctgccaagcctgc

SEQ ID NO: 8223843 - DNA, 22 bp, Homo sapiens
cggagctgcctgccaagcctgc

SEQ ID NO: 8223844 - DNA, 22 bp, Homo sapiens
cggagctggcgtctgtgtggac

SEQ ID NO: 8223845 - DNA, 22 bp, Homo sapiens
cggagctgcgccgggacacggg

SEQ ID NO: 8223846 - DNA, 23 bp, Homo sapiens
cggaggcaaatcggccatttaag

SEQ ID NO: 8223847 - DNA, 21 bp, Homo sapiens
cggagctgggcagggcatccc

SEQ ID NO: 8223848 - DNA, 22 bp, Homo sapiens
cggagctggcgtctgtgtggac

SEQ ID NO: 8223849 - DNA, 22 bp, Homo sapiens
cggaggcaaactcacctggctc

SEQ ID NO: 8223850 - DNA, 21 bp, Homo sapiens
cggagctgggcagggcatccc

SEQ ID NO: 8223851 - DNA, 22 bp, Homo sapiens
cgaggaggaaacgcggagaact

SEQ ID NO: 8223852 - DNA, 22 bp, Homo sapiens
cgaggccagctctaagccctac

SEQ ID NO: 8223853 - DNA, 22 bp, Homo sapiens
cgctcagactcatgatatgctg

SEQ ID NO: 8223854 - DNA, 23 bp, Homo sapiens
cgctcagaggttctgtccttggt

SEQ ID NO: 8223855 - DNA, 22 bp, Homo sapiens
cgaggccaccgtggtttccgag

SEQ ID NO: 8223856 - DNA, 20 bp, Homo sapiens
cgaggccaaggggctgggcc

SEQ ID NO: 8223857 - DNA, 20 bp, Homo sapiens
cgaggccaaggggctgggcc

SEQ ID NO: 8223858 - DNA, 22 bp, Homo sapiens
ccttttatagatcagtgtgtta

SEQ ID NO: 8223859 - DNA, 22 bp, Homo sapiens
ccttttatatggctcatcacag

SEQ ID NO: 8223860 - DNA, 22 bp, Homo sapiens
ccttttatagatcagtgtgtta

SEQ ID NO: 8223861 - DNA, 22 bp, Homo sapiens
ccttttatatggctcatcacag

SEQ ID NO: 8223862 - DNA, 22 bp, Homo sapiens
ccttttatgaacttgagcaggt

SEQ ID NO: 8223863 - DNA, 22 bp, Homo sapiens
ccttttataaagttgtattgaa

SEQ ID NO: 8223864 - DNA, 22 bp, Homo sapiens
ccttttatactcagtgatatca

SEQ ID NO: 8223865 - DNA, 22 bp, Homo sapiens
ccttttataaagttgtattgaa

SEQ ID NO: 8223866 - DNA, 22 bp, Homo sapiens
ccttttatactctgtcctctgg

SEQ ID NO: 8223867 - DNA, 22 bp, Homo sapiens
ccttttatactctgtcctctgg

SEQ ID NO: 8223868 - DNA, 22 bp, Homo sapiens
ccttttatactcagtgatatca

SEQ ID NO: 8223869 - DNA, 22 bp, Homo sapiens
cgaggaaatatttacaactgat

SEQ ID NO: 8223870 - DNA, 22 bp, Homo sapiens
cgaggaaaggcgatggctctcg

SEQ ID NO: 8223871 - DNA, 22 bp, Homo sapiens
cgaggaagaagtttgagtcaag

SEQ ID NO: 8223872 - DNA, 22 bp, Homo sapiens
ccttttatgaacttgagcaggt

SEQ ID NO: 8223873 - DNA, 22 bp, Homo sapiens
cgagcatgatgacggctgtggc

SEQ ID NO: 8223874 - DNA, 22 bp, Homo sapiens
cctttattcaattagtcctaat

SEQ ID NO: 8223875 - DNA, 22 bp, Homo sapiens
cctttggtcacctccactctta

SEQ ID NO: 8223876 - DNA, 22 bp, Homo sapiens
cctttggtcacctccactctta

SEQ ID NO: 8223877 - DNA, 22 bp, Homo sapiens
cctttggtcttgatgaactgtt

SEQ ID NO: 8223878 - DNA, 22 bp, Homo sapiens
cctttggtggttttcagagatc

SEQ ID NO: 8223879 - DNA, 22 bp, Homo sapiens
cctttggtgttattgggagaca

SEQ ID NO: 8223880 - DNA, 19 bp, Homo sapiens
cctttggtttccatgacat

SEQ ID NO: 8223881 - DNA, 22 bp, Homo sapiens
aggtggggtgagctgcagacta

SEQ ID NO: 8223882 - DNA, 22 bp, Homo sapiens
aggtggggtgagctgcagacta

SEQ ID NO: 8223883 - DNA, 22 bp, Homo sapiens
aggtggggtgagctgcagacta

SEQ ID NO: 8223884 - DNA, 22 bp, Homo sapiens
aggtgggggctgtgtccttgac

SEQ ID NO: 8223885 - DNA, 22 bp, Homo sapiens
aggtggggtgttggatgtttat

SEQ ID NO: 8223886 - DNA, 22 bp, Homo sapiens
aggtggggtgagctgcagacta

SEQ ID NO: 8223887 - DNA, 22 bp, Homo sapiens
cctttattcaattagtcctaat

SEQ ID NO: 8223888 - DNA, 22 bp, Homo sapiens
cctttattcaattagtcctaat

SEQ ID NO: 8223889 - DNA, 22 bp, Homo sapiens
cctttattcaattagtcctaat

SEQ ID NO: 8223890 - DNA, 22 bp, Homo sapiens
aggtggggtgagctgcagacta

SEQ ID NO: 8223891 - DNA, 22 bp, Homo sapiens
aggtggggtgttggatgtttat

SEQ ID NO: 8223892 - DNA, 21 bp, Homo sapiens
aggtggggctgcacctctgct

SEQ ID NO: 8223893 - DNA, 22 bp, Homo sapiens
aggtggggctgggaaagattcc

SEQ ID NO: 8223894 - DNA, 22 bp, Homo sapiens
aggtgggggctgtgtccttgac

SEQ ID NO: 8223895 - DNA, 22 bp, Homo sapiens
aggtggggctgggaaagattcc

SEQ ID NO: 8223896 - DNA, 22 bp, Homo sapiens
ccttggcatgtggcatgtggct

SEQ ID NO: 8223897 - DNA, 22 bp, Homo sapiens
ccttggcaaaccagggcagctg

SEQ ID NO: 8223898 - DNA, 22 bp, Homo sapiens
ccttggattttgtgcccacgcc

SEQ ID NO: 8223899 - DNA, 22 bp, Homo sapiens
ccttggcaaaccagggcagctg

SEQ ID NO: 8223900 - DNA, 22 bp, Homo sapiens
ccttggcaaaccagggcagctg

SEQ ID NO: 8223901 - DNA, 22 bp, Homo sapiens
ccttggcaagacagtggagggt

SEQ ID NO: 8223902 - DNA, 22 bp, Homo sapiens
ccttgctcatcccccagtgcct

SEQ ID NO: 8223903 - DNA, 22 bp, Homo sapiens
ccttgctgaccatcacctttga

SEQ ID NO: 8223904 - DNA, 22 bp, Homo sapiens
ccttgctcggggagctgcagga

SEQ ID NO: 8223905 - DNA, 22 bp, Homo sapiens
ccttgccttggtccttcgcagg

SEQ ID NO: 8223906 - DNA, 20 bp, Homo sapiens
ccttctctggaattgcctcc

SEQ ID NO: 8223907 - DNA, 20 bp, Homo sapiens
ccttctctggaattgcctcc

SEQ ID NO: 8223908 - DNA, 22 bp, Homo sapiens
ccttctctgcaggtagttggct

SEQ ID NO: 8223909 - DNA, 22 bp, Homo sapiens
ccttgcgttttacagcttctag

SEQ ID NO: 8223910 - DNA, 19 bp, Homo sapiens
ccttggagttccaggtgga

SEQ ID NO: 8223911 - DNA, 19 bp, Homo sapiens
ccttggagttccaggtgga

SEQ ID NO: 8223912 - DNA, 22 bp, Homo sapiens
ccttggagcggtcagcactggt

SEQ ID NO: 8223913 - DNA, 22 bp, Homo sapiens
ccttggagacctgggtctgtgc

SEQ ID NO: 8223914 - DNA, 22 bp, Homo sapiens
ccttgctgcgtgctagcacaga

SEQ ID NO: 8223915 - DNA, 17 bp, Homo sapiens
aggtggctgctgcgcct

SEQ ID NO: 8223916 - DNA, 17 bp, Homo sapiens
aggtggctgctgcgcct

SEQ ID NO: 8223917 - DNA, 22 bp, Homo sapiens
aggtggctgcctccccgcgcgg

SEQ ID NO: 8223918 - DNA, 17 bp, Homo sapiens
aggtggctgctgcgcct

SEQ ID NO: 8223919 - DNA, 22 bp, Homo sapiens
aggtggctgcctccccgcgcgg

SEQ ID NO: 8223920 - DNA, 21 bp, Homo sapiens
aggtggctgcatcctcagaag

SEQ ID NO: 8223921 - DNA, 21 bp, Homo sapiens
aggtggctgcatcctcagaag

SEQ ID NO: 8223922 - DNA, 21 bp, Homo sapiens
aggtggctgcatcctcagaag

SEQ ID NO: 8223923 - DNA, 22 bp, Homo sapiens
aggtggctgaagagtgggtgag

SEQ ID NO: 8223924 - DNA, 22 bp, Homo sapiens
aggtggctgagctgtgcccctg

SEQ ID NO: 8223925 - DNA, 22 bp, Homo sapiens
aggtggctgagctgtgcccctg

SEQ ID NO: 8223926 - DNA, 19 bp, Homo sapiens
aggtggctgaaactacaga

SEQ ID NO: 8223927 - DNA, 22 bp, Homo sapiens
aggtggctgaagagtgggtgag

SEQ ID NO: 8223928 - DNA, 22 bp, Homo sapiens
aggtggctgaagagtgggtgag

SEQ ID NO: 8223929 - DNA, 22 bp, Homo sapiens
aggtggctgtggcttcccttgt

SEQ ID NO: 8223930 - DNA, 22 bp, Homo sapiens
aggtggcttctggccaggtgtg

SEQ ID NO: 8223931 - DNA, 22 bp, Homo sapiens
aggtggcttctggccaggtgtg

SEQ ID NO: 8223932 - DNA, 22 bp, Homo sapiens
aggtggcttctggccaggtgtg

SEQ ID NO: 8223933 - DNA, 22 bp, Homo sapiens
aggtggcttctggccaggtgtg

SEQ ID NO: 8223934 - DNA, 22 bp, Homo sapiens
aggtggctgtattcagctgtaa

SEQ ID NO: 8223935 - DNA, 22 bp, Homo sapiens
aggtggctgtattcagctgtaa

SEQ ID NO: 8223936 - DNA, 22 bp, Homo sapiens
aggtggctgtattcagctgtaa

SEQ ID NO: 8223937 - DNA, 22 bp, Homo sapiens
aggtggctgtattcagctgtaa

SEQ ID NO: 8223938 - DNA, 22 bp, Homo sapiens
aggtggctgtggcttcccttgt

SEQ ID NO: 8223939 - DNA, 22 bp, Homo sapiens
aggtggctgtattcagctgtaa

SEQ ID NO: 8223940 - DNA, 22 bp, Homo sapiens
aggtggctggtccaggctgcag

SEQ ID NO: 8223941 - DNA, 22 bp, Homo sapiens
aggtggctggtccaggctgcag

SEQ ID NO: 8223942 - DNA, 22 bp, Homo sapiens
aggtggctggtccaggctgcag

SEQ ID NO: 8223943 - DNA, 22 bp, Homo sapiens
aggtggctggtccaggctgcag

SEQ ID NO: 8223944 - DNA, 22 bp, Homo sapiens
aggtggctggtccaggctgcag

SEQ ID NO: 8223945 - DNA, 22 bp, Homo sapiens
ccttctctgcaggtagttggct

SEQ ID NO: 8223946 - DNA, 22 bp, Homo sapiens
aggtgggcaatgaggcctgagt

SEQ ID NO: 8223947 - DNA, 22 bp, Homo sapiens
ccttctctctgaagaccccaaa

SEQ ID NO: 8223948 - DNA, 21 bp, Homo sapiens
aggtgggagaccatgtaggtc

SEQ ID NO: 8223949 - DNA, 21 bp, Homo sapiens
aggtgggagaccatgtaggtc

SEQ ID NO: 8223950 - DNA, 21 bp, Homo sapiens
aggtgggagaccatgtaggtc

SEQ ID NO: 8223951 - DNA, 22 bp, Homo sapiens
aggtgggacccgtggggtgcga

SEQ ID NO: 8223952 - DNA, 21 bp, Homo sapiens
aggtgggagaccatgtaggtc

SEQ ID NO: 8223953 - DNA, 22 bp, Homo sapiens
aggtgggacccgtggggtgcga

SEQ ID NO: 8223954 - DNA, 22 bp, Homo sapiens
aggtgggaacccagcagggccc

SEQ ID NO: 8223955 - DNA, 22 bp, Homo sapiens
aggtgggaacccagcagggccc

SEQ ID NO: 8223956 - DNA, 22 bp, Homo sapiens
aggtggcttctggccaggtgtg

SEQ ID NO: 8223957 - DNA, 22 bp, Homo sapiens
aggtggcttctggccaggtgtg

SEQ ID NO: 8223958 - DNA, 22 bp, Homo sapiens
aggtggcttctggccaggtgtg

SEQ ID NO: 8223959 - DNA, 22 bp, Homo sapiens
aggtggctttactgtttcttac

SEQ ID NO: 8223960 - DNA, 22 bp, Homo sapiens
aggtgggacccgtggggtgcga

SEQ ID NO: 8223961 - DNA, 22 bp, Homo sapiens
aggtgggacccgtggggtgcga

SEQ ID NO: 8223962 - DNA, 22 bp, Homo sapiens
aggtgggacccgtggggtgcga

SEQ ID NO: 8223963 - DNA, 22 bp, Homo sapiens
aggtgggaacccagcagggccc

SEQ ID NO: 8223964 - DNA, 22 bp, Homo sapiens
aggtgctctaggtatctacttt

SEQ ID NO: 8223965 - DNA, 22 bp, Homo sapiens
aggtgctctaggtatctacttt

SEQ ID NO: 8223966 - DNA, 22 bp, Homo sapiens
aggtgcctgtcgtctctggtta

SEQ ID NO: 8223967 - DNA, 22 bp, Homo sapiens
aggtgcctgggagctccctgag

SEQ ID NO: 8223968 - DNA, 22 bp, Homo sapiens
aggtgcctatctggtctctgca

SEQ ID NO: 8223969 - DNA, 22 bp, Homo sapiens
aggtgcctatctggtctctgca

SEQ ID NO: 8223970 - DNA, 22 bp, Homo sapiens
aggtgcctatctggtctctgca

SEQ ID NO: 8223971 - DNA, 18 bp, Homo sapiens
aggtgccctccttacact

SEQ ID NO: 8223972 - DNA, 22 bp, Homo sapiens
aggtgcccatcacctcacagtc

SEQ ID NO: 8223973 - DNA, 22 bp, Homo sapiens
aggtgcccatgagctccatggc

SEQ ID NO: 8223974 - DNA, 22 bp, Homo sapiens
aggtgcaggagctgtgcaggga

SEQ ID NO: 8223975 - DNA, 22 bp, Homo sapiens
aggtgccagctctcaggcagga

SEQ ID NO: 8223976 - DNA, 22 bp, Homo sapiens
aggtgccagctctcaggcagga

SEQ ID NO: 8223977 - DNA, 22 bp, Homo sapiens
aggtgccagctctcaggcagga

SEQ ID NO: 8223978 - DNA, 22 bp, Homo sapiens
cctgggagaactgctgggttgg

SEQ ID NO: 8223979 - DNA, 22 bp, Homo sapiens
aggtgccattgcttgccagttt

SEQ ID NO: 8223980 - DNA, 22 bp, Homo sapiens
aggtgccagtgctgtggtcccc

SEQ ID NO: 8223981 - DNA, 22 bp, Homo sapiens
aggtgccagtgctgtggtcccc

SEQ ID NO: 8223982 - DNA, 22 bp, Homo sapiens
aggtgcaggagctgtgcaggga

SEQ ID NO: 8223983 - DNA, 22 bp, Homo sapiens
cctgggagaactgctgggttgg

SEQ ID NO: 8223984 - DNA, 19 bp, Homo sapiens
cctgggacttaggctgggt

SEQ ID NO: 8223985 - DNA, 22 bp, Homo sapiens
cctgggaagttgtggctgcagt

SEQ ID NO: 8223986 - DNA, 22 bp, Homo sapiens
cctgggaagttgtggctgcagt

SEQ ID NO: 8223987 - DNA, 22 bp, Homo sapiens
cctgggaagttgtggctgcagt

SEQ ID NO: 8223988 - DNA, 22 bp, Homo sapiens
cctgggaagttgtggctgcagt

SEQ ID NO: 8223989 - DNA, 22 bp, Homo sapiens
cctgggaagtcagccaaggacg

SEQ ID NO: 8223990 - DNA, 22 bp, Homo sapiens
cctgggacctcgcgggaagcgg

SEQ ID NO: 8223991 - DNA, 22 bp, Homo sapiens
cctgggactcggccaggacaga

SEQ ID NO: 8223992 - DNA, 22 bp, Homo sapiens
cctgggacgactctgtaccctt

SEQ ID NO: 8223993 - DNA, 22 bp, Homo sapiens
cctgggacctcgcgggaagcgg

SEQ ID NO: 8223994 - DNA, 22 bp, Homo sapiens
aggtgctggcgccccaggagac

SEQ ID NO: 8223995 - DNA, 22 bp, Homo sapiens
aggtgctggcgccccaggagac

SEQ ID NO: 8223996 - DNA, 22 bp, Homo sapiens
aggtgctggcgccccaggagac

SEQ ID NO: 8223997 - DNA, 22 bp, Homo sapiens
aggtgctggcgccccaggagac

SEQ ID NO: 8223998 - DNA, 22 bp, Homo sapiens
aggtgctgggcagcagtcattg

SEQ ID NO: 8223999 - DNA, 22 bp, Homo sapiens
aggtgctgggcagcagtcattg

SEQ ID NO: 8224000 - DNA, 22 bp, Homo sapiens
aggtgctggcgccccaggagac

SEQ ID NO: 8224001 - DNA, 22 bp, Homo sapiens
aggtgctggagtctgggcagga

SEQ ID NO: 8224002 - DNA, 22 bp, Homo sapiens
aggtgctggagtctgggcagga

SEQ ID NO: 8224003 - DNA, 22 bp, Homo sapiens
aggtgctggagtctgggcagga

SEQ ID NO: 8224004 - DNA, 22 bp, Homo sapiens
aggtgctggagtctgggcagga

SEQ ID NO: 8224005 - DNA, 21 bp, Homo sapiens
aggtgctggcgccccaggaga

SEQ ID NO: 8224006 - DNA, 22 bp, Homo sapiens
aggtgctggagtagaagaaaaa

SEQ ID NO: 8224007 - DNA, 22 bp, Homo sapiens
aggtgctggagtctgggcagga

SEQ ID NO: 8224008 - DNA, 22 bp, Homo sapiens
aggtgctggagtagaagaaaaa

SEQ ID NO: 8224009 - DNA, 17 bp, Homo sapiens
aggtgctggagcatcag

SEQ ID NO: 8224010 - DNA, 17 bp, Homo sapiens
aggtgctggagcatcag

SEQ ID NO: 8224011 - DNA, 22 bp, Homo sapiens
aggtgctgccccgagaaggatg

SEQ ID NO: 8224012 - DNA, 22 bp, Homo sapiens
aggtgccttccgcggagctcgc

SEQ ID NO: 8224013 - DNA, 22 bp, Homo sapiens
aggtgctgaactggtgaggtct

SEQ ID NO: 8224014 - DNA, 22 bp, Homo sapiens
aggtgctgggcagcagtcattg

SEQ ID NO: 8224015 - DNA, 22 bp, Homo sapiens
aggtgctgggcagcagtcattg

SEQ ID NO: 8224016 - DNA, 22 bp, Homo sapiens
aggtgctgtgctatgcacttgt

SEQ ID NO: 8224017 - DNA, 22 bp, Homo sapiens
aggtgctgtgctatgcacttgt

SEQ ID NO: 8224018 - DNA, 22 bp, Homo sapiens
aggtgctgtttgtcagcagttt

SEQ ID NO: 8224019 - DNA, 22 bp, Homo sapiens
aggtgctgtttgtcagcagttt

SEQ ID NO: 8224020 - DNA, 22 bp, Homo sapiens
aggtgctgtttgtcagcagttt

SEQ ID NO: 8224021 - DNA, 22 bp, Homo sapiens
aggtgctgttggcagcgggcag

SEQ ID NO: 8224022 - DNA, 22 bp, Homo sapiens
aggtgctgtgctatgcacttgt

SEQ ID NO: 8224023 - DNA, 22 bp, Homo sapiens
aggtgctgttggcagcgggcag

SEQ ID NO: 8224024 - DNA, 22 bp, Homo sapiens
aggtgctgttggcagcgggcag

SEQ ID NO: 8224025 - DNA, 22 bp, Homo sapiens
aggtggctctgacagctctggt

SEQ ID NO: 8224026 - DNA, 22 bp, Homo sapiens
aggtggcatgagactgtaccag

SEQ ID NO: 8224027 - DNA, 22 bp, Homo sapiens
aggtgctgtttgtcagcagttt

SEQ ID NO: 8224028 - DNA, 22 bp, Homo sapiens
aggtgctgtttgtcagcagttt

SEQ ID NO: 8224029 - DNA, 22 bp, Homo sapiens
aggtgctgtttgtcagcagttt

SEQ ID NO: 8224030 - DNA, 22 bp, Homo sapiens
aggtggcagttgtggaaccatc

SEQ ID NO: 8224031 - DNA, 22 bp, Homo sapiens
aggtggcagttgtggaaccatc

SEQ ID NO: 8224032 - DNA, 22 bp, Homo sapiens
aggtggctctgacagctctggt

SEQ ID NO: 8224033 - DNA, 22 bp, Homo sapiens
aggtggctctgacagctctggt

SEQ ID NO: 8224034 - DNA, 22 bp, Homo sapiens
aggtggctctgacagctctggt

SEQ ID NO: 8224035 - DNA, 22 bp, Homo sapiens
aggtggctctgacagctctggt

SEQ ID NO: 8224036 - DNA, 20 bp, Homo sapiens
aggtggctcttcctgggctt

SEQ ID NO: 8224037 - DNA, 20 bp, Homo sapiens
aggtggctcttcctgggctt

SEQ ID NO: 8224038 - DNA, 20 bp, Homo sapiens
aggtggctcttcctgggctt

SEQ ID NO: 8224039 - DNA, 20 bp, Homo sapiens
aggtggctcttcctgggctt

SEQ ID NO: 8224040 - DNA, 20 bp, Homo sapiens
aggtggctcttcctgggctt

SEQ ID NO: 8224041 - DNA, 20 bp, Homo sapiens
aggtggctcttcctgggctt

SEQ ID NO: 8224042 - DNA, 20 bp, Homo sapiens
aggtggctcttcctgggctt

SEQ ID NO: 8224043 - DNA, 22 bp, Homo sapiens
aggcattttctgtatggacaga

SEQ ID NO: 8224044 - DNA, 22 bp, Homo sapiens
aggccaagattttggatcagct

SEQ ID NO: 8224045 - DNA, 22 bp, Homo sapiens
aggccaagctcccagagaagct

SEQ ID NO: 8224046 - DNA, 22 bp, Homo sapiens
aggccaagctcccagagaagct

SEQ ID NO: 8224047 - DNA, 22 bp, Homo sapiens
aggccaagctcccagagaagct

SEQ ID NO: 8224048 - DNA, 22 bp, Homo sapiens
aggccaagattttggatcagct

SEQ ID NO: 8224049 - DNA, 22 bp, Homo sapiens
aggccaagattttggatcagct

SEQ ID NO: 8224050 - DNA, 22 bp, Homo sapiens
aggccaagattttggatcagct

SEQ ID NO: 8224051 - DNA, 22 bp, Homo sapiens
aggccaagattttggatcagct

SEQ ID NO: 8224052 - DNA, 22 bp, Homo sapiens
aggccacaaccaccctgtgccc

SEQ ID NO: 8224053 - DNA, 22 bp, Homo sapiens
aggccacaaccaccctgtgccc

SEQ ID NO: 8224054 - DNA, 22 bp, Homo sapiens
aggccaagttacttgggaaagc

SEQ ID NO: 8224055 - DNA, 22 bp, Homo sapiens
aggccaagtgctgggacaggtg

SEQ ID NO: 8224056 - DNA, 22 bp, Homo sapiens
aggccaagtgctgggacaggtg

SEQ ID NO: 8224057 - DNA, 22 bp, Homo sapiens
aggccaagtgctgggacaggtg

SEQ ID NO: 8224058 - DNA, 22 bp, Homo sapiens
aggccaagtgctgggacaggtg

SEQ ID NO: 8224059 - DNA, 22 bp, Homo sapiens
aggccaagtgctgggacaggtg

SEQ ID NO: 8224060 - DNA, 22 bp, Homo sapiens
aggccaagtgctgggacaggtg

SEQ ID NO: 8224061 - DNA, 22 bp, Homo sapiens
aggccaagggcaaagcggagag

SEQ ID NO: 8224062 - DNA, 22 bp, Homo sapiens
aggccaagggcaaagcggagag

SEQ ID NO: 8224063 - DNA, 22 bp, Homo sapiens
aggccaagggcaaagcggagag

SEQ ID NO: 8224064 - DNA, 22 bp, Homo sapiens
aggccaagtgaacaatgctagt

SEQ ID NO: 8224065 - DNA, 22 bp, Homo sapiens
aggccaagtagccgctgtccta

SEQ ID NO: 8224066 - DNA, 22 bp, Homo sapiens
aggccaagtagctagcattgaa

SEQ ID NO: 8224067 - DNA, 22 bp, Homo sapiens
aggccaagtagctagcattgaa

SEQ ID NO: 8224068 - DNA, 22 bp, Homo sapiens
aggccagcgctgctagctcccg

SEQ ID NO: 8224069 - DNA, 22 bp, Homo sapiens
aggccagcgctgctagctcccg

SEQ ID NO: 8224070 - DNA, 23 bp, Homo sapiens
aggccagcgcagacaccgagcac

SEQ ID NO: 8224071 - DNA, 22 bp, Homo sapiens
aggccagctatgactctgctcc

SEQ ID NO: 8224072 - DNA, 22 bp, Homo sapiens
aggccagcgctgctagctcccg

SEQ ID NO: 8224073 - DNA, 22 bp, Homo sapiens
aggccagcaagaaagagagtct

SEQ ID NO: 8224074 - DNA, 22 bp, Homo sapiens
aggccacaagaaaatgcttcat

SEQ ID NO: 8224075 - DNA, 22 bp, Homo sapiens
aggccagatgtcgggctagaag

SEQ ID NO: 8224076 - DNA, 22 bp, Homo sapiens
aggccagctgccacccggtccg

SEQ ID NO: 8224077 - DNA, 22 bp, Homo sapiens
aggccagctctacccttggact

SEQ ID NO: 8224078 - DNA, 22 bp, Homo sapiens
aggccagctctacccttggact

SEQ ID NO: 8224079 - DNA, 22 bp, Homo sapiens
aggccagctctacccttggact

SEQ ID NO: 8224080 - DNA, 22 bp, Homo sapiens
aggccagctcaccctggctcct

SEQ ID NO: 8224081 - DNA, 22 bp, Homo sapiens
aggccagctcaccctggctcct

SEQ ID NO: 8224082 - DNA, 22 bp, Homo sapiens
aggccagctcaccctggctcct

SEQ ID NO: 8224083 - DNA, 22 bp, Homo sapiens
aggccagctgttactagagcca

SEQ ID NO: 8224084 - DNA, 22 bp, Homo sapiens
aggccagctgccacccggtccg

SEQ ID NO: 8224085 - DNA, 22 bp, Homo sapiens
aggccagctgttactagagcca

SEQ ID NO: 8224086 - DNA, 22 bp, Homo sapiens
aggccagctgttactagagcca

SEQ ID NO: 8224087 - DNA, 22 bp, Homo sapiens
aggccagctgttactagagcca

SEQ ID NO: 8224088 - DNA, 22 bp, Homo sapiens
aggccagctgttactagagcca

SEQ ID NO: 8224089 - DNA, 22 bp, Homo sapiens
aggccagctgttactagagcca

SEQ ID NO: 8224090 - DNA, 22 bp, Homo sapiens
aggccagcttccagaggggcag

SEQ ID NO: 8224091 - DNA, 22 bp, Homo sapiens
aggccagcttccagaggggcag

SEQ ID NO: 8224092 - DNA, 22 bp, Homo sapiens
aggccagcttctaccctctgtt

SEQ ID NO: 8224093 - DNA, 22 bp, Homo sapiens
aggccagcttctaccctctgtt

SEQ ID NO: 8224094 - DNA, 20 bp, Homo sapiens
aggccaggaaatgtagttct

SEQ ID NO: 8224095 - DNA, 20 bp, Homo sapiens
aggccaggaaatgtagttct

SEQ ID NO: 8224096 - DNA, 22 bp, Homo sapiens
aggccaggaccattagcccaga

SEQ ID NO: 8224097 - DNA, 22 bp, Homo sapiens
aggccaggaccattagcccaga

SEQ ID NO: 8224098 - DNA, 22 bp, Homo sapiens
aggccaggaccattagcccaga

SEQ ID NO: 8224099 - DNA, 22 bp, Homo sapiens
aggccaggaccattagcccaga

SEQ ID NO: 8224100 - DNA, 22 bp, Homo sapiens
aggccaggacacttaagtaaga

SEQ ID NO: 8224101 - DNA, 22 bp, Homo sapiens
aggccaggaatccttgtcccag

SEQ ID NO: 8224102 - DNA, 22 bp, Homo sapiens
aggccaggaatccttgtcccag

SEQ ID NO: 8224103 - DNA, 22 bp, Homo sapiens
aggcccagtagtgctgccttta

SEQ ID NO: 8224104 - DNA, 22 bp, Homo sapiens
aggcccagtagtgctgccttta

SEQ ID NO: 8224105 - DNA, 22 bp, Homo sapiens
aggcccagtagtgctgccttta

SEQ ID NO: 8224106 - DNA, 22 bp, Homo sapiens
aggcccagtcctctgccgtctg

SEQ ID NO: 8224107 - DNA, 22 bp, Homo sapiens
aggcccagtcctctgccgtctg

SEQ ID NO: 8224108 - DNA, 22 bp, Homo sapiens
aggcccagtgtggcttcctgga

SEQ ID NO: 8224109 - DNA, 22 bp, Homo sapiens
aggcccagtagtgctgccttta

SEQ ID NO: 8224110 - DNA, 22 bp, Homo sapiens
aggcccagctgggccaggaaca

SEQ ID NO: 8224111 - DNA, 22 bp, Homo sapiens
aggccaggatagcatggatcag

SEQ ID NO: 8224112 - DNA, 22 bp, Homo sapiens
aggccaggatagcatggatcag

SEQ ID NO: 8224113 - DNA, 22 bp, Homo sapiens
aggcccagctgggccaggaaca

SEQ ID NO: 8224114 - DNA, 22 bp, Homo sapiens
aggccaggatagcatggatcag

SEQ ID NO: 8224115 - DNA, 22 bp, Homo sapiens
aggccaggatagcatggatcag

SEQ ID NO: 8224116 - DNA, 22 bp, Homo sapiens
aggccgtgtgagcatgtgtgag

SEQ ID NO: 8224117 - DNA, 22 bp, Homo sapiens
aggcctagagctttggagggca

SEQ ID NO: 8224118 - DNA, 22 bp, Homo sapiens
aggcctagagctttggagggca

SEQ ID NO: 8224119 - DNA, 22 bp, Homo sapiens
aggccctgacctgggagatcta

SEQ ID NO: 8224120 - DNA, 22 bp, Homo sapiens
aggccctgggttagggcccact

SEQ ID NO: 8224121 - DNA, 22 bp, Homo sapiens
aggccctgggttagggcccact

SEQ ID NO: 8224122 - DNA, 22 bp, Homo sapiens
aggccctggtcaggtctggctg

SEQ ID NO: 8224123 - DNA, 22 bp, Homo sapiens
aggccctaatccaacatgactg

SEQ ID NO: 8224124 - DNA, 22 bp, Homo sapiens
aggccctattcaatggggccca

SEQ ID NO: 8224125 - DNA, 22 bp, Homo sapiens
aggccctattcaatggggccca

SEQ ID NO: 8224126 - DNA, 22 bp, Homo sapiens
aggccctattcaatggggccca

SEQ ID NO: 8224127 - DNA, 22 bp, Homo sapiens
aggccctattcaatggggccca

SEQ ID NO: 8224128 - DNA, 22 bp, Homo sapiens
aggccctgaagtcggcccctca

SEQ ID NO: 8224129 - DNA, 22 bp, Homo sapiens
aggccctccattgatgtttatt

SEQ ID NO: 8224130 - DNA, 22 bp, Homo sapiens
aggccctctagaggagtgtttg

SEQ ID NO: 8224131 - DNA, 22 bp, Homo sapiens
aggccctctcattccagaggca

SEQ ID NO: 8224132 - DNA, 22 bp, Homo sapiens
aggcccagttatcctacttgtt

SEQ ID NO: 8224133 - DNA, 22 bp, Homo sapiens
aggcccagttatcctacttgtt

SEQ ID NO: 8224134 - DNA, 22 bp, Homo sapiens
aggcccagttatcctacttgtt

SEQ ID NO: 8224135 - DNA, 22 bp, Homo sapiens
aggcccagtgtggcttcctgga

SEQ ID NO: 8224136 - DNA, 20 bp, Homo sapiens
aggccccaggtggacactag

SEQ ID NO: 8224137 - DNA, 22 bp, Homo sapiens
aggccccctccacccattctgg

SEQ ID NO: 8224138 - DNA, 22 bp, Homo sapiens
aggccccctccacccattctgg

SEQ ID NO: 8224139 - DNA, 18 bp, Homo sapiens
aggcccgttgtgtggaat

SEQ ID NO: 8224140 - DNA, 22 bp, Homo sapiens
aggccccaaagcagtgcaagta

SEQ ID NO: 8224141 - DNA, 22 bp, Homo sapiens
aggccccaaagcagtgcaagta

SEQ ID NO: 8224142 - DNA, 22 bp, Homo sapiens
aggcagtgagcagggtgtcatg

SEQ ID NO: 8224143 - DNA, 22 bp, Homo sapiens
aggcagtgagcagggtgtcatg

SEQ ID NO: 8224144 - DNA, 22 bp, Homo sapiens
aggcagtgctcaagacagcagc

SEQ ID NO: 8224145 - DNA, 22 bp, Homo sapiens
aggcagtgctcaagacagcagc

SEQ ID NO: 8224146 - DNA, 22 bp, Homo sapiens
aggcagtgctcaagacagcagc

SEQ ID NO: 8224147 - DNA, 22 bp, Homo sapiens
aggcagtgctcaagacagcagc

SEQ ID NO: 8224148 - DNA, 22 bp, Homo sapiens
aggcagtgcagagtcctcttct

SEQ ID NO: 8224149 - DNA, 22 bp, Homo sapiens
aggcagtgcctggaccccagct

SEQ ID NO: 8224150 - DNA, 22 bp, Homo sapiens
aggcagtgcctggaccccagct

SEQ ID NO: 8224151 - DNA, 22 bp, Homo sapiens
aggcagtggagctggaataggc

SEQ ID NO: 8224152 - DNA, 22 bp, Homo sapiens
aggcagtggagctggaataggc

SEQ ID NO: 8224153 - DNA, 22 bp, Homo sapiens
aggcagtggagaaggtttgtga

SEQ ID NO: 8224154 - DNA, 22 bp, Homo sapiens
aggcagtggagctggaataggc

SEQ ID NO: 8224155 - DNA, 22 bp, Homo sapiens
aggcagtggaaggagaaagcaa

SEQ ID NO: 8224156 - DNA, 22 bp, Homo sapiens
aggcagtggctgagaccagggg

SEQ ID NO: 8224157 - DNA, 22 bp, Homo sapiens
aggcagtggctgagaccagggg

SEQ ID NO: 8224158 - DNA, 22 bp, Homo sapiens
aggcagtggatgtcaggaatgg

SEQ ID NO: 8224159 - DNA, 22 bp, Homo sapiens
aggcagccattaccaagggcat

SEQ ID NO: 8224160 - DNA, 22 bp, Homo sapiens
aggcagcccacaggacacagga

SEQ ID NO: 8224161 - DNA, 22 bp, Homo sapiens
aggcagccattaccaagggcat

SEQ ID NO: 8224162 - DNA, 22 bp, Homo sapiens
aggcagccatctgcaggaagga

SEQ ID NO: 8224163 - DNA, 22 bp, Homo sapiens
aggcagccatctgcaggaagga

SEQ ID NO: 8224164 - DNA, 22 bp, Homo sapiens
aggcagccatccaggaggctca

SEQ ID NO: 8224165 - DNA, 22 bp, Homo sapiens
aggcagccagttcaggtttctt

SEQ ID NO: 8224166 - DNA, 22 bp, Homo sapiens
aggcagcctatggggagctcag

SEQ ID NO: 8224167 - DNA, 22 bp, Homo sapiens
aggcagcctatggggagctcag

SEQ ID NO: 8224168 - DNA, 22 bp, Homo sapiens
aggcagcctggtttgaatggaa

SEQ ID NO: 8224169 - DNA, 22 bp, Homo sapiens
aggcagcccacaggacacagga

SEQ ID NO: 8224170 - DNA, 22 bp, Homo sapiens
aggcagcccacaggacacagga

SEQ ID NO: 8224171 - DNA, 22 bp, Homo sapiens
aggcagccctgtgctggatgct

SEQ ID NO: 8224172 - DNA, 22 bp, Homo sapiens
aggcagccctgtgctggatgct

SEQ ID NO: 8224173 - DNA, 22 bp, Homo sapiens
aggcagcctttagacagtctgc

SEQ ID NO: 8224174 - DNA, 22 bp, Homo sapiens
aggcagcctggtttgaatggaa

SEQ ID NO: 8224175 - DNA, 18 bp, Homo sapiens
aggcaggtgctaatattt

SEQ ID NO: 8224176 - DNA, 22 bp, Homo sapiens
aggcagcctttttggaaacata

SEQ ID NO: 8224177 - DNA, 22 bp, Homo sapiens
aggcagcctttagacagtctgc

SEQ ID NO: 8224178 - DNA, 22 bp, Homo sapiens
aggcaggtttactcttatttgg

SEQ ID NO: 8224179 - DNA, 22 bp, Homo sapiens
aggcaggttggtgagaagactg

SEQ ID NO: 8224180 - DNA, 18 bp, Homo sapiens
aggcaggtgctggaagtc

SEQ ID NO: 8224181 - DNA, 22 bp, Homo sapiens
aggcaggttggtgagaagactg

SEQ ID NO: 8224182 - DNA, 18 bp, Homo sapiens
aggcaggtgctggaagtc

SEQ ID NO: 8224183 - DNA, 21 bp, Homo sapiens
aggcagcgattttcatattgc

SEQ ID NO: 8224184 - DNA, 18 bp, Homo sapiens
aggcaggtgctaatattt

SEQ ID NO: 8224185 - DNA, 18 bp, Homo sapiens
aggcaggtgctaatattt

SEQ ID NO: 8224186 - DNA, 19 bp, Homo sapiens
aggcagtcattggaatata

SEQ ID NO: 8224187 - DNA, 22 bp, Homo sapiens
aggcagtctatctctggagcct

SEQ ID NO: 8224188 - DNA, 22 bp, Homo sapiens
aggcaggtttactcttatttgg

SEQ ID NO: 8224189 - DNA, 22 bp, Homo sapiens
aggcaggtttcccggctgtcaa

SEQ ID NO: 8224190 - DNA, 22 bp, Homo sapiens
aggcaggtttcccggctgtcaa

SEQ ID NO: 8224191 - DNA, 23 bp, Homo sapiens
aggcaggtttgggctcttcttgt

SEQ ID NO: 8224192 - DNA, 22 bp, Homo sapiens
aggcaggtttcccggctgtcaa

SEQ ID NO: 8224193 - DNA, 23 bp, Homo sapiens
aggcaggtttgggctcttcttgt

SEQ ID NO: 8224194 - DNA, 21 bp, Homo sapiens
ccactgctcttccctagggcc

SEQ ID NO: 8224195 - DNA, 22 bp, Homo sapiens
ccactgctcctgaccaaggtca

SEQ ID NO: 8224196 - DNA, 22 bp, Homo sapiens
ccactgctctgccaggagctgg

SEQ ID NO: 8224197 - DNA, 22 bp, Homo sapiens
ccactgctctgccaggagctgg

SEQ ID NO: 8224198 - DNA, 22 bp, Homo sapiens
ccactgctgttacttacgcaaa

SEQ ID NO: 8224199 - DNA, 22 bp, Homo sapiens
ccactggaaatgacacgtcact

SEQ ID NO: 8224200 - DNA, 23 bp, Homo sapiens
ccactgctttcattttgtcatgg

SEQ ID NO: 8224201 - DNA, 22 bp, Homo sapiens
ccactggaagatgctgaggtca

SEQ ID NO: 8224202 - DNA, 22 bp, Homo sapiens
ccactggaagatgctgaggtca

SEQ ID NO: 8224203 - DNA, 22 bp, Homo sapiens
ccactggcatccagctgccatc

SEQ ID NO: 8224204 - DNA, 22 bp, Homo sapiens
ccactggcatccagctgccatc

SEQ ID NO: 8224205 - DNA, 22 bp, Homo sapiens
ccactggcagttggctagcctt

SEQ ID NO: 8224206 - DNA, 22 bp, Homo sapiens
ccactggagactggtctctgtg

SEQ ID NO: 8224207 - DNA, 22 bp, Homo sapiens
ccactggagatgtcagacaggt

SEQ ID NO: 8224208 - DNA, 22 bp, Homo sapiens
ccactggattttcttactgtag

SEQ ID NO: 8224209 - DNA, 22 bp, Homo sapiens
aggcattcaggctatttgatca

SEQ ID NO: 8224210 - DNA, 22 bp, Homo sapiens
aggcatttgatgaagattggct

SEQ ID NO: 8224211 - DNA, 22 bp, Homo sapiens
aggcattctagaagtagaagta

SEQ ID NO: 8224212 - DNA, 22 bp, Homo sapiens
aggcattacatctaaatattta

SEQ ID NO: 8224213 - DNA, 22 bp, Homo sapiens
aggcattagttgtaaagtattg

SEQ ID NO: 8224214 - DNA, 22 bp, Homo sapiens
aggcatgtgaccctggactcag

SEQ ID NO: 8224215 - DNA, 22 bp, Homo sapiens
aggcattaatgtaatacagtga

SEQ ID NO: 8224216 - DNA, 22 bp, Homo sapiens
aggcatgtgctgtttgtctcca

SEQ ID NO: 8224217 - DNA, 22 bp, Homo sapiens
aggcatggcatggggcagatgt

SEQ ID NO: 8224218 - DNA, 22 bp, Homo sapiens
aggcatggcatggggcagatgt

SEQ ID NO: 8224219 - DNA, 22 bp, Homo sapiens
aggcatgtcttcctttgagtgt

SEQ ID NO: 8224220 - DNA, 22 bp, Homo sapiens
aggcatgtcggattgttgtatt

SEQ ID NO: 8224221 - DNA, 20 bp, Homo sapiens
aggcatgtcccagtttctcc

SEQ ID NO: 8224222 - DNA, 22 bp, Homo sapiens
aggcatcaggagtatagccaga

SEQ ID NO: 8224223 - DNA, 22 bp, Homo sapiens
aggcatcaggagtatagccaga

SEQ ID NO: 8224224 - DNA, 23 bp, Homo sapiens
aggcagtggtggtaacatgtcaa

SEQ ID NO: 8224225 - DNA, 23 bp, Homo sapiens
aggcagtggtggtaacatgtcaa

SEQ ID NO: 8224226 - DNA, 23 bp, Homo sapiens
aggcagtggtggtaacatgtcaa

SEQ ID NO: 8224227 - DNA, 22 bp, Homo sapiens
aggcagtggctgagaccagggg

SEQ ID NO: 8224228 - DNA, 23 bp, Homo sapiens
aggcagtgggggccactttgctt

SEQ ID NO: 8224229 - DNA, 20 bp, Homo sapiens
aggcatctgagtcacatctt

SEQ ID NO: 8224230 - DNA, 23 bp, Homo sapiens
aggcatcttctgagttaagagca

SEQ ID NO: 8224231 - DNA, 22 bp, Homo sapiens
aggcatctaacagagatcttta

SEQ ID NO: 8224232 - DNA, 20 bp, Homo sapiens
aggcatctgagtcacatctt

SEQ ID NO: 8224233 - DNA, 17 bp, Homo sapiens
aggcatgaggcatcact

SEQ ID NO: 8224234 - DNA, 22 bp, Homo sapiens
aggcatgatgtgcagtggcaaa

SEQ ID NO: 8224235 - DNA, 22 bp, Homo sapiens
ccactgctagagatgcatcccc

SEQ ID NO: 8224236 - DNA, 22 bp, Homo sapiens
aggcatgatgtgcagtggcaaa

SEQ ID NO: 8224237 - DNA, 22 bp, Homo sapiens
aggcatgatgtgcagtggcaaa

SEQ ID NO: 8224238 - DNA, 21 bp, Homo sapiens
aggcatgagccctgcatggac

SEQ ID NO: 8224239 - DNA, 22 bp, Homo sapiens
aggcatgactttggctgaagaa

SEQ ID NO: 8224240 - DNA, 22 bp, Homo sapiens
aggcatgactttggctgaagaa

SEQ ID NO: 8224241 - DNA, 22 bp, Homo sapiens
aggctgagcggggtcccagagc

SEQ ID NO: 8224242 - DNA, 22 bp, Homo sapiens
aggctgagcggggtcccagagc

SEQ ID NO: 8224243 - DNA, 22 bp, Homo sapiens
aggctgagcggggtcccagagc

SEQ ID NO: 8224244 - DNA, 22 bp, Homo sapiens
aggctgagcggggtcccagagc

SEQ ID NO: 8224245 - DNA, 22 bp, Homo sapiens
aggctgagcctgggcgtggtgg

SEQ ID NO: 8224246 - DNA, 22 bp, Homo sapiens
aggctgagcctgggcgtggtgg

SEQ ID NO: 8224247 - DNA, 22 bp, Homo sapiens
aggctgagcctgggcgtggtgg

SEQ ID NO: 8224248 - DNA, 23 bp, Homo sapiens
aggctgagctctcccagcttcag

SEQ ID NO: 8224249 - DNA, 22 bp, Homo sapiens
aggctgagcggggtcccagagc

SEQ ID NO: 8224250 - DNA, 22 bp, Homo sapiens
aggctgagcggggtcccagagc

SEQ ID NO: 8224251 - DNA, 23 bp, Homo sapiens
aggctgagctctcccagcttcag

SEQ ID NO: 8224252 - DNA, 23 bp, Homo sapiens
aggctgagctctcccagcttcag

SEQ ID NO: 8224253 - DNA, 23 bp, Homo sapiens
aggctgagctctcccagcttcag

SEQ ID NO: 8224254 - DNA, 23 bp, Homo sapiens
aggctgagctctcccagcttcag

SEQ ID NO: 8224255 - DNA, 22 bp, Homo sapiens
aggctgagctgacctggtttgg

SEQ ID NO: 8224256 - DNA, 23 bp, Homo sapiens
aggctgagctctcccagcttcag

SEQ ID NO: 8224257 - DNA, 23 bp, Homo sapiens
aggctgagctctcccagcttcag

SEQ ID NO: 8224258 - DNA, 22 bp, Homo sapiens
ccagtcacaggtgtgtttatat

SEQ ID NO: 8224259 - DNA, 22 bp, Homo sapiens
ccagtcactctgtgagagctac

SEQ ID NO: 8224260 - DNA, 22 bp, Homo sapiens
ccagtcactctgtgagagctac

SEQ ID NO: 8224261 - DNA, 22 bp, Homo sapiens
ccagtctgtactttgctctgtt

SEQ ID NO: 8224262 - DNA, 22 bp, Homo sapiens
ccagtctgtactttgctctgtt

SEQ ID NO: 8224263 - DNA, 22 bp, Homo sapiens
ccagtcactggaaaatgggaat

SEQ ID NO: 8224264 - DNA, 23 bp, Homo sapiens
ccagtgattgcctggaaggaggt

SEQ ID NO: 8224265 - DNA, 22 bp, Homo sapiens
ccagtgattcctagtaatataa

SEQ ID NO: 8224266 - DNA, 22 bp, Homo sapiens
ccagtgattcattcatttacct

SEQ ID NO: 8224267 - DNA, 22 bp, Homo sapiens
ccagtgattcattcatttacct

SEQ ID NO: 8224268 - DNA, 22 bp, Homo sapiens
ccagtgatttagtacaatgtag

SEQ ID NO: 8224269 - DNA, 22 bp, Homo sapiens
ccagtgcacagccaggcaggtg

SEQ ID NO: 8224270 - DNA, 22 bp, Homo sapiens
ccagtgatttagtacaatgtag

SEQ ID NO: 8224271 - DNA, 22 bp, Homo sapiens
ccagtgcacagccaggcaggtg

SEQ ID NO: 8224272 - DNA, 22 bp, Homo sapiens
ccagtgatctgacaccaaatca

SEQ ID NO: 8224273 - DNA, 22 bp, Homo sapiens
ccagtgatgataggaagaccct

SEQ ID NO: 8224274 - DNA, 21 bp, Homo sapiens
ccagtgattcaatgaaaacag

SEQ ID NO: 8224275 - DNA, 22 bp, Homo sapiens
ccagtgagaatgaagataaggc

SEQ ID NO: 8224276 - DNA, 22 bp, Homo sapiens
ccagtctgtgtgccagcctgcg

SEQ ID NO: 8224277 - DNA, 22 bp, Homo sapiens
ccagtctgttctcacctctgag

SEQ ID NO: 8224278 - DNA, 22 bp, Homo sapiens
ccagtctgtgtgccagcctgcg

SEQ ID NO: 8224279 - DNA, 22 bp, Homo sapiens
ccagtctgtgtgccagcctgcg

SEQ ID NO: 8224280 - DNA, 22 bp, Homo sapiens
aggctgaggcaggtggatcatt

SEQ ID NO: 8224281 - DNA, 22 bp, Homo sapiens
aggctgaggcaggtggatcact

SEQ ID NO: 8224282 - DNA, 22 bp, Homo sapiens
aggctgaggcaggtggatcact

SEQ ID NO: 8224283 - DNA, 22 bp, Homo sapiens
aggctgaggcaggtggatcact

SEQ ID NO: 8224284 - DNA, 22 bp, Homo sapiens
aggctgaggcaggtggatcact

SEQ ID NO: 8224285 - DNA, 22 bp, Homo sapiens
aggctgaggcaggtggatcact

SEQ ID NO: 8224286 - DNA, 22 bp, Homo sapiens
aggctgaggcaggtggatcact

SEQ ID NO: 8224287 - DNA, 22 bp, Homo sapiens
ccagtgcaccaagaggcctaga

SEQ ID NO: 8224288 - DNA, 22 bp, Homo sapiens
aggctgaggcgggaggatcact

SEQ ID NO: 8224289 - DNA, 22 bp, Homo sapiens
aggctgaggcgggaggatcact

SEQ ID NO: 8224290 - DNA, 22 bp, Homo sapiens
aggctgaggcgggaggatcact

SEQ ID NO: 8224291 - DNA, 22 bp, Homo sapiens
aggctgaggcgggaggatcact

SEQ ID NO: 8224292 - DNA, 22 bp, Homo sapiens
aggctgaggcgggaggatcact

SEQ ID NO: 8224293 - DNA, 22 bp, Homo sapiens
aggctgaggcaggtggatcatt

SEQ ID NO: 8224294 - DNA, 22 bp, Homo sapiens
aggctgaggcaggtggatcatt

SEQ ID NO: 8224295 - DNA, 22 bp, Homo sapiens
aggctgaggcaggtggatcatt

SEQ ID NO: 8224296 - DNA, 22 bp, Homo sapiens
aggctgaggcaggtggatcatt

SEQ ID NO: 8224297 - DNA, 22 bp, Homo sapiens
aggctgaggcaggtggatcatt

SEQ ID NO: 8224298 - DNA, 22 bp, Homo sapiens
ccagttgtttgccttgaaatga

SEQ ID NO: 8224299 - DNA, 22 bp, Homo sapiens
ccagttgggatttgtcctggtt

SEQ ID NO: 8224300 - DNA, 22 bp, Homo sapiens
ccagtttaagacttatctcaat

SEQ ID NO: 8224301 - DNA, 22 bp, Homo sapiens
ccagttatccagcatgctgtct

SEQ ID NO: 8224302 - DNA, 22 bp, Homo sapiens
ccagttatccagcatgctgtct

SEQ ID NO: 8224303 - DNA, 22 bp, Homo sapiens
ccagtgtgccaatttacagctg

SEQ ID NO: 8224304 - DNA, 22 bp, Homo sapiens
ccagtgtgcattatcatgtgtc

SEQ ID NO: 8224305 - DNA, 22 bp, Homo sapiens
aggctgaggcgggaggatcact

SEQ ID NO: 8224306 - DNA, 22 bp, Homo sapiens
aggctgaggcgggaggatcact

SEQ ID NO: 8224307 - DNA, 22 bp, Homo sapiens
aggctctgcaggtatttcttga

SEQ ID NO: 8224308 - DNA, 22 bp, Homo sapiens
aggctctgcagaccccagctgt

SEQ ID NO: 8224309 - DNA, 22 bp, Homo sapiens
aggctctgcagtccatcccgtg

SEQ ID NO: 8224310 - DNA, 22 bp, Homo sapiens
aggctctgcagtccatcccgtg

SEQ ID NO: 8224311 - DNA, 22 bp, Homo sapiens
aggctctgcagtccatcccgtg

SEQ ID NO: 8224312 - DNA, 22 bp, Homo sapiens
aggctctgatgcaagcccaggg

SEQ ID NO: 8224313 - DNA, 22 bp, Homo sapiens
aggctctgcagaccccagctgt

SEQ ID NO: 8224314 - DNA, 22 bp, Homo sapiens
aggctctgcagaccccagctgt

SEQ ID NO: 8224315 - DNA, 22 bp, Homo sapiens
aggctctgcagaccccagctgt

SEQ ID NO: 8224316 - DNA, 22 bp, Homo sapiens
aggctctgcagaccccagctgt

SEQ ID NO: 8224317 - DNA, 22 bp, Homo sapiens
aggctctgatgcaagcccaggg

SEQ ID NO: 8224318 - DNA, 22 bp, Homo sapiens
aggctctgatgcaagcccaggg

SEQ ID NO: 8224319 - DNA, 22 bp, Homo sapiens
aggctctgatgcaagcccaggg

SEQ ID NO: 8224320 - DNA, 22 bp, Homo sapiens
aggctctgcatccaggctttat

SEQ ID NO: 8224321 - DNA, 22 bp, Homo sapiens
aggctctgcagtgctggaggac

SEQ ID NO: 8224322 - DNA, 22 bp, Homo sapiens
aggctctgcatccaggctttat

SEQ ID NO: 8224323 - DNA, 20 bp, Homo sapiens
aggctctgcatttctgagtg

SEQ ID NO: 8224324 - DNA, 22 bp, Homo sapiens
aggctctgcagtgctggaggac

SEQ ID NO: 8224325 - DNA, 22 bp, Homo sapiens
aggctctgcagtgctggaggac

SEQ ID NO: 8224326 - DNA, 22 bp, Homo sapiens
aggctctgcagtgctggaggac

SEQ ID NO: 8224327 - DNA, 22 bp, Homo sapiens
aggctctgcagtgctggaggac

SEQ ID NO: 8224328 - DNA, 22 bp, Homo sapiens
aggctctgcagtgctggaggac

SEQ ID NO: 8224329 - DNA, 22 bp, Homo sapiens
aggctctgcagtgctggaggac

SEQ ID NO: 8224330 - DNA, 22 bp, Homo sapiens
aggctctgcagtccatcccgtg

SEQ ID NO: 8224331 - DNA, 22 bp, Homo sapiens
aggctctgcagtccatcccgtg

SEQ ID NO: 8224332 - DNA, 19 bp, Homo sapiens
aggctctgagctcctggag

SEQ ID NO: 8224333 - DNA, 19 bp, Homo sapiens
aggctctgagctcctggag

SEQ ID NO: 8224334 - DNA, 19 bp, Homo sapiens
aggctctgagctcctggag

SEQ ID NO: 8224335 - DNA, 19 bp, Homo sapiens
aggctctgagctcctggag

SEQ ID NO: 8224336 - DNA, 22 bp, Homo sapiens
aggctctgagtagagctgccag

SEQ ID NO: 8224337 - DNA, 22 bp, Homo sapiens
aggctctgaggcagattttcgt

SEQ ID NO: 8224338 - DNA, 22 bp, Homo sapiens
aggctctgagtagagctgccag

SEQ ID NO: 8224339 - DNA, 22 bp, Homo sapiens
aggctctgagtagagctgccag

SEQ ID NO: 8224340 - DNA, 22 bp, Homo sapiens
aggctctgagtagagctgccag

SEQ ID NO: 8224341 - DNA, 22 bp, Homo sapiens
aggctctgagtagagctgccag

SEQ ID NO: 8224342 - DNA, 22 bp, Homo sapiens
aggctctgatgcaagcccaggg

SEQ ID NO: 8224343 - DNA, 22 bp, Homo sapiens
aggctctgatcaggtggctgtg

SEQ ID NO: 8224344 - DNA, 22 bp, Homo sapiens
aggctctgatcaggtggctgtg

SEQ ID NO: 8224345 - DNA, 22 bp, Homo sapiens
aggctctgatcaggtggctgtg

SEQ ID NO: 8224346 - DNA, 22 bp, Homo sapiens
aggctctgatcaggtggctgtg

SEQ ID NO: 8224347 - DNA, 22 bp, Homo sapiens
aggctctgagtctggtgtctgc

SEQ ID NO: 8224348 - DNA, 22 bp, Homo sapiens
aggctctgagtctggtgtctgc

SEQ ID NO: 8224349 - DNA, 22 bp, Homo sapiens
aggctctgatcaggtggctgtg

SEQ ID NO: 8224350 - DNA, 22 bp, Homo sapiens
aggctctgatcaggtggctgtg

SEQ ID NO: 8224351 - DNA, 22 bp, Homo sapiens
aggctctgagtagagctgccag

SEQ ID NO: 8224352 - DNA, 22 bp, Homo sapiens
aggctctgagtctggtgtctgc

SEQ ID NO: 8224353 - DNA, 22 bp, Homo sapiens
aggctctgagtctggtgtctgc

SEQ ID NO: 8224354 - DNA, 22 bp, Homo sapiens
aggctgagcaaagggccttacc

SEQ ID NO: 8224355 - DNA, 22 bp, Homo sapiens
aggctgagcaaagggccttacc

SEQ ID NO: 8224356 - DNA, 22 bp, Homo sapiens
aggctgagcaaagggccttacc

SEQ ID NO: 8224357 - DNA, 22 bp, Homo sapiens
aggctgagataggtggatcatt

SEQ ID NO: 8224358 - DNA, 22 bp, Homo sapiens
aggctgagataggtggatcatt

SEQ ID NO: 8224359 - DNA, 22 bp, Homo sapiens
aggctgagataggtggatcatt

SEQ ID NO: 8224360 - DNA, 22 bp, Homo sapiens
aggctgagataggtggatcatt

SEQ ID NO: 8224361 - DNA, 22 bp, Homo sapiens
aggctgagagcaacgtgtcaga

SEQ ID NO: 8224362 - DNA, 22 bp, Homo sapiens
aggctgagagcaacgtgtcaga

SEQ ID NO: 8224363 - DNA, 22 bp, Homo sapiens
aggctgagagcaacgtgtcaga

SEQ ID NO: 8224364 - DNA, 22 bp, Homo sapiens
aggctgagataggtggatcatt

SEQ ID NO: 8224365 - DNA, 22 bp, Homo sapiens
aggctgagataggtggatcatt

SEQ ID NO: 8224366 - DNA, 22 bp, Homo sapiens
aggctgagccacggggctggct

SEQ ID NO: 8224367 - DNA, 22 bp, Homo sapiens
aggctgagccacggggctggct

SEQ ID NO: 8224368 - DNA, 22 bp, Homo sapiens
aggctgagcaaagggccttacc

SEQ ID NO: 8224369 - DNA, 22 bp, Homo sapiens
aggctgagcaaagggccttacc

SEQ ID NO: 8224370 - DNA, 22 bp, Homo sapiens
aggctgagcctgggcgtggtgg

SEQ ID NO: 8224371 - DNA, 22 bp, Homo sapiens
aggctgagcctgggcgtggtgg

SEQ ID NO: 8224372 - DNA, 22 bp, Homo sapiens
aggctgagcctgggcgtggtgg

SEQ ID NO: 8224373 - DNA, 22 bp, Homo sapiens
aggctgagccacggggctggct

SEQ ID NO: 8224374 - DNA, 22 bp, Homo sapiens
aggctgagccacggggctggct

SEQ ID NO: 8224375 - DNA, 22 bp, Homo sapiens
aggctgagccacggggctggct

SEQ ID NO: 8224376 - DNA, 22 bp, Homo sapiens
aggctgagccacggggctggct

SEQ ID NO: 8224377 - DNA, 22 bp, Homo sapiens
aggctgagagcaacgtgtcaga

SEQ ID NO: 8224378 - DNA, 22 bp, Homo sapiens
aggctgagagcaacgtgtcaga

SEQ ID NO: 8224379 - DNA, 22 bp, Homo sapiens
aggctgagagcaacgtgtcaga

SEQ ID NO: 8224380 - DNA, 22 bp, Homo sapiens
aggctgagactgtgcattagtg

SEQ ID NO: 8224381 - DNA, 22 bp, Homo sapiens
aggctgagactgtgcattagtg

SEQ ID NO: 8224382 - DNA, 20 bp, Homo sapiens
aggctctgcctgcaggccca

SEQ ID NO: 8224383 - DNA, 20 bp, Homo sapiens
aggctctgcctgcaggccca

SEQ ID NO: 8224384 - DNA, 20 bp, Homo sapiens
aggctctgcctgcaggccca

SEQ ID NO: 8224385 - DNA, 22 bp, Homo sapiens
aggctctgttattctagagggc

SEQ ID NO: 8224386 - DNA, 22 bp, Homo sapiens
aggctctgttattctagagggc

SEQ ID NO: 8224387 - DNA, 22 bp, Homo sapiens
aggctctgttattctagagggc

SEQ ID NO: 8224388 - DNA, 22 bp, Homo sapiens
aggctgagactgtgcattagtg

SEQ ID NO: 8224389 - DNA, 22 bp, Homo sapiens
aggctctgttattctagagggc

SEQ ID NO: 8224390 - DNA, 22 bp, Homo sapiens
aggctctgttattctagagggc

SEQ ID NO: 8224391 - DNA, 20 bp, Homo sapiens
aggctctgcatttctgagtg

SEQ ID NO: 8224392 - DNA, 22 bp, Homo sapiens
aggctctgccaattccttcctc

SEQ ID NO: 8224393 - DNA, 22 bp, Homo sapiens
aggctctgccaattccttcctc

SEQ ID NO: 8224394 - DNA, 22 bp, Homo sapiens
aggctctgccaattccttcctc

SEQ ID NO: 8224395 - DNA, 22 bp, Homo sapiens
aggctctgccaattccttcctc

SEQ ID NO: 8224396 - DNA, 20 bp, Homo sapiens
aggctctgcatttctgagtg

SEQ ID NO: 8224397 - DNA, 20 bp, Homo sapiens
aggctctgcatttctgagtg

SEQ ID NO: 8224398 - DNA, 20 bp, Homo sapiens
aggctctgccattgtccctg

SEQ ID NO: 8224399 - DNA, 20 bp, Homo sapiens
aggctctgcctgcaggccca

SEQ ID NO: 8224400 - DNA, 20 bp, Homo sapiens
aggctctgcctgcaggccca

SEQ ID NO: 8224401 - DNA, 22 bp, Homo sapiens
ccaggccagagtgcagtggcac

SEQ ID NO: 8224402 - DNA, 22 bp, Homo sapiens
ccaggccaaattcagtcagcag

SEQ ID NO: 8224403 - DNA, 22 bp, Homo sapiens
ccaggccaaattcagtcagcag

SEQ ID NO: 8224404 - DNA, 22 bp, Homo sapiens
ccaggcattgtgagtgggcagg

SEQ ID NO: 8224405 - DNA, 22 bp, Homo sapiens
ccaggcattgtgagtgggcagg

SEQ ID NO: 8224406 - DNA, 22 bp, Homo sapiens
ccaggcattgtgagtgggcagg

SEQ ID NO: 8224407 - DNA, 22 bp, Homo sapiens
ccaggcattgtgagtgggcagg

SEQ ID NO: 8224408 - DNA, 22 bp, Homo sapiens
ccaggcatggggagagccagat

SEQ ID NO: 8224409 - DNA, 22 bp, Homo sapiens
ccaggcatggggagagccagat

SEQ ID NO: 8224410 - DNA, 22 bp, Homo sapiens
ccaggcagtggaagctaaaatt

SEQ ID NO: 8224411 - DNA, 22 bp, Homo sapiens
ccaggcagtggaagctaaaatt

SEQ ID NO: 8224412 - DNA, 22 bp, Homo sapiens
ccaggcatcacgggcatgtggc

SEQ ID NO: 8224413 - DNA, 22 bp, Homo sapiens
ccaggcagtcagggttgtgtgt

SEQ ID NO: 8224414 - DNA, 22 bp, Homo sapiens
ccaggcagtcagggttgtgtgt

SEQ ID NO: 8224415 - DNA, 22 bp, Homo sapiens
ccaggcatccattgcttcctct

SEQ ID NO: 8224416 - DNA, 22 bp, Homo sapiens
ccaggcatccattgcttcctct

SEQ ID NO: 8224417 - DNA, 22 bp, Homo sapiens
ccaggcatcacgggcatgtggc

SEQ ID NO: 8224418 - DNA, 21 bp, Homo sapiens
ccaggcatgactgcagagagc

SEQ ID NO: 8224419 - DNA, 22 bp, Homo sapiens
aggcctcctggctccaggcctt

SEQ ID NO: 8224420 - DNA, 22 bp, Homo sapiens
aggcctcctggctccaggcctt

SEQ ID NO: 8224421 - DNA, 22 bp, Homo sapiens
aggcctctctccttggcttgta

SEQ ID NO: 8224422 - DNA, 22 bp, Homo sapiens
aggcctctgagcagcactcatg

SEQ ID NO: 8224423 - DNA, 22 bp, Homo sapiens
aggcctctgagcagcactcatg

SEQ ID NO: 8224424 - DNA, 22 bp, Homo sapiens
ccaggcacttcatcattagggt

SEQ ID NO: 8224425 - DNA, 22 bp, Homo sapiens
ccaggcacttcatcattagggt

SEQ ID NO: 8224426 - DNA, 22 bp, Homo sapiens
aggcctctgagcagcactcatg

SEQ ID NO: 8224427 - DNA, 22 bp, Homo sapiens
aggcctctgagcagcactcatg

SEQ ID NO: 8224428 - DNA, 22 bp, Homo sapiens
ccaggcacttgtttgccaggca

SEQ ID NO: 8224429 - DNA, 22 bp, Homo sapiens
ccaggcagggagctgtttggcc

SEQ ID NO: 8224430 - DNA, 22 bp, Homo sapiens
ccaggcagggctcaaggaacct

SEQ ID NO: 8224431 - DNA, 22 bp, Homo sapiens
ccaggcagggctcaaggaacct

SEQ ID NO: 8224432 - DNA, 23 bp, Homo sapiens
ccaggcagtagctattgaagtga

SEQ ID NO: 8224433 - DNA, 23 bp, Homo sapiens
ccaggcagtagctattgaagtga

SEQ ID NO: 8224434 - DNA, 23 bp, Homo sapiens
ccaggcagtagctattgaagtga

SEQ ID NO: 8224435 - DNA, 22 bp, Homo sapiens
ccaggcagggctcaaggaacct

SEQ ID NO: 8224436 - DNA, 22 bp, Homo sapiens
aggcctcacacaacagatgcat

SEQ ID NO: 8224437 - DNA, 22 bp, Homo sapiens
aggcctcacacaacagatgcat

SEQ ID NO: 8224438 - DNA, 22 bp, Homo sapiens
aggcctcacacaacagatgcat

SEQ ID NO: 8224439 - DNA, 22 bp, Homo sapiens
aggcctagaggaatggccaggg

SEQ ID NO: 8224440 - DNA, 22 bp, Homo sapiens
aggcctagaggaatggccaggg

SEQ ID NO: 8224441 - DNA, 22 bp, Homo sapiens
aggcctagaggaatggccaggg

SEQ ID NO: 8224442 - DNA, 22 bp, Homo sapiens
aggcctcagcctgccaggcctg

SEQ ID NO: 8224443 - DNA, 22 bp, Homo sapiens
aggcctcagcctgccaggcctg

SEQ ID NO: 8224444 - DNA, 22 bp, Homo sapiens
aggcctcagcctgccaggcctg

SEQ ID NO: 8224445 - DNA, 22 bp, Homo sapiens
aggcctcacattgggcttcaag

SEQ ID NO: 8224446 - DNA, 22 bp, Homo sapiens
aggcctcactctcagagcttct

SEQ ID NO: 8224447 - DNA, 22 bp, Homo sapiens
aggcctcagtgatcatcatcag

SEQ ID NO: 8224448 - DNA, 22 bp, Homo sapiens
aggcctcagttcttgccaggtg

SEQ ID NO: 8224449 - DNA, 22 bp, Homo sapiens
aggcctcagttcttgccaggtg

SEQ ID NO: 8224450 - DNA, 22 bp, Homo sapiens
aggcctcaggaaggtaaagaag

SEQ ID NO: 8224451 - DNA, 22 bp, Homo sapiens
aggcctcagtgatcatcatcag

SEQ ID NO: 8224452 - DNA, 22 bp, Homo sapiens
aggcctcagctcagtgtgacag

SEQ ID NO: 8224453 - DNA, 22 bp, Homo sapiens
aggcctcatagtagacctgccc

SEQ ID NO: 8224454 - DNA, 22 bp, Homo sapiens
aggcctcatagtagacctgccc

SEQ ID NO: 8224455 - DNA, 22 bp, Homo sapiens
aggcctcagtttgtcatctgta

SEQ ID NO: 8224456 - DNA, 22 bp, Homo sapiens
aggcctcatagtagacctgccc

SEQ ID NO: 8224457 - DNA, 22 bp, Homo sapiens
aggcctcatgtcaaagcagcaa

SEQ ID NO: 8224458 - DNA, 22 bp, Homo sapiens
aggcctcatgtcaaagcagcaa

SEQ ID NO: 8224459 - DNA, 17 bp, Homo sapiens
aggcctccctccaggcc

SEQ ID NO: 8224460 - DNA, 21 bp, Homo sapiens
aggcctccctgttgacagggc

SEQ ID NO: 8224461 - DNA, 21 bp, Homo sapiens
aggcctccctgttgacagggc

SEQ ID NO: 8224462 - DNA, 17 bp, Homo sapiens
aggcctccctccaggcc

SEQ ID NO: 8224463 - DNA, 17 bp, Homo sapiens
aggcctccctccaggcc

SEQ ID NO: 8224464 - DNA, 17 bp, Homo sapiens
aggcctccctccaggcc

SEQ ID NO: 8224465 - DNA, 22 bp, Homo sapiens
aggcctccagccacatgccagt

SEQ ID NO: 8224466 - DNA, 22 bp, Homo sapiens
aggcctccagccacatgccagt

SEQ ID NO: 8224467 - DNA, 22 bp, Homo sapiens
ccaggcccgttcccttctccag

SEQ ID NO: 8224468 - DNA, 22 bp, Homo sapiens
ccaggcccgttcccttctccag

SEQ ID NO: 8224469 - DNA, 22 bp, Homo sapiens
ccaggcccgttcccttctccag

SEQ ID NO: 8224470 - DNA, 22 bp, Homo sapiens
ccaggccctgcctgtggttcct

SEQ ID NO: 8224471 - DNA, 22 bp, Homo sapiens
ccaggccctgcctgtggttcct

SEQ ID NO: 8224472 - DNA, 22 bp, Homo sapiens
ccaggccctgcctgtggttcct

SEQ ID NO: 8224473 - DNA, 22 bp, Homo sapiens
ccaggcccttgcaagtcccacc

SEQ ID NO: 8224474 - DNA, 22 bp, Homo sapiens
ccaggccctgctcctcacacca

SEQ ID NO: 8224475 - DNA, 22 bp, Homo sapiens
ccaggcctagcccctgagggta

SEQ ID NO: 8224476 - DNA, 22 bp, Homo sapiens
ccaggcctagcccctgagggta

SEQ ID NO: 8224477 - DNA, 22 bp, Homo sapiens
ccaggcctagcccctgagggta

SEQ ID NO: 8224478 - DNA, 22 bp, Homo sapiens
ccaggcctagcccctgagggta

SEQ ID NO: 8224479 - DNA, 22 bp, Homo sapiens
aggctccagtctgaaccttggg

SEQ ID NO: 8224480 - DNA, 22 bp, Homo sapiens
aggctccacggcaggatgctgt

SEQ ID NO: 8224481 - DNA, 22 bp, Homo sapiens
ccaggcctagcccctgagggta

SEQ ID NO: 8224482 - DNA, 22 bp, Homo sapiens
ccaggcctcacctgcccaccta

SEQ ID NO: 8224483 - DNA, 22 bp, Homo sapiens
ccaggcctcacctgcccaccta

SEQ ID NO: 8224484 - DNA, 22 bp, Homo sapiens
ccaggcctcacctgcccaccta

SEQ ID NO: 8224485 - DNA, 22 bp, Homo sapiens
ccaggcctcacctgcccaccta

SEQ ID NO: 8224486 - DNA, 22 bp, Homo sapiens
aggctccattcatgtgaaggca

SEQ ID NO: 8224487 - DNA, 22 bp, Homo sapiens
aggctccatgcaaaggctgttt

SEQ ID NO: 8224488 - DNA, 22 bp, Homo sapiens
aggctccatgcaaaggctgttt

SEQ ID NO: 8224489 - DNA, 22 bp, Homo sapiens
aggctccatgcaaaggctgttt

SEQ ID NO: 8224490 - DNA, 22 bp, Homo sapiens
aggctccatgcaaaggctgttt

SEQ ID NO: 8224491 - DNA, 22 bp, Homo sapiens
aggctccattttcctgcagctg

SEQ ID NO: 8224492 - DNA, 22 bp, Homo sapiens
aggctccattttcctgcagctg

SEQ ID NO: 8224493 - DNA, 22 bp, Homo sapiens
aggctccattttcctgcagctg

SEQ ID NO: 8224494 - DNA, 21 bp, Homo sapiens
aggctcccagaaatgggcatc

SEQ ID NO: 8224495 - DNA, 21 bp, Homo sapiens
ccaggctcctgaggctggtca

SEQ ID NO: 8224496 - DNA, 22 bp, Homo sapiens
aggctcccatggtgtggcagga

SEQ ID NO: 8224497 - DNA, 22 bp, Homo sapiens
ccaggctctatccctccttctt

SEQ ID NO: 8224498 - DNA, 22 bp, Homo sapiens
ccaggctctgacatagatggga

SEQ ID NO: 8224499 - DNA, 22 bp, Homo sapiens
ccaggctctatccctccttctt

SEQ ID NO: 8224500 - DNA, 22 bp, Homo sapiens
ccaggctctatccctccttctt

SEQ ID NO: 8224501 - DNA, 22 bp, Homo sapiens
ccaggctctatccctccttctt

SEQ ID NO: 8224502 - DNA, 22 bp, Homo sapiens
ccaggctctgcgctggacatgg

SEQ ID NO: 8224503 - DNA, 15 bp, Homo sapiens
ccaggctctgcactc

SEQ ID NO: 8224504 - DNA, 22 bp, Homo sapiens
ccaggctctgccaggcccttga

SEQ ID NO: 8224505 - DNA, 22 bp, Homo sapiens
ccaggctctgccaggcccttga

SEQ ID NO: 8224506 - DNA, 22 bp, Homo sapiens
ccaggctctgagcctcactctt

SEQ ID NO: 8224507 - DNA, 22 bp, Homo sapiens
ccaggctctgagaggaatgtga

SEQ ID NO: 8224508 - DNA, 22 bp, Homo sapiens
ccaggctctgagaggaatgtga

SEQ ID NO: 8224509 - DNA, 22 bp, Homo sapiens
ccaggctctgacatagatggga

SEQ ID NO: 8224510 - DNA, 22 bp, Homo sapiens
ccaggctctgagcctcactctt

SEQ ID NO: 8224511 - DNA, 22 bp, Homo sapiens
ccaggctctgagcctcactctt

SEQ ID NO: 8224512 - DNA, 22 bp, Homo sapiens
ccaggctctgcaaaatcaggct

SEQ ID NO: 8224513 - DNA, 22 bp, Homo sapiens
agggcagcagctgtccctgaga

SEQ ID NO: 8224514 - DNA, 22 bp, Homo sapiens
agggcagccatgagccttcagg

SEQ ID NO: 8224515 - DNA, 22 bp, Homo sapiens
agggcagccatgagccttcagg

SEQ ID NO: 8224516 - DNA, 22 bp, Homo sapiens
agggcagcccttctgggagggc

SEQ ID NO: 8224517 - DNA, 22 bp, Homo sapiens
agggcagcccttctgggagggc

SEQ ID NO: 8224518 - DNA, 22 bp, Homo sapiens
agggcagccattgagggattct

SEQ ID NO: 8224519 - DNA, 22 bp, Homo sapiens
agggcagccattgagggattct

SEQ ID NO: 8224520 - DNA, 22 bp, Homo sapiens
agggcagagggtgcctcacctg

SEQ ID NO: 8224521 - DNA, 22 bp, Homo sapiens
agggaggagtcctcaaagtcat

SEQ ID NO: 8224522 - DNA, 22 bp, Homo sapiens
agggaggagtcctcaaagtcat

SEQ ID NO: 8224523 - DNA, 22 bp, Homo sapiens
agggaggagtcctcaaagtcat

SEQ ID NO: 8224524 - DNA, 22 bp, Homo sapiens
agggaggagaatggactccttc

SEQ ID NO: 8224525 - DNA, 22 bp, Homo sapiens
agggaggagaatggactccttc

SEQ ID NO: 8224526 - DNA, 22 bp, Homo sapiens
agggaggaaggaactccttcta

SEQ ID NO: 8224527 - DNA, 22 bp, Homo sapiens
agggaggaccaatgtgtggtta

SEQ ID NO: 8224528 - DNA, 22 bp, Homo sapiens
agggaggaaggatgttccaaag

SEQ ID NO: 8224529 - DNA, 22 bp, Homo sapiens
agggaggaaggatgttccaaag

SEQ ID NO: 8224530 - DNA, 22 bp, Homo sapiens
agggaggagaatggactccttc

SEQ ID NO: 8224531 - DNA, 22 bp, Homo sapiens
agggaggagaatggactccttc

SEQ ID NO: 8224532 - DNA, 22 bp, Homo sapiens
agggaggaccaatgtgtggtta

SEQ ID NO: 8224533 - DNA, 22 bp, Homo sapiens
agggaggaccaatgtgtggtta

SEQ ID NO: 8224534 - DNA, 22 bp, Homo sapiens
agggaggaccaatgtgtggtta

SEQ ID NO: 8224535 - DNA, 22 bp, Homo sapiens
agggccagagtggcaaaagcct

SEQ ID NO: 8224536 - DNA, 22 bp, Homo sapiens
agggccagccccaccctctctg

SEQ ID NO: 8224537 - DNA, 22 bp, Homo sapiens
agggccagccccaccctctctg

SEQ ID NO: 8224538 - DNA, 22 bp, Homo sapiens
agggccagccccaccctctctg

SEQ ID NO: 8224539 - DNA, 22 bp, Homo sapiens
agggcagctgtgagccactgtg

SEQ ID NO: 8224540 - DNA, 22 bp, Homo sapiens
agggcagctggaaggtggcttc

SEQ ID NO: 8224541 - DNA, 22 bp, Homo sapiens
agggcagctctcacctctggcc

SEQ ID NO: 8224542 - DNA, 22 bp, Homo sapiens
agggcagctagctgtagaaaga

SEQ ID NO: 8224543 - DNA, 22 bp, Homo sapiens
agggcagcctctcagcctaggt

SEQ ID NO: 8224544 - DNA, 22 bp, Homo sapiens
agggcagcctctcagcctaggt

SEQ ID NO: 8224545 - DNA, 22 bp, Homo sapiens
agggcagcctgagtgctggccc

SEQ ID NO: 8224546 - DNA, 22 bp, Homo sapiens
agggcagcctgagtgctggccc

SEQ ID NO: 8224547 - DNA, 22 bp, Homo sapiens
agggcagcctgagtgctggccc

SEQ ID NO: 8224548 - DNA, 22 bp, Homo sapiens
agggccagggaaacgatcagca

SEQ ID NO: 8224549 - DNA, 22 bp, Homo sapiens
agggccagggaaacgatcagca

SEQ ID NO: 8224550 - DNA, 22 bp, Homo sapiens
agggccagggaaacgatcagca

SEQ ID NO: 8224551 - DNA, 22 bp, Homo sapiens
agggccagggaaacgatcagca

SEQ ID NO: 8224552 - DNA, 22 bp, Homo sapiens
agggccaggctcccatgtcagg

SEQ ID NO: 8224553 - DNA, 22 bp, Homo sapiens
agggccaggctcccatgtcagg

SEQ ID NO: 8224554 - DNA, 22 bp, Homo sapiens
ccctggcccctcactccgaggc

SEQ ID NO: 8224555 - DNA, 22 bp, Homo sapiens
ccctggcccctcactccgaggc

SEQ ID NO: 8224556 - DNA, 22 bp, Homo sapiens
ccctggcccctcactccgaggc

SEQ ID NO: 8224557 - DNA, 22 bp, Homo sapiens
agggccagggaagctgtatttt

SEQ ID NO: 8224558 - DNA, 21 bp, Homo sapiens
ccctgggatgggcttggactt

SEQ ID NO: 8224559 - DNA, 21 bp, Homo sapiens
ccctgggatgggcttggactt

SEQ ID NO: 8224560 - DNA, 22 bp, Homo sapiens
ccctggcccctcactccgaggc

SEQ ID NO: 8224561 - DNA, 22 bp, Homo sapiens
ccctgggatggattggcaggaa

SEQ ID NO: 8224562 - DNA, 22 bp, Homo sapiens
ccctggggagcaggcgaaggag

SEQ ID NO: 8224563 - DNA, 22 bp, Homo sapiens
ccctggggagcaggcgaaggag

SEQ ID NO: 8224564 - DNA, 22 bp, Homo sapiens
ccctgggctcagagcaggtagc

SEQ ID NO: 8224565 - DNA, 22 bp, Homo sapiens
ccctgggctcagagcaggtagc

SEQ ID NO: 8224566 - DNA, 22 bp, Homo sapiens
ccctgggcagtctgcacttcag

SEQ ID NO: 8224567 - DNA, 22 bp, Homo sapiens
ccctgggcagtctgcacttcag

SEQ ID NO: 8224568 - DNA, 22 bp, Homo sapiens
ccctgggcaccaggcctggtaa

SEQ ID NO: 8224569 - DNA, 22 bp, Homo sapiens
ccctgggcaccaggcctggtaa

SEQ ID NO: 8224570 - DNA, 22 bp, Homo sapiens
ccctgggcaagccctattttcc

SEQ ID NO: 8224571 - DNA, 22 bp, Homo sapiens
ccctgggcaccaggcctggtaa

SEQ ID NO: 8224572 - DNA, 22 bp, Homo sapiens
ccctgggcaagccctattttcc

SEQ ID NO: 8224573 - DNA, 22 bp, Homo sapiens
agggccagctagagccctcgcc

SEQ ID NO: 8224574 - DNA, 22 bp, Homo sapiens
agggccagctagagccctcgcc

SEQ ID NO: 8224575 - DNA, 22 bp, Homo sapiens
agggccagctagagccctcgcc

SEQ ID NO: 8224576 - DNA, 22 bp, Homo sapiens
agggccagctagagccctcgcc

SEQ ID NO: 8224577 - DNA, 22 bp, Homo sapiens
agggccagctagagccctcgcc

SEQ ID NO: 8224578 - DNA, 22 bp, Homo sapiens
agggccagccgacttccagcct

SEQ ID NO: 8224579 - DNA, 18 bp, Homo sapiens
agggccagctgtgagtag

SEQ ID NO: 8224580 - DNA, 22 bp, Homo sapiens
agggccagctgcagaattagca

SEQ ID NO: 8224581 - DNA, 22 bp, Homo sapiens
agggccagctgcagaattagca

SEQ ID NO: 8224582 - DNA, 22 bp, Homo sapiens
agggccagctgatgagaatgag

SEQ ID NO: 8224583 - DNA, 22 bp, Homo sapiens
agggccagctgatgagaatgag

SEQ ID NO: 8224584 - DNA, 22 bp, Homo sapiens
agggccagctgatgagaatgag

SEQ ID NO: 8224585 - DNA, 22 bp, Homo sapiens
agggccagctgatgagaatgag

SEQ ID NO: 8224586 - DNA, 22 bp, Homo sapiens
agggccaggatcacagccaaga

SEQ ID NO: 8224587 - DNA, 22 bp, Homo sapiens
agggccaggatcacagccaaga

SEQ ID NO: 8224588 - DNA, 19 bp, Homo sapiens
agggccaggattctggaac

SEQ ID NO: 8224589 - DNA, 19 bp, Homo sapiens
agggccaggattctggaac

SEQ ID NO: 8224590 - DNA, 19 bp, Homo sapiens
agggccaggattctggaac

SEQ ID NO: 8224591 - DNA, 19 bp, Homo sapiens
agggccaggattctggaac

SEQ ID NO: 8224592 - DNA, 22 bp, Homo sapiens
agggccaggaacacctgaaggg

SEQ ID NO: 8224593 - DNA, 18 bp, Homo sapiens
agggccagctgtgagtag

SEQ ID NO: 8224594 - DNA, 18 bp, Homo sapiens
agggccagctgtgagtag

SEQ ID NO: 8224595 - DNA, 22 bp, Homo sapiens
agggccagctgcagaattagca

SEQ ID NO: 8224596 - DNA, 18 bp, Homo sapiens
agggccagctgtgagtag

SEQ ID NO: 8224597 - DNA, 22 bp, Homo sapiens
agggccaggaacacctgaaggg

SEQ ID NO: 8224598 - DNA, 22 bp, Homo sapiens
agggccaggaacacctgaaggg

SEQ ID NO: 8224599 - DNA, 22 bp, Homo sapiens
cctccaggaggaaatggaacac

SEQ ID NO: 8224600 - DNA, 22 bp, Homo sapiens
cctccaggaggaaatggaacac

SEQ ID NO: 8224601 - DNA, 21 bp, Homo sapiens
cctccaggagcagagccctga

SEQ ID NO: 8224602 - DNA, 21 bp, Homo sapiens
cctccaggagcagagccctga

SEQ ID NO: 8224603 - DNA, 21 bp, Homo sapiens
cctccaggagcagagccctga

SEQ ID NO: 8224604 - DNA, 21 bp, Homo sapiens
cctccaggagcagagccctga

SEQ ID NO: 8224605 - DNA, 22 bp, Homo sapiens
cctccaggaacttgagagacac

SEQ ID NO: 8224606 - DNA, 22 bp, Homo sapiens
cctccaggaacttgagagacac

SEQ ID NO: 8224607 - DNA, 22 bp, Homo sapiens
cctcagtgagatgctcagcgaa

SEQ ID NO: 8224608 - DNA, 22 bp, Homo sapiens
cctccagctgcctcagtctctt

SEQ ID NO: 8224609 - DNA, 23 bp, Homo sapiens
cctcccaggctgcgagtcccgag

SEQ ID NO: 8224610 - DNA, 23 bp, Homo sapiens
cctcccaggctgcgagtcccgag

SEQ ID NO: 8224611 - DNA, 22 bp, Homo sapiens
cctccaggccttgcaggttaac

SEQ ID NO: 8224612 - DNA, 20 bp, Homo sapiens
cctccaggcacacccatgtg

SEQ ID NO: 8224613 - DNA, 20 bp, Homo sapiens
cctccaggcacacccatgtg

SEQ ID NO: 8224614 - DNA, 22 bp, Homo sapiens
cctccaggataagtcagggcct

SEQ ID NO: 8224615 - DNA, 20 bp, Homo sapiens
cctccaggcacacccatgtg

SEQ ID NO: 8224616 - DNA, 20 bp, Homo sapiens
cctccaggcacacccatgtg

SEQ ID NO: 8224617 - DNA, 22 bp, Homo sapiens
cctccaggataagtcagggcct

SEQ ID NO: 8224618 - DNA, 22 bp, Homo sapiens
cctccaggataagtcagggcct

SEQ ID NO: 8224619 - DNA, 22 bp, Homo sapiens
cctccaggataagtcagggcct

SEQ ID NO: 8224620 - DNA, 22 bp, Homo sapiens
cctcccagtgcctccagagcag

SEQ ID NO: 8224621 - DNA, 22 bp, Homo sapiens
cctcccatggagctctgtccat

SEQ ID NO: 8224622 - DNA, 22 bp, Homo sapiens
cctcccatggagctctgtccat

SEQ ID NO: 8224623 - DNA, 22 bp, Homo sapiens
cctcccagtgccggggccggct

SEQ ID NO: 8224624 - DNA, 22 bp, Homo sapiens
cctcccagtgcctccagagcag

SEQ ID NO: 8224625 - DNA, 22 bp, Homo sapiens
cctcccagtgcctccagagcag

SEQ ID NO: 8224626 - DNA, 22 bp, Homo sapiens
cctcccagtgcctccagagcag

SEQ ID NO: 8224627 - DNA, 22 bp, Homo sapiens
cctcccagtgcctccagagcag

SEQ ID NO: 8224628 - DNA, 22 bp, Homo sapiens
cctcccagtgcctccagagcag

SEQ ID NO: 8224629 - DNA, 22 bp, Homo sapiens
cctccccacaggccaaataggc

SEQ ID NO: 8224630 - DNA, 22 bp, Homo sapiens
cctccccacaggccaaataggc

SEQ ID NO: 8224631 - DNA, 22 bp, Homo sapiens
cctccccacaggccaaataggc

SEQ ID NO: 8224632 - DNA, 23 bp, Homo sapiens
cctccccaccagactctaacata

SEQ ID NO: 8224633 - DNA, 23 bp, Homo sapiens
cctccccaccagactctaacata

SEQ ID NO: 8224634 - DNA, 22 bp, Homo sapiens
cctccccacagcccaggagact

SEQ ID NO: 8224635 - DNA, 22 bp, Homo sapiens
cctcccatggagctctgtccat

SEQ ID NO: 8224636 - DNA, 22 bp, Homo sapiens
cctccccacagcccaggagact

SEQ ID NO: 8224637 - DNA, 22 bp, Homo sapiens
cctccccacagcccaggagact

SEQ ID NO: 8224638 - DNA, 22 bp, Homo sapiens
cctccccacagcccaggagact

SEQ ID NO: 8224639 - DNA, 22 bp, Homo sapiens
cctcgcggcactcgggccggat

SEQ ID NO: 8224640 - DNA, 22 bp, Homo sapiens
cctctccttgcacccgtcccgc

SEQ ID NO: 8224641 - DNA, 22 bp, Homo sapiens
cctctccttgcacccgtcccgc

SEQ ID NO: 8224642 - DNA, 22 bp, Homo sapiens
cctcgagcagcgacccctccac

SEQ ID NO: 8224643 - DNA, 22 bp, Homo sapiens
cctccccacccacggctggtgg

SEQ ID NO: 8224644 - DNA, 22 bp, Homo sapiens
cctccccacccacggctggtgg

SEQ ID NO: 8224645 - DNA, 22 bp, Homo sapiens
cctctccttgcacccgtcccgc

SEQ ID NO: 8224646 - DNA, 22 bp, Homo sapiens
cctctctcagcttgctgcaact

SEQ ID NO: 8224647 - DNA, 22 bp, Homo sapiens
cctctctcagcttgctgcaact

SEQ ID NO: 8224648 - DNA, 22 bp, Homo sapiens
cctctctcagcttgctgcaact

SEQ ID NO: 8224649 - DNA, 22 bp, Homo sapiens
cctctctccaagggaaatccta

SEQ ID NO: 8224650 - DNA, 22 bp, Homo sapiens
cctctctccaagggaaatccta

SEQ ID NO: 8224651 - DNA, 21 bp, Homo sapiens
cctctctcattgtaatgaagt

SEQ ID NO: 8224652 - DNA, 21 bp, Homo sapiens
cctctctcattgtaatgaagt

SEQ ID NO: 8224653 - DNA, 22 bp, Homo sapiens
cctctctccaagggaaatccta

SEQ ID NO: 8224654 - DNA, 22 bp, Homo sapiens
cctctctccaattttcacctca

SEQ ID NO: 8224655 - DNA, 22 bp, Homo sapiens
cctcagaccttgctagtagtct

SEQ ID NO: 8224656 - DNA, 22 bp, Homo sapiens
cctcagaccttgctagtagtct

SEQ ID NO: 8224657 - DNA, 22 bp, Homo sapiens
cctcagacgcaggcctatgggc

SEQ ID NO: 8224658 - DNA, 22 bp, Homo sapiens
cctcagactcagtgcgttgtga

SEQ ID NO: 8224659 - DNA, 22 bp, Homo sapiens
cctcagacccctgctgagcttc

SEQ ID NO: 8224660 - DNA, 22 bp, Homo sapiens
cctcagacccctgctgagcttc

SEQ ID NO: 8224661 - DNA, 22 bp, Homo sapiens
cctcagacacagtcaagctttt

SEQ ID NO: 8224662 - DNA, 22 bp, Homo sapiens
cctcagaccccacagggcctgt

SEQ ID NO: 8224663 - DNA, 22 bp, Homo sapiens
cctcagaccccacagggcctgt

SEQ ID NO: 8224664 - DNA, 22 bp, Homo sapiens
cctcagagacagtaactggaat

SEQ ID NO: 8224665 - DNA, 21 bp, Homo sapiens
cctcagagacagatacgggtg

SEQ ID NO: 8224666 - DNA, 22 bp, Homo sapiens
cctcagagaaaggtatggctga

SEQ ID NO: 8224667 - DNA, 22 bp, Homo sapiens
cctcagagaaatgtctattcaa

SEQ ID NO: 8224668 - DNA, 22 bp, Homo sapiens
cctcagacttgataattgggtt

SEQ ID NO: 8224669 - DNA, 22 bp, Homo sapiens
cctcagagaaaggtatggctga

SEQ ID NO: 8224670 - DNA, 22 bp, Homo sapiens
cctcagagcctccagaaggaat

SEQ ID NO: 8224671 - DNA, 22 bp, Homo sapiens
cctcagagccatgcctgagttc

SEQ ID NO: 8224672 - DNA, 22 bp, Homo sapiens
cctcagagcagcacccagatga

SEQ ID NO: 8224673 - DNA, 23 bp, Homo sapiens
cctcagagaggcagagccacatg

SEQ ID NO: 8224674 - DNA, 22 bp, Homo sapiens
cctcagagacagtaactggaat

SEQ ID NO: 8224675 - DNA, 22 bp, Homo sapiens
cctcagagactgcatcttccct

SEQ ID NO: 8224676 - DNA, 22 bp, Homo sapiens
cctcagagactgcatcttccct

SEQ ID NO: 8224677 - DNA, 22 bp, Homo sapiens
cctcagacacagtcaagctttt

SEQ ID NO: 8224678 - DNA, 18 bp, Homo sapiens
cctcacagacttccatgt

SEQ ID NO: 8224679 - DNA, 22 bp, Homo sapiens
cctcagaatagtcctcagatca

SEQ ID NO: 8224680 - DNA, 22 bp, Homo sapiens
cctcacacagttatctcttcat

SEQ ID NO: 8224681 - DNA, 22 bp, Homo sapiens
cctcaagttggaaataaaatgt

SEQ ID NO: 8224682 - DNA, 21 bp, Homo sapiens
cctcaagtgcctcctgctgct

SEQ ID NO: 8224683 - DNA, 22 bp, Homo sapiens
cctcaagtcaattctgtctcgc

SEQ ID NO: 8224684 - DNA, 20 bp, Homo sapiens
cctcaagcagactgacagct

SEQ ID NO: 8224685 - DNA, 22 bp, Homo sapiens
cctcaaattgtcaaataagaat

SEQ ID NO: 8224686 - DNA, 22 bp, Homo sapiens
cctcaaattggcattaattaag

SEQ ID NO: 8224687 - DNA, 22 bp, Homo sapiens
cctcaaattggcattaattaag

SEQ ID NO: 8224688 - DNA, 22 bp, Homo sapiens
cctcaaattgtcaaataagaat

SEQ ID NO: 8224689 - DNA, 22 bp, Homo sapiens
cctcaaatctttagagttattt

SEQ ID NO: 8224690 - DNA, 22 bp, Homo sapiens
cctcaaatctttagagttattt

SEQ ID NO: 8224691 - DNA, 22 bp, Homo sapiens
cctcaaatagcccccagtctag

SEQ ID NO: 8224692 - DNA, 23 bp, Homo sapiens
cctcaaatgtagcctttttccca

SEQ ID NO: 8224693 - DNA, 23 bp, Homo sapiens
cctcaaatgtagcctttttccca

SEQ ID NO: 8224694 - DNA, 22 bp, Homo sapiens
cctcaaattgctcagcgtctag

SEQ ID NO: 8224695 - DNA, 22 bp, Homo sapiens
cctcaaattgctcagcgtctag

SEQ ID NO: 8224696 - DNA, 22 bp, Homo sapiens
ccctgggtctaggttatgtgct

SEQ ID NO: 8224697 - DNA, 22 bp, Homo sapiens
ccctgtgtagttaactttccac

SEQ ID NO: 8224698 - DNA, 17 bp, Homo sapiens
ccctgggtgagttctca

SEQ ID NO: 8224699 - DNA, 22 bp, Homo sapiens
ccctgggttctggctgggctgc

SEQ ID NO: 8224700 - DNA, 22 bp, Homo sapiens
ccctgggttctggctgggctgc

SEQ ID NO: 8224701 - DNA, 21 bp, Homo sapiens
ccctgtgttccacagcagaca

SEQ ID NO: 8224702 - DNA, 22 bp, Homo sapiens
cccttcagggttaagtagaggg

SEQ ID NO: 8224703 - DNA, 22 bp, Homo sapiens
cccttcagggttaagtagaggg

SEQ ID NO: 8224704 - DNA, 22 bp, Homo sapiens
cccttcagctgagtgggacagc

SEQ ID NO: 8224705 - DNA, 23 bp, Homo sapiens
cccttcagcgagggcattaaggt

SEQ ID NO: 8224706 - DNA, 22 bp, Homo sapiens
cccttagctcaatttcttgccc

SEQ ID NO: 8224707 - DNA, 22 bp, Homo sapiens
cccttagctccaaggggtttgg

SEQ ID NO: 8224708 - DNA, 22 bp, Homo sapiens
cctcaaagtagagggagatgag

SEQ ID NO: 8224709 - DNA, 20 bp, Homo sapiens
cctcaaataagtgccagcat

SEQ ID NO: 8224710 - DNA, 20 bp, Homo sapiens
cctcaaataagtgccagcat

SEQ ID NO: 8224711 - DNA, 22 bp, Homo sapiens
cctcaaataagttttatttatc

SEQ ID NO: 8224712 - DNA, 22 bp, Homo sapiens
cctcaaataagttttatttatc

SEQ ID NO: 8224713 - DNA, 22 bp, Homo sapiens
cctcaaatagcccccagtctag

SEQ ID NO: 8224714 - DNA, 22 bp, Homo sapiens
cctagactagaggcagggagcc

SEQ ID NO: 8224715 - DNA, 22 bp, Homo sapiens
ccatgagccagctctaagcaaa

SEQ ID NO: 8224716 - DNA, 22 bp, Homo sapiens
ccatgaattcactccatgctag

SEQ ID NO: 8224717 - DNA, 22 bp, Homo sapiens
ccatgaattcactccatgctag

SEQ ID NO: 8224718 - DNA, 22 bp, Homo sapiens
ccatgacccctggcatccaggg

SEQ ID NO: 8224719 - DNA, 22 bp, Homo sapiens
ccatgacccctggcatccaggg

SEQ ID NO: 8224720 - DNA, 22 bp, Homo sapiens
ccatgaccatacctgggcctga

SEQ ID NO: 8224721 - DNA, 22 bp, Homo sapiens
ccatgaattcactccatgctag

SEQ ID NO: 8224722 - DNA, 22 bp, Homo sapiens
ccatgcaacagaatccagattt

SEQ ID NO: 8224723 - DNA, 22 bp, Homo sapiens
ccatctccagtttattcttcct

SEQ ID NO: 8224724 - DNA, 22 bp, Homo sapiens
ccatctgactgccacccaggcc

SEQ ID NO: 8224725 - DNA, 22 bp, Homo sapiens
ccatctccagtttattcttcct

SEQ ID NO: 8224726 - DNA, 22 bp, Homo sapiens
ccatctggatctgtccactgac

SEQ ID NO: 8224727 - DNA, 22 bp, Homo sapiens
ccatcttctcttgaacctcctt

SEQ ID NO: 8224728 - DNA, 22 bp, Homo sapiens
ccatgaattcactccatgctag

SEQ ID NO: 8224729 - DNA, 22 bp, Homo sapiens
ccatccttgtcatcttcatgtt

SEQ ID NO: 8224730 - DNA, 21 bp, Homo sapiens
ccataattttgtttcagaagt

SEQ ID NO: 8224731 - DNA, 21 bp, Homo sapiens
ccataattttgtttcagaagt

SEQ ID NO: 8224732 - DNA, 21 bp, Homo sapiens
ccataattttgtttcagaagt

SEQ ID NO: 8224733 - DNA, 22 bp, Homo sapiens
ccataattgggtagccatctga

SEQ ID NO: 8224734 - DNA, 22 bp, Homo sapiens
ccataaagcactgaatcaccga

SEQ ID NO: 8224735 - DNA, 22 bp, Homo sapiens
ccagtttgaggaagaagtagat

SEQ ID NO: 8224736 - DNA, 22 bp, Homo sapiens
ccataaggttgaaaactgtaca

SEQ ID NO: 8224737 - DNA, 22 bp, Homo sapiens
ccataaggagccagacattcca

SEQ ID NO: 8224738 - DNA, 22 bp, Homo sapiens
cccagcctcagctttacttcca

SEQ ID NO: 8224739 - DNA, 22 bp, Homo sapiens
cccagcatcctcagggagcggg

SEQ ID NO: 8224740 - DNA, 22 bp, Homo sapiens
cccagcatctccaggcatggcc

SEQ ID NO: 8224741 - DNA, 22 bp, Homo sapiens
cccagcatcccagtgggcagca

SEQ ID NO: 8224742 - DNA, 22 bp, Homo sapiens
cccagcatcctcagggagcggg

SEQ ID NO: 8224743 - DNA, 22 bp, Homo sapiens
cccagcatcccagtgggcagca

SEQ ID NO: 8224744 - DNA, 22 bp, Homo sapiens
cccagcatcccagtgggcagca

SEQ ID NO: 8224745 - DNA, 22 bp, Homo sapiens
cccagcagtggttctcaaactt

SEQ ID NO: 8224746 - DNA, 22 bp, Homo sapiens
cccagcagttgttggtgcacat

SEQ ID NO: 8224747 - DNA, 22 bp, Homo sapiens
cccagcagttgttggtgcacat

SEQ ID NO: 8224748 - DNA, 22 bp, Homo sapiens
cccagcagtttgcttagagtga

SEQ ID NO: 8224749 - DNA, 22 bp, Homo sapiens
cccagcagtgacccagtgatac

SEQ ID NO: 8224750 - DNA, 22 bp, Homo sapiens
cccagcagtgacccagtgatac

SEQ ID NO: 8224751 - DNA, 22 bp, Homo sapiens
cccagcagtacccaagcccttg

SEQ ID NO: 8224752 - DNA, 22 bp, Homo sapiens
cccagcacaggcaattccatac

SEQ ID NO: 8224753 - DNA, 22 bp, Homo sapiens
cccagcacaggcaattccatac

SEQ ID NO: 8224754 - DNA, 22 bp, Homo sapiens
cccagcctctgtttgctcctct

SEQ ID NO: 8224755 - DNA, 22 bp, Homo sapiens
cccagcctctgggttctgccgg

SEQ ID NO: 8224756 - DNA, 22 bp, Homo sapiens
cccagcctctgtttgctcctct

SEQ ID NO: 8224757 - DNA, 22 bp, Homo sapiens
cccagcctctgtttgctcctct

SEQ ID NO: 8224758 - DNA, 22 bp, Homo sapiens
cccagcctctgggctcacccaa

SEQ ID NO: 8224759 - DNA, 22 bp, Homo sapiens
cccagcctctgggctcacccaa

SEQ ID NO: 8224760 - DNA, 22 bp, Homo sapiens
cccagcctctggattctgccct

SEQ ID NO: 8224761 - DNA, 18 bp, Homo sapiens
cccagcctctcctttcta

SEQ ID NO: 8224762 - DNA, 22 bp, Homo sapiens
cccagcctggtgcactgtgggg

SEQ ID NO: 8224763 - DNA, 22 bp, Homo sapiens
cccagcctgatctcggccagct

SEQ ID NO: 8224764 - DNA, 22 bp, Homo sapiens
cccagctccttggatgggcagg

SEQ ID NO: 8224765 - DNA, 22 bp, Homo sapiens
cccagctccttggatgggcagg

SEQ ID NO: 8224766 - DNA, 22 bp, Homo sapiens
cccagctccttgtttgcatctc

SEQ ID NO: 8224767 - DNA, 22 bp, Homo sapiens
cccagctccttgtttgcatctc

SEQ ID NO: 8224768 - DNA, 22 bp, Homo sapiens
cccagctcgccgccgatgtgcg

SEQ ID NO: 8224769 - DNA, 22 bp, Homo sapiens
cccagctcgccgccgatgtgcg

SEQ ID NO: 8224770 - DNA, 22 bp, Homo sapiens
cccagctctaggagtggtggca

SEQ ID NO: 8224771 - DNA, 22 bp, Homo sapiens
cccagctctaggagtggtggca

SEQ ID NO: 8224772 - DNA, 22 bp, Homo sapiens
aggctgtgtttcccctggagct

SEQ ID NO: 8224773 - DNA, 22 bp, Homo sapiens
aggctgtgtttcccctggagct

SEQ ID NO: 8224774 - DNA, 22 bp, Homo sapiens
aggctgtgtttcccctggagct

SEQ ID NO: 8224775 - DNA, 22 bp, Homo sapiens
cccagctctggaaggtggggga

SEQ ID NO: 8224776 - DNA, 22 bp, Homo sapiens
aggctgtgtttaagtggtaatg

SEQ ID NO: 8224777 - DNA, 22 bp, Homo sapiens
aggctgtgtaaagtgctttccc

SEQ ID NO: 8224778 - DNA, 22 bp, Homo sapiens
cccagctctgccatctacccac

SEQ ID NO: 8224779 - DNA, 22 bp, Homo sapiens
cccagctctgcagacctgccct

SEQ ID NO: 8224780 - DNA, 22 bp, Homo sapiens
cccagctctgcagacctgccct

SEQ ID NO: 8224781 - DNA, 22 bp, Homo sapiens
cccagctctggaaggtggggga

SEQ ID NO: 8224782 - DNA, 22 bp, Homo sapiens
cccagctctgccatctacccac

SEQ ID NO: 8224783 - DNA, 22 bp, Homo sapiens
cccagctctgccatctacccac

SEQ ID NO: 8224784 - DNA, 22 bp, Homo sapiens
cccagctctctcagttctgctt

SEQ ID NO: 8224785 - DNA, 22 bp, Homo sapiens
cccagctctctcagttctgctt

SEQ ID NO: 8224786 - DNA, 22 bp, Homo sapiens
cccagctctctgctcttagcct

SEQ ID NO: 8224787 - DNA, 22 bp, Homo sapiens
cccagctctctgctcttagcct

SEQ ID NO: 8224788 - DNA, 22 bp, Homo sapiens
cccagctctctgctcttagcct

SEQ ID NO: 8224789 - DNA, 22 bp, Homo sapiens
cccagctctcgcacttactagc

SEQ ID NO: 8224790 - DNA, 22 bp, Homo sapiens
cccagctctcgcacttactagc

SEQ ID NO: 8224791 - DNA, 22 bp, Homo sapiens
cccagctctaggagtggtggca

SEQ ID NO: 8224792 - DNA, 22 bp, Homo sapiens
cccagctctcgcacttactagc

SEQ ID NO: 8224793 - DNA, 19 bp, Homo sapiens
cccagctctcgtggtgtgc

SEQ ID NO: 8224794 - DNA, 19 bp, Homo sapiens
cccagctctcgtggtgtgc

SEQ ID NO: 8224795 - DNA, 19 bp, Homo sapiens
agggaaggattctgtcatt

SEQ ID NO: 8224796 - DNA, 22 bp, Homo sapiens
agggaaggaggttagaacccac

SEQ ID NO: 8224797 - DNA, 22 bp, Homo sapiens
agggaaggaggttagaacccac

SEQ ID NO: 8224798 - DNA, 22 bp, Homo sapiens
agggaaggaggttagaacccac

SEQ ID NO: 8224799 - DNA, 22 bp, Homo sapiens
agggaaggaggccatgtgtccc

SEQ ID NO: 8224800 - DNA, 22 bp, Homo sapiens
agggaaggaggccatgtgtccc

SEQ ID NO: 8224801 - DNA, 22 bp, Homo sapiens
agggaagggaaaaacactcgtc

SEQ ID NO: 8224802 - DNA, 22 bp, Homo sapiens
agggaaggcttttgacatttcc

SEQ ID NO: 8224803 - DNA, 22 bp, Homo sapiens
agggaaggcttttgacatttcc

SEQ ID NO: 8224804 - DNA, 22 bp, Homo sapiens
agggaaggcttttgacatttcc

SEQ ID NO: 8224805 - DNA, 19 bp, Homo sapiens
agggaaggattctgtcatt

SEQ ID NO: 8224806 - DNA, 19 bp, Homo sapiens
agggaaggattctgtcatt

SEQ ID NO: 8224807 - DNA, 22 bp, Homo sapiens
agggaaggcttttgacatttcc

SEQ ID NO: 8224808 - DNA, 22 bp, Homo sapiens
agggaagaagctggtagtaggt

SEQ ID NO: 8224809 - DNA, 22 bp, Homo sapiens
agggaagaagctggtagtaggt

SEQ ID NO: 8224810 - DNA, 22 bp, Homo sapiens
aggcttaatgagttaaatcact

SEQ ID NO: 8224811 - DNA, 22 bp, Homo sapiens
aggcttagaaattcagctgagt

SEQ ID NO: 8224812 - DNA, 22 bp, Homo sapiens
aggcttagactacctggtctgt

SEQ ID NO: 8224813 - DNA, 21 bp, Homo sapiens
aggcttagcaatttcctatgg

SEQ ID NO: 8224814 - DNA, 22 bp, Homo sapiens
agggaaggaaaagctgtcgctt

SEQ ID NO: 8224815 - DNA, 22 bp, Homo sapiens
agggaaggaaaagctgtcgctt

SEQ ID NO: 8224816 - DNA, 22 bp, Homo sapiens
agggaaggaaaagctgtcgctt

SEQ ID NO: 8224817 - DNA, 22 bp, Homo sapiens
agggaaggaaaagctgtcgctt

SEQ ID NO: 8224818 - DNA, 22 bp, Homo sapiens
agggaaggaaaagctgtcgctt

SEQ ID NO: 8224819 - DNA, 22 bp, Homo sapiens
agggaaggaggccatgtgtccc

SEQ ID NO: 8224820 - DNA, 22 bp, Homo sapiens
agggagagtagatatcaggtgt

SEQ ID NO: 8224821 - DNA, 22 bp, Homo sapiens
agggagaggttgaaacctcagt

SEQ ID NO: 8224822 - DNA, 22 bp, Homo sapiens
agggagagtagatatcaggtgt

SEQ ID NO: 8224823 - DNA, 22 bp, Homo sapiens
agggagagtagatatcaggtgt

SEQ ID NO: 8224824 - DNA, 22 bp, Homo sapiens
agggagagtagatatcaggtgt

SEQ ID NO: 8224825 - DNA, 22 bp, Homo sapiens
agggagaggctgaactatccta

SEQ ID NO: 8224826 - DNA, 22 bp, Homo sapiens
agggagaggttgaaacctcagt

SEQ ID NO: 8224827 - DNA, 19 bp, Homo sapiens
agggaatccggctgaggga

SEQ ID NO: 8224828 - DNA, 19 bp, Homo sapiens
agggaatccggctgaggga

SEQ ID NO: 8224829 - DNA, 19 bp, Homo sapiens
agggaatccggctgaggga

SEQ ID NO: 8224830 - DNA, 22 bp, Homo sapiens
agggagaaggtttagctgtgag

SEQ ID NO: 8224831 - DNA, 22 bp, Homo sapiens
agggaatgctccgtataaatct

SEQ ID NO: 8224832 - DNA, 22 bp, Homo sapiens
agggaatgctccgtataaatct

SEQ ID NO: 8224833 - DNA, 19 bp, Homo sapiens
agggagaattccaagagga

SEQ ID NO: 8224834 - DNA, 22 bp, Homo sapiens
agggagaggctgaactatccta

SEQ ID NO: 8224835 - DNA, 22 bp, Homo sapiens
agggaagtgataggacgtctct

SEQ ID NO: 8224836 - DNA, 19 bp, Homo sapiens
agggaatccggctgaggga

SEQ ID NO: 8224837 - DNA, 19 bp, Homo sapiens
agggaatccggctgaggga

SEQ ID NO: 8224838 - DNA, 22 bp, Homo sapiens
agggaagtccatgggggcggtg

SEQ ID NO: 8224839 - DNA, 22 bp, Homo sapiens
agggaaggtagaggtcaccggc

SEQ ID NO: 8224840 - DNA, 22 bp, Homo sapiens
agggaaggtagaggtcaccggc

SEQ ID NO: 8224841 - DNA, 22 bp, Homo sapiens
agggaagggcagggtctatgca

SEQ ID NO: 8224842 - DNA, 22 bp, Homo sapiens
agggaagggcagggtctatgca

SEQ ID NO: 8224843 - DNA, 22 bp, Homo sapiens
agggaagggcagggtctatgca

SEQ ID NO: 8224844 - DNA, 23 bp, Homo sapiens
agggaagggggcttattccacag

SEQ ID NO: 8224845 - DNA, 22 bp, Homo sapiens
agggaagggcagggtctatgca

SEQ ID NO: 8224846 - DNA, 23 bp, Homo sapiens
agggaagggggcttattccacag

SEQ ID NO: 8224847 - DNA, 22 bp, Homo sapiens
agggagcatgggtgaagcaggc

SEQ ID NO: 8224848 - DNA, 22 bp, Homo sapiens
agggagcatgggtgaagcaggc

SEQ ID NO: 8224849 - DNA, 22 bp, Homo sapiens
agggagcatgggtgaagcaggc

SEQ ID NO: 8224850 - DNA, 22 bp, Homo sapiens
agggagcatgggtgaagcaggc

SEQ ID NO: 8224851 - DNA, 22 bp, Homo sapiens
agggagccagagttgggagctc

SEQ ID NO: 8224852 - DNA, 22 bp, Homo sapiens
agggagccaggggccagctatt

SEQ ID NO: 8224853 - DNA, 22 bp, Homo sapiens
agggagccaggaacgcaggtcg

SEQ ID NO: 8224854 - DNA, 22 bp, Homo sapiens
agggagccctgaaccagagggt

SEQ ID NO: 8224855 - DNA, 22 bp, Homo sapiens
agggagccagagttgggagctc

SEQ ID NO: 8224856 - DNA, 22 bp, Homo sapiens
agggagccagagttgggagctc

SEQ ID NO: 8224857 - DNA, 22 bp, Homo sapiens
agggagccaggaacgcaggtcg

SEQ ID NO: 8224858 - DNA, 22 bp, Homo sapiens
agggagccaggaacgcaggtcg

SEQ ID NO: 8224859 - DNA, 22 bp, Homo sapiens
agggagatcgaccgtgttatat

SEQ ID NO: 8224860 - DNA, 22 bp, Homo sapiens
agggagcaaaggtttcagggtt

SEQ ID NO: 8224861 - DNA, 22 bp, Homo sapiens
agggagagtagatatcaggtgt

SEQ ID NO: 8224862 - DNA, 22 bp, Homo sapiens
agggagagtttgatgtttcctc

SEQ ID NO: 8224863 - DNA, 22 bp, Homo sapiens
agggagagtttgatgtttcctc

SEQ ID NO: 8224864 - DNA, 22 bp, Homo sapiens
agggagagtttgatgtttcctc

SEQ ID NO: 8224865 - DNA, 22 bp, Homo sapiens
agggagcatgggtgaagcaggc

SEQ ID NO: 8224866 - DNA, 18 bp, Homo sapiens
agggagcatctggttgcc

SEQ ID NO: 8224867 - DNA, 22 bp, Homo sapiens
agggagcagggctcctttgggt

SEQ ID NO: 8224868 - DNA, 18 bp, Homo sapiens
agggagcatctggttgcc

SEQ ID NO: 8224869 - DNA, 22 bp, Homo sapiens
ccccatgggtgtagggaggtgg

SEQ ID NO: 8224870 - DNA, 21 bp, Homo sapiens
ccccatggagtacagttgggc

SEQ ID NO: 8224871 - DNA, 22 bp, Homo sapiens
ccccatggcaactgctgggggt

SEQ ID NO: 8224872 - DNA, 22 bp, Homo sapiens
ccccatggcaactgctgggggt

SEQ ID NO: 8224873 - DNA, 22 bp, Homo sapiens
agggagctttttcatgtgtcta

SEQ ID NO: 8224874 - DNA, 22 bp, Homo sapiens
agggagctttttcatgtgtcta

SEQ ID NO: 8224875 - DNA, 22 bp, Homo sapiens
agggaggaaggaactccttcta

SEQ ID NO: 8224876 - DNA, 22 bp, Homo sapiens
ccccagtggaggtgagggtcct

SEQ ID NO: 8224877 - DNA, 22 bp, Homo sapiens
ccccatcctattcatgtttctg

SEQ ID NO: 8224878 - DNA, 22 bp, Homo sapiens
ccccatcctattcatgtttctg

SEQ ID NO: 8224879 - DNA, 22 bp, Homo sapiens
ccccatgaagtagggtctctga

SEQ ID NO: 8224880 - DNA, 22 bp, Homo sapiens
ccccagggtcagtgtgtggagg

SEQ ID NO: 8224881 - DNA, 22 bp, Homo sapiens
ccccagggtcagtgtgtggagg

SEQ ID NO: 8224882 - DNA, 22 bp, Homo sapiens
ccccagggtcagtgtgtggagg

SEQ ID NO: 8224883 - DNA, 22 bp, Homo sapiens
ccccagggtcagtgtgtggagg

SEQ ID NO: 8224884 - DNA, 19 bp, Homo sapiens
ccccagggtaggctagggg

SEQ ID NO: 8224885 - DNA, 19 bp, Homo sapiens
ccccagggtaggctagggg

SEQ ID NO: 8224886 - DNA, 19 bp, Homo sapiens
ccccagggtaggctagggg

SEQ ID NO: 8224887 - DNA, 22 bp, Homo sapiens
ccccagggactggtttcatgga

SEQ ID NO: 8224888 - DNA, 22 bp, Homo sapiens
ccccagggactggtttcatgga

SEQ ID NO: 8224889 - DNA, 22 bp, Homo sapiens
ccccagcagactcagggcaggt

SEQ ID NO: 8224890 - DNA, 22 bp, Homo sapiens
ccccagggaagctttgcttact

SEQ ID NO: 8224891 - DNA, 22 bp, Homo sapiens
ccccagggaagctttgcttact

SEQ ID NO: 8224892 - DNA, 22 bp, Homo sapiens
ccccagcacttggagtggggag

SEQ ID NO: 8224893 - DNA, 22 bp, Homo sapiens
ccccagcacttggagtggggag

SEQ ID NO: 8224894 - DNA, 22 bp, Homo sapiens
cattaacactttggatttagac

SEQ ID NO: 8224895 - DNA, 22 bp, Homo sapiens
catggctcggggacaggaggta

SEQ ID NO: 8224896 - DNA, 22 bp, Homo sapiens
catggctcggggacaggaggta

SEQ ID NO: 8224897 - DNA, 22 bp, Homo sapiens
catggctcacaggatgggctag

SEQ ID NO: 8224898 - DNA, 22 bp, Homo sapiens
cattaagatttttttctactgg

SEQ ID NO: 8224899 - DNA, 22 bp, Homo sapiens
catggccttgagtgactgcact

SEQ ID NO: 8224900 - DNA, 22 bp, Homo sapiens
catggccttgagtgactgcact

SEQ ID NO: 8224901 - DNA, 22 bp, Homo sapiens
catggccttgagtgactgcact

SEQ ID NO: 8224902 - DNA, 22 bp, Homo sapiens
catggcggtcaggatgtaggtg

SEQ ID NO: 8224903 - DNA, 22 bp, Homo sapiens
catggcggtcaggatgtaggtg

SEQ ID NO: 8224904 - DNA, 22 bp, Homo sapiens
catggccccaaatcccatgcat

SEQ ID NO: 8224905 - DNA, 22 bp, Homo sapiens
catggccccaaatcccatgcat

SEQ ID NO: 8224906 - DNA, 22 bp, Homo sapiens
catggcctcaaaggactgcaga

SEQ ID NO: 8224907 - DNA, 22 bp, Homo sapiens
catggccctcttctggagcaat

SEQ ID NO: 8224908 - DNA, 22 bp, Homo sapiens
catggcctcaaaggactgcaga

SEQ ID NO: 8224909 - DNA, 22 bp, Homo sapiens
catggccctcttctggagcaat

SEQ ID NO: 8224910 - DNA, 22 bp, Homo sapiens
catggcctgcctcctcctggtg

SEQ ID NO: 8224911 - DNA, 22 bp, Homo sapiens
catggcctgcctcctcctggtg

SEQ ID NO: 8224912 - DNA, 22 bp, Homo sapiens
catggcctctctcctggaatgg

SEQ ID NO: 8224913 - DNA, 22 bp, Homo sapiens
catggcctcaaaggactgcaga

SEQ ID NO: 8224914 - DNA, 22 bp, Homo sapiens
cattatctgccattgacaccat

SEQ ID NO: 8224915 - DNA, 22 bp, Homo sapiens
cattatgaagcatcatcttatt

SEQ ID NO: 8224916 - DNA, 22 bp, Homo sapiens
cattatctcttctatatgctag

SEQ ID NO: 8224917 - DNA, 22 bp, Homo sapiens
cattatctgagagtgtcctaca

SEQ ID NO: 8224918 - DNA, 22 bp, Homo sapiens
cattatggaagtgaagagctct

SEQ ID NO: 8224919 - DNA, 22 bp, Homo sapiens
cattatggaagacagtgtggtg

SEQ ID NO: 8224920 - DNA, 22 bp, Homo sapiens
cattatggcagccaggatattg

SEQ ID NO: 8224921 - DNA, 22 bp, Homo sapiens
cattatggcagccaggatattg

SEQ ID NO: 8224922 - DNA, 20 bp, Homo sapiens
cattatggttgggcacagtg

SEQ ID NO: 8224923 - DNA, 20 bp, Homo sapiens
cattatggttgggcacagtg

SEQ ID NO: 8224924 - DNA, 22 bp, Homo sapiens
cattatgttcagtagcttaaaa

SEQ ID NO: 8224925 - DNA, 22 bp, Homo sapiens
cattatgttcagtagcttaaaa

SEQ ID NO: 8224926 - DNA, 22 bp, Homo sapiens
cattattaattcagcacatgct

SEQ ID NO: 8224927 - DNA, 22 bp, Homo sapiens
cattatgtgggaaaatgttctt

SEQ ID NO: 8224928 - DNA, 22 bp, Homo sapiens
cattatgtgcgtacatgtatct

SEQ ID NO: 8224929 - DNA, 22 bp, Homo sapiens
cattccgctccccttccttgcg

SEQ ID NO: 8224930 - DNA, 22 bp, Homo sapiens
cattcctattatgtccctagtg

SEQ ID NO: 8224931 - DNA, 19 bp, Homo sapiens
aggcagcacccagtccttg

SEQ ID NO: 8224932 - DNA, 19 bp, Homo sapiens
aggcagcacccagtccttg

SEQ ID NO: 8224933 - DNA, 19 bp, Homo sapiens
aggcagaggcttggctagc

SEQ ID NO: 8224934 - DNA, 22 bp, Homo sapiens
cattcaaacattaatttattca

SEQ ID NO: 8224935 - DNA, 22 bp, Homo sapiens
cattcaaagcaggaaaggcctt

SEQ ID NO: 8224936 - DNA, 22 bp, Homo sapiens
cattcaaagcaggaaaggcctt

SEQ ID NO: 8224937 - DNA, 22 bp, Homo sapiens
cattcatttgcccagtaagtca

SEQ ID NO: 8224938 - DNA, 22 bp, Homo sapiens
cattcatttgcccagtaagtca

SEQ ID NO: 8224939 - DNA, 22 bp, Homo sapiens
cattcaaaagctccatgtttgt

SEQ ID NO: 8224940 - DNA, 22 bp, Homo sapiens
cattcaaaagctccatgtttgt

SEQ ID NO: 8224941 - DNA, 22 bp, Homo sapiens
cattcaaaatgggctgacctgt

SEQ ID NO: 8224942 - DNA, 22 bp, Homo sapiens
cattcccatgactcctgctcag

SEQ ID NO: 8224943 - DNA, 22 bp, Homo sapiens
cattcccacgtgttctttgctt

SEQ ID NO: 8224944 - DNA, 22 bp, Homo sapiens
cattccagagctgcctctgcta

SEQ ID NO: 8224945 - DNA, 22 bp, Homo sapiens
cattccagctctcatactctgg

SEQ ID NO: 8224946 - DNA, 18 bp, Homo sapiens
cattccaagttctacctc

SEQ ID NO: 8224947 - DNA, 22 bp, Homo sapiens
cattccacactgcaggaaatat

SEQ ID NO: 8224948 - DNA, 22 bp, Homo sapiens
cattccaagtatatacatgata

SEQ ID NO: 8224949 - DNA, 22 bp, Homo sapiens
catttacagtgagagtttttac

SEQ ID NO: 8224950 - DNA, 22 bp, Homo sapiens
catttacagtgagagtttttac

SEQ ID NO: 8224951 - DNA, 22 bp, Homo sapiens
catttacagcagactgatgaaa

SEQ ID NO: 8224952 - DNA, 22 bp, Homo sapiens
catttacagcagactgatgaaa

SEQ ID NO: 8224953 - DNA, 22 bp, Homo sapiens
catttacagcagactgatgaaa

SEQ ID NO: 8224954 - DNA, 22 bp, Homo sapiens
catttacagcagactgatgaaa

SEQ ID NO: 8224955 - DNA, 22 bp, Homo sapiens
catttacagcagactgatgaaa

SEQ ID NO: 8224956 - DNA, 22 bp, Homo sapiens
catttacataacagtaacgctg

SEQ ID NO: 8224957 - DNA, 22 bp, Homo sapiens
catttacataacagtaacgctg

SEQ ID NO: 8224958 - DNA, 22 bp, Homo sapiens
catttacagtgagagtttttac

SEQ ID NO: 8224959 - DNA, 21 bp, Homo sapiens
catttacatgacagattggtt

SEQ ID NO: 8224960 - DNA, 21 bp, Homo sapiens
catttacatgacagattggtt

SEQ ID NO: 8224961 - DNA, 22 bp, Homo sapiens
catttacataacagtaacgctg

SEQ ID NO: 8224962 - DNA, 22 bp, Homo sapiens
catttacataacagtaacgctg

SEQ ID NO: 8224963 - DNA, 18 bp, Homo sapiens
aggcagcagcatcttctc

SEQ ID NO: 8224964 - DNA, 22 bp, Homo sapiens
aggcagcagcttgctggttgcc

SEQ ID NO: 8224965 - DNA, 22 bp, Homo sapiens
aggcagcagaggttgaggaaag

SEQ ID NO: 8224966 - DNA, 22 bp, Homo sapiens
aggcagcagactgttaatcaga

SEQ ID NO: 8224967 - DNA, 22 bp, Homo sapiens
catttacatttaaggttaatat

SEQ ID NO: 8224968 - DNA, 22 bp, Homo sapiens
catttacatttaaggttaatat

SEQ ID NO: 8224969 - DNA, 21 bp, Homo sapiens
catttacatgacagattggtt

SEQ ID NO: 8224970 - DNA, 22 bp, Homo sapiens
aggcagcagtcatgaggaaaga

SEQ ID NO: 8224971 - DNA, 22 bp, Homo sapiens
catttacatttaaggttaatat

SEQ ID NO: 8224972 - DNA, 22 bp, Homo sapiens
catttacatttaaggttaatat

SEQ ID NO: 8224973 - DNA, 22 bp, Homo sapiens
aggcagcatttctgcttatcca

SEQ ID NO: 8224974 - DNA, 19 bp, Homo sapiens
aggcagcattctggggctt

SEQ ID NO: 8224975 - DNA, 22 bp, Homo sapiens
aggcagccaatcagaggctgac

SEQ ID NO: 8224976 - DNA, 22 bp, Homo sapiens
aggcagccaatcagaggctgac

SEQ ID NO: 8224977 - DNA, 22 bp, Homo sapiens
aggcagccaatcagaggctgac

SEQ ID NO: 8224978 - DNA, 22 bp, Homo sapiens
aggcagccaaaaagaagtcctc

SEQ ID NO: 8224979 - DNA, 22 bp, Homo sapiens
aggcagccaaaaagaagtcctc

SEQ ID NO: 8224980 - DNA, 22 bp, Homo sapiens
aggcagcatttctgcttatcca

SEQ ID NO: 8224981 - DNA, 22 bp, Homo sapiens
aggcagcatttgaatccaggtc

SEQ ID NO: 8224982 - DNA, 22 bp, Homo sapiens
aggcagcatttgaatccaggtc

SEQ ID NO: 8224983 - DNA, 22 bp, Homo sapiens
aggcagccagttcaggtttctt

SEQ ID NO: 8224984 - DNA, 21 bp, Homo sapiens
aggcagccagtcatgctccct

SEQ ID NO: 8224985 - DNA, 21 bp, Homo sapiens
aggcagccagtcatgctccct

SEQ ID NO: 8224986 - DNA, 22 bp, Homo sapiens
aggcagccacatgagctcctga

SEQ ID NO: 8224987 - DNA, 22 bp, Homo sapiens
aggcagccagatggcagcctgc

SEQ ID NO: 8224988 - DNA, 22 bp, Homo sapiens
aggcagccagatggcagcctgc

SEQ ID NO: 8224989 - DNA, 22 bp, Homo sapiens
aggcagccagatggcagcctgc

SEQ ID NO: 8224990 - DNA, 22 bp, Homo sapiens
aggcagccacatgagctcctga

SEQ ID NO: 8224991 - DNA, 22 bp, Homo sapiens
aggcagccacatgagctcctga

SEQ ID NO: 8224992 - DNA, 22 bp, Homo sapiens
catgaaacatcagagatttctc

SEQ ID NO: 8224993 - DNA, 22 bp, Homo sapiens
catgaaatattagtaactgttt

SEQ ID NO: 8224994 - DNA, 22 bp, Homo sapiens
catgaaatattagtaactgttt

SEQ ID NO: 8224995 - DNA, 22 bp, Homo sapiens
catgaaatatgctacctgtctt

SEQ ID NO: 8224996 - DNA, 22 bp, Homo sapiens
catgaaatatgctacctgtctt

SEQ ID NO: 8224997 - DNA, 22 bp, Homo sapiens
catgaaatatgctacctgtctt

SEQ ID NO: 8224998 - DNA, 22 bp, Homo sapiens
catgaaagcaggaatggtttta

SEQ ID NO: 8224999 - DNA, 22 bp, Homo sapiens
aggaggcactcactctcagggt

SEQ ID NO: 8225000 - DNA, 22 bp, Homo sapiens
aggaggcactcactctcagggt

SEQ ID NO: 8225001 - DNA, 22 bp, Homo sapiens
aggaggcactcactctcagggt

SEQ ID NO: 8225002 - DNA, 22 bp, Homo sapiens
aggaggcactcactctcagggt

SEQ ID NO: 8225003 - DNA, 17 bp, Homo sapiens
catctttaaaatcctga

SEQ ID NO: 8225004 - DNA, 22 bp, Homo sapiens
aggaggcagatgcttggctgta

SEQ ID NO: 8225005 - DNA, 17 bp, Homo sapiens
catctttaaaatcctga

SEQ ID NO: 8225006 - DNA, 22 bp, Homo sapiens
catgaaatggccaaccttcggc

SEQ ID NO: 8225007 - DNA, 22 bp, Homo sapiens
catgaaatgtgttaatctcttg

SEQ ID NO: 8225008 - DNA, 22 bp, Homo sapiens
catgaaatgtgttaatctcttg

SEQ ID NO: 8225009 - DNA, 22 bp, Homo sapiens
catgaaatggccaaccttcggc

SEQ ID NO: 8225010 - DNA, 22 bp, Homo sapiens
catgaaatggccaaccttcggc

SEQ ID NO: 8225011 - DNA, 22 bp, Homo sapiens
catgaaatgatatttgggtggg

SEQ ID NO: 8225012 - DNA, 22 bp, Homo sapiens
catgaaatgatatttgggtggg

SEQ ID NO: 8225013 - DNA, 22 bp, Homo sapiens
catgaaatctgagtatgtttcc

SEQ ID NO: 8225014 - DNA, 22 bp, Homo sapiens
catgaaatcacaagctgaggac

SEQ ID NO: 8225015 - DNA, 22 bp, Homo sapiens
catgaaatctgagtatgtttcc

SEQ ID NO: 8225016 - DNA, 22 bp, Homo sapiens
catgaaatcacaagctgaggac

SEQ ID NO: 8225017 - DNA, 22 bp, Homo sapiens
catgaaatcacaagctgaggac

SEQ ID NO: 8225018 - DNA, 22 bp, Homo sapiens
catgaaatgtgttaatctcttg

SEQ ID NO: 8225019 - DNA, 22 bp, Homo sapiens
catgaaatgttagaattagaca

SEQ ID NO: 8225020 - DNA, 22 bp, Homo sapiens
catgaaatgttagaattagaca

SEQ ID NO: 8225021 - DNA, 22 bp, Homo sapiens
aggaggtgcgtggtgatcccct

SEQ ID NO: 8225022 - DNA, 22 bp, Homo sapiens
catgaaattgctcctttggtgc

SEQ ID NO: 8225023 - DNA, 22 bp, Homo sapiens
catgaaattcagcaggtgagta

SEQ ID NO: 8225024 - DNA, 22 bp, Homo sapiens
catgaaatgttagaattagaca

SEQ ID NO: 8225025 - DNA, 22 bp, Homo sapiens
catgaaattcagcaggtgagta

SEQ ID NO: 8225026 - DNA, 22 bp, Homo sapiens
catgcacagtgatatctgaaga

SEQ ID NO: 8225027 - DNA, 22 bp, Homo sapiens
catgcacagtgatatctgaaga

SEQ ID NO: 8225028 - DNA, 20 bp, Homo sapiens
catgcacagccatagcgcta

SEQ ID NO: 8225029 - DNA, 22 bp, Homo sapiens
catgcacagtgatatctgaaga

SEQ ID NO: 8225030 - DNA, 22 bp, Homo sapiens
catgcacattattcaaagccca

SEQ ID NO: 8225031 - DNA, 22 bp, Homo sapiens
catgcacatgtggctatgtaat

SEQ ID NO: 8225032 - DNA, 22 bp, Homo sapiens
catgcacatgtggctatgtaat

SEQ ID NO: 8225033 - DNA, 22 bp, Homo sapiens
catgcacagagcttggtcattg

SEQ ID NO: 8225034 - DNA, 22 bp, Homo sapiens
catgcacactgcaacaaggact

SEQ ID NO: 8225035 - DNA, 22 bp, Homo sapiens
catgcacactgcaacaaggact

SEQ ID NO: 8225036 - DNA, 22 bp, Homo sapiens
catgcacactgcaacaaggact

SEQ ID NO: 8225037 - DNA, 22 bp, Homo sapiens
catgagtgctatatgtgaagag

SEQ ID NO: 8225038 - DNA, 22 bp, Homo sapiens
catgaggtgataaagctgggat

SEQ ID NO: 8225039 - DNA, 22 bp, Homo sapiens
aggaggtgttgatagaaggttt

SEQ ID NO: 8225040 - DNA, 22 bp, Homo sapiens
aggaggtgttgatagaaggttt

SEQ ID NO: 8225041 - DNA, 22 bp, Homo sapiens
aggaggtgttgatagaaggttt

SEQ ID NO: 8225042 - DNA, 22 bp, Homo sapiens
aggaggtgttgatagaaggttt

SEQ ID NO: 8225043 - DNA, 22 bp, Homo sapiens
aggaggtggctgaacttgaggg

SEQ ID NO: 8225044 - DNA, 22 bp, Homo sapiens
aggaggtggcctgagcgtgccc

SEQ ID NO: 8225045 - DNA, 22 bp, Homo sapiens
aggaggtggcctgagcgtgccc

SEQ ID NO: 8225046 - DNA, 22 bp, Homo sapiens
aggaggtgtagatttcctgtca

SEQ ID NO: 8225047 - DNA, 22 bp, Homo sapiens
aggaggtgtagatttcctgtca

SEQ ID NO: 8225048 - DNA, 22 bp, Homo sapiens
aggaggtggctgaacttgaggg

SEQ ID NO: 8225049 - DNA, 22 bp, Homo sapiens
aggaggtggctgaacttgaggg

SEQ ID NO: 8225050 - DNA, 22 bp, Homo sapiens
aggaggtggctgaacttgaggg

SEQ ID NO: 8225051 - DNA, 22 bp, Homo sapiens
aggaggtgctgtttgtcctgga

SEQ ID NO: 8225052 - DNA, 22 bp, Homo sapiens
aggaggtgctagagaagatgtt

SEQ ID NO: 8225053 - DNA, 22 bp, Homo sapiens
aggaggtgctagagaagatgtt

SEQ ID NO: 8225054 - DNA, 22 bp, Homo sapiens
aggaggtgctagagaagatgtt

SEQ ID NO: 8225055 - DNA, 22 bp, Homo sapiens
aggaggtgctagagaagatgtt

SEQ ID NO: 8225056 - DNA, 22 bp, Homo sapiens
aggaggtgctgtttgtcctgga

SEQ ID NO: 8225057 - DNA, 22 bp, Homo sapiens
aggaggtgctgtttgtcctgga

SEQ ID NO: 8225058 - DNA, 22 bp, Homo sapiens
aggaggtggcaactgtcgacag

SEQ ID NO: 8225059 - DNA, 22 bp, Homo sapiens
aggaggtggcctgagcgtgccc

SEQ ID NO: 8225060 - DNA, 22 bp, Homo sapiens
aggcacagcctcccttcacatg

SEQ ID NO: 8225061 - DNA, 22 bp, Homo sapiens
aggcacagcctcccttcacatg

SEQ ID NO: 8225062 - DNA, 22 bp, Homo sapiens
aggcacagcctcccttcacatg

SEQ ID NO: 8225063 - DNA, 22 bp, Homo sapiens
aggcacaggaacaggaaaagag

SEQ ID NO: 8225064 - DNA, 22 bp, Homo sapiens
aggcacaggaacaggaaaagag

SEQ ID NO: 8225065 - DNA, 22 bp, Homo sapiens
aggcacaggaacaggaaaagag

SEQ ID NO: 8225066 - DNA, 22 bp, Homo sapiens
aggcacaggaatgtcatccagt

SEQ ID NO: 8225067 - DNA, 18 bp, Homo sapiens
catgccttcattcttcat

SEQ ID NO: 8225068 - DNA, 22 bp, Homo sapiens
aggcacagcctcccccaactcc

SEQ ID NO: 8225069 - DNA, 22 bp, Homo sapiens
catggccaggcccagggcccag

SEQ ID NO: 8225070 - DNA, 22 bp, Homo sapiens
catggccaggcccagggcccag

SEQ ID NO: 8225071 - DNA, 22 bp, Homo sapiens
catggccagggcagatggcagg

SEQ ID NO: 8225072 - DNA, 22 bp, Homo sapiens
catggccagggcagatggcagg

SEQ ID NO: 8225073 - DNA, 22 bp, Homo sapiens
catggccagggcagatggcagg

SEQ ID NO: 8225074 - DNA, 22 bp, Homo sapiens
catggccagggagagagaatgt

SEQ ID NO: 8225075 - DNA, 22 bp, Homo sapiens
catggccagggcagatggcagg

SEQ ID NO: 8225076 - DNA, 22 bp, Homo sapiens
aggcacaggcctcagcacccag

SEQ ID NO: 8225077 - DNA, 22 bp, Homo sapiens
catggccaggcacgcgcatagc

SEQ ID NO: 8225078 - DNA, 22 bp, Homo sapiens
catggccaggccaagagagtac

SEQ ID NO: 8225079 - DNA, 22 bp, Homo sapiens
aggcacaggaggtggtaagaag

SEQ ID NO: 8225080 - DNA, 22 bp, Homo sapiens
aggcacaggaggtggtaagaag

SEQ ID NO: 8225081 - DNA, 22 bp, Homo sapiens
aggcacaggaatgtcatccagt

SEQ ID NO: 8225082 - DNA, 22 bp, Homo sapiens
aggcacaggaatgtcatccagt

SEQ ID NO: 8225083 - DNA, 22 bp, Homo sapiens
aggcacaggaatgtcatccagt

SEQ ID NO: 8225084 - DNA, 22 bp, Homo sapiens
catgccaggtttgagtatcttg

SEQ ID NO: 8225085 - DNA, 22 bp, Homo sapiens
catgccaggattaggacccagc

SEQ ID NO: 8225086 - DNA, 22 bp, Homo sapiens
catgccagttttgagatgcacc

SEQ ID NO: 8225087 - DNA, 23 bp, Homo sapiens
catgccagtttgtgcaggcagat

SEQ ID NO: 8225088 - DNA, 22 bp, Homo sapiens
catgccatgtgtgaggagagga

SEQ ID NO: 8225089 - DNA, 22 bp, Homo sapiens
catgccatttacttggaggaga

SEQ ID NO: 8225090 - DNA, 22 bp, Homo sapiens
catgccagttttgagatgcacc

SEQ ID NO: 8225091 - DNA, 20 bp, Homo sapiens
catgcctgctggtatctggc

SEQ ID NO: 8225092 - DNA, 22 bp, Homo sapiens
catgcctgtaatcccagctctt

SEQ ID NO: 8225093 - DNA, 22 bp, Homo sapiens
catgcctgtaatcccagcactt

SEQ ID NO: 8225094 - DNA, 22 bp, Homo sapiens
catgcccagagctccgggcgcc

SEQ ID NO: 8225095 - DNA, 17 bp, Homo sapiens
catgccccaggcttagc

SEQ ID NO: 8225096 - DNA, 22 bp, Homo sapiens
catgcactttgatggagagcgt

SEQ ID NO: 8225097 - DNA, 22 bp, Homo sapiens
catgcagcctgtgaacagtgtc

SEQ ID NO: 8225098 - DNA, 22 bp, Homo sapiens
catgcaggaggaaaaagcagct

SEQ ID NO: 8225099 - DNA, 21 bp, Homo sapiens
catgcaggatttaacctagaa

SEQ ID NO: 8225100 - DNA, 22 bp, Homo sapiens
catgccagggcttgctgcctgg

SEQ ID NO: 8225101 - DNA, 22 bp, Homo sapiens
catgccaggattaggacccagc

SEQ ID NO: 8225102 - DNA, 22 bp, Homo sapiens
catgcaggcctatggagcagtg

SEQ ID NO: 8225103 - DNA, 22 bp, Homo sapiens
catgcaggcctatggagcagtg

SEQ ID NO: 8225104 - DNA, 22 bp, Homo sapiens
cagtctctggcagctgctggcc

SEQ ID NO: 8225105 - DNA, 22 bp, Homo sapiens
cagtctctcttgtagtgcagct

SEQ ID NO: 8225106 - DNA, 22 bp, Homo sapiens
cagtctctctccttgcaggcgt

SEQ ID NO: 8225107 - DNA, 23 bp, Homo sapiens
aggagaagagatttccacatgca

SEQ ID NO: 8225108 - DNA, 23 bp, Homo sapiens
aggagaagagatttccacatgca

SEQ ID NO: 8225109 - DNA, 19 bp, Homo sapiens
aggagaagactctctcccc

SEQ ID NO: 8225110 - DNA, 19 bp, Homo sapiens
aggagaagactctctcccc

SEQ ID NO: 8225111 - DNA, 22 bp, Homo sapiens
aggagaagccaagttgtgagca

SEQ ID NO: 8225112 - DNA, 22 bp, Homo sapiens
aggagaattaggaactcaagat

SEQ ID NO: 8225113 - DNA, 22 bp, Homo sapiens
cagtctcttttcagctccatcc

SEQ ID NO: 8225114 - DNA, 22 bp, Homo sapiens
cagtctcttgcttcattagttg

SEQ ID NO: 8225115 - DNA, 22 bp, Homo sapiens
cagtctcttgcttcattagttg

SEQ ID NO: 8225116 - DNA, 22 bp, Homo sapiens
cagtctctttatccaccaagcc

SEQ ID NO: 8225117 - DNA, 22 bp, Homo sapiens
cagtctcttttcagctccatcc

SEQ ID NO: 8225118 - DNA, 22 bp, Homo sapiens
cagtctctttatccaccaagcc

SEQ ID NO: 8225119 - DNA, 22 bp, Homo sapiens
cagtctctggtgagttgacagt

SEQ ID NO: 8225120 - DNA, 22 bp, Homo sapiens
cagtctctggtgagttgacagt

SEQ ID NO: 8225121 - DNA, 22 bp, Homo sapiens
cagtctctggtgagttgacagt

SEQ ID NO: 8225122 - DNA, 22 bp, Homo sapiens
cagtctctggcagctgctggcc

SEQ ID NO: 8225123 - DNA, 22 bp, Homo sapiens
cagtctctggcagctgctggcc

SEQ ID NO: 8225124 - DNA, 22 bp, Homo sapiens
cagtctctgtcatctcatggga

SEQ ID NO: 8225125 - DNA, 22 bp, Homo sapiens
cagtctctgtcatctcatggga

SEQ ID NO: 8225126 - DNA, 22 bp, Homo sapiens
cagtctctgtcatctcatggga

SEQ ID NO: 8225127 - DNA, 22 bp, Homo sapiens
cagtctctgtgccagatcctgg

SEQ ID NO: 8225128 - DNA, 22 bp, Homo sapiens
aggacagcccttgagagcacat

SEQ ID NO: 8225129 - DNA, 21 bp, Homo sapiens
aggacaggaactggctgaata

SEQ ID NO: 8225130 - DNA, 21 bp, Homo sapiens
aggacaggaactggctgaata

SEQ ID NO: 8225131 - DNA, 21 bp, Homo sapiens
aggacaggaactggctgaata

SEQ ID NO: 8225132 - DNA, 21 bp, Homo sapiens
aggacaggaactggctgaata

SEQ ID NO: 8225133 - DNA, 21 bp, Homo sapiens
aggacaggaactggctgaata

SEQ ID NO: 8225134 - DNA, 20 bp, Homo sapiens
aggagaaattcgggacacct

SEQ ID NO: 8225135 - DNA, 18 bp, Homo sapiens
aggagaaagggaccaggg

SEQ ID NO: 8225136 - DNA, 18 bp, Homo sapiens
aggagaaagggaccaggg

SEQ ID NO: 8225137 - DNA, 22 bp, Homo sapiens
aggactgacttttgccatgaaa

SEQ ID NO: 8225138 - DNA, 22 bp, Homo sapiens
aggactgacttttgccatgaaa

SEQ ID NO: 8225139 - DNA, 22 bp, Homo sapiens
aggactgacttttgccatgaaa

SEQ ID NO: 8225140 - DNA, 22 bp, Homo sapiens
aggactttagagccagaaagac

SEQ ID NO: 8225141 - DNA, 22 bp, Homo sapiens
aggactgaggtccttttaggtt

SEQ ID NO: 8225142 - DNA, 22 bp, Homo sapiens
aggactgacttttgccatgaaa

SEQ ID NO: 8225143 - DNA, 21 bp, Homo sapiens
aggagaaacacaggtcagccc

SEQ ID NO: 8225144 - DNA, 22 bp, Homo sapiens
aggactttagagccagaaagac

SEQ ID NO: 8225145 - DNA, 22 bp, Homo sapiens
aggactttgattttgtaagatc

SEQ ID NO: 8225146 - DNA, 22 bp, Homo sapiens
aggactttatcttctagacctc

SEQ ID NO: 8225147 - DNA, 22 bp, Homo sapiens
aggaagctggggtgttcttcat

SEQ ID NO: 8225148 - DNA, 22 bp, Homo sapiens
aggaagctggtgtgaggatgaa

SEQ ID NO: 8225149 - DNA, 22 bp, Homo sapiens
aggaagctggttacgaagggat

SEQ ID NO: 8225150 - DNA, 22 bp, Homo sapiens
aggaagctggtgtgaggatgaa

SEQ ID NO: 8225151 - DNA, 22 bp, Homo sapiens
aggaagctggttacgaagggat

SEQ ID NO: 8225152 - DNA, 22 bp, Homo sapiens
aggaagcttagatttccagatc

SEQ ID NO: 8225153 - DNA, 22 bp, Homo sapiens
aggaagcttggggcagggctac

SEQ ID NO: 8225154 - DNA, 23 bp, Homo sapiens
aggaagcttggcaataaggtttg

SEQ ID NO: 8225155 - DNA, 22 bp, Homo sapiens
aggaagcttagtgaaaggacca

SEQ ID NO: 8225156 - DNA, 20 bp, Homo sapiens
aggaagctgagatgtagagg

SEQ ID NO: 8225157 - DNA, 20 bp, Homo sapiens
aggaagctgagatgtagagg

SEQ ID NO: 8225158 - DNA, 22 bp, Homo sapiens
aggaagctgcctgggatgggaa

SEQ ID NO: 8225159 - DNA, 21 bp, Homo sapiens
aggaagctgcccagatagtag

SEQ ID NO: 8225160 - DNA, 22 bp, Homo sapiens
aggaagctgctaagaaacaatg

SEQ ID NO: 8225161 - DNA, 22 bp, Homo sapiens
aggaagctgcctgggatgggaa

SEQ ID NO: 8225162 - DNA, 22 bp, Homo sapiens
aggaagctgctaagaaacaatg

SEQ ID NO: 8225163 - DNA, 22 bp, Homo sapiens
aggaagctgctggagtagtgtg

SEQ ID NO: 8225164 - DNA, 22 bp, Homo sapiens
aggaagctgggaaactgacatt

SEQ ID NO: 8225165 - DNA, 22 bp, Homo sapiens
aggaagctgggaaactgacatt

SEQ ID NO: 8225166 - DNA, 22 bp, Homo sapiens
aggaagctttatgaccagctaa

SEQ ID NO: 8225167 - DNA, 22 bp, Homo sapiens
aggaagcttgtgtgtattggtc

SEQ ID NO: 8225168 - DNA, 19 bp, Homo sapiens
aggaaggaacctgagtctg

SEQ ID NO: 8225169 - DNA, 22 bp, Homo sapiens
aggaaggaagagacaccatttg

SEQ ID NO: 8225170 - DNA, 22 bp, Homo sapiens
aggaaggactgcagcatttggt

SEQ ID NO: 8225171 - DNA, 22 bp, Homo sapiens
aggaaggaagagacaccatttg

SEQ ID NO: 8225172 - DNA, 20 bp, Homo sapiens
aggaaggaagtttgcatgga

SEQ ID NO: 8225173 - DNA, 22 bp, Homo sapiens
aggacagcagccattggcagtc

SEQ ID NO: 8225174 - DNA, 22 bp, Homo sapiens
aggacagcagtgctggcacttg

SEQ ID NO: 8225175 - DNA, 22 bp, Homo sapiens
cagtcctgggcacagccctggg

SEQ ID NO: 8225176 - DNA, 22 bp, Homo sapiens
cagtcctgggcacagccctggg

SEQ ID NO: 8225177 - DNA, 22 bp, Homo sapiens
cagtcctgggcacagccctggg

SEQ ID NO: 8225178 - DNA, 22 bp, Homo sapiens
aggacagcaaccgttattcaca

SEQ ID NO: 8225179 - DNA, 22 bp, Homo sapiens
cagtcctgctagtgtgaaaagc

SEQ ID NO: 8225180 - DNA, 20 bp, Homo sapiens
cagtcctgccccttggggac

SEQ ID NO: 8225181 - DNA, 20 bp, Homo sapiens
cagtcctgccccttggggac

SEQ ID NO: 8225182 - DNA, 22 bp, Homo sapiens
cagtcctgggcacagccctggg

SEQ ID NO: 8225183 - DNA, 22 bp, Homo sapiens
cagtcctgggcacagccctggg

SEQ ID NO: 8225184 - DNA, 22 bp, Homo sapiens
cagtccagtgatttttccagtt

SEQ ID NO: 8225185 - DNA, 22 bp, Homo sapiens
cagtcctctgcaacaccccttc

SEQ ID NO: 8225186 - DNA, 18 bp, Homo sapiens
cagtcccaaaccttagga

SEQ ID NO: 8225187 - DNA, 18 bp, Homo sapiens
cagtcccaaaccttagga

SEQ ID NO: 8225188 - DNA, 22 bp, Homo sapiens
cagtcctgagccaatcatgatg

SEQ ID NO: 8225189 - DNA, 22 bp, Homo sapiens
cagtcctgaatactggacggtg

SEQ ID NO: 8225190 - DNA, 22 bp, Homo sapiens
cagtcctgaatactggacggtg

SEQ ID NO: 8225191 - DNA, 17 bp, Homo sapiens
cagtcctctgctctaag

SEQ ID NO: 8225192 - DNA, 22 bp, Homo sapiens
cagtcctgcccaggctgacaga

SEQ ID NO: 8225193 - DNA, 22 bp, Homo sapiens
cagtcctgcccaggctgacaga

SEQ ID NO: 8225194 - DNA, 22 bp, Homo sapiens
cagtcctgcccaggctgacaga

SEQ ID NO: 8225195 - DNA, 20 bp, Homo sapiens
cagtcctgcaggcgggagaa

SEQ ID NO: 8225196 - DNA, 22 bp, Homo sapiens
cagtcctgaggaagagctgctg

SEQ ID NO: 8225197 - DNA, 20 bp, Homo sapiens
cagtcctgcaggcgggagaa

SEQ ID NO: 8225198 - DNA, 20 bp, Homo sapiens
cagtcctgcaggcgggagaa

SEQ ID NO: 8225199 - DNA, 20 bp, Homo sapiens
cagtcctgcaggcgggagaa

SEQ ID NO: 8225200 - DNA, 22 bp, Homo sapiens
cagtcctgagctcctgggctga

SEQ ID NO: 8225201 - DNA, 22 bp, Homo sapiens
cagtcctgagctcctgggctga

SEQ ID NO: 8225202 - DNA, 22 bp, Homo sapiens
cagtcctgaggaagagctgctg

SEQ ID NO: 8225203 - DNA, 22 bp, Homo sapiens
cagtcctgaggaagagctgctg

SEQ ID NO: 8225204 - DNA, 22 bp, Homo sapiens
aggagagtcttgagtcactggt

SEQ ID NO: 8225205 - DNA, 22 bp, Homo sapiens
aggagagtaccattgggccgca

SEQ ID NO: 8225206 - DNA, 22 bp, Homo sapiens
aggagagggtggcattaagttt

SEQ ID NO: 8225207 - DNA, 22 bp, Homo sapiens
aggagagggtggcattaagttt

SEQ ID NO: 8225208 - DNA, 22 bp, Homo sapiens
aggagaggtctcccttccccag

SEQ ID NO: 8225209 - DNA, 22 bp, Homo sapiens
aggagaggtctcccttccccag

SEQ ID NO: 8225210 - DNA, 22 bp, Homo sapiens
aggagccatgagcaggaggcaa

SEQ ID NO: 8225211 - DNA, 22 bp, Homo sapiens
aggagatagtcaaagcttcttg

SEQ ID NO: 8225212 - DNA, 22 bp, Homo sapiens
aggagatcagcctccctgcaac

SEQ ID NO: 8225213 - DNA, 22 bp, Homo sapiens
aggagagttcacactggtcaga

SEQ ID NO: 8225214 - DNA, 22 bp, Homo sapiens
aggagcctggctggcccacagg

SEQ ID NO: 8225215 - DNA, 22 bp, Homo sapiens
aggagcctggctggcccacagg

SEQ ID NO: 8225216 - DNA, 22 bp, Homo sapiens
aggagcctggctggcccacagg

SEQ ID NO: 8225217 - DNA, 22 bp, Homo sapiens
aggagcctggctggcccacagg

SEQ ID NO: 8225218 - DNA, 22 bp, Homo sapiens
aggagccatgagcaggaggcaa

SEQ ID NO: 8225219 - DNA, 22 bp, Homo sapiens
aggagccatgagcaggaggcaa

SEQ ID NO: 8225220 - DNA, 18 bp, Homo sapiens
aggagcctttgcactgga

SEQ ID NO: 8225221 - DNA, 19 bp, Homo sapiens
aggagccttgagcagtgag

SEQ ID NO: 8225222 - DNA, 19 bp, Homo sapiens
aggagccttgagcagtgag

SEQ ID NO: 8225223 - DNA, 22 bp, Homo sapiens
aggagctcaaagatgccaggag

SEQ ID NO: 8225224 - DNA, 22 bp, Homo sapiens
aggagctcaaagatgccaggag

SEQ ID NO: 8225225 - DNA, 22 bp, Homo sapiens
aggagctcatgtggctgcctgt

SEQ ID NO: 8225226 - DNA, 22 bp, Homo sapiens
aggagctcattgaagtggatga

SEQ ID NO: 8225227 - DNA, 22 bp, Homo sapiens
aggagctccagcccagggaagt

SEQ ID NO: 8225228 - DNA, 21 bp, Homo sapiens
aggagctctccaaggacaaag

SEQ ID NO: 8225229 - DNA, 22 bp, Homo sapiens
aggagaggcatcaagaaaatcg

SEQ ID NO: 8225230 - DNA, 22 bp, Homo sapiens
aggagaggcatcaagaaaatcg

SEQ ID NO: 8225231 - DNA, 22 bp, Homo sapiens
aggagaggcatcaagaaaatcg

SEQ ID NO: 8225232 - DNA, 22 bp, Homo sapiens
aggagaggaatcattattacaa

SEQ ID NO: 8225233 - DNA, 22 bp, Homo sapiens
aggagaggaatcattattacaa

SEQ ID NO: 8225234 - DNA, 22 bp, Homo sapiens
aggagagcaggccagccgtccc

SEQ ID NO: 8225235 - DNA, 22 bp, Homo sapiens
aggagaggctctaactctgtgt

SEQ ID NO: 8225236 - DNA, 22 bp, Homo sapiens
aggagaggggtaggattaattt

SEQ ID NO: 8225237 - DNA, 22 bp, Homo sapiens
aggagaggggtaggattaattt

SEQ ID NO: 8225238 - DNA, 22 bp, Homo sapiens
aggagaggggtaggattaattt

SEQ ID NO: 8225239 - DNA, 22 bp, Homo sapiens
aggagaggctctaactctgtgt

SEQ ID NO: 8225240 - DNA, 22 bp, Homo sapiens
aggagaggctctaactctgtgt

SEQ ID NO: 8225241 - DNA, 22 bp, Homo sapiens
aggagagaattactgggtgtca

SEQ ID NO: 8225242 - DNA, 22 bp, Homo sapiens
aggagagaattactgggtgtca

SEQ ID NO: 8225243 - DNA, 22 bp, Homo sapiens
aggagagaattactgggtgtca

SEQ ID NO: 8225244 - DNA, 22 bp, Homo sapiens
aggagagaatgttccaggcttg

SEQ ID NO: 8225245 - DNA, 22 bp, Homo sapiens
aggagagaatgttccaggcttg

SEQ ID NO: 8225246 - DNA, 22 bp, Homo sapiens
aggagactcagagacctggccg

SEQ ID NO: 8225247 - DNA, 22 bp, Homo sapiens
aggagacagccaggggcctgag

SEQ ID NO: 8225248 - DNA, 22 bp, Homo sapiens
aggagagcaggccagccgtccc

SEQ ID NO: 8225249 - DNA, 22 bp, Homo sapiens
aggagagcaggccagccgtccc

SEQ ID NO: 8225250 - DNA, 22 bp, Homo sapiens
aggagagagctgagctttgctg

SEQ ID NO: 8225251 - DNA, 22 bp, Homo sapiens
aggagagaggttttaaatgggg

SEQ ID NO: 8225252 - DNA, 22 bp, Homo sapiens
aggagagagctgagctttgctg

SEQ ID NO: 8225253 - DNA, 22 bp, Homo sapiens
aggagagagaacacttgggtcc

SEQ ID NO: 8225254 - DNA, 22 bp, Homo sapiens
aggagagaattactgggtgtca

SEQ ID NO: 8225255 - DNA, 20 bp, Homo sapiens
aggaggcaatgtagataagc

SEQ ID NO: 8225256 - DNA, 20 bp, Homo sapiens
aggaggcaatgtagataagc

SEQ ID NO: 8225257 - DNA, 20 bp, Homo sapiens
aggaggcaatgtagataagc

SEQ ID NO: 8225258 - DNA, 22 bp, Homo sapiens
aggaggcaactgagatttagaa

SEQ ID NO: 8225259 - DNA, 22 bp, Homo sapiens
aggaggcaaaggtctctgataa

SEQ ID NO: 8225260 - DNA, 22 bp, Homo sapiens
aggaggcaactgagatttagaa

SEQ ID NO: 8225261 - DNA, 22 bp, Homo sapiens
aggaggcaaaggtctctgataa

SEQ ID NO: 8225262 - DNA, 17 bp, Homo sapiens
aggaggatcagagagta

SEQ ID NO: 8225263 - DNA, 22 bp, Homo sapiens
aggaggaggtgggacacagtga

SEQ ID NO: 8225264 - DNA, 22 bp, Homo sapiens
aggaggaggtgggacacagtga

SEQ ID NO: 8225265 - DNA, 22 bp, Homo sapiens
aggaggaggtgggacacagtga

SEQ ID NO: 8225266 - DNA, 22 bp, Homo sapiens
aggaggaggtgggacacagtga

SEQ ID NO: 8225267 - DNA, 22 bp, Homo sapiens
aggaggaatacaatccagcagc

SEQ ID NO: 8225268 - DNA, 22 bp, Homo sapiens
aggaggaatacaatccagcagc

SEQ ID NO: 8225269 - DNA, 22 bp, Homo sapiens
aggaggaatacaatccagcagc

SEQ ID NO: 8225270 - DNA, 22 bp, Homo sapiens
aggaggaattgacacagaagcc

SEQ ID NO: 8225271 - DNA, 22 bp, Homo sapiens
aggaggaattgacacagaagcc

SEQ ID NO: 8225272 - DNA, 22 bp, Homo sapiens
aggaggaggctggagtacaccc

SEQ ID NO: 8225273 - DNA, 22 bp, Homo sapiens
aggaggaggctggagtacaccc

SEQ ID NO: 8225274 - DNA, 22 bp, Homo sapiens
aggaggaggctggagtacaccc

SEQ ID NO: 8225275 - DNA, 22 bp, Homo sapiens
aggaggagcagctttttgtctc

SEQ ID NO: 8225276 - DNA, 21 bp, Homo sapiens
aggaggagagcttggcctacc

SEQ ID NO: 8225277 - DNA, 21 bp, Homo sapiens
aggaggagagcttggcctacc

SEQ ID NO: 8225278 - DNA, 21 bp, Homo sapiens
aggaggagagcttggcctacc

SEQ ID NO: 8225279 - DNA, 22 bp, Homo sapiens
aggaggaagggaagacaagtaa

SEQ ID NO: 8225280 - DNA, 22 bp, Homo sapiens
aggaggaagggaagacaagtaa

SEQ ID NO: 8225281 - DNA, 22 bp, Homo sapiens
aggaggaaggcttcattaggtt

SEQ ID NO: 8225282 - DNA, 22 bp, Homo sapiens
aggaggaagggaagacaagtaa

SEQ ID NO: 8225283 - DNA, 21 bp, Homo sapiens
aggagctgtgtgcttcctttc

SEQ ID NO: 8225284 - DNA, 22 bp, Homo sapiens
aggagctgtgaatgggaggggt

SEQ ID NO: 8225285 - DNA, 22 bp, Homo sapiens
aggagctgtgaatgggaggggt

SEQ ID NO: 8225286 - DNA, 22 bp, Homo sapiens
aggagctgtgaatgggaggggt

SEQ ID NO: 8225287 - DNA, 22 bp, Homo sapiens
aggagctgatagtctatggaga

SEQ ID NO: 8225288 - DNA, 22 bp, Homo sapiens
aggagctgataaaagggggtca

SEQ ID NO: 8225289 - DNA, 22 bp, Homo sapiens
aggagctgagtcagcccgacag

SEQ ID NO: 8225290 - DNA, 22 bp, Homo sapiens
aggagctgagtcagcccgacag

SEQ ID NO: 8225291 - DNA, 22 bp, Homo sapiens
aggagctgataaaagggggtca

SEQ ID NO: 8225292 - DNA, 22 bp, Homo sapiens
aggagctgataaaagggggtca

SEQ ID NO: 8225293 - DNA, 22 bp, Homo sapiens
aggagctgataaaagggggtca

SEQ ID NO: 8225294 - DNA, 22 bp, Homo sapiens
aggagctgagtcagcccgacag

SEQ ID NO: 8225295 - DNA, 22 bp, Homo sapiens
aggagctgagtcagcccgacag

SEQ ID NO: 8225296 - DNA, 22 bp, Homo sapiens
aggagctgagtcagcccgacag

SEQ ID NO: 8225297 - DNA, 22 bp, Homo sapiens
aggagctgagtcagcccgacag

SEQ ID NO: 8225298 - DNA, 22 bp, Homo sapiens
aggagctgagggagcgcccttg

SEQ ID NO: 8225299 - DNA, 22 bp, Homo sapiens
aggagctgagggagcgcccttg

SEQ ID NO: 8225300 - DNA, 22 bp, Homo sapiens
aggagctgagggagcgcccttg

SEQ ID NO: 8225301 - DNA, 22 bp, Homo sapiens
aggagctctgggcagggcctcc

SEQ ID NO: 8225302 - DNA, 22 bp, Homo sapiens
aggagctctgggcagggcctcc

SEQ ID NO: 8225303 - DNA, 22 bp, Homo sapiens
aggagctcttgatgcttgaggg

SEQ ID NO: 8225304 - DNA, 22 bp, Homo sapiens
aggagctgaagtctctgcactc

SEQ ID NO: 8225305 - DNA, 22 bp, Homo sapiens
aggagctgaagtctctgcactc

SEQ ID NO: 8225306 - DNA, 22 bp, Homo sapiens
aggagctgaaacttctcatatg

SEQ ID NO: 8225307 - DNA, 22 bp, Homo sapiens
aggagctgaaacttctcatatg

SEQ ID NO: 8225308 - DNA, 22 bp, Homo sapiens
aggagctgaaacttctcatatg

SEQ ID NO: 8225309 - DNA, 20 bp, Homo sapiens
aggagctgaattagagggtt

SEQ ID NO: 8225310 - DNA, 20 bp, Homo sapiens
aggagctgaattagagggtt

SEQ ID NO: 8225311 - DNA, 20 bp, Homo sapiens
aggagctgaattagagggtt

SEQ ID NO: 8225312 - DNA, 22 bp, Homo sapiens
aggagctgaagtctctgcactc

SEQ ID NO: 8225313 - DNA, 20 bp, Homo sapiens
aggagctgaattagagggtt

SEQ ID NO: 8225314 - DNA, 20 bp, Homo sapiens
aggagctgaattagagggtt

SEQ ID NO: 8225315 - DNA, 20 bp, Homo sapiens
aggagctgaattagagggtt

SEQ ID NO: 8225316 - DNA, 22 bp, Homo sapiens
aggagctgagggagcgcccttg

SEQ ID NO: 8225317 - DNA, 20 bp, Homo sapiens
aggagctgaattagagggtt

SEQ ID NO: 8225318 - DNA, 20 bp, Homo sapiens
aggagctgaattagagggtt

SEQ ID NO: 8225319 - DNA, 22 bp, Homo sapiens
agcttgggcaacacagcaagac

SEQ ID NO: 8225320 - DNA, 17 bp, Homo sapiens
agcttggagcagcatga

SEQ ID NO: 8225321 - DNA, 22 bp, Homo sapiens
agcttgctgtattttctggagg

SEQ ID NO: 8225322 - DNA, 22 bp, Homo sapiens
agcttgcctcttaatcacctca

SEQ ID NO: 8225323 - DNA, 22 bp, Homo sapiens
agcttgtaacagacataaaaat

SEQ ID NO: 8225324 - DNA, 22 bp, Homo sapiens
agcttgtagaaggccacgagca

SEQ ID NO: 8225325 - DNA, 22 bp, Homo sapiens
agcttacagttcaatgacaaag

SEQ ID NO: 8225326 - DNA, 22 bp, Homo sapiens
agcttaaactctttgaagttat

SEQ ID NO: 8225327 - DNA, 22 bp, Homo sapiens
agcttgacagacagatggtagc

SEQ ID NO: 8225328 - DNA, 22 bp, Homo sapiens
agcttgaattattctgctctta

SEQ ID NO: 8225329 - DNA, 22 bp, Homo sapiens
agcttcttttaccaggaagttg

SEQ ID NO: 8225330 - DNA, 22 bp, Homo sapiens
agcttgaaacgtaccaacattg

SEQ ID NO: 8225331 - DNA, 22 bp, Homo sapiens
agcttgaagccttggcgagatt

SEQ ID NO: 8225332 - DNA, 22 bp, Homo sapiens
agcttgaacctaaaacaataat

SEQ ID NO: 8225333 - DNA, 22 bp, Homo sapiens
agcttcttaagttcctgcagca

SEQ ID NO: 8225334 - DNA, 22 bp, Homo sapiens
agcttcttttacagctcatgct

SEQ ID NO: 8225335 - DNA, 22 bp, Homo sapiens
agcttacagttcaatgacaaag

SEQ ID NO: 8225336 - DNA, 22 bp, Homo sapiens
agctgtttaaatgacttacttt

SEQ ID NO: 8225337 - DNA, 22 bp, Homo sapiens
agctgtttccataaatgagaca

SEQ ID NO: 8225338 - DNA, 22 bp, Homo sapiens
agctgttttcctggttagagac

SEQ ID NO: 8225339 - DNA, 22 bp, Homo sapiens
agctgttttctaatgcatttga

SEQ ID NO: 8225340 - DNA, 21 bp, Homo sapiens
agctgtttgaagctatattgg

SEQ ID NO: 8225341 - DNA, 22 bp, Homo sapiens
agctgttccctcactgcagtca

SEQ ID NO: 8225342 - DNA, 22 bp, Homo sapiens
agctgtgtttccagatggtagc

SEQ ID NO: 8225343 - DNA, 22 bp, Homo sapiens
agctgttccaggcctcattgct

SEQ ID NO: 8225344 - DNA, 22 bp, Homo sapiens
agctgttgcagggatcagcacc

SEQ ID NO: 8225345 - DNA, 22 bp, Homo sapiens
agctgtgtgtttccactgagct

SEQ ID NO: 8225346 - DNA, 22 bp, Homo sapiens
agctgtgtggtgtctgacagct

SEQ ID NO: 8225347 - DNA, 22 bp, Homo sapiens
agctgtgtggtgtctgacagct

SEQ ID NO: 8225348 - DNA, 21 bp, Homo sapiens
caggccgggtgagcaggcagc

SEQ ID NO: 8225349 - DNA, 22 bp, Homo sapiens
caggccccattcctcttgggac

SEQ ID NO: 8225350 - DNA, 21 bp, Homo sapiens
caggccccaggcctggggtgc

SEQ ID NO: 8225351 - DNA, 22 bp, Homo sapiens
agctgggacagacaactatgtt

SEQ ID NO: 8225352 - DNA, 22 bp, Homo sapiens
agctgggactcaactgtctggg

SEQ ID NO: 8225353 - DNA, 22 bp, Homo sapiens
agctggcttttgtgaaggtttt

SEQ ID NO: 8225354 - DNA, 22 bp, Homo sapiens
agctggctttgagctgggaggt

SEQ ID NO: 8225355 - DNA, 22 bp, Homo sapiens
agctgggaagactggaagacag

SEQ ID NO: 8225356 - DNA, 22 bp, Homo sapiens
agctggcttttgtgaaggtttt

SEQ ID NO: 8225357 - DNA, 22 bp, Homo sapiens
agctggcttttgtgaaggtttt

SEQ ID NO: 8225358 - DNA, 22 bp, Homo sapiens
agctgggaagactggaagacag

SEQ ID NO: 8225359 - DNA, 22 bp, Homo sapiens
agctgggaagactggaagacag

SEQ ID NO: 8225360 - DNA, 22 bp, Homo sapiens
agctgggaagagttttctgcag

SEQ ID NO: 8225361 - DNA, 22 bp, Homo sapiens
agctgggaagagttttctgcag

SEQ ID NO: 8225362 - DNA, 22 bp, Homo sapiens
agctgggaagactggaagacag

SEQ ID NO: 8225363 - DNA, 22 bp, Homo sapiens
agctgggaagagttttctgcag

SEQ ID NO: 8225364 - DNA, 23 bp, Homo sapiens
agctgggaattttctgaagcttt

SEQ ID NO: 8225365 - DNA, 22 bp, Homo sapiens
caggccggtgattctggatgta

SEQ ID NO: 8225366 - DNA, 22 bp, Homo sapiens
caggccggtgattctggatgta

SEQ ID NO: 8225367 - DNA, 21 bp, Homo sapiens
caggccgggtgagcaggcagc

SEQ ID NO: 8225368 - DNA, 22 bp, Homo sapiens
caggcctcaccagcggagctgc

SEQ ID NO: 8225369 - DNA, 22 bp, Homo sapiens
caggccggtgattctggatgta

SEQ ID NO: 8225370 - DNA, 22 bp, Homo sapiens
caggcctcagggctgtccgtag

SEQ ID NO: 8225371 - DNA, 22 bp, Homo sapiens
caggcctcagggctgtccgtag

SEQ ID NO: 8225372 - DNA, 22 bp, Homo sapiens
caggcctcaggggctcaggctg

SEQ ID NO: 8225373 - DNA, 22 bp, Homo sapiens
caggcctcagagagtggcgggg

SEQ ID NO: 8225374 - DNA, 22 bp, Homo sapiens
caggcctcagagagtggcgggg

SEQ ID NO: 8225375 - DNA, 22 bp, Homo sapiens
caggcctcagagagtggcgggg

SEQ ID NO: 8225376 - DNA, 22 bp, Homo sapiens
caggcctcaggggctcaggctg

SEQ ID NO: 8225377 - DNA, 22 bp, Homo sapiens
caggcctcaggggctcaggctg

SEQ ID NO: 8225378 - DNA, 22 bp, Homo sapiens
caggcctcaggggctcaggctg

SEQ ID NO: 8225379 - DNA, 22 bp, Homo sapiens
caggcctcaggggctcaggctg

SEQ ID NO: 8225380 - DNA, 22 bp, Homo sapiens
caggcctcaggggctcaggctg

SEQ ID NO: 8225381 - DNA, 22 bp, Homo sapiens
caggcctcaggggctcaggctg

SEQ ID NO: 8225382 - DNA, 22 bp, Homo sapiens
caggcctccactccacgcagac

SEQ ID NO: 8225383 - DNA, 22 bp, Homo sapiens
caggcctccactccacgcagac

SEQ ID NO: 8225384 - DNA, 22 bp, Homo sapiens
caggcctccactccacgcagac

SEQ ID NO: 8225385 - DNA, 22 bp, Homo sapiens
caggcctcatggtgtgtccttc

SEQ ID NO: 8225386 - DNA, 22 bp, Homo sapiens
caggcctcatggtgtgtccttc

SEQ ID NO: 8225387 - DNA, 22 bp, Homo sapiens
caggcctggttgagccctgaga

SEQ ID NO: 8225388 - DNA, 22 bp, Homo sapiens
caggcctggttgagccctgaga

SEQ ID NO: 8225389 - DNA, 22 bp, Homo sapiens
caggcctggttgagccctgaga

SEQ ID NO: 8225390 - DNA, 22 bp, Homo sapiens
caggcctgggcttcggggctga

SEQ ID NO: 8225391 - DNA, 22 bp, Homo sapiens
caggcctgggcttcggggctga

SEQ ID NO: 8225392 - DNA, 22 bp, Homo sapiens
caggcctggggctggcttccag

SEQ ID NO: 8225393 - DNA, 22 bp, Homo sapiens
caggcctggggctggcttccag

SEQ ID NO: 8225394 - DNA, 22 bp, Homo sapiens
caggcctggggctggcttccag

SEQ ID NO: 8225395 - DNA, 22 bp, Homo sapiens
caggcctggggctggcttccag

SEQ ID NO: 8225396 - DNA, 22 bp, Homo sapiens
caggcctgggttcaaatccctt

SEQ ID NO: 8225397 - DNA, 22 bp, Homo sapiens
caggcctggggctggcttccag

SEQ ID NO: 8225398 - DNA, 22 bp, Homo sapiens
agctgtggccagatgtgagcgg

SEQ ID NO: 8225399 - DNA, 22 bp, Homo sapiens
agctgtgtagggaatcagagaa

SEQ ID NO: 8225400 - DNA, 22 bp, Homo sapiens
agctgtgtagggaatcagagaa

SEQ ID NO: 8225401 - DNA, 22 bp, Homo sapiens
caggcctggcccccggcacacc

SEQ ID NO: 8225402 - DNA, 22 bp, Homo sapiens
caggcctggcccccggcacacc

SEQ ID NO: 8225403 - DNA, 22 bp, Homo sapiens
caggcctggcccccggcacacc

SEQ ID NO: 8225404 - DNA, 22 bp, Homo sapiens
caggcctcccggtgcacactga

SEQ ID NO: 8225405 - DNA, 22 bp, Homo sapiens
caggcctcccggtgcacactga

SEQ ID NO: 8225406 - DNA, 22 bp, Homo sapiens
caggcctcccggtgcacactga

SEQ ID NO: 8225407 - DNA, 22 bp, Homo sapiens
caggcctgggcttcggggctga

SEQ ID NO: 8225408 - DNA, 22 bp, Homo sapiens
caggcctgggctgggtatcagg

SEQ ID NO: 8225409 - DNA, 22 bp, Homo sapiens
caggcctggctgcagctcgcct

SEQ ID NO: 8225410 - DNA, 22 bp, Homo sapiens
caggcctggctgcagctcgcct

SEQ ID NO: 8225411 - DNA, 22 bp, Homo sapiens
caggcctggctgcagctcgcct

SEQ ID NO: 8225412 - DNA, 22 bp, Homo sapiens
caggcctggctgcagctcgcct

SEQ ID NO: 8225413 - DNA, 22 bp, Homo sapiens
caggcctggctgcagctcgcct

SEQ ID NO: 8225414 - DNA, 21 bp, Homo sapiens
aggaaaggaagtccccagggt

SEQ ID NO: 8225415 - DNA, 20 bp, Homo sapiens
aggaaagcctgtgtgagtct

SEQ ID NO: 8225416 - DNA, 21 bp, Homo sapiens
aggaaaggaagtccccagggt

SEQ ID NO: 8225417 - DNA, 21 bp, Homo sapiens
aggaaaggaagtccccagggt

SEQ ID NO: 8225418 - DNA, 22 bp, Homo sapiens
aggaaactaacttatctttata

SEQ ID NO: 8225419 - DNA, 22 bp, Homo sapiens
aggaaagcaatggctgagaaca

SEQ ID NO: 8225420 - DNA, 22 bp, Homo sapiens
aggaaagatggaaggaggataa

SEQ ID NO: 8225421 - DNA, 22 bp, Homo sapiens
cagggccagcgcccaggcccag

SEQ ID NO: 8225422 - DNA, 22 bp, Homo sapiens
cagggccagccgcagcatccac

SEQ ID NO: 8225423 - DNA, 22 bp, Homo sapiens
cagggccagccgcagcatccac

SEQ ID NO: 8225424 - DNA, 22 bp, Homo sapiens
cagggccagccgcagcatccac

SEQ ID NO: 8225425 - DNA, 22 bp, Homo sapiens
cagggccagccgcagcatccac

SEQ ID NO: 8225426 - DNA, 22 bp, Homo sapiens
cagggccagccgcagcatccac

SEQ ID NO: 8225427 - DNA, 22 bp, Homo sapiens
cagggccagccatcctgctggg

SEQ ID NO: 8225428 - DNA, 22 bp, Homo sapiens
cagggccagcccactagcgagg

SEQ ID NO: 8225429 - DNA, 22 bp, Homo sapiens
cagggccagagagggctggctg

SEQ ID NO: 8225430 - DNA, 22 bp, Homo sapiens
cagggccactgtagatgaggag

SEQ ID NO: 8225431 - DNA, 22 bp, Homo sapiens
cagggccagagagggctggctg

SEQ ID NO: 8225432 - DNA, 22 bp, Homo sapiens
cagggccagccatcctgctggg

SEQ ID NO: 8225433 - DNA, 22 bp, Homo sapiens
cagggccagccatcctgctggg

SEQ ID NO: 8225434 - DNA, 18 bp, Homo sapiens
aggaaagacgaagagggc

SEQ ID NO: 8225435 - DNA, 18 bp, Homo sapiens
aggaaagacgaagagggc

SEQ ID NO: 8225436 - DNA, 22 bp, Homo sapiens
aggaaagaagtacattctcatg

SEQ ID NO: 8225437 - DNA, 22 bp, Homo sapiens
aggaaagaagtacattctcatg

SEQ ID NO: 8225438 - DNA, 22 bp, Homo sapiens
agctttatataaaagagtacat

SEQ ID NO: 8225439 - DNA, 22 bp, Homo sapiens
agctttatatgttgtttctcca

SEQ ID NO: 8225440 - DNA, 22 bp, Homo sapiens
agctttatataaaagagtacat

SEQ ID NO: 8225441 - DNA, 22 bp, Homo sapiens
agctttatataaaagagtacat

SEQ ID NO: 8225442 - DNA, 22 bp, Homo sapiens
agctttatagaaaggatcagtg

SEQ ID NO: 8225443 - DNA, 22 bp, Homo sapiens
agctttatataaaagagtacat

SEQ ID NO: 8225444 - DNA, 22 bp, Homo sapiens
agctttatatgttgtttctcca

SEQ ID NO: 8225445 - DNA, 17 bp, Homo sapiens
aggaaacattttctttc

SEQ ID NO: 8225446 - DNA, 22 bp, Homo sapiens
agctttatatgttgtttctcca

SEQ ID NO: 8225447 - DNA, 22 bp, Homo sapiens
aggaaactaaagcccagagagg

SEQ ID NO: 8225448 - DNA, 22 bp, Homo sapiens
aggaaactaaagcccagagagg

SEQ ID NO: 8225449 - DNA, 22 bp, Homo sapiens
agctttatagaaaggatcagtg

SEQ ID NO: 8225450 - DNA, 22 bp, Homo sapiens
agctttagagagccaagactca

SEQ ID NO: 8225451 - DNA, 22 bp, Homo sapiens
agctttaaaaatccaatatcca

SEQ ID NO: 8225452 - DNA, 22 bp, Homo sapiens
agctttaaagcatatttctaag

SEQ ID NO: 8225453 - DNA, 22 bp, Homo sapiens
agctttaaatcaatccagtgag

SEQ ID NO: 8225454 - DNA, 23 bp, Homo sapiens
agctttaaccctttcaggagcat

SEQ ID NO: 8225455 - DNA, 22 bp, Homo sapiens
agctttaaagcatatttctaag

SEQ ID NO: 8225456 - DNA, 22 bp, Homo sapiens
agcttgtgtttttctaagtatc

SEQ ID NO: 8225457 - DNA, 22 bp, Homo sapiens
agctttaaaaatccaatatcca

SEQ ID NO: 8225458 - DNA, 22 bp, Homo sapiens
aggaaatgtagtcctcatctcc

SEQ ID NO: 8225459 - DNA, 22 bp, Homo sapiens
aggaaatgggaatagatggtat

SEQ ID NO: 8225460 - DNA, 22 bp, Homo sapiens
aggaaatgtacaaatgaagatg

SEQ ID NO: 8225461 - DNA, 22 bp, Homo sapiens
aggaaatgtagtcctcatctcc

SEQ ID NO: 8225462 - DNA, 22 bp, Homo sapiens
aggaacacaacttcctgagagc

SEQ ID NO: 8225463 - DNA, 22 bp, Homo sapiens
aggaacaagggagccttttctc

SEQ ID NO: 8225464 - DNA, 22 bp, Homo sapiens
aggaaatgggaatagatggtat

SEQ ID NO: 8225465 - DNA, 22 bp, Homo sapiens
aggaaatgcaggcaaatactct

SEQ ID NO: 8225466 - DNA, 22 bp, Homo sapiens
aggaaatgcaggcaaatactct

SEQ ID NO: 8225467 - DNA, 22 bp, Homo sapiens
cagggccagcgcccaggcccag

SEQ ID NO: 8225468 - DNA, 22 bp, Homo sapiens
cagggccagcgcccaggcccag

SEQ ID NO: 8225469 - DNA, 22 bp, Homo sapiens
aggaaaggggtaggtgtggacg

SEQ ID NO: 8225470 - DNA, 22 bp, Homo sapiens
aggaaaggggtaggtgtggacg

SEQ ID NO: 8225471 - DNA, 18 bp, Homo sapiens
aggaagcaggaggaaggc

SEQ ID NO: 8225472 - DNA, 18 bp, Homo sapiens
aggaagcaggaggaaggc

SEQ ID NO: 8225473 - DNA, 22 bp, Homo sapiens
aggaagctcaaagccatgatgt

SEQ ID NO: 8225474 - DNA, 22 bp, Homo sapiens
aggaagcagcccatggatatag

SEQ ID NO: 8225475 - DNA, 22 bp, Homo sapiens
aggaagcagcccatggatatag

SEQ ID NO: 8225476 - DNA, 22 bp, Homo sapiens
aggaactggggctattcaccct

SEQ ID NO: 8225477 - DNA, 22 bp, Homo sapiens
aggaactgggctcagcaaacat

SEQ ID NO: 8225478 - DNA, 22 bp, Homo sapiens
aggaagctcagagaagtctttt

SEQ ID NO: 8225479 - DNA, 22 bp, Homo sapiens
aggaagctcattttgacatatc

SEQ ID NO: 8225480 - DNA, 22 bp, Homo sapiens
aggaagctcaaagccatgatgt

SEQ ID NO: 8225481 - DNA, 22 bp, Homo sapiens
aggaagctcaaagccatgatgt

SEQ ID NO: 8225482 - DNA, 22 bp, Homo sapiens
aggaagctcattttgacatatc

SEQ ID NO: 8225483 - DNA, 22 bp, Homo sapiens
aggaagctccatgaaggcagag

SEQ ID NO: 8225484 - DNA, 22 bp, Homo sapiens
aggaagctcctggagagccagt

SEQ ID NO: 8225485 - DNA, 22 bp, Homo sapiens
aggaagctcggagagggcaaat

SEQ ID NO: 8225486 - DNA, 22 bp, Homo sapiens
aggaagctctctgcttttaaga

SEQ ID NO: 8225487 - DNA, 22 bp, Homo sapiens
aggaaccagaggttgagcaact

SEQ ID NO: 8225488 - DNA, 22 bp, Homo sapiens
aggaaccctgcgccatactttg

SEQ ID NO: 8225489 - DNA, 23 bp, Homo sapiens
aggaaccttagaattcactgcca

SEQ ID NO: 8225490 - DNA, 22 bp, Homo sapiens
aggaacctaagagcctgcagtc

SEQ ID NO: 8225491 - DNA, 19 bp, Homo sapiens
aggaaccttcattgctccc

SEQ ID NO: 8225492 - DNA, 23 bp, Homo sapiens
aggaaccttagaattcactgcca

SEQ ID NO: 8225493 - DNA, 22 bp, Homo sapiens
aggaactggatataatgtgaga

SEQ ID NO: 8225494 - DNA, 20 bp, Homo sapiens
aggaactggaagggaggaaa

SEQ ID NO: 8225495 - DNA, 22 bp, Homo sapiens
aggaactgatgagcagccaggg

SEQ ID NO: 8225496 - DNA, 22 bp, Homo sapiens
aggaactctgtctccagagttg

SEQ ID NO: 8225497 - DNA, 22 bp, Homo sapiens
aggaactctgtctccagagttg

SEQ ID NO: 8225498 - DNA, 22 bp, Homo sapiens
aggaactagtgcaacaggagcg

SEQ ID NO: 8225499 - DNA, 22 bp, Homo sapiens
cagctttgtcatttgatttggg

SEQ ID NO: 8225500 - DNA, 22 bp, Homo sapiens
cagcttttaggactgtgagaaa

SEQ ID NO: 8225501 - DNA, 22 bp, Homo sapiens
agctgcaggtggacccgtaccg

SEQ ID NO: 8225502 - DNA, 22 bp, Homo sapiens
agctgcaggttcagcattccac

SEQ ID NO: 8225503 - DNA, 22 bp, Homo sapiens
agctgcaggttcagcattccac

SEQ ID NO: 8225504 - DNA, 22 bp, Homo sapiens
agctgcagtaaagctctccagg

SEQ ID NO: 8225505 - DNA, 22 bp, Homo sapiens
agctgcagtaaagctctccagg

SEQ ID NO: 8225506 - DNA, 22 bp, Homo sapiens
agctgcaggcctctcctgggga

SEQ ID NO: 8225507 - DNA, 22 bp, Homo sapiens
agctgcaggcctctcctgggga

SEQ ID NO: 8225508 - DNA, 22 bp, Homo sapiens
agctgcagggcttgggtttccc

SEQ ID NO: 8225509 - DNA, 22 bp, Homo sapiens
agctgcaggcgccggggccgat

SEQ ID NO: 8225510 - DNA, 22 bp, Homo sapiens
agctgcaggcgccggggccgat

SEQ ID NO: 8225511 - DNA, 22 bp, Homo sapiens
agctgcagtatgaggctggtgg

SEQ ID NO: 8225512 - DNA, 22 bp, Homo sapiens
agctgcagtatgaggctggtgg

SEQ ID NO: 8225513 - DNA, 22 bp, Homo sapiens
agctgcagtatgaggctggtgg

SEQ ID NO: 8225514 - DNA, 21 bp, Homo sapiens
agctgcagtcaagccagaggt

SEQ ID NO: 8225515 - DNA, 21 bp, Homo sapiens
agctgcagtcaagccagaggt

SEQ ID NO: 8225516 - DNA, 21 bp, Homo sapiens
agctgcagtcaagccagaggt

SEQ ID NO: 8225517 - DNA, 22 bp, Homo sapiens
agctgcagtcaagctgggccac

SEQ ID NO: 8225518 - DNA, 22 bp, Homo sapiens
agctgcagtcaagctgggccac

SEQ ID NO: 8225519 - DNA, 22 bp, Homo sapiens
agctgcagtcaagctgggccac

SEQ ID NO: 8225520 - DNA, 22 bp, Homo sapiens
agctgcagtcaagctgggccac

SEQ ID NO: 8225521 - DNA, 22 bp, Homo sapiens
agctgcagtcaagctgggccac

SEQ ID NO: 8225522 - DNA, 22 bp, Homo sapiens
agctgaggccacgagtgaaggg

SEQ ID NO: 8225523 - DNA, 22 bp, Homo sapiens
agctgaggccacgagtgaaggg

SEQ ID NO: 8225524 - DNA, 22 bp, Homo sapiens
agctgaggcatggacaggctgc

SEQ ID NO: 8225525 - DNA, 22 bp, Homo sapiens
agctgaggccacgagtgaaggg

SEQ ID NO: 8225526 - DNA, 22 bp, Homo sapiens
agctgaggcctgatttcgccgt

SEQ ID NO: 8225527 - DNA, 22 bp, Homo sapiens
agctgaggcctgatttcgccgt

SEQ ID NO: 8225528 - DNA, 22 bp, Homo sapiens
agctgaggcatgatgctatcag

SEQ ID NO: 8225529 - DNA, 22 bp, Homo sapiens
agctgaggcatggacaggctgc

SEQ ID NO: 8225530 - DNA, 22 bp, Homo sapiens
agctgaggcatggacaggctgc

SEQ ID NO: 8225531 - DNA, 22 bp, Homo sapiens
agctgaggcatggacaggctgc

SEQ ID NO: 8225532 - DNA, 22 bp, Homo sapiens
agctgaggcatggacaggctgc

SEQ ID NO: 8225533 - DNA, 23 bp, Homo sapiens
cagcttctttgggattctttata

SEQ ID NO: 8225534 - DNA, 23 bp, Homo sapiens
cagcttctttgggattctttata

SEQ ID NO: 8225535 - DNA, 23 bp, Homo sapiens
cagcttctttgggattctttata

SEQ ID NO: 8225536 - DNA, 23 bp, Homo sapiens
agctgaggcagaggggcattctc

SEQ ID NO: 8225537 - DNA, 21 bp, Homo sapiens
agctgcagcccaaaggcctgt

SEQ ID NO: 8225538 - DNA, 22 bp, Homo sapiens
agctgcaggcccatgctcagtc

SEQ ID NO: 8225539 - DNA, 22 bp, Homo sapiens
agctgcaggcccatgctcagtc

SEQ ID NO: 8225540 - DNA, 22 bp, Homo sapiens
agctgcaggcctctcctgggga

SEQ ID NO: 8225541 - DNA, 21 bp, Homo sapiens
agctgcaggcctcccagggat

SEQ ID NO: 8225542 - DNA, 21 bp, Homo sapiens
agctgcaggcctcccagggat

SEQ ID NO: 8225543 - DNA, 23 bp, Homo sapiens
agctgaggctgtgggtgtcagag

SEQ ID NO: 8225544 - DNA, 23 bp, Homo sapiens
agctgaggctgtgggtgtcagag

SEQ ID NO: 8225545 - DNA, 21 bp, Homo sapiens
agctgcagccatgtacatggc

SEQ ID NO: 8225546 - DNA, 21 bp, Homo sapiens
agctgcagccatgtacatggc

SEQ ID NO: 8225547 - DNA, 22 bp, Homo sapiens
agctgaggctctgagagggaag

SEQ ID NO: 8225548 - DNA, 23 bp, Homo sapiens
agctgaggctgtgggtgtcagag

SEQ ID NO: 8225549 - DNA, 22 bp, Homo sapiens
agctgaggctctgagagggaag

SEQ ID NO: 8225550 - DNA, 22 bp, Homo sapiens
agctgaggctctgagagggaag

SEQ ID NO: 8225551 - DNA, 23 bp, Homo sapiens
agctctgctcgggcatgccctgc

SEQ ID NO: 8225552 - DNA, 23 bp, Homo sapiens
agctctgctcgggcatgccctgc

SEQ ID NO: 8225553 - DNA, 22 bp, Homo sapiens
agctctggaactcccggctgct

SEQ ID NO: 8225554 - DNA, 22 bp, Homo sapiens
agctctggaactcccggctgct

SEQ ID NO: 8225555 - DNA, 22 bp, Homo sapiens
agctctgccttgacaccttctc

SEQ ID NO: 8225556 - DNA, 22 bp, Homo sapiens
agctctgccttgacaccttctc

SEQ ID NO: 8225557 - DNA, 22 bp, Homo sapiens
agctctgcagcccagcaggtgg

SEQ ID NO: 8225558 - DNA, 22 bp, Homo sapiens
agctctgcaggcacagctgagg

SEQ ID NO: 8225559 - DNA, 22 bp, Homo sapiens
agctctggaagccctggtagtt

SEQ ID NO: 8225560 - DNA, 22 bp, Homo sapiens
agctctggaagccctggtagtt

SEQ ID NO: 8225561 - DNA, 22 bp, Homo sapiens
agctctggaagccctggtagtt

SEQ ID NO: 8225562 - DNA, 22 bp, Homo sapiens
cagctcctgcctgggcagctgt

SEQ ID NO: 8225563 - DNA, 22 bp, Homo sapiens
cagctcctgcctgggcagctgt

SEQ ID NO: 8225564 - DNA, 22 bp, Homo sapiens
cagctcctgcctgggcagctgt

SEQ ID NO: 8225565 - DNA, 22 bp, Homo sapiens
cagctcctgttggtcttgagga

SEQ ID NO: 8225566 - DNA, 23 bp, Homo sapiens
agctctgaaatagggaaagagga

SEQ ID NO: 8225567 - DNA, 22 bp, Homo sapiens
agctctcttccagatccacttg

SEQ ID NO: 8225568 - DNA, 22 bp, Homo sapiens
agctctctgataaattgataaa

SEQ ID NO: 8225569 - DNA, 22 bp, Homo sapiens
agctctgatctttacaacaaag

SEQ ID NO: 8225570 - DNA, 22 bp, Homo sapiens
agctctgaagcttatctgatgt

SEQ ID NO: 8225571 - DNA, 22 bp, Homo sapiens
agctctgacattgattctcagc

SEQ ID NO: 8225572 - DNA, 22 bp, Homo sapiens
agctctgactgaagagatgcaa

SEQ ID NO: 8225573 - DNA, 22 bp, Homo sapiens
cagctctcacaccctcctccca

SEQ ID NO: 8225574 - DNA, 22 bp, Homo sapiens
cagctctacgtttctatgaatc

SEQ ID NO: 8225575 - DNA, 23 bp, Homo sapiens
cagctcgcttttgttccctccct

SEQ ID NO: 8225576 - DNA, 22 bp, Homo sapiens
cagctcctgttggtcttgagga

SEQ ID NO: 8225577 - DNA, 22 bp, Homo sapiens
cagctctcacacttagcttcta

SEQ ID NO: 8225578 - DNA, 22 bp, Homo sapiens
cagctctcacacttagcttcta

SEQ ID NO: 8225579 - DNA, 22 bp, Homo sapiens
cagctctctaaggtcttgcttt

SEQ ID NO: 8225580 - DNA, 22 bp, Homo sapiens
cagctctgaagaaaggtgtcta

SEQ ID NO: 8225581 - DNA, 22 bp, Homo sapiens
cagcttcttacgagctggtact

SEQ ID NO: 8225582 - DNA, 22 bp, Homo sapiens
cagcttctgtttctagcccctg

SEQ ID NO: 8225583 - DNA, 22 bp, Homo sapiens
cagcttcttacgagctggtact

SEQ ID NO: 8225584 - DNA, 22 bp, Homo sapiens
cagcttcttagtctttccttgt

SEQ ID NO: 8225585 - DNA, 22 bp, Homo sapiens
cagcttcttagtctttccttgt

SEQ ID NO: 8225586 - DNA, 22 bp, Homo sapiens
cagcttcttcagtcctggagct

SEQ ID NO: 8225587 - DNA, 22 bp, Homo sapiens
cagcttcttcagtcctggagct

SEQ ID NO: 8225588 - DNA, 22 bp, Homo sapiens
cagcttcttcagtcctggagct

SEQ ID NO: 8225589 - DNA, 21 bp, Homo sapiens
cagcttcttctgtgacctggt

SEQ ID NO: 8225590 - DNA, 21 bp, Homo sapiens
cagcttcttctgtgacctggt

SEQ ID NO: 8225591 - DNA, 22 bp, Homo sapiens
cagcttctttgggattctttat

SEQ ID NO: 8225592 - DNA, 22 bp, Homo sapiens
cagcttctttgggattctttat

SEQ ID NO: 8225593 - DNA, 22 bp, Homo sapiens
cagcttctgtctgattagcaag

SEQ ID NO: 8225594 - DNA, 22 bp, Homo sapiens
cagcttctgtcctagaaactgg

SEQ ID NO: 8225595 - DNA, 22 bp, Homo sapiens
cagcttctgtttctagcccctg

SEQ ID NO: 8225596 - DNA, 22 bp, Homo sapiens
cagcttctgtttattgtgtgcc

SEQ ID NO: 8225597 - DNA, 22 bp, Homo sapiens
cagcttctgtttattgtgtgcc

SEQ ID NO: 8225598 - DNA, 22 bp, Homo sapiens
cagcttctggcgtggagcctga

SEQ ID NO: 8225599 - DNA, 22 bp, Homo sapiens
cagcttctgctcatggaggggt

SEQ ID NO: 8225600 - DNA, 22 bp, Homo sapiens
cagcttctgctcatggaggggt

SEQ ID NO: 8225601 - DNA, 22 bp, Homo sapiens
caggacagaccaagatcgtgct

SEQ ID NO: 8225602 - DNA, 22 bp, Homo sapiens
caggacagaccaagatcgtgct

SEQ ID NO: 8225603 - DNA, 22 bp, Homo sapiens
caggacagaccaagatcgtgct

SEQ ID NO: 8225604 - DNA, 22 bp, Homo sapiens
caggacagaccaagatcgtgct

SEQ ID NO: 8225605 - DNA, 22 bp, Homo sapiens
caggacagacagaatgcctaac

SEQ ID NO: 8225606 - DNA, 22 bp, Homo sapiens
caggacagaaataaggaatata

SEQ ID NO: 8225607 - DNA, 22 bp, Homo sapiens
caggacagaaataaggaatata

SEQ ID NO: 8225608 - DNA, 22 bp, Homo sapiens
agctggcagtcggccttgatgc

SEQ ID NO: 8225609 - DNA, 22 bp, Homo sapiens
agctggcagtcggccttgatgc

SEQ ID NO: 8225610 - DNA, 21 bp, Homo sapiens
agctggcagtgcctggacctc

SEQ ID NO: 8225611 - DNA, 21 bp, Homo sapiens
agctggcagtgcctggacctc

SEQ ID NO: 8225612 - DNA, 22 bp, Homo sapiens
agctggcagtcggccttgatgc

SEQ ID NO: 8225613 - DNA, 22 bp, Homo sapiens
agctggcagttgcgataatgca

SEQ ID NO: 8225614 - DNA, 22 bp, Homo sapiens
agctggcatactttgctaggaa

SEQ ID NO: 8225615 - DNA, 22 bp, Homo sapiens
agctggcagttgcgataatgca

SEQ ID NO: 8225616 - DNA, 22 bp, Homo sapiens
agctggcatactttgctaggaa

SEQ ID NO: 8225617 - DNA, 22 bp, Homo sapiens
agctggcagtcatcctagtgag

SEQ ID NO: 8225618 - DNA, 22 bp, Homo sapiens
agctggcagtatgactggtgac

SEQ ID NO: 8225619 - DNA, 22 bp, Homo sapiens
agctggcaggtgaagatgattt

SEQ ID NO: 8225620 - DNA, 22 bp, Homo sapiens
agctggcagtatgactggtgac

SEQ ID NO: 8225621 - DNA, 22 bp, Homo sapiens
agctggcagtcatcctagtgag

SEQ ID NO: 8225622 - DNA, 22 bp, Homo sapiens
agctggcagtcatcctagtgag

SEQ ID NO: 8225623 - DNA, 22 bp, Homo sapiens
agctggcagtcatcctagtgag

SEQ ID NO: 8225624 - DNA, 22 bp, Homo sapiens
agctggcagtatgactggtgac

SEQ ID NO: 8225625 - DNA, 22 bp, Homo sapiens
caggacagagcccagactgtgt

SEQ ID NO: 8225626 - DNA, 22 bp, Homo sapiens
caggacagagcccagactgtgt

SEQ ID NO: 8225627 - DNA, 22 bp, Homo sapiens
caggacagagcccagactgtgt

SEQ ID NO: 8225628 - DNA, 22 bp, Homo sapiens
agctggaggataactcacttct

SEQ ID NO: 8225629 - DNA, 22 bp, Homo sapiens
agctggaggataactcacttct

SEQ ID NO: 8225630 - DNA, 22 bp, Homo sapiens
agctggcaggtgaagatgattt

SEQ ID NO: 8225631 - DNA, 22 bp, Homo sapiens
agctggcagtatgactggtgac

SEQ ID NO: 8225632 - DNA, 22 bp, Homo sapiens
agctggcagtatgactggtgac

SEQ ID NO: 8225633 - DNA, 21 bp, Homo sapiens
caggaaaagcggaagtctagc

SEQ ID NO: 8225634 - DNA, 22 bp, Homo sapiens
agctgcctggagtcatttcctg

SEQ ID NO: 8225635 - DNA, 22 bp, Homo sapiens
agctgctcattcccagcacatg

SEQ ID NO: 8225636 - DNA, 22 bp, Homo sapiens
agctgctccaacccagcgggct

SEQ ID NO: 8225637 - DNA, 22 bp, Homo sapiens
agctgctccaatttttaccatt

SEQ ID NO: 8225638 - DNA, 22 bp, Homo sapiens
agctgcctggccggagccactg

SEQ ID NO: 8225639 - DNA, 22 bp, Homo sapiens
agctgcctggccggagccactg

SEQ ID NO: 8225640 - DNA, 22 bp, Homo sapiens
agctgctccctatcctttcctt

SEQ ID NO: 8225641 - DNA, 22 bp, Homo sapiens
agctgctcctttcctgcaggcg

SEQ ID NO: 8225642 - DNA, 21 bp, Homo sapiens
agctgctccagggagctcagg

SEQ ID NO: 8225643 - DNA, 21 bp, Homo sapiens
agctgctccagggagctcagg

SEQ ID NO: 8225644 - DNA, 22 bp, Homo sapiens
agctgctgaatgacactgcaag

SEQ ID NO: 8225645 - DNA, 22 bp, Homo sapiens
agctgctgaatgacactgcaag

SEQ ID NO: 8225646 - DNA, 22 bp, Homo sapiens
agctgctgagagtctgccgggc

SEQ ID NO: 8225647 - DNA, 22 bp, Homo sapiens
agctgctgagccaggctgatgt

SEQ ID NO: 8225648 - DNA, 22 bp, Homo sapiens
agctgctgagccaggctgatgt

SEQ ID NO: 8225649 - DNA, 22 bp, Homo sapiens
agctgctctttgaaggacactt

SEQ ID NO: 8225650 - DNA, 22 bp, Homo sapiens
agctgctctttgaaggacactt

SEQ ID NO: 8225651 - DNA, 22 bp, Homo sapiens
agctgctgaagtgagagaattg

SEQ ID NO: 8225652 - DNA, 22 bp, Homo sapiens
agctgctgaagtgagagaattg

SEQ ID NO: 8225653 - DNA, 22 bp, Homo sapiens
agctgctgaatgacactgcaag

SEQ ID NO: 8225654 - DNA, 22 bp, Homo sapiens
agctgctgaagtgagagaattg

SEQ ID NO: 8225655 - DNA, 22 bp, Homo sapiens
agctgctgaagtgagagaattg

SEQ ID NO: 8225656 - DNA, 22 bp, Homo sapiens
agctgctctcactggacgcctg

SEQ ID NO: 8225657 - DNA, 22 bp, Homo sapiens
agctgctcctttcctgcaggcg

SEQ ID NO: 8225658 - DNA, 22 bp, Homo sapiens
agctgctcctttcctgcaggcg

SEQ ID NO: 8225659 - DNA, 20 bp, Homo sapiens
agctgctctcatccagacct

SEQ ID NO: 8225660 - DNA, 22 bp, Homo sapiens
agctgctctgagccctgattct

SEQ ID NO: 8225661 - DNA, 22 bp, Homo sapiens
agctgctctgggaaacagaagt

SEQ ID NO: 8225662 - DNA, 22 bp, Homo sapiens
agctgctcttgggtgacttcaa

SEQ ID NO: 8225663 - DNA, 22 bp, Homo sapiens
agctggccattgtgagtggcct

SEQ ID NO: 8225664 - DNA, 22 bp, Homo sapiens
agctggccagcacctccaggtc

SEQ ID NO: 8225665 - DNA, 22 bp, Homo sapiens
agctggccagcacctccaggtc

SEQ ID NO: 8225666 - DNA, 22 bp, Homo sapiens
agctggcattgcagggagctgc

SEQ ID NO: 8225667 - DNA, 22 bp, Homo sapiens
agctggcattgaagaatggtta

SEQ ID NO: 8225668 - DNA, 22 bp, Homo sapiens
agctggcattgcagggagctgc

SEQ ID NO: 8225669 - DNA, 22 bp, Homo sapiens
agctggccagcacctccaggtc

SEQ ID NO: 8225670 - DNA, 22 bp, Homo sapiens
agctggcattgcagggagctgc

SEQ ID NO: 8225671 - DNA, 22 bp, Homo sapiens
agctggcatcgagcatttgaac

SEQ ID NO: 8225672 - DNA, 22 bp, Homo sapiens
agctggcatactttgctaggaa

SEQ ID NO: 8225673 - DNA, 22 bp, Homo sapiens
agctggcatactttgctaggaa

SEQ ID NO: 8225674 - DNA, 22 bp, Homo sapiens
agctggcatactttgctaggaa

SEQ ID NO: 8225675 - DNA, 22 bp, Homo sapiens
agctggcatactttgctaggaa

SEQ ID NO: 8225676 - DNA, 22 bp, Homo sapiens
agctggcatctgaagtcagggc

SEQ ID NO: 8225677 - DNA, 22 bp, Homo sapiens
agctggcatctgaagtcagggc

SEQ ID NO: 8225678 - DNA, 22 bp, Homo sapiens
agctggcatctgaagtcagggc

SEQ ID NO: 8225679 - DNA, 22 bp, Homo sapiens
agctggcattgaagaatggtta

SEQ ID NO: 8225680 - DNA, 22 bp, Homo sapiens
agctggcattctccttgttatt

SEQ ID NO: 8225681 - DNA, 22 bp, Homo sapiens
agctggcattgaagaatggtta

SEQ ID NO: 8225682 - DNA, 22 bp, Homo sapiens
agctggcattgaagaatggtta

SEQ ID NO: 8225683 - DNA, 22 bp, Homo sapiens
agctggcattctccttgttatt

SEQ ID NO: 8225684 - DNA, 22 bp, Homo sapiens
agctggcattacaggagcatgc

SEQ ID NO: 8225685 - DNA, 22 bp, Homo sapiens
agctggcattacaggagcatgc

SEQ ID NO: 8225686 - DNA, 22 bp, Homo sapiens
agctggcattacaggagcatgc

SEQ ID NO: 8225687 - DNA, 22 bp, Homo sapiens
caggagtccagagtgtcatttt

SEQ ID NO: 8225688 - DNA, 22 bp, Homo sapiens
caggaggttgtaagagcaggcc

SEQ ID NO: 8225689 - DNA, 22 bp, Homo sapiens
caggaggttgtaagagcaggcc

SEQ ID NO: 8225690 - DNA, 22 bp, Homo sapiens
caggaggttggtagcagtagat

SEQ ID NO: 8225691 - DNA, 22 bp, Homo sapiens
caggaggttggtagcagtagat

SEQ ID NO: 8225692 - DNA, 22 bp, Homo sapiens
caggaggttggtagcagtagat

SEQ ID NO: 8225693 - DNA, 22 bp, Homo sapiens
caggaggttgtaagagcaggcc

SEQ ID NO: 8225694 - DNA, 22 bp, Homo sapiens
caggaggtacatagattcagat

SEQ ID NO: 8225695 - DNA, 22 bp, Homo sapiens
caggaggtacatagattcagat

SEQ ID NO: 8225696 - DNA, 22 bp, Homo sapiens
caggaggttgagggtgcagtga

SEQ ID NO: 8225697 - DNA, 22 bp, Homo sapiens
caggaggtgccctctagtggca

SEQ ID NO: 8225698 - DNA, 22 bp, Homo sapiens
caggaggtggagctcaagtggt

SEQ ID NO: 8225699 - DNA, 22 bp, Homo sapiens
agctggctggccccttcctgcc

SEQ ID NO: 8225700 - DNA, 22 bp, Homo sapiens
agctggctgccttctccttagg

SEQ ID NO: 8225701 - DNA, 22 bp, Homo sapiens
agctggctgggtgccagtctcc

SEQ ID NO: 8225702 - DNA, 22 bp, Homo sapiens
agctggctggccccttcctgcc

SEQ ID NO: 8225703 - DNA, 22 bp, Homo sapiens
agctggctggccccttcctgcc

SEQ ID NO: 8225704 - DNA, 22 bp, Homo sapiens
agctggctggccccttcctgcc

SEQ ID NO: 8225705 - DNA, 22 bp, Homo sapiens
agctggctggccccttcctgcc

SEQ ID NO: 8225706 - DNA, 21 bp, Homo sapiens
agctggcctggtttgagctcc

SEQ ID NO: 8225707 - DNA, 19 bp, Homo sapiens
agctggctcttctttgtct

SEQ ID NO: 8225708 - DNA, 19 bp, Homo sapiens
agctggctcttctttgtct

SEQ ID NO: 8225709 - DNA, 22 bp, Homo sapiens
agctggctgccttctccttagg

SEQ ID NO: 8225710 - DNA, 22 bp, Homo sapiens
agctggctgccttctccttagg

SEQ ID NO: 8225711 - DNA, 22 bp, Homo sapiens
agctggcctccgggtgcctggg

SEQ ID NO: 8225712 - DNA, 22 bp, Homo sapiens
agctggcctccgggtgcctggg

SEQ ID NO: 8225713 - DNA, 22 bp, Homo sapiens
agctggcctccgggtgcctggg

SEQ ID NO: 8225714 - DNA, 22 bp, Homo sapiens
caggagtctgttcctcatttgt

SEQ ID NO: 8225715 - DNA, 22 bp, Homo sapiens
caggagtccctctggccagcat

SEQ ID NO: 8225716 - DNA, 22 bp, Homo sapiens
caggagtccctctggccagcat

SEQ ID NO: 8225717 - DNA, 22 bp, Homo sapiens
agctggcttcacaggcagtgtg

SEQ ID NO: 8225718 - DNA, 22 bp, Homo sapiens
agctggcttcacaggcagtgtg

SEQ ID NO: 8225719 - DNA, 22 bp, Homo sapiens
agctggctgggtgccagtctcc

SEQ ID NO: 8225720 - DNA, 22 bp, Homo sapiens
agctggctgggtgccagtctcc

SEQ ID NO: 8225721 - DNA, 22 bp, Homo sapiens
agctggctgggtgccagtctcc

SEQ ID NO: 8225722 - DNA, 22 bp, Homo sapiens
agctggctgggtgccagtctcc

SEQ ID NO: 8225723 - DNA, 22 bp, Homo sapiens
agctggcttctctgcagacatt

SEQ ID NO: 8225724 - DNA, 22 bp, Homo sapiens
agctggcttctctgcagacatt

SEQ ID NO: 8225725 - DNA, 22 bp, Homo sapiens
agctggcttcacaggcagtgtg

SEQ ID NO: 8225726 - DNA, 22 bp, Homo sapiens
agctggctttgagctgggaggt

SEQ ID NO: 8225727 - DNA, 22 bp, Homo sapiens
agctggctttgagctgggaggt

SEQ ID NO: 8225728 - DNA, 22 bp, Homo sapiens
agctggctttgagctgggaggt

SEQ ID NO: 8225729 - DNA, 22 bp, Homo sapiens
agctggctttatggttggctaa

SEQ ID NO: 8225730 - DNA, 22 bp, Homo sapiens
agctggcttgcatgctaaggag

SEQ ID NO: 8225731 - DNA, 22 bp, Homo sapiens
agctggcttgcatgctaaggag

SEQ ID NO: 8225732 - DNA, 22 bp, Homo sapiens
agctggctttatggttggctaa

SEQ ID NO: 8225733 - DNA, 22 bp, Homo sapiens
agctggctttatggttggctaa

SEQ ID NO: 8225734 - DNA, 22 bp, Homo sapiens
agctggctttatggttggctaa

SEQ ID NO: 8225735 - DNA, 22 bp, Homo sapiens
cagcagcattgctctggattcc

SEQ ID NO: 8225736 - DNA, 22 bp, Homo sapiens
agcctgtccagaggacagggct

SEQ ID NO: 8225737 - DNA, 18 bp, Homo sapiens
agcctgtcccttctcctg

SEQ ID NO: 8225738 - DNA, 22 bp, Homo sapiens
agcctgtccagaggacagggct

SEQ ID NO: 8225739 - DNA, 22 bp, Homo sapiens
agccttccaggtagatggcaca

SEQ ID NO: 8225740 - DNA, 22 bp, Homo sapiens
agccttccacccagatcccctt

SEQ ID NO: 8225741 - DNA, 22 bp, Homo sapiens
agccttccacccagatcccctt

SEQ ID NO: 8225742 - DNA, 22 bp, Homo sapiens
agccttccaggtagatggcaca

SEQ ID NO: 8225743 - DNA, 22 bp, Homo sapiens
cagcagcagtggctgcagaaca

SEQ ID NO: 8225744 - DNA, 22 bp, Homo sapiens
cagcagcatcaggtctgtggtt

SEQ ID NO: 8225745 - DNA, 22 bp, Homo sapiens
cagcagcagtgttctagaatct

SEQ ID NO: 8225746 - DNA, 22 bp, Homo sapiens
cagcagcatgaattcgagccac

SEQ ID NO: 8225747 - DNA, 22 bp, Homo sapiens
cagcagcatgaattcgagccac

SEQ ID NO: 8225748 - DNA, 22 bp, Homo sapiens
cagcagcatcaggtctgtggtt

SEQ ID NO: 8225749 - DNA, 22 bp, Homo sapiens
cagcagcagccccaggaaggtt

SEQ ID NO: 8225750 - DNA, 22 bp, Homo sapiens
cagcagcagcttagtggtcccc

SEQ ID NO: 8225751 - DNA, 22 bp, Homo sapiens
cagcagcagccccaggaaggtt

SEQ ID NO: 8225752 - DNA, 22 bp, Homo sapiens
cagcagaggttttgctccatga

SEQ ID NO: 8225753 - DNA, 22 bp, Homo sapiens
cagcagaggttttgctccatga

SEQ ID NO: 8225754 - DNA, 22 bp, Homo sapiens
cagcagaggttttgctccatga

SEQ ID NO: 8225755 - DNA, 22 bp, Homo sapiens
cagcagaggttttgctccatga

SEQ ID NO: 8225756 - DNA, 22 bp, Homo sapiens
cagcagaggttttgctccatga

SEQ ID NO: 8225757 - DNA, 22 bp, Homo sapiens
cagcagcagcttagtggtcccc

SEQ ID NO: 8225758 - DNA, 22 bp, Homo sapiens
cagcagcagcttagtggtcccc

SEQ ID NO: 8225759 - DNA, 22 bp, Homo sapiens
cagcagcagtggctgcagaaca

SEQ ID NO: 8225760 - DNA, 22 bp, Homo sapiens
cagcagcaggcgcacggccgtc

SEQ ID NO: 8225761 - DNA, 22 bp, Homo sapiens
cagcagcaggcgcacggccgtc

SEQ ID NO: 8225762 - DNA, 22 bp, Homo sapiens
cagcagcagtggctgcagaaca

SEQ ID NO: 8225763 - DNA, 22 bp, Homo sapiens
cagcagcagtggctgcagaaca

SEQ ID NO: 8225764 - DNA, 22 bp, Homo sapiens
cagcagcagtggctgcagaaca

SEQ ID NO: 8225765 - DNA, 22 bp, Homo sapiens
cagcagagggagccattgaaat

SEQ ID NO: 8225766 - DNA, 22 bp, Homo sapiens
cagcagaggttggaacagttct

SEQ ID NO: 8225767 - DNA, 22 bp, Homo sapiens
cagcagaggtggttcacattgt

SEQ ID NO: 8225768 - DNA, 22 bp, Homo sapiens
cagcagaggtggttcacattgt

SEQ ID NO: 8225769 - DNA, 22 bp, Homo sapiens
cagcagaggaaagcaaatctaa

SEQ ID NO: 8225770 - DNA, 22 bp, Homo sapiens
agcctccatcccatgcacaaag

SEQ ID NO: 8225771 - DNA, 22 bp, Homo sapiens
agcctccatctcccatctgtga

SEQ ID NO: 8225772 - DNA, 22 bp, Homo sapiens
cagcagaaacccagcaaagcca

SEQ ID NO: 8225773 - DNA, 22 bp, Homo sapiens
agcctcagtgtcaccatctacc

SEQ ID NO: 8225774 - DNA, 22 bp, Homo sapiens
agcctcagtgtcaccatctacc

SEQ ID NO: 8225775 - DNA, 22 bp, Homo sapiens
agcctcagtgtcaccatctacc

SEQ ID NO: 8225776 - DNA, 22 bp, Homo sapiens
agcctcagtgtcaccatctacc

SEQ ID NO: 8225777 - DNA, 21 bp, Homo sapiens
agcctcaggttgttggttctt

SEQ ID NO: 8225778 - DNA, 22 bp, Homo sapiens
agcctcagtttcaggcctcctc

SEQ ID NO: 8225779 - DNA, 22 bp, Homo sapiens
agcctcagtttcaggcctcctc

SEQ ID NO: 8225780 - DNA, 22 bp, Homo sapiens
agcctcagtgtcaccatctacc

SEQ ID NO: 8225781 - DNA, 22 bp, Homo sapiens
agcctcagtttcaggcctcctc

SEQ ID NO: 8225782 - DNA, 22 bp, Homo sapiens
cagcacagtacaaggcacggat

SEQ ID NO: 8225783 - DNA, 22 bp, Homo sapiens
agcctcagcacgcagctctgtg

SEQ ID NO: 8225784 - DNA, 22 bp, Homo sapiens
agcctcagcacgcagctctgtg

SEQ ID NO: 8225785 - DNA, 22 bp, Homo sapiens
cagcacagtacaaggcacggat

SEQ ID NO: 8225786 - DNA, 22 bp, Homo sapiens
agcctcagggctctgcgcagac

SEQ ID NO: 8225787 - DNA, 22 bp, Homo sapiens
agcctcagggctctgcgcagac

SEQ ID NO: 8225788 - DNA, 22 bp, Homo sapiens
agcctcagggctctgcgcagac

SEQ ID NO: 8225789 - DNA, 22 bp, Homo sapiens
agcctcagggctctgcgcagac

SEQ ID NO: 8225790 - DNA, 22 bp, Homo sapiens
agcctcagggctctgcgcagac

SEQ ID NO: 8225791 - DNA, 23 bp, Homo sapiens
agcctcagccggtggcagaagtg

SEQ ID NO: 8225792 - DNA, 23 bp, Homo sapiens
agcctcagccggtggcagaagtg

SEQ ID NO: 8225793 - DNA, 23 bp, Homo sapiens
agcctcagccggtggcagaagtg

SEQ ID NO: 8225794 - DNA, 22 bp, Homo sapiens
agcctcagcacgcagctctgtg

SEQ ID NO: 8225795 - DNA, 22 bp, Homo sapiens
agcctcagcacgcagctctgtg

SEQ ID NO: 8225796 - DNA, 22 bp, Homo sapiens
cagcacagctgaggggctgtct

SEQ ID NO: 8225797 - DNA, 22 bp, Homo sapiens
cagcacaggaagtgggccttca

SEQ ID NO: 8225798 - DNA, 22 bp, Homo sapiens
cagcacagggacaatagcagat

SEQ ID NO: 8225799 - DNA, 22 bp, Homo sapiens
cagcacagggacaatagcagat

SEQ ID NO: 8225800 - DNA, 22 bp, Homo sapiens
cagaggcgaggcagctgaacct

SEQ ID NO: 8225801 - DNA, 22 bp, Homo sapiens
cagaggctaagagtgtccaaag

SEQ ID NO: 8225802 - DNA, 22 bp, Homo sapiens
cagaggcgaggcagctgaacct

SEQ ID NO: 8225803 - DNA, 22 bp, Homo sapiens
agccctccatctgtgctcaggc

SEQ ID NO: 8225804 - DNA, 22 bp, Homo sapiens
cagaggctagactgtgcttcct

SEQ ID NO: 8225805 - DNA, 22 bp, Homo sapiens
cagaggctaagggtagcttggg

SEQ ID NO: 8225806 - DNA, 22 bp, Homo sapiens
cagaggctaagatgagtgggtg

SEQ ID NO: 8225807 - DNA, 22 bp, Homo sapiens
cagaggctaagatgagtgggtg

SEQ ID NO: 8225808 - DNA, 22 bp, Homo sapiens
cagaggctaagatgagtgggtg

SEQ ID NO: 8225809 - DNA, 22 bp, Homo sapiens
cagaggctcagatggccctggc

SEQ ID NO: 8225810 - DNA, 22 bp, Homo sapiens
cagaggctcaccagcctttcac

SEQ ID NO: 8225811 - DNA, 22 bp, Homo sapiens
cagaggctcaccagcctttcac

SEQ ID NO: 8225812 - DNA, 22 bp, Homo sapiens
cagcaagaatcagacaacctca

SEQ ID NO: 8225813 - DNA, 22 bp, Homo sapiens
cagaggctcttcctcactgccc

SEQ ID NO: 8225814 - DNA, 22 bp, Homo sapiens
cagaggctcttcctcactgccc

SEQ ID NO: 8225815 - DNA, 22 bp, Homo sapiens
cagcacagcacagcggtgactc

SEQ ID NO: 8225816 - DNA, 22 bp, Homo sapiens
agccttggatgagctttatcat

SEQ ID NO: 8225817 - DNA, 23 bp, Homo sapiens
agccttggaggttgaggctgcag

SEQ ID NO: 8225818 - DNA, 22 bp, Homo sapiens
agccttggtcccgcgtcagcca

SEQ ID NO: 8225819 - DNA, 22 bp, Homo sapiens
agccttgggcaatttggacact

SEQ ID NO: 8225820 - DNA, 22 bp, Homo sapiens
agccttggccgtaaggtatgct

SEQ ID NO: 8225821 - DNA, 22 bp, Homo sapiens
agcctttaacacttcacattga

SEQ ID NO: 8225822 - DNA, 22 bp, Homo sapiens
agccttgttgctaccagatgcc

SEQ ID NO: 8225823 - DNA, 22 bp, Homo sapiens
agcctttaacacttcacattga

SEQ ID NO: 8225824 - DNA, 22 bp, Homo sapiens
agcctttaactggataaagtgt

SEQ ID NO: 8225825 - DNA, 22 bp, Homo sapiens
agccttctctgaaattctgttt

SEQ ID NO: 8225826 - DNA, 22 bp, Homo sapiens
agccttccaggtagatggcaca

SEQ ID NO: 8225827 - DNA, 22 bp, Homo sapiens
agccttctaggatgtcatctgc

SEQ ID NO: 8225828 - DNA, 22 bp, Homo sapiens
agccttctaggatgtcatctgc

SEQ ID NO: 8225829 - DNA, 22 bp, Homo sapiens
agccttctctgaaattctgttt

SEQ ID NO: 8225830 - DNA, 22 bp, Homo sapiens
agccttctctgattctcctagt

SEQ ID NO: 8225831 - DNA, 22 bp, Homo sapiens
agccttgctttttcagtagcac

SEQ ID NO: 8225832 - DNA, 23 bp, Homo sapiens
cagcaggagggtgcctgggctgc

SEQ ID NO: 8225833 - DNA, 23 bp, Homo sapiens
cagcaggagggtgcctgggctgc

SEQ ID NO: 8225834 - DNA, 22 bp, Homo sapiens
cagcaggaggcatggcttccct

SEQ ID NO: 8225835 - DNA, 22 bp, Homo sapiens
cagcaggagcagtcagactcct

SEQ ID NO: 8225836 - DNA, 22 bp, Homo sapiens
agcctttatactgtgtaaggca

SEQ ID NO: 8225837 - DNA, 22 bp, Homo sapiens
agcctttaagctgccacagctg

SEQ ID NO: 8225838 - DNA, 22 bp, Homo sapiens
cagcaggacgtccaagtgctat

SEQ ID NO: 8225839 - DNA, 22 bp, Homo sapiens
cagcaggagcagtcagactcct

SEQ ID NO: 8225840 - DNA, 22 bp, Homo sapiens
cagcaggacgtccaagtgctat

SEQ ID NO: 8225841 - DNA, 22 bp, Homo sapiens
cagcaggacgtccaagtgctat

SEQ ID NO: 8225842 - DNA, 22 bp, Homo sapiens
agctcacagcctagcactgtga

SEQ ID NO: 8225843 - DNA, 22 bp, Homo sapiens
agctcacagggagaaacgacca

SEQ ID NO: 8225844 - DNA, 22 bp, Homo sapiens
agctcacagtgtccttcctcaa

SEQ ID NO: 8225845 - DNA, 22 bp, Homo sapiens
agctcacattctcatcagatgt

SEQ ID NO: 8225846 - DNA, 22 bp, Homo sapiens
agctcagaaatgccagtaggta

SEQ ID NO: 8225847 - DNA, 22 bp, Homo sapiens
agctcagaacctcctcatccca

SEQ ID NO: 8225848 - DNA, 22 bp, Homo sapiens
agctcagaacctcctcatccca

SEQ ID NO: 8225849 - DNA, 22 bp, Homo sapiens
agctcagaactgcagacatgtg

SEQ ID NO: 8225850 - DNA, 22 bp, Homo sapiens
agctcagaaatgccagtaggta

SEQ ID NO: 8225851 - DNA, 22 bp, Homo sapiens
agctcagaaatgccagtaggta

SEQ ID NO: 8225852 - DNA, 22 bp, Homo sapiens
agctcagaaatgccagtaggta

SEQ ID NO: 8225853 - DNA, 22 bp, Homo sapiens
agctcagaagggaggaaatgag

SEQ ID NO: 8225854 - DNA, 22 bp, Homo sapiens
cagccagagaaagggcactgcc

SEQ ID NO: 8225855 - DNA, 22 bp, Homo sapiens
cagccagaacctaggatgagct

SEQ ID NO: 8225856 - DNA, 22 bp, Homo sapiens
cagccagagaaagggcactgcc

SEQ ID NO: 8225857 - DNA, 22 bp, Homo sapiens
agctcagaagggaggaaatgag

SEQ ID NO: 8225858 - DNA, 22 bp, Homo sapiens
agctcagaagcctatgcatagt

SEQ ID NO: 8225859 - DNA, 22 bp, Homo sapiens
agctcagaagcctatgcatagt

SEQ ID NO: 8225860 - DNA, 22 bp, Homo sapiens
agctcagaactgcagacatgtg

SEQ ID NO: 8225861 - DNA, 22 bp, Homo sapiens
agctcagaagcctatgcatagt

SEQ ID NO: 8225862 - DNA, 22 bp, Homo sapiens
agctcagaactgcagacatgtg

SEQ ID NO: 8225863 - DNA, 22 bp, Homo sapiens
agctcagaactgcagacatgtg

SEQ ID NO: 8225864 - DNA, 22 bp, Homo sapiens
cagcaggaggtgagtagcaggt

SEQ ID NO: 8225865 - DNA, 22 bp, Homo sapiens
cagcaggaggtgagtagcaggt

SEQ ID NO: 8225866 - DNA, 22 bp, Homo sapiens
cagcaggaggtgagtagcaggt

SEQ ID NO: 8225867 - DNA, 22 bp, Homo sapiens
cagcaggaggtgagatgtgacc

SEQ ID NO: 8225868 - DNA, 22 bp, Homo sapiens
cagcaggaggtgagtagcaggt

SEQ ID NO: 8225869 - DNA, 22 bp, Homo sapiens
cagcaggaggtgagatgtgacc

SEQ ID NO: 8225870 - DNA, 23 bp, Homo sapiens
cagcaggagggtgcctgggctgc

SEQ ID NO: 8225871 - DNA, 22 bp, Homo sapiens
agctaggataagcagagactgg

SEQ ID NO: 8225872 - DNA, 22 bp, Homo sapiens
agctaggagattttgtgaggct

SEQ ID NO: 8225873 - DNA, 22 bp, Homo sapiens
agctcaatgcaacctccgcctc

SEQ ID NO: 8225874 - DNA, 22 bp, Homo sapiens
agctcacagcctagcactgtga

SEQ ID NO: 8225875 - DNA, 22 bp, Homo sapiens
agctcacagaaatcctgcagga

SEQ ID NO: 8225876 - DNA, 22 bp, Homo sapiens
cagccctgggagttggggccga

SEQ ID NO: 8225877 - DNA, 22 bp, Homo sapiens
cagccctgggagttggggccga

SEQ ID NO: 8225878 - DNA, 22 bp, Homo sapiens
cagccctgggtccctgccctgg

SEQ ID NO: 8225879 - DNA, 22 bp, Homo sapiens
cagccctgggatcttagtgcct

SEQ ID NO: 8225880 - DNA, 22 bp, Homo sapiens
cagccctgggtccctgccctgg

SEQ ID NO: 8225881 - DNA, 22 bp, Homo sapiens
cagccctgggtccctgccctgg

SEQ ID NO: 8225882 - DNA, 22 bp, Homo sapiens
cagccctgggtccctgccctgg

SEQ ID NO: 8225883 - DNA, 22 bp, Homo sapiens
agctcctgtgtgaagcctccct

SEQ ID NO: 8225884 - DNA, 22 bp, Homo sapiens
cagccctggctagggcgagggc

SEQ ID NO: 8225885 - DNA, 22 bp, Homo sapiens
cagccctggctagggcgagggc

SEQ ID NO: 8225886 - DNA, 22 bp, Homo sapiens
cagccctggctagggcgagggc

SEQ ID NO: 8225887 - DNA, 22 bp, Homo sapiens
cagccctggctagggcgagggc

SEQ ID NO: 8225888 - DNA, 22 bp, Homo sapiens
cagccctggcgcccccagatct

SEQ ID NO: 8225889 - DNA, 22 bp, Homo sapiens
cagccctggctagggcgagggc

SEQ ID NO: 8225890 - DNA, 22 bp, Homo sapiens
cagccctgggagttggggccga

SEQ ID NO: 8225891 - DNA, 20 bp, Homo sapiens
agctcctcatcactggaggt

SEQ ID NO: 8225892 - DNA, 21 bp, Homo sapiens
agctccctgtttcctcactct

SEQ ID NO: 8225893 - DNA, 21 bp, Homo sapiens
agctccctgtttcctcactct

SEQ ID NO: 8225894 - DNA, 22 bp, Homo sapiens
cagccctggccccaggtggtct

SEQ ID NO: 8225895 - DNA, 22 bp, Homo sapiens
cagccctggccccaggtggtct

SEQ ID NO: 8225896 - DNA, 22 bp, Homo sapiens
agctcctctagatctgccactt

SEQ ID NO: 8225897 - DNA, 22 bp, Homo sapiens
agctcctcctgtgccaggccag

SEQ ID NO: 8225898 - DNA, 22 bp, Homo sapiens
agctcctcctgtgccaggccag

SEQ ID NO: 8225899 - DNA, 22 bp, Homo sapiens
cagccctggccccaggtggtct

SEQ ID NO: 8225900 - DNA, 22 bp, Homo sapiens
cagccctggcgcccccagatct

SEQ ID NO: 8225901 - DNA, 22 bp, Homo sapiens
cagccctggcgcccccagatct

SEQ ID NO: 8225902 - DNA, 22 bp, Homo sapiens
cagccctggcgcccccagatct

SEQ ID NO: 8225903 - DNA, 22 bp, Homo sapiens
cagccctggcctcttcgctttc

SEQ ID NO: 8225904 - DNA, 22 bp, Homo sapiens
cagccctggcctcttcgctttc

SEQ ID NO: 8225905 - DNA, 22 bp, Homo sapiens
agctccctgagatgccacagca

SEQ ID NO: 8225906 - DNA, 22 bp, Homo sapiens
agctccctgagatgccacagca

SEQ ID NO: 8225907 - DNA, 22 bp, Homo sapiens
agctcccattatcttctgaaac

SEQ ID NO: 8225908 - DNA, 22 bp, Homo sapiens
agctcccaggcagtcatgagga

SEQ ID NO: 8225909 - DNA, 22 bp, Homo sapiens
agctcccagggctgggcaagtt

SEQ ID NO: 8225910 - DNA, 22 bp, Homo sapiens
agctcccagcagagctggccac

SEQ ID NO: 8225911 - DNA, 22 bp, Homo sapiens
agctcccaggcagtcatgagga

SEQ ID NO: 8225912 - DNA, 22 bp, Homo sapiens
agctcccaggcagtcatgagga

SEQ ID NO: 8225913 - DNA, 22 bp, Homo sapiens
agctcccagctcctttgagaga

SEQ ID NO: 8225914 - DNA, 23 bp, Homo sapiens
agctccagggaacaggcagtagg

SEQ ID NO: 8225915 - DNA, 22 bp, Homo sapiens
agctcccagagtcctctgccca

SEQ ID NO: 8225916 - DNA, 22 bp, Homo sapiens
cagccagctggcactgtgagta

SEQ ID NO: 8225917 - DNA, 22 bp, Homo sapiens
agctccagggaaagagtggatc

SEQ ID NO: 8225918 - DNA, 22 bp, Homo sapiens
cagccagctggcactgtgagta

SEQ ID NO: 8225919 - DNA, 22 bp, Homo sapiens
cagccagctgaatgtaccatga

SEQ ID NO: 8225920 - DNA, 22 bp, Homo sapiens
cagccagctcaggaaggatttt

SEQ ID NO: 8225921 - DNA, 22 bp, Homo sapiens
cagccagcctctcaaccatgca

SEQ ID NO: 8225922 - DNA, 22 bp, Homo sapiens
cagccagcctctcaaccatgca

SEQ ID NO: 8225923 - DNA, 22 bp, Homo sapiens
cagccagatcagggcaggggtt

SEQ ID NO: 8225924 - DNA, 22 bp, Homo sapiens
cagccagatcaaactcagatgt

SEQ ID NO: 8225925 - DNA, 22 bp, Homo sapiens
cagccagatcagggcaggggtt

SEQ ID NO: 8225926 - DNA, 22 bp, Homo sapiens
cagccagagaggaaggaatgca

SEQ ID NO: 8225927 - DNA, 22 bp, Homo sapiens
cagccagaggctgcgaggggcc

SEQ ID NO: 8225928 - DNA, 22 bp, Homo sapiens
cagccagagaggaaggaatgca

SEQ ID NO: 8225929 - DNA, 22 bp, Homo sapiens
cagccagagaaagggcactgcc

SEQ ID NO: 8225930 - DNA, 22 bp, Homo sapiens
cagccagagaggaaggaatgca

SEQ ID NO: 8225931 - DNA, 22 bp, Homo sapiens
cagccagaggggccagagtcgg

SEQ ID NO: 8225932 - DNA, 22 bp, Homo sapiens
cagccagatcaaactcagatgt

SEQ ID NO: 8225933 - DNA, 22 bp, Homo sapiens
cagccagaggggccagagtcgg

SEQ ID NO: 8225934 - DNA, 22 bp, Homo sapiens
cagacagaggctgtatgagggc

SEQ ID NO: 8225935 - DNA, 22 bp, Homo sapiens
cagacagaggctgtatgagggc

SEQ ID NO: 8225936 - DNA, 22 bp, Homo sapiens
cagacagagctcacaagtcttt

SEQ ID NO: 8225937 - DNA, 22 bp, Homo sapiens
cagacagaggctgtatgagggc

SEQ ID NO: 8225938 - DNA, 22 bp, Homo sapiens
cagacagaggctgtatgagggc

SEQ ID NO: 8225939 - DNA, 22 bp, Homo sapiens
cagacagagctcacaagtcttt

SEQ ID NO: 8225940 - DNA, 22 bp, Homo sapiens
cagacagacctgcaagggcaca

SEQ ID NO: 8225941 - DNA, 22 bp, Homo sapiens
cagacagacctgcaagggcaca

SEQ ID NO: 8225942 - DNA, 22 bp, Homo sapiens
cagacagacctgcaagggcaca

SEQ ID NO: 8225943 - DNA, 22 bp, Homo sapiens
cagacagcaaatctgcttgcat

SEQ ID NO: 8225944 - DNA, 17 bp, Homo sapiens
cagacagatatcctggg

SEQ ID NO: 8225945 - DNA, 17 bp, Homo sapiens
cagacagatatcctggg

SEQ ID NO: 8225946 - DNA, 22 bp, Homo sapiens
cagacagcgagcggaggggctt

SEQ ID NO: 8225947 - DNA, 22 bp, Homo sapiens
cagacagcaggcctggatgtgt

SEQ ID NO: 8225948 - DNA, 22 bp, Homo sapiens
cagacagcgagcggaggggctt

SEQ ID NO: 8225949 - DNA, 22 bp, Homo sapiens
cagacagctgctttcttgctgt

SEQ ID NO: 8225950 - DNA, 23 bp, Homo sapiens
agccaggggatcttgggccctgg

SEQ ID NO: 8225951 - DNA, 22 bp, Homo sapiens
agccagggttagaagatagtca

SEQ ID NO: 8225952 - DNA, 22 bp, Homo sapiens
agccagggttagaagatagtca

SEQ ID NO: 8225953 - DNA, 22 bp, Homo sapiens
agccaggggattcatcagggac

SEQ ID NO: 8225954 - DNA, 23 bp, Homo sapiens
agccaggggatcttgggccctgg

SEQ ID NO: 8225955 - DNA, 20 bp, Homo sapiens
agccagggttctggatgcac

SEQ ID NO: 8225956 - DNA, 20 bp, Homo sapiens
agccagggttctggatgcac

SEQ ID NO: 8225957 - DNA, 20 bp, Homo sapiens
agccagggttctggatgcac

SEQ ID NO: 8225958 - DNA, 18 bp, Homo sapiens
agccaggtggaatggaac

SEQ ID NO: 8225959 - DNA, 22 bp, Homo sapiens
agccaggtcagctcaccctgct

SEQ ID NO: 8225960 - DNA, 22 bp, Homo sapiens
cagagatgggtcgcagagatgg

SEQ ID NO: 8225961 - DNA, 22 bp, Homo sapiens
cagagatgggtcgcagagatgg

SEQ ID NO: 8225962 - DNA, 22 bp, Homo sapiens
cagagatgggtcgcagagatgg

SEQ ID NO: 8225963 - DNA, 22 bp, Homo sapiens
cagagatgtgatccagctgtct

SEQ ID NO: 8225964 - DNA, 22 bp, Homo sapiens
cagagattattataactaatta

SEQ ID NO: 8225965 - DNA, 22 bp, Homo sapiens
cagagcaacaccctttacatcg

SEQ ID NO: 8225966 - DNA, 22 bp, Homo sapiens
cagagcaacaccctttacatcg

SEQ ID NO: 8225967 - DNA, 22 bp, Homo sapiens
cagagagtggcagttactgaag

SEQ ID NO: 8225968 - DNA, 22 bp, Homo sapiens
cagagagggcggccctggcttc

SEQ ID NO: 8225969 - DNA, 22 bp, Homo sapiens
cagagagggcggccctggcttc

SEQ ID NO: 8225970 - DNA, 22 bp, Homo sapiens
cagagagggcggccctggcttc

SEQ ID NO: 8225971 - DNA, 19 bp, Homo sapiens
agccagtgagcctctgggt

SEQ ID NO: 8225972 - DNA, 22 bp, Homo sapiens
agccagtgacatacgattggga

SEQ ID NO: 8225973 - DNA, 22 bp, Homo sapiens
agccagtgacatacgattggga

SEQ ID NO: 8225974 - DNA, 19 bp, Homo sapiens
agccagtgagcctctgggt

SEQ ID NO: 8225975 - DNA, 19 bp, Homo sapiens
agccagtgagcctctgggt

SEQ ID NO: 8225976 - DNA, 22 bp, Homo sapiens
agccagtgacatacgattggga

SEQ ID NO: 8225977 - DNA, 22 bp, Homo sapiens
agccagtcttacgctcgttttt

SEQ ID NO: 8225978 - DNA, 21 bp, Homo sapiens
agccagtctcagtactgtact

SEQ ID NO: 8225979 - DNA, 22 bp, Homo sapiens
agccagtctctctccctggaga

SEQ ID NO: 8225980 - DNA, 22 bp, Homo sapiens
agccagtcggggccatgctggg

SEQ ID NO: 8225981 - DNA, 22 bp, Homo sapiens
agccagtccatcactaatgggt

SEQ ID NO: 8225982 - DNA, 22 bp, Homo sapiens
agccagtacagggatgtgttca

SEQ ID NO: 8225983 - DNA, 22 bp, Homo sapiens
agccagtacagggatgtgttca

SEQ ID NO: 8225984 - DNA, 22 bp, Homo sapiens
agccagtatcactctgtgttct

SEQ ID NO: 8225985 - DNA, 22 bp, Homo sapiens
agccagtatcactctgtgttct

SEQ ID NO: 8225986 - DNA, 22 bp, Homo sapiens
agccagtcagaggctcccccaa

SEQ ID NO: 8225987 - DNA, 21 bp, Homo sapiens
agccagtcattatgagcggga

SEQ ID NO: 8225988 - DNA, 21 bp, Homo sapiens
agccagtcattatgagcggga

SEQ ID NO: 8225989 - DNA, 22 bp, Homo sapiens
agccagtgatgaagactctgga

SEQ ID NO: 8225990 - DNA, 22 bp, Homo sapiens
agccagtgatgaagactctgga

SEQ ID NO: 8225991 - DNA, 22 bp, Homo sapiens
agccagtgattctgatgtactg

SEQ ID NO: 8225992 - DNA, 22 bp, Homo sapiens
cagagagggagcagtagtctct

SEQ ID NO: 8225993 - DNA, 22 bp, Homo sapiens
cagagagggagcagtagtctct

SEQ ID NO: 8225994 - DNA, 22 bp, Homo sapiens
cagagagggagcagtagtctct

SEQ ID NO: 8225995 - DNA, 23 bp, Homo sapiens
cagagctggctcagagctgcctg

SEQ ID NO: 8225996 - DNA, 23 bp, Homo sapiens
cagagctggctcagagctgcctg

SEQ ID NO: 8225997 - DNA, 23 bp, Homo sapiens
cagagctggctcagagctgcctg

SEQ ID NO: 8225998 - DNA, 23 bp, Homo sapiens
cagagctggctcagagctgcctg

SEQ ID NO: 8225999 - DNA, 22 bp, Homo sapiens
agccccttctgtctccaggatc

SEQ ID NO: 8226000 - DNA, 19 bp, Homo sapiens
agcccccagacagcaggcc

SEQ ID NO: 8226001 - DNA, 23 bp, Homo sapiens
cagagctggctcagagctgcctg

SEQ ID NO: 8226002 - DNA, 23 bp, Homo sapiens
cagagctggctcagagctgcctg

SEQ ID NO: 8226003 - DNA, 22 bp, Homo sapiens
cagagctggagggaaccctggc

SEQ ID NO: 8226004 - DNA, 22 bp, Homo sapiens
cagagctggcctgtgatttttg

SEQ ID NO: 8226005 - DNA, 22 bp, Homo sapiens
cagagctggagggaaccctggc

SEQ ID NO: 8226006 - DNA, 22 bp, Homo sapiens
agccccttggaacacagggctg

SEQ ID NO: 8226007 - DNA, 22 bp, Homo sapiens
agccccttggaacacagggctg

SEQ ID NO: 8226008 - DNA, 22 bp, Homo sapiens
agccccttgctgccctctagag

SEQ ID NO: 8226009 - DNA, 22 bp, Homo sapiens
agccccttgctgccctctagag

SEQ ID NO: 8226010 - DNA, 22 bp, Homo sapiens
agccccttgtgggcgcacagca

SEQ ID NO: 8226011 - DNA, 22 bp, Homo sapiens
agcccgcatctcgctaaagata

SEQ ID NO: 8226012 - DNA, 22 bp, Homo sapiens
agcccggcttccccggttgcta

SEQ ID NO: 8226013 - DNA, 22 bp, Homo sapiens
agcccggcttccccggttgcta

SEQ ID NO: 8226014 - DNA, 22 bp, Homo sapiens
agccctcatggaacagctccta

SEQ ID NO: 8226015 - DNA, 22 bp, Homo sapiens
agccctcaggctttgctgggcc

SEQ ID NO: 8226016 - DNA, 22 bp, Homo sapiens
agccctcatggaacagctccta

SEQ ID NO: 8226017 - DNA, 22 bp, Homo sapiens
cagagctggagggaaccctggc

SEQ ID NO: 8226018 - DNA, 22 bp, Homo sapiens
cagagctggagcttgaatggag

SEQ ID NO: 8226019 - DNA, 22 bp, Homo sapiens
cagagctggagcttgaatggag

SEQ ID NO: 8226020 - DNA, 22 bp, Homo sapiens
cagagctggagaagtggattta

SEQ ID NO: 8226021 - DNA, 22 bp, Homo sapiens
cagagctggagcttgaatggag

SEQ ID NO: 8226022 - DNA, 22 bp, Homo sapiens
cagagctggagcttgaatggag

SEQ ID NO: 8226023 - DNA, 22 bp, Homo sapiens
cagagctggagaagtggattta

SEQ ID NO: 8226024 - DNA, 22 bp, Homo sapiens
cagagctggagaagtggattta

SEQ ID NO: 8226025 - DNA, 22 bp, Homo sapiens
cagagctgcttcccagtttgtg

SEQ ID NO: 8226026 - DNA, 22 bp, Homo sapiens
cagagctgcttcccagtttgtg

SEQ ID NO: 8226027 - DNA, 22 bp, Homo sapiens
agcccaggagtttgaggctgtg

SEQ ID NO: 8226028 - DNA, 22 bp, Homo sapiens
agcccaggagtttgaggctgtg

SEQ ID NO: 8226029 - DNA, 22 bp, Homo sapiens
agcccaggagtttgaggctgtg

SEQ ID NO: 8226030 - DNA, 22 bp, Homo sapiens
agcccaggagtttgaggctgtg

SEQ ID NO: 8226031 - DNA, 22 bp, Homo sapiens
agcccaggagtttgaggctgtg

SEQ ID NO: 8226032 - DNA, 22 bp, Homo sapiens
agcccaggagtccttaaggacc

SEQ ID NO: 8226033 - DNA, 22 bp, Homo sapiens
agcccaggagtccttaaggacc

SEQ ID NO: 8226034 - DNA, 22 bp, Homo sapiens
agcccaggaatctgcatcttga

SEQ ID NO: 8226035 - DNA, 22 bp, Homo sapiens
agcccaggaatctgcatcttga

SEQ ID NO: 8226036 - DNA, 22 bp, Homo sapiens
agcccaggaatctgcatcttga

SEQ ID NO: 8226037 - DNA, 22 bp, Homo sapiens
agcccaggaagttgaggcttgc

SEQ ID NO: 8226038 - DNA, 22 bp, Homo sapiens
agcccagcctgattctacaccc

SEQ ID NO: 8226039 - DNA, 22 bp, Homo sapiens
agcccagccggattcccagttc

SEQ ID NO: 8226040 - DNA, 22 bp, Homo sapiens
agcccaggaagttgaggcttgc

SEQ ID NO: 8226041 - DNA, 22 bp, Homo sapiens
agcccaggagcctttggagggt

SEQ ID NO: 8226042 - DNA, 22 bp, Homo sapiens
agcccaggaatctgcatcttga

SEQ ID NO: 8226043 - DNA, 22 bp, Homo sapiens
agcccaggaggtggaggttgca

SEQ ID NO: 8226044 - DNA, 22 bp, Homo sapiens
agcccaggagcctttggagggt

SEQ ID NO: 8226045 - DNA, 22 bp, Homo sapiens
agcccaggagcctttggagggt

SEQ ID NO: 8226046 - DNA, 22 bp, Homo sapiens
agcccaggaggtggaggttgca

SEQ ID NO: 8226047 - DNA, 22 bp, Homo sapiens
agcccaggagtccttaaggacc

SEQ ID NO: 8226048 - DNA, 22 bp, Homo sapiens
agcccaggaggtggaggttgca

SEQ ID NO: 8226049 - DNA, 22 bp, Homo sapiens
agccacacttgccaggggaagg

SEQ ID NO: 8226050 - DNA, 19 bp, Homo sapiens
agccacagaacttgcagga

SEQ ID NO: 8226051 - DNA, 19 bp, Homo sapiens
agccacagaacttgcagga

SEQ ID NO: 8226052 - DNA, 22 bp, Homo sapiens
agccacagagagggagctgcaa

SEQ ID NO: 8226053 - DNA, 22 bp, Homo sapiens
agccacagagagggagctgcaa

SEQ ID NO: 8226054 - DNA, 19 bp, Homo sapiens
agccacagaacttgcagga

SEQ ID NO: 8226055 - DNA, 19 bp, Homo sapiens
agccacagaacttgcagga

SEQ ID NO: 8226056 - DNA, 22 bp, Homo sapiens
agccacagagcaggagaccttt

SEQ ID NO: 8226057 - DNA, 22 bp, Homo sapiens
agccacagagcaggagaccttt

SEQ ID NO: 8226058 - DNA, 22 bp, Homo sapiens
agccacagagagggagctgcaa

SEQ ID NO: 8226059 - DNA, 22 bp, Homo sapiens
agccacagaggttgatgtggtt

SEQ ID NO: 8226060 - DNA, 22 bp, Homo sapiens
agccacagagcaggagaccttt

SEQ ID NO: 8226061 - DNA, 22 bp, Homo sapiens
agccaagctgatctcctgctga

SEQ ID NO: 8226062 - DNA, 22 bp, Homo sapiens
agccacacctgtcctgccagct

SEQ ID NO: 8226063 - DNA, 22 bp, Homo sapiens
agccacacagcttaatgacaga

SEQ ID NO: 8226064 - DNA, 22 bp, Homo sapiens
cactgaaaggcaatgctgacag

SEQ ID NO: 8226065 - DNA, 22 bp, Homo sapiens
cactgaaatcgaaaaatgtagg

SEQ ID NO: 8226066 - DNA, 22 bp, Homo sapiens
cactgaaatattaatatcttat

SEQ ID NO: 8226067 - DNA, 22 bp, Homo sapiens
cactctggttagtttaagcatg

SEQ ID NO: 8226068 - DNA, 22 bp, Homo sapiens
cactctggttctgaacaggatc

SEQ ID NO: 8226069 - DNA, 22 bp, Homo sapiens
cactctggttctgaacaggatc

SEQ ID NO: 8226070 - DNA, 22 bp, Homo sapiens
cactgaaacaggtattgctggt

SEQ ID NO: 8226071 - DNA, 22 bp, Homo sapiens
agccacagcctgacttaactgt

SEQ ID NO: 8226072 - DNA, 22 bp, Homo sapiens
agccacagcccacaggactctt

SEQ ID NO: 8226073 - DNA, 22 bp, Homo sapiens
agccacagcctgacttaactgt

SEQ ID NO: 8226074 - DNA, 22 bp, Homo sapiens
agccacagcccacaggactctt

SEQ ID NO: 8226075 - DNA, 22 bp, Homo sapiens
agccacagcccacaggactctt

SEQ ID NO: 8226076 - DNA, 23 bp, Homo sapiens
agccacagccagagctatctcca

SEQ ID NO: 8226077 - DNA, 22 bp, Homo sapiens
agccacagcatgtgtgtatgta

SEQ ID NO: 8226078 - DNA, 22 bp, Homo sapiens
agccacagcaacaagtgcaatt

SEQ ID NO: 8226079 - DNA, 22 bp, Homo sapiens
agccacagcaacaagtgcaatt

SEQ ID NO: 8226080 - DNA, 22 bp, Homo sapiens
agccacagcacattgtaagaaa

SEQ ID NO: 8226081 - DNA, 22 bp, Homo sapiens
agccacagcacattgtaagaaa

SEQ ID NO: 8226082 - DNA, 22 bp, Homo sapiens
agccacagcacattgtaagaaa

SEQ ID NO: 8226083 - DNA, 22 bp, Homo sapiens
agccacagcacattgtaagaaa

SEQ ID NO: 8226084 - DNA, 22 bp, Homo sapiens
agccacagcacattgtaagaaa

SEQ ID NO: 8226085 - DNA, 22 bp, Homo sapiens
agccacagcatgtgtgtatgta

SEQ ID NO: 8226086 - DNA, 22 bp, Homo sapiens
agccacagcatgtgtgtatgta

SEQ ID NO: 8226087 - DNA, 22 bp, Homo sapiens
cagaactgggcagggagcagag

SEQ ID NO: 8226088 - DNA, 22 bp, Homo sapiens
cagaacctgtgaatgtgttatc

SEQ ID NO: 8226089 - DNA, 22 bp, Homo sapiens
cagaactgagtctcatggccat

SEQ ID NO: 8226090 - DNA, 22 bp, Homo sapiens
cagaacattgttttctcatctg

SEQ ID NO: 8226091 - DNA, 22 bp, Homo sapiens
cagaacattgttttctcatctg

SEQ ID NO: 8226092 - DNA, 22 bp, Homo sapiens
agccacagcctgacttaactgt

SEQ ID NO: 8226093 - DNA, 22 bp, Homo sapiens
agccacagcgaacctctcttcc

SEQ ID NO: 8226094 - DNA, 22 bp, Homo sapiens
agccacagctccttggtggaga

SEQ ID NO: 8226095 - DNA, 22 bp, Homo sapiens
agccacagctccttggtggaga

SEQ ID NO: 8226096 - DNA, 22 bp, Homo sapiens
cagaaggagcgctaaggtccca

SEQ ID NO: 8226097 - DNA, 22 bp, Homo sapiens
agccagctgcctttcacatctg

SEQ ID NO: 8226098 - DNA, 22 bp, Homo sapiens
cagaagctggtacaaggcctag

SEQ ID NO: 8226099 - DNA, 22 bp, Homo sapiens
cagaagctttgtctagtcttga

SEQ ID NO: 8226100 - DNA, 17 bp, Homo sapiens
cagaaggaagcatggca

SEQ ID NO: 8226101 - DNA, 22 bp, Homo sapiens
agccaggatggtctcgatcggc

SEQ ID NO: 8226102 - DNA, 22 bp, Homo sapiens
agccaggatggtctcgatcggc

SEQ ID NO: 8226103 - DNA, 22 bp, Homo sapiens
agccaggatggtctcgatcggc

SEQ ID NO: 8226104 - DNA, 22 bp, Homo sapiens
agccaggatggtctcgatcggc

SEQ ID NO: 8226105 - DNA, 22 bp, Homo sapiens
agccaggacatctctagctgct

SEQ ID NO: 8226106 - DNA, 22 bp, Homo sapiens
agccaggacatctctagctgct

SEQ ID NO: 8226107 - DNA, 22 bp, Homo sapiens
agccaggacatctctagctgct

SEQ ID NO: 8226108 - DNA, 22 bp, Homo sapiens
agccaggatcacccggggctgt

SEQ ID NO: 8226109 - DNA, 22 bp, Homo sapiens
agccaggcagactctctttctt

SEQ ID NO: 8226110 - DNA, 22 bp, Homo sapiens
agccaggcagactctctttctt

SEQ ID NO: 8226111 - DNA, 21 bp, Homo sapiens
agccaggcaagcacccccact

SEQ ID NO: 8226112 - DNA, 22 bp, Homo sapiens
agccaggattggctgagcctta

SEQ ID NO: 8226113 - DNA, 21 bp, Homo sapiens
agccaggcaagcacccccact

SEQ ID NO: 8226114 - DNA, 22 bp, Homo sapiens
agccaggattggctgagcctta

SEQ ID NO: 8226115 - DNA, 22 bp, Homo sapiens
agccaggattggctgagcctta

SEQ ID NO: 8226116 - DNA, 22 bp, Homo sapiens
agccaggattggctgagcctta

SEQ ID NO: 8226117 - DNA, 22 bp, Homo sapiens
cagacagacagccgtggccacc

SEQ ID NO: 8226118 - DNA, 22 bp, Homo sapiens
cagacagacagccgtggccacc

SEQ ID NO: 8226119 - DNA, 22 bp, Homo sapiens
cagacagacagccgtggccacc

SEQ ID NO: 8226120 - DNA, 22 bp, Homo sapiens
cagacagacagccgtggccacc

SEQ ID NO: 8226121 - DNA, 22 bp, Homo sapiens
agccaggcagggctctcgctct

SEQ ID NO: 8226122 - DNA, 22 bp, Homo sapiens
agccaggcagggctctcgctct

SEQ ID NO: 8226123 - DNA, 22 bp, Homo sapiens
agccaggcagggctctcgctct

SEQ ID NO: 8226124 - DNA, 22 bp, Homo sapiens
agccaggcagggctctcgctct

SEQ ID NO: 8226125 - DNA, 22 bp, Homo sapiens
cagaacttggcaaagccgactg

SEQ ID NO: 8226126 - DNA, 22 bp, Homo sapiens
cagaacttcatattgacgttag

SEQ ID NO: 8226127 - DNA, 22 bp, Homo sapiens
cagaagaaagtggggagacaag

SEQ ID NO: 8226128 - DNA, 22 bp, Homo sapiens
cagaagaaagtggggagacaag

SEQ ID NO: 8226129 - DNA, 22 bp, Homo sapiens
cagaagaatggtgtctgagctc

SEQ ID NO: 8226130 - DNA, 22 bp, Homo sapiens
cagaagaatggtgtctgagctc

SEQ ID NO: 8226131 - DNA, 22 bp, Homo sapiens
cagaagacagctgtttcactcg

SEQ ID NO: 8226132 - DNA, 22 bp, Homo sapiens
cagaagaatggtgtctgagctc

SEQ ID NO: 8226133 - DNA, 22 bp, Homo sapiens
cagaagcagtgagagatgtgca

SEQ ID NO: 8226134 - DNA, 22 bp, Homo sapiens
cagaagactgcagggaagggac

SEQ ID NO: 8226135 - DNA, 22 bp, Homo sapiens
cagaagacgcctgggtgctgta

SEQ ID NO: 8226136 - DNA, 22 bp, Homo sapiens
cagaagcagtgagagatgtgca

SEQ ID NO: 8226137 - DNA, 22 bp, Homo sapiens
cagaagcattccagcaaatagt

SEQ ID NO: 8226138 - DNA, 22 bp, Homo sapiens
cagaagcattccagcaaatagt

SEQ ID NO: 8226139 - DNA, 22 bp, Homo sapiens
cagaagcattccagcaaatagt

SEQ ID NO: 8226140 - DNA, 22 bp, Homo sapiens
cagaagcattgactccttgctc

SEQ ID NO: 8226141 - DNA, 22 bp, Homo sapiens
cagaagcctaaatagtgcacca

SEQ ID NO: 8226142 - DNA, 22 bp, Homo sapiens
cagaagcctaaatagtgcacca

SEQ ID NO: 8226143 - DNA, 22 bp, Homo sapiens
cagaagcattgactccttgctc

SEQ ID NO: 8226144 - DNA, 22 bp, Homo sapiens
cagaagctgaggagtgaggcaa

SEQ ID NO: 8226145 - DNA, 19 bp, Homo sapiens
cagaagctgcagtcggata

SEQ ID NO: 8226146 - DNA, 22 bp, Homo sapiens
cagaagctggtacaaggcctag

SEQ ID NO: 8226147 - DNA, 22 bp, Homo sapiens
cagaagcctgcctcagatgcac

SEQ ID NO: 8226148 - DNA, 22 bp, Homo sapiens
cagaagcctgcctcagatgcac

SEQ ID NO: 8226149 - DNA, 22 bp, Homo sapiens
caaatgcatagaaagatgaaac

SEQ ID NO: 8226150 - DNA, 22 bp, Homo sapiens
caaatgttaagacaggatcaag

SEQ ID NO: 8226151 - DNA, 22 bp, Homo sapiens
caaatgttaaatgtgttaagac

SEQ ID NO: 8226152 - DNA, 22 bp, Homo sapiens
caaatgttaaatgtgttaagac

SEQ ID NO: 8226153 - DNA, 22 bp, Homo sapiens
caaatgatgcatggctagtgag

SEQ ID NO: 8226154 - DNA, 22 bp, Homo sapiens
caaatgatgcatggctagtgag

SEQ ID NO: 8226155 - DNA, 22 bp, Homo sapiens
caaatgcaggtcataacctgag

SEQ ID NO: 8226156 - DNA, 22 bp, Homo sapiens
caaatgcaggtcagcaggtgtc

SEQ ID NO: 8226157 - DNA, 22 bp, Homo sapiens
caaatgcaggtcagcaggtgtc

SEQ ID NO: 8226158 - DNA, 22 bp, Homo sapiens
caaatgcagattcaggagttct

SEQ ID NO: 8226159 - DNA, 22 bp, Homo sapiens
caaatgatactgtttttagtct

SEQ ID NO: 8226160 - DNA, 22 bp, Homo sapiens
caaatgatactgtttttagtct

SEQ ID NO: 8226161 - DNA, 22 bp, Homo sapiens
caaatgatacctattactaggc

SEQ ID NO: 8226162 - DNA, 22 bp, Homo sapiens
caaatattccaggtacatccct

SEQ ID NO: 8226163 - DNA, 22 bp, Homo sapiens
caaatattccaggtacatccct

SEQ ID NO: 8226164 - DNA, 22 bp, Homo sapiens
caaatgatagagccgattatca

SEQ ID NO: 8226165 - DNA, 22 bp, Homo sapiens
caaatgatactgtttttagtct

SEQ ID NO: 8226166 - DNA, 22 bp, Homo sapiens
caaatgatactgtttttagtct

SEQ ID NO: 8226167 - DNA, 22 bp, Homo sapiens
caaatgatccttgcaagctgtg

SEQ ID NO: 8226168 - DNA, 22 bp, Homo sapiens
agcacagcctctggtttctgac

SEQ ID NO: 8226169 - DNA, 22 bp, Homo sapiens
agcacagcctctggtttctgac

SEQ ID NO: 8226170 - DNA, 22 bp, Homo sapiens
caaatgttgactaagagggttt

SEQ ID NO: 8226171 - DNA, 22 bp, Homo sapiens
caaatgtttcttatctattgtt

SEQ ID NO: 8226172 - DNA, 22 bp, Homo sapiens
caaatgtttcttatctattgtt

SEQ ID NO: 8226173 - DNA, 22 bp, Homo sapiens
caaatgttattcattcttgttt

SEQ ID NO: 8226174 - DNA, 22 bp, Homo sapiens
caaatgttaagacaggatcaag

SEQ ID NO: 8226175 - DNA, 22 bp, Homo sapiens
caaatgttagtgcccatccctc

SEQ ID NO: 8226176 - DNA, 22 bp, Homo sapiens
caaatgtttcttgaacaccaac

SEQ ID NO: 8226177 - DNA, 22 bp, Homo sapiens
caaatgtttgcatcacagggca

SEQ ID NO: 8226178 - DNA, 22 bp, Homo sapiens
caaatgttttttagtataagta

SEQ ID NO: 8226179 - DNA, 22 bp, Homo sapiens
caaatgttttttagtataagta

SEQ ID NO: 8226180 - DNA, 22 bp, Homo sapiens
caaatgtttttattctacaaca

SEQ ID NO: 8226181 - DNA, 22 bp, Homo sapiens
caaatgtttttattctacaaca

SEQ ID NO: 8226182 - DNA, 22 bp, Homo sapiens
agcagaagaaagccacatgact

SEQ ID NO: 8226183 - DNA, 22 bp, Homo sapiens
agcagaagaggtcttgttgctg

SEQ ID NO: 8226184 - DNA, 17 bp, Homo sapiens
agcagaagtcagaggga

SEQ ID NO: 8226185 - DNA, 17 bp, Homo sapiens
agcagaagtcagaggga

SEQ ID NO: 8226186 - DNA, 17 bp, Homo sapiens
agcagaagtcagaggga

SEQ ID NO: 8226187 - DNA, 22 bp, Homo sapiens
agcagaagtgccttagcaatca

SEQ ID NO: 8226188 - DNA, 17 bp, Homo sapiens
agcagaagtcagaggga

SEQ ID NO: 8226189 - DNA, 22 bp, Homo sapiens
agcagaagaaagccacatgact

SEQ ID NO: 8226190 - DNA, 22 bp, Homo sapiens
agcagaagaaagccacatgact

SEQ ID NO: 8226191 - DNA, 22 bp, Homo sapiens
agcagaagaaagccacatgact

SEQ ID NO: 8226192 - DNA, 22 bp, Homo sapiens
agcactgttatgggatgactta

SEQ ID NO: 8226193 - DNA, 22 bp, Homo sapiens
caaattaatgtgtctcaaaata

SEQ ID NO: 8226194 - DNA, 22 bp, Homo sapiens
attttctgagcacgtgacagca

SEQ ID NO: 8226195 - DNA, 22 bp, Homo sapiens
attttctgagtccagaatttac

SEQ ID NO: 8226196 - DNA, 22 bp, Homo sapiens
attttctgagtccagaatttac

SEQ ID NO: 8226197 - DNA, 22 bp, Homo sapiens
attttctggttgaggtttaaca

SEQ ID NO: 8226198 - DNA, 22 bp, Homo sapiens
attttctgtaaaaaggcactaa

SEQ ID NO: 8226199 - DNA, 22 bp, Homo sapiens
attttctgtaactatttctata

SEQ ID NO: 8226200 - DNA, 22 bp, Homo sapiens
agcaatttttgattttcagtgt

SEQ ID NO: 8226201 - DNA, 22 bp, Homo sapiens
agcaatttttgattttcagtgt

SEQ ID NO: 8226202 - DNA, 22 bp, Homo sapiens
attttctgtaactatttctata

SEQ ID NO: 8226203 - DNA, 22 bp, Homo sapiens
attttctgtaaaaaggcactaa

SEQ ID NO: 8226204 - DNA, 22 bp, Homo sapiens
attttctgtaactatttctata

SEQ ID NO: 8226205 - DNA, 23 bp, Homo sapiens
agcacagactagaaaggtctttc

SEQ ID NO: 8226206 - DNA, 19 bp, Homo sapiens
agcacagacaagaccagca

SEQ ID NO: 8226207 - DNA, 22 bp, Homo sapiens
agcacagagaaactaagacatt

SEQ ID NO: 8226208 - DNA, 22 bp, Homo sapiens
agcacagactggtcccaggtct

SEQ ID NO: 8226209 - DNA, 22 bp, Homo sapiens
agcacagactggtcccaggtct

SEQ ID NO: 8226210 - DNA, 22 bp, Homo sapiens
agcacagagaaactaagacatt

SEQ ID NO: 8226211 - DNA, 22 bp, Homo sapiens
agcacagagaaactaagacatt

SEQ ID NO: 8226212 - DNA, 22 bp, Homo sapiens
attttctatgttgtaattgtta

SEQ ID NO: 8226213 - DNA, 22 bp, Homo sapiens
attttctattctgctggtttag

SEQ ID NO: 8226214 - DNA, 22 bp, Homo sapiens
attttctatgttgtaattgtta

SEQ ID NO: 8226215 - DNA, 22 bp, Homo sapiens
agcaaacattcagcagattggc

SEQ ID NO: 8226216 - DNA, 22 bp, Homo sapiens
attttctctttgtatatgctag

SEQ ID NO: 8226217 - DNA, 21 bp, Homo sapiens
attttctctggatgatggtca

SEQ ID NO: 8226218 - DNA, 21 bp, Homo sapiens
attttctctggatgatggtca

SEQ ID NO: 8226219 - DNA, 21 bp, Homo sapiens
attttctctggatgatggtca

SEQ ID NO: 8226220 - DNA, 21 bp, Homo sapiens
attttctctggatgatggtca

SEQ ID NO: 8226221 - DNA, 22 bp, Homo sapiens
attttctctcaaaccttaaaat

SEQ ID NO: 8226222 - DNA, 22 bp, Homo sapiens
attttctctcaaaccttaaaat

SEQ ID NO: 8226223 - DNA, 22 bp, Homo sapiens
attttctcacaatcctatgggg

SEQ ID NO: 8226224 - DNA, 22 bp, Homo sapiens
attttctcacaatgcagaagga

SEQ ID NO: 8226225 - DNA, 22 bp, Homo sapiens
agcacagatttgtcaacataga

SEQ ID NO: 8226226 - DNA, 22 bp, Homo sapiens
agcacagatttgtcaacataga

SEQ ID NO: 8226227 - DNA, 22 bp, Homo sapiens
agcacagattctgaagagtcct

SEQ ID NO: 8226228 - DNA, 22 bp, Homo sapiens
agcacagatttgtcaacataga

SEQ ID NO: 8226229 - DNA, 22 bp, Homo sapiens
agcacagatgtgagtggaggct

SEQ ID NO: 8226230 - DNA, 22 bp, Homo sapiens
agcacagatgtactttgagggg

SEQ ID NO: 8226231 - DNA, 22 bp, Homo sapiens
agcacagatgtgagtggaggct

SEQ ID NO: 8226232 - DNA, 22 bp, Homo sapiens
agcacagataacatggagtgga

SEQ ID NO: 8226233 - DNA, 22 bp, Homo sapiens
agcacagagttgctcactgccg

SEQ ID NO: 8226234 - DNA, 22 bp, Homo sapiens
agcacagagttgctcactgccg

SEQ ID NO: 8226235 - DNA, 22 bp, Homo sapiens
agcacagatgtactttgagggg

SEQ ID NO: 8226236 - DNA, 22 bp, Homo sapiens
agcacagatggatgtattcatt

SEQ ID NO: 8226237 - DNA, 22 bp, Homo sapiens
agcacagatggatgtattcatt

SEQ ID NO: 8226238 - DNA, 22 bp, Homo sapiens
agcacagatgcatgatcaccag

SEQ ID NO: 8226239 - DNA, 22 bp, Homo sapiens
agcacagagttgcagagagcgt

SEQ ID NO: 8226240 - DNA, 22 bp, Homo sapiens
agcacagagttgcagagagcgt

SEQ ID NO: 8226241 - DNA, 22 bp, Homo sapiens
agcacagagctcggggaatgga

SEQ ID NO: 8226242 - DNA, 22 bp, Homo sapiens
agcacagagttgcagagagcgt

SEQ ID NO: 8226243 - DNA, 22 bp, Homo sapiens
agcacagagaagatttcaatta

SEQ ID NO: 8226244 - DNA, 22 bp, Homo sapiens
agcacagagagctctaggtaaa

SEQ ID NO: 8226245 - DNA, 22 bp, Homo sapiens
agcacagagaagatttcaatta

SEQ ID NO: 8226246 - DNA, 22 bp, Homo sapiens
agcacagagagctctaggtaaa

SEQ ID NO: 8226247 - DNA, 22 bp, Homo sapiens
agcacagagagctctaggtaaa

SEQ ID NO: 8226248 - DNA, 19 bp, Homo sapiens
agcacagagagtctatagc

SEQ ID NO: 8226249 - DNA, 22 bp, Homo sapiens
agcacagagattatttacaaga

SEQ ID NO: 8226250 - DNA, 22 bp, Homo sapiens
agcacagagctaggagtggagg

SEQ ID NO: 8226251 - DNA, 22 bp, Homo sapiens
agcagcaatggaaagcaacaca

SEQ ID NO: 8226252 - DNA, 22 bp, Homo sapiens
caacttcttggcttcctaatgg

SEQ ID NO: 8226253 - DNA, 21 bp, Homo sapiens
agcagagtgctttgactttgt

SEQ ID NO: 8226254 - DNA, 22 bp, Homo sapiens
agcagcaagcagtgcacgggtt

SEQ ID NO: 8226255 - DNA, 22 bp, Homo sapiens
agcagcagaaagttgatggcag

SEQ ID NO: 8226256 - DNA, 22 bp, Homo sapiens
agcagcagaaagttgatggcag

SEQ ID NO: 8226257 - DNA, 22 bp, Homo sapiens
agcagcagaaagttgatggcag

SEQ ID NO: 8226258 - DNA, 22 bp, Homo sapiens
agcagcacatggggctggcaac

SEQ ID NO: 8226259 - DNA, 22 bp, Homo sapiens
agcagcacatggggctggcaac

SEQ ID NO: 8226260 - DNA, 22 bp, Homo sapiens
agcagcacccagagccatgtct

SEQ ID NO: 8226261 - DNA, 22 bp, Homo sapiens
agcagcagaagggagacccagg

SEQ ID NO: 8226262 - DNA, 22 bp, Homo sapiens
agcagcagaagggagacccagg

SEQ ID NO: 8226263 - DNA, 22 bp, Homo sapiens
agcagcagaagggagacccagg

SEQ ID NO: 8226264 - DNA, 22 bp, Homo sapiens
agcagcagaagggagacccagg

SEQ ID NO: 8226265 - DNA, 22 bp, Homo sapiens
agcagcagaaagttgatggcag

SEQ ID NO: 8226266 - DNA, 22 bp, Homo sapiens
agcagcagaagggagacccagg

SEQ ID NO: 8226267 - DNA, 22 bp, Homo sapiens
agcagcagaaggtttgcaccca

SEQ ID NO: 8226268 - DNA, 22 bp, Homo sapiens
agcagcagaaggtttgcaccca

SEQ ID NO: 8226269 - DNA, 22 bp, Homo sapiens
caaggcaggaagcctgtcttat

SEQ ID NO: 8226270 - DNA, 22 bp, Homo sapiens
caaggcaggcagttcacttgag

SEQ ID NO: 8226271 - DNA, 22 bp, Homo sapiens
caaggcaggcagttcacttgag

SEQ ID NO: 8226272 - DNA, 22 bp, Homo sapiens
caacttcactgtgcctctagtt

SEQ ID NO: 8226273 - DNA, 22 bp, Homo sapiens
caactgtgaattttatgatacc

SEQ ID NO: 8226274 - DNA, 22 bp, Homo sapiens
caactgtgaattttatgatacc

SEQ ID NO: 8226275 - DNA, 22 bp, Homo sapiens
caactgctgacaccatcactcc

SEQ ID NO: 8226276 - DNA, 19 bp, Homo sapiens
caactgccccctcaaacat

SEQ ID NO: 8226277 - DNA, 22 bp, Homo sapiens
caactgccatacagctccatgg

SEQ ID NO: 8226278 - DNA, 22 bp, Homo sapiens
caactgagaaatattgctgacg

SEQ ID NO: 8226279 - DNA, 22 bp, Homo sapiens
caactgaactgatatcaactat

SEQ ID NO: 8226280 - DNA, 22 bp, Homo sapiens
caactgagcagtagcgtctgga

SEQ ID NO: 8226281 - DNA, 22 bp, Homo sapiens
caactgagcagtagcgtctgga

SEQ ID NO: 8226282 - DNA, 22 bp, Homo sapiens
caactgaggtctcagccaatta

SEQ ID NO: 8226283 - DNA, 22 bp, Homo sapiens
caactctgtaggatccaggtgg

SEQ ID NO: 8226284 - DNA, 22 bp, Homo sapiens
caactcctggctgttaggcaca

SEQ ID NO: 8226285 - DNA, 22 bp, Homo sapiens
caactgaaaagattctacgcag

SEQ ID NO: 8226286 - DNA, 19 bp, Homo sapiens
caactcttgatactgttag

SEQ ID NO: 8226287 - DNA, 22 bp, Homo sapiens
caactcctccccagcatgccaa

SEQ ID NO: 8226288 - DNA, 21 bp, Homo sapiens
agcagacacttgtgaccttcc

SEQ ID NO: 8226289 - DNA, 22 bp, Homo sapiens
agcagacaattgcctggatgga

SEQ ID NO: 8226290 - DNA, 22 bp, Homo sapiens
agcagacaattgcctggatgga

SEQ ID NO: 8226291 - DNA, 22 bp, Homo sapiens
agcagacaattgcctggatgga

SEQ ID NO: 8226292 - DNA, 22 bp, Homo sapiens
agcagacaccaggagtaaagaa

SEQ ID NO: 8226293 - DNA, 22 bp, Homo sapiens
caactcaggcacctcatataag

SEQ ID NO: 8226294 - DNA, 22 bp, Homo sapiens
caactcaggcacctcatataag

SEQ ID NO: 8226295 - DNA, 22 bp, Homo sapiens
caactcagactggattaaataa

SEQ ID NO: 8226296 - DNA, 22 bp, Homo sapiens
agcagacaattgcctggatgga

SEQ ID NO: 8226297 - DNA, 22 bp, Homo sapiens
agcagacaacccagatgaccca

SEQ ID NO: 8226298 - DNA, 22 bp, Homo sapiens
agcagacaacccagatgaccca

SEQ ID NO: 8226299 - DNA, 22 bp, Homo sapiens
agcagaatgtgtgtgacaagta

SEQ ID NO: 8226300 - DNA, 22 bp, Homo sapiens
agcagaatggggctgggaatag

SEQ ID NO: 8226301 - DNA, 22 bp, Homo sapiens
agcagaatggggctgggaatag

SEQ ID NO: 8226302 - DNA, 22 bp, Homo sapiens
agcagaagtgccttagcaatca

SEQ ID NO: 8226303 - DNA, 22 bp, Homo sapiens
agcagaagtgccttagcaatca

SEQ ID NO: 8226304 - DNA, 22 bp, Homo sapiens
agcagaatctgtccttggaaga

SEQ ID NO: 8226305 - DNA, 22 bp, Homo sapiens
caatgaaattgagatccagaga

SEQ ID NO: 8226306 - DNA, 22 bp, Homo sapiens
caatgaaaatgaggactcctgt

SEQ ID NO: 8226307 - DNA, 22 bp, Homo sapiens
caatcttagagagattctttta

SEQ ID NO: 8226308 - DNA, 22 bp, Homo sapiens
caatctgagttgggaatgtatt

SEQ ID NO: 8226309 - DNA, 22 bp, Homo sapiens
agcagcatgttcattacattat

SEQ ID NO: 8226310 - DNA, 22 bp, Homo sapiens
agcagcattaagggaactgcag

SEQ ID NO: 8226311 - DNA, 22 bp, Homo sapiens
agcagcattcctggcttctatc

SEQ ID NO: 8226312 - DNA, 22 bp, Homo sapiens
agcagcatcttctgttctccgc

SEQ ID NO: 8226313 - DNA, 22 bp, Homo sapiens
agcagcatggatgggcctcagc

SEQ ID NO: 8226314 - DNA, 22 bp, Homo sapiens
agcagcagggtgtaattgggca

SEQ ID NO: 8226315 - DNA, 22 bp, Homo sapiens
agcagcaggtgacctcgatgcc

SEQ ID NO: 8226316 - DNA, 22 bp, Homo sapiens
agcagcatccccggcctccacc

SEQ ID NO: 8226317 - DNA, 22 bp, Homo sapiens
agcagcatattgtgtcttcata

SEQ ID NO: 8226318 - DNA, 22 bp, Homo sapiens
caaggcagttccccagagggct

SEQ ID NO: 8226319 - DNA, 22 bp, Homo sapiens
caaggcagtgggctaggaacct

SEQ ID NO: 8226320 - DNA, 22 bp, Homo sapiens
caaggcagtccctactccctgc

SEQ ID NO: 8226321 - DNA, 22 bp, Homo sapiens
caaggcaggtctgaggaggttg

SEQ ID NO: 8226322 - DNA, 22 bp, Homo sapiens
caaggcaggtctgaggaggttg

SEQ ID NO: 8226323 - DNA, 22 bp, Homo sapiens
caaggcagtccctactccctgc

SEQ ID NO: 8226324 - DNA, 22 bp, Homo sapiens
caaggcaggtctgaggaggttg

SEQ ID NO: 8226325 - DNA, 22 bp, Homo sapiens
caaggcaggtctgaggaggttg

SEQ ID NO: 8226326 - DNA, 22 bp, Homo sapiens
cacaggagctgtggggcagtgt

SEQ ID NO: 8226327 - DNA, 22 bp, Homo sapiens
cacaggagctgtggggcagtgt

SEQ ID NO: 8226328 - DNA, 22 bp, Homo sapiens
cacaggagctgtggggcagtgt

SEQ ID NO: 8226329 - DNA, 22 bp, Homo sapiens
cacaggagccctgaggcctccc

SEQ ID NO: 8226330 - DNA, 22 bp, Homo sapiens
cacaggaaggccttctcacaat

SEQ ID NO: 8226331 - DNA, 22 bp, Homo sapiens
cacaggagctgtggggcagtgt

SEQ ID NO: 8226332 - DNA, 22 bp, Homo sapiens
cacaggagccctgaggcctccc

SEQ ID NO: 8226333 - DNA, 22 bp, Homo sapiens
cacaggaagctgactgctggca

SEQ ID NO: 8226334 - DNA, 22 bp, Homo sapiens
agcagcttctttcactcctgga

SEQ ID NO: 8226335 - DNA, 22 bp, Homo sapiens
cacaggaagctgactgctggca

SEQ ID NO: 8226336 - DNA, 22 bp, Homo sapiens
agcagcttcagaggcgggcgca

SEQ ID NO: 8226337 - DNA, 22 bp, Homo sapiens
agcagcttcaattttctaagtg

SEQ ID NO: 8226338 - DNA, 22 bp, Homo sapiens
agcagcttcaattttctaagtg

SEQ ID NO: 8226339 - DNA, 22 bp, Homo sapiens
agcagcttcctgtttgcaggca

SEQ ID NO: 8226340 - DNA, 22 bp, Homo sapiens
agcagcttcctgtttgcaggca

SEQ ID NO: 8226341 - DNA, 22 bp, Homo sapiens
agcagcttctattttcttggtt

SEQ ID NO: 8226342 - DNA, 22 bp, Homo sapiens
agcagcttctattttcttggtt

SEQ ID NO: 8226343 - DNA, 22 bp, Homo sapiens
agcagcttcctgctcttcgcct

SEQ ID NO: 8226344 - DNA, 22 bp, Homo sapiens
agcagcttacatgtggcctatc

SEQ ID NO: 8226345 - DNA, 22 bp, Homo sapiens
agcagcttacatgtggcctatc

SEQ ID NO: 8226346 - DNA, 19 bp, Homo sapiens
agcagcttaattttgtagc

SEQ ID NO: 8226347 - DNA, 22 bp, Homo sapiens
agcagcttatcttggagaggca

SEQ ID NO: 8226348 - DNA, 22 bp, Homo sapiens
agcagcttagggaattctccct

SEQ ID NO: 8226349 - DNA, 22 bp, Homo sapiens
agcagcttagggaattctccct

SEQ ID NO: 8226350 - DNA, 22 bp, Homo sapiens
agcagctgtttgttgaattggt

SEQ ID NO: 8226351 - DNA, 22 bp, Homo sapiens
agcagctgtttgttgaattggt

SEQ ID NO: 8226352 - DNA, 22 bp, Homo sapiens
agcagctgtttgttgaattggt

SEQ ID NO: 8226353 - DNA, 20 bp, Homo sapiens
agcagctgtgttttcatcct

SEQ ID NO: 8226354 - DNA, 22 bp, Homo sapiens
agcagctgttagaaacaggaag

SEQ ID NO: 8226355 - DNA, 20 bp, Homo sapiens
agcagctgtgttttcatcct

SEQ ID NO: 8226356 - DNA, 23 bp, Homo sapiens
agcagctgtggtttaccttagta

SEQ ID NO: 8226357 - DNA, 22 bp, Homo sapiens
agcagctgtggggacaagggta

SEQ ID NO: 8226358 - DNA, 22 bp, Homo sapiens
caatgacactctgcacagtgct

SEQ ID NO: 8226359 - DNA, 22 bp, Homo sapiens
caatgacactctgcacagtgct

SEQ ID NO: 8226360 - DNA, 22 bp, Homo sapiens
caatgacatggataatcatatt

SEQ ID NO: 8226361 - DNA, 22 bp, Homo sapiens
caatgacatggataatcatatt

SEQ ID NO: 8226362 - DNA, 22 bp, Homo sapiens
agcagctgtactttcatctgtt

SEQ ID NO: 8226363 - DNA, 22 bp, Homo sapiens
agcagctgtactttcatctgtt

SEQ ID NO: 8226364 - DNA, 22 bp, Homo sapiens
agcagctgtactttcatctgtt

SEQ ID NO: 8226365 - DNA, 19 bp, Homo sapiens
agcagctgtagatagacac

SEQ ID NO: 8226366 - DNA, 19 bp, Homo sapiens
agcagctgtagatagacac

SEQ ID NO: 8226367 - DNA, 22 bp, Homo sapiens
agcagctgggctcagagctggg

SEQ ID NO: 8226368 - DNA, 22 bp, Homo sapiens
agcagctgggctcagagctggg

SEQ ID NO: 8226369 - DNA, 22 bp, Homo sapiens
agcagctgggctcagagctggg

SEQ ID NO: 8226370 - DNA, 18 bp, Homo sapiens
agcagctgtgccacactg

SEQ ID NO: 8226371 - DNA, 18 bp, Homo sapiens
agcagctgtgccacactg

SEQ ID NO: 8226372 - DNA, 18 bp, Homo sapiens
agcagctgtgccacactg

SEQ ID NO: 8226373 - DNA, 22 bp, Homo sapiens
agcagctgtggaaaagtaacta

SEQ ID NO: 8226374 - DNA, 22 bp, Homo sapiens
agcagctgtggaaaagtaacta

SEQ ID NO: 8226375 - DNA, 22 bp, Homo sapiens
agcagctgtgggcaatatgtaa

SEQ ID NO: 8226376 - DNA, 22 bp, Homo sapiens
agcagctgtgggcaatatgtaa

SEQ ID NO: 8226377 - DNA, 23 bp, Homo sapiens
agcagctgtggagttttgcattt

SEQ ID NO: 8226378 - DNA, 18 bp, Homo sapiens
agcagctgtgccacactg

SEQ ID NO: 8226379 - DNA, 22 bp, Homo sapiens
agcagctgtcccttaacatcag

SEQ ID NO: 8226380 - DNA, 22 bp, Homo sapiens
agcagctgtcccttaacatcag

SEQ ID NO: 8226381 - DNA, 18 bp, Homo sapiens
agcagctgtcagaatgcc

SEQ ID NO: 8226382 - DNA, 18 bp, Homo sapiens
agcagctgtcagaatgcc

SEQ ID NO: 8226383 - DNA, 22 bp, Homo sapiens
agcaggagaacactgtggctct

SEQ ID NO: 8226384 - DNA, 22 bp, Homo sapiens
agcaggagaacactgtggctct

SEQ ID NO: 8226385 - DNA, 22 bp, Homo sapiens
cacaggaggttaggaagtggtc

SEQ ID NO: 8226386 - DNA, 22 bp, Homo sapiens
cacaggagggagcgggcagcca

SEQ ID NO: 8226387 - DNA, 22 bp, Homo sapiens
cacaggagggagcgggcagcca

SEQ ID NO: 8226388 - DNA, 22 bp, Homo sapiens
cacaggaggaggccagagcgta

SEQ ID NO: 8226389 - DNA, 22 bp, Homo sapiens
cacaggaggaggccagagcgta

SEQ ID NO: 8226390 - DNA, 22 bp, Homo sapiens
cacaggagggagcgggcagcca

SEQ ID NO: 8226391 - DNA, 22 bp, Homo sapiens
cacaggaggcaatggtaagatt

SEQ ID NO: 8226392 - DNA, 22 bp, Homo sapiens
cacaggaggcaatggtaagatt

SEQ ID NO: 8226393 - DNA, 22 bp, Homo sapiens
cacaggaggaggtgcccgggcc

SEQ ID NO: 8226394 - DNA, 22 bp, Homo sapiens
cacaggaggaggtgcccgggcc

SEQ ID NO: 8226395 - DNA, 22 bp, Homo sapiens
agcaggagcatttccatgattc

SEQ ID NO: 8226396 - DNA, 22 bp, Homo sapiens
agcaggagcatttccatgattc

SEQ ID NO: 8226397 - DNA, 22 bp, Homo sapiens
cacaggctgcccgcagctggga

SEQ ID NO: 8226398 - DNA, 22 bp, Homo sapiens
agcaggagatggggcgtgatgt

SEQ ID NO: 8226399 - DNA, 22 bp, Homo sapiens
agcaggagcatttccatgattc

SEQ ID NO: 8226400 - DNA, 22 bp, Homo sapiens
agcaggagcatttccatgattc

SEQ ID NO: 8226401 - DNA, 22 bp, Homo sapiens
agcaggagatggggcgtgatgt

SEQ ID NO: 8226402 - DNA, 22 bp, Homo sapiens
agcaggagagcagtgcgtggtc

SEQ ID NO: 8226403 - DNA, 22 bp, Homo sapiens
agcaggagagcagtgcgtggtc

SEQ ID NO: 8226404 - DNA, 22 bp, Homo sapiens
agcaggagagcagtgcgtggtc

SEQ ID NO: 8226405 - DNA, 22 bp, Homo sapiens
agcaggagatggggcgtgatgt

SEQ ID NO: 8226406 - DNA, 22 bp, Homo sapiens
agcaggagatggggcgtgatgt

SEQ ID NO: 8226407 - DNA, 22 bp, Homo sapiens
agcaggagatggggcgtgatgt

SEQ ID NO: 8226408 - DNA, 22 bp, Homo sapiens
agcaggagagcagtgcgtggtc

SEQ ID NO: 8226409 - DNA, 22 bp, Homo sapiens
agcaggagagcagtgcgtggtc

SEQ ID NO: 8226410 - DNA, 22 bp, Homo sapiens
agcaggagagcagtgcgtggtc

SEQ ID NO: 8226411 - DNA, 22 bp, Homo sapiens
agcaggagagcagtgcgtggtc

SEQ ID NO: 8226412 - DNA, 22 bp, Homo sapiens
agcaggagagcagtgcgtggtc

SEQ ID NO: 8226413 - DNA, 22 bp, Homo sapiens
agcaggagacatgggggtggtg

SEQ ID NO: 8226414 - DNA, 22 bp, Homo sapiens
agcaggagaacactgtggctct

SEQ ID NO: 8226415 - DNA, 22 bp, Homo sapiens
agcaggagacatgggggtggtg

SEQ ID NO: 8226416 - DNA, 22 bp, Homo sapiens
agcaggagacatgggggtggtg

SEQ ID NO: 8226417 - DNA, 22 bp, Homo sapiens
agcaggagacatgggggtggtg

SEQ ID NO: 8226418 - DNA, 22 bp, Homo sapiens
cacagtatgatctaaagtaagt

SEQ ID NO: 8226419 - DNA, 22 bp, Homo sapiens
cacagggctaaatgaagggttg

SEQ ID NO: 8226420 - DNA, 22 bp, Homo sapiens
cacagggccttgtgtgactgca

SEQ ID NO: 8226421 - DNA, 22 bp, Homo sapiens
cacagggctttgatggctgagt

SEQ ID NO: 8226422 - DNA, 22 bp, Homo sapiens
cacagggctttgatggctgagt

SEQ ID NO: 8226423 - DNA, 22 bp, Homo sapiens
cacagggctttgatggctgagt

SEQ ID NO: 8226424 - DNA, 22 bp, Homo sapiens
cacagggcttctcatggggtgc

SEQ ID NO: 8226425 - DNA, 22 bp, Homo sapiens
cacagggccactttcccagtaa

SEQ ID NO: 8226426 - DNA, 22 bp, Homo sapiens
cacagggccttgtgtgactgca

SEQ ID NO: 8226427 - DNA, 22 bp, Homo sapiens
cacagggccttgtgtgactgca

SEQ ID NO: 8226428 - DNA, 22 bp, Homo sapiens
cacagggcctggggcagctgct

SEQ ID NO: 8226429 - DNA, 22 bp, Homo sapiens
cacagggcctggggcagctgct

SEQ ID NO: 8226430 - DNA, 19 bp, Homo sapiens
cacagggcaggtctcatgt

SEQ ID NO: 8226431 - DNA, 22 bp, Homo sapiens
cacagggcagtgattgtccaca

SEQ ID NO: 8226432 - DNA, 22 bp, Homo sapiens
cacagggcagtgattgtccaca

SEQ ID NO: 8226433 - DNA, 22 bp, Homo sapiens
cacagggcagtgctgcccactc

SEQ ID NO: 8226434 - DNA, 22 bp, Homo sapiens
agcaggtataggaggtatcctg

SEQ ID NO: 8226435 - DNA, 23 bp, Homo sapiens
agcaggtaggttgaaattttcct

SEQ ID NO: 8226436 - DNA, 22 bp, Homo sapiens
cacatcttccagagtagctaaa

SEQ ID NO: 8226437 - DNA, 22 bp, Homo sapiens
agcaggtgccaggtgtacccgc

SEQ ID NO: 8226438 - DNA, 22 bp, Homo sapiens
agcaggtgcatggcgagcgcgg

SEQ ID NO: 8226439 - DNA, 22 bp, Homo sapiens
agcaggtgcatggcgagcgcgg

SEQ ID NO: 8226440 - DNA, 22 bp, Homo sapiens
agcaggtgatgtgagtctggaa

SEQ ID NO: 8226441 - DNA, 22 bp, Homo sapiens
agcaggtgatgtgagtctggaa

SEQ ID NO: 8226442 - DNA, 22 bp, Homo sapiens
agcaggtgatgtgagtctggaa

SEQ ID NO: 8226443 - DNA, 22 bp, Homo sapiens
agcaggtgatgtgagtctggaa

SEQ ID NO: 8226444 - DNA, 22 bp, Homo sapiens
agcaggtgatgtgagtctggaa

SEQ ID NO: 8226445 - DNA, 21 bp, Homo sapiens
agcaggtctacaggttcatag

SEQ ID NO: 8226446 - DNA, 22 bp, Homo sapiens
agcaggtgatcgcgtgtgctcc

SEQ ID NO: 8226447 - DNA, 22 bp, Homo sapiens
agcaggtgatcgcgtgtgctcc

SEQ ID NO: 8226448 - DNA, 22 bp, Homo sapiens
cacatattgtagttcaccagga

SEQ ID NO: 8226449 - DNA, 22 bp, Homo sapiens
cacatatttgatgaagctttgt

SEQ ID NO: 8226450 - DNA, 22 bp, Homo sapiens
cacatcattcaatggtgatatt

SEQ ID NO: 8226451 - DNA, 22 bp, Homo sapiens
cacatctatagggacagcaaca

SEQ ID NO: 8226452 - DNA, 22 bp, Homo sapiens
cacatctatggagacagagagt

SEQ ID NO: 8226453 - DNA, 22 bp, Homo sapiens
cacatctatggagacagagagt

SEQ ID NO: 8226454 - DNA, 22 bp, Homo sapiens
cacatctagcttacaaaacagg

SEQ ID NO: 8226455 - DNA, 22 bp, Homo sapiens
cacatctactgatattccagga

SEQ ID NO: 8226456 - DNA, 22 bp, Homo sapiens
cacatccttcatactcagctct

SEQ ID NO: 8226457 - DNA, 22 bp, Homo sapiens
cacatctactgaatgagcagtg

SEQ ID NO: 8226458 - DNA, 22 bp, Homo sapiens
cacatccttcatactcagctct

SEQ ID NO: 8226459 - DNA, 22 bp, Homo sapiens
cacatccttcatactcagctct

SEQ ID NO: 8226460 - DNA, 22 bp, Homo sapiens
cacatccttcagctgagcccag

SEQ ID NO: 8226461 - DNA, 22 bp, Homo sapiens
cacatccttcagctgagcccag

SEQ ID NO: 8226462 - DNA, 22 bp, Homo sapiens
agcagggcctggcactcctggg

SEQ ID NO: 8226463 - DNA, 22 bp, Homo sapiens
agcagggcctgagtgacctaac

SEQ ID NO: 8226464 - DNA, 22 bp, Homo sapiens
agcagggcctgagtgacctaac

SEQ ID NO: 8226465 - DNA, 22 bp, Homo sapiens
agcagggctcacattagtggat

SEQ ID NO: 8226466 - DNA, 16 bp, Homo sapiens
agcagggcgggaagga

SEQ ID NO: 8226467 - DNA, 16 bp, Homo sapiens
agcagggcgggaagga

SEQ ID NO: 8226468 - DNA, 16 bp, Homo sapiens
agcagggcgggaagga

SEQ ID NO: 8226469 - DNA, 22 bp, Homo sapiens
agcagggcctggcactcctggg

SEQ ID NO: 8226470 - DNA, 22 bp, Homo sapiens
agcagggcctggcactcctggg

SEQ ID NO: 8226471 - DNA, 22 bp, Homo sapiens
agcagggctctgccatgggccc

SEQ ID NO: 8226472 - DNA, 22 bp, Homo sapiens
agcagggctctgccatgggccc

SEQ ID NO: 8226473 - DNA, 22 bp, Homo sapiens
agcagggctccatttcactgcc

SEQ ID NO: 8226474 - DNA, 22 bp, Homo sapiens
agcagggctcctgaaagccgcg

SEQ ID NO: 8226475 - DNA, 22 bp, Homo sapiens
agcagggctccatttcactgcc

SEQ ID NO: 8226476 - DNA, 22 bp, Homo sapiens
agcagggctccatttcactgcc

SEQ ID NO: 8226477 - DNA, 22 bp, Homo sapiens
agcagggctcacattagtggat

SEQ ID NO: 8226478 - DNA, 22 bp, Homo sapiens
cacagtcaccttatcaggatgt

SEQ ID NO: 8226479 - DNA, 22 bp, Homo sapiens
agcagggcagtgcttcagctct

SEQ ID NO: 8226480 - DNA, 22 bp, Homo sapiens
agcagggcctctggcactggtc

SEQ ID NO: 8226481 - DNA, 22 bp, Homo sapiens
agcagggcctgagtgacctaac

SEQ ID NO: 8226482 - DNA, 22 bp, Homo sapiens
cacagtcccattcgagagtaat

SEQ ID NO: 8226483 - DNA, 22 bp, Homo sapiens
cacagtcccattcgagagtaat

SEQ ID NO: 8226484 - DNA, 22 bp, Homo sapiens
agcagggcagtgcttcagctct

SEQ ID NO: 8226485 - DNA, 22 bp, Homo sapiens
cacagtccagactcctggagtt

SEQ ID NO: 8226486 - DNA, 22 bp, Homo sapiens
cacagtccagactcctggagtt

SEQ ID NO: 8226487 - DNA, 22 bp, Homo sapiens
cacagtccagactcctggagtt

SEQ ID NO: 8226488 - DNA, 22 bp, Homo sapiens
cacagtccagactcctggagtt

SEQ ID NO: 8226489 - DNA, 22 bp, Homo sapiens
agcataaactcagggacacaca

SEQ ID NO: 8226490 - DNA, 22 bp, Homo sapiens
agcataaactcagggacacaca

SEQ ID NO: 8226491 - DNA, 22 bp, Homo sapiens
agcataagttggtacagccact

SEQ ID NO: 8226492 - DNA, 22 bp, Homo sapiens
agcataagttggtacagccact

SEQ ID NO: 8226493 - DNA, 22 bp, Homo sapiens
agcataagttggtacagccact

SEQ ID NO: 8226494 - DNA, 22 bp, Homo sapiens
agcataagttggtacagccact

SEQ ID NO: 8226495 - DNA, 20 bp, Homo sapiens
cactctgagggagtccatgt

SEQ ID NO: 8226496 - DNA, 20 bp, Homo sapiens
cactctgagggagtccatgt

SEQ ID NO: 8226497 - DNA, 22 bp, Homo sapiens
cactctgatggtttctgttcaa

SEQ ID NO: 8226498 - DNA, 22 bp, Homo sapiens
cactctgagcccaagcaggctg

SEQ ID NO: 8226499 - DNA, 22 bp, Homo sapiens
cactctggccactgctaaaggc

SEQ ID NO: 8226500 - DNA, 22 bp, Homo sapiens
cactctgcagctgaagggctgg

SEQ ID NO: 8226501 - DNA, 22 bp, Homo sapiens
cactctgattccacaaggctcc

SEQ ID NO: 8226502 - DNA, 22 bp, Homo sapiens
cactctggggatgcaaggagag

SEQ ID NO: 8226503 - DNA, 22 bp, Homo sapiens
cactctgggctcttgtttcaga

SEQ ID NO: 8226504 - DNA, 22 bp, Homo sapiens
cactctggggatgcaaggagag

SEQ ID NO: 8226505 - DNA, 22 bp, Homo sapiens
cactctgggctcttgtttcaga

SEQ ID NO: 8226506 - DNA, 22 bp, Homo sapiens
cactctggccactgctaaaggc

SEQ ID NO: 8226507 - DNA, 22 bp, Homo sapiens
cactctggttagtttaagcatg

SEQ ID NO: 8226508 - DNA, 22 bp, Homo sapiens
cactctgggggctgccgctgcc

SEQ ID NO: 8226509 - DNA, 22 bp, Homo sapiens
caccagggcagcagcctagtct

SEQ ID NO: 8226510 - DNA, 22 bp, Homo sapiens
caccagggacaatgctaggggt

SEQ ID NO: 8226511 - DNA, 22 bp, Homo sapiens
caccagggacaatgctaggggt

SEQ ID NO: 8226512 - DNA, 22 bp, Homo sapiens
caccaggctggagtgcagtggc

SEQ ID NO: 8226513 - DNA, 22 bp, Homo sapiens
caccagggacaatgctaggggt

SEQ ID NO: 8226514 - DNA, 22 bp, Homo sapiens
caccagggacaatgctaggggt

SEQ ID NO: 8226515 - DNA, 22 bp, Homo sapiens
agcaggtggacagaggaagaaa

SEQ ID NO: 8226516 - DNA, 22 bp, Homo sapiens
agcaggtggacagaggaagaaa

SEQ ID NO: 8226517 - DNA, 22 bp, Homo sapiens
agcaggtggaaaattcttatca

SEQ ID NO: 8226518 - DNA, 22 bp, Homo sapiens
caccaggctggagtgcagtggc

SEQ ID NO: 8226519 - DNA, 22 bp, Homo sapiens
agcaggtgccaggtgtacccgc

SEQ ID NO: 8226520 - DNA, 22 bp, Homo sapiens
agcaggtgcgttacttcactct

SEQ ID NO: 8226521 - DNA, 21 bp, Homo sapiens
agcaggtgctgttggaggaaa

SEQ ID NO: 8226522 - DNA, 21 bp, Homo sapiens
agcaggtgctgttggaggaaa

SEQ ID NO: 8226523 - DNA, 22 bp, Homo sapiens
agcaggtgcgttacttcactct

SEQ ID NO: 8226524 - DNA, 22 bp, Homo sapiens
agcaggtgcgttacttcactct

SEQ ID NO: 8226525 - DNA, 22 bp, Homo sapiens
agcaggtgccaggtgtacccgc

SEQ ID NO: 8226526 - DNA, 18 bp, Homo sapiens
agcaggtgctgtttcttt

SEQ ID NO: 8226527 - DNA, 21 bp, Homo sapiens
agcaggtgctgttggaggaaa

SEQ ID NO: 8226528 - DNA, 22 bp, Homo sapiens
agcaggtggaaaattcttatca

SEQ ID NO: 8226529 - DNA, 18 bp, Homo sapiens
agcaggtgctgtttcttt

SEQ ID NO: 8226530 - DNA, 21 bp, Homo sapiens
agcaggtgctgttggaggaaa

SEQ ID NO: 8226531 - DNA, 22 bp, Homo sapiens
caccaggtggaaatgtcacagc

SEQ ID NO: 8226532 - DNA, 22 bp, Homo sapiens
agcagtggcctggggctctgtg

SEQ ID NO: 8226533 - DNA, 22 bp, Homo sapiens
agcagtggctgacagacttacc

SEQ ID NO: 8226534 - DNA, 22 bp, Homo sapiens
agcagtggctgaagatgttcct

SEQ ID NO: 8226535 - DNA, 22 bp, Homo sapiens
agcagttgagtgggaatcaggc

SEQ ID NO: 8226536 - DNA, 22 bp, Homo sapiens
caccaggtgctggaggacatca

SEQ ID NO: 8226537 - DNA, 22 bp, Homo sapiens
caccaggggcagagaccaaagt

SEQ ID NO: 8226538 - DNA, 22 bp, Homo sapiens
caccagggtacaatttcgcaga

SEQ ID NO: 8226539 - DNA, 22 bp, Homo sapiens
caccagggctctgagctctgaa

SEQ ID NO: 8226540 - DNA, 22 bp, Homo sapiens
caccagggcagcagcctagtct

SEQ ID NO: 8226541 - DNA, 22 bp, Homo sapiens
atggagttctgccagcgctgct

SEQ ID NO: 8226542 - DNA, 22 bp, Homo sapiens
atggataatcatgaactttgag

SEQ ID NO: 8226543 - DNA, 22 bp, Homo sapiens
atggcagatggctggagcaggt

SEQ ID NO: 8226544 - DNA, 22 bp, Homo sapiens
atggcagatggctggagcaggt

SEQ ID NO: 8226545 - DNA, 22 bp, Homo sapiens
atggcagcaaatgtctggctgg

SEQ ID NO: 8226546 - DNA, 22 bp, Homo sapiens
atggcagcaaagaggccttctt

SEQ ID NO: 8226547 - DNA, 22 bp, Homo sapiens
atggcagatggctggagcaggt

SEQ ID NO: 8226548 - DNA, 22 bp, Homo sapiens
atggacagtactgagtggacta

SEQ ID NO: 8226549 - DNA, 22 bp, Homo sapiens
atggaggtggaagaatgagtta

SEQ ID NO: 8226550 - DNA, 22 bp, Homo sapiens
atggaggtgccaggtgtgaggg

SEQ ID NO: 8226551 - DNA, 22 bp, Homo sapiens
atggacagtgtgaagcagatag

SEQ ID NO: 8226552 - DNA, 22 bp, Homo sapiens
atggaggtctgtgactcccaaa

SEQ ID NO: 8226553 - DNA, 22 bp, Homo sapiens
atggagtctacaaagtgttgga

SEQ ID NO: 8226554 - DNA, 20 bp, Homo sapiens
atggagtgaagagtgaaagc

SEQ ID NO: 8226555 - DNA, 22 bp, Homo sapiens
atggagtgggccaattttagtg

SEQ ID NO: 8226556 - DNA, 22 bp, Homo sapiens
atggagtgctgttgatcaaggt

SEQ ID NO: 8226557 - DNA, 22 bp, Homo sapiens
atggagtgggccaattttagtg

SEQ ID NO: 8226558 - DNA, 22 bp, Homo sapiens
atggagtgctgttgatcaaggt

SEQ ID NO: 8226559 - DNA, 22 bp, Homo sapiens
atggagtgctgttgatcaaggt

SEQ ID NO: 8226560 - DNA, 22 bp, Homo sapiens
atggagtgcctgtggcagtggg

SEQ ID NO: 8226561 - DNA, 22 bp, Homo sapiens
atggagtgcctgtggcagtggg

SEQ ID NO: 8226562 - DNA, 22 bp, Homo sapiens
atggagtgtcaccttcctggtt

SEQ ID NO: 8226563 - DNA, 22 bp, Homo sapiens
atggagtggtacttacttggct

SEQ ID NO: 8226564 - DNA, 22 bp, Homo sapiens
atggagtggggactgcagtgga

SEQ ID NO: 8226565 - DNA, 22 bp, Homo sapiens
atggagtggtacttacttggct

SEQ ID NO: 8226566 - DNA, 22 bp, Homo sapiens
atggagtgtcaccttcctggtt

SEQ ID NO: 8226567 - DNA, 22 bp, Homo sapiens
atggagtgtggccaggcagtaa

SEQ ID NO: 8226568 - DNA, 22 bp, Homo sapiens
atggctggtgatactggagtga

SEQ ID NO: 8226569 - DNA, 22 bp, Homo sapiens
atggctggtgatactggagtga

SEQ ID NO: 8226570 - DNA, 22 bp, Homo sapiens
atggctggtgatactggagtga

SEQ ID NO: 8226571 - DNA, 21 bp, Homo sapiens
atggctggtggctcagcctcc

SEQ ID NO: 8226572 - DNA, 22 bp, Homo sapiens
atggctgggtcaccatcagggt

SEQ ID NO: 8226573 - DNA, 22 bp, Homo sapiens
atggctgggttcttctataggt

SEQ ID NO: 8226574 - DNA, 22 bp, Homo sapiens
atggctggtagtgaattaatct

SEQ ID NO: 8226575 - DNA, 22 bp, Homo sapiens
atggctggtctcccatggaaaa

SEQ ID NO: 8226576 - DNA, 22 bp, Homo sapiens
atggctggtctcccatggaaaa

SEQ ID NO: 8226577 - DNA, 22 bp, Homo sapiens
atggctggctttacttgctttg

SEQ ID NO: 8226578 - DNA, 22 bp, Homo sapiens
atggctgggaggagagtatgat

SEQ ID NO: 8226579 - DNA, 22 bp, Homo sapiens
atggctgggatgcttctagcaa

SEQ ID NO: 8226580 - DNA, 22 bp, Homo sapiens
atggctgggatggggtagagaa

SEQ ID NO: 8226581 - DNA, 22 bp, Homo sapiens
atggctgggatggggtagagaa

SEQ ID NO: 8226582 - DNA, 22 bp, Homo sapiens
atggctgggatggggtagagaa

SEQ ID NO: 8226583 - DNA, 22 bp, Homo sapiens
atggctgggatggggtagagaa

SEQ ID NO: 8226584 - DNA, 22 bp, Homo sapiens
atggctgggatttcctttgcgt

SEQ ID NO: 8226585 - DNA, 22 bp, Homo sapiens
atggctgggcttttagtcagat

SEQ ID NO: 8226586 - DNA, 22 bp, Homo sapiens
atggctgggtcaccatcagggt

SEQ ID NO: 8226587 - DNA, 22 bp, Homo sapiens
atggctgggtcaccatcagggt

SEQ ID NO: 8226588 - DNA, 22 bp, Homo sapiens
atggctgggtcaccatcagggt

SEQ ID NO: 8226589 - DNA, 22 bp, Homo sapiens
atggctgggtcaccatcagggt

SEQ ID NO: 8226590 - DNA, 22 bp, Homo sapiens
atggcagcctgagcagaggaat

SEQ ID NO: 8226591 - DNA, 22 bp, Homo sapiens
atggcagcctgaacacttcctg

SEQ ID NO: 8226592 - DNA, 22 bp, Homo sapiens
atggcagccagtgttggaggaa

SEQ ID NO: 8226593 - DNA, 22 bp, Homo sapiens
atggcagccagtgttggaggaa

SEQ ID NO: 8226594 - DNA, 22 bp, Homo sapiens
atggcagcccacgatggcaatg

SEQ ID NO: 8226595 - DNA, 22 bp, Homo sapiens
atggcagcccacgatggcaatg

SEQ ID NO: 8226596 - DNA, 18 bp, Homo sapiens
atggctcaggaatggctt

SEQ ID NO: 8226597 - DNA, 22 bp, Homo sapiens
atggctggcatgtgcataacgg

SEQ ID NO: 8226598 - DNA, 22 bp, Homo sapiens
atggctggcgtcattgtgtggg

SEQ ID NO: 8226599 - DNA, 22 bp, Homo sapiens
atggctggcgtcattgtgtggg

SEQ ID NO: 8226600 - DNA, 22 bp, Homo sapiens
atggctggctgagcctggttat

SEQ ID NO: 8226601 - DNA, 22 bp, Homo sapiens
atggcagcatgggattggtaga

SEQ ID NO: 8226602 - DNA, 22 bp, Homo sapiens
atggcagcatgggattggtaga

SEQ ID NO: 8226603 - DNA, 22 bp, Homo sapiens
atggcagcagtttggagtcttt

SEQ ID NO: 8226604 - DNA, 22 bp, Homo sapiens
atggcagcagtttggagtcttt

SEQ ID NO: 8226605 - DNA, 22 bp, Homo sapiens
atggcagcatagtggcaagtta

SEQ ID NO: 8226606 - DNA, 22 bp, Homo sapiens
atggcagcagtccattgcctca

SEQ ID NO: 8226607 - DNA, 22 bp, Homo sapiens
atggcagcagggcttgattatg

SEQ ID NO: 8226608 - DNA, 22 bp, Homo sapiens
atggcagcagctttagctgtgg

SEQ ID NO: 8226609 - DNA, 19 bp, Homo sapiens
atggcagcagcagctctcc

SEQ ID NO: 8226610 - DNA, 22 bp, Homo sapiens
atggaaatacagccagagcaga

SEQ ID NO: 8226611 - DNA, 19 bp, Homo sapiens
atggaaaatgccagactga

SEQ ID NO: 8226612 - DNA, 22 bp, Homo sapiens
atgcagggattaaatgactgcc

SEQ ID NO: 8226613 - DNA, 22 bp, Homo sapiens
atgcaggggcagcagagcctgg

SEQ ID NO: 8226614 - DNA, 22 bp, Homo sapiens
atgcaggggccgcctggccagg

SEQ ID NO: 8226615 - DNA, 22 bp, Homo sapiens
atgcagggttctgggctagaga

SEQ ID NO: 8226616 - DNA, 22 bp, Homo sapiens
atgcttgatcttcatagcattt

SEQ ID NO: 8226617 - DNA, 22 bp, Homo sapiens
atgcagggtctccgtgtgacga

SEQ ID NO: 8226618 - DNA, 23 bp, Homo sapiens
atgcagggttacagggctgactt

SEQ ID NO: 8226619 - DNA, 22 bp, Homo sapiens
agacggattacctgaggtcagg

SEQ ID NO: 8226620 - DNA, 22 bp, Homo sapiens
agactaaaagaaggaagctacc

SEQ ID NO: 8226621 - DNA, 22 bp, Homo sapiens
atggaaatcaggttcatccaag

SEQ ID NO: 8226622 - DNA, 22 bp, Homo sapiens
atggaaatcaggttcatccaag

SEQ ID NO: 8226623 - DNA, 23 bp, Homo sapiens
atggaaatagcatgtgtcattta

SEQ ID NO: 8226624 - DNA, 22 bp, Homo sapiens
atggaaatatctttagagctta

SEQ ID NO: 8226625 - DNA, 22 bp, Homo sapiens
atggaaatatctttagagctta

SEQ ID NO: 8226626 - DNA, 22 bp, Homo sapiens
agactacaggagaaactcactc

SEQ ID NO: 8226627 - DNA, 22 bp, Homo sapiens
agactacatatgccacatgaag

SEQ ID NO: 8226628 - DNA, 22 bp, Homo sapiens
agactacatatgccacatgaag

SEQ ID NO: 8226629 - DNA, 22 bp, Homo sapiens
agactacatatgccacatgaag

SEQ ID NO: 8226630 - DNA, 22 bp, Homo sapiens
agactcatgacacttcctatga

SEQ ID NO: 8226631 - DNA, 22 bp, Homo sapiens
agactcatgacacttcctatga

SEQ ID NO: 8226632 - DNA, 22 bp, Homo sapiens
agactagtctgaaggttttttt

SEQ ID NO: 8226633 - DNA, 22 bp, Homo sapiens
agactattacctaaaagataca

SEQ ID NO: 8226634 - DNA, 22 bp, Homo sapiens
agactctgagacatgaaccatc

SEQ ID NO: 8226635 - DNA, 22 bp, Homo sapiens
agactctgaggagccctgagac

SEQ ID NO: 8226636 - DNA, 23 bp, Homo sapiens
agactctgagagtgtgctttgca

SEQ ID NO: 8226637 - DNA, 22 bp, Homo sapiens
agactcctcggaccaatcagcg

SEQ ID NO: 8226638 - DNA, 22 bp, Homo sapiens
agactccttctcactgcctgta

SEQ ID NO: 8226639 - DNA, 22 bp, Homo sapiens
agactctgaagtcattgcatga

SEQ ID NO: 8226640 - DNA, 22 bp, Homo sapiens
atgtccaagtcacagattttca

SEQ ID NO: 8226641 - DNA, 22 bp, Homo sapiens
atgtccagagaacatttgcttt

SEQ ID NO: 8226642 - DNA, 22 bp, Homo sapiens
atgtccagaggtgagtcagagc

SEQ ID NO: 8226643 - DNA, 22 bp, Homo sapiens
atgtccagagaacatttgcttt

SEQ ID NO: 8226644 - DNA, 22 bp, Homo sapiens
atgtccagagccggcctgctga

SEQ ID NO: 8226645 - DNA, 22 bp, Homo sapiens
atgtccagagtaaagcacattc

SEQ ID NO: 8226646 - DNA, 22 bp, Homo sapiens
atgtccagagtaaagcacattc

SEQ ID NO: 8226647 - DNA, 22 bp, Homo sapiens
atgtccagccaaccactggatt

SEQ ID NO: 8226648 - DNA, 22 bp, Homo sapiens
atgtccagctcatgatactatc

SEQ ID NO: 8226649 - DNA, 22 bp, Homo sapiens
atgtccagccaaccactggatt

SEQ ID NO: 8226650 - DNA, 22 bp, Homo sapiens
atgtacactttggaagagtcac

SEQ ID NO: 8226651 - DNA, 22 bp, Homo sapiens
atgtacagccacttcacagtta

SEQ ID NO: 8226652 - DNA, 22 bp, Homo sapiens
atgtacagccacttcacagtta

SEQ ID NO: 8226653 - DNA, 22 bp, Homo sapiens
atgtacaggtcttggcaaaggg

SEQ ID NO: 8226654 - DNA, 22 bp, Homo sapiens
atgtacagtgataagagggcag

SEQ ID NO: 8226655 - DNA, 22 bp, Homo sapiens
atgtacagtggaaactaacaaa

SEQ ID NO: 8226656 - DNA, 22 bp, Homo sapiens
atgtacaggatggtgctcatct

SEQ ID NO: 8226657 - DNA, 22 bp, Homo sapiens
atgtacaggatggtgctcatct

SEQ ID NO: 8226658 - DNA, 22 bp, Homo sapiens
atgtacataaaatgtataatga

SEQ ID NO: 8226659 - DNA, 22 bp, Homo sapiens
atgtacagtttctagactcaaa

SEQ ID NO: 8226660 - DNA, 22 bp, Homo sapiens
atgtacataaaatgtataatga

SEQ ID NO: 8226661 - DNA, 22 bp, Homo sapiens
atgtacataaaatgtataatga

SEQ ID NO: 8226662 - DNA, 22 bp, Homo sapiens
atgtacataaaatgtataatga

SEQ ID NO: 8226663 - DNA, 22 bp, Homo sapiens
atgtacagtttctagactcaaa

SEQ ID NO: 8226664 - DNA, 22 bp, Homo sapiens
atgtacataaaatgtataatga

SEQ ID NO: 8226665 - DNA, 22 bp, Homo sapiens
atgtacagtttctagactcaaa

SEQ ID NO: 8226666 - DNA, 22 bp, Homo sapiens
atgtccagggggcttgactggt

SEQ ID NO: 8226667 - DNA, 22 bp, Homo sapiens
atgtccagtacttctaaatggt

SEQ ID NO: 8226668 - DNA, 22 bp, Homo sapiens
atgtcccaagatacagctagag

SEQ ID NO: 8226669 - DNA, 22 bp, Homo sapiens
atgtcccagctgagagacaact

SEQ ID NO: 8226670 - DNA, 22 bp, Homo sapiens
atgtctgtatgtggagaggggt

SEQ ID NO: 8226671 - DNA, 22 bp, Homo sapiens
atgtctgtggcattatatgttt

SEQ ID NO: 8226672 - DNA, 22 bp, Homo sapiens
atgtctgtgttatctgtagaat

SEQ ID NO: 8226673 - DNA, 22 bp, Homo sapiens
atgtctgttttcatatcagata

SEQ ID NO: 8226674 - DNA, 22 bp, Homo sapiens
atgtctgtggcaattgttgatg

SEQ ID NO: 8226675 - DNA, 22 bp, Homo sapiens
atgtacacacaagtttgcacgc

SEQ ID NO: 8226676 - DNA, 22 bp, Homo sapiens
atgtacacatgcatgcatgtgc

SEQ ID NO: 8226677 - DNA, 22 bp, Homo sapiens
atgtacactttggaagagtcac

SEQ ID NO: 8226678 - DNA, 22 bp, Homo sapiens
atgtaaactttaccagctctga

SEQ ID NO: 8226679 - DNA, 22 bp, Homo sapiens
atgtaaagggcatggtattggg

SEQ ID NO: 8226680 - DNA, 20 bp, Homo sapiens
atgtaaaattataaggctga

SEQ ID NO: 8226681 - DNA, 22 bp, Homo sapiens
atggttttatttctctatagct

SEQ ID NO: 8226682 - DNA, 22 bp, Homo sapiens
atggttttcctctgctgcttaa

SEQ ID NO: 8226683 - DNA, 22 bp, Homo sapiens
atggttttagaatcaggaaaaa

SEQ ID NO: 8226684 - DNA, 22 bp, Homo sapiens
atggtttttcaagtattcagaa

SEQ ID NO: 8226685 - DNA, 22 bp, Homo sapiens
atggtttttcaagtattcagaa

SEQ ID NO: 8226686 - DNA, 22 bp, Homo sapiens
atggttttgtcctctttggttc

SEQ ID NO: 8226687 - DNA, 22 bp, Homo sapiens
atggttttgtcctctttggttc

SEQ ID NO: 8226688 - DNA, 22 bp, Homo sapiens
atggttttgaagggaggtcaaa

SEQ ID NO: 8226689 - DNA, 22 bp, Homo sapiens
atgggtggccccgtgtgcagtc

SEQ ID NO: 8226690 - DNA, 22 bp, Homo sapiens
atggtttagcaacttagggaaa

SEQ ID NO: 8226691 - DNA, 22 bp, Homo sapiens
atggtttcacaaacaaaaggtt

SEQ ID NO: 8226692 - DNA, 22 bp, Homo sapiens
atggtttcacaaacaaaaggtt

SEQ ID NO: 8226693 - DNA, 22 bp, Homo sapiens
atggctgtcacgccactgtgag

SEQ ID NO: 8226694 - DNA, 22 bp, Homo sapiens
atggctgtgaaatggtaggtgg

SEQ ID NO: 8226695 - DNA, 22 bp, Homo sapiens
atggctggtttgagctttagca

SEQ ID NO: 8226696 - DNA, 22 bp, Homo sapiens
atggctgtagtcatctgaaggc

SEQ ID NO: 8226697 - DNA, 22 bp, Homo sapiens
atgggaggaaggaggcccttga

SEQ ID NO: 8226698 - DNA, 22 bp, Homo sapiens
atgggaggatcacttgaggcca

SEQ ID NO: 8226699 - DNA, 22 bp, Homo sapiens
atgggaggaagagaagatgtct

SEQ ID NO: 8226700 - DNA, 22 bp, Homo sapiens
atgggaggaagagaagatgtct

SEQ ID NO: 8226701 - DNA, 22 bp, Homo sapiens
atgggaggaaggaggcccttga

SEQ ID NO: 8226702 - DNA, 22 bp, Homo sapiens
atgggaggcagcagagcccagc

SEQ ID NO: 8226703 - DNA, 22 bp, Homo sapiens
atgggaggcagacactaagttc

SEQ ID NO: 8226704 - DNA, 22 bp, Homo sapiens
atgggaggcagacactaagttc

SEQ ID NO: 8226705 - DNA, 22 bp, Homo sapiens
atgggaggcaaagatcgcagaa

SEQ ID NO: 8226706 - DNA, 22 bp, Homo sapiens
agacacagtataagcacaacaa

SEQ ID NO: 8226707 - DNA, 22 bp, Homo sapiens
agacacagtacttgccctcatg

SEQ ID NO: 8226708 - DNA, 22 bp, Homo sapiens
agacacagtctgtctggaggag

SEQ ID NO: 8226709 - DNA, 22 bp, Homo sapiens
agacacagtctgtctggaggag

SEQ ID NO: 8226710 - DNA, 22 bp, Homo sapiens
agacacagtctgtctggaggag

SEQ ID NO: 8226711 - DNA, 22 bp, Homo sapiens
agacacagctgcaggaggtggg

SEQ ID NO: 8226712 - DNA, 22 bp, Homo sapiens
agacacaggattctgcatttct

SEQ ID NO: 8226713 - DNA, 21 bp, Homo sapiens
agacacaggggttgctggggt

SEQ ID NO: 8226714 - DNA, 21 bp, Homo sapiens
agacacaggggttgctggggt

SEQ ID NO: 8226715 - DNA, 21 bp, Homo sapiens
agacacaggggttgctggggt

SEQ ID NO: 8226716 - DNA, 22 bp, Homo sapiens
agacacagtttgggatgggttg

SEQ ID NO: 8226717 - DNA, 22 bp, Homo sapiens
agacacagtttgggatgggttg

SEQ ID NO: 8226718 - DNA, 22 bp, Homo sapiens
agacacagtctgtctggaggag

SEQ ID NO: 8226719 - DNA, 22 bp, Homo sapiens
agacacagtgctgggtgctgag

SEQ ID NO: 8226720 - DNA, 22 bp, Homo sapiens
agacacagtgctgggtgctgag

SEQ ID NO: 8226721 - DNA, 22 bp, Homo sapiens
agacacataggaccacactgtg

SEQ ID NO: 8226722 - DNA, 22 bp, Homo sapiens
agacacataggaccacactgtg

SEQ ID NO: 8226723 - DNA, 22 bp, Homo sapiens
agacaggcagcagatggagtgt

SEQ ID NO: 8226724 - DNA, 22 bp, Homo sapiens
agacaggcagcagatggagtgt

SEQ ID NO: 8226725 - DNA, 22 bp, Homo sapiens
agacaggcatgaggctggattg

SEQ ID NO: 8226726 - DNA, 22 bp, Homo sapiens
atgcaggattagaaagttgcct

SEQ ID NO: 8226727 - DNA, 21 bp, Homo sapiens
atgcaggctgctcagaagcaa

SEQ ID NO: 8226728 - DNA, 22 bp, Homo sapiens
atgcaggcagacactgtgggca

SEQ ID NO: 8226729 - DNA, 22 bp, Homo sapiens
atgcagggaggtaagaggtgcc

SEQ ID NO: 8226730 - DNA, 22 bp, Homo sapiens
atgcaggagttcgaggctgtat

SEQ ID NO: 8226731 - DNA, 22 bp, Homo sapiens
atgcaggagttcgaggctgtat

SEQ ID NO: 8226732 - DNA, 22 bp, Homo sapiens
agacagtgattcttcacatttc

SEQ ID NO: 8226733 - DNA, 22 bp, Homo sapiens
agacagtgcaagaagagcaggc

SEQ ID NO: 8226734 - DNA, 22 bp, Homo sapiens
agacagtgcaagaagagcaggc

SEQ ID NO: 8226735 - DNA, 22 bp, Homo sapiens
agacagtgatgtaagcaggagt

SEQ ID NO: 8226736 - DNA, 22 bp, Homo sapiens
agacagtgatgtaagcaggagt

SEQ ID NO: 8226737 - DNA, 22 bp, Homo sapiens
agacagtgatggacaggcagac

SEQ ID NO: 8226738 - DNA, 22 bp, Homo sapiens
agacagtgatggacaggcagac

SEQ ID NO: 8226739 - DNA, 17 bp, Homo sapiens
agacagtgagtgccttg

SEQ ID NO: 8226740 - DNA, 17 bp, Homo sapiens
agacagtgagtgccttg

SEQ ID NO: 8226741 - DNA, 22 bp, Homo sapiens
agacagtaataaaataggtaag

SEQ ID NO: 8226742 - DNA, 17 bp, Homo sapiens
agacaggttatagttga

SEQ ID NO: 8226743 - DNA, 22 bp, Homo sapiens
agacaggtgctcgcccaagtcc

SEQ ID NO: 8226744 - DNA, 21 bp, Homo sapiens
agacaggtcagggagaggtga

SEQ ID NO: 8226745 - DNA, 22 bp, Homo sapiens
agacaggtgttttacaacttcg

SEQ ID NO: 8226746 - DNA, 21 bp, Homo sapiens
agacaggtcagggagaggtga

SEQ ID NO: 8226747 - DNA, 22 bp, Homo sapiens
agacaggcatgaggctggattg

SEQ ID NO: 8226748 - DNA, 19 bp, Homo sapiens
agacacacttacgtggaat

SEQ ID NO: 8226749 - DNA, 19 bp, Homo sapiens
agacacacttgatatgtgt

SEQ ID NO: 8226750 - DNA, 19 bp, Homo sapiens
agacacacttgatatgtgt

SEQ ID NO: 8226751 - DNA, 22 bp, Homo sapiens
agacacagaacacaaaagcata

SEQ ID NO: 8226752 - DNA, 22 bp, Homo sapiens
agacaatttcaaagtaatatta

SEQ ID NO: 8226753 - DNA, 22 bp, Homo sapiens
agacaatttcaaagtaatatta

SEQ ID NO: 8226754 - DNA, 22 bp, Homo sapiens
agacacagattttggaaaagat

SEQ ID NO: 8226755 - DNA, 22 bp, Homo sapiens
agacacagcaataactactgtt

SEQ ID NO: 8226756 - DNA, 22 bp, Homo sapiens
agacacagcaataactactgtt

SEQ ID NO: 8226757 - DNA, 22 bp, Homo sapiens
agacacagcagtgcctgcctca

SEQ ID NO: 8226758 - DNA, 22 bp, Homo sapiens
agacacagaagttgctgttggg

SEQ ID NO: 8226759 - DNA, 22 bp, Homo sapiens
agacacagatggtacctgagcc

SEQ ID NO: 8226760 - DNA, 22 bp, Homo sapiens
agacacagatggtacctgagcc

SEQ ID NO: 8226761 - DNA, 22 bp, Homo sapiens
agacacagaagttgctgttggg

SEQ ID NO: 8226762 - DNA, 22 bp, Homo sapiens
agacacagaagttgctgttggg

SEQ ID NO: 8226763 - DNA, 22 bp, Homo sapiens
agacacagaagttgctgttggg

SEQ ID NO: 8226764 - DNA, 22 bp, Homo sapiens
agaattacataaatacatgaat

SEQ ID NO: 8226765 - DNA, 22 bp, Homo sapiens
agaattagaggccatgtacttg

SEQ ID NO: 8226766 - DNA, 22 bp, Homo sapiens
agaattagccggattcttgttt

SEQ ID NO: 8226767 - DNA, 22 bp, Homo sapiens
agaattaggtaagttcatctga

SEQ ID NO: 8226768 - DNA, 22 bp, Homo sapiens
agaattcagaatgcatttctaa

SEQ ID NO: 8226769 - DNA, 22 bp, Homo sapiens
agacaatacatttattcccttt

SEQ ID NO: 8226770 - DNA, 22 bp, Homo sapiens
agaattctccacgctcagggtc

SEQ ID NO: 8226771 - DNA, 22 bp, Homo sapiens
agaatgcagcttgccagtatct

SEQ ID NO: 8226772 - DNA, 22 bp, Homo sapiens
agaatgcaagataaactttatt

SEQ ID NO: 8226773 - DNA, 22 bp, Homo sapiens
agaatgcagcttgccagtatct

SEQ ID NO: 8226774 - DNA, 22 bp, Homo sapiens
agaatgattttggacaatatgg

SEQ ID NO: 8226775 - DNA, 22 bp, Homo sapiens
agaatgattttggacaatatgg

SEQ ID NO: 8226776 - DNA, 22 bp, Homo sapiens
agaatgatactctatgccaaat

SEQ ID NO: 8226777 - DNA, 22 bp, Homo sapiens
agaatcaggaagacagcctggc

SEQ ID NO: 8226778 - DNA, 22 bp, Homo sapiens
agaatcaggacctgtggctgtc

SEQ ID NO: 8226779 - DNA, 22 bp, Homo sapiens
agaatgaagatgacttcggaga

SEQ ID NO: 8226780 - DNA, 22 bp, Homo sapiens
agaatgaattaatcaactggaa

SEQ ID NO: 8226781 - DNA, 21 bp, Homo sapiens
agaattaaattggatttgtgt

SEQ ID NO: 8226782 - DNA, 22 bp, Homo sapiens
agaatgttgatagcacctattt

SEQ ID NO: 8226783 - DNA, 22 bp, Homo sapiens
agaatgcttcctttgaaactga

SEQ ID NO: 8226784 - DNA, 22 bp, Homo sapiens
agaatgtgggggaaaagagtgt

SEQ ID NO: 8226785 - DNA, 22 bp, Homo sapiens
agaatgtgatatagtgatatgt

SEQ ID NO: 8226786 - DNA, 22 bp, Homo sapiens
agaatgtgaagattttgaatta

SEQ ID NO: 8226787 - DNA, 22 bp, Homo sapiens
agaatgtcaacagcctctcaag

SEQ ID NO: 8226788 - DNA, 22 bp, Homo sapiens
agaatgggggctacaggccaca

SEQ ID NO: 8226789 - DNA, 22 bp, Homo sapiens
agaatgcttcctttgaaactga

SEQ ID NO: 8226790 - DNA, 22 bp, Homo sapiens
agaatgctttggatatattgga

SEQ ID NO: 8226791 - DNA, 22 bp, Homo sapiens
agaatgcattttgtgtagctat

SEQ ID NO: 8226792 - DNA, 22 bp, Homo sapiens
agaatgctaaatggattcttct

SEQ ID NO: 8226793 - DNA, 22 bp, Homo sapiens
agaatgctccagagctgaaaga

SEQ ID NO: 8226794 - DNA, 22 bp, Homo sapiens
agaatacagttcagtaatggat

SEQ ID NO: 8226795 - DNA, 22 bp, Homo sapiens
agaatacatcaatctattttct

SEQ ID NO: 8226796 - DNA, 22 bp, Homo sapiens
agaatacagttcagtaatggat

SEQ ID NO: 8226797 - DNA, 22 bp, Homo sapiens
agaatacagtatgcaaaaagat

SEQ ID NO: 8226798 - DNA, 22 bp, Homo sapiens
agaatagtggcaatgactgcac

SEQ ID NO: 8226799 - DNA, 22 bp, Homo sapiens
agaatagagaaaaaggttattt

SEQ ID NO: 8226800 - DNA, 22 bp, Homo sapiens
agaatagaattctcatagaatt

SEQ ID NO: 8226801 - DNA, 22 bp, Homo sapiens
agaatactaggcttcagaaagg

SEQ ID NO: 8226802 - DNA, 22 bp, Homo sapiens
agaatacatctagtgctgcatg

SEQ ID NO: 8226803 - DNA, 22 bp, Homo sapiens
agaatactaggcttcagaaagg

SEQ ID NO: 8226804 - DNA, 22 bp, Homo sapiens
atctttggtcttgagtgcatct

SEQ ID NO: 8226805 - DNA, 22 bp, Homo sapiens
atctttgtgaatctcaacttgg

SEQ ID NO: 8226806 - DNA, 22 bp, Homo sapiens
atctttgtgctaatgtagttct

SEQ ID NO: 8226807 - DNA, 22 bp, Homo sapiens
agaatcagatgaagactcctgc

SEQ ID NO: 8226808 - DNA, 20 bp, Homo sapiens
atctttgtctctgtagttgt

SEQ ID NO: 8226809 - DNA, 22 bp, Homo sapiens
atctttgtcactctactgtcta

SEQ ID NO: 8226810 - DNA, 22 bp, Homo sapiens
agaatacaattgttcagtaata

SEQ ID NO: 8226811 - DNA, 22 bp, Homo sapiens
agaatacaattgttcagtaata

SEQ ID NO: 8226812 - DNA, 21 bp, Homo sapiens
agaataatggtatcatttgct

SEQ ID NO: 8226813 - DNA, 22 bp, Homo sapiens
agaatacaccacaggccgaaat

SEQ ID NO: 8226814 - DNA, 22 bp, Homo sapiens
agaatacaattgttcagtaata

SEQ ID NO: 8226815 - DNA, 23 bp, Homo sapiens
agaatacaggctttgtataggca

SEQ ID NO: 8226816 - DNA, 22 bp, Homo sapiens
agaagtttggtccttttcaagg

SEQ ID NO: 8226817 - DNA, 22 bp, Homo sapiens
agaagtttggtccttttcaagg

SEQ ID NO: 8226818 - DNA, 22 bp, Homo sapiens
agaaggccaatagggtgcactg

SEQ ID NO: 8226819 - DNA, 22 bp, Homo sapiens
atctttagtgtgaatttattga

SEQ ID NO: 8226820 - DNA, 22 bp, Homo sapiens
atctttatatatctcctctgaa

SEQ ID NO: 8226821 - DNA, 22 bp, Homo sapiens
agaaggcatcagaagtgtgtag

SEQ ID NO: 8226822 - DNA, 22 bp, Homo sapiens
agaaggccagatggacggggct

SEQ ID NO: 8226823 - DNA, 22 bp, Homo sapiens
agaaggccatgtcttggtactt

SEQ ID NO: 8226824 - DNA, 22 bp, Homo sapiens
agaaggccatgtcttggtactt

SEQ ID NO: 8226825 - DNA, 22 bp, Homo sapiens
agaaggcctaacttgggggcaa

SEQ ID NO: 8226826 - DNA, 22 bp, Homo sapiens
agaaggcctaacttgggggcaa

SEQ ID NO: 8226827 - DNA, 22 bp, Homo sapiens
agaaggctcactaagagtgact

SEQ ID NO: 8226828 - DNA, 22 bp, Homo sapiens
agaagcacaccagtagacaggg

SEQ ID NO: 8226829 - DNA, 22 bp, Homo sapiens
agaagcacaggtaaagtgattt

SEQ ID NO: 8226830 - DNA, 22 bp, Homo sapiens
agaagcacacctgacctctagc

SEQ ID NO: 8226831 - DNA, 22 bp, Homo sapiens
agaagcaaggtctgtcagtata

SEQ ID NO: 8226832 - DNA, 22 bp, Homo sapiens
atcttatgttgtattcaaaatc

SEQ ID NO: 8226833 - DNA, 19 bp, Homo sapiens
agaagcaccagtcattcct

SEQ ID NO: 8226834 - DNA, 22 bp, Homo sapiens
atcttatgagacccataaagat

SEQ ID NO: 8226835 - DNA, 22 bp, Homo sapiens
atcttgggccacaatgagccga

SEQ ID NO: 8226836 - DNA, 20 bp, Homo sapiens
atcttgggattgagattgcc

SEQ ID NO: 8226837 - DNA, 22 bp, Homo sapiens
atcttgggacatgtgctctggg

SEQ ID NO: 8226838 - DNA, 22 bp, Homo sapiens
atcttgttaaaatgcagaaact

SEQ ID NO: 8226839 - DNA, 22 bp, Homo sapiens
atcttgttaaaatgcagattct

SEQ ID NO: 8226840 - DNA, 22 bp, Homo sapiens
atcttgttaaaaagcagattct

SEQ ID NO: 8226841 - DNA, 22 bp, Homo sapiens
atctttagcattactttattca

SEQ ID NO: 8226842 - DNA, 22 bp, Homo sapiens
atctttagtagaggaatatatt

SEQ ID NO: 8226843 - DNA, 22 bp, Homo sapiens
atctttaggcaagttacttaac

SEQ ID NO: 8226844 - DNA, 19 bp, Homo sapiens
atctttagcaactttcaaa

SEQ ID NO: 8226845 - DNA, 22 bp, Homo sapiens
atctttagacaggaagcaatca

SEQ ID NO: 8226846 - DNA, 22 bp, Homo sapiens
atctttagacaggaagcaatca

SEQ ID NO: 8226847 - DNA, 22 bp, Homo sapiens
atcttgttataagagataatgg

SEQ ID NO: 8226848 - DNA, 22 bp, Homo sapiens
atcttgttctcccttgttctta

SEQ ID NO: 8226849 - DNA, 22 bp, Homo sapiens
atcttgttataagagataatgg

SEQ ID NO: 8226850 - DNA, 22 bp, Homo sapiens
atcttgttaaagtgcagattct

SEQ ID NO: 8226851 - DNA, 22 bp, Homo sapiens
atcttgttaaagtgcagatttt

SEQ ID NO: 8226852 - DNA, 22 bp, Homo sapiens
atctttaaagacatgtgaactt

SEQ ID NO: 8226853 - DNA, 22 bp, Homo sapiens
agaagaatacttgatgttcatg

SEQ ID NO: 8226854 - DNA, 22 bp, Homo sapiens
agaagaatttctctcatgattt

SEQ ID NO: 8226855 - DNA, 22 bp, Homo sapiens
agaagaaatgtgaaggccactg

SEQ ID NO: 8226856 - DNA, 22 bp, Homo sapiens
agaagaaatgtgaaggccactg

SEQ ID NO: 8226857 - DNA, 22 bp, Homo sapiens
agaagaaatgtgaaggccactg

SEQ ID NO: 8226858 - DNA, 22 bp, Homo sapiens
agaagagaactgccaaacactt

SEQ ID NO: 8226859 - DNA, 22 bp, Homo sapiens
agaagagaactgccaaacactt

SEQ ID NO: 8226860 - DNA, 22 bp, Homo sapiens
agaagaatttctctcatgattt

SEQ ID NO: 8226861 - DNA, 22 bp, Homo sapiens
agaagagccactgttgacggca

SEQ ID NO: 8226862 - DNA, 22 bp, Homo sapiens
agaagagcctggggaccatggc

SEQ ID NO: 8226863 - DNA, 22 bp, Homo sapiens
agaagagcctggggaccatggc

SEQ ID NO: 8226864 - DNA, 22 bp, Homo sapiens
agaagatgttgcagttgatgcg

SEQ ID NO: 8226865 - DNA, 22 bp, Homo sapiens
agaagaggggtgtccctgtggc

SEQ ID NO: 8226866 - DNA, 22 bp, Homo sapiens
agaagagtagtaacagaaatta

SEQ ID NO: 8226867 - DNA, 22 bp, Homo sapiens
attagatgtgaccttagataaa

SEQ ID NO: 8226868 - DNA, 22 bp, Homo sapiens
attacagtgccacctcgtggtc

SEQ ID NO: 8226869 - DNA, 22 bp, Homo sapiens
attacagtgccacctcgtggtc

SEQ ID NO: 8226870 - DNA, 22 bp, Homo sapiens
attacagtaggattggaaagga

SEQ ID NO: 8226871 - DNA, 22 bp, Homo sapiens
attacagtagcaaaagaccgga

SEQ ID NO: 8226872 - DNA, 22 bp, Homo sapiens
attacagtaggattggaaagga

SEQ ID NO: 8226873 - DNA, 22 bp, Homo sapiens
attaaagtgaagttctcagatg

SEQ ID NO: 8226874 - DNA, 22 bp, Homo sapiens
attacagtagcaaaagaccgga

SEQ ID NO: 8226875 - DNA, 22 bp, Homo sapiens
attagcaaattctaattcacta

SEQ ID NO: 8226876 - DNA, 22 bp, Homo sapiens
attagattgtaaatgttttcac

SEQ ID NO: 8226877 - DNA, 22 bp, Homo sapiens
attagattgtaaatgttttcac

SEQ ID NO: 8226878 - DNA, 22 bp, Homo sapiens
attagcaacatggtgaatatgt

SEQ ID NO: 8226879 - DNA, 22 bp, Homo sapiens
attagcaactcttatgtaagca

SEQ ID NO: 8226880 - DNA, 22 bp, Homo sapiens
attagcaactcttatgtaagca

SEQ ID NO: 8226881 - DNA, 22 bp, Homo sapiens
attagcaaggttcatgagaaga

SEQ ID NO: 8226882 - DNA, 22 bp, Homo sapiens
attagcatattaaatagtcatt

SEQ ID NO: 8226883 - DNA, 22 bp, Homo sapiens
attagcatattaaatagtcatt

SEQ ID NO: 8226884 - DNA, 22 bp, Homo sapiens
attagcagctttctggtctcta

SEQ ID NO: 8226885 - DNA, 22 bp, Homo sapiens
attagctaggaaattttgtgtc

SEQ ID NO: 8226886 - DNA, 22 bp, Homo sapiens
attagcatgccaagcttttaga

SEQ ID NO: 8226887 - DNA, 20 bp, Homo sapiens
attagctcaggtgaggtcat

SEQ ID NO: 8226888 - DNA, 22 bp, Homo sapiens
attagctgacctctaaggagcc

SEQ ID NO: 8226889 - DNA, 22 bp, Homo sapiens
attagctgttgtgaaaggggtg

SEQ ID NO: 8226890 - DNA, 22 bp, Homo sapiens
attagctgacctctaaggagcc

SEQ ID NO: 8226891 - DNA, 22 bp, Homo sapiens
atgtttgttgaacatctactgc

SEQ ID NO: 8226892 - DNA, 22 bp, Homo sapiens
atgtttgtgtttgctatgcggt

SEQ ID NO: 8226893 - DNA, 22 bp, Homo sapiens
atgtttgttgaatgaagaaagg

SEQ ID NO: 8226894 - DNA, 22 bp, Homo sapiens
atgtttgttgatcatttatgaa

SEQ ID NO: 8226895 - DNA, 22 bp, Homo sapiens
atgtttgtgggataaacaaatg

SEQ ID NO: 8226896 - DNA, 22 bp, Homo sapiens
atgtttgtgggataaacaaatg

SEQ ID NO: 8226897 - DNA, 22 bp, Homo sapiens
atgtttgtaggtaagtgacact

SEQ ID NO: 8226898 - DNA, 22 bp, Homo sapiens
atgtttgtaggtaagtgacact

SEQ ID NO: 8226899 - DNA, 22 bp, Homo sapiens
atgtttgtcaggattgtaatta

SEQ ID NO: 8226900 - DNA, 22 bp, Homo sapiens
attaaacaatgtaaagttcttg

SEQ ID NO: 8226901 - DNA, 22 bp, Homo sapiens
attaaacaatgtaaagttcttg

SEQ ID NO: 8226902 - DNA, 22 bp, Homo sapiens
attaaacaatgtaaagttcttg

SEQ ID NO: 8226903 - DNA, 22 bp, Homo sapiens
attaaactgagcaaattaacat

SEQ ID NO: 8226904 - DNA, 22 bp, Homo sapiens
attaaactgagcaaattaacat

SEQ ID NO: 8226905 - DNA, 22 bp, Homo sapiens
attaaagacagcagatggatgg

SEQ ID NO: 8226906 - DNA, 22 bp, Homo sapiens
attaaagaaacccagcatgtga

SEQ ID NO: 8226907 - DNA, 22 bp, Homo sapiens
attaaagaaacccagcatgtga

SEQ ID NO: 8226908 - DNA, 22 bp, Homo sapiens
attaaagtgaagttctcagatg

SEQ ID NO: 8226909 - DNA, 22 bp, Homo sapiens
attaaagctatccagtcatgaa

SEQ ID NO: 8226910 - DNA, 22 bp, Homo sapiens
attaaagacagcagatggatgg

SEQ ID NO: 8226911 - DNA, 18 bp, Homo sapiens
atgtgtggcttggggtcc

SEQ ID NO: 8226912 - DNA, 21 bp, Homo sapiens
atgtgtgctagaggactactg

SEQ ID NO: 8226913 - DNA, 22 bp, Homo sapiens
atgtgtgctacaggtgtgggaa

SEQ ID NO: 8226914 - DNA, 22 bp, Homo sapiens
atgtgtgctacaggtgtgggaa

SEQ ID NO: 8226915 - DNA, 22 bp, Homo sapiens
atgtgtgtacacacgtgactct

SEQ ID NO: 8226916 - DNA, 22 bp, Homo sapiens
atgtgtgtaaacaagtataatt

SEQ ID NO: 8226917 - DNA, 22 bp, Homo sapiens
atgtgtgtaaacaagtataatt

SEQ ID NO: 8226918 - DNA, 22 bp, Homo sapiens
atgtgtgtacacacgtgactct

SEQ ID NO: 8226919 - DNA, 22 bp, Homo sapiens
atgtgtgcctgagtgatggact

SEQ ID NO: 8226920 - DNA, 22 bp, Homo sapiens
atgtgtctttgagactctgcta

SEQ ID NO: 8226921 - DNA, 22 bp, Homo sapiens
atgtgtgcatcaatgatagatc

SEQ ID NO: 8226922 - DNA, 22 bp, Homo sapiens
atgtgtgcaatgctattttggc

SEQ ID NO: 8226923 - DNA, 22 bp, Homo sapiens
atgtgtctttcaaggtatagaa

SEQ ID NO: 8226924 - DNA, 22 bp, Homo sapiens
atgtgtatccatctgtctattt

SEQ ID NO: 8226925 - DNA, 22 bp, Homo sapiens
atgtgtatccatctgtctattt

SEQ ID NO: 8226926 - DNA, 22 bp, Homo sapiens
atgtgtatctaaggtgttctat

SEQ ID NO: 8226927 - DNA, 22 bp, Homo sapiens
atgtgtatctaaggtgttctat

SEQ ID NO: 8226928 - DNA, 22 bp, Homo sapiens
atgtgtatccatctgtctattt

SEQ ID NO: 8226929 - DNA, 22 bp, Homo sapiens
atgtttctgagtgtatatacat

SEQ ID NO: 8226930 - DNA, 22 bp, Homo sapiens
atgttacaatccaacaaaatta

SEQ ID NO: 8226931 - DNA, 22 bp, Homo sapiens
atgttacaatccaacaaaatta

SEQ ID NO: 8226932 - DNA, 22 bp, Homo sapiens
atgttacaattcaaaatgctgc

SEQ ID NO: 8226933 - DNA, 22 bp, Homo sapiens
atgtttatgttgggctatattt

SEQ ID NO: 8226934 - DNA, 22 bp, Homo sapiens
atgtttatgttgggctatattt

SEQ ID NO: 8226935 - DNA, 22 bp, Homo sapiens
atgttacacataggcataaatg

SEQ ID NO: 8226936 - DNA, 22 bp, Homo sapiens
atgtttatgttgggctatattt

SEQ ID NO: 8226937 - DNA, 22 bp, Homo sapiens
atgtttctgaagtttacagata

SEQ ID NO: 8226938 - DNA, 22 bp, Homo sapiens
atgttaagtttagcaggctagg

SEQ ID NO: 8226939 - DNA, 22 bp, Homo sapiens
atgttacaaatcctacaggtag

SEQ ID NO: 8226940 - DNA, 22 bp, Homo sapiens
atgttaagaatgcagacaaatg

SEQ ID NO: 8226941 - DNA, 22 bp, Homo sapiens
atgttaaatggtttattattaa

SEQ ID NO: 8226942 - DNA, 20 bp, Homo sapiens
atgttaaatagcatttagag

SEQ ID NO: 8226943 - DNA, 22 bp, Homo sapiens
atgttaaatagccatttgtttg

SEQ ID NO: 8226944 - DNA, 22 bp, Homo sapiens
attctggaattctaagattctg

SEQ ID NO: 8226945 - DNA, 22 bp, Homo sapiens
attctctgtggtgatgctggtg

SEQ ID NO: 8226946 - DNA, 22 bp, Homo sapiens
attctctgttcaaggatggtga

SEQ ID NO: 8226947 - DNA, 22 bp, Homo sapiens
attcagctgatggtatttaaat

SEQ ID NO: 8226948 - DNA, 22 bp, Homo sapiens
attcagggaggaaaggggcctc

SEQ ID NO: 8226949 - DNA, 22 bp, Homo sapiens
attcagcttcaatgtcttcacc

SEQ ID NO: 8226950 - DNA, 22 bp, Homo sapiens
attcagctaagtgcttcatgct

SEQ ID NO: 8226951 - DNA, 22 bp, Homo sapiens
attcagctaagtgcttcatgct

SEQ ID NO: 8226952 - DNA, 22 bp, Homo sapiens
attctggacaatgagaaactgg

SEQ ID NO: 8226953 - DNA, 22 bp, Homo sapiens
attctggacaatgagaaactgg

SEQ ID NO: 8226954 - DNA, 22 bp, Homo sapiens
attctggatattacttatctat

SEQ ID NO: 8226955 - DNA, 22 bp, Homo sapiens
attctggacaaggcaagctcct

SEQ ID NO: 8226956 - DNA, 22 bp, Homo sapiens
attctggacaaggcaagctcct

SEQ ID NO: 8226957 - DNA, 22 bp, Homo sapiens
attctggacaaggcaagctcct

SEQ ID NO: 8226958 - DNA, 22 bp, Homo sapiens
attctggattatcagtccacca

SEQ ID NO: 8226959 - DNA, 22 bp, Homo sapiens
attctggattatcagtccacca

SEQ ID NO: 8226960 - DNA, 22 bp, Homo sapiens
attctggattatcagtccacca

SEQ ID NO: 8226961 - DNA, 22 bp, Homo sapiens
attctggatattacttatctat

SEQ ID NO: 8226962 - DNA, 22 bp, Homo sapiens
attctggattatcagtccacca

SEQ ID NO: 8226963 - DNA, 22 bp, Homo sapiens
attctgggaactttgtctctca

SEQ ID NO: 8226964 - DNA, 22 bp, Homo sapiens
attctgggagtgtaggatggtt

SEQ ID NO: 8226965 - DNA, 21 bp, Homo sapiens
agagggagagtggcccttcca

SEQ ID NO: 8226966 - DNA, 22 bp, Homo sapiens
attctgtcagatcttactggat

SEQ ID NO: 8226967 - DNA, 21 bp, Homo sapiens
agagggagagtggcccttcca

SEQ ID NO: 8226968 - DNA, 22 bp, Homo sapiens
attctgtatttggatataaggg

SEQ ID NO: 8226969 - DNA, 22 bp, Homo sapiens
attctgtatttctaataagatc

SEQ ID NO: 8226970 - DNA, 22 bp, Homo sapiens
attctgtatttggatataaggg

SEQ ID NO: 8226971 - DNA, 22 bp, Homo sapiens
attctgtatttctaataagatc

SEQ ID NO: 8226972 - DNA, 22 bp, Homo sapiens
attctgtatggggaaactagag

SEQ ID NO: 8226973 - DNA, 22 bp, Homo sapiens
attctgtagggcttgctgacac

SEQ ID NO: 8226974 - DNA, 22 bp, Homo sapiens
attctgtaattgaactgtgttg

SEQ ID NO: 8226975 - DNA, 22 bp, Homo sapiens
attctgggtttgctgtacaaag

SEQ ID NO: 8226976 - DNA, 22 bp, Homo sapiens
attctgggcgcctatggctgca

SEQ ID NO: 8226977 - DNA, 22 bp, Homo sapiens
attctgggttcatgagtgagct

SEQ ID NO: 8226978 - DNA, 22 bp, Homo sapiens
attctgggttcatgagtgagct

SEQ ID NO: 8226979 - DNA, 22 bp, Homo sapiens
agagggcaagtgtagtccagta

SEQ ID NO: 8226980 - DNA, 22 bp, Homo sapiens
agagggagtgaaatggaataga

SEQ ID NO: 8226981 - DNA, 22 bp, Homo sapiens
agagggagtgaaatggaataga

SEQ ID NO: 8226982 - DNA, 22 bp, Homo sapiens
agagggagctttatttttctgt

SEQ ID NO: 8226983 - DNA, 23 bp, Homo sapiens
agagggagatgtttttctcaaga

SEQ ID NO: 8226984 - DNA, 22 bp, Homo sapiens
agagggagcccagtcatagctg

SEQ ID NO: 8226985 - DNA, 22 bp, Homo sapiens
agagggtagaagacagggttgc

SEQ ID NO: 8226986 - DNA, 22 bp, Homo sapiens
agagggcagcagcaacaactct

SEQ ID NO: 8226987 - DNA, 22 bp, Homo sapiens
agagggtagaagacagggttgc

SEQ ID NO: 8226988 - DNA, 22 bp, Homo sapiens
agagggtatgagtggggctaaa

SEQ ID NO: 8226989 - DNA, 22 bp, Homo sapiens
agagggtgaatgagatagaaaa

SEQ ID NO: 8226990 - DNA, 22 bp, Homo sapiens
agagggtgaatgagatagaaaa

SEQ ID NO: 8226991 - DNA, 22 bp, Homo sapiens
agagggtgctggagagacattg

SEQ ID NO: 8226992 - DNA, 22 bp, Homo sapiens
agagggtgagcaggtacacatg

SEQ ID NO: 8226993 - DNA, 23 bp, Homo sapiens
agagggtgcaacatggggatcta

SEQ ID NO: 8226994 - DNA, 22 bp, Homo sapiens
agagggtgctggagagacattg

SEQ ID NO: 8226995 - DNA, 22 bp, Homo sapiens
agagggtgctggagagacattg

SEQ ID NO: 8226996 - DNA, 22 bp, Homo sapiens
agagggtgggcacgtgatggat

SEQ ID NO: 8226997 - DNA, 22 bp, Homo sapiens
attcagcagttcctgcttcagt

SEQ ID NO: 8226998 - DNA, 22 bp, Homo sapiens
attcagcaagctatgggacagg

SEQ ID NO: 8226999 - DNA, 22 bp, Homo sapiens
attcagattggtttaagctagt

SEQ ID NO: 8227000 - DNA, 22 bp, Homo sapiens
attcagatcatatttatagctt

SEQ ID NO: 8227001 - DNA, 22 bp, Homo sapiens
attcagattcctaggtttcatt

SEQ ID NO: 8227002 - DNA, 22 bp, Homo sapiens
attcagatcatatttatagctt

SEQ ID NO: 8227003 - DNA, 22 bp, Homo sapiens
attcagattcctaggtttcatt

SEQ ID NO: 8227004 - DNA, 22 bp, Homo sapiens
attcagagtctgcacaacagca

SEQ ID NO: 8227005 - DNA, 22 bp, Homo sapiens
attcacagtttcctcatattct

SEQ ID NO: 8227006 - DNA, 22 bp, Homo sapiens
attcacagtttcctcatattct

SEQ ID NO: 8227007 - DNA, 22 bp, Homo sapiens
attcacagtatggacgaaatga

SEQ ID NO: 8227008 - DNA, 22 bp, Homo sapiens
attcacagggggagaagggtat

SEQ ID NO: 8227009 - DNA, 20 bp, Homo sapiens
attcacaggcacaaaaccct

SEQ ID NO: 8227010 - DNA, 22 bp, Homo sapiens
attcacaattagaagtagataa

SEQ ID NO: 8227011 - DNA, 22 bp, Homo sapiens
attcacaattagaagtagataa

SEQ ID NO: 8227012 - DNA, 22 bp, Homo sapiens
attcacaattagaagtagataa

SEQ ID NO: 8227013 - DNA, 22 bp, Homo sapiens
attcacaattagaagtagataa

SEQ ID NO: 8227014 - DNA, 22 bp, Homo sapiens
attcaaagcccagtaaacattg

SEQ ID NO: 8227015 - DNA, 22 bp, Homo sapiens
attcaaagcccagtaaacattg

SEQ ID NO: 8227016 - DNA, 22 bp, Homo sapiens
attcaaagagctgccagaactg

SEQ ID NO: 8227017 - DNA, 22 bp, Homo sapiens
attcaaagatcatgatctctac

SEQ ID NO: 8227018 - DNA, 22 bp, Homo sapiens
attcacacatactcatgtgtga

SEQ ID NO: 8227019 - DNA, 22 bp, Homo sapiens
attcacactgtatacacaggat

SEQ ID NO: 8227020 - DNA, 22 bp, Homo sapiens
attcacagagtggttagtggta

SEQ ID NO: 8227021 - DNA, 22 bp, Homo sapiens
attcacagaatagttttaccag

SEQ ID NO: 8227022 - DNA, 22 bp, Homo sapiens
attataaatattttctaggggt

SEQ ID NO: 8227023 - DNA, 22 bp, Homo sapiens
attataaatattttctaggggt

SEQ ID NO: 8227024 - DNA, 22 bp, Homo sapiens
attatacattttgtgtagagat

SEQ ID NO: 8227025 - DNA, 22 bp, Homo sapiens
attatacattttgtgtagagat

SEQ ID NO: 8227026 - DNA, 22 bp, Homo sapiens
attatacattttgtgtagagat

SEQ ID NO: 8227027 - DNA, 22 bp, Homo sapiens
attataaacctttgagggtggg

SEQ ID NO: 8227028 - DNA, 22 bp, Homo sapiens
attataaacctttgagggtggg

SEQ ID NO: 8227029 - DNA, 22 bp, Homo sapiens
attataaacctttgagggtggg

SEQ ID NO: 8227030 - DNA, 22 bp, Homo sapiens
attataaagaacatgtgtgtgg

SEQ ID NO: 8227031 - DNA, 22 bp, Homo sapiens
attataaagaacatgtgtgtgg

SEQ ID NO: 8227032 - DNA, 22 bp, Homo sapiens
attataaagaacatgtgtgtgg

SEQ ID NO: 8227033 - DNA, 22 bp, Homo sapiens
attataaagaacatgtgtgtgg

SEQ ID NO: 8227034 - DNA, 22 bp, Homo sapiens
atttaagattgcgtattcatgt

SEQ ID NO: 8227035 - DNA, 23 bp, Homo sapiens
atttaatgctgagttgaatgtta

SEQ ID NO: 8227036 - DNA, 18 bp, Homo sapiens
atttaatgaactgaaagc

SEQ ID NO: 8227037 - DNA, 18 bp, Homo sapiens
atttaatgaactgaaagc

SEQ ID NO: 8227038 - DNA, 22 bp, Homo sapiens
agagtggcttctttgacatgct

SEQ ID NO: 8227039 - DNA, 22 bp, Homo sapiens
agagtggctctgctgggcacag

SEQ ID NO: 8227040 - DNA, 22 bp, Homo sapiens
agagtggctctgctgggcacag

SEQ ID NO: 8227041 - DNA, 22 bp, Homo sapiens
agagtggctctgctgggcacag

SEQ ID NO: 8227042 - DNA, 17 bp, Homo sapiens
agagtggctaaggctca

SEQ ID NO: 8227043 - DNA, 22 bp, Homo sapiens
agagtggcctggcctggggcat

SEQ ID NO: 8227044 - DNA, 23 bp, Homo sapiens
agagtggcctactcacactcatt

SEQ ID NO: 8227045 - DNA, 22 bp, Homo sapiens
agagtggcctggcctggggcat

SEQ ID NO: 8227046 - DNA, 22 bp, Homo sapiens
agagtggcccgttggcctgaac

SEQ ID NO: 8227047 - DNA, 23 bp, Homo sapiens
atttaatgctgagttgaatgtta

SEQ ID NO: 8227048 - DNA, 19 bp, Homo sapiens
attcttctcttcctgctgt

SEQ ID NO: 8227049 - DNA, 22 bp, Homo sapiens
attgttaataactattacattg

SEQ ID NO: 8227050 - DNA, 19 bp, Homo sapiens
attcttctcttcctgctgt

SEQ ID NO: 8227051 - DNA, 19 bp, Homo sapiens
attcttctcttcctgctgt

SEQ ID NO: 8227052 - DNA, 22 bp, Homo sapiens
attgttaataactattacattg

SEQ ID NO: 8227053 - DNA, 22 bp, Homo sapiens
atttaaattttctgatggagag

SEQ ID NO: 8227054 - DNA, 22 bp, Homo sapiens
atttaaattttctgatggagag

SEQ ID NO: 8227055 - DNA, 22 bp, Homo sapiens
atttaagactgacttcaccagt

SEQ ID NO: 8227056 - DNA, 22 bp, Homo sapiens
atttaagactgacttcaccagt

SEQ ID NO: 8227057 - DNA, 22 bp, Homo sapiens
atttaacaagacagagaactgg

SEQ ID NO: 8227058 - DNA, 22 bp, Homo sapiens
atttaagattgcgtattcatgt

SEQ ID NO: 8227059 - DNA, 22 bp, Homo sapiens
atttaagattgcgtattcatgt

SEQ ID NO: 8227060 - DNA, 22 bp, Homo sapiens
attcttcatttactgttacttg

SEQ ID NO: 8227061 - DNA, 22 bp, Homo sapiens
attcttcatttactgttacttg

SEQ ID NO: 8227062 - DNA, 19 bp, Homo sapiens
attcttctcaaatatccat

SEQ ID NO: 8227063 - DNA, 22 bp, Homo sapiens
attcttctcccttagggcccag

SEQ ID NO: 8227064 - DNA, 23 bp, Homo sapiens
attcttcattatcttctagaaaa

SEQ ID NO: 8227065 - DNA, 23 bp, Homo sapiens
attcttcattatcttctagaaaa

SEQ ID NO: 8227066 - DNA, 23 bp, Homo sapiens
attcttcattatcttctagaaaa

SEQ ID NO: 8227067 - DNA, 23 bp, Homo sapiens
attcttcattatcttctagaaaa

SEQ ID NO: 8227068 - DNA, 23 bp, Homo sapiens
attcttcattatcttctagaaaa

SEQ ID NO: 8227069 - DNA, 23 bp, Homo sapiens
attcttcattatcttctagaaaa

SEQ ID NO: 8227070 - DNA, 22 bp, Homo sapiens
attcttcatgttgaagctgtca

SEQ ID NO: 8227071 - DNA, 22 bp, Homo sapiens
agaggtatatattctccatatt

SEQ ID NO: 8227072 - DNA, 22 bp, Homo sapiens
agaggtatatattctccatatt

SEQ ID NO: 8227073 - DNA, 22 bp, Homo sapiens
agaggtagaggttgcagtgagc

SEQ ID NO: 8227074 - DNA, 22 bp, Homo sapiens
agaggtagaggttgcagtgagc

SEQ ID NO: 8227075 - DNA, 22 bp, Homo sapiens
attcttcatacagacaagtcct

SEQ ID NO: 8227076 - DNA, 22 bp, Homo sapiens
agaggtatgtgtcagtgcttat

SEQ ID NO: 8227077 - DNA, 22 bp, Homo sapiens
attcttcatacagacaagtcct

SEQ ID NO: 8227078 - DNA, 22 bp, Homo sapiens
attcttcatacctactgaggtt

SEQ ID NO: 8227079 - DNA, 22 bp, Homo sapiens
agagggtgggcacgtgatggat

SEQ ID NO: 8227080 - DNA, 22 bp, Homo sapiens
agagggtggtgaggcctggttc

SEQ ID NO: 8227081 - DNA, 22 bp, Homo sapiens
agagggtggtgaggcctggttc

SEQ ID NO: 8227082 - DNA, 22 bp, Homo sapiens
agagggtggtgaggcctggttc

SEQ ID NO: 8227083 - DNA, 22 bp, Homo sapiens
atttagtgtatcaatgtgatat

SEQ ID NO: 8227084 - DNA, 22 bp, Homo sapiens
atttagtgtattctaatatgtg

SEQ ID NO: 8227085 - DNA, 22 bp, Homo sapiens
atttagtgacctgaactgaaac

SEQ ID NO: 8227086 - DNA, 22 bp, Homo sapiens
atttattatgggatttggctca

SEQ ID NO: 8227087 - DNA, 22 bp, Homo sapiens
atttattatgggatttggctca

SEQ ID NO: 8227088 - DNA, 22 bp, Homo sapiens
atttattatgggatttggctca

SEQ ID NO: 8227089 - DNA, 22 bp, Homo sapiens
atttagtgaaacccataaagca

SEQ ID NO: 8227090 - DNA, 22 bp, Homo sapiens
atttagtaagtacttgttgaat

SEQ ID NO: 8227091 - DNA, 22 bp, Homo sapiens
atttagtagagaaattaagaaa

SEQ ID NO: 8227092 - DNA, 17 bp, Homo sapiens
atttagcaagtagacag

SEQ ID NO: 8227093 - DNA, 17 bp, Homo sapiens
atttagcaagtagacag

SEQ ID NO: 8227094 - DNA, 22 bp, Homo sapiens
atttattgaacactgactatgt

SEQ ID NO: 8227095 - DNA, 22 bp, Homo sapiens
atttattgaacactgactatgt

SEQ ID NO: 8227096 - DNA, 22 bp, Homo sapiens
atttattgaacactgactatgt

SEQ ID NO: 8227097 - DNA, 22 bp, Homo sapiens
atttattgaacactgactatgt

SEQ ID NO: 8227098 - DNA, 22 bp, Homo sapiens
atttattgaacactgactatgt

SEQ ID NO: 8227099 - DNA, 22 bp, Homo sapiens
atttattgaacactgactatgt

SEQ ID NO: 8227100 - DNA, 22 bp, Homo sapiens
atttattgaacactgactatgt

SEQ ID NO: 8227101 - DNA, 22 bp, Homo sapiens
atttattctccagatggcgaga

SEQ ID NO: 8227102 - DNA, 22 bp, Homo sapiens
atttattcctttatggctggag

SEQ ID NO: 8227103 - DNA, 22 bp, Homo sapiens
atttattcctttatggctggag

SEQ ID NO: 8227104 - DNA, 22 bp, Homo sapiens
atttattctccagatggcgaga

SEQ ID NO: 8227105 - DNA, 22 bp, Homo sapiens
atttattattgtggttacttct

SEQ ID NO: 8227106 - DNA, 22 bp, Homo sapiens
atttattattgtggttacttct

SEQ ID NO: 8227107 - DNA, 22 bp, Homo sapiens
atttattattgtggttacttct

SEQ ID NO: 8227108 - DNA, 22 bp, Homo sapiens
atttattattgtggttacttct

SEQ ID NO: 8227109 - DNA, 22 bp, Homo sapiens
atttattcctgattcctggctt

SEQ ID NO: 8227110 - DNA, 22 bp, Homo sapiens
atttattcctgattcctggctt

SEQ ID NO: 8227111 - DNA, 22 bp, Homo sapiens
atttattattgtggttacttct

SEQ ID NO: 8227112 - DNA, 22 bp, Homo sapiens
atttattattgtggttacttct

SEQ ID NO: 8227113 - DNA, 22 bp, Homo sapiens
atttattattgtggttacttct

SEQ ID NO: 8227114 - DNA, 22 bp, Homo sapiens
agagtgggcctctgagtcccag

SEQ ID NO: 8227115 - DNA, 22 bp, Homo sapiens
agagtggggaaggtgttgagaa

SEQ ID NO: 8227116 - DNA, 22 bp, Homo sapiens
agagtggggaaggtgttgagaa

SEQ ID NO: 8227117 - DNA, 22 bp, Homo sapiens
agagtgggacacgggcgctgtc

SEQ ID NO: 8227118 - DNA, 22 bp, Homo sapiens
agagtggcttgctcagctagca

SEQ ID NO: 8227119 - DNA, 22 bp, Homo sapiens
agagtgggcaggagcctcgact

SEQ ID NO: 8227120 - DNA, 22 bp, Homo sapiens
agagtgggacacgggcgctgtc

SEQ ID NO: 8227121 - DNA, 22 bp, Homo sapiens
agagtgggacacgggcgctgtc

SEQ ID NO: 8227122 - DNA, 22 bp, Homo sapiens
atttagcaaaaaatgatgaagc

SEQ ID NO: 8227123 - DNA, 22 bp, Homo sapiens
atttagcaagagtacaaaataa

SEQ ID NO: 8227124 - DNA, 22 bp, Homo sapiens
atttagagtgaaacattatgca

SEQ ID NO: 8227125 - DNA, 22 bp, Homo sapiens
atttagagaataagacataaat

SEQ ID NO: 8227126 - DNA, 22 bp, Homo sapiens
atttagcaagagtacaaaataa

SEQ ID NO: 8227127 - DNA, 22 bp, Homo sapiens
atttagcaagagtacaaaataa

SEQ ID NO: 8227128 - DNA, 22 bp, Homo sapiens
atttagcaagcaggcaaattca

SEQ ID NO: 8227129 - DNA, 22 bp, Homo sapiens
atttagcaagagtacaaaataa

SEQ ID NO: 8227130 - DNA, 22 bp, Homo sapiens
atttagaagttggagggcaaga

SEQ ID NO: 8227131 - DNA, 23 bp, Homo sapiens
atttacaggttaaatgaaatcag

SEQ ID NO: 8227132 - DNA, 23 bp, Homo sapiens
atttacaggttaaatgaaatcag

SEQ ID NO: 8227133 - DNA, 23 bp, Homo sapiens
atttacaggttaaatgaaatcag

SEQ ID NO: 8227134 - DNA, 23 bp, Homo sapiens
atttacaggttaaatgaaatcag

SEQ ID NO: 8227135 - DNA, 18 bp, Homo sapiens
agatgaaagcaaatgaca

SEQ ID NO: 8227136 - DNA, 18 bp, Homo sapiens
agatgaaagcaaatgaca

SEQ ID NO: 8227137 - DNA, 18 bp, Homo sapiens
agatgaaagcaaatgaca

SEQ ID NO: 8227138 - DNA, 22 bp, Homo sapiens
agatgaaaatacgtgactttaa

SEQ ID NO: 8227139 - DNA, 22 bp, Homo sapiens
agatgaaagatttttatagaga

SEQ ID NO: 8227140 - DNA, 22 bp, Homo sapiens
agatgaaaagataagcagcaat

SEQ ID NO: 8227141 - DNA, 22 bp, Homo sapiens
agatgaaaatacgtgactttaa

SEQ ID NO: 8227142 - DNA, 22 bp, Homo sapiens
agatgaaaatacgtgactttaa

SEQ ID NO: 8227143 - DNA, 22 bp, Homo sapiens
atttattgaagcttattacgtt

SEQ ID NO: 8227144 - DNA, 22 bp, Homo sapiens
atttattgaagcttattacgtt

SEQ ID NO: 8227145 - DNA, 21 bp, Homo sapiens
agatccagtgccataaggccc

SEQ ID NO: 8227146 - DNA, 22 bp, Homo sapiens
agatccagggttggatttgcat

SEQ ID NO: 8227147 - DNA, 22 bp, Homo sapiens
agatgaagatatctgcaggggc

SEQ ID NO: 8227148 - DNA, 22 bp, Homo sapiens
agatgaagatatctgcaggggc

SEQ ID NO: 8227149 - DNA, 22 bp, Homo sapiens
agatgaagatatctgcaggggc

SEQ ID NO: 8227150 - DNA, 22 bp, Homo sapiens
atttcattgaagttaattcttc

SEQ ID NO: 8227151 - DNA, 22 bp, Homo sapiens
atttcattgaagttaattcttc

SEQ ID NO: 8227152 - DNA, 22 bp, Homo sapiens
atttcattgaagttaattcttc

SEQ ID NO: 8227153 - DNA, 22 bp, Homo sapiens
atttcattgaagttaattcttc

SEQ ID NO: 8227154 - DNA, 22 bp, Homo sapiens
agatgaattgatgttggacaga

SEQ ID NO: 8227155 - DNA, 22 bp, Homo sapiens
atttccaaggtaattttgagta

SEQ ID NO: 8227156 - DNA, 22 bp, Homo sapiens
atttccaatttcatccatgtcc

SEQ ID NO: 8227157 - DNA, 22 bp, Homo sapiens
atttccacataagggaaataag

SEQ ID NO: 8227158 - DNA, 22 bp, Homo sapiens
atttccaatttcatccatgtcc

SEQ ID NO: 8227159 - DNA, 22 bp, Homo sapiens
atttccaatctctgcatatggg

SEQ ID NO: 8227160 - DNA, 22 bp, Homo sapiens
atttccacataagggaaataag

SEQ ID NO: 8227161 - DNA, 21 bp, Homo sapiens
atttccacataatcataagac

SEQ ID NO: 8227162 - DNA, 22 bp, Homo sapiens
atttccaccatctctctgggcc

SEQ ID NO: 8227163 - DNA, 22 bp, Homo sapiens
atttccaccggctcaggaagtt

SEQ ID NO: 8227164 - DNA, 22 bp, Homo sapiens
atttccagactttttccaggaa

SEQ ID NO: 8227165 - DNA, 22 bp, Homo sapiens
atttccagaccaggtctcaccc

SEQ ID NO: 8227166 - DNA, 22 bp, Homo sapiens
atttccagaccaggtctcaccc

SEQ ID NO: 8227167 - DNA, 22 bp, Homo sapiens
atttccaccggctcaggaagtt

SEQ ID NO: 8227168 - DNA, 22 bp, Homo sapiens
atttccagaatagaaggttctc

SEQ ID NO: 8227169 - DNA, 22 bp, Homo sapiens
atttccagaatagaaggttctc

SEQ ID NO: 8227170 - DNA, 22 bp, Homo sapiens
atttccaaaaccacttattgcc

SEQ ID NO: 8227171 - DNA, 19 bp, Homo sapiens
atttccaagaattggagag

SEQ ID NO: 8227172 - DNA, 22 bp, Homo sapiens
agatggtgtttccccaggtgga

SEQ ID NO: 8227173 - DNA, 20 bp, Homo sapiens
agatggtgggctggaacacc

SEQ ID NO: 8227174 - DNA, 20 bp, Homo sapiens
agatggtgggctggaacacc

SEQ ID NO: 8227175 - DNA, 22 bp, Homo sapiens
agatgtaagaccttcatgaggg

SEQ ID NO: 8227176 - DNA, 22 bp, Homo sapiens
agatggtgatagagctgggatt

SEQ ID NO: 8227177 - DNA, 22 bp, Homo sapiens
agatggtgagggcagaagtaac

SEQ ID NO: 8227178 - DNA, 20 bp, Homo sapiens
agatggtgaaggccagggag

SEQ ID NO: 8227179 - DNA, 22 bp, Homo sapiens
agatggtagactatggaacgta

SEQ ID NO: 8227180 - DNA, 22 bp, Homo sapiens
agcaaacagtgtgctaagaaat

SEQ ID NO: 8227181 - DNA, 22 bp, Homo sapiens
agcaaacagtttctggggatct

SEQ ID NO: 8227182 - DNA, 22 bp, Homo sapiens
agcaaacattcagcagattggc

SEQ ID NO: 8227183 - DNA, 22 bp, Homo sapiens
agcaaacagtttctggggatct

SEQ ID NO: 8227184 - DNA, 20 bp, Homo sapiens
agcaaaatgcaagattttca

SEQ ID NO: 8227185 - DNA, 22 bp, Homo sapiens
agcaaacacaagaggtaatttc

SEQ ID NO: 8227186 - DNA, 22 bp, Homo sapiens
agcaaacagatgtctcctttag

SEQ ID NO: 8227187 - DNA, 20 bp, Homo sapiens
agcaaacaggctccaccaga

SEQ ID NO: 8227188 - DNA, 22 bp, Homo sapiens
agcaaaataaggtaatttattg

SEQ ID NO: 8227189 - DNA, 20 bp, Homo sapiens
agcaaaatgcaagattttca

SEQ ID NO: 8227190 - DNA, 22 bp, Homo sapiens
agcaaaataaggtaatttattg

SEQ ID NO: 8227191 - DNA, 22 bp, Homo sapiens
atttgctttcaggtataaaagg

SEQ ID NO: 8227192 - DNA, 22 bp, Homo sapiens
atttgctttaaggtataaaagg

SEQ ID NO: 8227193 - DNA, 22 bp, Homo sapiens
agcaaaataaggtaatttattg

SEQ ID NO: 8227194 - DNA, 17 bp, Homo sapiens
agcaaaagtatcaaagc

SEQ ID NO: 8227195 - DNA, 22 bp, Homo sapiens
atttgctgccagtgtacactta

SEQ ID NO: 8227196 - DNA, 22 bp, Homo sapiens
atttgctggtgaatgtatagct

SEQ ID NO: 8227197 - DNA, 20 bp, Homo sapiens
atttgctgtcagtccctagg

SEQ ID NO: 8227198 - DNA, 22 bp, Homo sapiens
atttgctgtttctctggccaca

SEQ ID NO: 8227199 - DNA, 22 bp, Homo sapiens
atttgctgtgtgctttagagac

SEQ ID NO: 8227200 - DNA, 19 bp, Homo sapiens
atttgctgcaatgcttcac

SEQ ID NO: 8227201 - DNA, 22 bp, Homo sapiens
atttgctgatggcatttgagct

SEQ ID NO: 8227202 - DNA, 22 bp, Homo sapiens
agatgtaaactctcatgtcatt

SEQ ID NO: 8227203 - DNA, 22 bp, Homo sapiens
agatgtgactgggcaagttact

SEQ ID NO: 8227204 - DNA, 22 bp, Homo sapiens
agatgtgagaatcaagtgacca

SEQ ID NO: 8227205 - DNA, 22 bp, Homo sapiens
agatgtgaatgaattctgctgg

SEQ ID NO: 8227206 - DNA, 22 bp, Homo sapiens
agatgtgatgttaggcccttgg

SEQ ID NO: 8227207 - DNA, 22 bp, Homo sapiens
agatgtgatgttaggcccttgg

SEQ ID NO: 8227208 - DNA, 22 bp, Homo sapiens
agatgtgagtggctgtacagtg

SEQ ID NO: 8227209 - DNA, 22 bp, Homo sapiens
agatgtgattcctgctgagctg

SEQ ID NO: 8227210 - DNA, 22 bp, Homo sapiens
agatgtgatctgttcaggacaa

SEQ ID NO: 8227211 - DNA, 22 bp, Homo sapiens
agatgtgagtggctgtacagtg

SEQ ID NO: 8227212 - DNA, 22 bp, Homo sapiens
atttgcttcctaatactcatat

SEQ ID NO: 8227213 - DNA, 19 bp, Homo sapiens
atttgcttgtctgctctgc

SEQ ID NO: 8227214 - DNA, 22 bp, Homo sapiens
atttgcttgactatggcttgca

SEQ ID NO: 8227215 - DNA, 22 bp, Homo sapiens
atttgcttgtaaatgtatgcct

SEQ ID NO: 8227216 - DNA, 22 bp, Homo sapiens
acttcaaattttcagaagaaat

SEQ ID NO: 8227217 - DNA, 22 bp, Homo sapiens
acttcaaattttcagaagaaat

SEQ ID NO: 8227218 - DNA, 22 bp, Homo sapiens
acttcacaaagagatcatctaa

SEQ ID NO: 8227219 - DNA, 22 bp, Homo sapiens
acttcagaaaatgttgaatgtt

SEQ ID NO: 8227220 - DNA, 22 bp, Homo sapiens
acttcagagactttatggtcca

SEQ ID NO: 8227221 - DNA, 19 bp, Homo sapiens
acttcagcagggttcctgt

SEQ ID NO: 8227222 - DNA, 22 bp, Homo sapiens
acttcacaggttttcataaaac

SEQ ID NO: 8227223 - DNA, 18 bp, Homo sapiens
actgttatctgataaggc

SEQ ID NO: 8227224 - DNA, 22 bp, Homo sapiens
actgttatgatttacacagtcc

SEQ ID NO: 8227225 - DNA, 22 bp, Homo sapiens
actgttatgggtgtcagcttaa

SEQ ID NO: 8227226 - DNA, 22 bp, Homo sapiens
acttagaattaaatatttttgg

SEQ ID NO: 8227227 - DNA, 22 bp, Homo sapiens
acttatttcatggatcataatg

SEQ ID NO: 8227228 - DNA, 22 bp, Homo sapiens
acttagaattaaatatttttgg

SEQ ID NO: 8227229 - DNA, 22 bp, Homo sapiens
acttcaaatgtgacaatgtgaa

SEQ ID NO: 8227230 - DNA, 19 bp, Homo sapiens
acttcaaatcttagagaaa

SEQ ID NO: 8227231 - DNA, 22 bp, Homo sapiens
acttcaaacaattaacagagaa

SEQ ID NO: 8227232 - DNA, 22 bp, Homo sapiens
acttcaaacaattaacagagaa

SEQ ID NO: 8227233 - DNA, 21 bp, Homo sapiens
actgttaagacgtagctgggg

SEQ ID NO: 8227234 - DNA, 22 bp, Homo sapiens
actgttacagagcaggaaattg

SEQ ID NO: 8227235 - DNA, 22 bp, Homo sapiens
actgttaattcaatcaacaggt

SEQ ID NO: 8227236 - DNA, 22 bp, Homo sapiens
actgtgtggaccactctgaggc

SEQ ID NO: 8227237 - DNA, 22 bp, Homo sapiens
actgtgtggaccactctgaggc

SEQ ID NO: 8227238 - DNA, 22 bp, Homo sapiens
actgtgtggaccactctgaggc

SEQ ID NO: 8227239 - DNA, 22 bp, Homo sapiens
actgtgtgggccgctcactggg

SEQ ID NO: 8227240 - DNA, 22 bp, Homo sapiens
actgtgtgggccgctcactggg

SEQ ID NO: 8227241 - DNA, 22 bp, Homo sapiens
actgtgtgtttgtctagcacag

SEQ ID NO: 8227242 - DNA, 22 bp, Homo sapiens
actgtgttcacacttacaaatg

SEQ ID NO: 8227243 - DNA, 22 bp, Homo sapiens
actgtgtgtttgtctagcacag

SEQ ID NO: 8227244 - DNA, 22 bp, Homo sapiens
actgtgtgctggacatgatgtt

SEQ ID NO: 8227245 - DNA, 22 bp, Homo sapiens
actgtgtggaaatttgtgaggg

SEQ ID NO: 8227246 - DNA, 22 bp, Homo sapiens
actgtgtgactgttattactgt

SEQ ID NO: 8227247 - DNA, 22 bp, Homo sapiens
actgtgtgccctgacgccaggg

SEQ ID NO: 8227248 - DNA, 22 bp, Homo sapiens
actgtgtgccctgacgccaggg

SEQ ID NO: 8227249 - DNA, 22 bp, Homo sapiens
actgtgtgccaggcgctggtct

SEQ ID NO: 8227250 - DNA, 22 bp, Homo sapiens
actgtgtcctcatgtggcagaa

SEQ ID NO: 8227251 - DNA, 22 bp, Homo sapiens
actgtgtctagcaccacgtgtc

SEQ ID NO: 8227252 - DNA, 22 bp, Homo sapiens
actgtgtcctatttccttgaca

SEQ ID NO: 8227253 - DNA, 18 bp, Homo sapiens
actgtgtgaattagctcc

SEQ ID NO: 8227254 - DNA, 18 bp, Homo sapiens
actgtgtgaattagctcc

SEQ ID NO: 8227255 - DNA, 22 bp, Homo sapiens
actgtgtctcattcatcattgt

SEQ ID NO: 8227256 - DNA, 22 bp, Homo sapiens
actgtgtgaaacatcaatgtgt

SEQ ID NO: 8227257 - DNA, 22 bp, Homo sapiens
acttggaatattgcgtttttgc

SEQ ID NO: 8227258 - DNA, 22 bp, Homo sapiens
acttggagagcattgctgggga

SEQ ID NO: 8227259 - DNA, 22 bp, Homo sapiens
acttgggaaagaagtttcaccg

SEQ ID NO: 8227260 - DNA, 22 bp, Homo sapiens
acttggcttttccatctctgca

SEQ ID NO: 8227261 - DNA, 20 bp, Homo sapiens
acttggaactcatttttctt

SEQ ID NO: 8227262 - DNA, 22 bp, Homo sapiens
acttggaaaattcaaaatggca

SEQ ID NO: 8227263 - DNA, 22 bp, Homo sapiens
acttgctggtggcatttacagt

SEQ ID NO: 8227264 - DNA, 20 bp, Homo sapiens
acttgctgggctttgttacc

SEQ ID NO: 8227265 - DNA, 22 bp, Homo sapiens
acttgctcaatgcttgaagcca

SEQ ID NO: 8227266 - DNA, 22 bp, Homo sapiens
acttgccccagaattgctgctg

SEQ ID NO: 8227267 - DNA, 22 bp, Homo sapiens
acttgccagctaaagcctggtg

SEQ ID NO: 8227268 - DNA, 22 bp, Homo sapiens
acttcattcattttcacgaatg

SEQ ID NO: 8227269 - DNA, 22 bp, Homo sapiens
acttcattgctaagaacaaggt

SEQ ID NO: 8227270 - DNA, 22 bp, Homo sapiens
acttcatttcatttgcacagtg

SEQ ID NO: 8227271 - DNA, 22 bp, Homo sapiens
acttcatttcatttgcacagtg

SEQ ID NO: 8227272 - DNA, 22 bp, Homo sapiens
acttcatttcatttgcacagtg

SEQ ID NO: 8227273 - DNA, 22 bp, Homo sapiens
acttcattgtaatattatagca

SEQ ID NO: 8227274 - DNA, 22 bp, Homo sapiens
acttcattgtaatattatagca

SEQ ID NO: 8227275 - DNA, 22 bp, Homo sapiens
acttcatgctttagagagatga

SEQ ID NO: 8227276 - DNA, 22 bp, Homo sapiens
acttcatgcagaagagagctgt

SEQ ID NO: 8227277 - DNA, 22 bp, Homo sapiens
acttctttcacaatgtttctag

SEQ ID NO: 8227278 - DNA, 22 bp, Homo sapiens
acttccagatggccccatctaa

SEQ ID NO: 8227279 - DNA, 22 bp, Homo sapiens
acttctttcacaatgtttctag

SEQ ID NO: 8227280 - DNA, 21 bp, Homo sapiens
actgtgaagatgctataaact

SEQ ID NO: 8227281 - DNA, 20 bp, Homo sapiens
actgtgaatgctgaattagc

SEQ ID NO: 8227282 - DNA, 22 bp, Homo sapiens
actgtgaatcactactagtaga

SEQ ID NO: 8227283 - DNA, 22 bp, Homo sapiens
actgtgaatcactactagtaga

SEQ ID NO: 8227284 - DNA, 22 bp, Homo sapiens
actgtcttcatatctgtgtctc

SEQ ID NO: 8227285 - DNA, 22 bp, Homo sapiens
actgtcttccaggtctggaggt

SEQ ID NO: 8227286 - DNA, 22 bp, Homo sapiens
actgtcttgtgttaaagaacca

SEQ ID NO: 8227287 - DNA, 22 bp, Homo sapiens
actgtctttattagaatcttat

SEQ ID NO: 8227288 - DNA, 22 bp, Homo sapiens
actgtctttgagctggaggagg

SEQ ID NO: 8227289 - DNA, 17 bp, Homo sapiens
actgtcttttacaccct

SEQ ID NO: 8227290 - DNA, 22 bp, Homo sapiens
actgtcttgttccaagactaaa

SEQ ID NO: 8227291 - DNA, 22 bp, Homo sapiens
actgtcttgttccaagactaaa

SEQ ID NO: 8227292 - DNA, 22 bp, Homo sapiens
actgtaaattacataagaacag

SEQ ID NO: 8227293 - DNA, 22 bp, Homo sapiens
actgtcatgatcgaagatgtca

SEQ ID NO: 8227294 - DNA, 22 bp, Homo sapiens
actgtaaagttacgatcaagtt

SEQ ID NO: 8227295 - DNA, 22 bp, Homo sapiens
actgtaaaggtttgtagcccag

SEQ ID NO: 8227296 - DNA, 22 bp, Homo sapiens
actgtcatgatcgaagatgtca

SEQ ID NO: 8227297 - DNA, 22 bp, Homo sapiens
actgtcttcaaatgaatatatt

SEQ ID NO: 8227298 - DNA, 22 bp, Homo sapiens
actgtcttcaaatgaatatatt

SEQ ID NO: 8227299 - DNA, 22 bp, Homo sapiens
actgtcttcaaatgaatatatt

SEQ ID NO: 8227300 - DNA, 21 bp, Homo sapiens
actgtgactgggtgtatgggt

SEQ ID NO: 8227301 - DNA, 20 bp, Homo sapiens
actgtgaatgctgaattagc

SEQ ID NO: 8227302 - DNA, 22 bp, Homo sapiens
agtttcatgtagccatatttac

SEQ ID NO: 8227303 - DNA, 22 bp, Homo sapiens
agtttcatgtagccatatttac

SEQ ID NO: 8227304 - DNA, 22 bp, Homo sapiens
agtttcatgtagccatatttac

SEQ ID NO: 8227305 - DNA, 22 bp, Homo sapiens
agtttcattgagatgtttgcta

SEQ ID NO: 8227306 - DNA, 23 bp, Homo sapiens
agtttccacccagggtagaaggg

SEQ ID NO: 8227307 - DNA, 22 bp, Homo sapiens
agtttcatttcttagtaccagt

SEQ ID NO: 8227308 - DNA, 22 bp, Homo sapiens
agtttcctcatctgtaaaatga

SEQ ID NO: 8227309 - DNA, 21 bp, Homo sapiens
agtttcctcaactgcagaagg

SEQ ID NO: 8227310 - DNA, 22 bp, Homo sapiens
actgtgggtcccagctgtgtct

SEQ ID NO: 8227311 - DNA, 22 bp, Homo sapiens
actgtggggttcctggtacttg

SEQ ID NO: 8227312 - DNA, 22 bp, Homo sapiens
actgtggggttcctggtacttg

SEQ ID NO: 8227313 - DNA, 22 bp, Homo sapiens
actgtgggtcccagctgtgtct

SEQ ID NO: 8227314 - DNA, 22 bp, Homo sapiens
actgtgggtgagggcaaatcaa

SEQ ID NO: 8227315 - DNA, 22 bp, Homo sapiens
actgtggtgcacggcctgctcc

SEQ ID NO: 8227316 - DNA, 21 bp, Homo sapiens
actgtgggtctgaccacctgg

SEQ ID NO: 8227317 - DNA, 21 bp, Homo sapiens
actgtgggtctgaccacctgg

SEQ ID NO: 8227318 - DNA, 22 bp, Homo sapiens
actgtgggtgagggcaaatcaa

SEQ ID NO: 8227319 - DNA, 22 bp, Homo sapiens
actgtgtatgatatgtactggg

SEQ ID NO: 8227320 - DNA, 20 bp, Homo sapiens
actgtgtaaacatgattcat

SEQ ID NO: 8227321 - DNA, 20 bp, Homo sapiens
actgtgtaaacatgattcat

SEQ ID NO: 8227322 - DNA, 22 bp, Homo sapiens
actgtgtattctaatgactaaa

SEQ ID NO: 8227323 - DNA, 22 bp, Homo sapiens
actggcagggggagccccgaga

SEQ ID NO: 8227324 - DNA, 22 bp, Homo sapiens
actggcaggtccatcgcccttt

SEQ ID NO: 8227325 - DNA, 22 bp, Homo sapiens
actggcagtagagggagcgcat

SEQ ID NO: 8227326 - DNA, 22 bp, Homo sapiens
actggcaggtccatcgcccttt

SEQ ID NO: 8227327 - DNA, 19 bp, Homo sapiens
actggcagggctgcggtgg

SEQ ID NO: 8227328 - DNA, 19 bp, Homo sapiens
actggcagggctgcggtgg

SEQ ID NO: 8227329 - DNA, 22 bp, Homo sapiens
actggcagggggagccccgaga

SEQ ID NO: 8227330 - DNA, 22 bp, Homo sapiens
actggcagtggcagcagaaaga

SEQ ID NO: 8227331 - DNA, 22 bp, Homo sapiens
actggcagtggcagcagaaaga

SEQ ID NO: 8227332 - DNA, 22 bp, Homo sapiens
actggcagtagagggagcgcat

SEQ ID NO: 8227333 - DNA, 22 bp, Homo sapiens
actggcagtagagggagcgcat

SEQ ID NO: 8227334 - DNA, 22 bp, Homo sapiens
actggcaggctgctggccggcg

SEQ ID NO: 8227335 - DNA, 19 bp, Homo sapiens
actggcagctgtagtctgt

SEQ ID NO: 8227336 - DNA, 22 bp, Homo sapiens
actggcaggctgctggccggcg

SEQ ID NO: 8227337 - DNA, 22 bp, Homo sapiens
actggcaggctgctggccggcg

SEQ ID NO: 8227338 - DNA, 19 bp, Homo sapiens
actggcagctgtagtctgt

SEQ ID NO: 8227339 - DNA, 22 bp, Homo sapiens
actggcagctgtaggatgcatg

SEQ ID NO: 8227340 - DNA, 22 bp, Homo sapiens
actggcagctgtaggatgcatg

SEQ ID NO: 8227341 - DNA, 20 bp, Homo sapiens
actggcagcctgcctgctgt

SEQ ID NO: 8227342 - DNA, 20 bp, Homo sapiens
actggcagcctgcctgctgt

SEQ ID NO: 8227343 - DNA, 19 bp, Homo sapiens
actggcagtttctgcatgg

SEQ ID NO: 8227344 - DNA, 19 bp, Homo sapiens
actggcagtttctgcatgg

SEQ ID NO: 8227345 - DNA, 22 bp, Homo sapiens
actggcagtgtcgtttacatga

SEQ ID NO: 8227346 - DNA, 22 bp, Homo sapiens
actggcagtgtcgtttacatga

SEQ ID NO: 8227347 - DNA, 22 bp, Homo sapiens
actggcagtttgagaatgcatt

SEQ ID NO: 8227348 - DNA, 22 bp, Homo sapiens
actggcagtttgagaatgcatt

SEQ ID NO: 8227349 - DNA, 19 bp, Homo sapiens
actggcagtttctgcatgg

SEQ ID NO: 8227350 - DNA, 22 bp, Homo sapiens
agttgctcaatgtggctgtgga

SEQ ID NO: 8227351 - DNA, 22 bp, Homo sapiens
agttgctcaatgtggctgtgga

SEQ ID NO: 8227352 - DNA, 22 bp, Homo sapiens
agtttacactatgaaaagacta

SEQ ID NO: 8227353 - DNA, 22 bp, Homo sapiens
agtttacacttttgattcttat

SEQ ID NO: 8227354 - DNA, 22 bp, Homo sapiens
agtttacacttttgattcttat

SEQ ID NO: 8227355 - DNA, 22 bp, Homo sapiens
agtttacactatgaaaagacta

SEQ ID NO: 8227356 - DNA, 22 bp, Homo sapiens
agtttacagatgctacaggagc

SEQ ID NO: 8227357 - DNA, 22 bp, Homo sapiens
agtttacacttttgattcttat

SEQ ID NO: 8227358 - DNA, 22 bp, Homo sapiens
agtttacagatgctacaggagc

SEQ ID NO: 8227359 - DNA, 22 bp, Homo sapiens
agtttacagatgctacaggagc

SEQ ID NO: 8227360 - DNA, 22 bp, Homo sapiens
agtttacagatgtagtaggggt

SEQ ID NO: 8227361 - DNA, 22 bp, Homo sapiens
actggtttttctcatgaaaatg

SEQ ID NO: 8227362 - DNA, 22 bp, Homo sapiens
actgtaaaacaggtttcatcat

SEQ ID NO: 8227363 - DNA, 22 bp, Homo sapiens
actggtttttccatatgagatg

SEQ ID NO: 8227364 - DNA, 22 bp, Homo sapiens
actggttttggaaatcagtaca

SEQ ID NO: 8227365 - DNA, 19 bp, Homo sapiens
agtttatgcagatactggt

SEQ ID NO: 8227366 - DNA, 22 bp, Homo sapiens
actggtttgggacaatttgtgc

SEQ ID NO: 8227367 - DNA, 22 bp, Homo sapiens
agtttatgtaaaattagtaatg

SEQ ID NO: 8227368 - DNA, 22 bp, Homo sapiens
actggttttccaggttacttct

SEQ ID NO: 8227369 - DNA, 22 bp, Homo sapiens
actggtttgtctattgtcattc

SEQ ID NO: 8227370 - DNA, 22 bp, Homo sapiens
actgtaaaatacataagtattg

SEQ ID NO: 8227371 - DNA, 22 bp, Homo sapiens
actgtaaaagaaggtctttgca

SEQ ID NO: 8227372 - DNA, 22 bp, Homo sapiens
actgtaaaactgctttggaaac

SEQ ID NO: 8227373 - DNA, 22 bp, Homo sapiens
actgtaaaatacataagtattg

SEQ ID NO: 8227374 - DNA, 22 bp, Homo sapiens
actgtaaaatgagatatgtata

SEQ ID NO: 8227375 - DNA, 22 bp, Homo sapiens
actgtaaaatgagatatgtata

SEQ ID NO: 8227376 - DNA, 22 bp, Homo sapiens
actgtaaagaagtaagtatggg

SEQ ID NO: 8227377 - DNA, 22 bp, Homo sapiens
agtttacatatttgtcggagtc

SEQ ID NO: 8227378 - DNA, 22 bp, Homo sapiens
agtttacatcttcaatctcatt

SEQ ID NO: 8227379 - DNA, 22 bp, Homo sapiens
agtttacatgacgtgtatttca

SEQ ID NO: 8227380 - DNA, 22 bp, Homo sapiens
agtttacatgacgtgtatttca

SEQ ID NO: 8227381 - DNA, 22 bp, Homo sapiens
agtttacatgacgtgtatttca

SEQ ID NO: 8227382 - DNA, 22 bp, Homo sapiens
agtttatagcccagattcatgg

SEQ ID NO: 8227383 - DNA, 22 bp, Homo sapiens
agtttagtataccagtacatct

SEQ ID NO: 8227384 - DNA, 22 bp, Homo sapiens
agtttagtataccagtacatct

SEQ ID NO: 8227385 - DNA, 22 bp, Homo sapiens
agtttatgattttatgtaagta

SEQ ID NO: 8227386 - DNA, 22 bp, Homo sapiens
agtttatagcccagattcatgg

SEQ ID NO: 8227387 - DNA, 22 bp, Homo sapiens
agtttagaagaggaacttgtta

SEQ ID NO: 8227388 - DNA, 22 bp, Homo sapiens
atcactgtggaaaactgtatgg

SEQ ID NO: 8227389 - DNA, 22 bp, Homo sapiens
atcactgtcgtcatctgagatt

SEQ ID NO: 8227390 - DNA, 22 bp, Homo sapiens
atcactgttatctagaagcaca

SEQ ID NO: 8227391 - DNA, 22 bp, Homo sapiens
atcactgttatctagaagcaca

SEQ ID NO: 8227392 - DNA, 22 bp, Homo sapiens
atcactgtggcccaaaacctca

SEQ ID NO: 8227393 - DNA, 22 bp, Homo sapiens
atcagagctgtgattcccactc

SEQ ID NO: 8227394 - DNA, 22 bp, Homo sapiens
atcagaggacctagttgggcag

SEQ ID NO: 8227395 - DNA, 22 bp, Homo sapiens
atcagaggaagacgacggaatg

SEQ ID NO: 8227396 - DNA, 22 bp, Homo sapiens
atcagaggaaattaactctctc

SEQ ID NO: 8227397 - DNA, 22 bp, Homo sapiens
atcagaggtgttgaaacatgac

SEQ ID NO: 8227398 - DNA, 22 bp, Homo sapiens
atcagaggttatgtggagggga

SEQ ID NO: 8227399 - DNA, 22 bp, Homo sapiens
atcagaggtggaactggggact

SEQ ID NO: 8227400 - DNA, 22 bp, Homo sapiens
atcagaggtgagggagagcccc

SEQ ID NO: 8227401 - DNA, 20 bp, Homo sapiens
atcagaggatagggaagtgg

SEQ ID NO: 8227402 - DNA, 22 bp, Homo sapiens
atcagagggtgagatggagaaa

SEQ ID NO: 8227403 - DNA, 22 bp, Homo sapiens
atcagagggtgagatggagaaa

SEQ ID NO: 8227404 - DNA, 22 bp, Homo sapiens
atcagaggtactttccattttt

SEQ ID NO: 8227405 - DNA, 22 bp, Homo sapiens
atcagagtagttgttgcccaga

SEQ ID NO: 8227406 - DNA, 21 bp, Homo sapiens
atcagagtacgcatgcgctga

SEQ ID NO: 8227407 - DNA, 22 bp, Homo sapiens
atcagagtgtaagttctttcct

SEQ ID NO: 8227408 - DNA, 22 bp, Homo sapiens
atcagatatttaagttatcaac

SEQ ID NO: 8227409 - DNA, 22 bp, Homo sapiens
atcagatatttaagttatcaac

SEQ ID NO: 8227410 - DNA, 22 bp, Homo sapiens
atcagatccataatgacctgtg

SEQ ID NO: 8227411 - DNA, 22 bp, Homo sapiens
atcaccaggcaaaatgtcagag

SEQ ID NO: 8227412 - DNA, 22 bp, Homo sapiens
atcaccagtaagttttcagttt

SEQ ID NO: 8227413 - DNA, 22 bp, Homo sapiens
atcaccattgaaaaacaggttt

SEQ ID NO: 8227414 - DNA, 22 bp, Homo sapiens
atcaccaggcaaaatgtcagag

SEQ ID NO: 8227415 - DNA, 21 bp, Homo sapiens
atcaccagcagaagctgcaga

SEQ ID NO: 8227416 - DNA, 21 bp, Homo sapiens
atcaccagcagaagctgcaga

SEQ ID NO: 8227417 - DNA, 22 bp, Homo sapiens
atcaccactacaaacatcattg

SEQ ID NO: 8227418 - DNA, 22 bp, Homo sapiens
atcacattgttagcatagactg

SEQ ID NO: 8227419 - DNA, 22 bp, Homo sapiens
atcactgagcttcagtgctggc

SEQ ID NO: 8227420 - DNA, 20 bp, Homo sapiens
atcacctgtaggttctttgt

SEQ ID NO: 8227421 - DNA, 22 bp, Homo sapiens
atcaccattgaaaaacaggttt

SEQ ID NO: 8227422 - DNA, 21 bp, Homo sapiens
agaaacatgatcaaaggaacc

SEQ ID NO: 8227423 - DNA, 22 bp, Homo sapiens
agaaacatttagattatatgtc

SEQ ID NO: 8227424 - DNA, 22 bp, Homo sapiens
agaaacatcttggcaactggaa

SEQ ID NO: 8227425 - DNA, 22 bp, Homo sapiens
atcaattttgaggatacaagaa

SEQ ID NO: 8227426 - DNA, 22 bp, Homo sapiens
atcaattttgaggatacaagaa

SEQ ID NO: 8227427 - DNA, 22 bp, Homo sapiens
atcacaaaggctgcttcatgat

SEQ ID NO: 8227428 - DNA, 21 bp, Homo sapiens
atcacattggctgttattatt

SEQ ID NO: 8227429 - DNA, 21 bp, Homo sapiens
atcacattggctgttattatt

SEQ ID NO: 8227430 - DNA, 22 bp, Homo sapiens
agaaacatcattggaacacaag

SEQ ID NO: 8227431 - DNA, 22 bp, Homo sapiens
agaaacatcattggaacacaag

SEQ ID NO: 8227432 - DNA, 22 bp, Homo sapiens
agaaacatcctgctttccattt

SEQ ID NO: 8227433 - DNA, 22 bp, Homo sapiens
agaaacagcattagcatcaatt

SEQ ID NO: 8227434 - DNA, 20 bp, Homo sapiens
agaaacagcacaattctgtt

SEQ ID NO: 8227435 - DNA, 20 bp, Homo sapiens
agaaacagcacaattctgtt

SEQ ID NO: 8227436 - DNA, 22 bp, Homo sapiens
agaaacagaagggaaagctttt

SEQ ID NO: 8227437 - DNA, 22 bp, Homo sapiens
atcagcaagatgtaatttctat

SEQ ID NO: 8227438 - DNA, 22 bp, Homo sapiens
atcagcaagcatttattgagtg

SEQ ID NO: 8227439 - DNA, 19 bp, Homo sapiens
atcagcaaggtaggatgtg

SEQ ID NO: 8227440 - DNA, 22 bp, Homo sapiens
atcatcttgctttctgtttact

SEQ ID NO: 8227441 - DNA, 20 bp, Homo sapiens
atcatctttacaatgtcagt

SEQ ID NO: 8227442 - DNA, 22 bp, Homo sapiens
atcattctctgcttgagcactc

SEQ ID NO: 8227443 - DNA, 22 bp, Homo sapiens
atcattctgatggtcaatgcta

SEQ ID NO: 8227444 - DNA, 22 bp, Homo sapiens
atcattgggctccattactaga

SEQ ID NO: 8227445 - DNA, 22 bp, Homo sapiens
atcattggaggcactgtgcagt

SEQ ID NO: 8227446 - DNA, 22 bp, Homo sapiens
atcatttaaaacaagtctctat

SEQ ID NO: 8227447 - DNA, 21 bp, Homo sapiens
atcattctggaaaattcaagc

SEQ ID NO: 8227448 - DNA, 22 bp, Homo sapiens
atcatttacaaactcagcattg

SEQ ID NO: 8227449 - DNA, 22 bp, Homo sapiens
atcatttacaaactcagcattg

SEQ ID NO: 8227450 - DNA, 22 bp, Homo sapiens
atcatttacaatgaaagcctga

SEQ ID NO: 8227451 - DNA, 22 bp, Homo sapiens
atcatttacaaactcagcattg

SEQ ID NO: 8227452 - DNA, 22 bp, Homo sapiens
atcatttacaaactcagcattg

SEQ ID NO: 8227453 - DNA, 22 bp, Homo sapiens
atcatttacaatgaaagcctga

SEQ ID NO: 8227454 - DNA, 22 bp, Homo sapiens
atccagagacccaaggacagaa

SEQ ID NO: 8227455 - DNA, 22 bp, Homo sapiens
atccacttgccactgtatagtt

SEQ ID NO: 8227456 - DNA, 22 bp, Homo sapiens
atccacttggctggttgttcta

SEQ ID NO: 8227457 - DNA, 22 bp, Homo sapiens
atcatttgcctcaagtgaaagt

SEQ ID NO: 8227458 - DNA, 22 bp, Homo sapiens
atcatttccctttagatcacaa

SEQ ID NO: 8227459 - DNA, 22 bp, Homo sapiens
atcatttccctttagatcacaa

SEQ ID NO: 8227460 - DNA, 22 bp, Homo sapiens
atcatttgtgcatagtaacaga

SEQ ID NO: 8227461 - DNA, 22 bp, Homo sapiens
atccacttcactggaatgtagg

SEQ ID NO: 8227462 - DNA, 22 bp, Homo sapiens
atccagctttgtctggtcttcg

SEQ ID NO: 8227463 - DNA, 22 bp, Homo sapiens
agaagaaatgaggccgttctgc

SEQ ID NO: 8227464 - DNA, 22 bp, Homo sapiens
agaagaaatgaggccgttctgc

SEQ ID NO: 8227465 - DNA, 22 bp, Homo sapiens
agaacctttctttagaaattca

SEQ ID NO: 8227466 - DNA, 22 bp, Homo sapiens
atccagagaggttaggtgacat

SEQ ID NO: 8227467 - DNA, 22 bp, Homo sapiens
atccagagggtagcaggattag

SEQ ID NO: 8227468 - DNA, 22 bp, Homo sapiens
atccagagtaatacagaatgca

SEQ ID NO: 8227469 - DNA, 22 bp, Homo sapiens
atatacacatgtgtatacattt

SEQ ID NO: 8227470 - DNA, 22 bp, Homo sapiens
actttggtcttagaggaggaat

SEQ ID NO: 8227471 - DNA, 22 bp, Homo sapiens
actttggtgatacagatacggc

SEQ ID NO: 8227472 - DNA, 19 bp, Homo sapiens
actttggtgattagaggga

SEQ ID NO: 8227473 - DNA, 22 bp, Homo sapiens
actttggtcccatgtgtgtaaa

SEQ ID NO: 8227474 - DNA, 17 bp, Homo sapiens
actttggtcctgtgctc

SEQ ID NO: 8227475 - DNA, 22 bp, Homo sapiens
actttgtaggaaaaagtcacaa

SEQ ID NO: 8227476 - DNA, 22 bp, Homo sapiens
actttgtaaattgttgtgactc

SEQ ID NO: 8227477 - DNA, 22 bp, Homo sapiens
actttggtgcgaagtcacttta

SEQ ID NO: 8227478 - DNA, 22 bp, Homo sapiens
actttggtgcgaagtcacttta

SEQ ID NO: 8227479 - DNA, 20 bp, Homo sapiens
actttggttattgggaccat

SEQ ID NO: 8227480 - DNA, 22 bp, Homo sapiens
atatataacctggataaggctt

SEQ ID NO: 8227481 - DNA, 22 bp, Homo sapiens
actttgtataagacaataaaga

SEQ ID NO: 8227482 - DNA, 22 bp, Homo sapiens
atatattcttaaagaatctgac

SEQ ID NO: 8227483 - DNA, 18 bp, Homo sapiens
atatattgacaagaggga

SEQ ID NO: 8227484 - DNA, 22 bp, Homo sapiens
atatattggtgtcagaaagagt

SEQ ID NO: 8227485 - DNA, 22 bp, Homo sapiens
atatacaaagggcaacctcgct

SEQ ID NO: 8227486 - DNA, 22 bp, Homo sapiens
atatacaaagggcaacctcgct

SEQ ID NO: 8227487 - DNA, 22 bp, Homo sapiens
atatacaaagggcaacctcgct

SEQ ID NO: 8227488 - DNA, 22 bp, Homo sapiens
atatacacagagcttatggtga

SEQ ID NO: 8227489 - DNA, 22 bp, Homo sapiens
atatacacagagcttatggtga

SEQ ID NO: 8227490 - DNA, 22 bp, Homo sapiens
atatacacatctttttaaatat

SEQ ID NO: 8227491 - DNA, 22 bp, Homo sapiens
atatacacatctttttaaatat

SEQ ID NO: 8227492 - DNA, 22 bp, Homo sapiens
atataatttagaaggggaaaca

SEQ ID NO: 8227493 - DNA, 22 bp, Homo sapiens
atataatagtttcataaaggct

SEQ ID NO: 8227494 - DNA, 22 bp, Homo sapiens
acttggtggaacgtgtatttta

SEQ ID NO: 8227495 - DNA, 22 bp, Homo sapiens
atagtttaaggaactatgcgat

SEQ ID NO: 8227496 - DNA, 22 bp, Homo sapiens
atagtttacaaaaatgatgcat

SEQ ID NO: 8227497 - DNA, 22 bp, Homo sapiens
atataatagtttcataaaggct

SEQ ID NO: 8227498 - DNA, 22 bp, Homo sapiens
atataatagtttcataaaggct

SEQ ID NO: 8227499 - DNA, 22 bp, Homo sapiens
atataatagtttcataaaggct

SEQ ID NO: 8227500 - DNA, 22 bp, Homo sapiens
atatctcattaccttgctgttc

SEQ ID NO: 8227501 - DNA, 22 bp, Homo sapiens
atatcttggccccaggatttta

SEQ ID NO: 8227502 - DNA, 22 bp, Homo sapiens
atatcttctttattttgtgagg

SEQ ID NO: 8227503 - DNA, 22 bp, Homo sapiens
atatattttgaatagcctctgt

SEQ ID NO: 8227504 - DNA, 22 bp, Homo sapiens
atatattttgaatagcctctgt

SEQ ID NO: 8227505 - DNA, 22 bp, Homo sapiens
atatccagcagcaggtgagtat

SEQ ID NO: 8227506 - DNA, 22 bp, Homo sapiens
atatccagcagcaggtgagtat

SEQ ID NO: 8227507 - DNA, 22 bp, Homo sapiens
atatccagcagcaggtgagtat

SEQ ID NO: 8227508 - DNA, 22 bp, Homo sapiens
atatatttactctcctgttgca

SEQ ID NO: 8227509 - DNA, 22 bp, Homo sapiens
atatatttactctcctgttgca

SEQ ID NO: 8227510 - DNA, 22 bp, Homo sapiens
atatatttactctcctgttgca

SEQ ID NO: 8227511 - DNA, 22 bp, Homo sapiens
atatatttgagaatattcatga

SEQ ID NO: 8227512 - DNA, 22 bp, Homo sapiens
atatatttgagaatattcatga

SEQ ID NO: 8227513 - DNA, 22 bp, Homo sapiens
atatatttgagaatattcatga

SEQ ID NO: 8227514 - DNA, 22 bp, Homo sapiens
atatatttgagaatattcatga

SEQ ID NO: 8227515 - DNA, 22 bp, Homo sapiens
atatatttgagaatattcatga

SEQ ID NO: 8227516 - DNA, 22 bp, Homo sapiens
atatatttgagaatattcatga

SEQ ID NO: 8227517 - DNA, 22 bp, Homo sapiens
atatatttgagaatattcatga

SEQ ID NO: 8227518 - DNA, 22 bp, Homo sapiens
atatatttgagaatattcatga

SEQ ID NO: 8227519 - DNA, 22 bp, Homo sapiens
atatatttgagaatattcatga

SEQ ID NO: 8227520 - DNA, 22 bp, Homo sapiens
agaaacaacttgtttctcttgc

SEQ ID NO: 8227521 - DNA, 22 bp, Homo sapiens
agaaacagaaccaggtgtcatt

SEQ ID NO: 8227522 - DNA, 22 bp, Homo sapiens
agaaacagaaccaggtgtcatt

SEQ ID NO: 8227523 - DNA, 22 bp, Homo sapiens
agaaaatttaaagagacacaca

SEQ ID NO: 8227524 - DNA, 22 bp, Homo sapiens
agaaaatttaaagagacacaca

SEQ ID NO: 8227525 - DNA, 22 bp, Homo sapiens
agaaaatttaaagagacacaca

SEQ ID NO: 8227526 - DNA, 22 bp, Homo sapiens
agaaaataaattgatggtggaa

SEQ ID NO: 8227527 - DNA, 22 bp, Homo sapiens
agaaaattagattttactgtgt

SEQ ID NO: 8227528 - DNA, 22 bp, Homo sapiens
agaaaataatttcttggctggt

SEQ ID NO: 8227529 - DNA, 22 bp, Homo sapiens
atatgaaaagaagtcaccattg

SEQ ID NO: 8227530 - DNA, 22 bp, Homo sapiens
atatcttttagagcaagcttgt

SEQ ID NO: 8227531 - DNA, 22 bp, Homo sapiens
actccacaccacgggggccgcc

SEQ ID NO: 8227532 - DNA, 22 bp, Homo sapiens
actccagaatcctagggtcagc

SEQ ID NO: 8227533 - DNA, 22 bp, Homo sapiens
actccacaccacgggggccgcc

SEQ ID NO: 8227534 - DNA, 22 bp, Homo sapiens
actcatttttactgcaattgag

SEQ ID NO: 8227535 - DNA, 22 bp, Homo sapiens
actccaaggccacatgcattcc

SEQ ID NO: 8227536 - DNA, 21 bp, Homo sapiens
actccaaacaagttaagctgt

SEQ ID NO: 8227537 - DNA, 22 bp, Homo sapiens
actcatttaaacatttactgaa

SEQ ID NO: 8227538 - DNA, 20 bp, Homo sapiens
actcatttccagcatctgat

SEQ ID NO: 8227539 - DNA, 22 bp, Homo sapiens
actcatttgacactttaaactg

SEQ ID NO: 8227540 - DNA, 21 bp, Homo sapiens
actcatttgtctgcatctaat

SEQ ID NO: 8227541 - DNA, 22 bp, Homo sapiens
actcattttataacactgtagt

SEQ ID NO: 8227542 - DNA, 22 bp, Homo sapiens
actccaggcatctgcttctgct

SEQ ID NO: 8227543 - DNA, 22 bp, Homo sapiens
actccaggcatctgcttctgct

SEQ ID NO: 8227544 - DNA, 22 bp, Homo sapiens
actccaggcatctgcttctgct

SEQ ID NO: 8227545 - DNA, 19 bp, Homo sapiens
actccagggatgacagaag

SEQ ID NO: 8227546 - DNA, 19 bp, Homo sapiens
actccagggatgacagaag

SEQ ID NO: 8227547 - DNA, 22 bp, Homo sapiens
actccagacacagacactatga

SEQ ID NO: 8227548 - DNA, 22 bp, Homo sapiens
actccagatgataagggacagt

SEQ ID NO: 8227549 - DNA, 22 bp, Homo sapiens
actccaggatgtagaatcagag

SEQ ID NO: 8227550 - DNA, 22 bp, Homo sapiens
agtctctgccagcttgtcctct

SEQ ID NO: 8227551 - DNA, 22 bp, Homo sapiens
agtctctgccagcttgtcctct

SEQ ID NO: 8227552 - DNA, 22 bp, Homo sapiens
agtctctgctggttgtgcctat

SEQ ID NO: 8227553 - DNA, 22 bp, Homo sapiens
agtctctggactgggagatggc

SEQ ID NO: 8227554 - DNA, 22 bp, Homo sapiens
agtctctgtgagctcccaatgg

SEQ ID NO: 8227555 - DNA, 22 bp, Homo sapiens
agtctctgttccagggcttcag

SEQ ID NO: 8227556 - DNA, 20 bp, Homo sapiens
agtctctgtagtgcctgaga

SEQ ID NO: 8227557 - DNA, 22 bp, Homo sapiens
agtctctggggaggagtggaaa

SEQ ID NO: 8227558 - DNA, 22 bp, Homo sapiens
agtctctgggcatggttgtgac

SEQ ID NO: 8227559 - DNA, 22 bp, Homo sapiens
agtctctgaggttcagatgcct

SEQ ID NO: 8227560 - DNA, 22 bp, Homo sapiens
agtctctcttgggtgtggtttg

SEQ ID NO: 8227561 - DNA, 22 bp, Homo sapiens
agtctacaacgcaagcaacatg

SEQ ID NO: 8227562 - DNA, 22 bp, Homo sapiens
actccagggctccaccccagat

SEQ ID NO: 8227563 - DNA, 22 bp, Homo sapiens
actccagggctccatcccttgt

SEQ ID NO: 8227564 - DNA, 22 bp, Homo sapiens
actccagggctccatcccttgt

SEQ ID NO: 8227565 - DNA, 22 bp, Homo sapiens
actccagggctgaacgaggccc

SEQ ID NO: 8227566 - DNA, 22 bp, Homo sapiens
actccagggctccatcccttgt

SEQ ID NO: 8227567 - DNA, 22 bp, Homo sapiens
actccagggctgaacgaggccc

SEQ ID NO: 8227568 - DNA, 22 bp, Homo sapiens
actgaaaatgaattagaaacag

SEQ ID NO: 8227569 - DNA, 22 bp, Homo sapiens
actgaaaatgaattagaaacag

SEQ ID NO: 8227570 - DNA, 22 bp, Homo sapiens
actgaaaatgaattagaaacag

SEQ ID NO: 8227571 - DNA, 22 bp, Homo sapiens
actgaaatactgctcttggatt

SEQ ID NO: 8227572 - DNA, 22 bp, Homo sapiens
actgaacaccatttataacatt

SEQ ID NO: 8227573 - DNA, 22 bp, Homo sapiens
actgaaatggggacagtcctta

SEQ ID NO: 8227574 - DNA, 22 bp, Homo sapiens
actgaaatttatattttgggca

SEQ ID NO: 8227575 - DNA, 22 bp, Homo sapiens
actgaaatatttagaagtgaag

SEQ ID NO: 8227576 - DNA, 22 bp, Homo sapiens
actgaaatatttagaagtgaag

SEQ ID NO: 8227577 - DNA, 22 bp, Homo sapiens
actgaaatggggacagtcctta

SEQ ID NO: 8227578 - DNA, 22 bp, Homo sapiens
actgaaatgaaatctatcatct

SEQ ID NO: 8227579 - DNA, 22 bp, Homo sapiens
actgaacagcctttcaaactta

SEQ ID NO: 8227580 - DNA, 22 bp, Homo sapiens
actgaagaacgcatcagtggtt

SEQ ID NO: 8227581 - DNA, 22 bp, Homo sapiens
actgaagacctcctgtcagcgg

SEQ ID NO: 8227582 - DNA, 18 bp, Homo sapiens
actgaagatgcaagacct

SEQ ID NO: 8227583 - DNA, 19 bp, Homo sapiens
actgaagcagggactgaaa

SEQ ID NO: 8227584 - DNA, 22 bp, Homo sapiens
actgaagcacatttgccatgaa

SEQ ID NO: 8227585 - DNA, 23 bp, Homo sapiens
actgaagatgtcttagtggccct

SEQ ID NO: 8227586 - DNA, 22 bp, Homo sapiens
actgaagccagagggaggacat

SEQ ID NO: 8227587 - DNA, 22 bp, Homo sapiens
actgaagctgggcgatgcctcc

SEQ ID NO: 8227588 - DNA, 22 bp, Homo sapiens
actgaagctgggcgatgcctcc

SEQ ID NO: 8227589 - DNA, 22 bp, Homo sapiens
actgaagcttgggtggaactta

SEQ ID NO: 8227590 - DNA, 22 bp, Homo sapiens
agtctggattttctacccttct

SEQ ID NO: 8227591 - DNA, 22 bp, Homo sapiens
agtctcttattccctattgctg

SEQ ID NO: 8227592 - DNA, 22 bp, Homo sapiens
agtctcttattccctattgctg

SEQ ID NO: 8227593 - DNA, 22 bp, Homo sapiens
agtctcttagatgtggacctgc

SEQ ID NO: 8227594 - DNA, 22 bp, Homo sapiens
agtctcttccttcaaggctggt

SEQ ID NO: 8227595 - DNA, 22 bp, Homo sapiens
agtctgggaggcttataaacag

SEQ ID NO: 8227596 - DNA, 20 bp, Homo sapiens
agtctggcacctattcctgt

SEQ ID NO: 8227597 - DNA, 20 bp, Homo sapiens
agtctggcatgatgcaggca

SEQ ID NO: 8227598 - DNA, 22 bp, Homo sapiens
agtctgggaactgggaacgttt

SEQ ID NO: 8227599 - DNA, 22 bp, Homo sapiens
agtctggggtctggtagaacga

SEQ ID NO: 8227600 - DNA, 22 bp, Homo sapiens
agtctgggctgtctgcaggagt

SEQ ID NO: 8227601 - DNA, 22 bp, Homo sapiens
agtctgggctgtctgcaggagt

SEQ ID NO: 8227602 - DNA, 22 bp, Homo sapiens
actcttcatacagtcatctaat

SEQ ID NO: 8227603 - DNA, 22 bp, Homo sapiens
actgaatatattccattgcatg

SEQ ID NO: 8227604 - DNA, 22 bp, Homo sapiens
actgaatagtgctgcattgtac

SEQ ID NO: 8227605 - DNA, 21 bp, Homo sapiens
actgaatgtgtccaagctgag

SEQ ID NO: 8227606 - DNA, 22 bp, Homo sapiens
actgagggtgcacaggcaggca

SEQ ID NO: 8227607 - DNA, 22 bp, Homo sapiens
actgaattagggaacactgaac

SEQ ID NO: 8227608 - DNA, 22 bp, Homo sapiens
actgaatagcccttctgtctcc

SEQ ID NO: 8227609 - DNA, 22 bp, Homo sapiens
actgaatagaaatgctcatagg

SEQ ID NO: 8227610 - DNA, 22 bp, Homo sapiens
actgaataatggtctgtgatct

SEQ ID NO: 8227611 - DNA, 22 bp, Homo sapiens
actgaataaggtgaatgctctg

SEQ ID NO: 8227612 - DNA, 22 bp, Homo sapiens
actgaagttcatacaacagact

SEQ ID NO: 8227613 - DNA, 22 bp, Homo sapiens
actgatttcagggatgagaaga

SEQ ID NO: 8227614 - DNA, 22 bp, Homo sapiens
actgatggcccaccttggtctc

SEQ ID NO: 8227615 - DNA, 22 bp, Homo sapiens
actgatgtgacagctgagcaga

SEQ ID NO: 8227616 - DNA, 22 bp, Homo sapiens
actgatggcccaccttggtctc

SEQ ID NO: 8227617 - DNA, 22 bp, Homo sapiens
actgatgaaaactaataaatta

SEQ ID NO: 8227618 - DNA, 22 bp, Homo sapiens
actgatcacatagatatattcc

SEQ ID NO: 8227619 - DNA, 23 bp, Homo sapiens
actgaggtactgaggttgtgaca

SEQ ID NO: 8227620 - DNA, 22 bp, Homo sapiens
actgagggtttttatactcttt

SEQ ID NO: 8227621 - DNA, 22 bp, Homo sapiens
actgaggtaattgtgaggatta

SEQ ID NO: 8227622 - DNA, 22 bp, Homo sapiens
actgaggtaattgtgaggatta

SEQ ID NO: 8227623 - DNA, 22 bp, Homo sapiens
actgatgaaaactaataaatta

SEQ ID NO: 8227624 - DNA, 20 bp, Homo sapiens
actgatcttgttcttactcc

SEQ ID NO: 8227625 - DNA, 22 bp, Homo sapiens
actgatctgttttcagattctg

SEQ ID NO: 8227626 - DNA, 22 bp, Homo sapiens
actgatcacatagatatattcc

SEQ ID NO: 8227627 - DNA, 22 bp, Homo sapiens
actgcacaaggcctggacacac

SEQ ID NO: 8227628 - DNA, 22 bp, Homo sapiens
actgcaagtcacttggctatgt

SEQ ID NO: 8227629 - DNA, 22 bp, Homo sapiens
actgcaaggaggtggggtatca

SEQ ID NO: 8227630 - DNA, 20 bp, Homo sapiens
actgcaagtcacttttaggg

SEQ ID NO: 8227631 - DNA, 22 bp, Homo sapiens
actgcaacctccgcctgccagg

SEQ ID NO: 8227632 - DNA, 22 bp, Homo sapiens
actgcaagaatggtaatatttg

SEQ ID NO: 8227633 - DNA, 22 bp, Homo sapiens
actgcaacctccgcctgccagg

SEQ ID NO: 8227634 - DNA, 22 bp, Homo sapiens
actgcacagaattatggttggt

SEQ ID NO: 8227635 - DNA, 22 bp, Homo sapiens
actgcaacacctcctgggttca

SEQ ID NO: 8227636 - DNA, 22 bp, Homo sapiens
actgcaacacctcctgggttca

SEQ ID NO: 8227637 - DNA, 22 bp, Homo sapiens
actgcaacacctcctgggttca

SEQ ID NO: 8227638 - DNA, 22 bp, Homo sapiens
actgcaacctccacctcctggg

SEQ ID NO: 8227639 - DNA, 22 bp, Homo sapiens
actgcaacctccacctcctggg

SEQ ID NO: 8227640 - DNA, 22 bp, Homo sapiens
actgcaacctccacctcctggg

SEQ ID NO: 8227641 - DNA, 22 bp, Homo sapiens
actgcaacctccacctcctggg

SEQ ID NO: 8227642 - DNA, 22 bp, Homo sapiens
actgcaacctccacctcctggg

SEQ ID NO: 8227643 - DNA, 22 bp, Homo sapiens
actgcaacctccacctcctggg

SEQ ID NO: 8227644 - DNA, 20 bp, Homo sapiens
actgcaaagtactctttcag

SEQ ID NO: 8227645 - DNA, 22 bp, Homo sapiens
actgcaacacctcctgggttca

SEQ ID NO: 8227646 - DNA, 22 bp, Homo sapiens
actgcaaagggaagccctttct

SEQ ID NO: 8227647 - DNA, 21 bp, Homo sapiens
actgcaaacagcagagactga

SEQ ID NO: 8227648 - DNA, 22 bp, Homo sapiens
actgcaaacatagtacttgagc

SEQ ID NO: 8227649 - DNA, 22 bp, Homo sapiens
actgatttcagggatgagaaga

SEQ ID NO: 8227650 - DNA, 22 bp, Homo sapiens
actgctttaaaaaagcaagctt

SEQ ID NO: 8227651 - DNA, 22 bp, Homo sapiens
actgctttagacctagagctct

SEQ ID NO: 8227652 - DNA, 23 bp, Homo sapiens
agtggctgagagtgtttcatatg

SEQ ID NO: 8227653 - DNA, 22 bp, Homo sapiens
actgcttcctgagaaatcaaca

SEQ ID NO: 8227654 - DNA, 22 bp, Homo sapiens
actgcttctccaatgaattaga

SEQ ID NO: 8227655 - DNA, 22 bp, Homo sapiens
actgctgtgttcggctccccgt

SEQ ID NO: 8227656 - DNA, 22 bp, Homo sapiens
agtggctgatgtaggcagtggg

SEQ ID NO: 8227657 - DNA, 22 bp, Homo sapiens
agtggctgatgtaggcagtggg

SEQ ID NO: 8227658 - DNA, 22 bp, Homo sapiens
agtggctgatgtaggcagtggg

SEQ ID NO: 8227659 - DNA, 22 bp, Homo sapiens
agtggctgatgtaggcagtggg

SEQ ID NO: 8227660 - DNA, 22 bp, Homo sapiens
agtggctgatgtaggcagtggg

SEQ ID NO: 8227661 - DNA, 22 bp, Homo sapiens
agtggctgagtgactgtgactc

SEQ ID NO: 8227662 - DNA, 23 bp, Homo sapiens
agtggctgagagtgtttcatatg

SEQ ID NO: 8227663 - DNA, 22 bp, Homo sapiens
agtggctgagtgactgtgactc

SEQ ID NO: 8227664 - DNA, 22 bp, Homo sapiens
agtggctgagtgactgtgactc

SEQ ID NO: 8227665 - DNA, 22 bp, Homo sapiens
agtggctgagtgactgtgactc

SEQ ID NO: 8227666 - DNA, 22 bp, Homo sapiens
actgctggaaacccagaatggt

SEQ ID NO: 8227667 - DNA, 22 bp, Homo sapiens
actgctgtgatctgatgtaatt

SEQ ID NO: 8227668 - DNA, 22 bp, Homo sapiens
actgctcacgcattacttgagc

SEQ ID NO: 8227669 - DNA, 22 bp, Homo sapiens
actgctctctttgcaggggcta

SEQ ID NO: 8227670 - DNA, 22 bp, Homo sapiens
actgctctgttttcatatgttt

SEQ ID NO: 8227671 - DNA, 22 bp, Homo sapiens
actggcagccacaactggcagg

SEQ ID NO: 8227672 - DNA, 22 bp, Homo sapiens
actggcagcagcagcccttggg

SEQ ID NO: 8227673 - DNA, 22 bp, Homo sapiens
actggcagcagcagcccttggg

SEQ ID NO: 8227674 - DNA, 22 bp, Homo sapiens
actggcagcagcagcccttggg

SEQ ID NO: 8227675 - DNA, 22 bp, Homo sapiens
actggcagccacaactggcagg

SEQ ID NO: 8227676 - DNA, 22 bp, Homo sapiens
actggcagccacaactggcagg

SEQ ID NO: 8227677 - DNA, 22 bp, Homo sapiens
actggcagaggttggacaccat

SEQ ID NO: 8227678 - DNA, 22 bp, Homo sapiens
actggcagaggttggacaccat

SEQ ID NO: 8227679 - DNA, 22 bp, Homo sapiens
actggcagagggaaaaccattc

SEQ ID NO: 8227680 - DNA, 22 bp, Homo sapiens
actggcagaggatagcactaat

SEQ ID NO: 8227681 - DNA, 22 bp, Homo sapiens
actggcagaggatagcactaat

SEQ ID NO: 8227682 - DNA, 22 bp, Homo sapiens
actggcagagggaaaaccattc

SEQ ID NO: 8227683 - DNA, 22 bp, Homo sapiens
actggcagaggatagcactaat

SEQ ID NO: 8227684 - DNA, 22 bp, Homo sapiens
actggcagaattgaatagttgt

SEQ ID NO: 8227685 - DNA, 22 bp, Homo sapiens
actggcagaattgaatagttgt

SEQ ID NO: 8227686 - DNA, 22 bp, Homo sapiens
actggcagaactggtgattgtc

SEQ ID NO: 8227687 - DNA, 22 bp, Homo sapiens
actggcagagaccctgatggcc

SEQ ID NO: 8227688 - DNA, 22 bp, Homo sapiens
actggcagagaccctgatggcc

SEQ ID NO: 8227689 - DNA, 22 bp, Homo sapiens
actggcagagaccctgatggcc

SEQ ID NO: 8227690 - DNA, 22 bp, Homo sapiens
actggcagaactggtgattgtc

SEQ ID NO: 8227691 - DNA, 22 bp, Homo sapiens
actggcagaacgtgatgcgggt

SEQ ID NO: 8227692 - DNA, 22 bp, Homo sapiens
actggcagaacgtgatgcgggt

SEQ ID NO: 8227693 - DNA, 19 bp, Homo sapiens
actggcacacaggggctgc

SEQ ID NO: 8227694 - DNA, 22 bp, Homo sapiens
agtggctgctatgatcaggaca

SEQ ID NO: 8227695 - DNA, 22 bp, Homo sapiens
agtggctgctatgatcaggaca

SEQ ID NO: 8227696 - DNA, 22 bp, Homo sapiens
agtggctgctggagtggagatg

SEQ ID NO: 8227697 - DNA, 22 bp, Homo sapiens
agtggctgcttctggttgctcc

SEQ ID NO: 8227698 - DNA, 22 bp, Homo sapiens
agtggctgctggagtggagatg

SEQ ID NO: 8227699 - DNA, 22 bp, Homo sapiens
agtggctgctgactttaataca

SEQ ID NO: 8227700 - DNA, 22 bp, Homo sapiens
actggagttttaaaggaacttg

SEQ ID NO: 8227701 - DNA, 22 bp, Homo sapiens
actggacagaggaaatatggag

SEQ ID NO: 8227702 - DNA, 22 bp, Homo sapiens
actggacagaggaaatatggag

SEQ ID NO: 8227703 - DNA, 22 bp, Homo sapiens
actggagttgattacataaaac

SEQ ID NO: 8227704 - DNA, 22 bp, Homo sapiens
actggagttgggtcaagattct

SEQ ID NO: 8227705 - DNA, 22 bp, Homo sapiens
acctgccttctcaaggacatga

SEQ ID NO: 8227706 - DNA, 22 bp, Homo sapiens
acctgcccggggacattccttt

SEQ ID NO: 8227707 - DNA, 22 bp, Homo sapiens
acctccctggccttctgattcc

SEQ ID NO: 8227708 - DNA, 22 bp, Homo sapiens
acctgcccacttcccatgacat

SEQ ID NO: 8227709 - DNA, 22 bp, Homo sapiens
acctgcccacttcccatgacat

SEQ ID NO: 8227710 - DNA, 22 bp, Homo sapiens
acctgcccacttcccatgacat

SEQ ID NO: 8227711 - DNA, 22 bp, Homo sapiens
acctggacttgaatcctgactt

SEQ ID NO: 8227712 - DNA, 22 bp, Homo sapiens
acctggacacctgctgtcatct

SEQ ID NO: 8227713 - DNA, 22 bp, Homo sapiens
acctggagaaagcctctccctg

SEQ ID NO: 8227714 - DNA, 22 bp, Homo sapiens
acctggagaaagcctctccctg

SEQ ID NO: 8227715 - DNA, 22 bp, Homo sapiens
acctggagaaagcctctccctg

SEQ ID NO: 8227716 - DNA, 22 bp, Homo sapiens
acctggacacctgctgtcatct

SEQ ID NO: 8227717 - DNA, 22 bp, Homo sapiens
acctggacacctgctgtcatct

SEQ ID NO: 8227718 - DNA, 22 bp, Homo sapiens
acctggacacctgctgtcatct

SEQ ID NO: 8227719 - DNA, 22 bp, Homo sapiens
acctggacacctgctgtcatct

SEQ ID NO: 8227720 - DNA, 22 bp, Homo sapiens
acctggagcttccaactcaact

SEQ ID NO: 8227721 - DNA, 22 bp, Homo sapiens
acctggagcttccaactcaact

SEQ ID NO: 8227722 - DNA, 22 bp, Homo sapiens
acctggagatccatggtgtcga

SEQ ID NO: 8227723 - DNA, 17 bp, Homo sapiens
acctggagaccaagtcc

SEQ ID NO: 8227724 - DNA, 20 bp, Homo sapiens
acctggagacagcactctgg

SEQ ID NO: 8227725 - DNA, 20 bp, Homo sapiens
acctggagacagcactctgg

SEQ ID NO: 8227726 - DNA, 20 bp, Homo sapiens
acctggagagattattacca

SEQ ID NO: 8227727 - DNA, 17 bp, Homo sapiens
acctggagaccaagtcc

SEQ ID NO: 8227728 - DNA, 22 bp, Homo sapiens
acctggagatccatggtgtcga

SEQ ID NO: 8227729 - DNA, 22 bp, Homo sapiens
acctggagatccatggtgtcga

SEQ ID NO: 8227730 - DNA, 20 bp, Homo sapiens
acctggagagattattacca

SEQ ID NO: 8227731 - DNA, 22 bp, Homo sapiens
aggtactgaaaaaatgtttgca

SEQ ID NO: 8227732 - DNA, 22 bp, Homo sapiens
aggtagaggcctccaggcagca

SEQ ID NO: 8227733 - DNA, 22 bp, Homo sapiens
aggtagcatattccagacttgt

SEQ ID NO: 8227734 - DNA, 22 bp, Homo sapiens
aggtagcaagacacctgctttt

SEQ ID NO: 8227735 - DNA, 22 bp, Homo sapiens
aggtagaggcctccaggcagca

SEQ ID NO: 8227736 - DNA, 22 bp, Homo sapiens
aggtagaggcctccaggcagca

SEQ ID NO: 8227737 - DNA, 22 bp, Homo sapiens
aggtactaccagggattttcag

SEQ ID NO: 8227738 - DNA, 22 bp, Homo sapiens
aggtacgggtctgagagccatg

SEQ ID NO: 8227739 - DNA, 22 bp, Homo sapiens
aggtacatggggtgtgtgcacg

SEQ ID NO: 8227740 - DNA, 22 bp, Homo sapiens
aggtacatttgataaaaatagc

SEQ ID NO: 8227741 - DNA, 22 bp, Homo sapiens
aggtacatttgataaaaatagc

SEQ ID NO: 8227742 - DNA, 22 bp, Homo sapiens
aggtacatctatggggatagaa

SEQ ID NO: 8227743 - DNA, 22 bp, Homo sapiens
aggtacataatgatggtgatga

SEQ ID NO: 8227744 - DNA, 22 bp, Homo sapiens
aggtacataggaaagtggagct

SEQ ID NO: 8227745 - DNA, 22 bp, Homo sapiens
aggtacatggggtgtgtgcacg

SEQ ID NO: 8227746 - DNA, 22 bp, Homo sapiens
aggtacatggggtgtgtgcacg

SEQ ID NO: 8227747 - DNA, 22 bp, Homo sapiens
acctgggttgctggcgtgaggg

SEQ ID NO: 8227748 - DNA, 22 bp, Homo sapiens
acctggttcctcctcactgctg

SEQ ID NO: 8227749 - DNA, 22 bp, Homo sapiens
acctggtttgtctcatcaccac

SEQ ID NO: 8227750 - DNA, 23 bp, Homo sapiens
acctggctgctcaacctgcaggg

SEQ ID NO: 8227751 - DNA, 22 bp, Homo sapiens
aggtagctatccagacgctgaa

SEQ ID NO: 8227752 - DNA, 22 bp, Homo sapiens
acctgtctataaaagtgaatac

SEQ ID NO: 8227753 - DNA, 22 bp, Homo sapiens
acctgtcatcccggctgcaccg

SEQ ID NO: 8227754 - DNA, 22 bp, Homo sapiens
acctgtgcacagtcagccctgg

SEQ ID NO: 8227755 - DNA, 22 bp, Homo sapiens
acctgtggatcagattcttgta

SEQ ID NO: 8227756 - DNA, 22 bp, Homo sapiens
acctgtggatcagattcttgta

SEQ ID NO: 8227757 - DNA, 22 bp, Homo sapiens
agggtgcctgctgcaggttcag

SEQ ID NO: 8227758 - DNA, 22 bp, Homo sapiens
agggcttgtggtcgtggctgtg

SEQ ID NO: 8227759 - DNA, 22 bp, Homo sapiens
agggcttgttaacatagagatt

SEQ ID NO: 8227760 - DNA, 22 bp, Homo sapiens
agggcttgtagggtggctgtag

SEQ ID NO: 8227761 - DNA, 22 bp, Homo sapiens
agggcttgtggtcgtggctgtg

SEQ ID NO: 8227762 - DNA, 22 bp, Homo sapiens
agggtgggctagactcttcccc

SEQ ID NO: 8227763 - DNA, 22 bp, Homo sapiens
agggtgcctggaagccactcac

SEQ ID NO: 8227764 - DNA, 20 bp, Homo sapiens
agggtggggacgttctgact

SEQ ID NO: 8227765 - DNA, 22 bp, Homo sapiens
accctcagagtaggcactgctg

SEQ ID NO: 8227766 - DNA, 22 bp, Homo sapiens
accctcagctggagattgaatt

SEQ ID NO: 8227767 - DNA, 22 bp, Homo sapiens
accctcaggcagaatgtattct

SEQ ID NO: 8227768 - DNA, 22 bp, Homo sapiens
accctcagcttcttggattaat

SEQ ID NO: 8227769 - DNA, 22 bp, Homo sapiens
agggctggtatgtccatgaaag

SEQ ID NO: 8227770 - DNA, 22 bp, Homo sapiens
agggctggtatgtccatgaaag

SEQ ID NO: 8227771 - DNA, 22 bp, Homo sapiens
agggctgtttttggcacctggg

SEQ ID NO: 8227772 - DNA, 22 bp, Homo sapiens
agggctgtttttggcacctggg

SEQ ID NO: 8227773 - DNA, 22 bp, Homo sapiens
agggcttgacaagggctggagc

SEQ ID NO: 8227774 - DNA, 22 bp, Homo sapiens
agggcttgacaagggctggagc

SEQ ID NO: 8227775 - DNA, 22 bp, Homo sapiens
agggcttgcagaaatgagaaat

SEQ ID NO: 8227776 - DNA, 22 bp, Homo sapiens
agggctgtcagactgaggaggc

SEQ ID NO: 8227777 - DNA, 22 bp, Homo sapiens
agggctgtgtttgcaccctctg

SEQ ID NO: 8227778 - DNA, 20 bp, Homo sapiens
agggtggggacgttctgact

SEQ ID NO: 8227779 - DNA, 22 bp, Homo sapiens
agggtgtcagccacggaatggg

SEQ ID NO: 8227780 - DNA, 22 bp, Homo sapiens
agggtgtcagccacggaatggg

SEQ ID NO: 8227781 - DNA, 22 bp, Homo sapiens
agggtgtgctgttgggtctttc

SEQ ID NO: 8227782 - DNA, 22 bp, Homo sapiens
agggtgtgttctcctatgagaa

SEQ ID NO: 8227783 - DNA, 22 bp, Homo sapiens
acctcccagctctgagcttggg

SEQ ID NO: 8227784 - DNA, 22 bp, Homo sapiens
agggtgtgttctcctatgagaa

SEQ ID NO: 8227785 - DNA, 22 bp, Homo sapiens
acctcccagctctgagcttggg

SEQ ID NO: 8227786 - DNA, 22 bp, Homo sapiens
acctccctaagggtccagctta

SEQ ID NO: 8227787 - DNA, 22 bp, Homo sapiens
acctcccctcaccaatctggtt

SEQ ID NO: 8227788 - DNA, 22 bp, Homo sapiens
acctccccgggagcagcctcct

SEQ ID NO: 8227789 - DNA, 22 bp, Homo sapiens
acctccccgggagcagcctcct

SEQ ID NO: 8227790 - DNA, 22 bp, Homo sapiens
acctccccattaggtcacccac

SEQ ID NO: 8227791 - DNA, 22 bp, Homo sapiens
acctccccattaggtcacccac

SEQ ID NO: 8227792 - DNA, 22 bp, Homo sapiens
actatatacacattatcttgtt

SEQ ID NO: 8227793 - DNA, 22 bp, Homo sapiens
actatatacacattatcttgtt

SEQ ID NO: 8227794 - DNA, 22 bp, Homo sapiens
actatagctcgggttataatgt

SEQ ID NO: 8227795 - DNA, 22 bp, Homo sapiens
actatagatgctggcgaggctg

SEQ ID NO: 8227796 - DNA, 22 bp, Homo sapiens
actatatgtgaaggtagaattt

SEQ ID NO: 8227797 - DNA, 22 bp, Homo sapiens
actatatacacattatcttgtt

SEQ ID NO: 8227798 - DNA, 22 bp, Homo sapiens
actatatacacattatcttgtt

SEQ ID NO: 8227799 - DNA, 22 bp, Homo sapiens
actatatacacattatcttgtt

SEQ ID NO: 8227800 - DNA, 22 bp, Homo sapiens
actatatacacattatcttgtt

SEQ ID NO: 8227801 - DNA, 22 bp, Homo sapiens
actatatacacattatcttgtt

SEQ ID NO: 8227802 - DNA, 18 bp, Homo sapiens
actatgctgaataaatgg

SEQ ID NO: 8227803 - DNA, 22 bp, Homo sapiens
actatgtacccaaagatctgat

SEQ ID NO: 8227804 - DNA, 22 bp, Homo sapiens
actattagcatatcatgaatgg

SEQ ID NO: 8227805 - DNA, 22 bp, Homo sapiens
actatgtatactagatgtgtaa

SEQ ID NO: 8227806 - DNA, 22 bp, Homo sapiens
actatgtattgtatgggctggt

SEQ ID NO: 8227807 - DNA, 22 bp, Homo sapiens
actatgaatccacattgatttt

SEQ ID NO: 8227808 - DNA, 19 bp, Homo sapiens
actatgcatttatttgttt

SEQ ID NO: 8227809 - DNA, 22 bp, Homo sapiens
actaaatacacacatttgttca

SEQ ID NO: 8227810 - DNA, 22 bp, Homo sapiens
actaaatagcctctggtagttg

SEQ ID NO: 8227811 - DNA, 22 bp, Homo sapiens
actaaatagttttgacagaaca

SEQ ID NO: 8227812 - DNA, 22 bp, Homo sapiens
actaaatagttttgacagaaca

SEQ ID NO: 8227813 - DNA, 22 bp, Homo sapiens
actaaagtcctgttgtagcata

SEQ ID NO: 8227814 - DNA, 22 bp, Homo sapiens
actaaatagttttgacagaaca

SEQ ID NO: 8227815 - DNA, 22 bp, Homo sapiens
actagtgtccttatataagagg

SEQ ID NO: 8227816 - DNA, 18 bp, Homo sapiens
actagtgagcaagctagg

SEQ ID NO: 8227817 - DNA, 22 bp, Homo sapiens
actaaatatttgagaggtgtag

SEQ ID NO: 8227818 - DNA, 22 bp, Homo sapiens
actatacattgaatgttaaggt

SEQ ID NO: 8227819 - DNA, 22 bp, Homo sapiens
actatacattgaatgttaaggt

SEQ ID NO: 8227820 - DNA, 22 bp, Homo sapiens
actatactgtctcttatagata

SEQ ID NO: 8227821 - DNA, 22 bp, Homo sapiens
actagtttatgctcagatgtct

SEQ ID NO: 8227822 - DNA, 22 bp, Homo sapiens
actagtttattacagttccact

SEQ ID NO: 8227823 - DNA, 22 bp, Homo sapiens
actcaaatttgtcaactgaagc

SEQ ID NO: 8227824 - DNA, 23 bp, Homo sapiens
actcaaatttcgcttggagttca

SEQ ID NO: 8227825 - DNA, 20 bp, Homo sapiens
actcaaatcacctgcctcaa

SEQ ID NO: 8227826 - DNA, 22 bp, Homo sapiens
actcaagtcataggcttctttc

SEQ ID NO: 8227827 - DNA, 22 bp, Homo sapiens
actcaagagctggctggttcct

SEQ ID NO: 8227828 - DNA, 18 bp, Homo sapiens
actcaagggtggagagaa

SEQ ID NO: 8227829 - DNA, 22 bp, Homo sapiens
actattcacagattcagtgttc

SEQ ID NO: 8227830 - DNA, 23 bp, Homo sapiens
actcaaaatttggcatttgagga

SEQ ID NO: 8227831 - DNA, 22 bp, Homo sapiens
actcaaatagctgcccctagtg

SEQ ID NO: 8227832 - DNA, 22 bp, Homo sapiens
actcaaatagcaacggtgagaa

SEQ ID NO: 8227833 - DNA, 22 bp, Homo sapiens
actcaaaagaccagagagctga

SEQ ID NO: 8227834 - DNA, 22 bp, Homo sapiens
actatttctagatgctctgata

SEQ ID NO: 8227835 - DNA, 22 bp, Homo sapiens
actcattgaaacttaagatcta

SEQ ID NO: 8227836 - DNA, 22 bp, Homo sapiens
actcacagcatgagcttggcag

SEQ ID NO: 8227837 - DNA, 19 bp, Homo sapiens
actcaggcttcctctgagg

SEQ ID NO: 8227838 - DNA, 22 bp, Homo sapiens
actcacagcagactatgaggga

SEQ ID NO: 8227839 - DNA, 22 bp, Homo sapiens
actcacagcagactatgaggga

SEQ ID NO: 8227840 - DNA, 22 bp, Homo sapiens
actcaatgttctcatagcacct

SEQ ID NO: 8227841 - DNA, 21 bp, Homo sapiens
actcaagtggagatgccaggt

SEQ ID NO: 8227842 - DNA, 23 bp, Homo sapiens
actcacaaagcaggatcatgttg

SEQ ID NO: 8227843 - DNA, 23 bp, Homo sapiens
actcacaaagcaggatcatgttg

SEQ ID NO: 8227844 - DNA, 22 bp, Homo sapiens
acgggctgggacggggaagctc

SEQ ID NO: 8227845 - DNA, 20 bp, Homo sapiens
acgtgtgtgtgcacgcgcgc

SEQ ID NO: 8227846 - DNA, 22 bp, Homo sapiens
acgttaaacatttagcatagta

SEQ ID NO: 8227847 - DNA, 22 bp, Homo sapiens
acgtgtgtgacattgggaacgt

SEQ ID NO: 8227848 - DNA, 22 bp, Homo sapiens
acgttttcagccttaatgtaga

SEQ ID NO: 8227849 - DNA, 22 bp, Homo sapiens
acgttatatctgaaaaaagtga

SEQ ID NO: 8227850 - DNA, 19 bp, Homo sapiens
actaaaaatgatgtttgag

SEQ ID NO: 8227851 - DNA, 22 bp, Homo sapiens
actaaactgaagcatgaaaagg

SEQ ID NO: 8227852 - DNA, 22 bp, Homo sapiens
actaaaacatagccagtcagtg

SEQ ID NO: 8227853 - DNA, 22 bp, Homo sapiens
actaaaacagtggctagtagac

SEQ ID NO: 8227854 - DNA, 22 bp, Homo sapiens
actaaaacagtggctagtagac

SEQ ID NO: 8227855 - DNA, 19 bp, Homo sapiens
actaaaaatgatgtttgag

SEQ ID NO: 8227856 - DNA, 19 bp, Homo sapiens
actaaaaatgatgtttgag

SEQ ID NO: 8227857 - DNA, 22 bp, Homo sapiens
actaaagatgtctaaatatatt

SEQ ID NO: 8227858 - DNA, 22 bp, Homo sapiens
actaaagatgtctaaatatatt

SEQ ID NO: 8227859 - DNA, 22 bp, Homo sapiens
actaaagaagccaaagttttct

SEQ ID NO: 8227860 - DNA, 22 bp, Homo sapiens
actaaactgttcatcagcatct

SEQ ID NO: 8227861 - DNA, 22 bp, Homo sapiens
accttaaatgtgacatagtcta

SEQ ID NO: 8227862 - DNA, 22 bp, Homo sapiens
accttagaaaatcaaaattaga

SEQ ID NO: 8227863 - DNA, 22 bp, Homo sapiens
accttaaaggccgaagtaaaga

SEQ ID NO: 8227864 - DNA, 22 bp, Homo sapiens
accttatttggaaatataatta

SEQ ID NO: 8227865 - DNA, 22 bp, Homo sapiens
accttattcttgcccttagatg

SEQ ID NO: 8227866 - DNA, 22 bp, Homo sapiens
acgggccttctcttcaggcgag

SEQ ID NO: 8227867 - DNA, 23 bp, Homo sapiens
acgggagggctgtttgcttggtg

SEQ ID NO: 8227868 - DNA, 22 bp, Homo sapiens
accttcacctccacaccttggg

SEQ ID NO: 8227869 - DNA, 22 bp, Homo sapiens
accttcagacatcaactatctc

SEQ ID NO: 8227870 - DNA, 22 bp, Homo sapiens
accttcaggtgagcacacagat

SEQ ID NO: 8227871 - DNA, 20 bp, Homo sapiens
accttcaggaacttatcagc

SEQ ID NO: 8227872 - DNA, 22 bp, Homo sapiens
aggctggcaaggcagatgtgtg

SEQ ID NO: 8227873 - DNA, 22 bp, Homo sapiens
aggctggcaaggcagatgtgtg

SEQ ID NO: 8227874 - DNA, 22 bp, Homo sapiens
aggctggcaaggcagatgtgtg

SEQ ID NO: 8227875 - DNA, 22 bp, Homo sapiens
aggctggcaaggcagatgtgtg

SEQ ID NO: 8227876 - DNA, 22 bp, Homo sapiens
aggctggatgtgcctcaccgag

SEQ ID NO: 8227877 - DNA, 22 bp, Homo sapiens
aggctggatttatggggacttc

SEQ ID NO: 8227878 - DNA, 20 bp, Homo sapiens
aggctggcactcctggccag

SEQ ID NO: 8227879 - DNA, 20 bp, Homo sapiens
aggctggcactcctggccag

SEQ ID NO: 8227880 - DNA, 20 bp, Homo sapiens
aggctggcactcctggccag

SEQ ID NO: 8227881 - DNA, 20 bp, Homo sapiens
aggctggcactcctggccag

SEQ ID NO: 8227882 - DNA, 22 bp, Homo sapiens
aggctggcaaggcagatgtgtg

SEQ ID NO: 8227883 - DNA, 22 bp, Homo sapiens
aggctggatctctgttgccttc

SEQ ID NO: 8227884 - DNA, 19 bp, Homo sapiens
aggctggatgcccatctta

SEQ ID NO: 8227885 - DNA, 19 bp, Homo sapiens
aggctggatgcccatctta

SEQ ID NO: 8227886 - DNA, 22 bp, Homo sapiens
aggctggatttatggggacttc

SEQ ID NO: 8227887 - DNA, 22 bp, Homo sapiens
aggctggagtgtgcagtggcgc

SEQ ID NO: 8227888 - DNA, 22 bp, Homo sapiens
aggctggagtgtgcagtggcgc

SEQ ID NO: 8227889 - DNA, 22 bp, Homo sapiens
aggctggagtgtgcagtggcgc

SEQ ID NO: 8227890 - DNA, 22 bp, Homo sapiens
aggctggagtgtgcagtggcgc

SEQ ID NO: 8227891 - DNA, 22 bp, Homo sapiens
aggctggagtgtgcagtggcgc

SEQ ID NO: 8227892 - DNA, 22 bp, Homo sapiens
aggctggagtgtgcagtggcgc

SEQ ID NO: 8227893 - DNA, 22 bp, Homo sapiens
agggaagaatcactgggatgtt

SEQ ID NO: 8227894 - DNA, 22 bp, Homo sapiens
agggaagaatcactgggatgtt

SEQ ID NO: 8227895 - DNA, 22 bp, Homo sapiens
agggaagaggaccagagtctct

SEQ ID NO: 8227896 - DNA, 22 bp, Homo sapiens
aggctggcagccacctcagcag

SEQ ID NO: 8227897 - DNA, 22 bp, Homo sapiens
aggctggcagccacctcagcag

SEQ ID NO: 8227898 - DNA, 22 bp, Homo sapiens
aggctttactggatttttcgct

SEQ ID NO: 8227899 - DNA, 22 bp, Homo sapiens
aggctggcagccacctcagcag

SEQ ID NO: 8227900 - DNA, 22 bp, Homo sapiens
aggctggcagccacctcagcag

SEQ ID NO: 8227901 - DNA, 22 bp, Homo sapiens
aggctggcagccacctcagcag

SEQ ID NO: 8227902 - DNA, 22 bp, Homo sapiens
agggaagaatcactgggatgtt

SEQ ID NO: 8227903 - DNA, 22 bp, Homo sapiens
aggctttcctgtcactcatgct

SEQ ID NO: 8227904 - DNA, 23 bp, Homo sapiens
aggctttatggtagaaagtttgc

SEQ ID NO: 8227905 - DNA, 22 bp, Homo sapiens
aggctttactgcctcaggactc

SEQ ID NO: 8227906 - DNA, 23 bp, Homo sapiens
aggctttatggtagaaagtttgc

SEQ ID NO: 8227907 - DNA, 19 bp, Homo sapiens
accaaaggagtggggtata

SEQ ID NO: 8227908 - DNA, 22 bp, Homo sapiens
aggctggagtgtgcagtggcgc

SEQ ID NO: 8227909 - DNA, 21 bp, Homo sapiens
accaaaacctatactttctgt

SEQ ID NO: 8227910 - DNA, 21 bp, Homo sapiens
accaaaacctatactttctgt

SEQ ID NO: 8227911 - DNA, 22 bp, Homo sapiens
acatttttgggttgatgtctga

SEQ ID NO: 8227912 - DNA, 22 bp, Homo sapiens
aggctgcagaacagtcaggtgc

SEQ ID NO: 8227913 - DNA, 22 bp, Homo sapiens
aggctgcagaacagtcaggtgc

SEQ ID NO: 8227914 - DNA, 20 bp, Homo sapiens
acattttggcatactctcaa

SEQ ID NO: 8227915 - DNA, 22 bp, Homo sapiens
acatttttactgggcatctgca

SEQ ID NO: 8227916 - DNA, 22 bp, Homo sapiens
accaggcccatgtggattacta

SEQ ID NO: 8227917 - DNA, 22 bp, Homo sapiens
accaggcccaccgcatgctcct

SEQ ID NO: 8227918 - DNA, 22 bp, Homo sapiens
accaggcccaccgcatgctcct

SEQ ID NO: 8227919 - DNA, 22 bp, Homo sapiens
accaggagttgggggtgggacc

SEQ ID NO: 8227920 - DNA, 22 bp, Homo sapiens
agggacagtatccatctcacag

SEQ ID NO: 8227921 - DNA, 17 bp, Homo sapiens
agggacagcagtttagg

SEQ ID NO: 8227922 - DNA, 22 bp, Homo sapiens
agggacagtatccatctcacag

SEQ ID NO: 8227923 - DNA, 20 bp, Homo sapiens
accaggcccggtgtctcctc

SEQ ID NO: 8227924 - DNA, 22 bp, Homo sapiens
accaggcccgctgctatggtgg

SEQ ID NO: 8227925 - DNA, 22 bp, Homo sapiens
accaggcccgctgctatggtgg

SEQ ID NO: 8227926 - DNA, 20 bp, Homo sapiens
accaggccccgggccctgca

SEQ ID NO: 8227927 - DNA, 22 bp, Homo sapiens
accaggcccatgtggattacta

SEQ ID NO: 8227928 - DNA, 20 bp, Homo sapiens
accaggccccgggccctgca

SEQ ID NO: 8227929 - DNA, 20 bp, Homo sapiens
accaggccccgggccctgca

SEQ ID NO: 8227930 - DNA, 20 bp, Homo sapiens
accaggccccgggccctgca

SEQ ID NO: 8227931 - DNA, 22 bp, Homo sapiens
accaggccctccagctgcgtgg

SEQ ID NO: 8227932 - DNA, 22 bp, Homo sapiens
accaggcctagcaagtacatta

SEQ ID NO: 8227933 - DNA, 22 bp, Homo sapiens
accaggccctccagctgcgtgg

SEQ ID NO: 8227934 - DNA, 22 bp, Homo sapiens
accaggccctccagctgcgtgg

SEQ ID NO: 8227935 - DNA, 20 bp, Homo sapiens
accaggcccggtgtctcctc

SEQ ID NO: 8227936 - DNA, 19 bp, Homo sapiens
accaggcctcagaggccct

SEQ ID NO: 8227937 - DNA, 19 bp, Homo sapiens
accaggcctcagaggccct

SEQ ID NO: 8227938 - DNA, 19 bp, Homo sapiens
accaggcctcagaggccct

SEQ ID NO: 8227939 - DNA, 22 bp, Homo sapiens
accaggcctagcaagtacatta

SEQ ID NO: 8227940 - DNA, 22 bp, Homo sapiens
accaggcctagcaagtacatta

SEQ ID NO: 8227941 - DNA, 21 bp, Homo sapiens
agggagctatttatagtaagc

SEQ ID NO: 8227942 - DNA, 22 bp, Homo sapiens
agggagctattgtgttactttg

SEQ ID NO: 8227943 - DNA, 22 bp, Homo sapiens
agggagctaggatcctgaaggt

SEQ ID NO: 8227944 - DNA, 23 bp, Homo sapiens
agggagctaaaaggctggagcag

SEQ ID NO: 8227945 - DNA, 23 bp, Homo sapiens
agggagctaaaaggctggagcag

SEQ ID NO: 8227946 - DNA, 23 bp, Homo sapiens
agggagctaaaaggctggagcag

SEQ ID NO: 8227947 - DNA, 22 bp, Homo sapiens
agggaatgtagcaagatgccaa

SEQ ID NO: 8227948 - DNA, 22 bp, Homo sapiens
agggaagctgctgggtccacct

SEQ ID NO: 8227949 - DNA, 22 bp, Homo sapiens
agggaagccccgaggaggcacc

SEQ ID NO: 8227950 - DNA, 22 bp, Homo sapiens
agggaagaggaccagagtctct

SEQ ID NO: 8227951 - DNA, 22 bp, Homo sapiens
agggaagaggaccagagtctct

SEQ ID NO: 8227952 - DNA, 22 bp, Homo sapiens
agggaagaggaccagagtctct

SEQ ID NO: 8227953 - DNA, 22 bp, Homo sapiens
agggaagaggcaaggtttatgg

SEQ ID NO: 8227954 - DNA, 22 bp, Homo sapiens
agggaagcaggaatagctctga

SEQ ID NO: 8227955 - DNA, 22 bp, Homo sapiens
agggaattcactggaacgccct

SEQ ID NO: 8227956 - DNA, 22 bp, Homo sapiens
agggaattcactggaacgccct

SEQ ID NO: 8227957 - DNA, 22 bp, Homo sapiens
agggaatgtgaaaacacctctc

SEQ ID NO: 8227958 - DNA, 22 bp, Homo sapiens
agggaatgtagcaagatgccaa

SEQ ID NO: 8227959 - DNA, 21 bp, Homo sapiens
agggacaaaacacaatgccac

SEQ ID NO: 8227960 - DNA, 20 bp, Homo sapiens
agggacacaatatttctgtg

SEQ ID NO: 8227961 - DNA, 22 bp, Homo sapiens
agggacacgaggtcctgctggg

SEQ ID NO: 8227962 - DNA, 22 bp, Homo sapiens
agggacagatgaatgactgagt

SEQ ID NO: 8227963 - DNA, 22 bp, Homo sapiens
agggacacttgctttcaggccc

SEQ ID NO: 8227964 - DNA, 17 bp, Homo sapiens
agggacagcagtttagg

SEQ ID NO: 8227965 - DNA, 17 bp, Homo sapiens
agggacagcagtttagg

SEQ ID NO: 8227966 - DNA, 17 bp, Homo sapiens
agggacagcagtttagg

SEQ ID NO: 8227967 - DNA, 22 bp, Homo sapiens
agggcagttcagccacaggctc

SEQ ID NO: 8227968 - DNA, 22 bp, Homo sapiens
agggcagttcaacttcatagtg

SEQ ID NO: 8227969 - DNA, 23 bp, Homo sapiens
agggcatgaagcagaggacgtgg

SEQ ID NO: 8227970 - DNA, 22 bp, Homo sapiens
agggcatgaaatgggcagaagc

SEQ ID NO: 8227971 - DNA, 22 bp, Homo sapiens
agggcatgaaatgggcagaagc

SEQ ID NO: 8227972 - DNA, 22 bp, Homo sapiens
acccaggcctgagagacaggag

SEQ ID NO: 8227973 - DNA, 22 bp, Homo sapiens
acccaggcctgagagacaggag

SEQ ID NO: 8227974 - DNA, 22 bp, Homo sapiens
acccaggagcaggctgggcagt

SEQ ID NO: 8227975 - DNA, 22 bp, Homo sapiens
acccaggagcaggctgggcagt

SEQ ID NO: 8227976 - DNA, 22 bp, Homo sapiens
agggcatgaagcagtggacagc

SEQ ID NO: 8227977 - DNA, 22 bp, Homo sapiens
agggcatgaagcagtggacagc

SEQ ID NO: 8227978 - DNA, 22 bp, Homo sapiens
agggcatgaagcagtggacagc

SEQ ID NO: 8227979 - DNA, 23 bp, Homo sapiens
agggcatgaagcagaggacgtgg

SEQ ID NO: 8227980 - DNA, 23 bp, Homo sapiens
agggcatgaagcagaggacgtgg

SEQ ID NO: 8227981 - DNA, 23 bp, Homo sapiens
agggcatgaagcagaggacgtgg

SEQ ID NO: 8227982 - DNA, 22 bp, Homo sapiens
acccaataatgcaactccactt

SEQ ID NO: 8227983 - DNA, 22 bp, Homo sapiens
acccaatacctgtgcagggctt

SEQ ID NO: 8227984 - DNA, 22 bp, Homo sapiens
acccacacatctctaattcagt

SEQ ID NO: 8227985 - DNA, 22 bp, Homo sapiens
accattttgggtattttcagag

SEQ ID NO: 8227986 - DNA, 22 bp, Homo sapiens
acccacacctccgtatatcact

SEQ ID NO: 8227987 - DNA, 22 bp, Homo sapiens
acccaaagcaatattcatcagt

SEQ ID NO: 8227988 - DNA, 20 bp, Homo sapiens
agggcagcttgaggagccgg

SEQ ID NO: 8227989 - DNA, 22 bp, Homo sapiens
agggcagcttccatagtctggc

SEQ ID NO: 8227990 - DNA, 20 bp, Homo sapiens
agggcagcttgaggagccgg

SEQ ID NO: 8227991 - DNA, 20 bp, Homo sapiens
agggcagcttgaggagccgg

SEQ ID NO: 8227992 - DNA, 22 bp, Homo sapiens
agggagctcgatgcctgagtgt

SEQ ID NO: 8227993 - DNA, 22 bp, Homo sapiens
agggagctcgatgcctgagtgt

SEQ ID NO: 8227994 - DNA, 22 bp, Homo sapiens
agggagctcgatgcctgagtgt

SEQ ID NO: 8227995 - DNA, 22 bp, Homo sapiens
agggagctcacagtccagtaga

SEQ ID NO: 8227996 - DNA, 22 bp, Homo sapiens
agggagctcagttggaagcggt

SEQ ID NO: 8227997 - DNA, 22 bp, Homo sapiens
agggagctcacagtccagtaga

SEQ ID NO: 8227998 - DNA, 22 bp, Homo sapiens
agggagctcacagtccagtaga

SEQ ID NO: 8227999 - DNA, 22 bp, Homo sapiens
agggagctatttcagggttatt

SEQ ID NO: 8228000 - DNA, 22 bp, Homo sapiens
accatcagtactggatgctgac

SEQ ID NO: 8228001 - DNA, 22 bp, Homo sapiens
accatgttggccaagctggtct

SEQ ID NO: 8228002 - DNA, 22 bp, Homo sapiens
agggagctctttggtcttgccg

SEQ ID NO: 8228003 - DNA, 22 bp, Homo sapiens
agggagctctgggggcacacgg

SEQ ID NO: 8228004 - DNA, 22 bp, Homo sapiens
agggagctctgggggcacacgg

SEQ ID NO: 8228005 - DNA, 22 bp, Homo sapiens
agggagctctaagtagagggac

SEQ ID NO: 8228006 - DNA, 22 bp, Homo sapiens
agggagctctgggggcacacgg

SEQ ID NO: 8228007 - DNA, 22 bp, Homo sapiens
agggagctctgggggcacacgg

SEQ ID NO: 8228008 - DNA, 21 bp, Homo sapiens
accattctgcacatgctgtca

SEQ ID NO: 8228009 - DNA, 22 bp, Homo sapiens
accatgttggccaagctggtct

SEQ ID NO: 8228010 - DNA, 22 bp, Homo sapiens
accattgccccctagtgtctgt

SEQ ID NO: 8228011 - DNA, 22 bp, Homo sapiens
accatttaaggaaaatgtatca

SEQ ID NO: 8228012 - DNA, 22 bp, Homo sapiens
accatttaaggaaaatgtatca

SEQ ID NO: 8228013 - DNA, 22 bp, Homo sapiens
accattgccccctagtgtctgt

SEQ ID NO: 8228014 - DNA, 22 bp, Homo sapiens
acccaggcctgagagacaggag

SEQ ID NO: 8228015 - DNA, 22 bp, Homo sapiens
acccaggcctgagagacaggag

SEQ ID NO: 8228016 - DNA, 22 bp, Homo sapiens
acccaggcgggagtgcagtgtc

SEQ ID NO: 8228017 - DNA, 22 bp, Homo sapiens
acccaggcgggagtgcagtgtc

SEQ ID NO: 8228018 - DNA, 22 bp, Homo sapiens
acccaggctagaagtgaattat

SEQ ID NO: 8228019 - DNA, 22 bp, Homo sapiens
acccaggctagagtgcagtggt

SEQ ID NO: 8228020 - DNA, 22 bp, Homo sapiens
acccaggctagagtgcagtggt

SEQ ID NO: 8228021 - DNA, 22 bp, Homo sapiens
acccaggctagggtgcagtggc

SEQ ID NO: 8228022 - DNA, 22 bp, Homo sapiens
acccaggctagggtgcagtggc

SEQ ID NO: 8228023 - DNA, 17 bp, Homo sapiens
acccaggctctatcttg

SEQ ID NO: 8228024 - DNA, 18 bp, Homo sapiens
acccaggctcatggtcct

SEQ ID NO: 8228025 - DNA, 22 bp, Homo sapiens
acccaggctggagtgcagtagc

SEQ ID NO: 8228026 - DNA, 22 bp, Homo sapiens
acccaggctggagtgcagtgac

SEQ ID NO: 8228027 - DNA, 22 bp, Homo sapiens
agggcctgggaagaggaaccct

SEQ ID NO: 8228028 - DNA, 22 bp, Homo sapiens
agggcctgggaagaggaaccct

SEQ ID NO: 8228029 - DNA, 22 bp, Homo sapiens
acccaggctggagtgcagtagc

SEQ ID NO: 8228030 - DNA, 22 bp, Homo sapiens
acccaggctgcttctcagtggc

SEQ ID NO: 8228031 - DNA, 22 bp, Homo sapiens
agggcctgggccagcacccttt

SEQ ID NO: 8228032 - DNA, 22 bp, Homo sapiens
agggcctggggtagcttactgc

SEQ ID NO: 8228033 - DNA, 22 bp, Homo sapiens
agggcctgggccagcacccttt

SEQ ID NO: 8228034 - DNA, 22 bp, Homo sapiens
agggcctgggatgtcctcctag

SEQ ID NO: 8228035 - DNA, 22 bp, Homo sapiens
agggcctgggatgtcctcctag

SEQ ID NO: 8228036 - DNA, 22 bp, Homo sapiens
agggcctgggccagcacccttt

SEQ ID NO: 8228037 - DNA, 22 bp, Homo sapiens
agggcctggttctgtgtaggga

SEQ ID NO: 8228038 - DNA, 22 bp, Homo sapiens
agggcctggttctgtgtaggga

SEQ ID NO: 8228039 - DNA, 22 bp, Homo sapiens
agggcctggggtagcttactgc

SEQ ID NO: 8228040 - DNA, 22 bp, Homo sapiens
agggcctgggtctgtactcctc

SEQ ID NO: 8228041 - DNA, 22 bp, Homo sapiens
agggcctgggtctgtactcctc

SEQ ID NO: 8228042 - DNA, 22 bp, Homo sapiens
agggcctggtgacctgggtcct

SEQ ID NO: 8228043 - DNA, 22 bp, Homo sapiens
agggcctggtgacctgggtcct

SEQ ID NO: 8228044 - DNA, 22 bp, Homo sapiens
accctcagacagctgtggccag

SEQ ID NO: 8228045 - DNA, 22 bp, Homo sapiens
accctcagacatattccatcat

SEQ ID NO: 8228046 - DNA, 22 bp, Homo sapiens
accctcaagatggaagcagttt

SEQ ID NO: 8228047 - DNA, 22 bp, Homo sapiens
accctcaagatggaagcagttt

SEQ ID NO: 8228048 - DNA, 16 bp, Homo sapiens
accctcagaaactgct

SEQ ID NO: 8228049 - DNA, 22 bp, Homo sapiens
accctcaacaaattcactctat

SEQ ID NO: 8228050 - DNA, 22 bp, Homo sapiens
accctcaacaaattcactctat

SEQ ID NO: 8228051 - DNA, 19 bp, Homo sapiens
accctaggaggtctggtga

SEQ ID NO: 8228052 - DNA, 22 bp, Homo sapiens
acccgggaggcaggagtcatag

SEQ ID NO: 8228053 - DNA, 22 bp, Homo sapiens
accctagacattgaactagggt

SEQ ID NO: 8228054 - DNA, 22 bp, Homo sapiens
accctactaaatgtggtatgtc

SEQ ID NO: 8228055 - DNA, 22 bp, Homo sapiens
accctaataatcacagactagt

SEQ ID NO: 8228056 - DNA, 22 bp, Homo sapiens
accctaataatcacagactagt

SEQ ID NO: 8228057 - DNA, 22 bp, Homo sapiens
acccggagtcggaggttgcagt

SEQ ID NO: 8228058 - DNA, 22 bp, Homo sapiens
acatgcacacctatatacatgt

SEQ ID NO: 8228059 - DNA, 22 bp, Homo sapiens
acatgcacacgattcagtctgg

SEQ ID NO: 8228060 - DNA, 22 bp, Homo sapiens
acatgcacacgattcagtctgg

SEQ ID NO: 8228061 - DNA, 22 bp, Homo sapiens
acatgcacccagggcattgctt

SEQ ID NO: 8228062 - DNA, 22 bp, Homo sapiens
acatgcacccagttacactctc

SEQ ID NO: 8228063 - DNA, 22 bp, Homo sapiens
acatgcacccagttacactctc

SEQ ID NO: 8228064 - DNA, 22 bp, Homo sapiens
acatgcacccagttacactctc

SEQ ID NO: 8228065 - DNA, 22 bp, Homo sapiens
acatgcacagcaagggtgagag

SEQ ID NO: 8228066 - DNA, 22 bp, Homo sapiens
acatgcacccagggcattgctt

SEQ ID NO: 8228067 - DNA, 19 bp, Homo sapiens
acatgcaaggcacctgcag

SEQ ID NO: 8228068 - DNA, 19 bp, Homo sapiens
acatgcaaggcacctgcag

SEQ ID NO: 8228069 - DNA, 22 bp, Homo sapiens
acatgcaatattgagactttct

SEQ ID NO: 8228070 - DNA, 22 bp, Homo sapiens
acatgcacacctatatacatgt

SEQ ID NO: 8228071 - DNA, 23 bp, Homo sapiens
acatgcaaaaatcacagtctcct

SEQ ID NO: 8228072 - DNA, 22 bp, Homo sapiens
acatgcaacaaagtacctgcaa

SEQ ID NO: 8228073 - DNA, 22 bp, Homo sapiens
acatgcaaatgtgcatgcatgt

SEQ ID NO: 8228074 - DNA, 22 bp, Homo sapiens
acatgcaaatgtgcatgcatgt

SEQ ID NO: 8228075 - DNA, 22 bp, Homo sapiens
acatgaggaactcaggagtcac

SEQ ID NO: 8228076 - DNA, 22 bp, Homo sapiens
acatgagatttgggtggtgata

SEQ ID NO: 8228077 - DNA, 22 bp, Homo sapiens
acatgaggaaacaagggtatat

SEQ ID NO: 8228078 - DNA, 22 bp, Homo sapiens
acatgaggaactcaggagtcac

SEQ ID NO: 8228079 - DNA, 22 bp, Homo sapiens
acatgagaggctgtggagtaca

SEQ ID NO: 8228080 - DNA, 22 bp, Homo sapiens
acatgagaggctgtggagtaca

SEQ ID NO: 8228081 - DNA, 22 bp, Homo sapiens
acatgagagaaaagtattctga

SEQ ID NO: 8228082 - DNA, 22 bp, Homo sapiens
acatgagatcacaaagataaat

SEQ ID NO: 8228083 - DNA, 22 bp, Homo sapiens
acatgatttgcatgatttgtaa

SEQ ID NO: 8228084 - DNA, 23 bp, Homo sapiens
acatgatacacaattagcaaacc

SEQ ID NO: 8228085 - DNA, 22 bp, Homo sapiens
acatgatatatgggaaatgctt

SEQ ID NO: 8228086 - DNA, 22 bp, Homo sapiens
acatgagagaaaagtattctga

SEQ ID NO: 8228087 - DNA, 22 bp, Homo sapiens
acatgagaagctgcaacatgac

SEQ ID NO: 8228088 - DNA, 22 bp, Homo sapiens
aggcaggggagctggaagggta

SEQ ID NO: 8228089 - DNA, 22 bp, Homo sapiens
aggcaggggagctggaagggta

SEQ ID NO: 8228090 - DNA, 22 bp, Homo sapiens
acatgaaagttattctgagttg

SEQ ID NO: 8228091 - DNA, 22 bp, Homo sapiens
aggcagggctcatttcttaggc

SEQ ID NO: 8228092 - DNA, 22 bp, Homo sapiens
aggcagggctgggattagactc

SEQ ID NO: 8228093 - DNA, 22 bp, Homo sapiens
aggcagggctgggattagactc

SEQ ID NO: 8228094 - DNA, 22 bp, Homo sapiens
aggcagggctgggattagactc

SEQ ID NO: 8228095 - DNA, 22 bp, Homo sapiens
aggcaggggagctggaagggta

SEQ ID NO: 8228096 - DNA, 22 bp, Homo sapiens
aggcaggggagctggaagggta

SEQ ID NO: 8228097 - DNA, 22 bp, Homo sapiens
aggcaggggagctggaagggta

SEQ ID NO: 8228098 - DNA, 22 bp, Homo sapiens
aggcagggctgggattagactc

SEQ ID NO: 8228099 - DNA, 22 bp, Homo sapiens
aggcaggcagctgtcaccactc

SEQ ID NO: 8228100 - DNA, 22 bp, Homo sapiens
aggcaggcagctgtcaccactc

SEQ ID NO: 8228101 - DNA, 22 bp, Homo sapiens
aggcaggcagggctcactgtct

SEQ ID NO: 8228102 - DNA, 22 bp, Homo sapiens
aggcaggcagggctcactgtct

SEQ ID NO: 8228103 - DNA, 17 bp, Homo sapiens
aggcaggcagagcggga

SEQ ID NO: 8228104 - DNA, 22 bp, Homo sapiens
aggcaggcactccggaagtgtc

SEQ ID NO: 8228105 - DNA, 22 bp, Homo sapiens
aggcaggcactccggaagtgtc

SEQ ID NO: 8228106 - DNA, 17 bp, Homo sapiens
aggcaggcagagcggga

SEQ ID NO: 8228107 - DNA, 22 bp, Homo sapiens
aggcagggctcatttcttaggc

SEQ ID NO: 8228108 - DNA, 22 bp, Homo sapiens
aggcagggctcatttcttaggc

SEQ ID NO: 8228109 - DNA, 23 bp, Homo sapiens
aggcaggcagttcagctgttgtt

SEQ ID NO: 8228110 - DNA, 22 bp, Homo sapiens
aggcaggctggtctgaagagtg

SEQ ID NO: 8228111 - DNA, 22 bp, Homo sapiens
aggcagggaccagttgttttct

SEQ ID NO: 8228112 - DNA, 22 bp, Homo sapiens
aggccctgttatgagccactgt

SEQ ID NO: 8228113 - DNA, 22 bp, Homo sapiens
aggccctgttatgagccactgt

SEQ ID NO: 8228114 - DNA, 22 bp, Homo sapiens
aggccctgtccatggtgctgaa

SEQ ID NO: 8228115 - DNA, 22 bp, Homo sapiens
aggccctgtccatggtgctgaa

SEQ ID NO: 8228116 - DNA, 22 bp, Homo sapiens
aggccctgtccatggtgctgaa

SEQ ID NO: 8228117 - DNA, 22 bp, Homo sapiens
aggccctgtaaggtgtggagat

SEQ ID NO: 8228118 - DNA, 22 bp, Homo sapiens
aggccctgtaaggtgtggagat

SEQ ID NO: 8228119 - DNA, 22 bp, Homo sapiens
aggccctgtaaggtgtggagat

SEQ ID NO: 8228120 - DNA, 22 bp, Homo sapiens
aggccctgtaaggtgtggagat

SEQ ID NO: 8228121 - DNA, 22 bp, Homo sapiens
aggccctgtaaggtgtggagat

SEQ ID NO: 8228122 - DNA, 22 bp, Homo sapiens
aggccctggtcaggtctggctg

SEQ ID NO: 8228123 - DNA, 22 bp, Homo sapiens
aggccctggtcaggtctggctg

SEQ ID NO: 8228124 - DNA, 22 bp, Homo sapiens
aggccctggtcaggtctggctg

SEQ ID NO: 8228125 - DNA, 22 bp, Homo sapiens
aggccctgcccagagctcctcg

SEQ ID NO: 8228126 - DNA, 20 bp, Homo sapiens
aggccctgccagggacggag

SEQ ID NO: 8228127 - DNA, 22 bp, Homo sapiens
acatgcataaactacttcttat

SEQ ID NO: 8228128 - DNA, 22 bp, Homo sapiens
acatgcagaattcttagagagc

SEQ ID NO: 8228129 - DNA, 22 bp, Homo sapiens
acatgcactctcactgtgctct

SEQ ID NO: 8228130 - DNA, 22 bp, Homo sapiens
acatgcactctcactgtgctct

SEQ ID NO: 8228131 - DNA, 22 bp, Homo sapiens
acatgcactctcactgtgctct

SEQ ID NO: 8228132 - DNA, 22 bp, Homo sapiens
acatgcactgctcagggttccg

SEQ ID NO: 8228133 - DNA, 22 bp, Homo sapiens
acatgcactggttgaggggttt

SEQ ID NO: 8228134 - DNA, 22 bp, Homo sapiens
acatgcacggcaccatcttctg

SEQ ID NO: 8228135 - DNA, 22 bp, Homo sapiens
acatgcacccagttacactctc

SEQ ID NO: 8228136 - DNA, 22 bp, Homo sapiens
acatgcacggcaccatcttctg

SEQ ID NO: 8228137 - DNA, 20 bp, Homo sapiens
acatgcacgtgtgtatatat

SEQ ID NO: 8228138 - DNA, 20 bp, Homo sapiens
acatgcacgtgtgtatatat

SEQ ID NO: 8228139 - DNA, 21 bp, Homo sapiens
acatggactgtgaatggggac

SEQ ID NO: 8228140 - DNA, 21 bp, Homo sapiens
acatggactgtgaatggggac

SEQ ID NO: 8228141 - DNA, 20 bp, Homo sapiens
acatggatcaaatgtcagtt

SEQ ID NO: 8228142 - DNA, 22 bp, Homo sapiens
acatggatgaattgtctagtgg

SEQ ID NO: 8228143 - DNA, 20 bp, Homo sapiens
acatggcattcccacgtggt

SEQ ID NO: 8228144 - DNA, 22 bp, Homo sapiens
aggcctgcctggagcctggctg

SEQ ID NO: 8228145 - DNA, 22 bp, Homo sapiens
aggcctgcctggagcctggctg

SEQ ID NO: 8228146 - DNA, 19 bp, Homo sapiens
acatggcatcccaggaggt

SEQ ID NO: 8228147 - DNA, 22 bp, Homo sapiens
acatggcattcactcccacagg

SEQ ID NO: 8228148 - DNA, 19 bp, Homo sapiens
acatggcatcccaggaggt

SEQ ID NO: 8228149 - DNA, 17 bp, Homo sapiens
acatggcagttcacgct

SEQ ID NO: 8228150 - DNA, 22 bp, Homo sapiens
acatggcaggaatcatgtgttt

SEQ ID NO: 8228151 - DNA, 22 bp, Homo sapiens
aggcccttggactcatgctcga

SEQ ID NO: 8228152 - DNA, 22 bp, Homo sapiens
aggcccttggagtagaggctga

SEQ ID NO: 8228153 - DNA, 22 bp, Homo sapiens
aggcccttgggtcctctccaca

SEQ ID NO: 8228154 - DNA, 22 bp, Homo sapiens
aggcccttgggtcctctccaca

SEQ ID NO: 8228155 - DNA, 22 bp, Homo sapiens
acatggaaaactaactgctttt

SEQ ID NO: 8228156 - DNA, 22 bp, Homo sapiens
acatggaaaactaactgctttt

SEQ ID NO: 8228157 - DNA, 22 bp, Homo sapiens
acatggaaaactaactgctttt

SEQ ID NO: 8228158 - DNA, 22 bp, Homo sapiens
acatggaaaactaactgctttt

SEQ ID NO: 8228159 - DNA, 22 bp, Homo sapiens
acatggaaagtactccacaatt

SEQ ID NO: 8228160 - DNA, 22 bp, Homo sapiens
acatggaagataaaaatactca

SEQ ID NO: 8228161 - DNA, 20 bp, Homo sapiens
acatggaaggtcaaactatc

SEQ ID NO: 8228162 - DNA, 22 bp, Homo sapiens
acatggaagcaaagttctattt

SEQ ID NO: 8228163 - DNA, 22 bp, Homo sapiens
acattgtgatccgactgattaa

SEQ ID NO: 8228164 - DNA, 22 bp, Homo sapiens
acatttaaccaaactgtttaat

SEQ ID NO: 8228165 - DNA, 22 bp, Homo sapiens
acattgtgcctgtgatattaca

SEQ ID NO: 8228166 - DNA, 22 bp, Homo sapiens
acatttaaccaaactgtttaat

SEQ ID NO: 8228167 - DNA, 22 bp, Homo sapiens
acatttaaccaaactgtttaat

SEQ ID NO: 8228168 - DNA, 22 bp, Homo sapiens
acatttaacctttgaggaactg

SEQ ID NO: 8228169 - DNA, 22 bp, Homo sapiens
acatttaaccctcaggtttctg

SEQ ID NO: 8228170 - DNA, 22 bp, Homo sapiens
aggctaggcatgtgctaccaca

SEQ ID NO: 8228171 - DNA, 22 bp, Homo sapiens
aggctagggccatggctggtga

SEQ ID NO: 8228172 - DNA, 22 bp, Homo sapiens
aggctatttccactcttctcat

SEQ ID NO: 8228173 - DNA, 22 bp, Homo sapiens
aggctatttccactcttctcat

SEQ ID NO: 8228174 - DNA, 22 bp, Homo sapiens
aggctatggtggggccagtggc

SEQ ID NO: 8228175 - DNA, 22 bp, Homo sapiens
aggctatggtggggccagtggc

SEQ ID NO: 8228176 - DNA, 22 bp, Homo sapiens
aggctagggtaacagatgtggc

SEQ ID NO: 8228177 - DNA, 22 bp, Homo sapiens
aggccttgaaccttgctgggtg

SEQ ID NO: 8228178 - DNA, 22 bp, Homo sapiens
aggccttgccaatgagagaact

SEQ ID NO: 8228179 - DNA, 22 bp, Homo sapiens
aggccttgccaatgagagaact

SEQ ID NO: 8228180 - DNA, 22 bp, Homo sapiens
aggccttgtgagaagcagagaa

SEQ ID NO: 8228181 - DNA, 22 bp, Homo sapiens
aggccttgggccatagtctcct

SEQ ID NO: 8228182 - DNA, 22 bp, Homo sapiens
aggcctgtttcttgtccagctc

SEQ ID NO: 8228183 - DNA, 22 bp, Homo sapiens
aggccttcctcggagacaggga

SEQ ID NO: 8228184 - DNA, 22 bp, Homo sapiens
aggccttaccatagctgtagca

SEQ ID NO: 8228185 - DNA, 22 bp, Homo sapiens
aggcgcagacatacagggtctg

SEQ ID NO: 8228186 - DNA, 22 bp, Homo sapiens
aggcgcagaaggccaggggcct

SEQ ID NO: 8228187 - DNA, 22 bp, Homo sapiens
aggcgcagaaggccaggggcct

SEQ ID NO: 8228188 - DNA, 22 bp, Homo sapiens
aggcgcagaaggccaggggcct

SEQ ID NO: 8228189 - DNA, 22 bp, Homo sapiens
aggcgagaggcttgggctagta

SEQ ID NO: 8228190 - DNA, 22 bp, Homo sapiens
aggcgaagggaccagacggtag

SEQ ID NO: 8228191 - DNA, 22 bp, Homo sapiens
aggcgaagggaccagacggtag

SEQ ID NO: 8228192 - DNA, 20 bp, Homo sapiens
aggccttgtttatagtgaga

SEQ ID NO: 8228193 - DNA, 22 bp, Homo sapiens
aggctagctgtttcagggctag

SEQ ID NO: 8228194 - DNA, 22 bp, Homo sapiens
aggctagctgtttcagggctag

SEQ ID NO: 8228195 - DNA, 22 bp, Homo sapiens
aggcgcagcacgtgagagttgg

SEQ ID NO: 8228196 - DNA, 22 bp, Homo sapiens
aggcgcctgcgggatccttgcc

SEQ ID NO: 8228197 - DNA, 22 bp, Homo sapiens
aggcgctgagtaggcaaggagg

SEQ ID NO: 8228198 - DNA, 22 bp, Homo sapiens
acatttatataactcactagga

SEQ ID NO: 8228199 - DNA, 22 bp, Homo sapiens
acatttatataactcactagga

SEQ ID NO: 8228200 - DNA, 22 bp, Homo sapiens
acatttatataactcactagga

SEQ ID NO: 8228201 - DNA, 22 bp, Homo sapiens
acatttatataactcactagga

SEQ ID NO: 8228202 - DNA, 22 bp, Homo sapiens
acatttatataactcactagga

SEQ ID NO: 8228203 - DNA, 22 bp, Homo sapiens
acatttattactcaggttgttg

SEQ ID NO: 8228204 - DNA, 22 bp, Homo sapiens
acatttattactcaggttgttg

SEQ ID NO: 8228205 - DNA, 22 bp, Homo sapiens
acatttattactcaggttgttg

SEQ ID NO: 8228206 - DNA, 22 bp, Homo sapiens
acatttatatttagtggggaat

SEQ ID NO: 8228207 - DNA, 22 bp, Homo sapiens
acatttatatttagtggggaat

SEQ ID NO: 8228208 - DNA, 23 bp, Homo sapiens
acatttcaatactgagggtctga

SEQ ID NO: 8228209 - DNA, 22 bp, Homo sapiens
acatttattttggcacggcaca

SEQ ID NO: 8228210 - DNA, 22 bp, Homo sapiens
acatttattttggcacggcaca

SEQ ID NO: 8228211 - DNA, 22 bp, Homo sapiens
acatttattttggcacggcaca

SEQ ID NO: 8228212 - DNA, 22 bp, Homo sapiens
acatttattactcaggttgttg

SEQ ID NO: 8228213 - DNA, 22 bp, Homo sapiens
acatttattactcaggttgttg

SEQ ID NO: 8228214 - DNA, 22 bp, Homo sapiens
acatttattactcaggttgttg

SEQ ID NO: 8228215 - DNA, 22 bp, Homo sapiens
acatttattactcaggttgttg

SEQ ID NO: 8228216 - DNA, 22 bp, Homo sapiens
acatttattttcagctgggaaa

SEQ ID NO: 8228217 - DNA, 22 bp, Homo sapiens
acatttattttcagctgggaaa

SEQ ID NO: 8228218 - DNA, 22 bp, Homo sapiens
acatttattttcagctgggaaa

SEQ ID NO: 8228219 - DNA, 22 bp, Homo sapiens
acatttacagtgctagacaatc

SEQ ID NO: 8228220 - DNA, 22 bp, Homo sapiens
acatttacagtgctagacaatc

SEQ ID NO: 8228221 - DNA, 22 bp, Homo sapiens
acatttacattttctctggcct

SEQ ID NO: 8228222 - DNA, 22 bp, Homo sapiens
acatttacattttctctggcct

SEQ ID NO: 8228223 - DNA, 22 bp, Homo sapiens
acatttacagtgctagacaatc

SEQ ID NO: 8228224 - DNA, 22 bp, Homo sapiens
acatttacagtgctagacaatc

SEQ ID NO: 8228225 - DNA, 22 bp, Homo sapiens
acatttaccctggaacattgga

SEQ ID NO: 8228226 - DNA, 22 bp, Homo sapiens
acatttacctagttaagtcaat

SEQ ID NO: 8228227 - DNA, 18 bp, Homo sapiens
acatttaggagagtcaat

SEQ ID NO: 8228228 - DNA, 22 bp, Homo sapiens
acatttaggatgttttgagaga

SEQ ID NO: 8228229 - DNA, 22 bp, Homo sapiens
acatttatataactcactagga

SEQ ID NO: 8228230 - DNA, 22 bp, Homo sapiens
aggctgaggctttccttggaga

SEQ ID NO: 8228231 - DNA, 22 bp, Homo sapiens
aggctgaggctttccttggaga

SEQ ID NO: 8228232 - DNA, 22 bp, Homo sapiens
aggctgaggctttccttggaga

SEQ ID NO: 8228233 - DNA, 22 bp, Homo sapiens
aggctgagggctcctgagggca

SEQ ID NO: 8228234 - DNA, 22 bp, Homo sapiens
aggctgaggctttccttggaga

SEQ ID NO: 8228235 - DNA, 22 bp, Homo sapiens
aggctgaggctttccttggaga

SEQ ID NO: 8228236 - DNA, 22 bp, Homo sapiens
aggctgagggctcctgagggca

SEQ ID NO: 8228237 - DNA, 22 bp, Homo sapiens
aggctgagggctcctgagggca

SEQ ID NO: 8228238 - DNA, 22 bp, Homo sapiens
aggctgagggctcctgagggca

SEQ ID NO: 8228239 - DNA, 22 bp, Homo sapiens
aggctgagggctcctgagggca

SEQ ID NO: 8228240 - DNA, 22 bp, Homo sapiens
aggctgagggctcctgagggca

SEQ ID NO: 8228241 - DNA, 22 bp, Homo sapiens
aggctgagggctcctgagggca

SEQ ID NO: 8228242 - DNA, 22 bp, Homo sapiens
aggctgagggctcctgagggca

SEQ ID NO: 8228243 - DNA, 22 bp, Homo sapiens
aggctgaggatccctgtgttct

SEQ ID NO: 8228244 - DNA, 22 bp, Homo sapiens
aggctgaggatccctgtgttct

SEQ ID NO: 8228245 - DNA, 22 bp, Homo sapiens
acatttcactgttcacagcagg

SEQ ID NO: 8228246 - DNA, 22 bp, Homo sapiens
aggctgaggctggcagctccag

SEQ ID NO: 8228247 - DNA, 22 bp, Homo sapiens
aggctgaggcgggtagatcacc

SEQ ID NO: 8228248 - DNA, 22 bp, Homo sapiens
aggctgaggctggcagctccag

SEQ ID NO: 8228249 - DNA, 22 bp, Homo sapiens
aggctgaggctggcagctccag

SEQ ID NO: 8228250 - DNA, 22 bp, Homo sapiens
aggctgaggctggcagctccag

SEQ ID NO: 8228251 - DNA, 22 bp, Homo sapiens
aggctgaggctggcagctccag

SEQ ID NO: 8228252 - DNA, 22 bp, Homo sapiens
aggctgaggctggcagctccag

SEQ ID NO: 8228253 - DNA, 22 bp, Homo sapiens
aggctgaggctggcagctccag

SEQ ID NO: 8228254 - DNA, 22 bp, Homo sapiens
aggctgatgctggctgaggctg

SEQ ID NO: 8228255 - DNA, 22 bp, Homo sapiens
aggctgagtttctcattctcgc

SEQ ID NO: 8228256 - DNA, 22 bp, Homo sapiens
aggctgagtttctcattctcgc

SEQ ID NO: 8228257 - DNA, 22 bp, Homo sapiens
aggctgagtttctcattctcgc

SEQ ID NO: 8228258 - DNA, 22 bp, Homo sapiens
aggctgagtttctcattctcgc

SEQ ID NO: 8228259 - DNA, 22 bp, Homo sapiens
aggctgagtttctcattctcgc

SEQ ID NO: 8228260 - DNA, 18 bp, Homo sapiens
aggctgcactgtcttaaa

SEQ ID NO: 8228261 - DNA, 18 bp, Homo sapiens
aggctgcactgtcttaaa

SEQ ID NO: 8228262 - DNA, 19 bp, Homo sapiens
aggctgcaaggtggtgggc

SEQ ID NO: 8228263 - DNA, 19 bp, Homo sapiens
aggctgcaaggtggtgggc

SEQ ID NO: 8228264 - DNA, 22 bp, Homo sapiens
aggctgatgctggctgaggctg

SEQ ID NO: 8228265 - DNA, 22 bp, Homo sapiens
aggctgattgaagtttttgtgg

SEQ ID NO: 8228266 - DNA, 22 bp, Homo sapiens
aggctgcaaagtgcttgggtgc

SEQ ID NO: 8228267 - DNA, 20 bp, Homo sapiens
aggctgagttctatgcactt

SEQ ID NO: 8228268 - DNA, 22 bp, Homo sapiens
aggctgagtgctcccctagatg

SEQ ID NO: 8228269 - DNA, 20 bp, Homo sapiens
aggctgagttctatgcactt

SEQ ID NO: 8228270 - DNA, 20 bp, Homo sapiens
aggctgagttctatgcactt

SEQ ID NO: 8228271 - DNA, 20 bp, Homo sapiens
aggctgagttctatgcactt

SEQ ID NO: 8228272 - DNA, 22 bp, Homo sapiens
aggctgagggctcctgagggca

SEQ ID NO: 8228273 - DNA, 22 bp, Homo sapiens
aggctgagtgctcccctagatg

SEQ ID NO: 8228274 - DNA, 22 bp, Homo sapiens
aggctgagtgctcccctagatg

SEQ ID NO: 8228275 - DNA, 22 bp, Homo sapiens
aggctgagtgctcccctagatg

SEQ ID NO: 8228276 - DNA, 22 bp, Homo sapiens
aggctgagtgctcccctagatg

SEQ ID NO: 8228277 - DNA, 22 bp, Homo sapiens
acagtttgccctgacattctcc

SEQ ID NO: 8228278 - DNA, 22 bp, Homo sapiens
acagtttgccctgacattctcc

SEQ ID NO: 8228279 - DNA, 22 bp, Homo sapiens
acagtttggcagtttcttacta

SEQ ID NO: 8228280 - DNA, 22 bp, Homo sapiens
acagtttggcgtgattgatagt

SEQ ID NO: 8228281 - DNA, 17 bp, Homo sapiens
acagtttgtcattctaa

SEQ ID NO: 8228282 - DNA, 17 bp, Homo sapiens
acagtttgtcattctaa

SEQ ID NO: 8228283 - DNA, 19 bp, Homo sapiens
acagtttgggaaatgagca

SEQ ID NO: 8228284 - DNA, 22 bp, Homo sapiens
aggcagcatgggccccagctcc

SEQ ID NO: 8228285 - DNA, 22 bp, Homo sapiens
aggcagcatgggcccagagtcc

SEQ ID NO: 8228286 - DNA, 22 bp, Homo sapiens
aggcagcatgggccccagctcc

SEQ ID NO: 8228287 - DNA, 22 bp, Homo sapiens
aggcagcatgggccccagctcc

SEQ ID NO: 8228288 - DNA, 22 bp, Homo sapiens
aggcagcatccagaggagaatg

SEQ ID NO: 8228289 - DNA, 22 bp, Homo sapiens
aggcagcatgctctgcttctac

SEQ ID NO: 8228290 - DNA, 21 bp, Homo sapiens
aggcagcatctgatttatatg

SEQ ID NO: 8228291 - DNA, 22 bp, Homo sapiens
aggcagcatgctctgcttctac

SEQ ID NO: 8228292 - DNA, 19 bp, Homo sapiens
aggcagcacccagtccttg

SEQ ID NO: 8228293 - DNA, 19 bp, Homo sapiens
aggcagcacccagtccttg

SEQ ID NO: 8228294 - DNA, 22 bp, Homo sapiens
aggcagcagtgataagatagga

SEQ ID NO: 8228295 - DNA, 22 bp, Homo sapiens
aggcagcatccagaggagaatg

SEQ ID NO: 8228296 - DNA, 22 bp, Homo sapiens
aggcaggcaaccacctgggaag

SEQ ID NO: 8228297 - DNA, 22 bp, Homo sapiens
aggcaggcaagttcatatgagg

SEQ ID NO: 8228298 - DNA, 22 bp, Homo sapiens
aggcaggcaagttcatatgagg

SEQ ID NO: 8228299 - DNA, 22 bp, Homo sapiens
aggcaggcacacttcctccagg

SEQ ID NO: 8228300 - DNA, 22 bp, Homo sapiens
aggcaggcactccggaagtgtc

SEQ ID NO: 8228301 - DNA, 22 bp, Homo sapiens
aggcaggcactccggaagtgtc

SEQ ID NO: 8228302 - DNA, 22 bp, Homo sapiens
aggcaggcactccggaagtgtc

SEQ ID NO: 8228303 - DNA, 22 bp, Homo sapiens
aggcaggattgctgacaacaat

SEQ ID NO: 8228304 - DNA, 22 bp, Homo sapiens
aggcaggattgctgacaacaat

SEQ ID NO: 8228305 - DNA, 22 bp, Homo sapiens
aggcaggcaaccacctgggaag

SEQ ID NO: 8228306 - DNA, 22 bp, Homo sapiens
aggcaggattgctgacaacaat

SEQ ID NO: 8228307 - DNA, 22 bp, Homo sapiens
aggcaggcaaccacctgggaag

SEQ ID NO: 8228308 - DNA, 22 bp, Homo sapiens
aggcaggcaaccacctgggaag

SEQ ID NO: 8228309 - DNA, 22 bp, Homo sapiens
aggcaggcaaccacctgggaag

SEQ ID NO: 8228310 - DNA, 21 bp, Homo sapiens
acagttttaaggagcacatgg

SEQ ID NO: 8228311 - DNA, 22 bp, Homo sapiens
acagtttgtgttggccatgggc

SEQ ID NO: 8228312 - DNA, 22 bp, Homo sapiens
acagtttgttccttttcattgc

SEQ ID NO: 8228313 - DNA, 22 bp, Homo sapiens
acagtttgttccttttcattgc

SEQ ID NO: 8228314 - DNA, 23 bp, Homo sapiens
acataaacagaaggtgtgcttcc

SEQ ID NO: 8228315 - DNA, 22 bp, Homo sapiens
acataaaggtgactaacatctt

SEQ ID NO: 8228316 - DNA, 22 bp, Homo sapiens
acataaatagattattgggagg

SEQ ID NO: 8228317 - DNA, 22 bp, Homo sapiens
acataaatagattattgggagg

SEQ ID NO: 8228318 - DNA, 22 bp, Homo sapiens
aggcagctggaggcagagacta

SEQ ID NO: 8228319 - DNA, 22 bp, Homo sapiens
aggcagctggaggcagagacta

SEQ ID NO: 8228320 - DNA, 22 bp, Homo sapiens
acagtgcaaaccctcgggaaag

SEQ ID NO: 8228321 - DNA, 22 bp, Homo sapiens
acagtgattttttcgagcagaa

SEQ ID NO: 8228322 - DNA, 22 bp, Homo sapiens
acagtgatttcatccttctggg

SEQ ID NO: 8228323 - DNA, 22 bp, Homo sapiens
acagtgattttaggatagatgg

SEQ ID NO: 8228324 - DNA, 22 bp, Homo sapiens
acagtgattttttcgagcagaa

SEQ ID NO: 8228325 - DNA, 22 bp, Homo sapiens
acagtgattggggtatctgcag

SEQ ID NO: 8228326 - DNA, 18 bp, Homo sapiens
acagtgattgttctatgc

SEQ ID NO: 8228327 - DNA, 22 bp, Homo sapiens
acagtgattggggtatctgcag

SEQ ID NO: 8228328 - DNA, 22 bp, Homo sapiens
acagtgattctgcaaaccatat

SEQ ID NO: 8228329 - DNA, 22 bp, Homo sapiens
acagtgataaaatttcacatgt

SEQ ID NO: 8228330 - DNA, 22 bp, Homo sapiens
acagtgataaaatttcacatgt

SEQ ID NO: 8228331 - DNA, 22 bp, Homo sapiens
acagtgaggacagggactgtgt

SEQ ID NO: 8228332 - DNA, 22 bp, Homo sapiens
acagtgataaaatttcacatgt

SEQ ID NO: 8228333 - DNA, 22 bp, Homo sapiens
acagtgatcagttactgtctgt

SEQ ID NO: 8228334 - DNA, 22 bp, Homo sapiens
acagtgatgccgggcgagaatg

SEQ ID NO: 8228335 - DNA, 22 bp, Homo sapiens
acagtgatcttttagttggaac

SEQ ID NO: 8228336 - DNA, 22 bp, Homo sapiens
acagtgatgagccggctgaggc

SEQ ID NO: 8228337 - DNA, 22 bp, Homo sapiens
acagtgcaaacttttgtctcct

SEQ ID NO: 8228338 - DNA, 22 bp, Homo sapiens
acagtgttttagaaaagcttga

SEQ ID NO: 8228339 - DNA, 22 bp, Homo sapiens
acagtgttctgctttttaatcc

SEQ ID NO: 8228340 - DNA, 22 bp, Homo sapiens
acagtgttttagaaaagcttga

SEQ ID NO: 8228341 - DNA, 22 bp, Homo sapiens
acagtgttctgctttttaatcc

SEQ ID NO: 8228342 - DNA, 22 bp, Homo sapiens
acagtgttttgtctggcagggc

SEQ ID NO: 8228343 - DNA, 22 bp, Homo sapiens
acagtgttttgtctggcagggc

SEQ ID NO: 8228344 - DNA, 22 bp, Homo sapiens
acagtgttttcttaaggagaaa

SEQ ID NO: 8228345 - DNA, 22 bp, Homo sapiens
acagtgttttatgagaattgtt

SEQ ID NO: 8228346 - DNA, 22 bp, Homo sapiens
acagttaactggagagcgagtt

SEQ ID NO: 8228347 - DNA, 22 bp, Homo sapiens
acagttaaatatttctactggg

SEQ ID NO: 8228348 - DNA, 20 bp, Homo sapiens
acagtgtttttgagtagagc

SEQ ID NO: 8228349 - DNA, 22 bp, Homo sapiens
acagttaggtcctaaaattctg

SEQ ID NO: 8228350 - DNA, 23 bp, Homo sapiens
acagttatagctgtgaataacat

SEQ ID NO: 8228351 - DNA, 22 bp, Homo sapiens
acagttcaagacatcagtatga

SEQ ID NO: 8228352 - DNA, 22 bp, Homo sapiens
acagttcaagcaagtttctgtt

SEQ ID NO: 8228353 - DNA, 22 bp, Homo sapiens
acagttcaagcaagtttctgtt

SEQ ID NO: 8228354 - DNA, 22 bp, Homo sapiens
acagttagggactataatcatt

SEQ ID NO: 8228355 - DNA, 22 bp, Homo sapiens
acagttagaaagtggcagaacc

SEQ ID NO: 8228356 - DNA, 22 bp, Homo sapiens
acagttaggcacgggtacagca

SEQ ID NO: 8228357 - DNA, 22 bp, Homo sapiens
acagtaattaaacattctgatt

SEQ ID NO: 8228358 - DNA, 22 bp, Homo sapiens
acagtaatgcatacaagttagt

SEQ ID NO: 8228359 - DNA, 21 bp, Homo sapiens
acagtaaattccctgcaaaga

SEQ ID NO: 8228360 - DNA, 22 bp, Homo sapiens
acagtaataagtgttggtgagg

SEQ ID NO: 8228361 - DNA, 21 bp, Homo sapiens
aggaggaacccgtggctgggc

SEQ ID NO: 8228362 - DNA, 23 bp, Homo sapiens
aggaggaaaagttatctgctgag

SEQ ID NO: 8228363 - DNA, 23 bp, Homo sapiens
aggaggaaaagttatctgctgag

SEQ ID NO: 8228364 - DNA, 23 bp, Homo sapiens
aggaggaaaagttatctgctgag

SEQ ID NO: 8228365 - DNA, 22 bp, Homo sapiens
aggaggaaaaaggccacagcaa

SEQ ID NO: 8228366 - DNA, 22 bp, Homo sapiens
aggaggaactcagaaagaaggt

SEQ ID NO: 8228367 - DNA, 22 bp, Homo sapiens
aggaggaactcagaaagaaggt

SEQ ID NO: 8228368 - DNA, 20 bp, Homo sapiens
aggaggaagaaagcacactg

SEQ ID NO: 8228369 - DNA, 22 bp, Homo sapiens
acagtaaatcaacagaatatct

SEQ ID NO: 8228370 - DNA, 21 bp, Homo sapiens
aggaggaacccgtggctgggc

SEQ ID NO: 8228371 - DNA, 22 bp, Homo sapiens
aggagtggaattactgggttct

SEQ ID NO: 8228372 - DNA, 22 bp, Homo sapiens
aggagtggaattactgggttct

SEQ ID NO: 8228373 - DNA, 22 bp, Homo sapiens
acagtgaggacagggactgtgt

SEQ ID NO: 8228374 - DNA, 22 bp, Homo sapiens
aggagtgcaaatagtccagaga

SEQ ID NO: 8228375 - DNA, 22 bp, Homo sapiens
aggagtgagtgtcctcagcaga

SEQ ID NO: 8228376 - DNA, 22 bp, Homo sapiens
aggagtgcaaatagtccagaga

SEQ ID NO: 8228377 - DNA, 22 bp, Homo sapiens
aggagtgcaaatagtccagaga

SEQ ID NO: 8228378 - DNA, 22 bp, Homo sapiens
aggagtgctgcaagttgacaga

SEQ ID NO: 8228379 - DNA, 22 bp, Homo sapiens
aggagtgccttttcatgagtgt

SEQ ID NO: 8228380 - DNA, 22 bp, Homo sapiens
aggagtgagctttggggtcaga

SEQ ID NO: 8228381 - DNA, 22 bp, Homo sapiens
aggagtgagtgtcctcagcaga

SEQ ID NO: 8228382 - DNA, 22 bp, Homo sapiens
aggagtctgaactggtcccctg

SEQ ID NO: 8228383 - DNA, 22 bp, Homo sapiens
aggagtccatgagcagctagag

SEQ ID NO: 8228384 - DNA, 20 bp, Homo sapiens
aggagtccctgtgctctctc

SEQ ID NO: 8228385 - DNA, 17 bp, Homo sapiens
aggagtctcagatgagc

SEQ ID NO: 8228386 - DNA, 22 bp, Homo sapiens
aggagggtgatccgggctggtc

SEQ ID NO: 8228387 - DNA, 22 bp, Homo sapiens
aggagtcactcagggcttcatc

SEQ ID NO: 8228388 - DNA, 22 bp, Homo sapiens
aggagtcagatatgggaaagtt

SEQ ID NO: 8228389 - DNA, 22 bp, Homo sapiens
aggagtcagatatgggaaagtt

SEQ ID NO: 8228390 - DNA, 22 bp, Homo sapiens
aggagtcagattgtttgaatgt

SEQ ID NO: 8228391 - DNA, 22 bp, Homo sapiens
aggagtcataaatgtgaacaaa

SEQ ID NO: 8228392 - DNA, 22 bp, Homo sapiens
aggagtcaggaccaaatggaaa

SEQ ID NO: 8228393 - DNA, 22 bp, Homo sapiens
aggagtcaggaattatttatga

SEQ ID NO: 8228394 - DNA, 22 bp, Homo sapiens
acagtacaagcatgatacataa

SEQ ID NO: 8228395 - DNA, 22 bp, Homo sapiens
acagtacaagcaatgcattttt

SEQ ID NO: 8228396 - DNA, 22 bp, Homo sapiens
acagtacaaaacccaccagagg

SEQ ID NO: 8228397 - DNA, 22 bp, Homo sapiens
aggagggtgatccgggctggtc

SEQ ID NO: 8228398 - DNA, 22 bp, Homo sapiens
acagtacaccactgtgtacagt

SEQ ID NO: 8228399 - DNA, 22 bp, Homo sapiens
acaggtggaaacatggtgttgg

SEQ ID NO: 8228400 - DNA, 22 bp, Homo sapiens
acaggtggaaacatggtgttgg

SEQ ID NO: 8228401 - DNA, 22 bp, Homo sapiens
acaggtggacacagcagcagtc

SEQ ID NO: 8228402 - DNA, 22 bp, Homo sapiens
acaggtggacacagcagcagtc

SEQ ID NO: 8228403 - DNA, 22 bp, Homo sapiens
acaggtggacacagcagcagtc

SEQ ID NO: 8228404 - DNA, 22 bp, Homo sapiens
acaggtggcactgctgttactc

SEQ ID NO: 8228405 - DNA, 22 bp, Homo sapiens
acaggtggcagaagcatttact

SEQ ID NO: 8228406 - DNA, 22 bp, Homo sapiens
acaggtggcactgctgttactc

SEQ ID NO: 8228407 - DNA, 22 bp, Homo sapiens
acaggtggcagaagcatttact

SEQ ID NO: 8228408 - DNA, 22 bp, Homo sapiens
acaggtggcataggcagtttga

SEQ ID NO: 8228409 - DNA, 22 bp, Homo sapiens
acaggtggcataggcagtttga

SEQ ID NO: 8228410 - DNA, 22 bp, Homo sapiens
acaggtggccccgagggagtgg

SEQ ID NO: 8228411 - DNA, 22 bp, Homo sapiens
acaggtggagtggttagcaggc

SEQ ID NO: 8228412 - DNA, 22 bp, Homo sapiens
acaggtggaggctttaggaggt

SEQ ID NO: 8228413 - DNA, 22 bp, Homo sapiens
acaggtggagtggttagcaggc

SEQ ID NO: 8228414 - DNA, 22 bp, Homo sapiens
acaggtggaggctttaggaggt

SEQ ID NO: 8228415 - DNA, 22 bp, Homo sapiens
acaggtggacacagcagcagtc

SEQ ID NO: 8228416 - DNA, 22 bp, Homo sapiens
acagggagtctgaggggatagt

SEQ ID NO: 8228417 - DNA, 22 bp, Homo sapiens
acagggattttccaggctaccc

SEQ ID NO: 8228418 - DNA, 22 bp, Homo sapiens
acagggattttccaggctaccc

SEQ ID NO: 8228419 - DNA, 22 bp, Homo sapiens
acagggcaacctctgggagact

SEQ ID NO: 8228420 - DNA, 18 bp, Homo sapiens
acagggatggggtaagtg

SEQ ID NO: 8228421 - DNA, 18 bp, Homo sapiens
acagggatggggtaagtg

SEQ ID NO: 8228422 - DNA, 22 bp, Homo sapiens
acagggcaacctctgggagact

SEQ ID NO: 8228423 - DNA, 22 bp, Homo sapiens
acagggcacctgaggtaggaag

SEQ ID NO: 8228424 - DNA, 22 bp, Homo sapiens
acagggcaacctctgggagact

SEQ ID NO: 8228425 - DNA, 22 bp, Homo sapiens
acagggcaacctctgggagact

SEQ ID NO: 8228426 - DNA, 22 bp, Homo sapiens
acaggtggtaaaatggactgtc

SEQ ID NO: 8228427 - DNA, 22 bp, Homo sapiens
acaggtggtaaaatggactgtc

SEQ ID NO: 8228428 - DNA, 22 bp, Homo sapiens
acaggtggtagagtggaaagag

SEQ ID NO: 8228429 - DNA, 22 bp, Homo sapiens
acaggtggtaaaatggactgtc

SEQ ID NO: 8228430 - DNA, 22 bp, Homo sapiens
acaggtggtaaaatggactgtc

SEQ ID NO: 8228431 - DNA, 22 bp, Homo sapiens
acaggtggggcacttggagcct

SEQ ID NO: 8228432 - DNA, 22 bp, Homo sapiens
acaggtggggaggctgaggttc

SEQ ID NO: 8228433 - DNA, 22 bp, Homo sapiens
acaggtggggcacttggagcct

SEQ ID NO: 8228434 - DNA, 22 bp, Homo sapiens
acaggtgggcttaagagtcggc

SEQ ID NO: 8228435 - DNA, 22 bp, Homo sapiens
acaggtgggcttaagagtcggc

SEQ ID NO: 8228436 - DNA, 22 bp, Homo sapiens
acaggtggggaggctgaggttc

SEQ ID NO: 8228437 - DNA, 22 bp, Homo sapiens
acaggtggcttattggctgatt

SEQ ID NO: 8228438 - DNA, 22 bp, Homo sapiens
acaggtggcttattggctgatt

SEQ ID NO: 8228439 - DNA, 22 bp, Homo sapiens
acaggtggcttccattttctaa

SEQ ID NO: 8228440 - DNA, 22 bp, Homo sapiens
acaggtggcttccattttctaa

SEQ ID NO: 8228441 - DNA, 22 bp, Homo sapiens
acaggtgggcttaagagtcggc

SEQ ID NO: 8228442 - DNA, 22 bp, Homo sapiens
acaggtgggcttaagagtcggc

SEQ ID NO: 8228443 - DNA, 22 bp, Homo sapiens
acaggtggcttattggctgatt

SEQ ID NO: 8228444 - DNA, 22 bp, Homo sapiens
acaggtggccccgagggagtgg

SEQ ID NO: 8228445 - DNA, 22 bp, Homo sapiens
aggagctgttttgttcagcaaa

SEQ ID NO: 8228446 - DNA, 22 bp, Homo sapiens
aggagctgttttgttcagcaaa

SEQ ID NO: 8228447 - DNA, 21 bp, Homo sapiens
aggagctgtgttagctggtcg

SEQ ID NO: 8228448 - DNA, 21 bp, Homo sapiens
aggagctgtgttagctggtcg

SEQ ID NO: 8228449 - DNA, 21 bp, Homo sapiens
aggagctgtgttagctggtcg

SEQ ID NO: 8228450 - DNA, 21 bp, Homo sapiens
aggagctgtgttagctggtcg

SEQ ID NO: 8228451 - DNA, 21 bp, Homo sapiens
aggagctgtgttagctggtcg

SEQ ID NO: 8228452 - DNA, 21 bp, Homo sapiens
aggagctgtgttagctggtcg

SEQ ID NO: 8228453 - DNA, 21 bp, Homo sapiens
aggagctgtgttagctggtcg

SEQ ID NO: 8228454 - DNA, 22 bp, Homo sapiens
acaggtgtaatttgcccgaggt

SEQ ID NO: 8228455 - DNA, 22 bp, Homo sapiens
aggagctggagtccaggcaagt

SEQ ID NO: 8228456 - DNA, 22 bp, Homo sapiens
aggagctggagtccaggcaagt

SEQ ID NO: 8228457 - DNA, 22 bp, Homo sapiens
aggagctggagtccaggcaagt

SEQ ID NO: 8228458 - DNA, 22 bp, Homo sapiens
aggagctggagtccaggcaagt

SEQ ID NO: 8228459 - DNA, 22 bp, Homo sapiens
acaggtggtagagtggaaagag

SEQ ID NO: 8228460 - DNA, 22 bp, Homo sapiens
acaggtggtctttgctcctttt

SEQ ID NO: 8228461 - DNA, 22 bp, Homo sapiens
acaggtggtctttgctcctttt

SEQ ID NO: 8228462 - DNA, 22 bp, Homo sapiens
acaggtggtagagtggaaagag

SEQ ID NO: 8228463 - DNA, 22 bp, Homo sapiens
acaggtggtctttgctcctttt

SEQ ID NO: 8228464 - DNA, 22 bp, Homo sapiens
acaggtgtaaaacccaggatgg

SEQ ID NO: 8228465 - DNA, 22 bp, Homo sapiens
acaggtgtaaaacccaggatgg

SEQ ID NO: 8228466 - DNA, 19 bp, Homo sapiens
aggaatggaattaattctg

SEQ ID NO: 8228467 - DNA, 19 bp, Homo sapiens
aggaatggaattaattctg

SEQ ID NO: 8228468 - DNA, 19 bp, Homo sapiens
aggaatggaattaattctg

SEQ ID NO: 8228469 - DNA, 21 bp, Homo sapiens
aggaatgctgaggctcacttt

SEQ ID NO: 8228470 - DNA, 19 bp, Homo sapiens
aggaatggaattaattctg

SEQ ID NO: 8228471 - DNA, 19 bp, Homo sapiens
aggaatggaattaattctg

SEQ ID NO: 8228472 - DNA, 23 bp, Homo sapiens
aggaatggctagaagtgtgaccc

SEQ ID NO: 8228473 - DNA, 22 bp, Homo sapiens
aggaatggtgctcagcagaaat

SEQ ID NO: 8228474 - DNA, 23 bp, Homo sapiens
aggaatggctagaagtgtgaccc

SEQ ID NO: 8228475 - DNA, 22 bp, Homo sapiens
aggaatggttatggggatagta

SEQ ID NO: 8228476 - DNA, 22 bp, Homo sapiens
aggaatgtaaatctagatttta

SEQ ID NO: 8228477 - DNA, 22 bp, Homo sapiens
aggaatgtaaatctagatttta

SEQ ID NO: 8228478 - DNA, 22 bp, Homo sapiens
aggaatgtaaatctagatttta

SEQ ID NO: 8228479 - DNA, 22 bp, Homo sapiens
aggaatgtaacaggagtaaaaa

SEQ ID NO: 8228480 - DNA, 22 bp, Homo sapiens
aggaatgtaacaggagtaaaaa

SEQ ID NO: 8228481 - DNA, 22 bp, Homo sapiens
aggaatgtagtttgagtagaaa

SEQ ID NO: 8228482 - DNA, 22 bp, Homo sapiens
aggaatgtaatagtgtggctca

SEQ ID NO: 8228483 - DNA, 22 bp, Homo sapiens
aggaatgtaatagtgtggctca

SEQ ID NO: 8228484 - DNA, 22 bp, Homo sapiens
aggaatgtattattccttctgg

SEQ ID NO: 8228485 - DNA, 22 bp, Homo sapiens
aggaatgtagtttgagtagaaa

SEQ ID NO: 8228486 - DNA, 22 bp, Homo sapiens
aggaatgtagtttgagtagaaa

SEQ ID NO: 8228487 - DNA, 22 bp, Homo sapiens
aggaatgtattattccttctgg

SEQ ID NO: 8228488 - DNA, 22 bp, Homo sapiens
aggaatgtattgacctgttgca

SEQ ID NO: 8228489 - DNA, 22 bp, Homo sapiens
aggaatgtattgacctgttgca

SEQ ID NO: 8228490 - DNA, 22 bp, Homo sapiens
aggaatgtcaagtagatgtgcg

SEQ ID NO: 8228491 - DNA, 22 bp, Homo sapiens
aggaatgtcatagaataatcat

SEQ ID NO: 8228492 - DNA, 22 bp, Homo sapiens
aggaatgtcaagtagatgtgcg

SEQ ID NO: 8228493 - DNA, 22 bp, Homo sapiens
aggaatgtcatagaataatcat

SEQ ID NO: 8228494 - DNA, 22 bp, Homo sapiens
acaggctggtttgtaaaagatg

SEQ ID NO: 8228495 - DNA, 22 bp, Homo sapiens
acaggctggtttgtaaaagatg

SEQ ID NO: 8228496 - DNA, 22 bp, Homo sapiens
acaggctgtacttctaatcatc

SEQ ID NO: 8228497 - DNA, 22 bp, Homo sapiens
acaggctgtacttctaatcatc

SEQ ID NO: 8228498 - DNA, 22 bp, Homo sapiens
acaggctgttggggtccagggt

SEQ ID NO: 8228499 - DNA, 18 bp, Homo sapiens
acaggctgtgggaatggt

SEQ ID NO: 8228500 - DNA, 18 bp, Homo sapiens
acaggctgtgggaatggt

SEQ ID NO: 8228501 - DNA, 18 bp, Homo sapiens
acaggctgtgggaatggt

SEQ ID NO: 8228502 - DNA, 22 bp, Homo sapiens
aggaatgatagtaaaagagaat

SEQ ID NO: 8228503 - DNA, 22 bp, Homo sapiens
aggaatgatagtaaaagagaat

SEQ ID NO: 8228504 - DNA, 22 bp, Homo sapiens
aggaatgacttgtagctctgag

SEQ ID NO: 8228505 - DNA, 22 bp, Homo sapiens
aggaatgacttgtagctctgag

SEQ ID NO: 8228506 - DNA, 22 bp, Homo sapiens
aggaatgacatagaaaggggag

SEQ ID NO: 8228507 - DNA, 22 bp, Homo sapiens
aggaagggctgtttctccaaga

SEQ ID NO: 8228508 - DNA, 22 bp, Homo sapiens
acaggctgttggggtccagggt

SEQ ID NO: 8228509 - DNA, 18 bp, Homo sapiens
acaggctgtgggaatggt

SEQ ID NO: 8228510 - DNA, 22 bp, Homo sapiens
aggaagggctgtttctccaaga

SEQ ID NO: 8228511 - DNA, 22 bp, Homo sapiens
acaggctgggcgcttcctgcgg

SEQ ID NO: 8228512 - DNA, 22 bp, Homo sapiens
acaggctgggcgcttcctgcgg

SEQ ID NO: 8228513 - DNA, 22 bp, Homo sapiens
acaggctgggcgcttcctgcgg

SEQ ID NO: 8228514 - DNA, 22 bp, Homo sapiens
acaggctggtggtcctggccat

SEQ ID NO: 8228515 - DNA, 22 bp, Homo sapiens
acaggctggtggtcctggccat

SEQ ID NO: 8228516 - DNA, 22 bp, Homo sapiens
acaggctggtggtcctggccat

SEQ ID NO: 8228517 - DNA, 22 bp, Homo sapiens
acaggctggtggtcctggccat

SEQ ID NO: 8228518 - DNA, 22 bp, Homo sapiens
acaggctggtggtcctggccat

SEQ ID NO: 8228519 - DNA, 22 bp, Homo sapiens
acaggctggtggtcctggccat

SEQ ID NO: 8228520 - DNA, 22 bp, Homo sapiens
acaggctggtggtcctggccat

SEQ ID NO: 8228521 - DNA, 22 bp, Homo sapiens
acaggctgggcgcttcctgcgg

SEQ ID NO: 8228522 - DNA, 22 bp, Homo sapiens
acaggctggaggaggaccaaga

SEQ ID NO: 8228523 - DNA, 22 bp, Homo sapiens
acaggctgctgggctccgtgct

SEQ ID NO: 8228524 - DNA, 22 bp, Homo sapiens
acaggctgctgggctccgtgct

SEQ ID NO: 8228525 - DNA, 22 bp, Homo sapiens
acaggctggaggaggaccaaga

SEQ ID NO: 8228526 - DNA, 22 bp, Homo sapiens
acaggctgctgggctccgtgct

SEQ ID NO: 8228527 - DNA, 22 bp, Homo sapiens
acaggctgctgggctccgtgct

SEQ ID NO: 8228528 - DNA, 22 bp, Homo sapiens
acaggctgctgggctccgtgct

SEQ ID NO: 8228529 - DNA, 22 bp, Homo sapiens
acaggctgctgggctccgtgct

SEQ ID NO: 8228530 - DNA, 22 bp, Homo sapiens
acaggctgctgggctccgtgct

SEQ ID NO: 8228531 - DNA, 22 bp, Homo sapiens
acaggctgcctaccaagtatca

SEQ ID NO: 8228532 - DNA, 22 bp, Homo sapiens
acaggctgcccgctccccacct

SEQ ID NO: 8228533 - DNA, 22 bp, Homo sapiens
acaggctgcccgctccccacct

SEQ ID NO: 8228534 - DNA, 22 bp, Homo sapiens
acaggctgcccgctccccacct

SEQ ID NO: 8228535 - DNA, 22 bp, Homo sapiens
acaggctgcctaccaagtatca

SEQ ID NO: 8228536 - DNA, 22 bp, Homo sapiens
acaggctgctgagccatttgct

SEQ ID NO: 8228537 - DNA, 22 bp, Homo sapiens
acaggctgctgagccatttgct

SEQ ID NO: 8228538 - DNA, 22 bp, Homo sapiens
acaggctgcccgctccccacct

SEQ ID NO: 8228539 - DNA, 22 bp, Homo sapiens
acaggctctggggcaggatggc

SEQ ID NO: 8228540 - DNA, 22 bp, Homo sapiens
acaggctgccacttgcatccaa

SEQ ID NO: 8228541 - DNA, 22 bp, Homo sapiens
acaggctctggggcaggatggc

SEQ ID NO: 8228542 - DNA, 22 bp, Homo sapiens
agctttatgggagcttagataa

SEQ ID NO: 8228543 - DNA, 22 bp, Homo sapiens
agctttatgggagcttagataa

SEQ ID NO: 8228544 - DNA, 22 bp, Homo sapiens
agctttatgggagcttagataa

SEQ ID NO: 8228545 - DNA, 22 bp, Homo sapiens
agctttatgggagcttagataa

SEQ ID NO: 8228546 - DNA, 22 bp, Homo sapiens
agctttatgcttcctacaagct

SEQ ID NO: 8228547 - DNA, 22 bp, Homo sapiens
acaggcctgacacacagagggc

SEQ ID NO: 8228548 - DNA, 22 bp, Homo sapiens
acaggcctcccatccggagccc

SEQ ID NO: 8228549 - DNA, 22 bp, Homo sapiens
acaggcctgacacacagagggc

SEQ ID NO: 8228550 - DNA, 22 bp, Homo sapiens
acaggcctggaaaggaaggagt

SEQ ID NO: 8228551 - DNA, 17 bp, Homo sapiens
acaggcctgcttgcact

SEQ ID NO: 8228552 - DNA, 22 bp, Homo sapiens
acaggcctgagattttgcattt

SEQ ID NO: 8228553 - DNA, 22 bp, Homo sapiens
acaggcctgatgccttggctgg

SEQ ID NO: 8228554 - DNA, 22 bp, Homo sapiens
acaggcctgatgccttggctgg

SEQ ID NO: 8228555 - DNA, 18 bp, Homo sapiens
acaggcctcagtcctgca

SEQ ID NO: 8228556 - DNA, 18 bp, Homo sapiens
acaggcctcagtcctgca

SEQ ID NO: 8228557 - DNA, 22 bp, Homo sapiens
acaggcctagggtcaatttcct

SEQ ID NO: 8228558 - DNA, 22 bp, Homo sapiens
acaggcctagctaatgctttcc

SEQ ID NO: 8228559 - DNA, 22 bp, Homo sapiens
acaggcctcaaatagggtgcct

SEQ ID NO: 8228560 - DNA, 22 bp, Homo sapiens
acaggcctagctaatgctttcc

SEQ ID NO: 8228561 - DNA, 22 bp, Homo sapiens
agctttatgcttcctacaagct

SEQ ID NO: 8228562 - DNA, 22 bp, Homo sapiens
agctttatgcttcctacaagct

SEQ ID NO: 8228563 - DNA, 22 bp, Homo sapiens
agctttatgcttcctacaagct

SEQ ID NO: 8228564 - DNA, 22 bp, Homo sapiens
agctttatgaggagaccttagt

SEQ ID NO: 8228565 - DNA, 22 bp, Homo sapiens
agctttatgaggagaccttagt

SEQ ID NO: 8228566 - DNA, 22 bp, Homo sapiens
agctttatgaggagaccttagt

SEQ ID NO: 8228567 - DNA, 22 bp, Homo sapiens
agctttatcccttgcccatcga

SEQ ID NO: 8228568 - DNA, 22 bp, Homo sapiens
agctttatcccttgcccatcga

SEQ ID NO: 8228569 - DNA, 22 bp, Homo sapiens
agctttatcccttgcccatcga

SEQ ID NO: 8228570 - DNA, 22 bp, Homo sapiens
agctttatcttcacctgggaat

SEQ ID NO: 8228571 - DNA, 22 bp, Homo sapiens
agctttatcttcacctgggaat

SEQ ID NO: 8228572 - DNA, 22 bp, Homo sapiens
acaggcctggtgctgctgacag

SEQ ID NO: 8228573 - DNA, 22 bp, Homo sapiens
acaggcctgggttcaaatttgg

SEQ ID NO: 8228574 - DNA, 22 bp, Homo sapiens
acaggcctggaaaggaaggagt

SEQ ID NO: 8228575 - DNA, 22 bp, Homo sapiens
agctttatcagaggagtctcta

SEQ ID NO: 8228576 - DNA, 22 bp, Homo sapiens
agctttatcagaggagtctcta

SEQ ID NO: 8228577 - DNA, 22 bp, Homo sapiens
agctttatcacaatattggcta

SEQ ID NO: 8228578 - DNA, 22 bp, Homo sapiens
agctttatcacaatattggcta

SEQ ID NO: 8228579 - DNA, 22 bp, Homo sapiens
agctttatcacaatattggcta

SEQ ID NO: 8228580 - DNA, 22 bp, Homo sapiens
acagctgtgttttataatcagc

SEQ ID NO: 8228581 - DNA, 22 bp, Homo sapiens
acagctgtggggactcttgccc

SEQ ID NO: 8228582 - DNA, 22 bp, Homo sapiens
acagcttcacccattatccctg

SEQ ID NO: 8228583 - DNA, 23 bp, Homo sapiens
acagcttcctactttgctgctgc

SEQ ID NO: 8228584 - DNA, 22 bp, Homo sapiens
acaggcaggtaatttacatatt

SEQ ID NO: 8228585 - DNA, 22 bp, Homo sapiens
acaggcaggtaatttacatatt

SEQ ID NO: 8228586 - DNA, 22 bp, Homo sapiens
acaggcctacgaagtcaggtgc

SEQ ID NO: 8228587 - DNA, 22 bp, Homo sapiens
acaggccataaaggcaggccct

SEQ ID NO: 8228588 - DNA, 22 bp, Homo sapiens
acaggccataaaggcaggccct

SEQ ID NO: 8228589 - DNA, 22 bp, Homo sapiens
acaggccataaaggcaggccct

SEQ ID NO: 8228590 - DNA, 22 bp, Homo sapiens
acagctgtgaaaatccacagga

SEQ ID NO: 8228591 - DNA, 22 bp, Homo sapiens
acagctgtgaagcaagcactct

SEQ ID NO: 8228592 - DNA, 22 bp, Homo sapiens
acagctgtgaagcaagcactct

SEQ ID NO: 8228593 - DNA, 22 bp, Homo sapiens
agctgggtgaaggcagatggct

SEQ ID NO: 8228594 - DNA, 22 bp, Homo sapiens
agctgggtgaaggcagatggct

SEQ ID NO: 8228595 - DNA, 22 bp, Homo sapiens
agctgggtcttgggccaggaga

SEQ ID NO: 8228596 - DNA, 22 bp, Homo sapiens
agctgggtcttgggccaggaga

SEQ ID NO: 8228597 - DNA, 22 bp, Homo sapiens
acagctacatggaatttcattt

SEQ ID NO: 8228598 - DNA, 22 bp, Homo sapiens
acagctaacagaatctggagag

SEQ ID NO: 8228599 - DNA, 22 bp, Homo sapiens
acagctcagacatcactgctct

SEQ ID NO: 8228600 - DNA, 22 bp, Homo sapiens
acagctcatttgtaaaacggag

SEQ ID NO: 8228601 - DNA, 22 bp, Homo sapiens
acagctcagacatcactgctct

SEQ ID NO: 8228602 - DNA, 22 bp, Homo sapiens
acagctcttaggcagaaccaac

SEQ ID NO: 8228603 - DNA, 22 bp, Homo sapiens
acagctgaaaccagggatctgg

SEQ ID NO: 8228604 - DNA, 22 bp, Homo sapiens
acagctgaaaccagggatctgg

SEQ ID NO: 8228605 - DNA, 22 bp, Homo sapiens
acagctctccctcagagaaatg

SEQ ID NO: 8228606 - DNA, 22 bp, Homo sapiens
acagctctgcattttgggttaa

SEQ ID NO: 8228607 - DNA, 22 bp, Homo sapiens
acagctctgagatattactatt

SEQ ID NO: 8228608 - DNA, 22 bp, Homo sapiens
agctggggctgtggttgtgatt

SEQ ID NO: 8228609 - DNA, 22 bp, Homo sapiens
agctggggctgtggttgtgatt

SEQ ID NO: 8228610 - DNA, 22 bp, Homo sapiens
agctggggctgtggttgtgatt

SEQ ID NO: 8228611 - DNA, 22 bp, Homo sapiens
agctggggctgtggttgtgatt

SEQ ID NO: 8228612 - DNA, 22 bp, Homo sapiens
agctgggggtagtgagaaataa

SEQ ID NO: 8228613 - DNA, 22 bp, Homo sapiens
agctgggggtagtgagaaataa

SEQ ID NO: 8228614 - DNA, 22 bp, Homo sapiens
agctgggggtagtgagaaataa

SEQ ID NO: 8228615 - DNA, 22 bp, Homo sapiens
agctgggggttggataagggta

SEQ ID NO: 8228616 - DNA, 22 bp, Homo sapiens
agctgggggttggataagggta

SEQ ID NO: 8228617 - DNA, 22 bp, Homo sapiens
agctggggttgcacacattttg

SEQ ID NO: 8228618 - DNA, 22 bp, Homo sapiens
agctggggttgcacacattttg

SEQ ID NO: 8228619 - DNA, 22 bp, Homo sapiens
agctgggtacagcctgtgccta

SEQ ID NO: 8228620 - DNA, 22 bp, Homo sapiens
agctgggtactgatgtcttcag

SEQ ID NO: 8228621 - DNA, 22 bp, Homo sapiens
agctgggtccctctgctgatgg

SEQ ID NO: 8228622 - DNA, 22 bp, Homo sapiens
agctgggtcaataggaaatgta

SEQ ID NO: 8228623 - DNA, 22 bp, Homo sapiens
agctggggctgcagagaacagg

SEQ ID NO: 8228624 - DNA, 22 bp, Homo sapiens
agctggggctgcagagaacagg

SEQ ID NO: 8228625 - DNA, 20 bp, Homo sapiens
agctgggcaattatgactat

SEQ ID NO: 8228626 - DNA, 22 bp, Homo sapiens
agctgggcaccccgctgcgtct

SEQ ID NO: 8228627 - DNA, 23 bp, Homo sapiens
acagctgcacctggccgcctggc

SEQ ID NO: 8228628 - DNA, 23 bp, Homo sapiens
acagctgcacctggccgcctggc

SEQ ID NO: 8228629 - DNA, 22 bp, Homo sapiens
acagctgattggatcaaggaca

SEQ ID NO: 8228630 - DNA, 22 bp, Homo sapiens
acagctgcacttgaagcaggtt

SEQ ID NO: 8228631 - DNA, 23 bp, Homo sapiens
acagctgcacctggccgcctggc

SEQ ID NO: 8228632 - DNA, 22 bp, Homo sapiens
acagctgcacttgaagcaggtt

SEQ ID NO: 8228633 - DNA, 22 bp, Homo sapiens
acagctgcattcttaacaggaa

SEQ ID NO: 8228634 - DNA, 22 bp, Homo sapiens
acagcacttattcagcacagtg

SEQ ID NO: 8228635 - DNA, 22 bp, Homo sapiens
acagcacttgggttttcctgtt

SEQ ID NO: 8228636 - DNA, 22 bp, Homo sapiens
acagcagaataatgagtaatag

SEQ ID NO: 8228637 - DNA, 22 bp, Homo sapiens
acagcagaataatgagtaatag

SEQ ID NO: 8228638 - DNA, 22 bp, Homo sapiens
acagcactttacttctcagtga

SEQ ID NO: 8228639 - DNA, 22 bp, Homo sapiens
acagcagacacaggcacgctgt

SEQ ID NO: 8228640 - DNA, 21 bp, Homo sapiens
acagcagacaggcttaggacc

SEQ ID NO: 8228641 - DNA, 22 bp, Homo sapiens
acagcagacagtcggcttcctg

SEQ ID NO: 8228642 - DNA, 22 bp, Homo sapiens
acagcagacagtcggcttcctg

SEQ ID NO: 8228643 - DNA, 22 bp, Homo sapiens
acagcagacagtcggcttcctg

SEQ ID NO: 8228644 - DNA, 22 bp, Homo sapiens
acagcagacattgggtgattga

SEQ ID NO: 8228645 - DNA, 22 bp, Homo sapiens
agctgccagcatcccggaaggg

SEQ ID NO: 8228646 - DNA, 22 bp, Homo sapiens
agctgccagcatcccggaaggg

SEQ ID NO: 8228647 - DNA, 22 bp, Homo sapiens
acagcagaccactactagtagg

SEQ ID NO: 8228648 - DNA, 22 bp, Homo sapiens
agctgcaggcccatgctcagtc

SEQ ID NO: 8228649 - DNA, 22 bp, Homo sapiens
agctgcaggcccatgctcagtc

SEQ ID NO: 8228650 - DNA, 22 bp, Homo sapiens
agctgcaggcccatgctcagtc

SEQ ID NO: 8228651 - DNA, 22 bp, Homo sapiens
agctgcaggcccatgctcagtc

SEQ ID NO: 8228652 - DNA, 22 bp, Homo sapiens
agctgcccaatcctgcagggcg

SEQ ID NO: 8228653 - DNA, 22 bp, Homo sapiens
agctgcccaaggtcacagagct

SEQ ID NO: 8228654 - DNA, 22 bp, Homo sapiens
agctgccatctgaagaactgca

SEQ ID NO: 8228655 - DNA, 22 bp, Homo sapiens
agctgccatcctgttcagcacc

SEQ ID NO: 8228656 - DNA, 22 bp, Homo sapiens
agctgccatccgaggtgtcaga

SEQ ID NO: 8228657 - DNA, 22 bp, Homo sapiens
agctgccatctgaagaactgca

SEQ ID NO: 8228658 - DNA, 22 bp, Homo sapiens
agctgccatccgaggtgtcaga

SEQ ID NO: 8228659 - DNA, 22 bp, Homo sapiens
agctgccatcagcctttggatg

SEQ ID NO: 8228660 - DNA, 22 bp, Homo sapiens
agctgccaggcccctgagaacc

SEQ ID NO: 8228661 - DNA, 22 bp, Homo sapiens
agctgccaggcccctgagaacc

SEQ ID NO: 8228662 - DNA, 22 bp, Homo sapiens
agctgccaggcccctgagaacc

SEQ ID NO: 8228663 - DNA, 22 bp, Homo sapiens
agctgccagggactgggcatgg

SEQ ID NO: 8228664 - DNA, 22 bp, Homo sapiens
agctgccagggactgggcatgg

SEQ ID NO: 8228665 - DNA, 17 bp, Homo sapiens
agctgccagggagtgtg

SEQ ID NO: 8228666 - DNA, 17 bp, Homo sapiens
agctgccagggagtgtg

SEQ ID NO: 8228667 - DNA, 22 bp, Homo sapiens
acagcctgcagccccaggtcgc

SEQ ID NO: 8228668 - DNA, 22 bp, Homo sapiens
agctgctcacagggattcatgc

SEQ ID NO: 8228669 - DNA, 22 bp, Homo sapiens
acagcctgctgcctgcttcttg

SEQ ID NO: 8228670 - DNA, 22 bp, Homo sapiens
acagccttgggttctctggggg

SEQ ID NO: 8228671 - DNA, 21 bp, Homo sapiens
agctgcctttagagagaacca

SEQ ID NO: 8228672 - DNA, 17 bp, Homo sapiens
agctgccttgcttgagc

SEQ ID NO: 8228673 - DNA, 22 bp, Homo sapiens
agctgccttccctctcattagg

SEQ ID NO: 8228674 - DNA, 22 bp, Homo sapiens
agctgccttttgagaaagctca

SEQ ID NO: 8228675 - DNA, 22 bp, Homo sapiens
agctgcccaggttcattgggcc

SEQ ID NO: 8228676 - DNA, 22 bp, Homo sapiens
agctgccccatgagaggcaggt

SEQ ID NO: 8228677 - DNA, 22 bp, Homo sapiens
agctgcctgtcctaggccatca

SEQ ID NO: 8228678 - DNA, 22 bp, Homo sapiens
agctgcctgtaaaatgtgtgat

SEQ ID NO: 8228679 - DNA, 22 bp, Homo sapiens
agctgcctgtcctaggccatca

SEQ ID NO: 8228680 - DNA, 22 bp, Homo sapiens
agctgcctgggcttgtacacct

SEQ ID NO: 8228681 - DNA, 22 bp, Homo sapiens
agctgcctgggcttgtacacct

SEQ ID NO: 8228682 - DNA, 22 bp, Homo sapiens
agctgcctgggcttgtacacct

SEQ ID NO: 8228683 - DNA, 22 bp, Homo sapiens
agctgccttatggagtatgaaa

SEQ ID NO: 8228684 - DNA, 20 bp, Homo sapiens
agctgccttcattttctaga

SEQ ID NO: 8228685 - DNA, 22 bp, Homo sapiens
agctgcctgtcctaggccatca

SEQ ID NO: 8228686 - DNA, 22 bp, Homo sapiens
agctgcctgtcctaggccatca

SEQ ID NO: 8228687 - DNA, 22 bp, Homo sapiens
acacatgagaaacatcagttgt

SEQ ID NO: 8228688 - DNA, 22 bp, Homo sapiens
acacatgagaaacatcagttgt

SEQ ID NO: 8228689 - DNA, 22 bp, Homo sapiens
acacatgagaaacatcagttgt

SEQ ID NO: 8228690 - DNA, 22 bp, Homo sapiens
acacatgagaaacatcagttgt

SEQ ID NO: 8228691 - DNA, 22 bp, Homo sapiens
acacatgagttctcatcttgtg

SEQ ID NO: 8228692 - DNA, 22 bp, Homo sapiens
acacatgagttctcatcttgtg

SEQ ID NO: 8228693 - DNA, 22 bp, Homo sapiens
acacatgcaggtatacatgttc

SEQ ID NO: 8228694 - DNA, 22 bp, Homo sapiens
acacatgataagaaagtttaaa

SEQ ID NO: 8228695 - DNA, 22 bp, Homo sapiens
acacatgataagaaagtttaaa

SEQ ID NO: 8228696 - DNA, 22 bp, Homo sapiens
acacatgataagaaagtttaaa

SEQ ID NO: 8228697 - DNA, 22 bp, Homo sapiens
acacatgcaggtatacatgttc

SEQ ID NO: 8228698 - DNA, 22 bp, Homo sapiens
acacatgcataagccttccctt

SEQ ID NO: 8228699 - DNA, 22 bp, Homo sapiens
acacatgctcataaataaatag

SEQ ID NO: 8228700 - DNA, 22 bp, Homo sapiens
aagagcaggctgtcaatggggc

SEQ ID NO: 8228701 - DNA, 22 bp, Homo sapiens
aagagcaggctgctgtggagta

SEQ ID NO: 8228702 - DNA, 22 bp, Homo sapiens
aagagcagcctccaggggtgga

SEQ ID NO: 8228703 - DNA, 22 bp, Homo sapiens
acacatgaaagacattaaggtg

SEQ ID NO: 8228704 - DNA, 22 bp, Homo sapiens
acacatgaaataatattatgca

SEQ ID NO: 8228705 - DNA, 22 bp, Homo sapiens
acacatgaatcactggtggaag

SEQ ID NO: 8228706 - DNA, 22 bp, Homo sapiens
acacatatatacatatttgtgc

SEQ ID NO: 8228707 - DNA, 22 bp, Homo sapiens
acacatatatacatatttgtgc

SEQ ID NO: 8228708 - DNA, 22 bp, Homo sapiens
acacatatatacatatttgtgc

SEQ ID NO: 8228709 - DNA, 22 bp, Homo sapiens
acacatatatacatatttgtgc

SEQ ID NO: 8228710 - DNA, 17 bp, Homo sapiens
acacatcttggctttgc

SEQ ID NO: 8228711 - DNA, 22 bp, Homo sapiens
acacatcttagactgaaatatg

SEQ ID NO: 8228712 - DNA, 22 bp, Homo sapiens
acacatatatgtcgaagtcctc

SEQ ID NO: 8228713 - DNA, 22 bp, Homo sapiens
acacattgcagacatctcatta

SEQ ID NO: 8228714 - DNA, 22 bp, Homo sapiens
acacattctttaaatgtctgtt

SEQ ID NO: 8228715 - DNA, 22 bp, Homo sapiens
acacattgcagacatctcatta

SEQ ID NO: 8228716 - DNA, 22 bp, Homo sapiens
acacattgtcatttccatacta

SEQ ID NO: 8228717 - DNA, 22 bp, Homo sapiens
acacatttaaaaaggaacatat

SEQ ID NO: 8228718 - DNA, 22 bp, Homo sapiens
acacatttacatgtttacgtat

SEQ ID NO: 8228719 - DNA, 22 bp, Homo sapiens
acacatttacatgtttacgtat

SEQ ID NO: 8228720 - DNA, 22 bp, Homo sapiens
acacattatgagcagttgtctt

SEQ ID NO: 8228721 - DNA, 21 bp, Homo sapiens
acacattatgagcatagactc

SEQ ID NO: 8228722 - DNA, 22 bp, Homo sapiens
acacattatctcattaaatact

SEQ ID NO: 8228723 - DNA, 19 bp, Homo sapiens
acacatgctcctggagcct

SEQ ID NO: 8228724 - DNA, 22 bp, Homo sapiens
acacatgctgataagaatataa

SEQ ID NO: 8228725 - DNA, 22 bp, Homo sapiens
aagatgaaaatttactgtgatg

SEQ ID NO: 8228726 - DNA, 22 bp, Homo sapiens
aagatgaaaatttactgtgatg

SEQ ID NO: 8228727 - DNA, 22 bp, Homo sapiens
aagatgaagaacatgagcacac

SEQ ID NO: 8228728 - DNA, 22 bp, Homo sapiens
aagatgaatcagtatgtgtcct

SEQ ID NO: 8228729 - DNA, 22 bp, Homo sapiens
aagatgaatcagtatgtgtcct

SEQ ID NO: 8228730 - DNA, 22 bp, Homo sapiens
aagatgaatcagtatgtgtcct

SEQ ID NO: 8228731 - DNA, 22 bp, Homo sapiens
aagatatagataaaactatgca

SEQ ID NO: 8228732 - DNA, 22 bp, Homo sapiens
acacatttctaaatttttaccg

SEQ ID NO: 8228733 - DNA, 22 bp, Homo sapiens
aagatatagatggtggtataaa

SEQ ID NO: 8228734 - DNA, 22 bp, Homo sapiens
aagatccttctcactgcagtgt

SEQ ID NO: 8228735 - DNA, 22 bp, Homo sapiens
aagatatagatggtggtataaa

SEQ ID NO: 8228736 - DNA, 22 bp, Homo sapiens
acacatttctaaatttttaccg

SEQ ID NO: 8228737 - DNA, 22 bp, Homo sapiens
acacatttctaaatttttaccg

SEQ ID NO: 8228738 - DNA, 22 bp, Homo sapiens
acacatttctaaatttttaccg

SEQ ID NO: 8228739 - DNA, 22 bp, Homo sapiens
acacatttattacatgcatgtg

SEQ ID NO: 8228740 - DNA, 22 bp, Homo sapiens
acacatttattacatgcatgtg

SEQ ID NO: 8228741 - DNA, 22 bp, Homo sapiens
acacatttatggatcgcagaaa

SEQ ID NO: 8228742 - DNA, 22 bp, Homo sapiens
acacatttagcaccaggtttat

SEQ ID NO: 8228743 - DNA, 22 bp, Homo sapiens
acacatttattacatgcatgtg

SEQ ID NO: 8228744 - DNA, 22 bp, Homo sapiens
aagcaaagagataaccttttgg

SEQ ID NO: 8228745 - DNA, 22 bp, Homo sapiens
aagcaaagacagtttgagtgga

SEQ ID NO: 8228746 - DNA, 22 bp, Homo sapiens
aagatgttaaatctgtagaatt

SEQ ID NO: 8228747 - DNA, 22 bp, Homo sapiens
aagatgtgtctcatcagggtgt

SEQ ID NO: 8228748 - DNA, 22 bp, Homo sapiens
aagatgttagaggtcatgcaga

SEQ ID NO: 8228749 - DNA, 22 bp, Homo sapiens
aagatgttaaatctgtagaatt

SEQ ID NO: 8228750 - DNA, 22 bp, Homo sapiens
aagcaataaataatttttagta

SEQ ID NO: 8228751 - DNA, 21 bp, Homo sapiens
aagatgatattttatctgtag

SEQ ID NO: 8228752 - DNA, 22 bp, Homo sapiens
aagatgcagctttacaataagg

SEQ ID NO: 8228753 - DNA, 22 bp, Homo sapiens
aagatgcatgctgaagctggct

SEQ ID NO: 8228754 - DNA, 22 bp, Homo sapiens
aagatgcacaatgtggcaatta

SEQ ID NO: 8228755 - DNA, 22 bp, Homo sapiens
aagatgattaggatgaaagcaa

SEQ ID NO: 8228756 - DNA, 22 bp, Homo sapiens
aagatgcggttgaccatggtgt

SEQ ID NO: 8228757 - DNA, 22 bp, Homo sapiens
aagatgctaattgtggaagttg

SEQ ID NO: 8228758 - DNA, 22 bp, Homo sapiens
aagatgcctgtagcaggaagat

SEQ ID NO: 8228759 - DNA, 23 bp, Homo sapiens
aagatgtatttttaccaaatgtc

SEQ ID NO: 8228760 - DNA, 22 bp, Homo sapiens
aagatgcttccactgcagtggc

SEQ ID NO: 8228761 - DNA, 22 bp, Homo sapiens
aagatgcttgagaactgtttga

SEQ ID NO: 8228762 - DNA, 22 bp, Homo sapiens
aagatgcttgcaaatttctgaa

SEQ ID NO: 8228763 - DNA, 22 bp, Homo sapiens
aagatgctggcaggaatagcta

SEQ ID NO: 8228764 - DNA, 22 bp, Homo sapiens
aagatgcttattgctcctgcag

SEQ ID NO: 8228765 - DNA, 22 bp, Homo sapiens
aagcacaatttaggactgaaat

SEQ ID NO: 8228766 - DNA, 22 bp, Homo sapiens
aagcacctctatgattgctttt

SEQ ID NO: 8228767 - DNA, 22 bp, Homo sapiens
aagcacctctatgattgctttt

SEQ ID NO: 8228768 - DNA, 22 bp, Homo sapiens
aagcaattcacagttcacttaa

SEQ ID NO: 8228769 - DNA, 22 bp, Homo sapiens
aagcagagccaccagctttgga

SEQ ID NO: 8228770 - DNA, 22 bp, Homo sapiens
aagcagaggaccgacggaggga

SEQ ID NO: 8228771 - DNA, 22 bp, Homo sapiens
aagcagagcctgagacagggat

SEQ ID NO: 8228772 - DNA, 22 bp, Homo sapiens
aagcagagcctgagacagggat

SEQ ID NO: 8228773 - DNA, 22 bp, Homo sapiens
aagcagagcctgagacagggat

SEQ ID NO: 8228774 - DNA, 22 bp, Homo sapiens
aagcagactcccggccagctca

SEQ ID NO: 8228775 - DNA, 21 bp, Homo sapiens
aagcagacctgagcacagaac

SEQ ID NO: 8228776 - DNA, 19 bp, Homo sapiens
aagcagactctgagccagg

SEQ ID NO: 8228777 - DNA, 22 bp, Homo sapiens
aagcagactgggccataaggaa

SEQ ID NO: 8228778 - DNA, 22 bp, Homo sapiens
aagcagagaatctgggagcgag

SEQ ID NO: 8228779 - DNA, 22 bp, Homo sapiens
aagcagagaatctgggagcgag

SEQ ID NO: 8228780 - DNA, 21 bp, Homo sapiens
aagcagacctgagcacagaac

SEQ ID NO: 8228781 - DNA, 22 bp, Homo sapiens
aagcagacatcccatacttttg

SEQ ID NO: 8228782 - DNA, 22 bp, Homo sapiens
aagcagacagagaatgggtttg

SEQ ID NO: 8228783 - DNA, 22 bp, Homo sapiens
aagcagaatttcccactagttg

SEQ ID NO: 8228784 - DNA, 22 bp, Homo sapiens
aagcagaatttcccactagttg

SEQ ID NO: 8228785 - DNA, 22 bp, Homo sapiens
aagcagaatttaatagaaaggt

SEQ ID NO: 8228786 - DNA, 22 bp, Homo sapiens
aagcagaatttaatagaaaggt

SEQ ID NO: 8228787 - DNA, 22 bp, Homo sapiens
aagcagaatttaatagaaaggt

SEQ ID NO: 8228788 - DNA, 22 bp, Homo sapiens
aagcagaatagaggcccttccc

SEQ ID NO: 8228789 - DNA, 22 bp, Homo sapiens
aagcagaagttgatctaccata

SEQ ID NO: 8228790 - DNA, 22 bp, Homo sapiens
aagcagaaggggaataatattt

SEQ ID NO: 8228791 - DNA, 20 bp, Homo sapiens
aagcagaagctgctctcagc

SEQ ID NO: 8228792 - DNA, 20 bp, Homo sapiens
aagcagaagctgctctcagc

SEQ ID NO: 8228793 - DNA, 22 bp, Homo sapiens
acagcaaaagacaagaacttaa

SEQ ID NO: 8228794 - DNA, 22 bp, Homo sapiens
acagcaaaagacaagaacttaa

SEQ ID NO: 8228795 - DNA, 22 bp, Homo sapiens
aagcagagggtatggccaggtt

SEQ ID NO: 8228796 - DNA, 22 bp, Homo sapiens
aagcagaggaccgacggaggga

SEQ ID NO: 8228797 - DNA, 22 bp, Homo sapiens
aagcagaggaccgacggaggga

SEQ ID NO: 8228798 - DNA, 22 bp, Homo sapiens
aagcagaggaccgacggaggga

SEQ ID NO: 8228799 - DNA, 22 bp, Homo sapiens
aagcagaggaccgacggaggga

SEQ ID NO: 8228800 - DNA, 22 bp, Homo sapiens
acagcagactttctacagctca

SEQ ID NO: 8228801 - DNA, 22 bp, Homo sapiens
acagcagactttctacagctca

SEQ ID NO: 8228802 - DNA, 22 bp, Homo sapiens
acagcagagacactcaggaggc

SEQ ID NO: 8228803 - DNA, 22 bp, Homo sapiens
acagcagagacactcaggaggc

SEQ ID NO: 8228804 - DNA, 22 bp, Homo sapiens
acagcagagacactcaggaggc

SEQ ID NO: 8228805 - DNA, 22 bp, Homo sapiens
acagcagagcaccagggccact

SEQ ID NO: 8228806 - DNA, 22 bp, Homo sapiens
acagcagagcaccagggccact

SEQ ID NO: 8228807 - DNA, 22 bp, Homo sapiens
acagcagagccagtggctctag

SEQ ID NO: 8228808 - DNA, 22 bp, Homo sapiens
acagcagagcaccagggccact

SEQ ID NO: 8228809 - DNA, 21 bp, Homo sapiens
acagcagagatcaagactaag

SEQ ID NO: 8228810 - DNA, 22 bp, Homo sapiens
aagcagcttccctggctcctgg

SEQ ID NO: 8228811 - DNA, 22 bp, Homo sapiens
aagcagcttttgaagagtgagg

SEQ ID NO: 8228812 - DNA, 22 bp, Homo sapiens
aagcagcttttgaagagtgagg

SEQ ID NO: 8228813 - DNA, 22 bp, Homo sapiens
aagcagcttttgaagagtgagg

SEQ ID NO: 8228814 - DNA, 22 bp, Homo sapiens
aagcagctttctttcctgtgaa

SEQ ID NO: 8228815 - DNA, 22 bp, Homo sapiens
aagcagctttctttcctgtgaa

SEQ ID NO: 8228816 - DNA, 22 bp, Homo sapiens
acagccagggtctcaggaggcg

SEQ ID NO: 8228817 - DNA, 22 bp, Homo sapiens
acagccagggcattgtcgccga

SEQ ID NO: 8228818 - DNA, 22 bp, Homo sapiens
acagcctggactggctctctgc

SEQ ID NO: 8228819 - DNA, 22 bp, Homo sapiens
acagccagggcattgtcgccga

SEQ ID NO: 8228820 - DNA, 22 bp, Homo sapiens
aagcagctgatttcacagctca

SEQ ID NO: 8228821 - DNA, 22 bp, Homo sapiens
acagcagaggaaaagtctgata

SEQ ID NO: 8228822 - DNA, 22 bp, Homo sapiens
acagcagaggaaaagtctgata

SEQ ID NO: 8228823 - DNA, 22 bp, Homo sapiens
acagcagagcctggtacttact

SEQ ID NO: 8228824 - DNA, 22 bp, Homo sapiens
acagcagaggaaaagtctgata

SEQ ID NO: 8228825 - DNA, 22 bp, Homo sapiens
acagcagagcctagcttaatct

SEQ ID NO: 8228826 - DNA, 22 bp, Homo sapiens
acagcagagcctagcttaatct

SEQ ID NO: 8228827 - DNA, 22 bp, Homo sapiens
acagcagagcctggtacttact

SEQ ID NO: 8228828 - DNA, 22 bp, Homo sapiens
acagcagagcctagcttaatct

SEQ ID NO: 8228829 - DNA, 22 bp, Homo sapiens
aagcagctgtgtgacataatct

SEQ ID NO: 8228830 - DNA, 22 bp, Homo sapiens
aagcagcttaaattagagcctg

SEQ ID NO: 8228831 - DNA, 22 bp, Homo sapiens
aagcagctggaagagtaagatg

SEQ ID NO: 8228832 - DNA, 22 bp, Homo sapiens
aagcagctggaagagtaagatg

SEQ ID NO: 8228833 - DNA, 22 bp, Homo sapiens
aagcagctgcaggttcaaagga

SEQ ID NO: 8228834 - DNA, 22 bp, Homo sapiens
aagactttccctcatcagaacg

SEQ ID NO: 8228835 - DNA, 22 bp, Homo sapiens
aagacttgaccaggttgaaggc

SEQ ID NO: 8228836 - DNA, 20 bp, Homo sapiens
aattttatctccatcctttg

SEQ ID NO: 8228837 - DNA, 22 bp, Homo sapiens
aattttatctctaagcaggctt

SEQ ID NO: 8228838 - DNA, 22 bp, Homo sapiens
aagaccataatgtaagatgaat

SEQ ID NO: 8228839 - DNA, 20 bp, Homo sapiens
aattttatctccatcctttg

SEQ ID NO: 8228840 - DNA, 20 bp, Homo sapiens
aattttatctccatcctttg

SEQ ID NO: 8228841 - DNA, 20 bp, Homo sapiens
aattttatctccatcctttg

SEQ ID NO: 8228842 - DNA, 22 bp, Homo sapiens
aagagaaagcagactttgtcat

SEQ ID NO: 8228843 - DNA, 22 bp, Homo sapiens
aagagaacagtcaccatgcaca

SEQ ID NO: 8228844 - DNA, 22 bp, Homo sapiens
aagagaaagcagactttgtcat

SEQ ID NO: 8228845 - DNA, 20 bp, Homo sapiens
aagagaagaagtctttgaaa

SEQ ID NO: 8228846 - DNA, 22 bp, Homo sapiens
aagagaaggattctgagcctgg

SEQ ID NO: 8228847 - DNA, 22 bp, Homo sapiens
aagagaagaaagtgtctacaca

SEQ ID NO: 8228848 - DNA, 22 bp, Homo sapiens
aagagaagaaagtgtctacaca

SEQ ID NO: 8228849 - DNA, 22 bp, Homo sapiens
aattttaatcagtggtgctgag

SEQ ID NO: 8228850 - DNA, 22 bp, Homo sapiens
aattttacaaaatacctccgat

SEQ ID NO: 8228851 - DNA, 22 bp, Homo sapiens
aatttgttttcaagtcactgga

SEQ ID NO: 8228852 - DNA, 22 bp, Homo sapiens
aatttgttagcatactctagtt

SEQ ID NO: 8228853 - DNA, 22 bp, Homo sapiens
aatttgttataacttgggctga

SEQ ID NO: 8228854 - DNA, 22 bp, Homo sapiens
aattttaagcatatgactggtt

SEQ ID NO: 8228855 - DNA, 22 bp, Homo sapiens
aatttgttacacagcaatataa

SEQ ID NO: 8228856 - DNA, 22 bp, Homo sapiens
aatttgttacacagcaatataa

SEQ ID NO: 8228857 - DNA, 22 bp, Homo sapiens
aatttgttagcatactctagtt

SEQ ID NO: 8228858 - DNA, 22 bp, Homo sapiens
aatttccaaatttctgtcacac

SEQ ID NO: 8228859 - DNA, 22 bp, Homo sapiens
aatttccagaccccatccacag

SEQ ID NO: 8228860 - DNA, 22 bp, Homo sapiens
aatttcagaccatttgcaatta

SEQ ID NO: 8228861 - DNA, 22 bp, Homo sapiens
aatttcagaccatttgcaatta

SEQ ID NO: 8228862 - DNA, 22 bp, Homo sapiens
aatttcagaactatctgggagt

SEQ ID NO: 8228863 - DNA, 22 bp, Homo sapiens
aatttcagaactatctgggagt

SEQ ID NO: 8228864 - DNA, 22 bp, Homo sapiens
aatttcagaacccaaattagcg

SEQ ID NO: 8228865 - DNA, 21 bp, Homo sapiens
aatttcagacccattttgcct

SEQ ID NO: 8228866 - DNA, 21 bp, Homo sapiens
aatttcagacccattttgcct

SEQ ID NO: 8228867 - DNA, 22 bp, Homo sapiens
aatttcagaggtagagattcta

SEQ ID NO: 8228868 - DNA, 22 bp, Homo sapiens
aatttcagatgtcataaatata

SEQ ID NO: 8228869 - DNA, 22 bp, Homo sapiens
aatttcagcttaagttgtttgg

SEQ ID NO: 8228870 - DNA, 22 bp, Homo sapiens
aatttcagcttaagttgtttgg

SEQ ID NO: 8228871 - DNA, 22 bp, Homo sapiens
aatttcagctcaaacttgtgtt

SEQ ID NO: 8228872 - DNA, 22 bp, Homo sapiens
aatttcagcaacgggagcctag

SEQ ID NO: 8228873 - DNA, 22 bp, Homo sapiens
aatttcagcaacgggagcctag

SEQ ID NO: 8228874 - DNA, 22 bp, Homo sapiens
aatttcagatgtcataaatata

SEQ ID NO: 8228875 - DNA, 22 bp, Homo sapiens
aatttcagttgctaataagttc

SEQ ID NO: 8228876 - DNA, 22 bp, Homo sapiens
aatttcagtatgaagtttcaca

SEQ ID NO: 8228877 - DNA, 22 bp, Homo sapiens
aatttcagtatgaagtttcaca

SEQ ID NO: 8228878 - DNA, 22 bp, Homo sapiens
aatttcagggtgaatggactga

SEQ ID NO: 8228879 - DNA, 22 bp, Homo sapiens
aatttcagttgctaataagttc

SEQ ID NO: 8228880 - DNA, 22 bp, Homo sapiens
aatttcagttgctaataagttc

SEQ ID NO: 8228881 - DNA, 22 bp, Homo sapiens
aagagaaggtgaggaagccggt

SEQ ID NO: 8228882 - DNA, 22 bp, Homo sapiens
aagagaaggattctgagcctgg

SEQ ID NO: 8228883 - DNA, 22 bp, Homo sapiens
aagagaatgacaaggagaacct

SEQ ID NO: 8228884 - DNA, 22 bp, Homo sapiens
aagagaattctggttttcctat

SEQ ID NO: 8228885 - DNA, 22 bp, Homo sapiens
acaatgtttctctttagtcatt

SEQ ID NO: 8228886 - DNA, 22 bp, Homo sapiens
acacaaaatcaaagtcctaggc

SEQ ID NO: 8228887 - DNA, 22 bp, Homo sapiens
acacaaaatcaaagtcctaggc

SEQ ID NO: 8228888 - DNA, 22 bp, Homo sapiens
aagagacttctagatttgttga

SEQ ID NO: 8228889 - DNA, 22 bp, Homo sapiens
aagagacatgaatactcgaagg

SEQ ID NO: 8228890 - DNA, 22 bp, Homo sapiens
aagagacatgaatactcgaagg

SEQ ID NO: 8228891 - DNA, 22 bp, Homo sapiens
acacaaagttggatgacaaaat

SEQ ID NO: 8228892 - DNA, 22 bp, Homo sapiens
acacaaagttggatgacaaaat

SEQ ID NO: 8228893 - DNA, 22 bp, Homo sapiens
acacaaactgctagaaaattgg

SEQ ID NO: 8228894 - DNA, 22 bp, Homo sapiens
acacaaacagtctatagcacca

SEQ ID NO: 8228895 - DNA, 22 bp, Homo sapiens
acacaaacagtctatagcacca

SEQ ID NO: 8228896 - DNA, 22 bp, Homo sapiens
acacaaacagtctatagcacca

SEQ ID NO: 8228897 - DNA, 22 bp, Homo sapiens
acacaaacagtctatagcacca

SEQ ID NO: 8228898 - DNA, 22 bp, Homo sapiens
acacaaactgctagaaaattgg

SEQ ID NO: 8228899 - DNA, 21 bp, Homo sapiens
acacaaacctcctcagcctgg

SEQ ID NO: 8228900 - DNA, 21 bp, Homo sapiens
acacaaacctcctcagcctgg

SEQ ID NO: 8228901 - DNA, 22 bp, Homo sapiens
aagagcagaagtccttggatcc

SEQ ID NO: 8228902 - DNA, 22 bp, Homo sapiens
aagagcagattcctagtggagc

SEQ ID NO: 8228903 - DNA, 22 bp, Homo sapiens
aagagcagcctccaggggtgga

SEQ ID NO: 8228904 - DNA, 22 bp, Homo sapiens
aagagcaccttaattatgcaga

SEQ ID NO: 8228905 - DNA, 22 bp, Homo sapiens
acacaaattgtaggataattgc

SEQ ID NO: 8228906 - DNA, 22 bp, Homo sapiens
acacaaattgtaggataattgc

SEQ ID NO: 8228907 - DNA, 22 bp, Homo sapiens
acacaaattgtaggataattgc

SEQ ID NO: 8228908 - DNA, 22 bp, Homo sapiens
aagagcaacttggaaacactca

SEQ ID NO: 8228909 - DNA, 22 bp, Homo sapiens
aagagattgtcagagatatgcc

SEQ ID NO: 8228910 - DNA, 22 bp, Homo sapiens
aagagcaacttggaaacactca

SEQ ID NO: 8228911 - DNA, 20 bp, Homo sapiens
aagaaacttgaaagtacaag

SEQ ID NO: 8228912 - DNA, 22 bp, Homo sapiens
aagaaagataaggtttgcttgg

SEQ ID NO: 8228913 - DNA, 22 bp, Homo sapiens
aagaaagagatcactcctccat

SEQ ID NO: 8228914 - DNA, 22 bp, Homo sapiens
aagaaagataaggtttgcttgg

SEQ ID NO: 8228915 - DNA, 22 bp, Homo sapiens
aattcccatttgcagaaaatca

SEQ ID NO: 8228916 - DNA, 22 bp, Homo sapiens
aattcccaccttctctcttttg

SEQ ID NO: 8228917 - DNA, 21 bp, Homo sapiens
aattcccagaaacagcacaag

SEQ ID NO: 8228918 - DNA, 22 bp, Homo sapiens
aattcccactatatgccaagca

SEQ ID NO: 8228919 - DNA, 21 bp, Homo sapiens
aagaaagataattaaggaccc

SEQ ID NO: 8228920 - DNA, 22 bp, Homo sapiens
aattcctctatctttcttcaag

SEQ ID NO: 8228921 - DNA, 22 bp, Homo sapiens
aattctagcattgtgaaaatat

SEQ ID NO: 8228922 - DNA, 22 bp, Homo sapiens
aattctataggcaagctatttt

SEQ ID NO: 8228923 - DNA, 22 bp, Homo sapiens
aattctcaggtaaaagttaagt

SEQ ID NO: 8228924 - DNA, 22 bp, Homo sapiens
aattctctccagggtaacatca

SEQ ID NO: 8228925 - DNA, 22 bp, Homo sapiens
aattctctactgtttggtgctc

SEQ ID NO: 8228926 - DNA, 22 bp, Homo sapiens
aattctgaaagattccttattc

SEQ ID NO: 8228927 - DNA, 22 bp, Homo sapiens
aattctataggcaagctatttt

SEQ ID NO: 8228928 - DNA, 22 bp, Homo sapiens
aattctataggcaagctatttt

SEQ ID NO: 8228929 - DNA, 22 bp, Homo sapiens
aattctcaggaatttcatctgt

SEQ ID NO: 8228930 - DNA, 22 bp, Homo sapiens
aatttcactgtggagcacattt

SEQ ID NO: 8228931 - DNA, 22 bp, Homo sapiens
aatttcactgtggagcacattt

SEQ ID NO: 8228932 - DNA, 22 bp, Homo sapiens
aatttcactggaaaagataatt

SEQ ID NO: 8228933 - DNA, 22 bp, Homo sapiens
aatttcactggaaaagataatt

SEQ ID NO: 8228934 - DNA, 22 bp, Homo sapiens
aatttcacctatcacttaagcc

SEQ ID NO: 8228935 - DNA, 22 bp, Homo sapiens
aatttcactgataaagactcca

SEQ ID NO: 8228936 - DNA, 22 bp, Homo sapiens
aatttcacctgcactacatcgc

SEQ ID NO: 8228937 - DNA, 22 bp, Homo sapiens
aatttcacataaggctcattgg

SEQ ID NO: 8228938 - DNA, 22 bp, Homo sapiens
aatttcacagtgaactttgagg

SEQ ID NO: 8228939 - DNA, 17 bp, Homo sapiens
aagaacactcaatagca

SEQ ID NO: 8228940 - DNA, 22 bp, Homo sapiens
aagaacaactgctttaaaagca

SEQ ID NO: 8228941 - DNA, 22 bp, Homo sapiens
aatttaagagcatagctccaac

SEQ ID NO: 8228942 - DNA, 22 bp, Homo sapiens
aagaacaactgctttaaaagca

SEQ ID NO: 8228943 - DNA, 22 bp, Homo sapiens
aagaacaactgctttaaaagca

SEQ ID NO: 8228944 - DNA, 22 bp, Homo sapiens
aagaaattaaggaatgcaacga

SEQ ID NO: 8228945 - DNA, 22 bp, Homo sapiens
aagaaattaatgtgccattact

SEQ ID NO: 8228946 - DNA, 22 bp, Homo sapiens
aagaaattaaggaatgcaacga

SEQ ID NO: 8228947 - DNA, 22 bp, Homo sapiens
aagaaatgtgaatattgaatag

SEQ ID NO: 8228948 - DNA, 22 bp, Homo sapiens
aagaaatgtgaatattgaatag

SEQ ID NO: 8228949 - DNA, 22 bp, Homo sapiens
aagaaatgtgaatattgaatag

SEQ ID NO: 8228950 - DNA, 22 bp, Homo sapiens
aagaaatgtagagcctagtaaa

SEQ ID NO: 8228951 - DNA, 22 bp, Homo sapiens
aagaaatggcttcatctgagta

SEQ ID NO: 8228952 - DNA, 22 bp, Homo sapiens
aactggtcctcaaattttgatg

SEQ ID NO: 8228953 - DNA, 22 bp, Homo sapiens
aactttctgtctgagctgcaga

SEQ ID NO: 8228954 - DNA, 22 bp, Homo sapiens
aactggattattcagttgctgc

SEQ ID NO: 8228955 - DNA, 22 bp, Homo sapiens
aatgggaaaagagtatgattta

SEQ ID NO: 8228956 - DNA, 22 bp, Homo sapiens
aatgggaagccagaagacaagg

SEQ ID NO: 8228957 - DNA, 22 bp, Homo sapiens
aatgggaaagagactagatgct

SEQ ID NO: 8228958 - DNA, 22 bp, Homo sapiens
aactgcttcttactgctgggca

SEQ ID NO: 8228959 - DNA, 22 bp, Homo sapiens
aatgggaagccagaagacaagg

SEQ ID NO: 8228960 - DNA, 22 bp, Homo sapiens
aactgcttgagatatgtttgtc

SEQ ID NO: 8228961 - DNA, 22 bp, Homo sapiens
aactgcttgatgaagctcccac

SEQ ID NO: 8228962 - DNA, 22 bp, Homo sapiens
aatggctttgagtattttctgg

SEQ ID NO: 8228963 - DNA, 22 bp, Homo sapiens
aatggcttttgcacttaaatcg

SEQ ID NO: 8228964 - DNA, 17 bp, Homo sapiens
aactgctttttttagcc

SEQ ID NO: 8228965 - DNA, 17 bp, Homo sapiens
aactgctttttttagcc

SEQ ID NO: 8228966 - DNA, 22 bp, Homo sapiens
aactggaaagatcagtaggaag

SEQ ID NO: 8228967 - DNA, 22 bp, Homo sapiens
aactgctttgtgagctttctgg

SEQ ID NO: 8228968 - DNA, 22 bp, Homo sapiens
aactgctttttgatctcaggag

SEQ ID NO: 8228969 - DNA, 22 bp, Homo sapiens
aactgcttgtaaataatgttga

SEQ ID NO: 8228970 - DNA, 22 bp, Homo sapiens
aactgcttgtaaataatgttga

SEQ ID NO: 8228971 - DNA, 22 bp, Homo sapiens
aactgcttgtagtgacttgcct

SEQ ID NO: 8228972 - DNA, 22 bp, Homo sapiens
aactggaatagcacaggaaaag

SEQ ID NO: 8228973 - DNA, 22 bp, Homo sapiens
aactggaaggattgcagatgtc

SEQ ID NO: 8228974 - DNA, 22 bp, Homo sapiens
aactggaaagatcagtaggaag

SEQ ID NO: 8228975 - DNA, 22 bp, Homo sapiens
aagaaactgttgcgtgacagcg

SEQ ID NO: 8228976 - DNA, 22 bp, Homo sapiens
aagaaactgttgcgtgacagcg

SEQ ID NO: 8228977 - DNA, 22 bp, Homo sapiens
aagaaactgttgcgtgacagcg

SEQ ID NO: 8228978 - DNA, 20 bp, Homo sapiens
aagaaacttgaaagtacaag

SEQ ID NO: 8228979 - DNA, 22 bp, Homo sapiens
aagaaactggaatatagagagc

SEQ ID NO: 8228980 - DNA, 22 bp, Homo sapiens
aagaaactgaaagtggcttcat

SEQ ID NO: 8228981 - DNA, 22 bp, Homo sapiens
aagaaactcactttgggaggca

SEQ ID NO: 8228982 - DNA, 22 bp, Homo sapiens
aagaaacaaccactgctctcct

SEQ ID NO: 8228983 - DNA, 22 bp, Homo sapiens
aagaaacaaccactgctctcct

SEQ ID NO: 8228984 - DNA, 22 bp, Homo sapiens
aagaaacaaccactgctctcct

SEQ ID NO: 8228985 - DNA, 22 bp, Homo sapiens
aagaaaatcagttctggtcagt

SEQ ID NO: 8228986 - DNA, 22 bp, Homo sapiens
aagaaacaaccactgctctcct

SEQ ID NO: 8228987 - DNA, 22 bp, Homo sapiens
aagaaaacatgatctaatttaa

SEQ ID NO: 8228988 - DNA, 22 bp, Homo sapiens
aagaaaacgttttgaggagttt

SEQ ID NO: 8228989 - DNA, 22 bp, Homo sapiens
aagaaaagaaacctgaggcttt

SEQ ID NO: 8228990 - DNA, 22 bp, Homo sapiens
aagaaaacaatgacttgccagc

SEQ ID NO: 8228991 - DNA, 22 bp, Homo sapiens
aagaaaacaatgacttgccagc

SEQ ID NO: 8228992 - DNA, 22 bp, Homo sapiens
aagaaaacaatgacttgccagc

SEQ ID NO: 8228993 - DNA, 22 bp, Homo sapiens
aagaaaacatgatctaatttaa

SEQ ID NO: 8228994 - DNA, 22 bp, Homo sapiens
aagaaaatcagttctggtcagt

SEQ ID NO: 8228995 - DNA, 22 bp, Homo sapiens
aagaaaagaaacctgaggcttt

SEQ ID NO: 8228996 - DNA, 22 bp, Homo sapiens
aagaaaagaaacctgaggcttt

SEQ ID NO: 8228997 - DNA, 22 bp, Homo sapiens
aagaaaagaaacctgaggcttt

SEQ ID NO: 8228998 - DNA, 22 bp, Homo sapiens
aatgaattcgagtgaaggaaag

SEQ ID NO: 8228999 - DNA, 22 bp, Homo sapiens
aatgaattcgagtgaaggaaag

SEQ ID NO: 8229000 - DNA, 22 bp, Homo sapiens
aatgaattcgagtgaaggaaag

SEQ ID NO: 8229001 - DNA, 22 bp, Homo sapiens
aacctttatttggtactattct

SEQ ID NO: 8229002 - DNA, 22 bp, Homo sapiens
aacctttgaggggagctctttc

SEQ ID NO: 8229003 - DNA, 19 bp, Homo sapiens
aaccttgcatgtcattata

SEQ ID NO: 8229004 - DNA, 22 bp, Homo sapiens
aacctgaatttaattgaaatga

SEQ ID NO: 8229005 - DNA, 22 bp, Homo sapiens
aacctgctttctcagagaaggg

SEQ ID NO: 8229006 - DNA, 22 bp, Homo sapiens
aacctgttttcttctcatctag

SEQ ID NO: 8229007 - DNA, 22 bp, Homo sapiens
aacctggaggctgtgtagtctt

SEQ ID NO: 8229008 - DNA, 22 bp, Homo sapiens
aacctggagcaccctcatatct

SEQ ID NO: 8229009 - DNA, 22 bp, Homo sapiens
aacatgttgctttaataatatt

SEQ ID NO: 8229010 - DNA, 22 bp, Homo sapiens
aacatgtgtcttgcatttcttg

SEQ ID NO: 8229011 - DNA, 22 bp, Homo sapiens
aacatgtgtctggctagattgt

SEQ ID NO: 8229012 - DNA, 22 bp, Homo sapiens
aacatgtgtctggctagattgt

SEQ ID NO: 8229013 - DNA, 22 bp, Homo sapiens
aacatgtgtcttgcatttcttg

SEQ ID NO: 8229014 - DNA, 22 bp, Homo sapiens
aacatgttgagttgaaagtagc

SEQ ID NO: 8229015 - DNA, 22 bp, Homo sapiens
aacatgttgctttaataatatt

SEQ ID NO: 8229016 - DNA, 22 bp, Homo sapiens
aacatgttgagttgaaagtagc

SEQ ID NO: 8229017 - DNA, 22 bp, Homo sapiens
aacccgggaggtggaggttatg

SEQ ID NO: 8229018 - DNA, 22 bp, Homo sapiens
aacccgggaggtggaggttatg

SEQ ID NO: 8229019 - DNA, 22 bp, Homo sapiens
aacccgggaggcggaggttgtg

SEQ ID NO: 8229020 - DNA, 22 bp, Homo sapiens
aacccgggaggcggaggttgtg

SEQ ID NO: 8229021 - DNA, 22 bp, Homo sapiens
aacccacaaaggatttcagctc

SEQ ID NO: 8229022 - DNA, 22 bp, Homo sapiens
aacctagggcatgaggatggtt

SEQ ID NO: 8229023 - DNA, 22 bp, Homo sapiens
aacctcaaactcttgggcttaa

SEQ ID NO: 8229024 - DNA, 22 bp, Homo sapiens
aacctcaaactcttgggcttaa

SEQ ID NO: 8229025 - DNA, 23 bp, Homo sapiens
aacctagactacttactatgtgg

SEQ ID NO: 8229026 - DNA, 22 bp, Homo sapiens
aacctcaggctctctggacaat

SEQ ID NO: 8229027 - DNA, 22 bp, Homo sapiens
aacctgaaactacattcttgat

SEQ ID NO: 8229028 - DNA, 22 bp, Homo sapiens
aaccctggggctgctctgcctg

SEQ ID NO: 8229029 - DNA, 22 bp, Homo sapiens
aaccctgggtcggcaccatttt

SEQ ID NO: 8229030 - DNA, 22 bp, Homo sapiens
aaccctgggaggcagctcagtt

SEQ ID NO: 8229031 - DNA, 22 bp, Homo sapiens
aaccctaggtggcagaggttgc

SEQ ID NO: 8229032 - DNA, 22 bp, Homo sapiens
aaccctctcttattctttgcca

SEQ ID NO: 8229033 - DNA, 22 bp, Homo sapiens
aatggccattgggtcatgctag

SEQ ID NO: 8229034 - DNA, 22 bp, Homo sapiens
aatggccatatcattgcagagc

SEQ ID NO: 8229035 - DNA, 22 bp, Homo sapiens
aatggccagctgggagagttga

SEQ ID NO: 8229036 - DNA, 22 bp, Homo sapiens
aatggccatatcattgcagagc

SEQ ID NO: 8229037 - DNA, 22 bp, Homo sapiens
aatggccagctgggagagttga

SEQ ID NO: 8229038 - DNA, 22 bp, Homo sapiens
aatgctttcttataaccactgc

SEQ ID NO: 8229039 - DNA, 22 bp, Homo sapiens
aactagtttagctttttaagac

SEQ ID NO: 8229040 - DNA, 22 bp, Homo sapiens
aactagttttagctctagcaac

SEQ ID NO: 8229041 - DNA, 22 bp, Homo sapiens
aatgctttctcagagtccttca

SEQ ID NO: 8229042 - DNA, 18 bp, Homo sapiens
aactagagggctgtcaat

SEQ ID NO: 8229043 - DNA, 22 bp, Homo sapiens
aactagaacgtctagttgctgg

SEQ ID NO: 8229044 - DNA, 22 bp, Homo sapiens
aactagagcttccagcttcttg

SEQ ID NO: 8229045 - DNA, 22 bp, Homo sapiens
aactagaacgtctagttgctgg

SEQ ID NO: 8229046 - DNA, 22 bp, Homo sapiens
aactagaacgtctagttgctgg

SEQ ID NO: 8229047 - DNA, 22 bp, Homo sapiens
aactagtttagctttttaagac

SEQ ID NO: 8229048 - DNA, 22 bp, Homo sapiens
aactagtcagtgattctcagaa

SEQ ID NO: 8229049 - DNA, 22 bp, Homo sapiens
aactagctttagttttggaagg

SEQ ID NO: 8229050 - DNA, 22 bp, Homo sapiens
aactagctggattagtgttttc

SEQ ID NO: 8229051 - DNA, 22 bp, Homo sapiens
aatggctgccagggcaggaggt

SEQ ID NO: 8229052 - DNA, 22 bp, Homo sapiens
aatggctgccagggcaggaggt

SEQ ID NO: 8229053 - DNA, 22 bp, Homo sapiens
aatggctgaatgagtgaactag

SEQ ID NO: 8229054 - DNA, 22 bp, Homo sapiens
aatggctgatgccaggtctagg

SEQ ID NO: 8229055 - DNA, 22 bp, Homo sapiens
aatggctgatgtttctgatgac

SEQ ID NO: 8229056 - DNA, 22 bp, Homo sapiens
aatggctgatgtttctgatgac

SEQ ID NO: 8229057 - DNA, 21 bp, Homo sapiens
aatggctgggcaaggtctctc

SEQ ID NO: 8229058 - DNA, 22 bp, Homo sapiens
aatggctgccagggcaggaggt

SEQ ID NO: 8229059 - DNA, 22 bp, Homo sapiens
aatggctgggagtgtattttgg

SEQ ID NO: 8229060 - DNA, 21 bp, Homo sapiens
aatggctgggcaaggtctctc

SEQ ID NO: 8229061 - DNA, 22 bp, Homo sapiens
aatggctctgatgttgttgtga

SEQ ID NO: 8229062 - DNA, 22 bp, Homo sapiens
aatggctctttgaggacagaag

SEQ ID NO: 8229063 - DNA, 22 bp, Homo sapiens
aatggctgaaacataatagaag

SEQ ID NO: 8229064 - DNA, 22 bp, Homo sapiens
aatggctgaagaagtgtggcca

SEQ ID NO: 8229065 - DNA, 22 bp, Homo sapiens
aatggctgaatgagtgaactag

SEQ ID NO: 8229066 - DNA, 22 bp, Homo sapiens
aatggctgaatgagtgaactag

SEQ ID NO: 8229067 - DNA, 22 bp, Homo sapiens
aatggcttctttttggtataat

SEQ ID NO: 8229068 - DNA, 22 bp, Homo sapiens
aatggctgttctctgtgattgg

SEQ ID NO: 8229069 - DNA, 18 bp, Homo sapiens
aatggctgggttgttgcc

SEQ ID NO: 8229070 - DNA, 22 bp, Homo sapiens
aatggctgggtttcattttgta

SEQ ID NO: 8229071 - DNA, 22 bp, Homo sapiens
aatggctgttatttcagcagat

SEQ ID NO: 8229072 - DNA, 22 bp, Homo sapiens
aatgacaataatcattaacttt

SEQ ID NO: 8229073 - DNA, 21 bp, Homo sapiens
aatgacagccagatcctttta

SEQ ID NO: 8229074 - DNA, 22 bp, Homo sapiens
aatgacagagcactgaacttgg

SEQ ID NO: 8229075 - DNA, 23 bp, Homo sapiens
aatgacaggcaatgtaattgtgt

SEQ ID NO: 8229076 - DNA, 22 bp, Homo sapiens
aatgacagccctctagtctggg

SEQ ID NO: 8229077 - DNA, 22 bp, Homo sapiens
aatgacaatattaatttggagg

SEQ ID NO: 8229078 - DNA, 22 bp, Homo sapiens
aatgacagagatagaagggatg

SEQ ID NO: 8229079 - DNA, 22 bp, Homo sapiens
aatgacagagcactgaacttgg

SEQ ID NO: 8229080 - DNA, 22 bp, Homo sapiens
aactagaaatcactacaggtat

SEQ ID NO: 8229081 - DNA, 22 bp, Homo sapiens
aactagaacctgcattttaaca

SEQ ID NO: 8229082 - DNA, 22 bp, Homo sapiens
aactagaaaaagactttctgag

SEQ ID NO: 8229083 - DNA, 22 bp, Homo sapiens
aactagaaaacaagatgctgat

SEQ ID NO: 8229084 - DNA, 20 bp, Homo sapiens
aactagaaagcacccatgga

SEQ ID NO: 8229085 - DNA, 22 bp, Homo sapiens
aactagaaagaacatatttcca

SEQ ID NO: 8229086 - DNA, 22 bp, Homo sapiens
aatgacatgctttttaattata

SEQ ID NO: 8229087 - DNA, 22 bp, Homo sapiens
aatgacagtattccctttatca

SEQ ID NO: 8229088 - DNA, 23 bp, Homo sapiens
aatgacagtgtgtgattgaagaa

SEQ ID NO: 8229089 - DNA, 23 bp, Homo sapiens
aatgacagtgtgtgattgaagaa

SEQ ID NO: 8229090 - DNA, 22 bp, Homo sapiens
aacatctttttgtttgctgaaa

SEQ ID NO: 8229091 - DNA, 22 bp, Homo sapiens
aacatctttgtagtgttctcct

SEQ ID NO: 8229092 - DNA, 22 bp, Homo sapiens
aacatgaaaactacctgtgatt

SEQ ID NO: 8229093 - DNA, 22 bp, Homo sapiens
aacatgaaaactacctgtgatt

SEQ ID NO: 8229094 - DNA, 22 bp, Homo sapiens
aacatgaaaactacctgtgatt

SEQ ID NO: 8229095 - DNA, 22 bp, Homo sapiens
aacatgaaaacctccacagcaa

SEQ ID NO: 8229096 - DNA, 22 bp, Homo sapiens
aacatctttgataaacttagtg

SEQ ID NO: 8229097 - DNA, 19 bp, Homo sapiens
aacatctttccagtagagg

SEQ ID NO: 8229098 - DNA, 22 bp, Homo sapiens
aatacatgttttctactattct

SEQ ID NO: 8229099 - DNA, 22 bp, Homo sapiens
aatacatgttttctactattct

SEQ ID NO: 8229100 - DNA, 22 bp, Homo sapiens
aatacatgttttctactattct

SEQ ID NO: 8229101 - DNA, 22 bp, Homo sapiens
aacatgaaaagcccagagaggt

SEQ ID NO: 8229102 - DNA, 22 bp, Homo sapiens
aacatgaaaagcccagagaggt

SEQ ID NO: 8229103 - DNA, 22 bp, Homo sapiens
aacatgaaaagcccagagaggt

SEQ ID NO: 8229104 - DNA, 20 bp, Homo sapiens
aatacatgagcacactttca

SEQ ID NO: 8229105 - DNA, 22 bp, Homo sapiens
aacatcttgtctaatgtcagct

SEQ ID NO: 8229106 - DNA, 22 bp, Homo sapiens
aacatcttgtcaaatgtccaca

SEQ ID NO: 8229107 - DNA, 22 bp, Homo sapiens
aacatcttgtccttagattaaa

SEQ ID NO: 8229108 - DNA, 22 bp, Homo sapiens
aacatctccaacctacatccac

SEQ ID NO: 8229109 - DNA, 22 bp, Homo sapiens
aacatctctgtattttatagac

SEQ ID NO: 8229110 - DNA, 22 bp, Homo sapiens
aacatctgtgaactccgaaaat

SEQ ID NO: 8229111 - DNA, 22 bp, Homo sapiens
aacatctaggttctcatcgata

SEQ ID NO: 8229112 - DNA, 22 bp, Homo sapiens
aacatctagttcctatataata

SEQ ID NO: 8229113 - DNA, 22 bp, Homo sapiens
aacatctcatggactacattct

SEQ ID NO: 8229114 - DNA, 22 bp, Homo sapiens
aacatctagttcctatataata

SEQ ID NO: 8229115 - DNA, 22 bp, Homo sapiens
aatagatactacttagatgtag

SEQ ID NO: 8229116 - DNA, 22 bp, Homo sapiens
aatagatactacttagatgtag

SEQ ID NO: 8229117 - DNA, 22 bp, Homo sapiens
aatagatactacttagatgtag

SEQ ID NO: 8229118 - DNA, 22 bp, Homo sapiens
aatagatactacttagatgtag

SEQ ID NO: 8229119 - DNA, 22 bp, Homo sapiens
aatagactttctttttagaaca

SEQ ID NO: 8229120 - DNA, 22 bp, Homo sapiens
aatagactccagggtctatttt

SEQ ID NO: 8229121 - DNA, 22 bp, Homo sapiens
aatagcaaacactggtaaagtt

SEQ ID NO: 8229122 - DNA, 22 bp, Homo sapiens
aacatgtaaccagcattcatct

SEQ ID NO: 8229123 - DNA, 22 bp, Homo sapiens
aacatgtaaccagcattcatct

SEQ ID NO: 8229124 - DNA, 22 bp, Homo sapiens
aacatgtacctacaatcagaat

SEQ ID NO: 8229125 - DNA, 22 bp, Homo sapiens
aacatgtacctacaatcagaat

SEQ ID NO: 8229126 - DNA, 22 bp, Homo sapiens
aacatgtctgggtattcacaag

SEQ ID NO: 8229127 - DNA, 22 bp, Homo sapiens
aacatgtcttactttgctttct

SEQ ID NO: 8229128 - DNA, 22 bp, Homo sapiens
aacatgtctttagagaaacatt

SEQ ID NO: 8229129 - DNA, 22 bp, Homo sapiens
aacatgtgagcaggttttttat

SEQ ID NO: 8229130 - DNA, 22 bp, Homo sapiens
aacatgtgtctggctagattgt

SEQ ID NO: 8229131 - DNA, 22 bp, Homo sapiens
aacatgtctgggtattcacaag

SEQ ID NO: 8229132 - DNA, 22 bp, Homo sapiens
aacatcagcacacaatagcaag

SEQ ID NO: 8229133 - DNA, 22 bp, Homo sapiens
aacatcagcacacaatagcaag

SEQ ID NO: 8229134 - DNA, 22 bp, Homo sapiens
aacatcagcacacaatagcaag

SEQ ID NO: 8229135 - DNA, 22 bp, Homo sapiens
aacatcatcctttgagtattta

SEQ ID NO: 8229136 - DNA, 22 bp, Homo sapiens
aacatcatcctttgagtattta

SEQ ID NO: 8229137 - DNA, 22 bp, Homo sapiens
aacatcatcctttgagtattta

SEQ ID NO: 8229138 - DNA, 22 bp, Homo sapiens
aacatcatcatgaacaactaat

SEQ ID NO: 8229139 - DNA, 22 bp, Homo sapiens
aacatatcataggatgtcattg

SEQ ID NO: 8229140 - DNA, 22 bp, Homo sapiens
aacatatctacggatacgatta

SEQ ID NO: 8229141 - DNA, 22 bp, Homo sapiens
aacatattcagatgccaagtcc

SEQ ID NO: 8229142 - DNA, 22 bp, Homo sapiens
aacatatttggctgatattccc

SEQ ID NO: 8229143 - DNA, 22 bp, Homo sapiens
aacatatttggctgatattccc

SEQ ID NO: 8229144 - DNA, 22 bp, Homo sapiens
aacataaatttgaagtggcaaa

SEQ ID NO: 8229145 - DNA, 22 bp, Homo sapiens
aacataaatttgaagtggcaaa

SEQ ID NO: 8229146 - DNA, 22 bp, Homo sapiens
aacatatcataggatgtcattg

SEQ ID NO: 8229147 - DNA, 22 bp, Homo sapiens
aacagctgttcgcagatgtagg

SEQ ID NO: 8229148 - DNA, 22 bp, Homo sapiens
aacagcttactcaatggtgatt

SEQ ID NO: 8229149 - DNA, 22 bp, Homo sapiens
aacagcttgagactggatatgc

SEQ ID NO: 8229150 - DNA, 22 bp, Homo sapiens
aacagcttcatcacatggcata

SEQ ID NO: 8229151 - DNA, 22 bp, Homo sapiens
aacagcttcatcacatggcata

SEQ ID NO: 8229152 - DNA, 22 bp, Homo sapiens
aacagcttagaaatgttgctaa

SEQ ID NO: 8229153 - DNA, 22 bp, Homo sapiens
aagtgtataacgacctacagga

SEQ ID NO: 8229154 - DNA, 22 bp, Homo sapiens
aagtgtcctcattcaacatgca

SEQ ID NO: 8229155 - DNA, 22 bp, Homo sapiens
aagtgtcctcattcaacatgca

SEQ ID NO: 8229156 - DNA, 22 bp, Homo sapiens
aagtgtctacatttgctaacca

SEQ ID NO: 8229157 - DNA, 22 bp, Homo sapiens
aagtgtctaactggttacttct

SEQ ID NO: 8229158 - DNA, 22 bp, Homo sapiens
aagtgtctagcacctggatgca

SEQ ID NO: 8229159 - DNA, 22 bp, Homo sapiens
aacagctgcttcagtacttgaa

SEQ ID NO: 8229160 - DNA, 22 bp, Homo sapiens
aacagctgcttcagtacttgaa

SEQ ID NO: 8229161 - DNA, 22 bp, Homo sapiens
aacagctgcttctatcttttca

SEQ ID NO: 8229162 - DNA, 22 bp, Homo sapiens
aacagctattcactactatggg

SEQ ID NO: 8229163 - DNA, 22 bp, Homo sapiens
aacagctagtaccaatccacta

SEQ ID NO: 8229164 - DNA, 22 bp, Homo sapiens
aacagctagtggtctagacttt

SEQ ID NO: 8229165 - DNA, 22 bp, Homo sapiens
aacagctagtggtctagacttt

SEQ ID NO: 8229166 - DNA, 22 bp, Homo sapiens
aacagctattagaacttcatgg

SEQ ID NO: 8229167 - DNA, 22 bp, Homo sapiens
aagtgcttctgggattaggagt

SEQ ID NO: 8229168 - DNA, 22 bp, Homo sapiens
aagtgcttgatcatagttctca

SEQ ID NO: 8229169 - DNA, 22 bp, Homo sapiens
aagtgggtttgaaatgctttca

SEQ ID NO: 8229170 - DNA, 20 bp, Homo sapiens
aagtgggtttattctttttc

SEQ ID NO: 8229171 - DNA, 23 bp, Homo sapiens
aagtgggtttagacagtcatttt

SEQ ID NO: 8229172 - DNA, 22 bp, Homo sapiens
aagtgcttggattgcaggtatg

SEQ ID NO: 8229173 - DNA, 22 bp, Homo sapiens
aagtggtcagtcatgggagatt

SEQ ID NO: 8229174 - DNA, 20 bp, Homo sapiens
aagtggtcacagtccttggc

SEQ ID NO: 8229175 - DNA, 22 bp, Homo sapiens
aagtggtaggaagagagcactg

SEQ ID NO: 8229176 - DNA, 22 bp, Homo sapiens
aagtggtagagagagcataagc

SEQ ID NO: 8229177 - DNA, 22 bp, Homo sapiens
aagtggttattttgatctagaa

SEQ ID NO: 8229178 - DNA, 22 bp, Homo sapiens
aagtggttgcttgtgagtcccc

SEQ ID NO: 8229179 - DNA, 21 bp, Homo sapiens
aagtggtttacatccagctgt

SEQ ID NO: 8229180 - DNA, 21 bp, Homo sapiens
aagtggtttacatccagctgt

SEQ ID NO: 8229181 - DNA, 21 bp, Homo sapiens
aagtggtttaggttaccgggg

SEQ ID NO: 8229182 - DNA, 22 bp, Homo sapiens
aagtggtttgattcagtttatg

SEQ ID NO: 8229183 - DNA, 22 bp, Homo sapiens
aagtggtttgagcacagtgctg

SEQ ID NO: 8229184 - DNA, 22 bp, Homo sapiens
aagtggtttgattcagtttatg

SEQ ID NO: 8229185 - DNA, 23 bp, Homo sapiens
aagtggttttgaacccggaccct

SEQ ID NO: 8229186 - DNA, 22 bp, Homo sapiens
aagtggttttaagaggttcctt

SEQ ID NO: 8229187 - DNA, 22 bp, Homo sapiens
aaggaagagtctagaacaggca

SEQ ID NO: 8229188 - DNA, 22 bp, Homo sapiens
aaggaagagtctagaacaggca

SEQ ID NO: 8229189 - DNA, 22 bp, Homo sapiens
aaggaagagtctagaacaggca

SEQ ID NO: 8229190 - DNA, 22 bp, Homo sapiens
aaggaagagtctagaacaggca

SEQ ID NO: 8229191 - DNA, 22 bp, Homo sapiens
aaatgtcaaggtgatagatgca

SEQ ID NO: 8229192 - DNA, 22 bp, Homo sapiens
aaatgtcaaggtgatagatgca

SEQ ID NO: 8229193 - DNA, 22 bp, Homo sapiens
aaatgtcaaggtgatagatgca

SEQ ID NO: 8229194 - DNA, 22 bp, Homo sapiens
aaggaagatgaaagtactgcta

SEQ ID NO: 8229195 - DNA, 22 bp, Homo sapiens
aaggaagatatatcaagcttaa

SEQ ID NO: 8229196 - DNA, 22 bp, Homo sapiens
aaatgcattggtttctacttgt

SEQ ID NO: 8229197 - DNA, 22 bp, Homo sapiens
aaatgcattggtttctacttgt

SEQ ID NO: 8229198 - DNA, 22 bp, Homo sapiens
aaatgcatttcactaatgtttc

SEQ ID NO: 8229199 - DNA, 22 bp, Homo sapiens
aaatgcatttcactaatgtttc

SEQ ID NO: 8229200 - DNA, 22 bp, Homo sapiens
aaatgcatgtatgtaatatgct

SEQ ID NO: 8229201 - DNA, 22 bp, Homo sapiens
aaatgcatgtatgtaatatgct

SEQ ID NO: 8229202 - DNA, 22 bp, Homo sapiens
aaatgcatgtgctatagatgtg

SEQ ID NO: 8229203 - DNA, 22 bp, Homo sapiens
aaatgcattaagtcagaacaat

SEQ ID NO: 8229204 - DNA, 22 bp, Homo sapiens
aaatgcattaagtcagaacaat

SEQ ID NO: 8229205 - DNA, 22 bp, Homo sapiens
aaatgcattctgttttcactag

SEQ ID NO: 8229206 - DNA, 22 bp, Homo sapiens
aaatgcattaagtcagaacaat

SEQ ID NO: 8229207 - DNA, 22 bp, Homo sapiens
aaggaaagacaggacggaattc

SEQ ID NO: 8229208 - DNA, 22 bp, Homo sapiens
aaggaagactcgcaggtctatg

SEQ ID NO: 8229209 - DNA, 22 bp, Homo sapiens
aaggaagacacagatgaagtga

SEQ ID NO: 8229210 - DNA, 22 bp, Homo sapiens
aaggaagagcaaagaattatgt

SEQ ID NO: 8229211 - DNA, 22 bp, Homo sapiens
aaggaagagaatccttctcaga

SEQ ID NO: 8229212 - DNA, 22 bp, Homo sapiens
aaggaagagaatccttctcaga

SEQ ID NO: 8229213 - DNA, 22 bp, Homo sapiens
aaggaagagaatccttctcaga

SEQ ID NO: 8229214 - DNA, 22 bp, Homo sapiens
aaggaagacttgagaaggttcc

SEQ ID NO: 8229215 - DNA, 22 bp, Homo sapiens
aaggcagcagtgcacgactgat

SEQ ID NO: 8229216 - DNA, 22 bp, Homo sapiens
aaattattcaaaaagctgtgtt

SEQ ID NO: 8229217 - DNA, 22 bp, Homo sapiens
aaattattcaaaaagctgtgtt

SEQ ID NO: 8229218 - DNA, 22 bp, Homo sapiens
aaggcagccctggctcagcctg

SEQ ID NO: 8229219 - DNA, 22 bp, Homo sapiens
aaggcagccctggctcagcctg

SEQ ID NO: 8229220 - DNA, 22 bp, Homo sapiens
aaggcacttaacgtgggaggat

SEQ ID NO: 8229221 - DNA, 22 bp, Homo sapiens
aaggcagatataaagactagag

SEQ ID NO: 8229222 - DNA, 22 bp, Homo sapiens
aaggcagatataaagactagag

SEQ ID NO: 8229223 - DNA, 22 bp, Homo sapiens
aaggcagcacagcaactgctca

SEQ ID NO: 8229224 - DNA, 22 bp, Homo sapiens
aaggcagcaccgcctcctgaaa

SEQ ID NO: 8229225 - DNA, 22 bp, Homo sapiens
aaggcagcaggatttggtgact

SEQ ID NO: 8229226 - DNA, 19 bp, Homo sapiens
aaggctggtaccataggtt

SEQ ID NO: 8229227 - DNA, 19 bp, Homo sapiens
aaggctggtaccataggtt

SEQ ID NO: 8229228 - DNA, 19 bp, Homo sapiens
aaggctggtaccataggtt

SEQ ID NO: 8229229 - DNA, 22 bp, Homo sapiens
aaggctggtcagatgtggtgaa

SEQ ID NO: 8229230 - DNA, 22 bp, Homo sapiens
aaggctgggtaacctgtccact

SEQ ID NO: 8229231 - DNA, 22 bp, Homo sapiens
aaggctgggtttgggatgtgat

SEQ ID NO: 8229232 - DNA, 22 bp, Homo sapiens
aaggctgggtttgggatgtgat

SEQ ID NO: 8229233 - DNA, 22 bp, Homo sapiens
aaggctgggtttgggatgtgat

SEQ ID NO: 8229234 - DNA, 22 bp, Homo sapiens
aaggctgggtttgggatgtgat

SEQ ID NO: 8229235 - DNA, 22 bp, Homo sapiens
aaggctgggtttgggatgtgat

SEQ ID NO: 8229236 - DNA, 21 bp, Homo sapiens
aaattcacctagtaaaacttc

SEQ ID NO: 8229237 - DNA, 22 bp, Homo sapiens
aaggctgagagtcacagtccta

SEQ ID NO: 8229238 - DNA, 22 bp, Homo sapiens
aaggctgagccagggcccctat

SEQ ID NO: 8229239 - DNA, 22 bp, Homo sapiens
aaggctgggtaacctgtccact

SEQ ID NO: 8229240 - DNA, 22 bp, Homo sapiens
aaggctgggtaacctgtccact

SEQ ID NO: 8229241 - DNA, 22 bp, Homo sapiens
aaggctgagccagggcccctat

SEQ ID NO: 8229242 - DNA, 22 bp, Homo sapiens
aaggctggggtgcagacggcct

SEQ ID NO: 8229243 - DNA, 22 bp, Homo sapiens
aaggctggggtgcagacggcct

SEQ ID NO: 8229244 - DNA, 22 bp, Homo sapiens
aaggctggggtgcagacggcct

SEQ ID NO: 8229245 - DNA, 22 bp, Homo sapiens
aaattattttcagaatggagaa

SEQ ID NO: 8229246 - DNA, 22 bp, Homo sapiens
aaattattttcagaatggagaa

SEQ ID NO: 8229247 - DNA, 22 bp, Homo sapiens
aaattcacaagagcattgcctg

SEQ ID NO: 8229248 - DNA, 22 bp, Homo sapiens
aaattcaattaactttcatgct

SEQ ID NO: 8229249 - DNA, 23 bp, Homo sapiens
aaattattgctcttcaattgcct

SEQ ID NO: 8229250 - DNA, 18 bp, Homo sapiens
aaattattcttccttttc

SEQ ID NO: 8229251 - DNA, 22 bp, Homo sapiens
aaattattctcatgtgtttctt

SEQ ID NO: 8229252 - DNA, 22 bp, Homo sapiens
aacacagacatagtgattacag

SEQ ID NO: 8229253 - DNA, 22 bp, Homo sapiens
aacacagagtatttgaagcatt

SEQ ID NO: 8229254 - DNA, 22 bp, Homo sapiens
aacacagctaatttctgtcaat

SEQ ID NO: 8229255 - DNA, 22 bp, Homo sapiens
aacacaggaggctatgttttct

SEQ ID NO: 8229256 - DNA, 22 bp, Homo sapiens
aacacagggactcccaggagaa

SEQ ID NO: 8229257 - DNA, 22 bp, Homo sapiens
aacacaggccagcctgtgcagt

SEQ ID NO: 8229258 - DNA, 22 bp, Homo sapiens
aacacaggcatactggctccag

SEQ ID NO: 8229259 - DNA, 22 bp, Homo sapiens
aacacagggactcccaggagaa

SEQ ID NO: 8229260 - DNA, 22 bp, Homo sapiens
aacacagggggttacaaattgt

SEQ ID NO: 8229261 - DNA, 22 bp, Homo sapiens
aaatttgttcaatgtctatttg

SEQ ID NO: 8229262 - DNA, 22 bp, Homo sapiens
aaatttgataagccattgttac

SEQ ID NO: 8229263 - DNA, 22 bp, Homo sapiens
aaatttgataagccattgttac

SEQ ID NO: 8229264 - DNA, 22 bp, Homo sapiens
aaatttgataagccattgttac

SEQ ID NO: 8229265 - DNA, 22 bp, Homo sapiens
aaatttcttgaggctctctagc

SEQ ID NO: 8229266 - DNA, 22 bp, Homo sapiens
aaatttctgttgttttgagcca

SEQ ID NO: 8229267 - DNA, 22 bp, Homo sapiens
aaatttctgttgttttgagcca

SEQ ID NO: 8229268 - DNA, 22 bp, Homo sapiens
aaatttctgttgttttgagcca

SEQ ID NO: 8229269 - DNA, 22 bp, Homo sapiens
aaattttaaggctggaacttaa

SEQ ID NO: 8229270 - DNA, 22 bp, Homo sapiens
aaatttgttcaatgtctatttg

SEQ ID NO: 8229271 - DNA, 22 bp, Homo sapiens
aaattttaaggctggaacttaa

SEQ ID NO: 8229272 - DNA, 22 bp, Homo sapiens
aacaatgcttgccaagtgtgat

SEQ ID NO: 8229273 - DNA, 22 bp, Homo sapiens
aaggctggttccatccctggtg

SEQ ID NO: 8229274 - DNA, 22 bp, Homo sapiens
aaatttctaagtcaagaagaac

SEQ ID NO: 8229275 - DNA, 22 bp, Homo sapiens
aaggctggtttccttgatgttt

SEQ ID NO: 8229276 - DNA, 22 bp, Homo sapiens
aaatttctaagtcaagaagaac

SEQ ID NO: 8229277 - DNA, 22 bp, Homo sapiens
aaatttctaagtcaagaagaac

SEQ ID NO: 8229278 - DNA, 22 bp, Homo sapiens
aaatttctaagtcaagaagaac

SEQ ID NO: 8229279 - DNA, 21 bp, Homo sapiens
aaatttctgcaagcctcaact

SEQ ID NO: 8229280 - DNA, 22 bp, Homo sapiens
aaatttctggaagtgtcagagt

SEQ ID NO: 8229281 - DNA, 22 bp, Homo sapiens
aaatttctggaagtgtcagagt

SEQ ID NO: 8229282 - DNA, 22 bp, Homo sapiens
aaggctggtggattatgaggtc

SEQ ID NO: 8229283 - DNA, 22 bp, Homo sapiens
aaggctggtcagatgtggtgaa

SEQ ID NO: 8229284 - DNA, 22 bp, Homo sapiens
aaggctggtcagatgtggtgaa

SEQ ID NO: 8229285 - DNA, 22 bp, Homo sapiens
aaggctggtcagatgtggtgaa

SEQ ID NO: 8229286 - DNA, 22 bp, Homo sapiens
aaggctggtggattatgaggtc

SEQ ID NO: 8229287 - DNA, 22 bp, Homo sapiens
aaggctggtggattatgaggtc

SEQ ID NO: 8229288 - DNA, 22 bp, Homo sapiens
aaggctggtggattatgaggtc

SEQ ID NO: 8229289 - DNA, 22 bp, Homo sapiens
aaggctggttccatccctggtg

SEQ ID NO: 8229290 - DNA, 22 bp, Homo sapiens
aacactttttagtaaagattga

SEQ ID NO: 8229291 - DNA, 22 bp, Homo sapiens
aacactttttagtaaagattga

SEQ ID NO: 8229292 - DNA, 22 bp, Homo sapiens
aacactttttagtaaagattga

SEQ ID NO: 8229293 - DNA, 22 bp, Homo sapiens
aacactttgttgcctatgaacg

SEQ ID NO: 8229294 - DNA, 22 bp, Homo sapiens
aacactttttcctcctgtctgg

SEQ ID NO: 8229295 - DNA, 22 bp, Homo sapiens
aacactttttcctcctgtctgg

SEQ ID NO: 8229296 - DNA, 22 bp, Homo sapiens
aacactttttatatattgtatc

SEQ ID NO: 8229297 - DNA, 22 bp, Homo sapiens
aacactttcttccttgctcagg

SEQ ID NO: 8229298 - DNA, 22 bp, Homo sapiens
aacactttctattattatggtt

SEQ ID NO: 8229299 - DNA, 22 bp, Homo sapiens
aacactttcttccttgctcagg

SEQ ID NO: 8229300 - DNA, 22 bp, Homo sapiens
aacactttggaatagagatagg

SEQ ID NO: 8229301 - DNA, 22 bp, Homo sapiens
aacactttggaatagagatagg

SEQ ID NO: 8229302 - DNA, 22 bp, Homo sapiens
aacactttggaatagagatagg

SEQ ID NO: 8229303 - DNA, 22 bp, Homo sapiens
aacactttggatgcagaaccaa

SEQ ID NO: 8229304 - DNA, 22 bp, Homo sapiens
aacacaggttgctgggcctcac

SEQ ID NO: 8229305 - DNA, 22 bp, Homo sapiens
aacacaggttcattctgtgagg

SEQ ID NO: 8229306 - DNA, 22 bp, Homo sapiens
aacacaggttcattctgtgagg

SEQ ID NO: 8229307 - DNA, 22 bp, Homo sapiens
aacacagtcagttcctggatca

SEQ ID NO: 8229308 - DNA, 22 bp, Homo sapiens
aacacagtcctgctcacttatt

SEQ ID NO: 8229309 - DNA, 22 bp, Homo sapiens
aacactgtatcagtcttcaata

SEQ ID NO: 8229310 - DNA, 22 bp, Homo sapiens
aacactgtatcagtcttcaata

SEQ ID NO: 8229311 - DNA, 22 bp, Homo sapiens
aacacagttttccaaaatagag

SEQ ID NO: 8229312 - DNA, 22 bp, Homo sapiens
aacactgtatcagtcttcaata

SEQ ID NO: 8229313 - DNA, 22 bp, Homo sapiens
aacacagtttctctatgagagt

SEQ ID NO: 8229314 - DNA, 22 bp, Homo sapiens
aacacagtttctgcattggtag

SEQ ID NO: 8229315 - DNA, 22 bp, Homo sapiens
aacacagttttccaaaatagag

SEQ ID NO: 8229316 - DNA, 22 bp, Homo sapiens
aagtgcttcgttctgtattggg

SEQ ID NO: 8229317 - DNA, 22 bp, Homo sapiens
aagtgcttccatgtttgagtgt

SEQ ID NO: 8229318 - DNA, 22 bp, Homo sapiens
aacagacatatttttaatatgc

SEQ ID NO: 8229319 - DNA, 22 bp, Homo sapiens
aacagacagaaaaatgtgatct

SEQ ID NO: 8229320 - DNA, 22 bp, Homo sapiens
aacagacagaaaaatgtgatct

SEQ ID NO: 8229321 - DNA, 22 bp, Homo sapiens
aacagacaactcctgtggctca

SEQ ID NO: 8229322 - DNA, 22 bp, Homo sapiens
aacagaaatcatttagggctct

SEQ ID NO: 8229323 - DNA, 22 bp, Homo sapiens
aacagaactgttgttctggagg

SEQ ID NO: 8229324 - DNA, 22 bp, Homo sapiens
aacagaagggggtatttacatt

SEQ ID NO: 8229325 - DNA, 22 bp, Homo sapiens
aacagaagggggtatttacatt

SEQ ID NO: 8229326 - DNA, 22 bp, Homo sapiens
aacagaagggggtatttacatt

SEQ ID NO: 8229327 - DNA, 22 bp, Homo sapiens
aacagaaaaggtaggtggcttt

SEQ ID NO: 8229328 - DNA, 22 bp, Homo sapiens
aacagaaaaggtaggtggcttt

SEQ ID NO: 8229329 - DNA, 22 bp, Homo sapiens
aacagaaaaggtaggtggcttt

SEQ ID NO: 8229330 - DNA, 22 bp, Homo sapiens
aacagaatagttgatgtacagt

SEQ ID NO: 8229331 - DNA, 22 bp, Homo sapiens
aacagaatagttgatgtacagt

SEQ ID NO: 8229332 - DNA, 22 bp, Homo sapiens
aaagcacttgaaatctggcagt

SEQ ID NO: 8229333 - DNA, 22 bp, Homo sapiens
aaagcactttgagactgacagg

SEQ ID NO: 8229334 - DNA, 22 bp, Homo sapiens
aaagcagaactgagagagctgg

SEQ ID NO: 8229335 - DNA, 22 bp, Homo sapiens
aaagcagactgatttgcatcac

SEQ ID NO: 8229336 - DNA, 22 bp, Homo sapiens
aaagcagagatcatggcttgta

SEQ ID NO: 8229337 - DNA, 22 bp, Homo sapiens
aaagcagagcagggcacttatg

SEQ ID NO: 8229338 - DNA, 22 bp, Homo sapiens
aacactttccgtaggtttagta

SEQ ID NO: 8229339 - DNA, 22 bp, Homo sapiens
aacactttcctgcctttctgat

SEQ ID NO: 8229340 - DNA, 22 bp, Homo sapiens
aacactttcctgcctttctgat

SEQ ID NO: 8229341 - DNA, 22 bp, Homo sapiens
aaagcactgcacatatatttgc

SEQ ID NO: 8229342 - DNA, 22 bp, Homo sapiens
aaagcactgcacatatatttgc

SEQ ID NO: 8229343 - DNA, 22 bp, Homo sapiens
aaagcagcaaatacttttgcac

SEQ ID NO: 8229344 - DNA, 22 bp, Homo sapiens
aacagtgaggtgaatatgctcc

SEQ ID NO: 8229345 - DNA, 22 bp, Homo sapiens
aaagcagattctgatgcagtag

SEQ ID NO: 8229346 - DNA, 22 bp, Homo sapiens
aaagcagattctgatgcagtag

SEQ ID NO: 8229347 - DNA, 22 bp, Homo sapiens
aacataagggagcttcaaaact

SEQ ID NO: 8229348 - DNA, 22 bp, Homo sapiens
aaagcagaggttgcagtgagct

SEQ ID NO: 8229349 - DNA, 19 bp, Homo sapiens
aaagcagaggagcatctga

SEQ ID NO: 8229350 - DNA, 22 bp, Homo sapiens
aaagcagaggtgatatgactta

SEQ ID NO: 8229351 - DNA, 22 bp, Homo sapiens
aacataatgtggccaaagtcac

SEQ ID NO: 8229352 - DNA, 22 bp, Homo sapiens
aacataagtggcactttgccca

SEQ ID NO: 8229353 - DNA, 22 bp, Homo sapiens
aacatacagtgagcagtggact

SEQ ID NO: 8229354 - DNA, 22 bp, Homo sapiens
aacatacagtgagcagtggact

SEQ ID NO: 8229355 - DNA, 22 bp, Homo sapiens
aacatacttatactaaataatg

SEQ ID NO: 8229356 - DNA, 22 bp, Homo sapiens
aacatacttatactaaataatg

SEQ ID NO: 8229357 - DNA, 23 bp, Homo sapiens
aacatactgtttaatattcacag

SEQ ID NO: 8229358 - DNA, 22 bp, Homo sapiens
aacatacttatactaaataatg

SEQ ID NO: 8229359 - DNA, 22 bp, Homo sapiens
aacatataaactcttaagttca

SEQ ID NO: 8229360 - DNA, 22 bp, Homo sapiens
aacatataaactcttaagttca

SEQ ID NO: 8229361 - DNA, 22 bp, Homo sapiens
aacatataaactcttaagttca

SEQ ID NO: 8229362 - DNA, 22 bp, Homo sapiens
aacatataaactcttaagttca

SEQ ID NO: 8229363 - DNA, 22 bp, Homo sapiens
aacatagacccagttcaacaaa

SEQ ID NO: 8229364 - DNA, 22 bp, Homo sapiens
aacatagcgagacactgtgtct

SEQ ID NO: 8229365 - DNA, 22 bp, Homo sapiens
aaagcctcccaggttatgagta

SEQ ID NO: 8229366 - DNA, 22 bp, Homo sapiens
aaagccattgcagagcaggatt

SEQ ID NO: 8229367 - DNA, 22 bp, Homo sapiens
aaagccattacaaaatttcata

SEQ ID NO: 8229368 - DNA, 22 bp, Homo sapiens
aaagccattacaaaatttcata

SEQ ID NO: 8229369 - DNA, 23 bp, Homo sapiens
aaagcaaggaattggcaacagag

SEQ ID NO: 8229370 - DNA, 22 bp, Homo sapiens
aaagcaaacagaaccccaagct

SEQ ID NO: 8229371 - DNA, 22 bp, Homo sapiens
aacactgtcttatacttcaatg

SEQ ID NO: 8229372 - DNA, 22 bp, Homo sapiens
aacactgtcttatacttcaatg

SEQ ID NO: 8229373 - DNA, 22 bp, Homo sapiens
aacactgtcagcctttgatgga

SEQ ID NO: 8229374 - DNA, 22 bp, Homo sapiens
aacactgtcagcctttgatgga

SEQ ID NO: 8229375 - DNA, 22 bp, Homo sapiens
aacactgtcagcctttgatgga

SEQ ID NO: 8229376 - DNA, 22 bp, Homo sapiens
aacactgtatcagtcttcaata

SEQ ID NO: 8229377 - DNA, 23 bp, Homo sapiens
aacaccaaggctcagagagataa

SEQ ID NO: 8229378 - DNA, 22 bp, Homo sapiens
aacacattttgcctaggcaata

SEQ ID NO: 8229379 - DNA, 22 bp, Homo sapiens
aacacattttgcctaggcaata

SEQ ID NO: 8229380 - DNA, 22 bp, Homo sapiens
aaagcaagtctctacaaagtac

SEQ ID NO: 8229381 - DNA, 22 bp, Homo sapiens
aaagcaagtctctacaaagtac

SEQ ID NO: 8229382 - DNA, 22 bp, Homo sapiens
aacacttatccacatttgaaag

SEQ ID NO: 8229383 - DNA, 22 bp, Homo sapiens
aacactgtggtcttttcagtaa

SEQ ID NO: 8229384 - DNA, 22 bp, Homo sapiens
aacactgtgctccccaggctgt

SEQ ID NO: 8229385 - DNA, 22 bp, Homo sapiens
aacactgtggtcttttcagtaa

SEQ ID NO: 8229386 - DNA, 20 bp, Homo sapiens
aacactgtgcgtggtaggtg

SEQ ID NO: 8229387 - DNA, 22 bp, Homo sapiens
aacactgtgctccccaggctgt

SEQ ID NO: 8229388 - DNA, 20 bp, Homo sapiens
aacactgtgcgtggtaggtg

SEQ ID NO: 8229389 - DNA, 22 bp, Homo sapiens
aacactgtggtcttttcagtaa

SEQ ID NO: 8229390 - DNA, 22 bp, Homo sapiens
aacactgtggtcttttcagtaa

SEQ ID NO: 8229391 - DNA, 22 bp, Homo sapiens
aacactgtggtcttttcagtaa

SEQ ID NO: 8229392 - DNA, 22 bp, Homo sapiens
aacactgtcttatacttcaatg

SEQ ID NO: 8229393 - DNA, 22 bp, Homo sapiens
aacactgtgcagtgtaatgctg

SEQ ID NO: 8229394 - DNA, 22 bp, Homo sapiens
aacactgtgaggtaatgaccta

SEQ ID NO: 8229395 - DNA, 22 bp, Homo sapiens
aacactgtgcccaccctagtcc

SEQ ID NO: 8229396 - DNA, 22 bp, Homo sapiens
aacactgtgcagtgtaatgctg

SEQ ID NO: 8229397 - DNA, 22 bp, Homo sapiens
aacactgtgcccaccctagtcc

SEQ ID NO: 8229398 - DNA, 22 bp, Homo sapiens
aacactgtgcccaccctagtcc

SEQ ID NO: 8229399 - DNA, 22 bp, Homo sapiens
aacactgtgaggtaatgaccta

SEQ ID NO: 8229400 - DNA, 21 bp, Homo sapiens
aaagatgtttcttttcctcac

SEQ ID NO: 8229401 - DNA, 22 bp, Homo sapiens
aaagatgtttgttccaaaattc

SEQ ID NO: 8229402 - DNA, 22 bp, Homo sapiens
aaagatttgagttctgcttata

SEQ ID NO: 8229403 - DNA, 22 bp, Homo sapiens
aaagatttcagaagcctgtgcc

SEQ ID NO: 8229404 - DNA, 22 bp, Homo sapiens
aaagatttgaaattaggcatca

SEQ ID NO: 8229405 - DNA, 22 bp, Homo sapiens
aaagatttatgaagttcaatta

SEQ ID NO: 8229406 - DNA, 22 bp, Homo sapiens
aaagatttcacatcccaagcct

SEQ ID NO: 8229407 - DNA, 22 bp, Homo sapiens
aaagatttaagaataatttgtg

SEQ ID NO: 8229408 - DNA, 22 bp, Homo sapiens
aaagatttatgaagttcaatta

SEQ ID NO: 8229409 - DNA, 22 bp, Homo sapiens
aaagccttggtcatctggttcc

SEQ ID NO: 8229410 - DNA, 22 bp, Homo sapiens
aaagccttgggatttgtgatca

SEQ ID NO: 8229411 - DNA, 22 bp, Homo sapiens
aacatttgtttcgttatgtgaa

SEQ ID NO: 8229412 - DNA, 16 bp, Homo sapiens
aacccacagctcccga

SEQ ID NO: 8229413 - DNA, 22 bp, Homo sapiens
aacccacaagcagctgtagccc

SEQ ID NO: 8229414 - DNA, 22 bp, Homo sapiens
aaagcctgggttcctcactatc

SEQ ID NO: 8229415 - DNA, 22 bp, Homo sapiens
aaagcctcccaggttatgagta

SEQ ID NO: 8229416 - DNA, 22 bp, Homo sapiens
aaagcctcccaggttatgagta

SEQ ID NO: 8229417 - DNA, 22 bp, Homo sapiens
aacccagggtgaggggagtcta

SEQ ID NO: 8229418 - DNA, 22 bp, Homo sapiens
aacccagggtgaggggagtcta

SEQ ID NO: 8229419 - DNA, 22 bp, Homo sapiens
aacccagggtggaggttgcagt

SEQ ID NO: 8229420 - DNA, 22 bp, Homo sapiens
aacccatgttggaagcttatca

SEQ ID NO: 8229421 - DNA, 22 bp, Homo sapiens
aacccaggtctttggcttccag

SEQ ID NO: 8229422 - DNA, 22 bp, Homo sapiens
aacccaggaggtggaggttgtg

SEQ ID NO: 8229423 - DNA, 22 bp, Homo sapiens
aacccaggaggcggaggttgtg

SEQ ID NO: 8229424 - DNA, 22 bp, Homo sapiens
aacccaggaggcagatgttgtg

SEQ ID NO: 8229425 - DNA, 22 bp, Homo sapiens
aacccaggagttggaggctgtg

SEQ ID NO: 8229426 - DNA, 22 bp, Homo sapiens
aacccaggagccggaggttgtg

SEQ ID NO: 8229427 - DNA, 22 bp, Homo sapiens
aacccaggaggcagaggctgca

SEQ ID NO: 8229428 - DNA, 22 bp, Homo sapiens
aacccaggagacaggttgcagt

SEQ ID NO: 8229429 - DNA, 22 bp, Homo sapiens
aacccaggagacggagtttgtg

SEQ ID NO: 8229430 - DNA, 22 bp, Homo sapiens
aacccaggagatggaggttgtg

SEQ ID NO: 8229431 - DNA, 22 bp, Homo sapiens
aacccagccgtgtagctgccgc

SEQ ID NO: 8229432 - DNA, 22 bp, Homo sapiens
aacccagagctggaggagagta

SEQ ID NO: 8229433 - DNA, 22 bp, Homo sapiens
aacccaggacagagctttgtgg

SEQ ID NO: 8229434 - DNA, 22 bp, Homo sapiens
aaccccaacacaggaaatatct

SEQ ID NO: 8229435 - DNA, 22 bp, Homo sapiens
aaccccgctcaggctgggtgag

SEQ ID NO: 8229436 - DNA, 22 bp, Homo sapiens
aaaggcagagttgttggaggca

SEQ ID NO: 8229437 - DNA, 22 bp, Homo sapiens
aacccgggaggcagaggttgtg

SEQ ID NO: 8229438 - DNA, 22 bp, Homo sapiens
aacccgggaggcagaggttgtg

SEQ ID NO: 8229439 - DNA, 19 bp, Homo sapiens
aaaggcagtgggtggcgtg

SEQ ID NO: 8229440 - DNA, 18 bp, Homo sapiens
aaaggcatatatagaagt

SEQ ID NO: 8229441 - DNA, 22 bp, Homo sapiens
aaaggcagtgtgatactgtggt

SEQ ID NO: 8229442 - DNA, 23 bp, Homo sapiens
aaaggcaggcctaggacatattg

SEQ ID NO: 8229443 - DNA, 22 bp, Homo sapiens
aaaggcaggctttcacatctca

SEQ ID NO: 8229444 - DNA, 22 bp, Homo sapiens
aaaggcaggctttcacatctca

SEQ ID NO: 8229445 - DNA, 23 bp, Homo sapiens
aaaggcaggcctaggacatattg

SEQ ID NO: 8229446 - DNA, 22 bp, Homo sapiens
aaaggcaggctttcacatctca

SEQ ID NO: 8229447 - DNA, 22 bp, Homo sapiens
aaaggcagtgggtatgtggatc

SEQ ID NO: 8229448 - DNA, 22 bp, Homo sapiens
aaaggcagtgggtatgtggatc

SEQ ID NO: 8229449 - DNA, 22 bp, Homo sapiens
aactgtaaggcttagaacagca

SEQ ID NO: 8229450 - DNA, 22 bp, Homo sapiens
aactgtaagagaataaatgtgt

SEQ ID NO: 8229451 - DNA, 22 bp, Homo sapiens
aactgtaagaaataaaattctg

SEQ ID NO: 8229452 - DNA, 22 bp, Homo sapiens
aactgtagaagggacacaaaag

SEQ ID NO: 8229453 - DNA, 22 bp, Homo sapiens
aactgtaatttttacatagtaa

SEQ ID NO: 8229454 - DNA, 22 bp, Homo sapiens
aactgtaatgaattgttcatga

SEQ ID NO: 8229455 - DNA, 22 bp, Homo sapiens
aactgtctaaggagaatatgaa

SEQ ID NO: 8229456 - DNA, 22 bp, Homo sapiens
aactgtcttgcctactcagcat

SEQ ID NO: 8229457 - DNA, 23 bp, Homo sapiens
aactgtcttgcaagtgtgatacc

SEQ ID NO: 8229458 - DNA, 22 bp, Homo sapiens
aaaggttttctagggttgaggg

SEQ ID NO: 8229459 - DNA, 22 bp, Homo sapiens
aactgtggcatgttgaatttgt

SEQ ID NO: 8229460 - DNA, 22 bp, Homo sapiens
aaaggttttggtaaggctttaa

SEQ ID NO: 8229461 - DNA, 22 bp, Homo sapiens
aaaggttttggtaaggctttaa

SEQ ID NO: 8229462 - DNA, 22 bp, Homo sapiens
aaaggttttggtaaggctttaa

SEQ ID NO: 8229463 - DNA, 22 bp, Homo sapiens
aaaggttttgccctgggtattc

SEQ ID NO: 8229464 - DNA, 22 bp, Homo sapiens
aaaggttttgccctgggtattc

SEQ ID NO: 8229465 - DNA, 22 bp, Homo sapiens
aaaggttttctgacccttagta

SEQ ID NO: 8229466 - DNA, 22 bp, Homo sapiens
aaaggttttctgacccttagta

SEQ ID NO: 8229467 - DNA, 22 bp, Homo sapiens
aaagtaattaagaagctggaca

SEQ ID NO: 8229468 - DNA, 22 bp, Homo sapiens
aaagtaattgcagtttctgcca

SEQ ID NO: 8229469 - DNA, 22 bp, Homo sapiens
aaagtaagggttaatctacttt

SEQ ID NO: 8229470 - DNA, 22 bp, Homo sapiens
aaagtaagatttgcatttcaga

SEQ ID NO: 8229471 - DNA, 22 bp, Homo sapiens
aaagtaagatttgcatttcaga

SEQ ID NO: 8229472 - DNA, 22 bp, Homo sapiens
aaagtaagaccaagtgatcatt

SEQ ID NO: 8229473 - DNA, 22 bp, Homo sapiens
aagaaataagacttctctgtcc

SEQ ID NO: 8229474 - DNA, 22 bp, Homo sapiens
aagaaataagacttctctgtcc

SEQ ID NO: 8229475 - DNA, 22 bp, Homo sapiens
aaagtaattgcagtttctgcca

SEQ ID NO: 8229476 - DNA, 22 bp, Homo sapiens
aagaaataagacttctctgtcc

SEQ ID NO: 8229477 - DNA, 22 bp, Homo sapiens
aagaaataagacttctctgtcc

SEQ ID NO: 8229478 - DNA, 22 bp, Homo sapiens
aaaggtttttcagcagggagat

SEQ ID NO: 8229479 - DNA, 22 bp, Homo sapiens
aaagtaacctagtaatagtgtc

SEQ ID NO: 8229480 - DNA, 22 bp, Homo sapiens
aaagtaacctagtaatagtgtc

SEQ ID NO: 8229481 - DNA, 22 bp, Homo sapiens
aaaggttttgttcatcgatttt

SEQ ID NO: 8229482 - DNA, 22 bp, Homo sapiens
aaaggtttttatttatcctgga

SEQ ID NO: 8229483 - DNA, 22 bp, Homo sapiens
aaaggttttgttcatcgatttt

SEQ ID NO: 8229484 - DNA, 22 bp, Homo sapiens
aaaggtttttcagcagggagat

SEQ ID NO: 8229485 - DNA, 22 bp, Homo sapiens
aaaggtttttatttatcctgga

SEQ ID NO: 8229486 - DNA, 22 bp, Homo sapiens
aagaacatgaacctcttctaac

SEQ ID NO: 8229487 - DNA, 22 bp, Homo sapiens
aagaacatgaacctcttctaac

SEQ ID NO: 8229488 - DNA, 22 bp, Homo sapiens
aagaacatgaacacaatgttta

SEQ ID NO: 8229489 - DNA, 22 bp, Homo sapiens
aagaacatgaacctcttctaac

SEQ ID NO: 8229490 - DNA, 22 bp, Homo sapiens
aagaacatgagttatgatgatt

SEQ ID NO: 8229491 - DNA, 22 bp, Homo sapiens
aagaacatgagttatgatgatt

SEQ ID NO: 8229492 - DNA, 22 bp, Homo sapiens
aagaacatgaagtcacaaatgc

SEQ ID NO: 8229493 - DNA, 22 bp, Homo sapiens
aagaacagttgggaggtgagcc

SEQ ID NO: 8229494 - DNA, 22 bp, Homo sapiens
aagaacataaacagaaggacag

SEQ ID NO: 8229495 - DNA, 22 bp, Homo sapiens
aagaacataacagaagctgtgt

SEQ ID NO: 8229496 - DNA, 22 bp, Homo sapiens
aagaacataacagaagctgtgt

SEQ ID NO: 8229497 - DNA, 22 bp, Homo sapiens
aagatgttgcattagaatacct

SEQ ID NO: 8229498 - DNA, 22 bp, Homo sapiens
aagatcctgcttttgcttctgt

SEQ ID NO: 8229499 - DNA, 22 bp, Homo sapiens
aagatcataatatttatctcat

SEQ ID NO: 8229500 - DNA, 22 bp, Homo sapiens
aagatccatgagggcagagatt

SEQ ID NO: 8229501 - DNA, 22 bp, Homo sapiens
aagatgttgcattagaatacct

SEQ ID NO: 8229502 - DNA, 22 bp, Homo sapiens
aagatgttgtcgttagtgatga

SEQ ID NO: 8229503 - DNA, 22 bp, Homo sapiens
aagatgtttaggtaaaaagttt

SEQ ID NO: 8229504 - DNA, 22 bp, Homo sapiens
aagatcaccttgacatgaaaag

SEQ ID NO: 8229505 - DNA, 22 bp, Homo sapiens
aagatcaatgttcattaagatg

SEQ ID NO: 8229506 - DNA, 22 bp, Homo sapiens
aagatcaagatcagagaacagc

SEQ ID NO: 8229507 - DNA, 22 bp, Homo sapiens
aagatcaagtgtactttatgta

SEQ ID NO: 8229508 - DNA, 22 bp, Homo sapiens
aagatatattttggtgatttca

SEQ ID NO: 8229509 - DNA, 22 bp, Homo sapiens
aagatatattttggtgatttca

SEQ ID NO: 8229510 - DNA, 22 bp, Homo sapiens
aagatattcaaagatttattag

SEQ ID NO: 8229511 - DNA, 22 bp, Homo sapiens
aagatattcaaagatttattag

SEQ ID NO: 8229512 - DNA, 22 bp, Homo sapiens
aagatattttagaacattcact

SEQ ID NO: 8229513 - DNA, 22 bp, Homo sapiens
aagatattcaaagatttattag

SEQ ID NO: 8229514 - DNA, 22 bp, Homo sapiens
aagatattcaaagatttattag

SEQ ID NO: 8229515 - DNA, 22 bp, Homo sapiens
aagcaggagatgggtgcttttc

SEQ ID NO: 8229516 - DNA, 22 bp, Homo sapiens
aagcaggcatcttggaggtcaa

SEQ ID NO: 8229517 - DNA, 22 bp, Homo sapiens
aagcaggcatcttggaggtcaa

SEQ ID NO: 8229518 - DNA, 22 bp, Homo sapiens
aagcaggcatgggaggccatcc

SEQ ID NO: 8229519 - DNA, 22 bp, Homo sapiens
aagcaggcatgggaggccatcc

SEQ ID NO: 8229520 - DNA, 22 bp, Homo sapiens
aagcaggcatcttggaggtcaa

SEQ ID NO: 8229521 - DNA, 22 bp, Homo sapiens
aagcaggatggatctagtgttc

SEQ ID NO: 8229522 - DNA, 22 bp, Homo sapiens
aagcaggcaaggttgtggggca

SEQ ID NO: 8229523 - DNA, 22 bp, Homo sapiens
aagcaggcaaggttgtggggca

SEQ ID NO: 8229524 - DNA, 22 bp, Homo sapiens
aagcaggcagggtggagagttt

SEQ ID NO: 8229525 - DNA, 22 bp, Homo sapiens
aagcaggcaaggttgtggggca

SEQ ID NO: 8229526 - DNA, 22 bp, Homo sapiens
aagcagcatagctcccttagtt

SEQ ID NO: 8229527 - DNA, 22 bp, Homo sapiens
aagcagcatatgacagcatcca

SEQ ID NO: 8229528 - DNA, 22 bp, Homo sapiens
aagattatggcagataacaatt

SEQ ID NO: 8229529 - DNA, 22 bp, Homo sapiens
aagattagacaggattatgcat

SEQ ID NO: 8229530 - DNA, 22 bp, Homo sapiens
aagattatggcagataacaatt

SEQ ID NO: 8229531 - DNA, 22 bp, Homo sapiens
aaatgcatggctgttttaaagc

SEQ ID NO: 8229532 - DNA, 22 bp, Homo sapiens
aaatgcatggtaaatgattgcc

SEQ ID NO: 8229533 - DNA, 22 bp, Homo sapiens
aaatgcatggtaaatgattgcc

SEQ ID NO: 8229534 - DNA, 22 bp, Homo sapiens
aaatgcatggtaaatgattgcc

SEQ ID NO: 8229535 - DNA, 22 bp, Homo sapiens
aaatgcatgtagaataatagag

SEQ ID NO: 8229536 - DNA, 22 bp, Homo sapiens
aaatgcatgtagaataatagag

SEQ ID NO: 8229537 - DNA, 22 bp, Homo sapiens
aaatgcatgtagaataatagag

SEQ ID NO: 8229538 - DNA, 22 bp, Homo sapiens
aaatgcatgtagaataatagag

SEQ ID NO: 8229539 - DNA, 22 bp, Homo sapiens
aagcctctggggcctcatctgt

SEQ ID NO: 8229540 - DNA, 22 bp, Homo sapiens
aagcctgctttgttccacagca

SEQ ID NO: 8229541 - DNA, 22 bp, Homo sapiens
aagcctggcacattggagtctg

SEQ ID NO: 8229542 - DNA, 22 bp, Homo sapiens
aagcctggcacattggagtctg

SEQ ID NO: 8229543 - DNA, 22 bp, Homo sapiens
aagcctggcacattggagtctg

SEQ ID NO: 8229544 - DNA, 22 bp, Homo sapiens
aagccttcagtccgttgcagag

SEQ ID NO: 8229545 - DNA, 22 bp, Homo sapiens
aagcccttccgtgctgctggat

SEQ ID NO: 8229546 - DNA, 22 bp, Homo sapiens
aagcccttggcagagttcccca

SEQ ID NO: 8229547 - DNA, 22 bp, Homo sapiens
aagcccttggcgcacaccgggc

SEQ ID NO: 8229548 - DNA, 22 bp, Homo sapiens
aagccggctgggccgaggctgc

SEQ ID NO: 8229549 - DNA, 22 bp, Homo sapiens
aagccgggcctgagaaatgaca

SEQ ID NO: 8229550 - DNA, 22 bp, Homo sapiens
aaatctcagcccttattttaga

SEQ ID NO: 8229551 - DNA, 22 bp, Homo sapiens
aaatctctgaacttaataatgc

SEQ ID NO: 8229552 - DNA, 22 bp, Homo sapiens
aaatctctgaacttaataatgc

SEQ ID NO: 8229553 - DNA, 22 bp, Homo sapiens
aagcaggccctgggccagggga

SEQ ID NO: 8229554 - DNA, 22 bp, Homo sapiens
aagcaggcattccagagacaat

SEQ ID NO: 8229555 - DNA, 22 bp, Homo sapiens
aagcaggcgagggcctggagca

SEQ ID NO: 8229556 - DNA, 22 bp, Homo sapiens
aaatctcaatttgaattgtagc

SEQ ID NO: 8229557 - DNA, 22 bp, Homo sapiens
aaatctcaatttgaattgtagc

SEQ ID NO: 8229558 - DNA, 22 bp, Homo sapiens
aagcaggcgagggcctggagca

SEQ ID NO: 8229559 - DNA, 22 bp, Homo sapiens
aaatctctggtcacagaactta

SEQ ID NO: 8229560 - DNA, 22 bp, Homo sapiens
aaatctctggcagaaataaact

SEQ ID NO: 8229561 - DNA, 22 bp, Homo sapiens
aaatctctgcaggcaaatgtga

SEQ ID NO: 8229562 - DNA, 22 bp, Homo sapiens
aaatctctgaacttaataatgc

SEQ ID NO: 8229563 - DNA, 22 bp, Homo sapiens
aaatctgagaaatattgtccag

SEQ ID NO: 8229564 - DNA, 22 bp, Homo sapiens
aagcccagatgggagcatttca

SEQ ID NO: 8229565 - DNA, 22 bp, Homo sapiens
aaatctttccctttactatcca

SEQ ID NO: 8229566 - DNA, 22 bp, Homo sapiens
aagcccagatgggagcatttca

SEQ ID NO: 8229567 - DNA, 23 bp, Homo sapiens
aaagtgattagcatttctgcaga

SEQ ID NO: 8229568 - DNA, 23 bp, Homo sapiens
aaagtgattagcatttctgcaga

SEQ ID NO: 8229569 - DNA, 22 bp, Homo sapiens
aaagtgatgccaggagtctggt

SEQ ID NO: 8229570 - DNA, 22 bp, Homo sapiens
aaagtgatgccaggagtctggt

SEQ ID NO: 8229571 - DNA, 22 bp, Homo sapiens
aaagtgatgaactctgtgacct

SEQ ID NO: 8229572 - DNA, 22 bp, Homo sapiens
aaagtgaggacttgagtactgt

SEQ ID NO: 8229573 - DNA, 22 bp, Homo sapiens
aagaacatggtaggataacaaa

SEQ ID NO: 8229574 - DNA, 22 bp, Homo sapiens
aagaacatggtaggataacaaa

SEQ ID NO: 8229575 - DNA, 22 bp, Homo sapiens
aagaacatgctataattatctt

SEQ ID NO: 8229576 - DNA, 22 bp, Homo sapiens
aagaacatgatggccatgtgca

SEQ ID NO: 8229577 - DNA, 22 bp, Homo sapiens
aaagtgcactctcagtgctgct

SEQ ID NO: 8229578 - DNA, 22 bp, Homo sapiens
aaagtgattatgctgtcaaaga

SEQ ID NO: 8229579 - DNA, 22 bp, Homo sapiens
aaagtgatttaagtacctcagg

SEQ ID NO: 8229580 - DNA, 22 bp, Homo sapiens
aaagtgatttaagtacctcagg

SEQ ID NO: 8229581 - DNA, 19 bp, Homo sapiens
aaagtgattttttctggca

SEQ ID NO: 8229582 - DNA, 20 bp, Homo sapiens
aaagtgcacagatacagctc

SEQ ID NO: 8229583 - DNA, 22 bp, Homo sapiens
aagactgagttcaaatcacagc

SEQ ID NO: 8229584 - DNA, 22 bp, Homo sapiens
aagactgtacattttccagtct

SEQ ID NO: 8229585 - DNA, 22 bp, Homo sapiens
aaagtttacagtgcacatgggt

SEQ ID NO: 8229586 - DNA, 22 bp, Homo sapiens
aagactgtcttttctgagtgac

SEQ ID NO: 8229587 - DNA, 22 bp, Homo sapiens
aagactgtgtctatggctactc

SEQ ID NO: 8229588 - DNA, 22 bp, Homo sapiens
aagacctgcagtttctctacct

SEQ ID NO: 8229589 - DNA, 22 bp, Homo sapiens
aagacctgcatgcggactaaca

SEQ ID NO: 8229590 - DNA, 22 bp, Homo sapiens
aagacctattttaggatatgaa

SEQ ID NO: 8229591 - DNA, 22 bp, Homo sapiens
aagaccgaggtgaggtgttatt

SEQ ID NO: 8229592 - DNA, 22 bp, Homo sapiens
aagaccctatactcagtgaccc

SEQ ID NO: 8229593 - DNA, 17 bp, Homo sapiens
aagaccctagtctaccc

SEQ ID NO: 8229594 - DNA, 22 bp, Homo sapiens
aagactagggtgtgtttaatct

SEQ ID NO: 8229595 - DNA, 22 bp, Homo sapiens
aagactagaccagtgaatagga

SEQ ID NO: 8229596 - DNA, 22 bp, Homo sapiens
aagacctgggagagattgggtt

SEQ ID NO: 8229597 - DNA, 22 bp, Homo sapiens
aagacctgcgttatcctgcctg

SEQ ID NO: 8229598 - DNA, 22 bp, Homo sapiens
aagacgcaccctttgagggcac

SEQ ID NO: 8229599 - DNA, 22 bp, Homo sapiens
aagagggctcgatttggcaaaa

SEQ ID NO: 8229600 - DNA, 22 bp, Homo sapiens
aagagggctgcaatcttattgc

SEQ ID NO: 8229601 - DNA, 22 bp, Homo sapiens
aagagggctgcaatcttattgc

SEQ ID NO: 8229602 - DNA, 22 bp, Homo sapiens
aagagggaggtgcgggtgcaga

SEQ ID NO: 8229603 - DNA, 22 bp, Homo sapiens
aagagggaggtgcgggtgcaga

SEQ ID NO: 8229604 - DNA, 22 bp, Homo sapiens
aagagggaggtgcgggtgcaga

SEQ ID NO: 8229605 - DNA, 19 bp, Homo sapiens
aagagggaaagtgctatgc

SEQ ID NO: 8229606 - DNA, 22 bp, Homo sapiens
aagaggaggatgctttacagct

SEQ ID NO: 8229607 - DNA, 22 bp, Homo sapiens
aagagggaagtcacctggaggt

SEQ ID NO: 8229608 - DNA, 22 bp, Homo sapiens
aagagggaaattgttggctgct

SEQ ID NO: 8229609 - DNA, 22 bp, Homo sapiens
aagagggaaattgttggctgct

SEQ ID NO: 8229610 - DNA, 22 bp, Homo sapiens
aagagggaaattgttggctgct

SEQ ID NO: 8229611 - DNA, 22 bp, Homo sapiens
aagagggagggcaaaggcactg

SEQ ID NO: 8229612 - DNA, 22 bp, Homo sapiens
aaagtttggatccagcaaaaga

SEQ ID NO: 8229613 - DNA, 22 bp, Homo sapiens
aaagttttagaactaggaagca

SEQ ID NO: 8229614 - DNA, 22 bp, Homo sapiens
aaagttttagctgtccagttcc

SEQ ID NO: 8229615 - DNA, 23 bp, Homo sapiens
aaagtttgaagcaacagtagttg

SEQ ID NO: 8229616 - DNA, 22 bp, Homo sapiens
aaatactgctgctattcctttt

SEQ ID NO: 8229617 - DNA, 22 bp, Homo sapiens
aaatactgctgctattcctttt

SEQ ID NO: 8229618 - DNA, 22 bp, Homo sapiens
aaatactgggctcaaaagggtt

SEQ ID NO: 8229619 - DNA, 22 bp, Homo sapiens
aagatatattttggtgatttca

SEQ ID NO: 8229620 - DNA, 22 bp, Homo sapiens
aagatatagatggtggtataaa

SEQ ID NO: 8229621 - DNA, 22 bp, Homo sapiens
aagataaactcttgatttctga

SEQ ID NO: 8229622 - DNA, 22 bp, Homo sapiens
aaatacatttacagtcgtggct

SEQ ID NO: 8229623 - DNA, 22 bp, Homo sapiens
aaatacattagacggagagtta

SEQ ID NO: 8229624 - DNA, 22 bp, Homo sapiens
aaatacattagacggagagtta

SEQ ID NO: 8229625 - DNA, 22 bp, Homo sapiens
aaatacatttacagtcgtggct

SEQ ID NO: 8229626 - DNA, 22 bp, Homo sapiens
aaatacatttacagtcgtggct

SEQ ID NO: 8229627 - DNA, 22 bp, Homo sapiens
aaatactagaattcagagttga

SEQ ID NO: 8229628 - DNA, 22 bp, Homo sapiens
aaatactagaattcagagttga

SEQ ID NO: 8229629 - DNA, 22 bp, Homo sapiens
aaatactagaattcagagttga

SEQ ID NO: 8229630 - DNA, 17 bp, Homo sapiens
aagaggtaactgtacta

SEQ ID NO: 8229631 - DNA, 22 bp, Homo sapiens
aagaggtaaccatagcaaccac

SEQ ID NO: 8229632 - DNA, 22 bp, Homo sapiens
aagaggtaatgactgcttgagt

SEQ ID NO: 8229633 - DNA, 17 bp, Homo sapiens
aagaggtaactgtacta

SEQ ID NO: 8229634 - DNA, 22 bp, Homo sapiens
aagaggtagcagtcacaaaaga

SEQ ID NO: 8229635 - DNA, 22 bp, Homo sapiens
aagaggggtggtctgtgaggat

SEQ ID NO: 8229636 - DNA, 22 bp, Homo sapiens
aagaggggtggtctgtgaggat

SEQ ID NO: 8229637 - DNA, 22 bp, Homo sapiens
aaacttctctccctactttgtg

SEQ ID NO: 8229638 - DNA, 22 bp, Homo sapiens
aaatagtttagctctcatttca

SEQ ID NO: 8229639 - DNA, 22 bp, Homo sapiens
aaatagtttagctctcatttca

SEQ ID NO: 8229640 - DNA, 17 bp, Homo sapiens
aaacttcattctcagga

SEQ ID NO: 8229641 - DNA, 22 bp, Homo sapiens
aaatataatttctgcctcaata

SEQ ID NO: 8229642 - DNA, 22 bp, Homo sapiens
aaatagttgtttggatcaataa

SEQ ID NO: 8229643 - DNA, 22 bp, Homo sapiens
aaacttctggctacaagcaata

SEQ ID NO: 8229644 - DNA, 22 bp, Homo sapiens
aaacttctggctacaagcaata

SEQ ID NO: 8229645 - DNA, 22 bp, Homo sapiens
aaactttggattgtgattgtgc

SEQ ID NO: 8229646 - DNA, 22 bp, Homo sapiens
aaacttttcctgctcttgtcct

SEQ ID NO: 8229647 - DNA, 22 bp, Homo sapiens
aaacttttcctgctcttgtcct

SEQ ID NO: 8229648 - DNA, 22 bp, Homo sapiens
aaactgtgaagcaagtacaagg

SEQ ID NO: 8229649 - DNA, 22 bp, Homo sapiens
aaatagtcctgggaatagtact

SEQ ID NO: 8229650 - DNA, 20 bp, Homo sapiens
aaactgtctgtcagtatcta

SEQ ID NO: 8229651 - DNA, 22 bp, Homo sapiens
aaactgtcattttatatagtta

SEQ ID NO: 8229652 - DNA, 22 bp, Homo sapiens
aaatagttagccctgcatatat

SEQ ID NO: 8229653 - DNA, 22 bp, Homo sapiens
aaatagttacttctgctgtctt

SEQ ID NO: 8229654 - DNA, 22 bp, Homo sapiens
aaatagttacttctgctgtctt

SEQ ID NO: 8229655 - DNA, 22 bp, Homo sapiens
aaatagttcagcttgtaaaccc

SEQ ID NO: 8229656 - DNA, 22 bp, Homo sapiens
aaatagttcagcttgtaaaccc

SEQ ID NO: 8229657 - DNA, 22 bp, Homo sapiens
aaatagttcagcttgtaaaccc

SEQ ID NO: 8229658 - DNA, 22 bp, Homo sapiens
aaatagttcagcttgtaaaccc

SEQ ID NO: 8229659 - DNA, 22 bp, Homo sapiens
aaatagttgtttggatcaataa

SEQ ID NO: 8229660 - DNA, 22 bp, Homo sapiens
aaatagttcagcttgtaaaccc

SEQ ID NO: 8229661 - DNA, 22 bp, Homo sapiens
aaatagttcagcttgtaaaccc

SEQ ID NO: 8229662 - DNA, 22 bp, Homo sapiens
aaatagttcagccacggtgact

SEQ ID NO: 8229663 - DNA, 22 bp, Homo sapiens
aaatagttcagccacggtgact

SEQ ID NO: 8229664 - DNA, 22 bp, Homo sapiens
aaatagttcagccacggtgact

SEQ ID NO: 8229665 - DNA, 22 bp, Homo sapiens
aaatagttagccctgcatatat

SEQ ID NO: 8229666 - DNA, 22 bp, Homo sapiens
aaatagttagccctgcatatat

SEQ ID NO: 8229667 - DNA, 22 bp, Homo sapiens
aaatagttagccctgcatatat

SEQ ID NO: 8229668 - DNA, 22 bp, Homo sapiens
aaatagttcagccacggtgact

SEQ ID NO: 8229669 - DNA, 22 bp, Homo sapiens
aaagaaatacctttctcagctt

SEQ ID NO: 8229670 - DNA, 22 bp, Homo sapiens
aaagaaatagatggcatttaaa

SEQ ID NO: 8229671 - DNA, 22 bp, Homo sapiens
aaagaaatagatggcatttaaa

SEQ ID NO: 8229672 - DNA, 22 bp, Homo sapiens
aaagaaatagatggcatttaaa

SEQ ID NO: 8229673 - DNA, 22 bp, Homo sapiens
aaagaaatagatggcatttaaa

SEQ ID NO: 8229674 - DNA, 22 bp, Homo sapiens
aaagaacaaattagctgtttta

SEQ ID NO: 8229675 - DNA, 22 bp, Homo sapiens
aaagaacaaattagctgtttta

SEQ ID NO: 8229676 - DNA, 22 bp, Homo sapiens
aaagaaacctatcagccacatg

SEQ ID NO: 8229677 - DNA, 22 bp, Homo sapiens
aaagaaacctatcagccacatg

SEQ ID NO: 8229678 - DNA, 22 bp, Homo sapiens
aaacttttttaggttcataggc

SEQ ID NO: 8229679 - DNA, 22 bp, Homo sapiens
aaactttttattctaatgtcta

SEQ ID NO: 8229680 - DNA, 22 bp, Homo sapiens
aaacttttggtcctcatgggtt

SEQ ID NO: 8229681 - DNA, 22 bp, Homo sapiens
aaagagaaacttagaagcctga

SEQ ID NO: 8229682 - DNA, 22 bp, Homo sapiens
aaagagaaacttagaagcctga

SEQ ID NO: 8229683 - DNA, 22 bp, Homo sapiens
aaagagaaaatgatctgtacat

SEQ ID NO: 8229684 - DNA, 21 bp, Homo sapiens
aaagagacaaatggcatatac

SEQ ID NO: 8229685 - DNA, 20 bp, Homo sapiens
aaagagaagcctcaccttgt

SEQ ID NO: 8229686 - DNA, 22 bp, Homo sapiens
aaagagatgtgccaaatagcct

SEQ ID NO: 8229687 - DNA, 22 bp, Homo sapiens
aaagagatgtgccaaatagcct

SEQ ID NO: 8229688 - DNA, 22 bp, Homo sapiens
aaagagcaagctgagatttgaa

SEQ ID NO: 8229689 - DNA, 22 bp, Homo sapiens
aaagagcaagggctttgaggct

SEQ ID NO: 8229690 - DNA, 22 bp, Homo sapiens
aaagatcagtctgaagcaacat

SEQ ID NO: 8229691 - DNA, 22 bp, Homo sapiens
aaagaacaatgtggaatctcct

SEQ ID NO: 8229692 - DNA, 22 bp, Homo sapiens
aaagacatgacacattggagag

SEQ ID NO: 8229693 - DNA, 22 bp, Homo sapiens
aaagaacagatgtgtggtgcat

SEQ ID NO: 8229694 - DNA, 22 bp, Homo sapiens
aaagactaagaagagtattatt

SEQ ID NO: 8229695 - DNA, 22 bp, Homo sapiens
aaagactagcatttatatgtac

SEQ ID NO: 8229696 - DNA, 23 bp, Homo sapiens
aaagactgaggaaagtctctgtc

SEQ ID NO: 8229697 - DNA, 22 bp, Homo sapiens
aaagactcttaactccctagcg

SEQ ID NO: 8229698 - DNA, 22 bp, Homo sapiens
aaagactttaggttagaggcat

SEQ ID NO: 8229699 - DNA, 22 bp, Homo sapiens
aaagactttcacctagcaaaga

SEQ ID NO: 8229700 - DNA, 22 bp, Homo sapiens
aaagacttgggagcagtatgct

SEQ ID NO: 8229701 - DNA, 21 bp, Homo sapiens
aaagacttgcctgaaagtgag

SEQ ID NO: 8229702 - DNA, 22 bp, Homo sapiens
aaagactggttggggtgggcag

SEQ ID NO: 8229703 - DNA, 21 bp, Homo sapiens
aaagacttgcctgaaagtgag

SEQ ID NO: 8229704 - DNA, 22 bp, Homo sapiens
aaagactgggactgcagcaggc

SEQ ID NO: 8229705 - DNA, 22 bp, Homo sapiens
aaagactgaggggaaagtgatg

SEQ ID NO: 8229706 - DNA, 22 bp, Homo sapiens
aaagactgcaaaaacgcacaga

SEQ ID NO: 8229707 - DNA, 22 bp, Homo sapiens
aaacatgatgtcatatatgcca

SEQ ID NO: 8229708 - DNA, 21 bp, Homo sapiens
aaacatctctgcttttgtgtc

SEQ ID NO: 8229709 - DNA, 21 bp, Homo sapiens
aaacatctctgcttttgtgtc

SEQ ID NO: 8229710 - DNA, 22 bp, Homo sapiens
aaacagctgtcattgttttaaa

SEQ ID NO: 8229711 - DNA, 22 bp, Homo sapiens
aaacagctggtctcaaatgttc

SEQ ID NO: 8229712 - DNA, 22 bp, Homo sapiens
aaacatctcaaagaggtatttg

SEQ ID NO: 8229713 - DNA, 22 bp, Homo sapiens
aaacagctgcagtacacggcct

SEQ ID NO: 8229714 - DNA, 22 bp, Homo sapiens
aaacagctgcactgctgatgtc

SEQ ID NO: 8229715 - DNA, 22 bp, Homo sapiens
aaacagctgggaggtagaggcg

SEQ ID NO: 8229716 - DNA, 22 bp, Homo sapiens
aaacagctccttagtttccatc

SEQ ID NO: 8229717 - DNA, 22 bp, Homo sapiens
aaacagctcaagaagttactct

SEQ ID NO: 8229718 - DNA, 22 bp, Homo sapiens
aaacagctcaagaagttactct

SEQ ID NO: 8229719 - DNA, 22 bp, Homo sapiens
aaacagctcaagaagttactct

SEQ ID NO: 8229720 - DNA, 22 bp, Homo sapiens
aaacagcaggaacatcttgcca

SEQ ID NO: 8229721 - DNA, 22 bp, Homo sapiens
aaacagcaggaacatcttgcca

SEQ ID NO: 8229722 - DNA, 20 bp, Homo sapiens
aaacagctaaaccagctctc

SEQ ID NO: 8229723 - DNA, 22 bp, Homo sapiens
aaacagctaagtacattcaagg

SEQ ID NO: 8229724 - DNA, 22 bp, Homo sapiens
aaacagctaagtacattcaagg

SEQ ID NO: 8229725 - DNA, 22 bp, Homo sapiens
aaacagctacttctgtataatg

SEQ ID NO: 8229726 - DNA, 22 bp, Homo sapiens
aaacagctacttctgtataatg

SEQ ID NO: 8229727 - DNA, 22 bp, Homo sapiens
aaacagctaatggccaggaata

SEQ ID NO: 8229728 - DNA, 22 bp, Homo sapiens
aaacagcagctgtttaatttgc

SEQ ID NO: 8229729 - DNA, 22 bp, Homo sapiens
aaacagcaatggagaagccagg

SEQ ID NO: 8229730 - DNA, 22 bp, Homo sapiens
aaacagatgagttataatagcc

SEQ ID NO: 8229731 - DNA, 22 bp, Homo sapiens
aaacagagtttggtaaatagcc

SEQ ID NO: 8229732 - DNA, 22 bp, Homo sapiens
aaacagataatgctataaatgg

SEQ ID NO: 8229733 - DNA, 22 bp, Homo sapiens
aaacagataatgctataaatgg

SEQ ID NO: 8229734 - DNA, 22 bp, Homo sapiens
aaacactgtgggacatcttact

SEQ ID NO: 8229735 - DNA, 22 bp, Homo sapiens
aaacactgtgggacatcttact

SEQ ID NO: 8229736 - DNA, 22 bp, Homo sapiens
aaagccaggcagccaagccagt

SEQ ID NO: 8229737 - DNA, 22 bp, Homo sapiens
aaagccactgcatgtgtagtat

SEQ ID NO: 8229738 - DNA, 22 bp, Homo sapiens
aaacactgatggatatttttcc

SEQ ID NO: 8229739 - DNA, 22 bp, Homo sapiens
aaacactgatggatatttttcc

SEQ ID NO: 8229740 - DNA, 22 bp, Homo sapiens
aaacactgaagacctatctggt

SEQ ID NO: 8229741 - DNA, 22 bp, Homo sapiens
aaacactgaagacctatctggt

SEQ ID NO: 8229742 - DNA, 22 bp, Homo sapiens
aaacactgaagacctatctggt

SEQ ID NO: 8229743 - DNA, 22 bp, Homo sapiens
aaacactgaaaattttggtcat

SEQ ID NO: 8229744 - DNA, 22 bp, Homo sapiens
aaacactgaaaattttggtcat

SEQ ID NO: 8229745 - DNA, 22 bp, Homo sapiens
aaacactgaaaattttggtcat

SEQ ID NO: 8229746 - DNA, 22 bp, Homo sapiens
aaacactgaagacctatctggt

SEQ ID NO: 8229747 - DNA, 22 bp, Homo sapiens
aaagccagaattcgtccagcct

SEQ ID NO: 8229748 - DNA, 22 bp, Homo sapiens
aaagccagaattcgtccagcct

SEQ ID NO: 8229749 - DNA, 22 bp, Homo sapiens
aaagccagagcaagctgtcaca

SEQ ID NO: 8229750 - DNA, 22 bp, Homo sapiens
aaagccagagcaagctgtcaca

SEQ ID NO: 8229751 - DNA, 22 bp, Homo sapiens
aaagccagagtgtgttagagac

SEQ ID NO: 8229752 - DNA, 22 bp, Homo sapiens
aaagccagcaaggtgagtttca

SEQ ID NO: 8229753 - DNA, 22 bp, Homo sapiens
aaagccagctctgagctgcacc

SEQ ID NO: 8229754 - DNA, 22 bp, Homo sapiens
aaacattgagtgcctttggtat

SEQ ID NO: 8229755 - DNA, 22 bp, Homo sapiens
aaacattgctaaataatgctgc

SEQ ID NO: 8229756 - DNA, 22 bp, Homo sapiens
aaacattgagcacttgctattt

SEQ ID NO: 8229757 - DNA, 22 bp, Homo sapiens
aaactgtaaacacagcagtaca

SEQ ID NO: 8229758 - DNA, 22 bp, Homo sapiens
aaactgcaatgacaggtaggag

SEQ ID NO: 8229759 - DNA, 22 bp, Homo sapiens
aaactgtaagtgcctcaaggtc

SEQ ID NO: 8229760 - DNA, 22 bp, Homo sapiens
aaactgtaagagaataaactac

SEQ ID NO: 8229761 - DNA, 22 bp, Homo sapiens
aaactgtaagagaataaactac

SEQ ID NO: 8229762 - DNA, 22 bp, Homo sapiens
aaactgtagtgcttcgatctga

SEQ ID NO: 8229763 - DNA, 22 bp, Homo sapiens
aaactgtattccatcctcatca

SEQ ID NO: 8229764 - DNA, 22 bp, Homo sapiens
aaactgtcacctaatgtatttt

SEQ ID NO: 8229765 - DNA, 22 bp, Homo sapiens
aaactgtatagggaaaagtaga

SEQ ID NO: 8229766 - DNA, 22 bp, Homo sapiens
aaactgtatatttatggcatgt

SEQ ID NO: 8229767 - DNA, 22 bp, Homo sapiens
aaactgtatatttatggcatgt

SEQ ID NO: 8229768 - DNA, 22 bp, Homo sapiens
aaacatgctggatttagaatat

SEQ ID NO: 8229769 - DNA, 22 bp, Homo sapiens
aaacatgctggatttagaatat

SEQ ID NO: 8229770 - DNA, 22 bp, Homo sapiens
aaacatggccattcagactgtg

SEQ ID NO: 8229771 - DNA, 22 bp, Homo sapiens
aaacatgctggatttagaatat

SEQ ID NO: 8229772 - DNA, 22 bp, Homo sapiens
aaacatgggcttcctgatgcga

SEQ ID NO: 8229773 - DNA, 18 bp, Homo sapiens
aaacatggcttaaaggct

SEQ ID NO: 8229774 - DNA, 22 bp, Homo sapiens
aaacatgcattcaagaaaatct

SEQ ID NO: 8229775 - DNA, 22 bp, Homo sapiens
aaacatgcattcaagaaaatct

SEQ ID NO: 8229776 - DNA, 22 bp, Homo sapiens
aaacatgatgtcatatatgcca

SEQ ID NO: 8229777 - DNA, 23 bp, Homo sapiens
aaacatgcagcacatgaatgcta

SEQ ID NO: 8229778 - DNA, 22 bp, Homo sapiens
aaacatgtaattctgcttaaga

SEQ ID NO: 8229779 - DNA, 22 bp, Homo sapiens
aaacatgtagtgcatgaggatc

SEQ ID NO: 8229780 - DNA, 22 bp, Homo sapiens
aaacatgtttagaaagcagctg

SEQ ID NO: 8229781 - DNA, 22 bp, Homo sapiens
aaacatgtaagttcagatcacc

SEQ ID NO: 8229782 - DNA, 22 bp, Homo sapiens
aaacatgggcttcctgatgcga

SEQ ID NO: 8229783 - DNA, 22 bp, Homo sapiens
aaacatgtaattctgcttaaga

SEQ ID NO: 8229784 - DNA, 20 bp, Homo sapiens
aaacattcatgtacaagtga

SEQ ID NO: 8229785 - DNA, 20 bp, Homo sapiens
aaacattcatgtacaagtga

SEQ ID NO: 8229786 - DNA, 22 bp, Homo sapiens
aaacattcactctcaattttag

SEQ ID NO: 8229787 - DNA, 20 bp, Homo sapiens
aaacattcatgtacaagtga

SEQ ID NO: 8229788 - DNA, 22 bp, Homo sapiens
aaacattagacaccatatgctc

SEQ ID NO: 8229789 - DNA, 22 bp, Homo sapiens
aaacattagacaccatatgctc

SEQ ID NO: 8229790 - DNA, 22 bp, Homo sapiens
aaacattagacaccatatgctc

SEQ ID NO: 8229791 - DNA, 22 bp, Homo sapiens
aaacatgttttctgaatatttt

SEQ ID NO: 8229792 - DNA, 22 bp, Homo sapiens
aaacattagacaccatatgctc

SEQ ID NO: 8229793 - DNA, 22 bp, Homo sapiens
aaaattcatagaactgtacgct

SEQ ID NO: 8229794 - DNA, 22 bp, Homo sapiens
aaaattcatggcttgggaaaag

SEQ ID NO: 8229795 - DNA, 22 bp, Homo sapiens
aaaattatggagtatcccaaag

SEQ ID NO: 8229796 - DNA, 22 bp, Homo sapiens
aaaattaagtgtctgggaagcc

SEQ ID NO: 8229797 - DNA, 22 bp, Homo sapiens
aaaattatggagtatcccaaag

SEQ ID NO: 8229798 - DNA, 22 bp, Homo sapiens
aaaattatggagtatcccaaag

SEQ ID NO: 8229799 - DNA, 22 bp, Homo sapiens
aaaactgaggtttcctgaagaa

SEQ ID NO: 8229800 - DNA, 22 bp, Homo sapiens
aaaactgaaccttgagatcttt

SEQ ID NO: 8229801 - DNA, 22 bp, Homo sapiens
aaaactgaaccttgagatcttt

SEQ ID NO: 8229802 - DNA, 22 bp, Homo sapiens
aaaactgaggtttcctgaagaa

SEQ ID NO: 8229803 - DNA, 22 bp, Homo sapiens
aaaacttagctaggcaagtttt

SEQ ID NO: 8229804 - DNA, 22 bp, Homo sapiens
aaaactgtatcttcttgggact

SEQ ID NO: 8229805 - DNA, 22 bp, Homo sapiens
aaaaggttttgagtacaaatat

SEQ ID NO: 8229806 - DNA, 22 bp, Homo sapiens
aaaaggaggacatggttacaga

SEQ ID NO: 8229807 - DNA, 22 bp, Homo sapiens
aaaaggaggacatggttacaga

SEQ ID NO: 8229808 - DNA, 19 bp, Homo sapiens
aaaaggagagatcagagtt

SEQ ID NO: 8229809 - DNA, 19 bp, Homo sapiens
aaaaggagagatcagagtt

SEQ ID NO: 8229810 - DNA, 22 bp, Homo sapiens
aaaaggtagttgccaaataagg

SEQ ID NO: 8229811 - DNA, 22 bp, Homo sapiens
aaaaggtagattctccttctat

SEQ ID NO: 8229812 - DNA, 22 bp, Homo sapiens
aaaaggtagattctccttctat

SEQ ID NO: 8229813 - DNA, 22 bp, Homo sapiens
aaaagtaattgcagttttcgcc

SEQ ID NO: 8229814 - DNA, 22 bp, Homo sapiens
aaaagtaattgcaattttgtag

SEQ ID NO: 8229815 - DNA, 22 bp, Homo sapiens
aaaagtaattgcagttttgcca

SEQ ID NO: 8229816 - DNA, 22 bp, Homo sapiens
aaaagtaattgcagttttgtca

SEQ ID NO: 8229817 - DNA, 22 bp, Homo sapiens
aaacagcttgtttcaggaaagt

SEQ ID NO: 8229818 - DNA, 22 bp, Homo sapiens
aaacagcttgtttcaggaaagt

SEQ ID NO: 8229819 - DNA, 22 bp, Homo sapiens
aaacagctttcagaatctctca

SEQ ID NO: 8229820 - DNA, 22 bp, Homo sapiens
aaacagctttcagaatctctca

SEQ ID NO: 8229821 - DNA, 22 bp, Homo sapiens
aaaactgaaccttgagatcttt

SEQ ID NO: 8229822 - DNA, 22 bp, Homo sapiens
aaaactcaaacattttggcata

SEQ ID NO: 8229823 - DNA, 22 bp, Homo sapiens
aaaactctgcagttagtttcta

SEQ ID NO: 8229824 - DNA, 22 bp, Homo sapiens
aaaaccaggcttgctgtgctcg

SEQ ID NO: 8229825 - DNA, 22 bp, Homo sapiens
aaaaccaggtagcaaaggagac

SEQ ID NO: 8229826 - DNA, 22 bp, Homo sapiens
aaaacataaactgacagcccat

SEQ ID NO: 8229827 - DNA, 22 bp, Homo sapiens
aaaacctgattgaattctattt

SEQ ID NO: 8229828 - DNA, 22 bp, Homo sapiens
aaaaggcagtgcaagagagggt

SEQ ID NO: 8229829 - DNA, 22 bp, Homo sapiens
aaaaggcagtgcaagagagggt

SEQ ID NO: 8229830 - DNA, 22 bp, Homo sapiens
aaaaggcatggaggttgatagt

SEQ ID NO: 8229831 - DNA, 22 bp, Homo sapiens
aaaaggcatggaggttgatagt

SEQ ID NO: 8229832 - DNA, 22 bp, Homo sapiens
aaaaggcagtgcaagagagggt

SEQ ID NO: 8229833 - DNA, 22 bp, Homo sapiens
aaaaggatgttttcatgaaaca

SEQ ID NO: 8229834 - DNA, 22 bp, Homo sapiens
aaaaggctaatccagagcaact

SEQ ID NO: 8229835 - DNA, 22 bp, Homo sapiens
aaaaggctaattaagttttgga

SEQ ID NO: 8229836 - DNA, 22 bp, Homo sapiens
aaaaggctcttcaaaatggaag

SEQ ID NO: 8229837 - DNA, 22 bp, Homo sapiens
aaaacagtttttgctaactgct

SEQ ID NO: 8229838 - DNA, 22 bp, Homo sapiens
aaaaatacttcacttctgggtg

SEQ ID NO: 8229839 - DNA, 22 bp, Homo sapiens
aaaaagtttcaactgccaactc

SEQ ID NO: 8229840 - DNA, 22 bp, Homo sapiens
aaaaggatcagattttgagcag

SEQ ID NO: 8229841 - DNA, 22 bp, Homo sapiens
aaaaggaggtcactttattcct

SEQ ID NO: 8229842 - DNA, 22 bp, Homo sapiens
aaaaggaggtcactttattcct

SEQ ID NO: 8229843 - DNA, 22 bp, Homo sapiens
aaaaggaggcaaacagcctaga

SEQ ID NO: 8229844 - DNA, 22 bp, Homo sapiens
aaaaatacttcacttctgggtg

SEQ ID NO: 8229845 - DNA, 22 bp, Homo sapiens
aaaaagggatttgtgatccagg

SEQ ID NO: 8229846 - DNA, 21 bp, Homo sapiens
aaaaagctggggcatgcatgc

SEQ ID NO: 8229847 - DNA, 22 bp, Homo sapiens
aaaaagcttaaatgagcagttc

SEQ ID NO: 8229848 - DNA, 22 bp, Homo sapiens
aaaaactgcaattacttttgtc

SEQ ID NO: 8229849 - DNA, 22 bp, Homo sapiens
aaaattgagagttatagatggt

SEQ ID NO: 8229850 - DNA, 19 bp, Homo sapiens
aaaattgcgtattttgagg

SEQ ID NO: 8229851 - DNA, 22 bp, Homo sapiens
aaaattgaggctcatgttaaat

SEQ ID NO: 8229852 - DNA, 22 bp, Homo sapiens
aaagagccgctgatgtcagccc

SEQ ID NO: 8229853 - DNA, 22 bp, Homo sapiens
aaagagcctatattcagctgca

SEQ ID NO: 8229854 - DNA, 22 bp, Homo sapiens
aaagagctatacaaccatgtcc

SEQ ID NO: 8229855 - DNA, 22 bp, Homo sapiens
aaagagctaacattgccgagat

SEQ ID NO: 8229856 - DNA, 21 bp, Homo sapiens
aaagagcccgctgagaggttc

SEQ ID NO: 8229857 - DNA, 22 bp, Homo sapiens
aaagagcccttccatgactctt

SEQ ID NO: 8229858 - DNA, 22 bp, Homo sapiens
aaagagccagggcattaggtga

SEQ ID NO: 8229859 - DNA, 22 bp, Homo sapiens
aaagagccagggcattaggtga

SEQ ID NO: 8229860 - DNA, 22 bp, Homo sapiens
aaagagcatggaaagttcagga

SEQ ID NO: 8229861 - DNA, 22 bp, Homo sapiens
aaagagccagctacctcagttt

SEQ ID NO: 8229862 - DNA, 18 bp, Homo sapiens
aaagagccacccagggcc

SEQ ID NO: 8229863 - DNA, 22 bp, Homo sapiens
aaaattgagagtcttgtgcaag

SEQ ID NO: 8229864 - DNA, 22 bp, Homo sapiens
aaaattgaagtgatcaggaact

SEQ ID NO: 8229865 - DNA, 22 bp, Homo sapiens
aaaattgaagtgatcaggaact

SEQ ID NO: 8229866 - DNA, 17 bp, Homo sapiens
aaaattctgtaaagagg

SEQ ID NO: 8229867 - DNA, 17 bp, Homo sapiens
aaaattctgtaaagagg

SEQ ID NO: 8229868 - DNA, 17 bp, Homo sapiens
aaaattctgtaaagagg

SEQ ID NO: 8229869 - DNA, 22 bp, Homo sapiens
aaaattctaacatgcagccaag

SEQ ID NO: 8229870 - DNA, 22 bp, Homo sapiens
aaaattctcttgatcttgacag

SEQ ID NO: 8229871 - DNA, 22 bp, Homo sapiens
aaaattctcttgatcttgacag

SEQ ID NO: 8229872 - DNA, 22 bp, Homo sapiens
aaaattctcttgatcttgacag

SEQ ID NO: 8229873 - DNA, 22 bp, Homo sapiens
aaaattcattcctcagactgcc

SEQ ID NO: 8229874 - DNA, 22 bp, Homo sapiens
aaagagctgggacttaaagtgc

SEQ ID NO: 8229875 - DNA, 22 bp, Homo sapiens
aaagagctgatagcatctgttt

SEQ ID NO: 8229876 - DNA, 22 bp, Homo sapiens
aaagagctcttactctagtgta

SEQ ID NO: 8229877 - DNA, 22 bp, Homo sapiens
aaagagctcttactctagtgta

SEQ ID NO: 8229878 - DNA, 22 bp, Homo sapiens
aaagagctggcatttatagtct

SEQ ID NO: 8229879 - DNA, 22 bp, Homo sapiens
aaacacaagaggcagggtacag

SEQ ID NO: 8229880 - DNA, 22 bp, Homo sapiens
aaacaccaagagctagctatta

SEQ ID NO: 8229881 - DNA, 22 bp, Homo sapiens
aaacacattttaggaaaatcta

SEQ ID NO: 8229882 - DNA, 22 bp, Homo sapiens
aaacaccaagagctagctatta

SEQ ID NO: 8229883 - DNA, 22 bp, Homo sapiens
aaacaccagtcccagtatacac

SEQ ID NO: 8229884 - DNA, 22 bp, Homo sapiens
aaacactaataacagtggctgg

SEQ ID NO: 8229885 - DNA, 22 bp, Homo sapiens
aaacactcatgtgttactctcc

SEQ ID NO: 8229886 - DNA, 22 bp, Homo sapiens
aaactggtaatcggcaagtgag

SEQ ID NO: 8229887 - DNA, 17 bp, Homo sapiens
aaactggggtcaggagc

SEQ ID NO: 8229888 - DNA, 22 bp, Homo sapiens
aaactggattaccaggctggtg

SEQ ID NO: 8229889 - DNA, 22 bp, Homo sapiens
aaactgctttccacagtggcta

SEQ ID NO: 8229890 - DNA, 18 bp, Homo sapiens
aaactggcttggcctgtg

SEQ ID NO: 8229891 - DNA, 22 bp, Homo sapiens
aaactgcatgaagctgatttta

SEQ ID NO: 8229892 - DNA, 22 bp, Homo sapiens
aaactgctggttgctggccagc

SEQ ID NO: 8229893 - DNA, 23 bp, Homo sapiens
aaactgcttccaattcctgccat

SEQ ID NO: 8229894 - DNA, 22 bp, Homo sapiens
aaactgcatgaagctgatttta

SEQ ID NO: 8229895 - DNA, 22 bp, Homo sapiens
aaactgcagagccatggttcaa

SEQ ID NO: 8229896 - DNA, 20 bp, Homo sapiens
aaaatatgtataactcttct

SEQ ID NO: 8229897 - DNA, 22 bp, Homo sapiens
aaaatatgtataactcttctgc

SEQ ID NO: 8229898 - DNA, 22 bp, Homo sapiens
aaaatatgtataactcttctgc

SEQ ID NO: 8229899 - DNA, 22 bp, Homo sapiens
aaaatatgtataactcttctgc

SEQ ID NO: 8229900 - DNA, 22 bp, Homo sapiens
aaaatatgtataactcttctgc

SEQ ID NO: 8229901 - DNA, 22 bp, Homo sapiens
aaaatattttagggccaggaga

SEQ ID NO: 8229902 - DNA, 22 bp, Homo sapiens
aaaatattttagggccaggaga

SEQ ID NO: 8229903 - DNA, 22 bp, Homo sapiens
aaaatattttagggccaggaga

SEQ ID NO: 8229904 - DNA, 22 bp, Homo sapiens
aaaatattttagggccaggaga

SEQ ID NO: 8229905 - DNA, 22 bp, Homo sapiens
aaaatattttagggccaggaga

SEQ ID NO: 8229906 - DNA, 22 bp, Homo sapiens
aaaatattttagggccaggaga

SEQ ID NO: 8229907 - DNA, 22 bp, Homo sapiens
aaaatattttagggccaggaga

SEQ ID NO: 8229908 - DNA, 22 bp, Homo sapiens
aaaatattttagggccaggaga

SEQ ID NO: 8229909 - DNA, 22 bp, Homo sapiens
aaaatattttagggccaggaga

SEQ ID NO: 8229910 - DNA, 22 bp, Homo sapiens
aaaatattttagggccaggaga

SEQ ID NO: 8229911 - DNA, 22 bp, Homo sapiens
aaactgcacacgatgtgcctga

SEQ ID NO: 8229912 - DNA, 22 bp, Homo sapiens
aaacagtattatcaatatattt

SEQ ID NO: 8229913 - DNA, 20 bp, Homo sapiens
aaaatatgtataactcttct

SEQ ID NO: 8229914 - DNA, 20 bp, Homo sapiens
aaaatatgtataactcttct

SEQ ID NO: 8229915 - DNA, 22 bp, Homo sapiens
aaaatatgaagttgtcagtatg

SEQ ID NO: 8229916 - DNA, 22 bp, Homo sapiens
aaaatactgtggagtgttgaaa

SEQ ID NO: 8229917 - DNA, 22 bp, Homo sapiens
aaacagtattatcaatatattt

SEQ ID NO: 8229918 - DNA, 22 bp, Homo sapiens
agcagatgagcctcatgactgg

SEQ ID NO: 8229919 - DNA, 22 bp, Homo sapiens
agcagatgagcctcatgactgg

SEQ ID NO: 8229920 - DNA, 22 bp, Homo sapiens
agcagatatttgttgagcactt

SEQ ID NO: 8229921 - DNA, 22 bp, Homo sapiens
agcagatgaatcccagataaag

SEQ ID NO: 8229922 - DNA, 22 bp, Homo sapiens
agcagatatgatacttaattta

SEQ ID NO: 8229923 - DNA, 18 bp, Homo sapiens
agcagagcccatgcattc

SEQ ID NO: 8229924 - DNA, 19 bp, Homo sapiens
agcagagccctgaagatcc

SEQ ID NO: 8229925 - DNA, 19 bp, Homo sapiens
agcagagccctgaagatcc

SEQ ID NO: 8229926 - DNA, 22 bp, Homo sapiens
agcagagccaggtctctctgta

SEQ ID NO: 8229927 - DNA, 18 bp, Homo sapiens
agcagagcccatgcattc

SEQ ID NO: 8229928 - DNA, 18 bp, Homo sapiens
agcagagcccatgcattc

SEQ ID NO: 8229929 - DNA, 19 bp, Homo sapiens
agcagagccctgaagatcc

SEQ ID NO: 8229930 - DNA, 22 bp, Homo sapiens
agcagagcccttccatggcctt

SEQ ID NO: 8229931 - DNA, 22 bp, Homo sapiens
agcagatgtttcagagcaggct

SEQ ID NO: 8229932 - DNA, 22 bp, Homo sapiens
acacagaagatctcttaatgct

SEQ ID NO: 8229933 - DNA, 22 bp, Homo sapiens
agcagatgagcctcatgactgg

SEQ ID NO: 8229934 - DNA, 22 bp, Homo sapiens
agcagatggtgtcatgggatgg

SEQ ID NO: 8229935 - DNA, 22 bp, Homo sapiens
agcagatgtttcagagcaggct

SEQ ID NO: 8229936 - DNA, 22 bp, Homo sapiens
agcagatgtgtctctgcactgt

SEQ ID NO: 8229937 - DNA, 22 bp, Homo sapiens
acaatgctcatatttatgccaa

SEQ ID NO: 8229938 - DNA, 22 bp, Homo sapiens
acaatgctgcagggaaattagg

SEQ ID NO: 8229939 - DNA, 21 bp, Homo sapiens
acaatgcatggaactcatggc

SEQ ID NO: 8229940 - DNA, 22 bp, Homo sapiens
agcagaacctgcagacctgtct

SEQ ID NO: 8229941 - DNA, 22 bp, Homo sapiens
agcagaactgatgagacttgag

SEQ ID NO: 8229942 - DNA, 22 bp, Homo sapiens
acaatgcacctattttaaaact

SEQ ID NO: 8229943 - DNA, 22 bp, Homo sapiens
acaatgcacctattttaaaact

SEQ ID NO: 8229944 - DNA, 22 bp, Homo sapiens
acaatgcaccagcatcttcacc

SEQ ID NO: 8229945 - DNA, 22 bp, Homo sapiens
agcagagcagaatgtgaaggtg

SEQ ID NO: 8229946 - DNA, 19 bp, Homo sapiens
agcagagcaaagtggctga

SEQ ID NO: 8229947 - DNA, 18 bp, Homo sapiens
agcagagagtgaatggga

SEQ ID NO: 8229948 - DNA, 22 bp, Homo sapiens
agcagagccagaattggaccag

SEQ ID NO: 8229949 - DNA, 22 bp, Homo sapiens
agcagagccaggtctctctgta

SEQ ID NO: 8229950 - DNA, 21 bp, Homo sapiens
agcagagccaccattacctgc

SEQ ID NO: 8229951 - DNA, 22 bp, Homo sapiens
agcagagccagaattggaccag

SEQ ID NO: 8229952 - DNA, 19 bp, Homo sapiens
agcagagcagggccgtggg

SEQ ID NO: 8229953 - DNA, 22 bp, Homo sapiens
agcagagcatgctaagtgactc

SEQ ID NO: 8229954 - DNA, 22 bp, Homo sapiens
agcagagcatggtgggaagggc

SEQ ID NO: 8229955 - DNA, 22 bp, Homo sapiens
agcagctgggtccggcggagca

SEQ ID NO: 8229956 - DNA, 22 bp, Homo sapiens
agcagctgggtccggcggagca

SEQ ID NO: 8229957 - DNA, 22 bp, Homo sapiens
agcagctgggtccggcggagca

SEQ ID NO: 8229958 - DNA, 23 bp, Homo sapiens
agcagctggggtgctcttttgtc

SEQ ID NO: 8229959 - DNA, 17 bp, Homo sapiens
agcagctgggttgatct

SEQ ID NO: 8229960 - DNA, 17 bp, Homo sapiens
agcagctgggttgatct

SEQ ID NO: 8229961 - DNA, 22 bp, Homo sapiens
agcagctggtaggagtggccac

SEQ ID NO: 8229962 - DNA, 22 bp, Homo sapiens
agcagctggtaggagtggccac

SEQ ID NO: 8229963 - DNA, 22 bp, Homo sapiens
agcagctggtaggagtggccac

SEQ ID NO: 8229964 - DNA, 22 bp, Homo sapiens
agcagctggtaggagtggccac

SEQ ID NO: 8229965 - DNA, 22 bp, Homo sapiens
agcagctggtaggagtggccac

SEQ ID NO: 8229966 - DNA, 22 bp, Homo sapiens
agcagctggtgagcaagctcag

SEQ ID NO: 8229967 - DNA, 22 bp, Homo sapiens
agcagctggtgagcaagctcag

SEQ ID NO: 8229968 - DNA, 22 bp, Homo sapiens
agcagctggtgcaactctaaga

SEQ ID NO: 8229969 - DNA, 22 bp, Homo sapiens
agcagctggtgagcaagctcag

SEQ ID NO: 8229970 - DNA, 22 bp, Homo sapiens
acacagatgctatttagtctct

SEQ ID NO: 8229971 - DNA, 22 bp, Homo sapiens
agcagctgagccccagctgtga

SEQ ID NO: 8229972 - DNA, 22 bp, Homo sapiens
agcagctgagccccagctgtga

SEQ ID NO: 8229973 - DNA, 22 bp, Homo sapiens
agcagctgagccccagctgtga

SEQ ID NO: 8229974 - DNA, 22 bp, Homo sapiens
agcagctggggcctgtgacgat

SEQ ID NO: 8229975 - DNA, 22 bp, Homo sapiens
agcagctggggcctgtgacgat

SEQ ID NO: 8229976 - DNA, 22 bp, Homo sapiens
agcagctgagccccagctgtga

SEQ ID NO: 8229977 - DNA, 22 bp, Homo sapiens
agcagctgggctcagagctggg

SEQ ID NO: 8229978 - DNA, 22 bp, Homo sapiens
acacagataatgctcatatagg

SEQ ID NO: 8229979 - DNA, 22 bp, Homo sapiens
acacagatattgtacttgatcc

SEQ ID NO: 8229980 - DNA, 22 bp, Homo sapiens
acacagatattttgaatacata

SEQ ID NO: 8229981 - DNA, 22 bp, Homo sapiens
acacagatgcattacacatcta

SEQ ID NO: 8229982 - DNA, 22 bp, Homo sapiens
acacagatgcattacacatcta

SEQ ID NO: 8229983 - DNA, 22 bp, Homo sapiens
acacagatgatgttccaggaac

SEQ ID NO: 8229984 - DNA, 22 bp, Homo sapiens
acacagatattttgaatacata

SEQ ID NO: 8229985 - DNA, 22 bp, Homo sapiens
acacagaggctccagagataga

SEQ ID NO: 8229986 - DNA, 21 bp, Homo sapiens
acacagaggcatcatcacttt

SEQ ID NO: 8229987 - DNA, 22 bp, Homo sapiens
acacagagttattatgtgaact

SEQ ID NO: 8229988 - DNA, 22 bp, Homo sapiens
acacagagtttgacacatggga

SEQ ID NO: 8229989 - DNA, 22 bp, Homo sapiens
acacagagtttgacacatggga

SEQ ID NO: 8229990 - DNA, 22 bp, Homo sapiens
acacagagtatttagaaggggt

SEQ ID NO: 8229991 - DNA, 20 bp, Homo sapiens
acacagagtgagtctgcttg

SEQ ID NO: 8229992 - DNA, 22 bp, Homo sapiens
acacagagtccttactgaggta

SEQ ID NO: 8229993 - DNA, 20 bp, Homo sapiens
acacatgtcaagctaaaggc

SEQ ID NO: 8229994 - DNA, 20 bp, Homo sapiens
acacatgtcaagctaaaggc

SEQ ID NO: 8229995 - DNA, 22 bp, Homo sapiens
acacatgtatgttttgtatttg

SEQ ID NO: 8229996 - DNA, 22 bp, Homo sapiens
acacatgtatgttttgtatttg

SEQ ID NO: 8229997 - DNA, 22 bp, Homo sapiens
acacatgtgattctaagacagc

SEQ ID NO: 8229998 - DNA, 20 bp, Homo sapiens
acacatgtgcgtgttcagta

SEQ ID NO: 8229999 - DNA, 22 bp, Homo sapiens
acacatgtgattctaagacagc

SEQ ID NO: 8230000 - DNA, 22 bp, Homo sapiens
acacatgtgattctaagacagc

SEQ ID NO: 8230001 - DNA, 22 bp, Homo sapiens
acacatgtacagattagtattt

SEQ ID NO: 8230002 - DNA, 19 bp, Homo sapiens
acacatgtaacagtttttc

SEQ ID NO: 8230003 - DNA, 22 bp, Homo sapiens
acacatgtacagattagtattt

SEQ ID NO: 8230004 - DNA, 22 bp, Homo sapiens
acacatgtacagattagtattt

SEQ ID NO: 8230005 - DNA, 22 bp, Homo sapiens
acacatgtatggcacttacatt

SEQ ID NO: 8230006 - DNA, 22 bp, Homo sapiens
acacatgtatggcacttacatt

SEQ ID NO: 8230007 - DNA, 22 bp, Homo sapiens
acacatgtatatgcttgtgtgt

SEQ ID NO: 8230008 - DNA, 22 bp, Homo sapiens
acacattaacctttgaaattct

SEQ ID NO: 8230009 - DNA, 22 bp, Homo sapiens
acacattaaaacgtctacaatg

SEQ ID NO: 8230010 - DNA, 22 bp, Homo sapiens
acacattaaaacgtctacaatg

SEQ ID NO: 8230011 - DNA, 22 bp, Homo sapiens
acacatgtttccaaaagcaccc

SEQ ID NO: 8230012 - DNA, 22 bp, Homo sapiens
acacatgtttccaaaagcaccc

SEQ ID NO: 8230013 - DNA, 22 bp, Homo sapiens
acacatgtttgtgtagtcagtt

SEQ ID NO: 8230014 - DNA, 22 bp, Homo sapiens
acacatgtttgtgtagtcagtt

SEQ ID NO: 8230015 - DNA, 22 bp, Homo sapiens
acacatgtgtctgcatgcagtg

SEQ ID NO: 8230016 - DNA, 20 bp, Homo sapiens
acacatgtgcgtgttcagta

SEQ ID NO: 8230017 - DNA, 22 bp, Homo sapiens
acacatgtgtctgcatgcagtg

SEQ ID NO: 8230018 - DNA, 22 bp, Homo sapiens
acacatgtgtctgcatgcagtg

SEQ ID NO: 8230019 - DNA, 22 bp, Homo sapiens
acacatgtgtctgcatgcagtg

SEQ ID NO: 8230020 - DNA, 22 bp, Homo sapiens
acacatgtttacagtcttcagt

SEQ ID NO: 8230021 - DNA, 22 bp, Homo sapiens
acacatgtttacagtcttcagt

SEQ ID NO: 8230022 - DNA, 22 bp, Homo sapiens
acacatgtttacagtcttcagt

SEQ ID NO: 8230023 - DNA, 22 bp, Homo sapiens
acacatgttcaagaatgttcag

SEQ ID NO: 8230024 - DNA, 22 bp, Homo sapiens
acacatgttcaagaatgttcag

SEQ ID NO: 8230025 - DNA, 19 bp, Homo sapiens
acacatgtgtgttatgtgc

SEQ ID NO: 8230026 - DNA, 17 bp, Homo sapiens
acacagggagagggagc

SEQ ID NO: 8230027 - DNA, 17 bp, Homo sapiens
acacagggagagggagc

SEQ ID NO: 8230028 - DNA, 22 bp, Homo sapiens
acacagggaggaggtgctgtgc

SEQ ID NO: 8230029 - DNA, 22 bp, Homo sapiens
acacagggatatttcaggtggt

SEQ ID NO: 8230030 - DNA, 22 bp, Homo sapiens
acacagggatatttcaggtggt

SEQ ID NO: 8230031 - DNA, 18 bp, Homo sapiens
acacaggctgacagcacc

SEQ ID NO: 8230032 - DNA, 18 bp, Homo sapiens
acacaggctgacagcacc

SEQ ID NO: 8230033 - DNA, 18 bp, Homo sapiens
acacaggctgacagcacc

SEQ ID NO: 8230034 - DNA, 22 bp, Homo sapiens
agcagctgtactttcatctgtt

SEQ ID NO: 8230035 - DNA, 22 bp, Homo sapiens
agcagctggttcccgagggcgt

SEQ ID NO: 8230036 - DNA, 22 bp, Homo sapiens
agcagctggttcccgagggcgt

SEQ ID NO: 8230037 - DNA, 22 bp, Homo sapiens
agcagctggttcccgagggcgt

SEQ ID NO: 8230038 - DNA, 22 bp, Homo sapiens
acacagggcaatgctttgacct

SEQ ID NO: 8230039 - DNA, 19 bp, Homo sapiens
acacagggatcagagggtt

SEQ ID NO: 8230040 - DNA, 22 bp, Homo sapiens
acacagggcggaaagcatgaga

SEQ ID NO: 8230041 - DNA, 22 bp, Homo sapiens
acacagggcagagagctggctc

SEQ ID NO: 8230042 - DNA, 22 bp, Homo sapiens
acacatggtggctggactatag

SEQ ID NO: 8230043 - DNA, 22 bp, Homo sapiens
acacatggtggctggactatag

SEQ ID NO: 8230044 - DNA, 22 bp, Homo sapiens
acacatgtaaaacacttagcaa

SEQ ID NO: 8230045 - DNA, 22 bp, Homo sapiens
acacatgtaaaacacttagcaa

SEQ ID NO: 8230046 - DNA, 22 bp, Homo sapiens
acacatgggtggggagctaagt

SEQ ID NO: 8230047 - DNA, 22 bp, Homo sapiens
acacatctgcaagagccagacc

SEQ ID NO: 8230048 - DNA, 22 bp, Homo sapiens
acacatctccagccagcaggag

SEQ ID NO: 8230049 - DNA, 22 bp, Homo sapiens
acacatctctctttgaggagtg

SEQ ID NO: 8230050 - DNA, 22 bp, Homo sapiens
acacatctgcaagagccagacc

SEQ ID NO: 8230051 - DNA, 22 bp, Homo sapiens
acacatcttagactgaaatatg

SEQ ID NO: 8230052 - DNA, 22 bp, Homo sapiens
acacatcttagactgaaatatg

SEQ ID NO: 8230053 - DNA, 22 bp, Homo sapiens
acactgagccatacaactggaa

SEQ ID NO: 8230054 - DNA, 22 bp, Homo sapiens
acactgagctgagcattcttgt

SEQ ID NO: 8230055 - DNA, 22 bp, Homo sapiens
acactgagattttcctgacacc

SEQ ID NO: 8230056 - DNA, 22 bp, Homo sapiens
acactgacgcttgacagtcacc

SEQ ID NO: 8230057 - DNA, 22 bp, Homo sapiens
acactgaatgtttaagaacttg

SEQ ID NO: 8230058 - DNA, 22 bp, Homo sapiens
acactgaatgtttaagaacttg

SEQ ID NO: 8230059 - DNA, 22 bp, Homo sapiens
acactgaatgtttaagaacttg

SEQ ID NO: 8230060 - DNA, 22 bp, Homo sapiens
acactgaatcagaaattgttgg

SEQ ID NO: 8230061 - DNA, 22 bp, Homo sapiens
acactttacagaatgttttgat

SEQ ID NO: 8230062 - DNA, 22 bp, Homo sapiens
acacttcagcagtatgcttggg

SEQ ID NO: 8230063 - DNA, 22 bp, Homo sapiens
acactttactcttacaccattg

SEQ ID NO: 8230064 - DNA, 22 bp, Homo sapiens
acactttagaaaaaagaatggt

SEQ ID NO: 8230065 - DNA, 22 bp, Homo sapiens
acactttagaaaaaagaatggt

SEQ ID NO: 8230066 - DNA, 22 bp, Homo sapiens
acactttagtatgaagaggtag

SEQ ID NO: 8230067 - DNA, 22 bp, Homo sapiens
acactttagaaaaaagaatggt

SEQ ID NO: 8230068 - DNA, 22 bp, Homo sapiens
acactttactcttacaccattg

SEQ ID NO: 8230069 - DNA, 22 bp, Homo sapiens
acactttagaaaaaagaatggt

SEQ ID NO: 8230070 - DNA, 22 bp, Homo sapiens
acactgcagatgaaagcataag

SEQ ID NO: 8230071 - DNA, 22 bp, Homo sapiens
acactgattgtagtctgtggtg

SEQ ID NO: 8230072 - DNA, 22 bp, Homo sapiens
acactgagttttaccaggcaca

SEQ ID NO: 8230073 - DNA, 22 bp, Homo sapiens
acactgagtgagaaaaggaaat

SEQ ID NO: 8230074 - DNA, 22 bp, Homo sapiens
acactgaatatacaatgaatat

SEQ ID NO: 8230075 - DNA, 22 bp, Homo sapiens
acactctttctgtgggtcacat

SEQ ID NO: 8230076 - DNA, 22 bp, Homo sapiens
acactgaagagcactttcaaag

SEQ ID NO: 8230077 - DNA, 22 bp, Homo sapiens
acactgaagagcactttcaaag

SEQ ID NO: 8230078 - DNA, 22 bp, Homo sapiens
acactccagggagggagggaat

SEQ ID NO: 8230079 - DNA, 22 bp, Homo sapiens
acactatacttccattgctggt

SEQ ID NO: 8230080 - DNA, 22 bp, Homo sapiens
acacattatagagagtataata

SEQ ID NO: 8230081 - DNA, 22 bp, Homo sapiens
acacattaggcagtgcttaaat

SEQ ID NO: 8230082 - DNA, 22 bp, Homo sapiens
acacattataggcaatcaaaag

SEQ ID NO: 8230083 - DNA, 22 bp, Homo sapiens
acacattataggcaatcaaaag

SEQ ID NO: 8230084 - DNA, 22 bp, Homo sapiens
acactagctattaacttcacat

SEQ ID NO: 8230085 - DNA, 22 bp, Homo sapiens
acactataagacagatacagca

SEQ ID NO: 8230086 - DNA, 22 bp, Homo sapiens
acacccaggctggcgtgcagtg

SEQ ID NO: 8230087 - DNA, 22 bp, Homo sapiens
acacccaggctggcgtgcagtg

SEQ ID NO: 8230088 - DNA, 22 bp, Homo sapiens
acagagacacggaagctaaaga

SEQ ID NO: 8230089 - DNA, 23 bp, Homo sapiens
acagagacaatggtttcatcttg

SEQ ID NO: 8230090 - DNA, 22 bp, Homo sapiens
acagagacaaatgttagtagtt

SEQ ID NO: 8230091 - DNA, 22 bp, Homo sapiens
acagagacaatatttgtaaagt

SEQ ID NO: 8230092 - DNA, 22 bp, Homo sapiens
acagagacaggcagacagtctt

SEQ ID NO: 8230093 - DNA, 22 bp, Homo sapiens
acagagacaggcagacagtctt

SEQ ID NO: 8230094 - DNA, 22 bp, Homo sapiens
acagagaccagcatcttctgcc

SEQ ID NO: 8230095 - DNA, 22 bp, Homo sapiens
acagagaccagttacagcgtcc

SEQ ID NO: 8230096 - DNA, 22 bp, Homo sapiens
acagagaccagttacagcgtcc

SEQ ID NO: 8230097 - DNA, 22 bp, Homo sapiens
acagagactaagcttttcatca

SEQ ID NO: 8230098 - DNA, 22 bp, Homo sapiens
acagagacctggccttgctttg

SEQ ID NO: 8230099 - DNA, 23 bp, Homo sapiens
acagagactgccaagatattctc

SEQ ID NO: 8230100 - DNA, 20 bp, Homo sapiens
acagagactgagacacttgc

SEQ ID NO: 8230101 - DNA, 22 bp, Homo sapiens
acagagactcatgaaagatgac

SEQ ID NO: 8230102 - DNA, 22 bp, Homo sapiens
acagagactgggatgcctgcct

SEQ ID NO: 8230103 - DNA, 22 bp, Homo sapiens
acagagacttggagcaggctga

SEQ ID NO: 8230104 - DNA, 22 bp, Homo sapiens
acagagactgggagcaagaggc

SEQ ID NO: 8230105 - DNA, 22 bp, Homo sapiens
acagagagaaacaatcagcagc

SEQ ID NO: 8230106 - DNA, 22 bp, Homo sapiens
acagagagaaacaatcagcagc

SEQ ID NO: 8230107 - DNA, 22 bp, Homo sapiens
acagagagaaacaatcagcagc

SEQ ID NO: 8230108 - DNA, 22 bp, Homo sapiens
acagagagaggcccgaggctgc

SEQ ID NO: 8230109 - DNA, 22 bp, Homo sapiens
acagactgtcccaccacatgga

SEQ ID NO: 8230110 - DNA, 23 bp, Homo sapiens
acagacattccataatgtacacc

SEQ ID NO: 8230111 - DNA, 22 bp, Homo sapiens
acagacattcagctaagtctat

SEQ ID NO: 8230112 - DNA, 21 bp, Homo sapiens
acagagaaagagcagcctcct

SEQ ID NO: 8230113 - DNA, 19 bp, Homo sapiens
agccagggtgagaaggagc

SEQ ID NO: 8230114 - DNA, 22 bp, Homo sapiens
agccagggtctctcgctctgtt

SEQ ID NO: 8230115 - DNA, 19 bp, Homo sapiens
agccagggtgagaaggagc

SEQ ID NO: 8230116 - DNA, 19 bp, Homo sapiens
agccagggtgagaaggagc

SEQ ID NO: 8230117 - DNA, 19 bp, Homo sapiens
agccagggtccagacatgt

SEQ ID NO: 8230118 - DNA, 19 bp, Homo sapiens
agccagggtccagacatgt

SEQ ID NO: 8230119 - DNA, 22 bp, Homo sapiens
agccagggtctctcgctctgtt

SEQ ID NO: 8230120 - DNA, 19 bp, Homo sapiens
agccagggtccagacatgt

SEQ ID NO: 8230121 - DNA, 22 bp, Homo sapiens
agccagggtaaggtacttagta

SEQ ID NO: 8230122 - DNA, 22 bp, Homo sapiens
agccagggggacgctttctggc

SEQ ID NO: 8230123 - DNA, 22 bp, Homo sapiens
agccagggtaaggtacttagta

SEQ ID NO: 8230124 - DNA, 22 bp, Homo sapiens
acactttgctacatttcatatt

SEQ ID NO: 8230125 - DNA, 22 bp, Homo sapiens
acactttgatagataatgcagg

SEQ ID NO: 8230126 - DNA, 22 bp, Homo sapiens
acactttctggagctgcacata

SEQ ID NO: 8230127 - DNA, 22 bp, Homo sapiens
acactttgtcctttttcattgt

SEQ ID NO: 8230128 - DNA, 22 bp, Homo sapiens
acactttgggctggataattat

SEQ ID NO: 8230129 - DNA, 22 bp, Homo sapiens
acactttgctacatttcatatt

SEQ ID NO: 8230130 - DNA, 22 bp, Homo sapiens
acacttttaagactttaatgaa

SEQ ID NO: 8230131 - DNA, 22 bp, Homo sapiens
acactttgttgtggcatatacg

SEQ ID NO: 8230132 - DNA, 22 bp, Homo sapiens
acacttttaagactttaatgaa

SEQ ID NO: 8230133 - DNA, 22 bp, Homo sapiens
acacttttagctatgagttaat

SEQ ID NO: 8230134 - DNA, 22 bp, Homo sapiens
acacttttatctctggaggctt

SEQ ID NO: 8230135 - DNA, 22 bp, Homo sapiens
acactttatcaatattcaaaaa

SEQ ID NO: 8230136 - DNA, 22 bp, Homo sapiens
acactttatcaatattcaaaaa

SEQ ID NO: 8230137 - DNA, 22 bp, Homo sapiens
acactttatcaatattcaaaaa

SEQ ID NO: 8230138 - DNA, 22 bp, Homo sapiens
acactttatgtctagatctggg

SEQ ID NO: 8230139 - DNA, 22 bp, Homo sapiens
acactttatgtctagatctggg

SEQ ID NO: 8230140 - DNA, 23 bp, Homo sapiens
acactttcaaatatgcacagagc

SEQ ID NO: 8230141 - DNA, 22 bp, Homo sapiens
acacttttgtttgaagtctcca

SEQ ID NO: 8230142 - DNA, 22 bp, Homo sapiens
acacttttgtttgaagtctcca

SEQ ID NO: 8230143 - DNA, 22 bp, Homo sapiens
acacttttgtgtatatccagtt

SEQ ID NO: 8230144 - DNA, 22 bp, Homo sapiens
acagaaagaccttgtaacactt

SEQ ID NO: 8230145 - DNA, 22 bp, Homo sapiens
acagaaagaccttgtaacactt

SEQ ID NO: 8230146 - DNA, 22 bp, Homo sapiens
acagaaagaaggtgtatttgag

SEQ ID NO: 8230147 - DNA, 22 bp, Homo sapiens
acagaaagaaggtgtatttgag

SEQ ID NO: 8230148 - DNA, 22 bp, Homo sapiens
acagaaagaaggtgtatttgag

SEQ ID NO: 8230149 - DNA, 22 bp, Homo sapiens
acagaaacccagaaaacctctc

SEQ ID NO: 8230150 - DNA, 22 bp, Homo sapiens
acagaaacccagaaaacctctc

SEQ ID NO: 8230151 - DNA, 22 bp, Homo sapiens
acagaaaatgccagaagggtgg

SEQ ID NO: 8230152 - DNA, 20 bp, Homo sapiens
acagaaagagagaatgtcag

SEQ ID NO: 8230153 - DNA, 20 bp, Homo sapiens
acagaaagagagaatgtcag

SEQ ID NO: 8230154 - DNA, 20 bp, Homo sapiens
acagaaagagagaatgtcag

SEQ ID NO: 8230155 - DNA, 20 bp, Homo sapiens
acagaaagagagaatgtcag

SEQ ID NO: 8230156 - DNA, 20 bp, Homo sapiens
acagaaagagagaatgtcag

SEQ ID NO: 8230157 - DNA, 22 bp, Homo sapiens
acagaaagataggcacaaggtc

SEQ ID NO: 8230158 - DNA, 22 bp, Homo sapiens
acagaattaatgaaaattacaa

SEQ ID NO: 8230159 - DNA, 22 bp, Homo sapiens
acagaattaatgaaaattacaa

SEQ ID NO: 8230160 - DNA, 22 bp, Homo sapiens
acagacacaggcgtggagtcgc

SEQ ID NO: 8230161 - DNA, 22 bp, Homo sapiens
acagacacaggcgtggagtcgc

SEQ ID NO: 8230162 - DNA, 22 bp, Homo sapiens
acagacaagtagttcagacaag

SEQ ID NO: 8230163 - DNA, 22 bp, Homo sapiens
acagaattaggagatcctcttg

SEQ ID NO: 8230164 - DNA, 22 bp, Homo sapiens
acagacagattttgtctgatgt

SEQ ID NO: 8230165 - DNA, 22 bp, Homo sapiens
acagacagggcacctgcctcct

SEQ ID NO: 8230166 - DNA, 22 bp, Homo sapiens
acagacagattttgtctgatgt

SEQ ID NO: 8230167 - DNA, 22 bp, Homo sapiens
acagacagggcacctgcctcct

SEQ ID NO: 8230168 - DNA, 22 bp, Homo sapiens
agccaggggattcatcagggac

SEQ ID NO: 8230169 - DNA, 22 bp, Homo sapiens
agccaggggattcatcagggac

SEQ ID NO: 8230170 - DNA, 18 bp, Homo sapiens
acagacacttagtatgag

SEQ ID NO: 8230171 - DNA, 22 bp, Homo sapiens
acagacactgcactcccacctt

SEQ ID NO: 8230172 - DNA, 22 bp, Homo sapiens
acagacagacagagaactattc

SEQ ID NO: 8230173 - DNA, 22 bp, Homo sapiens
acagacagacagagaactattc

SEQ ID NO: 8230174 - DNA, 22 bp, Homo sapiens
acagacagaggctccatgagga

SEQ ID NO: 8230175 - DNA, 22 bp, Homo sapiens
acagacagaggctccatgagga

SEQ ID NO: 8230176 - DNA, 22 bp, Homo sapiens
acagacagacagattgcatatg

SEQ ID NO: 8230177 - DNA, 22 bp, Homo sapiens
acagacagacagagaactattc

SEQ ID NO: 8230178 - DNA, 22 bp, Homo sapiens
acagcaatgagtaactccttgg

SEQ ID NO: 8230179 - DNA, 22 bp, Homo sapiens
acagcaatgagtaactccttgg

SEQ ID NO: 8230180 - DNA, 22 bp, Homo sapiens
acagcaattgtatgcatagcat

SEQ ID NO: 8230181 - DNA, 22 bp, Homo sapiens
agctcctgctctttgtccctaa

SEQ ID NO: 8230182 - DNA, 22 bp, Homo sapiens
agctcctgctctttgtccctaa

SEQ ID NO: 8230183 - DNA, 22 bp, Homo sapiens
acagcacagagtggtatggctg

SEQ ID NO: 8230184 - DNA, 19 bp, Homo sapiens
acagcacagaaatatttca

SEQ ID NO: 8230185 - DNA, 22 bp, Homo sapiens
acagcacaatctgagtcccaga

SEQ ID NO: 8230186 - DNA, 17 bp, Homo sapiens
agctcctgcccatggct

SEQ ID NO: 8230187 - DNA, 22 bp, Homo sapiens
agctcctgcgcacggtgcacac

SEQ ID NO: 8230188 - DNA, 22 bp, Homo sapiens
agctcctgcgcacggtgcacac

SEQ ID NO: 8230189 - DNA, 22 bp, Homo sapiens
agctcctgccaacactgatggg

SEQ ID NO: 8230190 - DNA, 22 bp, Homo sapiens
agctcctgcccaggaaggctct

SEQ ID NO: 8230191 - DNA, 22 bp, Homo sapiens
agctcctgcacccagccttgag

SEQ ID NO: 8230192 - DNA, 22 bp, Homo sapiens
agctcctgcagactcctgctca

SEQ ID NO: 8230193 - DNA, 22 bp, Homo sapiens
agctcccagagtcctctgccca

SEQ ID NO: 8230194 - DNA, 21 bp, Homo sapiens
acagatgggatgagcacactg

SEQ ID NO: 8230195 - DNA, 21 bp, Homo sapiens
acagatgggatgagcacactg

SEQ ID NO: 8230196 - DNA, 22 bp, Homo sapiens
acagatggttattgtcatttct

SEQ ID NO: 8230197 - DNA, 22 bp, Homo sapiens
acagatgtaatctattcacatt

SEQ ID NO: 8230198 - DNA, 22 bp, Homo sapiens
acagatggccatattactatat

SEQ ID NO: 8230199 - DNA, 22 bp, Homo sapiens
acagatggagctactaggtaaa

SEQ ID NO: 8230200 - DNA, 22 bp, Homo sapiens
acagatggagctactaggtaaa

SEQ ID NO: 8230201 - DNA, 22 bp, Homo sapiens
acagatgtggagtttgcatgat

SEQ ID NO: 8230202 - DNA, 21 bp, Homo sapiens
acagatgtgatatgcagtctt

SEQ ID NO: 8230203 - DNA, 21 bp, Homo sapiens
acagatgtgatatgcagtctt

SEQ ID NO: 8230204 - DNA, 22 bp, Homo sapiens
acagatgtggagtttgcatgat

SEQ ID NO: 8230205 - DNA, 22 bp, Homo sapiens
acagatgttagcaatgatgatg

SEQ ID NO: 8230206 - DNA, 22 bp, Homo sapiens
acagatgttgcttgtcattctc

SEQ ID NO: 8230207 - DNA, 21 bp, Homo sapiens
acagattagcacaatgcaggc

SEQ ID NO: 8230208 - DNA, 22 bp, Homo sapiens
acagattcactgcactggccat

SEQ ID NO: 8230209 - DNA, 22 bp, Homo sapiens
acagattcactgcactggccat

SEQ ID NO: 8230210 - DNA, 22 bp, Homo sapiens
agctcccagaaggccctgcgcc

SEQ ID NO: 8230211 - DNA, 22 bp, Homo sapiens
agctcccagaaggccctgcgcc

SEQ ID NO: 8230212 - DNA, 22 bp, Homo sapiens
agctcccagagctcgagagtaa

SEQ ID NO: 8230213 - DNA, 19 bp, Homo sapiens
agctcctgattgtgcctcg

SEQ ID NO: 8230214 - DNA, 22 bp, Homo sapiens
acagatgagttagaataggcag

SEQ ID NO: 8230215 - DNA, 22 bp, Homo sapiens
acagatgagttaaagcagagtg

SEQ ID NO: 8230216 - DNA, 22 bp, Homo sapiens
acagatgatgtgcacagataga

SEQ ID NO: 8230217 - DNA, 22 bp, Homo sapiens
acagatgagttaaagcagagtg

SEQ ID NO: 8230218 - DNA, 22 bp, Homo sapiens
acagatgaggcccatcagtctg

SEQ ID NO: 8230219 - DNA, 22 bp, Homo sapiens
acagatgcaaggaaatgattgc

SEQ ID NO: 8230220 - DNA, 17 bp, Homo sapiens
acagatgctgataagaa

SEQ ID NO: 8230221 - DNA, 19 bp, Homo sapiens
acagatgcttttgctgccc

SEQ ID NO: 8230222 - DNA, 22 bp, Homo sapiens
acagatggaatgtgttatggga

SEQ ID NO: 8230223 - DNA, 22 bp, Homo sapiens
acagatgatgtgcacagataga

SEQ ID NO: 8230224 - DNA, 22 bp, Homo sapiens
acagatgatttttatgaaaaca

SEQ ID NO: 8230225 - DNA, 22 bp, Homo sapiens
acagatgatttttatgaaaaca

SEQ ID NO: 8230226 - DNA, 22 bp, Homo sapiens
acagagctaaatttcaatccca

SEQ ID NO: 8230227 - DNA, 22 bp, Homo sapiens
acagagctaatgttgcataggc

SEQ ID NO: 8230228 - DNA, 19 bp, Homo sapiens
acagagctctctgcttctg

SEQ ID NO: 8230229 - DNA, 22 bp, Homo sapiens
acagagctcccagccatctcct

SEQ ID NO: 8230230 - DNA, 22 bp, Homo sapiens
acagagctcccagccatctcct

SEQ ID NO: 8230231 - DNA, 22 bp, Homo sapiens
acagagctcccagccatctcct

SEQ ID NO: 8230232 - DNA, 22 bp, Homo sapiens
acagatatttggggaaagacgt

SEQ ID NO: 8230233 - DNA, 20 bp, Homo sapiens
acagatatttgattttcagt

SEQ ID NO: 8230234 - DNA, 22 bp, Homo sapiens
acagagctgtacatgtgccatg

SEQ ID NO: 8230235 - DNA, 22 bp, Homo sapiens
acagagctgggatctgaaccca

SEQ ID NO: 8230236 - DNA, 22 bp, Homo sapiens
acagagctgggatctgaaccca

SEQ ID NO: 8230237 - DNA, 22 bp, Homo sapiens
acagagctgggtgccccctgga

SEQ ID NO: 8230238 - DNA, 22 bp, Homo sapiens
acagagctgggtgccccctgga

SEQ ID NO: 8230239 - DNA, 22 bp, Homo sapiens
agcctctgatgatcacaggggg

SEQ ID NO: 8230240 - DNA, 22 bp, Homo sapiens
agcctctgatgatcacaggggg

SEQ ID NO: 8230241 - DNA, 22 bp, Homo sapiens
agcctctcttatcccttcaaag

SEQ ID NO: 8230242 - DNA, 22 bp, Homo sapiens
agcctctctttattcccagcta

SEQ ID NO: 8230243 - DNA, 22 bp, Homo sapiens
agcctctgactgtcagcaaggt

SEQ ID NO: 8230244 - DNA, 22 bp, Homo sapiens
acagagccactttggtgcctac

SEQ ID NO: 8230245 - DNA, 22 bp, Homo sapiens
acagagccactttggtgcctac

SEQ ID NO: 8230246 - DNA, 22 bp, Homo sapiens
acagagccactttggtgcctac

SEQ ID NO: 8230247 - DNA, 21 bp, Homo sapiens
acagagccgggcacaaagctg

SEQ ID NO: 8230248 - DNA, 22 bp, Homo sapiens
acagagcccttccttgcaccat

SEQ ID NO: 8230249 - DNA, 22 bp, Homo sapiens
agcctcctgtagccctcaccca

SEQ ID NO: 8230250 - DNA, 20 bp, Homo sapiens
agccctgtttcctggagaga

SEQ ID NO: 8230251 - DNA, 22 bp, Homo sapiens
agcctcctgtagccctcaccca

SEQ ID NO: 8230252 - DNA, 22 bp, Homo sapiens
agcctctagaccctggcctgca

SEQ ID NO: 8230253 - DNA, 22 bp, Homo sapiens
agcctctcactgtcaccctccc

SEQ ID NO: 8230254 - DNA, 22 bp, Homo sapiens
agcctctcactgtcaccctccc

SEQ ID NO: 8230255 - DNA, 22 bp, Homo sapiens
agcctctctccagcttggcaga

SEQ ID NO: 8230256 - DNA, 22 bp, Homo sapiens
agcctctctccagcttggcaga

SEQ ID NO: 8230257 - DNA, 22 bp, Homo sapiens
agcctctctgttagtcactggg

SEQ ID NO: 8230258 - DNA, 22 bp, Homo sapiens
agcctctccagagcctggcaga

SEQ ID NO: 8230259 - DNA, 22 bp, Homo sapiens
agcctctcagagtgctgggatt

SEQ ID NO: 8230260 - DNA, 22 bp, Homo sapiens
agcctctcatgttctcccccag

SEQ ID NO: 8230261 - DNA, 22 bp, Homo sapiens
aattgctagactatactgtaat

SEQ ID NO: 8230262 - DNA, 22 bp, Homo sapiens
aattgctagactatactgtaat

SEQ ID NO: 8230263 - DNA, 22 bp, Homo sapiens
agaggccctctctctcctgatg

SEQ ID NO: 8230264 - DNA, 18 bp, Homo sapiens
agaggctcgatactagaa

SEQ ID NO: 8230265 - DNA, 17 bp, Homo sapiens
aattgcttgtactccca

SEQ ID NO: 8230266 - DNA, 22 bp, Homo sapiens
agaggctgaatgatgtcatcat

SEQ ID NO: 8230267 - DNA, 22 bp, Homo sapiens
agaggctgaatgatgtcatcat

SEQ ID NO: 8230268 - DNA, 22 bp, Homo sapiens
agaggctgaatgatgtcatcat

SEQ ID NO: 8230269 - DNA, 22 bp, Homo sapiens
agaggctgagaaaccctcttct

SEQ ID NO: 8230270 - DNA, 22 bp, Homo sapiens
agaggctgaatgatgtcatcat

SEQ ID NO: 8230271 - DNA, 22 bp, Homo sapiens
agaggctgaatgatgtcatcat

SEQ ID NO: 8230272 - DNA, 22 bp, Homo sapiens
agaggctctttgagctgggaga

SEQ ID NO: 8230273 - DNA, 22 bp, Homo sapiens
agaggctctggtgcagcatgca

SEQ ID NO: 8230274 - DNA, 22 bp, Homo sapiens
agaggctctggtgggagttggt

SEQ ID NO: 8230275 - DNA, 22 bp, Homo sapiens
agaggctctggtgcagcatgca

SEQ ID NO: 8230276 - DNA, 22 bp, Homo sapiens
agaggctctggtgcagcatgca

SEQ ID NO: 8230277 - DNA, 22 bp, Homo sapiens
aattgcaaattcagacttaaga

SEQ ID NO: 8230278 - DNA, 22 bp, Homo sapiens
aattgatgtctaccacatgcct

SEQ ID NO: 8230279 - DNA, 22 bp, Homo sapiens
aattgatgggcactgaaatatt

SEQ ID NO: 8230280 - DNA, 22 bp, Homo sapiens
aattgatggacagagatgaaga

SEQ ID NO: 8230281 - DNA, 22 bp, Homo sapiens
aattgatgatacccacacttat

SEQ ID NO: 8230282 - DNA, 22 bp, Homo sapiens
aattgatggacagagatgaaga

SEQ ID NO: 8230283 - DNA, 22 bp, Homo sapiens
aattgatgattcttatgtgaaa

SEQ ID NO: 8230284 - DNA, 22 bp, Homo sapiens
aattgacagaaagtttacgagg

SEQ ID NO: 8230285 - DNA, 22 bp, Homo sapiens
aattgagtgactgctgcatgtc

SEQ ID NO: 8230286 - DNA, 22 bp, Homo sapiens
aattgagtcatgctgtattgaa

SEQ ID NO: 8230287 - DNA, 22 bp, Homo sapiens
aattgcatgttaatgactaagt

SEQ ID NO: 8230288 - DNA, 22 bp, Homo sapiens
aattgcatgttaatgactaagt

SEQ ID NO: 8230289 - DNA, 22 bp, Homo sapiens
aattgcaggcaccagcaggagc

SEQ ID NO: 8230290 - DNA, 22 bp, Homo sapiens
aattgcataaatttcatagcat

SEQ ID NO: 8230291 - DNA, 22 bp, Homo sapiens
aattgcataaatttcatagcat

SEQ ID NO: 8230292 - DNA, 22 bp, Homo sapiens
aattgcagcagcttcagcagtt

SEQ ID NO: 8230293 - DNA, 22 bp, Homo sapiens
aattgaaattctttgtggtcca

SEQ ID NO: 8230294 - DNA, 22 bp, Homo sapiens
aattgacaaatcatacttgtat

SEQ ID NO: 8230295 - DNA, 22 bp, Homo sapiens
aattgacaaatcatacttgtat

SEQ ID NO: 8230296 - DNA, 22 bp, Homo sapiens
aattcttgttgttagtatattt

SEQ ID NO: 8230297 - DNA, 22 bp, Homo sapiens
aattcttggtcctagtgtataa

SEQ ID NO: 8230298 - DNA, 22 bp, Homo sapiens
aattcttggaaacattactgga

SEQ ID NO: 8230299 - DNA, 22 bp, Homo sapiens
aattcttcaagtgctttggaga

SEQ ID NO: 8230300 - DNA, 22 bp, Homo sapiens
aattcttaatcccataaagtga

SEQ ID NO: 8230301 - DNA, 22 bp, Homo sapiens
aattcttaatcccataaagtga

SEQ ID NO: 8230302 - DNA, 22 bp, Homo sapiens
aattcttaatcccataaagtga

SEQ ID NO: 8230303 - DNA, 22 bp, Homo sapiens
aattcttaatcccataaagtga

SEQ ID NO: 8230304 - DNA, 22 bp, Homo sapiens
acaaagacgggataaggtttgg

SEQ ID NO: 8230305 - DNA, 22 bp, Homo sapiens
acaaagaaggaattggtcttta

SEQ ID NO: 8230306 - DNA, 22 bp, Homo sapiens
agaggcttcctgccacctgaga

SEQ ID NO: 8230307 - DNA, 22 bp, Homo sapiens
acaaaggcagccaatcatctgc

SEQ ID NO: 8230308 - DNA, 22 bp, Homo sapiens
acaaagcttagacctaagagat

SEQ ID NO: 8230309 - DNA, 22 bp, Homo sapiens
acaaagcttagacctaagagat

SEQ ID NO: 8230310 - DNA, 22 bp, Homo sapiens
agaggctgttacactcccagat

SEQ ID NO: 8230311 - DNA, 22 bp, Homo sapiens
agaggctgttacactcccagat

SEQ ID NO: 8230312 - DNA, 22 bp, Homo sapiens
agaggctgtgcccaccaggcaa

SEQ ID NO: 8230313 - DNA, 22 bp, Homo sapiens
agaggctgtgcccaccaggcaa

SEQ ID NO: 8230314 - DNA, 22 bp, Homo sapiens
agaggctgttacactcccagat

SEQ ID NO: 8230315 - DNA, 22 bp, Homo sapiens
agaggctgttacactcccagat

SEQ ID NO: 8230316 - DNA, 22 bp, Homo sapiens
agaggctgttacactcccagat

SEQ ID NO: 8230317 - DNA, 22 bp, Homo sapiens
agaggctgttacactcccagat

SEQ ID NO: 8230318 - DNA, 22 bp, Homo sapiens
agaggctgtgcccaccaggcaa

SEQ ID NO: 8230319 - DNA, 22 bp, Homo sapiens
agaggctgtgcccaccaggcaa

SEQ ID NO: 8230320 - DNA, 22 bp, Homo sapiens
agaggctgtgcccaccaggcaa

SEQ ID NO: 8230321 - DNA, 22 bp, Homo sapiens
agaggctgagaaaccctcttct

SEQ ID NO: 8230322 - DNA, 22 bp, Homo sapiens
agaggctgatggagtagtgtct

SEQ ID NO: 8230323 - DNA, 22 bp, Homo sapiens
agaggctgtgcagagggagtgc

SEQ ID NO: 8230324 - DNA, 22 bp, Homo sapiens
acaaagtagtcaaagtagatga

SEQ ID NO: 8230325 - DNA, 18 bp, Homo sapiens
acaaaggtctgcaagacc

SEQ ID NO: 8230326 - DNA, 22 bp, Homo sapiens
acaaaggcaggattgacttagt

SEQ ID NO: 8230327 - DNA, 22 bp, Homo sapiens
acaaaggtgagcagaagacaca

SEQ ID NO: 8230328 - DNA, 18 bp, Homo sapiens
acaaaggtctgcaagacc

SEQ ID NO: 8230329 - DNA, 22 bp, Homo sapiens
acaaaggtgagcagaagacaca

SEQ ID NO: 8230330 - DNA, 22 bp, Homo sapiens
acaaaggttgggtcaattgtcc

SEQ ID NO: 8230331 - DNA, 22 bp, Homo sapiens
agagggggaaaatagaggtgtt

SEQ ID NO: 8230332 - DNA, 22 bp, Homo sapiens
agagggggaaaatagaggtgtt

SEQ ID NO: 8230333 - DNA, 22 bp, Homo sapiens
agagggggaaaatagaggtgtt

SEQ ID NO: 8230334 - DNA, 22 bp, Homo sapiens
agagggggaaaatagaggtgtt

SEQ ID NO: 8230335 - DNA, 22 bp, Homo sapiens
agagggggaaaatagaggtgtt

SEQ ID NO: 8230336 - DNA, 22 bp, Homo sapiens
agagggggcagcggaccagtga

SEQ ID NO: 8230337 - DNA, 22 bp, Homo sapiens
agagggggcagcggaccagtga

SEQ ID NO: 8230338 - DNA, 22 bp, Homo sapiens
agagggggcagcggaccagtga

SEQ ID NO: 8230339 - DNA, 22 bp, Homo sapiens
agagggggtgttccagaagcat

SEQ ID NO: 8230340 - DNA, 22 bp, Homo sapiens
agaggggtgggcacagcgccca

SEQ ID NO: 8230341 - DNA, 22 bp, Homo sapiens
agagggggtgtcagcactgcag

SEQ ID NO: 8230342 - DNA, 22 bp, Homo sapiens
agagggggtgtcagcactgcag

SEQ ID NO: 8230343 - DNA, 22 bp, Homo sapiens
acaagaattatttctagttaac

SEQ ID NO: 8230344 - DNA, 22 bp, Homo sapiens
agataatggagggatttgcatt

SEQ ID NO: 8230345 - DNA, 22 bp, Homo sapiens
agataatgattctgcatttcta

SEQ ID NO: 8230346 - DNA, 22 bp, Homo sapiens
agataatgaatttattgaatgt

SEQ ID NO: 8230347 - DNA, 22 bp, Homo sapiens
agataactggtttacattattg

SEQ ID NO: 8230348 - DNA, 22 bp, Homo sapiens
agataactggtttacattattg

SEQ ID NO: 8230349 - DNA, 17 bp, Homo sapiens
agataagcttcagagct

SEQ ID NO: 8230350 - DNA, 22 bp, Homo sapiens
agataagctgtttttcaagaat

SEQ ID NO: 8230351 - DNA, 22 bp, Homo sapiens
acaagataaggtgtcagtgtgt

SEQ ID NO: 8230352 - DNA, 22 bp, Homo sapiens
acaagatagcttagaagattca

SEQ ID NO: 8230353 - DNA, 22 bp, Homo sapiens
acaagagcattgcaggtgtgtt

SEQ ID NO: 8230354 - DNA, 22 bp, Homo sapiens
acaagagagacactaggaatgt

SEQ ID NO: 8230355 - DNA, 22 bp, Homo sapiens
acaagagacaagaggttcttct

SEQ ID NO: 8230356 - DNA, 22 bp, Homo sapiens
acaagagattatctacagatga

SEQ ID NO: 8230357 - DNA, 22 bp, Homo sapiens
acaacagagctggactgagagg

SEQ ID NO: 8230358 - DNA, 22 bp, Homo sapiens
acaacacatgtgtatatgtgtg

SEQ ID NO: 8230359 - DNA, 22 bp, Homo sapiens
acaacacatgtgtatatgtgtg

SEQ ID NO: 8230360 - DNA, 22 bp, Homo sapiens
acaacacatgtgtatatgtgtg

SEQ ID NO: 8230361 - DNA, 22 bp, Homo sapiens
acaacacatgtgtatatgtgtg

SEQ ID NO: 8230362 - DNA, 22 bp, Homo sapiens
acaacacatgtgtatatgtgtg

SEQ ID NO: 8230363 - DNA, 22 bp, Homo sapiens
agataactcattttgtatatcc

SEQ ID NO: 8230364 - DNA, 22 bp, Homo sapiens
agataacatttattgaatgtaa

SEQ ID NO: 8230365 - DNA, 22 bp, Homo sapiens
agataacatttattgaatgtaa

SEQ ID NO: 8230366 - DNA, 22 bp, Homo sapiens
acaacagagctggactgagagg

SEQ ID NO: 8230367 - DNA, 22 bp, Homo sapiens
acaacagagctggactgagagg

SEQ ID NO: 8230368 - DNA, 22 bp, Homo sapiens
acaacagagctggactgagagg

SEQ ID NO: 8230369 - DNA, 22 bp, Homo sapiens
agataaattcctaagatttcag

SEQ ID NO: 8230370 - DNA, 22 bp, Homo sapiens
agaggggtggtgctctcctgga

SEQ ID NO: 8230371 - DNA, 22 bp, Homo sapiens
agaggggtgggcacagcgccca

SEQ ID NO: 8230372 - DNA, 22 bp, Homo sapiens
agaggggttaagtgctagtccg

SEQ ID NO: 8230373 - DNA, 22 bp, Homo sapiens
acaaattgcctagtctagcatc

SEQ ID NO: 8230374 - DNA, 19 bp, Homo sapiens
acaaattggcaaaatgcaa

SEQ ID NO: 8230375 - DNA, 22 bp, Homo sapiens
acaacaaagacacttgaaatga

SEQ ID NO: 8230376 - DNA, 19 bp, Homo sapiens
acaaattggcaaaatgcaa

SEQ ID NO: 8230377 - DNA, 20 bp, Homo sapiens
acaaattggcagaatgacaa

SEQ ID NO: 8230378 - DNA, 22 bp, Homo sapiens
acaacacagctttcctcaagtt

SEQ ID NO: 8230379 - DNA, 22 bp, Homo sapiens
acaacacagcaaaaccccatct

SEQ ID NO: 8230380 - DNA, 22 bp, Homo sapiens
acaacaatctaccctagcttct

SEQ ID NO: 8230381 - DNA, 22 bp, Homo sapiens
acaacaaagacacttgaaatga

SEQ ID NO: 8230382 - DNA, 22 bp, Homo sapiens
acaacaaagacacttgaaatga

SEQ ID NO: 8230383 - DNA, 22 bp, Homo sapiens
acaacaatctaccctagcttct

SEQ ID NO: 8230384 - DNA, 22 bp, Homo sapiens
acaagatgtgtttatacaagct

SEQ ID NO: 8230385 - DNA, 22 bp, Homo sapiens
acaagatgtgtttatacaagct

SEQ ID NO: 8230386 - DNA, 22 bp, Homo sapiens
acaagatgtgtttatacaagct

SEQ ID NO: 8230387 - DNA, 22 bp, Homo sapiens
acaagatggaatattgagaaaa

SEQ ID NO: 8230388 - DNA, 22 bp, Homo sapiens
acaagataggttgagtctagcc

SEQ ID NO: 8230389 - DNA, 22 bp, Homo sapiens
acaagatagcttagaagattca

SEQ ID NO: 8230390 - DNA, 23 bp, Homo sapiens
acaagatagggataaaaagataa

SEQ ID NO: 8230391 - DNA, 23 bp, Homo sapiens
acaagatagggataaaaagataa

SEQ ID NO: 8230392 - DNA, 23 bp, Homo sapiens
acaagatagggataaaaagataa

SEQ ID NO: 8230393 - DNA, 22 bp, Homo sapiens
acaagcagaaggtggggtctta

SEQ ID NO: 8230394 - DNA, 22 bp, Homo sapiens
acaagattttatgactcttttt

SEQ ID NO: 8230395 - DNA, 22 bp, Homo sapiens
acaagcacttcactgtcctctg

SEQ ID NO: 8230396 - DNA, 23 bp, Homo sapiens
acaagcagcccagtgctctgcct

SEQ ID NO: 8230397 - DNA, 22 bp, Homo sapiens
acaatagacaaagtgaatggct

SEQ ID NO: 8230398 - DNA, 22 bp, Homo sapiens
acaagctcacatcagccaatga

SEQ ID NO: 8230399 - DNA, 22 bp, Homo sapiens
acaagcgggccacagtgctggt

SEQ ID NO: 8230400 - DNA, 22 bp, Homo sapiens
acaagcgggccacagtgctggt

SEQ ID NO: 8230401 - DNA, 22 bp, Homo sapiens
acaagcatcaggttcagcaata

SEQ ID NO: 8230402 - DNA, 22 bp, Homo sapiens
acaagcatcaggttcagcaata

SEQ ID NO: 8230403 - DNA, 22 bp, Homo sapiens
acaagcatgtggtaaaaagacc

SEQ ID NO: 8230404 - DNA, 17 bp, Homo sapiens
acaagcagtggccatgg

SEQ ID NO: 8230405 - DNA, 22 bp, Homo sapiens
acaagcataagtgagatgaata

SEQ ID NO: 8230406 - DNA, 17 bp, Homo sapiens
acaagcagtggccatgg

SEQ ID NO: 8230407 - DNA, 22 bp, Homo sapiens
acaagcagtaaaggccacagtc

SEQ ID NO: 8230408 - DNA, 22 bp, Homo sapiens
acaatgaatatcatgaagtact

SEQ ID NO: 8230409 - DNA, 22 bp, Homo sapiens
acaatgaagataatgttgcagt

SEQ ID NO: 8230410 - DNA, 22 bp, Homo sapiens
acaatgattttttagagtagtt

SEQ ID NO: 8230411 - DNA, 19 bp, Homo sapiens
acaatgaatgtgttctctt

SEQ ID NO: 8230412 - DNA, 22 bp, Homo sapiens
acaatgatgcagatgagtaaga

SEQ ID NO: 8230413 - DNA, 22 bp, Homo sapiens
acaatcttattagtagtataga

SEQ ID NO: 8230414 - DNA, 22 bp, Homo sapiens
acaatgaaagcaagaagacggc

SEQ ID NO: 8230415 - DNA, 22 bp, Homo sapiens
acaatgaaaaaatttactgtgg

SEQ ID NO: 8230416 - DNA, 22 bp, Homo sapiens
acaatcattggcttcattacaa

SEQ ID NO: 8230417 - DNA, 22 bp, Homo sapiens
acaatcagtatttagacccagg

SEQ ID NO: 8230418 - DNA, 22 bp, Homo sapiens
acaatctggaaaagttaactat

SEQ ID NO: 8230419 - DNA, 22 bp, Homo sapiens
acaatgaacacacaaggaattc

SEQ ID NO: 8230420 - DNA, 22 bp, Homo sapiens
acaatgaacgctttttaactgt

SEQ ID NO: 8230421 - DNA, 23 bp, Homo sapiens
aatggtcttcctccacccctctg

SEQ ID NO: 8230422 - DNA, 22 bp, Homo sapiens
aatggtttaacatatgcttgag

SEQ ID NO: 8230423 - DNA, 22 bp, Homo sapiens
aatggtttagttaagactgagt

SEQ ID NO: 8230424 - DNA, 22 bp, Homo sapiens
aatggtttggactattcaatag

SEQ ID NO: 8230425 - DNA, 22 bp, Homo sapiens
aatggtttggactattcaatag

SEQ ID NO: 8230426 - DNA, 22 bp, Homo sapiens
aatggttttctagaacatgaaa

SEQ ID NO: 8230427 - DNA, 19 bp, Homo sapiens
aatggtttgatgaagtata

SEQ ID NO: 8230428 - DNA, 22 bp, Homo sapiens
aatgggcatttggggttgagaa

SEQ ID NO: 8230429 - DNA, 22 bp, Homo sapiens
aatgggcatttgtttgtggtac

SEQ ID NO: 8230430 - DNA, 22 bp, Homo sapiens
aatggggtagtgggcagcctgg

SEQ ID NO: 8230431 - DNA, 23 bp, Homo sapiens
aatgggtgcaactatccatgaca

SEQ ID NO: 8230432 - DNA, 23 bp, Homo sapiens
aatgggtgcaactatccatgaca

SEQ ID NO: 8230433 - DNA, 23 bp, Homo sapiens
aatgggtgcaactatccatgaca

SEQ ID NO: 8230434 - DNA, 23 bp, Homo sapiens
aatgggtgcaactatccatgaca

SEQ ID NO: 8230435 - DNA, 22 bp, Homo sapiens
aatggtcagggcttttgtaggt

SEQ ID NO: 8230436 - DNA, 19 bp, Homo sapiens
aatggtaattagagaaatg

SEQ ID NO: 8230437 - DNA, 22 bp, Homo sapiens
aatgtgcttctggctgtggtca

SEQ ID NO: 8230438 - DNA, 17 bp, Homo sapiens
aatgtggaagtacatgc

SEQ ID NO: 8230439 - DNA, 22 bp, Homo sapiens
aatgtggatccttacagatacc

SEQ ID NO: 8230440 - DNA, 22 bp, Homo sapiens
aatgtggatgatactagtactt

SEQ ID NO: 8230441 - DNA, 22 bp, Homo sapiens
aatgtggattcacaagtgctca

SEQ ID NO: 8230442 - DNA, 22 bp, Homo sapiens
aatgtgagccaatgcccgtggg

SEQ ID NO: 8230443 - DNA, 22 bp, Homo sapiens
aatgtgaggccttggtagttat

SEQ ID NO: 8230444 - DNA, 22 bp, Homo sapiens
aatgtgatcgctttagaagctt

SEQ ID NO: 8230445 - DNA, 22 bp, Homo sapiens
aatgtgagccaatgcccgtggg

SEQ ID NO: 8230446 - DNA, 22 bp, Homo sapiens
aatgtgattagcctctactgga

SEQ ID NO: 8230447 - DNA, 22 bp, Homo sapiens
aatgtgatctgtcatgatggca

SEQ ID NO: 8230448 - DNA, 22 bp, Homo sapiens
aatgtgattgaaaatcaggtcc

SEQ ID NO: 8230449 - DNA, 22 bp, Homo sapiens
aatgtgattgaaaatcaggtcc

SEQ ID NO: 8230450 - DNA, 22 bp, Homo sapiens
aatgtgattttcccagtagaat

SEQ ID NO: 8230451 - DNA, 22 bp, Homo sapiens
aatgtgaatcttcctttttgat

SEQ ID NO: 8230452 - DNA, 22 bp, Homo sapiens
aatgtgactggagtctcttggc

SEQ ID NO: 8230453 - DNA, 22 bp, Homo sapiens
aatgtgaactttgtcatgtaac

SEQ ID NO: 8230454 - DNA, 18 bp, Homo sapiens
aatgtgaatatttacttc

SEQ ID NO: 8230455 - DNA, 22 bp, Homo sapiens
aatgtgaatcttcctttttgat

SEQ ID NO: 8230456 - DNA, 22 bp, Homo sapiens
aatgtgaactttgtcatgtaac

SEQ ID NO: 8230457 - DNA, 18 bp, Homo sapiens
aatgtgaatatttacttc

SEQ ID NO: 8230458 - DNA, 22 bp, Homo sapiens
aatggtttttgcatattcaggt

SEQ ID NO: 8230459 - DNA, 22 bp, Homo sapiens
aatgtaaaatatcttgtacttg

SEQ ID NO: 8230460 - DNA, 22 bp, Homo sapiens
aatgtcttcagtgtatacatgg

SEQ ID NO: 8230461 - DNA, 22 bp, Homo sapiens
aatggttttgtctcatcaatgt

SEQ ID NO: 8230462 - DNA, 22 bp, Homo sapiens
aatggtttttagtgagatcgat

SEQ ID NO: 8230463 - DNA, 22 bp, Homo sapiens
aatggttttgctttagtattct

SEQ ID NO: 8230464 - DNA, 22 bp, Homo sapiens
agacaatatgtatattaagaat

SEQ ID NO: 8230465 - DNA, 20 bp, Homo sapiens
agacaatgagtgacagagtt

SEQ ID NO: 8230466 - DNA, 22 bp, Homo sapiens
agacaatggaccaagcaccttc

SEQ ID NO: 8230467 - DNA, 22 bp, Homo sapiens
agacaatggagagcagagtact

SEQ ID NO: 8230468 - DNA, 19 bp, Homo sapiens
agacaatggggttggcagt

SEQ ID NO: 8230469 - DNA, 22 bp, Homo sapiens
agacaatgtcaaggtgatcatc

SEQ ID NO: 8230470 - DNA, 22 bp, Homo sapiens
agaagcagactctgaggcaagg

SEQ ID NO: 8230471 - DNA, 22 bp, Homo sapiens
agaagcagaaggaagcagggcc

SEQ ID NO: 8230472 - DNA, 22 bp, Homo sapiens
agaagcagactctgaggcaagg

SEQ ID NO: 8230473 - DNA, 22 bp, Homo sapiens
agaagcagactctgaggcaagg

SEQ ID NO: 8230474 - DNA, 22 bp, Homo sapiens
agaagcagactctgaggcaagg

SEQ ID NO: 8230475 - DNA, 22 bp, Homo sapiens
agaagcagctttcaaggtgatt

SEQ ID NO: 8230476 - DNA, 23 bp, Homo sapiens
agaagcagcttctggagtatcgg

SEQ ID NO: 8230477 - DNA, 23 bp, Homo sapiens
agaagcagcttctggagtatcgg

SEQ ID NO: 8230478 - DNA, 20 bp, Homo sapiens
agacaaaatgacttcatgca

SEQ ID NO: 8230479 - DNA, 22 bp, Homo sapiens
agaagcagcaagcccttcaaag

SEQ ID NO: 8230480 - DNA, 23 bp, Homo sapiens
agaagcagcttctggagtatcgg

SEQ ID NO: 8230481 - DNA, 22 bp, Homo sapiens
aatggagactgacacaaagata

SEQ ID NO: 8230482 - DNA, 22 bp, Homo sapiens
aatggagaggctgtgagtgaga

SEQ ID NO: 8230483 - DNA, 22 bp, Homo sapiens
aatggagaggctgtgagtgaga

SEQ ID NO: 8230484 - DNA, 22 bp, Homo sapiens
agacaattaaaaaattatgctt

SEQ ID NO: 8230485 - DNA, 22 bp, Homo sapiens
agacaattaaaaaattatgctt

SEQ ID NO: 8230486 - DNA, 22 bp, Homo sapiens
agacaattaaaaaattatgctt

SEQ ID NO: 8230487 - DNA, 22 bp, Homo sapiens
aatggcaattcagtgaaattat

SEQ ID NO: 8230488 - DNA, 22 bp, Homo sapiens
aatggcacccgtaataccaaag

SEQ ID NO: 8230489 - DNA, 22 bp, Homo sapiens
aatggcacaagagtaaactgtt

SEQ ID NO: 8230490 - DNA, 22 bp, Homo sapiens
aatggcactttataaatgttaa

SEQ ID NO: 8230491 - DNA, 22 bp, Homo sapiens
aatggcacctgctatatactga

SEQ ID NO: 8230492 - DNA, 22 bp, Homo sapiens
aatggaggtgtctggcctggta

SEQ ID NO: 8230493 - DNA, 22 bp, Homo sapiens
aatggagatgtctagagggtgc

SEQ ID NO: 8230494 - DNA, 22 bp, Homo sapiens
aatggcaaaaggataacaagga

SEQ ID NO: 8230495 - DNA, 22 bp, Homo sapiens
aatggcagaatgggccagaagc

SEQ ID NO: 8230496 - DNA, 19 bp, Homo sapiens
aatggcagatgccatatct

SEQ ID NO: 8230497 - DNA, 22 bp, Homo sapiens
aatggcagaggcaaagatggta

SEQ ID NO: 8230498 - DNA, 22 bp, Homo sapiens
aatggcagtagttgcatgagag

SEQ ID NO: 8230499 - DNA, 22 bp, Homo sapiens
aatggccagacagatggctgct

SEQ ID NO: 8230500 - DNA, 22 bp, Homo sapiens
aatgggataatagaagtagaat

SEQ ID NO: 8230501 - DNA, 22 bp, Homo sapiens
aatgggcacacttagagagtaa

SEQ ID NO: 8230502 - DNA, 22 bp, Homo sapiens
aatgggcacacttagagagtaa

SEQ ID NO: 8230503 - DNA, 22 bp, Homo sapiens
aatgggaagtcactactgttac

SEQ ID NO: 8230504 - DNA, 22 bp, Homo sapiens
aatggccagcaacaggagtgaa

SEQ ID NO: 8230505 - DNA, 22 bp, Homo sapiens
aatggccagacagatggctgct

SEQ ID NO: 8230506 - DNA, 22 bp, Homo sapiens
aatggccagcaacaggagtgaa

SEQ ID NO: 8230507 - DNA, 22 bp, Homo sapiens
aatgggaagtcactactgttac

SEQ ID NO: 8230508 - DNA, 22 bp, Homo sapiens
aatgggaagtcactactgttac

SEQ ID NO: 8230509 - DNA, 22 bp, Homo sapiens
agaccctgcacctctcgtgggc

SEQ ID NO: 8230510 - DNA, 22 bp, Homo sapiens
agaccctggtaaacactccagg

SEQ ID NO: 8230511 - DNA, 22 bp, Homo sapiens
agaccctggggaaagtcacttc

SEQ ID NO: 8230512 - DNA, 22 bp, Homo sapiens
agaccctgcattttccagggtt

SEQ ID NO: 8230513 - DNA, 22 bp, Homo sapiens
aatgtgggggtgagctgtatat

SEQ ID NO: 8230514 - DNA, 22 bp, Homo sapiens
aatgtgtaaatgaggagtcttg

SEQ ID NO: 8230515 - DNA, 22 bp, Homo sapiens
aatgtgtaaatgaggagtcttg

SEQ ID NO: 8230516 - DNA, 22 bp, Homo sapiens
aattaaaaaaggagagcttgct

SEQ ID NO: 8230517 - DNA, 22 bp, Homo sapiens
aattaaaaaaggagagcttgct

SEQ ID NO: 8230518 - DNA, 22 bp, Homo sapiens
aattaaaaaaggagagcttgct

SEQ ID NO: 8230519 - DNA, 22 bp, Homo sapiens
aatgtttggctagatagatgga

SEQ ID NO: 8230520 - DNA, 22 bp, Homo sapiens
agacctcaataccaggcaccac

SEQ ID NO: 8230521 - DNA, 22 bp, Homo sapiens
aatgttttaaaagagattgaga

SEQ ID NO: 8230522 - DNA, 22 bp, Homo sapiens
agacccttcatgtagttcccca

SEQ ID NO: 8230523 - DNA, 22 bp, Homo sapiens
agacccttgcatgaattaattc

SEQ ID NO: 8230524 - DNA, 22 bp, Homo sapiens
agaccctgtcagtgttaggaaa

SEQ ID NO: 8230525 - DNA, 20 bp, Homo sapiens
agaccctgtgtcctgtggcc

SEQ ID NO: 8230526 - DNA, 22 bp, Homo sapiens
aattaaaaaaggagagcttgct

SEQ ID NO: 8230527 - DNA, 22 bp, Homo sapiens
aattaaaaaaggagagcttgct

SEQ ID NO: 8230528 - DNA, 22 bp, Homo sapiens
aattaaaaaaggagagcttgct

SEQ ID NO: 8230529 - DNA, 22 bp, Homo sapiens
aattaaaagataacccatgagt

SEQ ID NO: 8230530 - DNA, 22 bp, Homo sapiens
aattaaaagataacccatgagt

SEQ ID NO: 8230531 - DNA, 22 bp, Homo sapiens
aattaaaagataacccatgagt

SEQ ID NO: 8230532 - DNA, 22 bp, Homo sapiens
aattaaaagataacccatgagt

SEQ ID NO: 8230533 - DNA, 22 bp, Homo sapiens
aattaaatgacaggggaagatg

SEQ ID NO: 8230534 - DNA, 23 bp, Homo sapiens
aattaaattgctagatccagggc

SEQ ID NO: 8230535 - DNA, 22 bp, Homo sapiens
aattaaattggtttagagagga

SEQ ID NO: 8230536 - DNA, 23 bp, Homo sapiens
aattaaattgctagatccagggc

SEQ ID NO: 8230537 - DNA, 22 bp, Homo sapiens
aattaaattggtttagagagga

SEQ ID NO: 8230538 - DNA, 18 bp, Homo sapiens
agagacagcagcaaaaga

SEQ ID NO: 8230539 - DNA, 22 bp, Homo sapiens
agagacagatctgagggacctc

SEQ ID NO: 8230540 - DNA, 22 bp, Homo sapiens
agagcaggtggcaactctggga

SEQ ID NO: 8230541 - DNA, 22 bp, Homo sapiens
agagacagggttttgccatgtt

SEQ ID NO: 8230542 - DNA, 22 bp, Homo sapiens
agagacagggttttgccatgtt

SEQ ID NO: 8230543 - DNA, 22 bp, Homo sapiens
agagccaggcggctgggcacct

SEQ ID NO: 8230544 - DNA, 22 bp, Homo sapiens
agagccaggcggctgggcacct

SEQ ID NO: 8230545 - DNA, 22 bp, Homo sapiens
agagccaggctcccatggggca

SEQ ID NO: 8230546 - DNA, 22 bp, Homo sapiens
agagccaggctcccatggggca

SEQ ID NO: 8230547 - DNA, 22 bp, Homo sapiens
agagccaggctcccatggggca

SEQ ID NO: 8230548 - DNA, 22 bp, Homo sapiens
agagccaggctcccatggggca

SEQ ID NO: 8230549 - DNA, 22 bp, Homo sapiens
agagccaggcggctgggcacct

SEQ ID NO: 8230550 - DNA, 22 bp, Homo sapiens
agagccaggtgtagtctcggag

SEQ ID NO: 8230551 - DNA, 22 bp, Homo sapiens
agagccaggtgtagtctcggag

SEQ ID NO: 8230552 - DNA, 22 bp, Homo sapiens
agagccaggtgtagtctcggag

SEQ ID NO: 8230553 - DNA, 22 bp, Homo sapiens
agagccaggtgtagtctcggag

SEQ ID NO: 8230554 - DNA, 22 bp, Homo sapiens
agagccagttacaactgtggag

SEQ ID NO: 8230555 - DNA, 22 bp, Homo sapiens
agagccagttacaactgtggag

SEQ ID NO: 8230556 - DNA, 22 bp, Homo sapiens
agagccagttaagcacttacag

SEQ ID NO: 8230557 - DNA, 22 bp, Homo sapiens
agagccagttaagcacttacag

SEQ ID NO: 8230558 - DNA, 22 bp, Homo sapiens
agagccagttacaactgtggag

SEQ ID NO: 8230559 - DNA, 22 bp, Homo sapiens
agagccagttacaactgtggag

SEQ ID NO: 8230560 - DNA, 22 bp, Homo sapiens
agagccaggctcccatggggca

SEQ ID NO: 8230561 - DNA, 22 bp, Homo sapiens
agagccaggctcccatggggca

SEQ ID NO: 8230562 - DNA, 22 bp, Homo sapiens
agagccaggtgctgctgtttga

SEQ ID NO: 8230563 - DNA, 22 bp, Homo sapiens
agagccaggctctacctgggtt

SEQ ID NO: 8230564 - DNA, 22 bp, Homo sapiens
agagccaggctctacctgggtt

SEQ ID NO: 8230565 - DNA, 22 bp, Homo sapiens
aattccatccatttgtttcaac

SEQ ID NO: 8230566 - DNA, 22 bp, Homo sapiens
aattctgaggagggaagaggaa

SEQ ID NO: 8230567 - DNA, 22 bp, Homo sapiens
aattctgatccagaacctgtca

SEQ ID NO: 8230568 - DNA, 22 bp, Homo sapiens
aattccagtaggcaccactcat

SEQ ID NO: 8230569 - DNA, 22 bp, Homo sapiens
aattccagggtacctctgattt

SEQ ID NO: 8230570 - DNA, 22 bp, Homo sapiens
aattccagtctctgctctattt

SEQ ID NO: 8230571 - DNA, 22 bp, Homo sapiens
aattccatatctgtgattatta

SEQ ID NO: 8230572 - DNA, 22 bp, Homo sapiens
aattctgatgagtcagagaaag

SEQ ID NO: 8230573 - DNA, 22 bp, Homo sapiens
aattctgatgagtcagagaaag

SEQ ID NO: 8230574 - DNA, 22 bp, Homo sapiens
aattctgctcttaacataatgt

SEQ ID NO: 8230575 - DNA, 22 bp, Homo sapiens
agagcctggcaaaaggtcctgc

SEQ ID NO: 8230576 - DNA, 22 bp, Homo sapiens
aattccaggcagaaatgtgagt

SEQ ID NO: 8230577 - DNA, 22 bp, Homo sapiens
agagcctggcaaaaggtcctgc

SEQ ID NO: 8230578 - DNA, 22 bp, Homo sapiens
agagcctggaggttctgctgaa

SEQ ID NO: 8230579 - DNA, 22 bp, Homo sapiens
agagcctggacttttctgagcc

SEQ ID NO: 8230580 - DNA, 22 bp, Homo sapiens
agagcctggacctgggctctga

SEQ ID NO: 8230581 - DNA, 22 bp, Homo sapiens
agagcctgcatctagcctcaga

SEQ ID NO: 8230582 - DNA, 22 bp, Homo sapiens
agagcctgcatctagcctcaga

SEQ ID NO: 8230583 - DNA, 22 bp, Homo sapiens
agagcctgcatctagcctcaga

SEQ ID NO: 8230584 - DNA, 22 bp, Homo sapiens
agagcctgcatcaggcttgggg

SEQ ID NO: 8230585 - DNA, 22 bp, Homo sapiens
agagccagttgttaagcactta

SEQ ID NO: 8230586 - DNA, 22 bp, Homo sapiens
agagccagttgttaagcactta

SEQ ID NO: 8230587 - DNA, 22 bp, Homo sapiens
agagccagttgttaagcactta

SEQ ID NO: 8230588 - DNA, 22 bp, Homo sapiens
agagccagttgttaagcactta

SEQ ID NO: 8230589 - DNA, 22 bp, Homo sapiens
agagccagttgttaagcactta

SEQ ID NO: 8230590 - DNA, 22 bp, Homo sapiens
agagcctgctacctcattccag

SEQ ID NO: 8230591 - DNA, 22 bp, Homo sapiens
agagcctgctacctcattccag

SEQ ID NO: 8230592 - DNA, 22 bp, Homo sapiens
agagcctgctgtgtaagtcaca

SEQ ID NO: 8230593 - DNA, 20 bp, Homo sapiens
agagcctggaaaaagacatc

SEQ ID NO: 8230594 - DNA, 20 bp, Homo sapiens
agagcctggaaaaagacatc

SEQ ID NO: 8230595 - DNA, 22 bp, Homo sapiens
agagcctgctgtgtaagtcaca

SEQ ID NO: 8230596 - DNA, 22 bp, Homo sapiens
agagcctggacctgagctacaa

SEQ ID NO: 8230597 - DNA, 20 bp, Homo sapiens
agagcctggaaaaagacatc

SEQ ID NO: 8230598 - DNA, 22 bp, Homo sapiens
agagcctggacctgggctctga

SEQ ID NO: 8230599 - DNA, 22 bp, Homo sapiens
agagcctggacctgagctacaa

SEQ ID NO: 8230600 - DNA, 22 bp, Homo sapiens
agagcctggacctgagctacaa

SEQ ID NO: 8230601 - DNA, 22 bp, Homo sapiens
acgtgcaggatctggttggcga

SEQ ID NO: 8230602 - DNA, 22 bp, Homo sapiens
acgtatattgaaatatcatgag

SEQ ID NO: 8230603 - DNA, 22 bp, Homo sapiens
acgtagcactgagagatgcagg

SEQ ID NO: 8230604 - DNA, 22 bp, Homo sapiens
acggggctagagaaggtttctt

SEQ ID NO: 8230605 - DNA, 22 bp, Homo sapiens
acggggctagagaaggtttctt

SEQ ID NO: 8230606 - DNA, 22 bp, Homo sapiens
acggggctagagaaggtttctt

SEQ ID NO: 8230607 - DNA, 22 bp, Homo sapiens
acgggtggctgaggaggcctct

SEQ ID NO: 8230608 - DNA, 22 bp, Homo sapiens
acctacatggctttaagtaagt

SEQ ID NO: 8230609 - DNA, 22 bp, Homo sapiens
acctagaatttaaaacattgct

SEQ ID NO: 8230610 - DNA, 22 bp, Homo sapiens
acctttatcgccatcattgtgc

SEQ ID NO: 8230611 - DNA, 22 bp, Homo sapiens
acctaacttacctaggtccaca

SEQ ID NO: 8230612 - DNA, 22 bp, Homo sapiens
actacacagggatgtgactacc

SEQ ID NO: 8230613 - DNA, 22 bp, Homo sapiens
aagtctctttacctctccaggc

SEQ ID NO: 8230614 - DNA, 22 bp, Homo sapiens
aagtctctggtgatgcaggaaa

SEQ ID NO: 8230615 - DNA, 22 bp, Homo sapiens
aagtctcttagtaatatccaac

SEQ ID NO: 8230616 - DNA, 22 bp, Homo sapiens
aagtctcttcctctgccaaaga

SEQ ID NO: 8230617 - DNA, 22 bp, Homo sapiens
aagtctctgatgtgtgttaggt

SEQ ID NO: 8230618 - DNA, 22 bp, Homo sapiens
aagtctctgatgtgtgttaggt

SEQ ID NO: 8230619 - DNA, 18 bp, Homo sapiens
aagtctctgaaagctttt

SEQ ID NO: 8230620 - DNA, 22 bp, Homo sapiens
aagtctctctgtgtgggataag

SEQ ID NO: 8230621 - DNA, 22 bp, Homo sapiens
aagtctcatccgtgtagctcca

SEQ ID NO: 8230622 - DNA, 22 bp, Homo sapiens
aagtctctaagactgtgccatc

SEQ ID NO: 8230623 - DNA, 22 bp, Homo sapiens
aagtctctaagactgtgccatc

SEQ ID NO: 8230624 - DNA, 20 bp, Homo sapiens
acgtggccaccagtggctta

SEQ ID NO: 8230625 - DNA, 20 bp, Homo sapiens
acgtggccaccagtggctta

SEQ ID NO: 8230626 - DNA, 22 bp, Homo sapiens
acgtggagagaatagggcacca

SEQ ID NO: 8230627 - DNA, 22 bp, Homo sapiens
acgtggagagaatagggcacca

SEQ ID NO: 8230628 - DNA, 22 bp, Homo sapiens
acgtgcatctttccatatgtgg

SEQ ID NO: 8230629 - DNA, 22 bp, Homo sapiens
aagtcgtcgaagatggaggttg

SEQ ID NO: 8230630 - DNA, 22 bp, Homo sapiens
aagtctaaacacatatttaaaa

SEQ ID NO: 8230631 - DNA, 22 bp, Homo sapiens
aagtcgtggcaggcttgcacga

SEQ ID NO: 8230632 - DNA, 22 bp, Homo sapiens
aagtctcatccgtgtagctcca

SEQ ID NO: 8230633 - DNA, 22 bp, Homo sapiens
aagtctcagaaaactagtgtgg

SEQ ID NO: 8230634 - DNA, 22 bp, Homo sapiens
aagtctaacctattccggtgtt

SEQ ID NO: 8230635 - DNA, 22 bp, Homo sapiens
aagtctaagtttgtaacttgga

SEQ ID NO: 8230636 - DNA, 22 bp, Homo sapiens
actcaccacagagcagggaacc

SEQ ID NO: 8230637 - DNA, 22 bp, Homo sapiens
actatacattgaatgttaaggt

SEQ ID NO: 8230638 - DNA, 22 bp, Homo sapiens
actcactgcactttgaaatgtg

SEQ ID NO: 8230639 - DNA, 22 bp, Homo sapiens
actatacagtatgtacgtgcac

SEQ ID NO: 8230640 - DNA, 22 bp, Homo sapiens
actatacagtatgtacgtgcac

SEQ ID NO: 8230641 - DNA, 22 bp, Homo sapiens
actatacagtatgtacgtgcac

SEQ ID NO: 8230642 - DNA, 22 bp, Homo sapiens
actatacagtatgtacgtgcac

SEQ ID NO: 8230643 - DNA, 22 bp, Homo sapiens
actatacattgaatgttaaggt

SEQ ID NO: 8230644 - DNA, 22 bp, Homo sapiens
actcactttccattcaagcacc

SEQ ID NO: 8230645 - DNA, 22 bp, Homo sapiens
actcactgggtcccggaagccc

SEQ ID NO: 8230646 - DNA, 22 bp, Homo sapiens
actcacttcttttactataaaa

SEQ ID NO: 8230647 - DNA, 22 bp, Homo sapiens
actcactgggtcccggaagccc

SEQ ID NO: 8230648 - DNA, 22 bp, Homo sapiens
actcagaaccatttactctgag

SEQ ID NO: 8230649 - DNA, 22 bp, Homo sapiens
actcagaaccatttactctgag

SEQ ID NO: 8230650 - DNA, 22 bp, Homo sapiens
actcagaagatataatgactca

SEQ ID NO: 8230651 - DNA, 22 bp, Homo sapiens
actcagaagatataatgactca

SEQ ID NO: 8230652 - DNA, 22 bp, Homo sapiens
actcagaagatataatgactca

SEQ ID NO: 8230653 - DNA, 22 bp, Homo sapiens
actcagacagaccaaagttctg

SEQ ID NO: 8230654 - DNA, 22 bp, Homo sapiens
actcagaatgactgatgctgtg

SEQ ID NO: 8230655 - DNA, 22 bp, Homo sapiens
actagtttgaaaatatctgatt

SEQ ID NO: 8230656 - DNA, 22 bp, Homo sapiens
actagtttgagtaattgtaatg

SEQ ID NO: 8230657 - DNA, 22 bp, Homo sapiens
actagtttgagtaattgtaatg

SEQ ID NO: 8230658 - DNA, 22 bp, Homo sapiens
actagttttcaggcatgtctgg

SEQ ID NO: 8230659 - DNA, 22 bp, Homo sapiens
actagttttcaggcatgtctgg

SEQ ID NO: 8230660 - DNA, 22 bp, Homo sapiens
actagttttccataatatagga

SEQ ID NO: 8230661 - DNA, 22 bp, Homo sapiens
actacagaagtcttattagaga

SEQ ID NO: 8230662 - DNA, 22 bp, Homo sapiens
actagtttgaaaatatctgatt

SEQ ID NO: 8230663 - DNA, 22 bp, Homo sapiens
actagtttttcctctgtcctgt

SEQ ID NO: 8230664 - DNA, 22 bp, Homo sapiens
actataaaaggataaaccagaa

SEQ ID NO: 8230665 - DNA, 22 bp, Homo sapiens
actataaaaggataaaccagaa

SEQ ID NO: 8230666 - DNA, 22 bp, Homo sapiens
actataaaaggataaaccagaa

SEQ ID NO: 8230667 - DNA, 22 bp, Homo sapiens
actatacaccaaaatattaagg

SEQ ID NO: 8230668 - DNA, 22 bp, Homo sapiens
actatacaccaaaatattaagg

SEQ ID NO: 8230669 - DNA, 22 bp, Homo sapiens
actatacaccaaaatattaagg

SEQ ID NO: 8230670 - DNA, 22 bp, Homo sapiens
actatacaccaaaatattaagg

SEQ ID NO: 8230671 - DNA, 22 bp, Homo sapiens
actatacaccaaaatattaagg

SEQ ID NO: 8230672 - DNA, 22 bp, Homo sapiens
actataacccatggaatataag

SEQ ID NO: 8230673 - DNA, 23 bp, Homo sapiens
actataaagttgttctgatttac

SEQ ID NO: 8230674 - DNA, 23 bp, Homo sapiens
actataaagttgttctgatttac

SEQ ID NO: 8230675 - DNA, 22 bp, Homo sapiens
actctcactagctctgtgacct

SEQ ID NO: 8230676 - DNA, 22 bp, Homo sapiens
actctcactgcttggctcctgc

SEQ ID NO: 8230677 - DNA, 21 bp, Homo sapiens
actctatttcagtttcaacaa

SEQ ID NO: 8230678 - DNA, 22 bp, Homo sapiens
actctccagggatttaggatgg

SEQ ID NO: 8230679 - DNA, 22 bp, Homo sapiens
actctccacccactcactctgt

SEQ ID NO: 8230680 - DNA, 23 bp, Homo sapiens
actctcaggttctttccagcagg

SEQ ID NO: 8230681 - DNA, 23 bp, Homo sapiens
actctcaggttctttccagcagg

SEQ ID NO: 8230682 - DNA, 22 bp, Homo sapiens
actctccctgctatccacttcc

SEQ ID NO: 8230683 - DNA, 22 bp, Homo sapiens
actctccctgctatccacttcc

SEQ ID NO: 8230684 - DNA, 22 bp, Homo sapiens
actctcccacgttcgactctaa

SEQ ID NO: 8230685 - DNA, 22 bp, Homo sapiens
actctcccagctatatgtggtg

SEQ ID NO: 8230686 - DNA, 22 bp, Homo sapiens
actctcccagctatatgtggtg

SEQ ID NO: 8230687 - DNA, 22 bp, Homo sapiens
actctcccacgttcgactctaa

SEQ ID NO: 8230688 - DNA, 22 bp, Homo sapiens
actcagagaacattcccagtct

SEQ ID NO: 8230689 - DNA, 22 bp, Homo sapiens
actcagagaaacagcagggtgt

SEQ ID NO: 8230690 - DNA, 22 bp, Homo sapiens
actcagagaaacagcagggtgt

SEQ ID NO: 8230691 - DNA, 22 bp, Homo sapiens
actcagagaaacagcagggtgt

SEQ ID NO: 8230692 - DNA, 22 bp, Homo sapiens
actcagacttgcttcctggtgc

SEQ ID NO: 8230693 - DNA, 22 bp, Homo sapiens
actcagacgaaaacatgaacat

SEQ ID NO: 8230694 - DNA, 22 bp, Homo sapiens
actcagactataagcttatttt

SEQ ID NO: 8230695 - DNA, 22 bp, Homo sapiens
actcagactataagcttatttt

SEQ ID NO: 8230696 - DNA, 22 bp, Homo sapiens
actcagacttgcttcctggtgc

SEQ ID NO: 8230697 - DNA, 22 bp, Homo sapiens
actcagacagaccaaagttctg

SEQ ID NO: 8230698 - DNA, 22 bp, Homo sapiens
actcagacatgccttttacttc

SEQ ID NO: 8230699 - DNA, 22 bp, Homo sapiens
actcagacagaccaaagttctg

SEQ ID NO: 8230700 - DNA, 22 bp, Homo sapiens
actcagacatgccttttacttc

SEQ ID NO: 8230701 - DNA, 23 bp, Homo sapiens
actcagagaccccgggaagtgac

SEQ ID NO: 8230702 - DNA, 23 bp, Homo sapiens
actccccagtctcttcttgccaa

SEQ ID NO: 8230703 - DNA, 22 bp, Homo sapiens
actcagagaatatctagaagga

SEQ ID NO: 8230704 - DNA, 22 bp, Homo sapiens
actcagagaactggattagagg

SEQ ID NO: 8230705 - DNA, 22 bp, Homo sapiens
actcagagaatatctagaagga

SEQ ID NO: 8230706 - DNA, 19 bp, Homo sapiens
actctacagtgtgtacaac

SEQ ID NO: 8230707 - DNA, 22 bp, Homo sapiens
actctaccatgccactccatag

SEQ ID NO: 8230708 - DNA, 19 bp, Homo sapiens
actctacagtgtgtacaac

SEQ ID NO: 8230709 - DNA, 22 bp, Homo sapiens
actctacagaatgaatacctgt

SEQ ID NO: 8230710 - DNA, 22 bp, Homo sapiens
actccctccaaatctgcacagt

SEQ ID NO: 8230711 - DNA, 22 bp, Homo sapiens
actctaaatagcctcttaaaca

SEQ ID NO: 8230712 - DNA, 22 bp, Homo sapiens
actctaaattgtgccaatatgc

SEQ ID NO: 8230713 - DNA, 22 bp, Homo sapiens
aataccttttcagtgcacaaaa

SEQ ID NO: 8230714 - DNA, 22 bp, Homo sapiens
aatacagaggaaacatttaata

SEQ ID NO: 8230715 - DNA, 22 bp, Homo sapiens
aatacagaggaaacatttaata

SEQ ID NO: 8230716 - DNA, 22 bp, Homo sapiens
actggctgaggaagttgccact

SEQ ID NO: 8230717 - DNA, 22 bp, Homo sapiens
actggctgaggaagttgccact

SEQ ID NO: 8230718 - DNA, 22 bp, Homo sapiens
actggctgaagtttactttttg

SEQ ID NO: 8230719 - DNA, 22 bp, Homo sapiens
actggctgaaagtaaagaacac

SEQ ID NO: 8230720 - DNA, 22 bp, Homo sapiens
actggcccttgattgcatcagc

SEQ ID NO: 8230721 - DNA, 22 bp, Homo sapiens
actggccctggctgctaggctg

SEQ ID NO: 8230722 - DNA, 22 bp, Homo sapiens
actggccatgggatttatattt

SEQ ID NO: 8230723 - DNA, 22 bp, Homo sapiens
actggcccgggagcagaggcct

SEQ ID NO: 8230724 - DNA, 22 bp, Homo sapiens
actggcctatcagcatgagtct

SEQ ID NO: 8230725 - DNA, 22 bp, Homo sapiens
actggcctatcagcatgagtct

SEQ ID NO: 8230726 - DNA, 22 bp, Homo sapiens
actggctgaaagtaaagaacac

SEQ ID NO: 8230727 - DNA, 22 bp, Homo sapiens
actggccaggcagcagtagctt

SEQ ID NO: 8230728 - DNA, 22 bp, Homo sapiens
actggccaggcagcagtagctt

SEQ ID NO: 8230729 - DNA, 22 bp, Homo sapiens
actggccatgaacttgggatct

SEQ ID NO: 8230730 - DNA, 22 bp, Homo sapiens
actggccaggcacagctgtggg

SEQ ID NO: 8230731 - DNA, 22 bp, Homo sapiens
actggccaggcacagctgtggg

SEQ ID NO: 8230732 - DNA, 22 bp, Homo sapiens
actggccaggcacagctgtggg

SEQ ID NO: 8230733 - DNA, 22 bp, Homo sapiens
actggccagaactaagtcacat

SEQ ID NO: 8230734 - DNA, 22 bp, Homo sapiens
actggactcacgtattcctgag

SEQ ID NO: 8230735 - DNA, 22 bp, Homo sapiens
actggagactgtgtcttttgat

SEQ ID NO: 8230736 - DNA, 22 bp, Homo sapiens
actggagactgtgtcttttgat

SEQ ID NO: 8230737 - DNA, 22 bp, Homo sapiens
actggagactgtgtcttttgat

SEQ ID NO: 8230738 - DNA, 19 bp, Homo sapiens
actggagcctgatggagga

SEQ ID NO: 8230739 - DNA, 22 bp, Homo sapiens
actggacagaggaaatatggag

SEQ ID NO: 8230740 - DNA, 22 bp, Homo sapiens
actgcactccagcctgggtgac

SEQ ID NO: 8230741 - DNA, 22 bp, Homo sapiens
actggaggcccctcccagtgaa

SEQ ID NO: 8230742 - DNA, 22 bp, Homo sapiens
actggaggggaaaatggtagta

SEQ ID NO: 8230743 - DNA, 22 bp, Homo sapiens
actggaggggaaaatggtagta

SEQ ID NO: 8230744 - DNA, 22 bp, Homo sapiens
actggaggggaaaatggtagta

SEQ ID NO: 8230745 - DNA, 22 bp, Homo sapiens
actggagtaaaggtcacttgtg

SEQ ID NO: 8230746 - DNA, 22 bp, Homo sapiens
actggagtaaaggtcacttgtg

SEQ ID NO: 8230747 - DNA, 22 bp, Homo sapiens
actggagtacagtggcgtgaac

SEQ ID NO: 8230748 - DNA, 22 bp, Homo sapiens
actggagctgagagcatgggta

SEQ ID NO: 8230749 - DNA, 22 bp, Homo sapiens
actggagcttctaaggaggagt

SEQ ID NO: 8230750 - DNA, 22 bp, Homo sapiens
actggaggattcctggaaggcg

SEQ ID NO: 8230751 - DNA, 22 bp, Homo sapiens
actggaggcccctcccagtgaa

SEQ ID NO: 8230752 - DNA, 22 bp, Homo sapiens
actggaggattcctggaaggcg

SEQ ID NO: 8230753 - DNA, 22 bp, Homo sapiens
actggccagaactaagtcacat

SEQ ID NO: 8230754 - DNA, 22 bp, Homo sapiens
actggagttcatggtaaagtca

SEQ ID NO: 8230755 - DNA, 22 bp, Homo sapiens
actggagttattatttgcagct

SEQ ID NO: 8230756 - DNA, 20 bp, Homo sapiens
actggagttcatgctaagag

SEQ ID NO: 8230757 - DNA, 16 bp, Homo sapiens
actggagtggggatgc

SEQ ID NO: 8230758 - DNA, 22 bp, Homo sapiens
actggagtgagtatcgatgaac

SEQ ID NO: 8230759 - DNA, 22 bp, Homo sapiens
actggagtgtttggaggatgca

SEQ ID NO: 8230760 - DNA, 22 bp, Homo sapiens
actggagtgtttggaggatgca

SEQ ID NO: 8230761 - DNA, 22 bp, Homo sapiens
actggagtacagtggcgtgaac

SEQ ID NO: 8230762 - DNA, 20 bp, Homo sapiens
actggagtaccctagagaag

SEQ ID NO: 8230763 - DNA, 20 bp, Homo sapiens
actggagtaccctagagaag

SEQ ID NO: 8230764 - DNA, 22 bp, Homo sapiens
actggagtagatctgactgagt

SEQ ID NO: 8230765 - DNA, 22 bp, Homo sapiens
actggagtagatctgactgagt

SEQ ID NO: 8230766 - DNA, 22 bp, Homo sapiens
actggagtattgtttaatacca

SEQ ID NO: 8230767 - DNA, 22 bp, Homo sapiens
actggagtattgtttaatacca

SEQ ID NO: 8230768 - DNA, 22 bp, Homo sapiens
actggagtcagggaaaaagtgt

SEQ ID NO: 8230769 - DNA, 22 bp, Homo sapiens
actggagtgagtatcgatgaac

SEQ ID NO: 8230770 - DNA, 22 bp, Homo sapiens
actggagtccagacccaagagg

SEQ ID NO: 8230771 - DNA, 22 bp, Homo sapiens
actgcactccagcctgggtaac

SEQ ID NO: 8230772 - DNA, 22 bp, Homo sapiens
actgcactccagcctgggtaac

SEQ ID NO: 8230773 - DNA, 22 bp, Homo sapiens
actgcactccagcctgggtgac

SEQ ID NO: 8230774 - DNA, 22 bp, Homo sapiens
actgcactccaacctgggtgac

SEQ ID NO: 8230775 - DNA, 22 bp, Homo sapiens
actgcactccaacctgggtgac

SEQ ID NO: 8230776 - DNA, 22 bp, Homo sapiens
actgcactccaacctgggtgac

SEQ ID NO: 8230777 - DNA, 22 bp, Homo sapiens
actgatcacagatatgtatatt

SEQ ID NO: 8230778 - DNA, 22 bp, Homo sapiens
actgatcaagggtttaatttta

SEQ ID NO: 8230779 - DNA, 22 bp, Homo sapiens
actgatcaagggtttaatttta

SEQ ID NO: 8230780 - DNA, 22 bp, Homo sapiens
actgagtgtccactatgagcca

SEQ ID NO: 8230781 - DNA, 22 bp, Homo sapiens
actgaggtttttagtgttaaat

SEQ ID NO: 8230782 - DNA, 22 bp, Homo sapiens
actgataagttgcttgctctca

SEQ ID NO: 8230783 - DNA, 22 bp, Homo sapiens
actgagtggctggggagtggca

SEQ ID NO: 8230784 - DNA, 22 bp, Homo sapiens
actgagtgggaggtttgtgtga

SEQ ID NO: 8230785 - DNA, 22 bp, Homo sapiens
actgagtgtaggactttgagtt

SEQ ID NO: 8230786 - DNA, 22 bp, Homo sapiens
actgaggtttttagtgttaaat

SEQ ID NO: 8230787 - DNA, 22 bp, Homo sapiens
actgaggttgtagtaggaattc

SEQ ID NO: 8230788 - DNA, 22 bp, Homo sapiens
actgaggtttacttgaaggaga

SEQ ID NO: 8230789 - DNA, 22 bp, Homo sapiens
actgaggtttacttgaaggaga

SEQ ID NO: 8230790 - DNA, 22 bp, Homo sapiens
actgaggtttcattttatcgct

SEQ ID NO: 8230791 - DNA, 22 bp, Homo sapiens
actgaggttattgcaataaaat

SEQ ID NO: 8230792 - DNA, 22 bp, Homo sapiens
actgaggttgaaatagtgatgt

SEQ ID NO: 8230793 - DNA, 20 bp, Homo sapiens
actgaggttagataacaggt

SEQ ID NO: 8230794 - DNA, 21 bp, Homo sapiens
actgaggttagatgccttgcc

SEQ ID NO: 8230795 - DNA, 22 bp, Homo sapiens
actgaggttgaaatagtgatgt

SEQ ID NO: 8230796 - DNA, 22 bp, Homo sapiens
actgaggttgtagtaggaattc

SEQ ID NO: 8230797 - DNA, 22 bp, Homo sapiens
actctccctgctatccacttcc

SEQ ID NO: 8230798 - DNA, 22 bp, Homo sapiens
actctcccttatctaactttac

SEQ ID NO: 8230799 - DNA, 22 bp, Homo sapiens
actctgctcttatagtgttata

SEQ ID NO: 8230800 - DNA, 22 bp, Homo sapiens
actctgctgtttactctctata

SEQ ID NO: 8230801 - DNA, 22 bp, Homo sapiens
actctgcttgggccatatctgg

SEQ ID NO: 8230802 - DNA, 22 bp, Homo sapiens
actctgcttgggccatatctgg

SEQ ID NO: 8230803 - DNA, 22 bp, Homo sapiens
actctgcttgggccatatctgg

SEQ ID NO: 8230804 - DNA, 22 bp, Homo sapiens
actctggagatggatgtcagga

SEQ ID NO: 8230805 - DNA, 22 bp, Homo sapiens
actctggagatggatgtcagga

SEQ ID NO: 8230806 - DNA, 22 bp, Homo sapiens
actgagagaacgggctgctccc

SEQ ID NO: 8230807 - DNA, 22 bp, Homo sapiens
actgagactttgttgagttctt

SEQ ID NO: 8230808 - DNA, 22 bp, Homo sapiens
actctggcgggcgggcgagcca

SEQ ID NO: 8230809 - DNA, 22 bp, Homo sapiens
actgaggtagggcacacctagg

SEQ ID NO: 8230810 - DNA, 22 bp, Homo sapiens
actgaggtataattgacataac

SEQ ID NO: 8230811 - DNA, 23 bp, Homo sapiens
actgaggtactgaggttgtgaca

SEQ ID NO: 8230812 - DNA, 22 bp, Homo sapiens
actgaggtctatcatgagccag

SEQ ID NO: 8230813 - DNA, 22 bp, Homo sapiens
actgaggtataattgacataac

SEQ ID NO: 8230814 - DNA, 22 bp, Homo sapiens
actgaggtcaggggtatgtgat

SEQ ID NO: 8230815 - DNA, 22 bp, Homo sapiens
actgaggtctatcatgagccag

SEQ ID NO: 8230816 - DNA, 22 bp, Homo sapiens
actgaggtcaggggtatgtgat

SEQ ID NO: 8230817 - DNA, 22 bp, Homo sapiens
actgaggtcatgcatagtttct

SEQ ID NO: 8230818 - DNA, 22 bp, Homo sapiens
actgaggtctcaggtggggaag

SEQ ID NO: 8230819 - DNA, 22 bp, Homo sapiens
actgaggtctcaggtggggaag

SEQ ID NO: 8230820 - DNA, 22 bp, Homo sapiens
actgaggtggggtctgcttgga

SEQ ID NO: 8230821 - DNA, 22 bp, Homo sapiens
actgaggtggggtctgcttgga

SEQ ID NO: 8230822 - DNA, 22 bp, Homo sapiens
aatgattgtcattccaaaaagt

SEQ ID NO: 8230823 - DNA, 23 bp, Homo sapiens
aatgatttcatgatgatagcagc

SEQ ID NO: 8230824 - DNA, 23 bp, Homo sapiens
aatgatttcatgatgatagcagc

SEQ ID NO: 8230825 - DNA, 23 bp, Homo sapiens
aatgatttcatgatgatagcagc

SEQ ID NO: 8230826 - DNA, 22 bp, Homo sapiens
aatgattctatttgcagcttgg

SEQ ID NO: 8230827 - DNA, 22 bp, Homo sapiens
aatgatggatttagacaagctg

SEQ ID NO: 8230828 - DNA, 22 bp, Homo sapiens
aatgatgagttctaatagaccc

SEQ ID NO: 8230829 - DNA, 22 bp, Homo sapiens
aatgatggttaaacactggagg

SEQ ID NO: 8230830 - DNA, 22 bp, Homo sapiens
aatgatggtttcatcacttgaa

SEQ ID NO: 8230831 - DNA, 22 bp, Homo sapiens
agaagcagaaaagggcactttt

SEQ ID NO: 8230832 - DNA, 22 bp, Homo sapiens
agaagcagaaactgggcttgtg

SEQ ID NO: 8230833 - DNA, 22 bp, Homo sapiens
agaagcagaaggaagcagggcc

SEQ ID NO: 8230834 - DNA, 22 bp, Homo sapiens
agaagcagaaggaagcagggcc

SEQ ID NO: 8230835 - DNA, 23 bp, Homo sapiens
aatgatttcatgatgatagcagc

SEQ ID NO: 8230836 - DNA, 22 bp, Homo sapiens
aatgatttcccctacacagaag

SEQ ID NO: 8230837 - DNA, 22 bp, Homo sapiens
aatgatttcccctacacagaag

SEQ ID NO: 8230838 - DNA, 22 bp, Homo sapiens
aatgatttcccctacacagaag

SEQ ID NO: 8230839 - DNA, 22 bp, Homo sapiens
aatgatttggcaaaggaatcca

SEQ ID NO: 8230840 - DNA, 22 bp, Homo sapiens
aatgcaaacagcccagaatcca

SEQ ID NO: 8230841 - DNA, 22 bp, Homo sapiens
agaaatgacacacatgagacat

SEQ ID NO: 8230842 - DNA, 22 bp, Homo sapiens
agaaatgacacacatgagacat

SEQ ID NO: 8230843 - DNA, 22 bp, Homo sapiens
agaaatgacacacatgagacat

SEQ ID NO: 8230844 - DNA, 22 bp, Homo sapiens
agaaatgacacacatgagacat

SEQ ID NO: 8230845 - DNA, 22 bp, Homo sapiens
agaaatgacacacatgagacat

SEQ ID NO: 8230846 - DNA, 22 bp, Homo sapiens
agaaattctaagcatcaatagc

SEQ ID NO: 8230847 - DNA, 22 bp, Homo sapiens
agaaattcaattctaattagct

SEQ ID NO: 8230848 - DNA, 22 bp, Homo sapiens
agaaattgccagaatgtcaggc

SEQ ID NO: 8230849 - DNA, 22 bp, Homo sapiens
agaacaaggctgtttccaatgc

SEQ ID NO: 8230850 - DNA, 23 bp, Homo sapiens
aatgagttgggcagcatacaggc

SEQ ID NO: 8230851 - DNA, 23 bp, Homo sapiens
aatgagttgggcagcatacaggc

SEQ ID NO: 8230852 - DNA, 22 bp, Homo sapiens
aatgatgagttctaatagaccc

SEQ ID NO: 8230853 - DNA, 22 bp, Homo sapiens
aatgataagacatgagtagagg

SEQ ID NO: 8230854 - DNA, 22 bp, Homo sapiens
aatgagttctggttcattttat

SEQ ID NO: 8230855 - DNA, 22 bp, Homo sapiens
agaacaatgttaaattattaag

SEQ ID NO: 8230856 - DNA, 22 bp, Homo sapiens
agaacaatgaggtatggatgga

SEQ ID NO: 8230857 - DNA, 22 bp, Homo sapiens
agaaatgaaaccaaagcctaga

SEQ ID NO: 8230858 - DNA, 22 bp, Homo sapiens
agaaatagcagagtcaggcggg

SEQ ID NO: 8230859 - DNA, 22 bp, Homo sapiens
agaaatactttgtaaatctcac

SEQ ID NO: 8230860 - DNA, 22 bp, Homo sapiens
agaaatagaggaaaggtttgac

SEQ ID NO: 8230861 - DNA, 22 bp, Homo sapiens
agaaatgaagagagtcaaggtt

SEQ ID NO: 8230862 - DNA, 22 bp, Homo sapiens
agaaatgaagagagtcaaggtt

SEQ ID NO: 8230863 - DNA, 22 bp, Homo sapiens
agaaatgaaaccaaagcctaga

SEQ ID NO: 8230864 - DNA, 22 bp, Homo sapiens
agaaatgaaaccaaagcctaga

SEQ ID NO: 8230865 - DNA, 22 bp, Homo sapiens
agaaatgacaagactgatcagg

SEQ ID NO: 8230866 - DNA, 22 bp, Homo sapiens
agaaatgacaagactgatcagg

SEQ ID NO: 8230867 - DNA, 22 bp, Homo sapiens
agaaatgacaagactgatcagg

SEQ ID NO: 8230868 - DNA, 22 bp, Homo sapiens
agaaatgacaagactgatcagg

SEQ ID NO: 8230869 - DNA, 22 bp, Homo sapiens
agaaatgacaagactgatcagg

SEQ ID NO: 8230870 - DNA, 22 bp, Homo sapiens
agaaatgaagcaggagttatta

SEQ ID NO: 8230871 - DNA, 22 bp, Homo sapiens
agaaatgaatatgtagtggtta

SEQ ID NO: 8230872 - DNA, 22 bp, Homo sapiens
agaaatgaagcaggagttatta

SEQ ID NO: 8230873 - DNA, 22 bp, Homo sapiens
aatcataattcaaataagctta

SEQ ID NO: 8230874 - DNA, 22 bp, Homo sapiens
agaaatactttgtaaatctcac

SEQ ID NO: 8230875 - DNA, 22 bp, Homo sapiens
aatcagttgtccaaagttcaca

SEQ ID NO: 8230876 - DNA, 22 bp, Homo sapiens
aatcagtttcttggcaagttta

SEQ ID NO: 8230877 - DNA, 23 bp, Homo sapiens
aatcagtgcagttttatgccaag

SEQ ID NO: 8230878 - DNA, 22 bp, Homo sapiens
aatcagaatcagttgacacagc

SEQ ID NO: 8230879 - DNA, 22 bp, Homo sapiens
aatcagaccgttctggctgtcc

SEQ ID NO: 8230880 - DNA, 22 bp, Homo sapiens
aatcagacagttctggattcaa

SEQ ID NO: 8230881 - DNA, 22 bp, Homo sapiens
aatcagagccctctgagcttca

SEQ ID NO: 8230882 - DNA, 17 bp, Homo sapiens
aatcagatttctgagga

SEQ ID NO: 8230883 - DNA, 22 bp, Homo sapiens
aatcagatgaatcaatatatcc

SEQ ID NO: 8230884 - DNA, 22 bp, Homo sapiens
aatcagcaaatgcttactcagg

SEQ ID NO: 8230885 - DNA, 22 bp, Homo sapiens
aatcagcaggcttctaaatttt

SEQ ID NO: 8230886 - DNA, 22 bp, Homo sapiens
aatcagccatttttccaaggag

SEQ ID NO: 8230887 - DNA, 22 bp, Homo sapiens
aatcaggacccactctacagtt

SEQ ID NO: 8230888 - DNA, 22 bp, Homo sapiens
aatcaggatgactgtcatttca

SEQ ID NO: 8230889 - DNA, 22 bp, Homo sapiens
aatactgaattagttgagacaa

SEQ ID NO: 8230890 - DNA, 22 bp, Homo sapiens
actgggctgcctggttcttcta

SEQ ID NO: 8230891 - DNA, 22 bp, Homo sapiens
aatactgcctgtgaggtaactc

SEQ ID NO: 8230892 - DNA, 22 bp, Homo sapiens
aatactgcctgtgaggtaactc

SEQ ID NO: 8230893 - DNA, 22 bp, Homo sapiens
aatactgcctgtgaggtaactc

SEQ ID NO: 8230894 - DNA, 22 bp, Homo sapiens
aatactgcctgtgaggtaactc

SEQ ID NO: 8230895 - DNA, 22 bp, Homo sapiens
aatactatgtagccaaaataat

SEQ ID NO: 8230896 - DNA, 22 bp, Homo sapiens
aatactatgtagccaaaataat

SEQ ID NO: 8230897 - DNA, 22 bp, Homo sapiens
aatactatgtagccaaaataat

SEQ ID NO: 8230898 - DNA, 22 bp, Homo sapiens
aatactagttattaaagctttt

SEQ ID NO: 8230899 - DNA, 20 bp, Homo sapiens
aatactaaacacaaagcagt

SEQ ID NO: 8230900 - DNA, 20 bp, Homo sapiens
aatactaaacacaaagcagt

SEQ ID NO: 8230901 - DNA, 22 bp, Homo sapiens
actgggcttatgctgtggagta

SEQ ID NO: 8230902 - DNA, 23 bp, Homo sapiens
actgggcttatgaggaggcttgt

SEQ ID NO: 8230903 - DNA, 23 bp, Homo sapiens
actgggcttatgaggaggcttgt

SEQ ID NO: 8230904 - DNA, 22 bp, Homo sapiens
actgggctgttttttgagtgga

SEQ ID NO: 8230905 - DNA, 22 bp, Homo sapiens
actgggctgttttttgagtgga

SEQ ID NO: 8230906 - DNA, 22 bp, Homo sapiens
actgggctgttttttgagtgga

SEQ ID NO: 8230907 - DNA, 22 bp, Homo sapiens
actgggctgttttttgagtgga

SEQ ID NO: 8230908 - DNA, 22 bp, Homo sapiens
actgggctgttccttatttcta

SEQ ID NO: 8230909 - DNA, 22 bp, Homo sapiens
actgggcttcacttggcacatc

SEQ ID NO: 8230910 - DNA, 22 bp, Homo sapiens
actgggcttatttcttgtgaac

SEQ ID NO: 8230911 - DNA, 22 bp, Homo sapiens
actgggcttatgctgtggagta

SEQ ID NO: 8230912 - DNA, 22 bp, Homo sapiens
actgggcttatgctgtggagta

SEQ ID NO: 8230913 - DNA, 22 bp, Homo sapiens
actgggcttatgctgtggagta

SEQ ID NO: 8230914 - DNA, 22 bp, Homo sapiens
actgggcttatgctgtggagta

SEQ ID NO: 8230915 - DNA, 22 bp, Homo sapiens
actgggctgtaaagagaggcaa

SEQ ID NO: 8230916 - DNA, 22 bp, Homo sapiens
actgggctggttagttttacta

SEQ ID NO: 8230917 - DNA, 22 bp, Homo sapiens
actgggctggggctcattctcc

SEQ ID NO: 8230918 - DNA, 22 bp, Homo sapiens
actgggctgcttgagtgccttc

SEQ ID NO: 8230919 - DNA, 22 bp, Homo sapiens
actgggctgcttgagtgccttc

SEQ ID NO: 8230920 - DNA, 22 bp, Homo sapiens
actgggctgtggacacccagcg

SEQ ID NO: 8230921 - DNA, 22 bp, Homo sapiens
actgggctgtggacacccagcg

SEQ ID NO: 8230922 - DNA, 22 bp, Homo sapiens
actgggctgtaaagagaggcaa

SEQ ID NO: 8230923 - DNA, 22 bp, Homo sapiens
actgggctgtaaagagaggcaa

SEQ ID NO: 8230924 - DNA, 22 bp, Homo sapiens
actgggctgtaaagagaggcaa

SEQ ID NO: 8230925 - DNA, 22 bp, Homo sapiens
actgggctgtaaagagaggcaa

SEQ ID NO: 8230926 - DNA, 22 bp, Homo sapiens
actgggctgtaaagagaggcaa

SEQ ID NO: 8230927 - DNA, 22 bp, Homo sapiens
aatatagatttactcaagagaa

SEQ ID NO: 8230928 - DNA, 22 bp, Homo sapiens
aatatagatttactcaagagaa

SEQ ID NO: 8230929 - DNA, 22 bp, Homo sapiens
aatatagaatcactttccttca

SEQ ID NO: 8230930 - DNA, 22 bp, Homo sapiens
aatatagaatcactttccttca

SEQ ID NO: 8230931 - DNA, 22 bp, Homo sapiens
aatatactatactactttctgg

SEQ ID NO: 8230932 - DNA, 22 bp, Homo sapiens
aatatactatactactttctgg

SEQ ID NO: 8230933 - DNA, 22 bp, Homo sapiens
aatatactatactactttctgg

SEQ ID NO: 8230934 - DNA, 22 bp, Homo sapiens
aatatactatactactttctgg

SEQ ID NO: 8230935 - DNA, 22 bp, Homo sapiens
aatataattttattcctagagt

SEQ ID NO: 8230936 - DNA, 22 bp, Homo sapiens
aatataattttattcctagagt

SEQ ID NO: 8230937 - DNA, 22 bp, Homo sapiens
aatataattttattcctagagt

SEQ ID NO: 8230938 - DNA, 22 bp, Homo sapiens
aatagtatttatttggaaaaag

SEQ ID NO: 8230939 - DNA, 22 bp, Homo sapiens
actgggcttcacttggcacatc

SEQ ID NO: 8230940 - DNA, 22 bp, Homo sapiens
actgggcttcacttggcacatc

SEQ ID NO: 8230941 - DNA, 22 bp, Homo sapiens
aatatagttctagaaatatttt

SEQ ID NO: 8230942 - DNA, 22 bp, Homo sapiens
aatatagttctagaaatatttt

SEQ ID NO: 8230943 - DNA, 22 bp, Homo sapiens
aatatagttctagaaatatttt

SEQ ID NO: 8230944 - DNA, 22 bp, Homo sapiens
aatatagttctagaaatatttt

SEQ ID NO: 8230945 - DNA, 22 bp, Homo sapiens
aatatagtgttagctcatttga

SEQ ID NO: 8230946 - DNA, 22 bp, Homo sapiens
aatatagttctagaaatatttt

SEQ ID NO: 8230947 - DNA, 22 bp, Homo sapiens
aatatagtgttagctcatttga

SEQ ID NO: 8230948 - DNA, 22 bp, Homo sapiens
aatatagctcactataccatgg

SEQ ID NO: 8230949 - DNA, 22 bp, Homo sapiens
aatatagttctggtattgttaa

SEQ ID NO: 8230950 - DNA, 22 bp, Homo sapiens
aatatagttctggtattgttaa

SEQ ID NO: 8230951 - DNA, 22 bp, Homo sapiens
aatatagttctggtattgttaa

SEQ ID NO: 8230952 - DNA, 22 bp, Homo sapiens
aatatagttctggtattgttaa

SEQ ID NO: 8230953 - DNA, 22 bp, Homo sapiens
actttcttggtcccatgtttga

SEQ ID NO: 8230954 - DNA, 22 bp, Homo sapiens
actttcttggtcccatgtttga

SEQ ID NO: 8230955 - DNA, 22 bp, Homo sapiens
actttcttcttatgcattaagg

SEQ ID NO: 8230956 - DNA, 22 bp, Homo sapiens
actttcttcttatgcattaagg

SEQ ID NO: 8230957 - DNA, 22 bp, Homo sapiens
actttcttatccatgatctcac

SEQ ID NO: 8230958 - DNA, 22 bp, Homo sapiens
actttcttctactacttggaga

SEQ ID NO: 8230959 - DNA, 22 bp, Homo sapiens
actttcttctactacttggaga

SEQ ID NO: 8230960 - DNA, 22 bp, Homo sapiens
actttcttaggctgtataaatg

SEQ ID NO: 8230961 - DNA, 22 bp, Homo sapiens
actttcttaggctgtataaatg

SEQ ID NO: 8230962 - DNA, 22 bp, Homo sapiens
actttctgttagatgaatggat

SEQ ID NO: 8230963 - DNA, 22 bp, Homo sapiens
actttcttaggctgtataaatg

SEQ ID NO: 8230964 - DNA, 22 bp, Homo sapiens
actttatttcctattgcatcca

SEQ ID NO: 8230965 - DNA, 22 bp, Homo sapiens
actttatttcctattgcatcca

SEQ ID NO: 8230966 - DNA, 22 bp, Homo sapiens
actttatttcctattgcatcca

SEQ ID NO: 8230967 - DNA, 22 bp, Homo sapiens
actttctgttagatgaatggat

SEQ ID NO: 8230968 - DNA, 22 bp, Homo sapiens
aatcagaaattctacatcacaa

SEQ ID NO: 8230969 - DNA, 22 bp, Homo sapiens
aatcacatctcattcaacagcc

SEQ ID NO: 8230970 - DNA, 22 bp, Homo sapiens
aatcagaaagaggtcatgttgc

SEQ ID NO: 8230971 - DNA, 22 bp, Homo sapiens
actttcttggtcccatgtttga

SEQ ID NO: 8230972 - DNA, 22 bp, Homo sapiens
actttgaaactaaaattcatta

SEQ ID NO: 8230973 - DNA, 22 bp, Homo sapiens
actttatgacaccctttagtga

SEQ ID NO: 8230974 - DNA, 22 bp, Homo sapiens
actttaaaactgatcatcagag

SEQ ID NO: 8230975 - DNA, 22 bp, Homo sapiens
actgttgaagtgccagcttgat

SEQ ID NO: 8230976 - DNA, 22 bp, Homo sapiens
actgttgaagtgccagcttgat

SEQ ID NO: 8230977 - DNA, 22 bp, Homo sapiens
actgttcttcatttagcaaaga

SEQ ID NO: 8230978 - DNA, 22 bp, Homo sapiens
actgttgaagtgccagcttgat

SEQ ID NO: 8230979 - DNA, 22 bp, Homo sapiens
actgttcttcccatttatattg

SEQ ID NO: 8230980 - DNA, 22 bp, Homo sapiens
actgttctgcatgctgtgaggg

SEQ ID NO: 8230981 - DNA, 22 bp, Homo sapiens
actgttctgcatgtacctgagg

SEQ ID NO: 8230982 - DNA, 22 bp, Homo sapiens
actgttctcctttggctatatc

SEQ ID NO: 8230983 - DNA, 22 bp, Homo sapiens
actgttctgccaagatcaacgt

SEQ ID NO: 8230984 - DNA, 19 bp, Homo sapiens
actgttctgtatgttgatt

SEQ ID NO: 8230985 - DNA, 23 bp, Homo sapiens
actttattgaccccaggtcagtt

SEQ ID NO: 8230986 - DNA, 23 bp, Homo sapiens
actttattgaccccaggtcagtt

SEQ ID NO: 8230987 - DNA, 23 bp, Homo sapiens
actttattgaccccaggtcagtt

SEQ ID NO: 8230988 - DNA, 23 bp, Homo sapiens
actttattgaccccaggtcagtt

SEQ ID NO: 8230989 - DNA, 23 bp, Homo sapiens
actttattgaccccaggtcagtt

SEQ ID NO: 8230990 - DNA, 23 bp, Homo sapiens
actttattgaccccaggtcagtt

SEQ ID NO: 8230991 - DNA, 23 bp, Homo sapiens
actttattgaccccaggtcagtt

SEQ ID NO: 8230992 - DNA, 23 bp, Homo sapiens
actttattgaccccaggtcagtt

SEQ ID NO: 8230993 - DNA, 22 bp, Homo sapiens
actttatttcctattgcatcca

SEQ ID NO: 8230994 - DNA, 22 bp, Homo sapiens
actttatttcctattgcatcca

SEQ ID NO: 8230995 - DNA, 22 bp, Homo sapiens
actttatttcctattgcatcca

SEQ ID NO: 8230996 - DNA, 22 bp, Homo sapiens
actttaaaactgatcatcagag

SEQ ID NO: 8230997 - DNA, 21 bp, Homo sapiens
actttatgacctacccttttt

SEQ ID NO: 8230998 - DNA, 20 bp, Homo sapiens
actttatgagttcaattttg

SEQ ID NO: 8230999 - DNA, 22 bp, Homo sapiens
actttatgctaaactttactct

SEQ ID NO: 8231000 - DNA, 22 bp, Homo sapiens
actttatgatacagggaagggt

SEQ ID NO: 8231001 - DNA, 20 bp, Homo sapiens
actttatgagttcaattttg

SEQ ID NO: 8231002 - DNA, 22 bp, Homo sapiens
actttatgtgcttgctctttcc

SEQ ID NO: 8231003 - DNA, 22 bp, Homo sapiens
actttatgtttgatatctatgg

SEQ ID NO: 8231004 - DNA, 22 bp, Homo sapiens
actttatgtttgatatctatgg

SEQ ID NO: 8231005 - DNA, 23 bp, Homo sapiens
actttattgaccccaggtcagtt

SEQ ID NO: 8231006 - DNA, 23 bp, Homo sapiens
actttattgaccccaggtcagtt

SEQ ID NO: 8231007 - DNA, 23 bp, Homo sapiens
actttattgaccccaggtcagtt

SEQ ID NO: 8231008 - DNA, 22 bp, Homo sapiens
acattgttgtttgcagcacagg

SEQ ID NO: 8231009 - DNA, 22 bp, Homo sapiens
acattgtttctgaccatgatga

SEQ ID NO: 8231010 - DNA, 22 bp, Homo sapiens
acattgttgtgcaattatagtt

SEQ ID NO: 8231011 - DNA, 22 bp, Homo sapiens
acattgttgtgcaattatagtt

SEQ ID NO: 8231012 - DNA, 22 bp, Homo sapiens
acattgttgtgcaattatagtt

SEQ ID NO: 8231013 - DNA, 22 bp, Homo sapiens
acattgttgcctagccatgagt

SEQ ID NO: 8231014 - DNA, 22 bp, Homo sapiens
acattgttgagcctcttgttca

SEQ ID NO: 8231015 - DNA, 22 bp, Homo sapiens
acattgttctacttctagttag

SEQ ID NO: 8231016 - DNA, 22 bp, Homo sapiens
acattgttctacttctagttag

SEQ ID NO: 8231017 - DNA, 22 bp, Homo sapiens
acattgtttgagaatacagatg

SEQ ID NO: 8231018 - DNA, 22 bp, Homo sapiens
acattgtttggaggagtgagag

SEQ ID NO: 8231019 - DNA, 22 bp, Homo sapiens
acatttaaatacctatgtttct

SEQ ID NO: 8231020 - DNA, 22 bp, Homo sapiens
acatttaaatatgccttatatt

SEQ ID NO: 8231021 - DNA, 22 bp, Homo sapiens
acatttaaatacctatgtttct

SEQ ID NO: 8231022 - DNA, 21 bp, Homo sapiens
aaggctggagatgcaggtctg

SEQ ID NO: 8231023 - DNA, 22 bp, Homo sapiens
aaggctggagatggttggaatg

SEQ ID NO: 8231024 - DNA, 22 bp, Homo sapiens
aaggctggagatggttggaatg

SEQ ID NO: 8231025 - DNA, 22 bp, Homo sapiens
aaggctggagatggttggaatg

SEQ ID NO: 8231026 - DNA, 21 bp, Homo sapiens
aaggctggagatgcaggtctg

SEQ ID NO: 8231027 - DNA, 21 bp, Homo sapiens
aaggctggagatgcaggtctg

SEQ ID NO: 8231028 - DNA, 21 bp, Homo sapiens
aaggctggagatgcaggtctg

SEQ ID NO: 8231029 - DNA, 19 bp, Homo sapiens
aaggctggagaaggcctct

SEQ ID NO: 8231030 - DNA, 22 bp, Homo sapiens
aaggctggacctggatgaatct

SEQ ID NO: 8231031 - DNA, 22 bp, Homo sapiens
aaggctggacctggatgaatct

SEQ ID NO: 8231032 - DNA, 19 bp, Homo sapiens
aaggctggagaaggcctct

SEQ ID NO: 8231033 - DNA, 22 bp, Homo sapiens
acatttctggagtttctcaaca

SEQ ID NO: 8231034 - DNA, 22 bp, Homo sapiens
acatttctggagtttctcaaca

SEQ ID NO: 8231035 - DNA, 22 bp, Homo sapiens
acatttctggagtttctcaaca

SEQ ID NO: 8231036 - DNA, 22 bp, Homo sapiens
acatttctggagtttctcaaca

SEQ ID NO: 8231037 - DNA, 22 bp, Homo sapiens
acatttctgtcttagggactgt

SEQ ID NO: 8231038 - DNA, 22 bp, Homo sapiens
acatttctgctagaataggtga

SEQ ID NO: 8231039 - DNA, 22 bp, Homo sapiens
acatttctgctagaataggtga

SEQ ID NO: 8231040 - DNA, 22 bp, Homo sapiens
acatttctggagtttctcaaca

SEQ ID NO: 8231041 - DNA, 22 bp, Homo sapiens
acatttcttagcctagttccag

SEQ ID NO: 8231042 - DNA, 22 bp, Homo sapiens
acatttcttccacatgctgctg

SEQ ID NO: 8231043 - DNA, 22 bp, Homo sapiens
acatttcttccacatgctgctg

SEQ ID NO: 8231044 - DNA, 22 bp, Homo sapiens
acatttcttccacatgctgctg

SEQ ID NO: 8231045 - DNA, 22 bp, Homo sapiens
acatttcttccctttagcagaa

SEQ ID NO: 8231046 - DNA, 22 bp, Homo sapiens
acatttcttccctttagcagaa

SEQ ID NO: 8231047 - DNA, 22 bp, Homo sapiens
acatttcttcctaattatccct

SEQ ID NO: 8231048 - DNA, 22 bp, Homo sapiens
acatttcatgttttccagagca

SEQ ID NO: 8231049 - DNA, 22 bp, Homo sapiens
acatttcatttgcagtatggat

SEQ ID NO: 8231050 - DNA, 22 bp, Homo sapiens
aaggctgggaaacatgcaggcc

SEQ ID NO: 8231051 - DNA, 22 bp, Homo sapiens
aaggctgggaaacatgcaggcc

SEQ ID NO: 8231052 - DNA, 22 bp, Homo sapiens
acatttcatgttttccagagca

SEQ ID NO: 8231053 - DNA, 22 bp, Homo sapiens
aaggctgggaaacatgcaggcc

SEQ ID NO: 8231054 - DNA, 22 bp, Homo sapiens
aaggctgggaaacatgcaggcc

SEQ ID NO: 8231055 - DNA, 22 bp, Homo sapiens
aaggctggagatggttggaatg

SEQ ID NO: 8231056 - DNA, 22 bp, Homo sapiens
aaggctggcaatatatttgtta

SEQ ID NO: 8231057 - DNA, 22 bp, Homo sapiens
aaggctggcaatatatttgtta

SEQ ID NO: 8231058 - DNA, 22 bp, Homo sapiens
acatttctgagcagggagctgt

SEQ ID NO: 8231059 - DNA, 22 bp, Homo sapiens
acatttctgcatctcagagcta

SEQ ID NO: 8231060 - DNA, 22 bp, Homo sapiens
acatttctgcatctcagagcta

SEQ ID NO: 8231061 - DNA, 22 bp, Homo sapiens
acatttctgcatgtagggtaat

SEQ ID NO: 8231062 - DNA, 22 bp, Homo sapiens
acatttctcttgatgtctctat

SEQ ID NO: 8231063 - DNA, 22 bp, Homo sapiens
acatttctcttgatgtctctat

SEQ ID NO: 8231064 - DNA, 22 bp, Homo sapiens
acatttcatttgcagtatggat

SEQ ID NO: 8231065 - DNA, 22 bp, Homo sapiens
acatttcatttgcagtatggat

SEQ ID NO: 8231066 - DNA, 22 bp, Homo sapiens
acattcttcttgtgaatttact

SEQ ID NO: 8231067 - DNA, 22 bp, Homo sapiens
aaggctctgggtttcataggtg

SEQ ID NO: 8231068 - DNA, 22 bp, Homo sapiens
aaggctctgggtttcataggtg

SEQ ID NO: 8231069 - DNA, 22 bp, Homo sapiens
acattgttcctgagaacttggg

SEQ ID NO: 8231070 - DNA, 22 bp, Homo sapiens
acattgttccagcgatagagaa

SEQ ID NO: 8231071 - DNA, 23 bp, Homo sapiens
acattgttcaatgaaagttagga

SEQ ID NO: 8231072 - DNA, 22 bp, Homo sapiens
acattgttcacaggggcttctc

SEQ ID NO: 8231073 - DNA, 22 bp, Homo sapiens
acattgttagtagaccagtggc

SEQ ID NO: 8231074 - DNA, 22 bp, Homo sapiens
acattcttgaagtgaagtttat

SEQ ID NO: 8231075 - DNA, 22 bp, Homo sapiens
aaggctcggcaatgtgcggctc

SEQ ID NO: 8231076 - DNA, 22 bp, Homo sapiens
aaggctcctttgtagttctttt

SEQ ID NO: 8231077 - DNA, 21 bp, Homo sapiens
aaggctcctcctctaggcctc

SEQ ID NO: 8231078 - DNA, 22 bp, Homo sapiens
aaggctccgtgactggggctga

SEQ ID NO: 8231079 - DNA, 22 bp, Homo sapiens
aaggctctctgatggcagcagt

SEQ ID NO: 8231080 - DNA, 22 bp, Homo sapiens
aaggctctctgatggcagcagt

SEQ ID NO: 8231081 - DNA, 22 bp, Homo sapiens
aaggctctgcaaaacctccaag

SEQ ID NO: 8231082 - DNA, 22 bp, Homo sapiens
aaggctctgcaaaacctccaag

SEQ ID NO: 8231083 - DNA, 22 bp, Homo sapiens
aaggcggggggatcacgaggtc

SEQ ID NO: 8231084 - DNA, 22 bp, Homo sapiens
aaggctcagagcctggagctgc

SEQ ID NO: 8231085 - DNA, 22 bp, Homo sapiens
aaggctcagtaataagttggaa

SEQ ID NO: 8231086 - DNA, 22 bp, Homo sapiens
aaggctccaccctcatggatgc

SEQ ID NO: 8231087 - DNA, 22 bp, Homo sapiens
aaggctccagtgaatgctggca

SEQ ID NO: 8231088 - DNA, 22 bp, Homo sapiens
aaggctccctcttctcgagtgt

SEQ ID NO: 8231089 - DNA, 20 bp, Homo sapiens
aaggcagagtgggttggagc

SEQ ID NO: 8231090 - DNA, 20 bp, Homo sapiens
aaggcagagtgggttggagc

SEQ ID NO: 8231091 - DNA, 20 bp, Homo sapiens
aaggcagagtgggttggagc

SEQ ID NO: 8231092 - DNA, 22 bp, Homo sapiens
aaggccaggggctggcgcctcc

SEQ ID NO: 8231093 - DNA, 22 bp, Homo sapiens
aaggccaggggctggcgcctcc

SEQ ID NO: 8231094 - DNA, 22 bp, Homo sapiens
aaggccaggggctggcgcctcc

SEQ ID NO: 8231095 - DNA, 22 bp, Homo sapiens
aaggccaggggctggcgcctcc

SEQ ID NO: 8231096 - DNA, 22 bp, Homo sapiens
aaggccagggatgccagctcgg

SEQ ID NO: 8231097 - DNA, 22 bp, Homo sapiens
aaggcagataagaattcagcaa

SEQ ID NO: 8231098 - DNA, 22 bp, Homo sapiens
aaggccagggatgccagctcgg

SEQ ID NO: 8231099 - DNA, 22 bp, Homo sapiens
aaggcctcttctctctggagat

SEQ ID NO: 8231100 - DNA, 22 bp, Homo sapiens
aaggcctccctctttcatggga

SEQ ID NO: 8231101 - DNA, 22 bp, Homo sapiens
aaggcctcatgtaatcaggccc

SEQ ID NO: 8231102 - DNA, 22 bp, Homo sapiens
aaggcctccgccaatggcagag

SEQ ID NO: 8231103 - DNA, 22 bp, Homo sapiens
aaggcccttggaaaatgcagta

SEQ ID NO: 8231104 - DNA, 21 bp, Homo sapiens
aaggcctgcttactgctagtt

SEQ ID NO: 8231105 - DNA, 22 bp, Homo sapiens
aaggcctgaacatgaggagatg

SEQ ID NO: 8231106 - DNA, 22 bp, Homo sapiens
aaggccttaaagctctctccag

SEQ ID NO: 8231107 - DNA, 22 bp, Homo sapiens
aaggccttctaccaaggctggg

SEQ ID NO: 8231108 - DNA, 22 bp, Homo sapiens
aaggcctgggaggcctctcttc

SEQ ID NO: 8231109 - DNA, 22 bp, Homo sapiens
aaggccttgcctgacagcacca

SEQ ID NO: 8231110 - DNA, 22 bp, Homo sapiens
acatttgtttctctagagtagg

SEQ ID NO: 8231111 - DNA, 22 bp, Homo sapiens
acatttgtttctctagagtagg

SEQ ID NO: 8231112 - DNA, 22 bp, Homo sapiens
acattttaatatgcttagtgtg

SEQ ID NO: 8231113 - DNA, 22 bp, Homo sapiens
acattttacaccaagacttctt

SEQ ID NO: 8231114 - DNA, 22 bp, Homo sapiens
acattttacaccaagacttctt

SEQ ID NO: 8231115 - DNA, 22 bp, Homo sapiens
acattttacaccaagacttctt

SEQ ID NO: 8231116 - DNA, 22 bp, Homo sapiens
acattttacagttgtctggcta

SEQ ID NO: 8231117 - DNA, 22 bp, Homo sapiens
acattttacagttgtctggcta

SEQ ID NO: 8231118 - DNA, 21 bp, Homo sapiens
acattttctgttttaggaagt

SEQ ID NO: 8231119 - DNA, 22 bp, Homo sapiens
acattttgaaagggaaattgtt

SEQ ID NO: 8231120 - DNA, 22 bp, Homo sapiens
acattttgagaaatgacaagct

SEQ ID NO: 8231121 - DNA, 22 bp, Homo sapiens
acattttgaaagggaaattgtt

SEQ ID NO: 8231122 - DNA, 22 bp, Homo sapiens
acattttgaaagggaaattgtt

SEQ ID NO: 8231123 - DNA, 22 bp, Homo sapiens
accaggcccaccgcatgctcct

SEQ ID NO: 8231124 - DNA, 22 bp, Homo sapiens
accaggctgttgggcccagtgt

SEQ ID NO: 8231125 - DNA, 22 bp, Homo sapiens
acattttgagaaatgacaagct

SEQ ID NO: 8231126 - DNA, 21 bp, Homo sapiens
accaggccaggaggctggcac

SEQ ID NO: 8231127 - DNA, 22 bp, Homo sapiens
accaggcttaatcctttgctat

SEQ ID NO: 8231128 - DNA, 22 bp, Homo sapiens
accaggcttaatcctttgctat

SEQ ID NO: 8231129 - DNA, 19 bp, Homo sapiens
accaggcttatggtcagtg

SEQ ID NO: 8231130 - DNA, 19 bp, Homo sapiens
accaggcttatggtcagtg

SEQ ID NO: 8231131 - DNA, 19 bp, Homo sapiens
accaggcttatggtcagtg

SEQ ID NO: 8231132 - DNA, 22 bp, Homo sapiens
accaggcttgataccaagaaat

SEQ ID NO: 8231133 - DNA, 22 bp, Homo sapiens
accaggcttgataccaagaaat

SEQ ID NO: 8231134 - DNA, 22 bp, Homo sapiens
aagggctgtaagccaagtaaag

SEQ ID NO: 8231135 - DNA, 22 bp, Homo sapiens
aagggctgtaagccaagtaaag

SEQ ID NO: 8231136 - DNA, 22 bp, Homo sapiens
aagggctgtaagccaagtaaag

SEQ ID NO: 8231137 - DNA, 22 bp, Homo sapiens
aagggctggtctagaaagggag

SEQ ID NO: 8231138 - DNA, 22 bp, Homo sapiens
aagggctggtctagaaagggag

SEQ ID NO: 8231139 - DNA, 22 bp, Homo sapiens
aagggctggtctagaaagggag

SEQ ID NO: 8231140 - DNA, 22 bp, Homo sapiens
aagggctgggtctggttaaccc

SEQ ID NO: 8231141 - DNA, 22 bp, Homo sapiens
aagggctgggtctggttaaccc

SEQ ID NO: 8231142 - DNA, 22 bp, Homo sapiens
accagggcacaggagtctgaag

SEQ ID NO: 8231143 - DNA, 22 bp, Homo sapiens
accagggcaaatgtttgtactc

SEQ ID NO: 8231144 - DNA, 21 bp, Homo sapiens
accaggcttgtgggagggagc

SEQ ID NO: 8231145 - DNA, 22 bp, Homo sapiens
accagggcaaatgtttgtactc

SEQ ID NO: 8231146 - DNA, 22 bp, Homo sapiens
accagggcacaggagtctgaag

SEQ ID NO: 8231147 - DNA, 22 bp, Homo sapiens
accaggcttgatgatttgctta

SEQ ID NO: 8231148 - DNA, 22 bp, Homo sapiens
accaggcttgatgatttgctta

SEQ ID NO: 8231149 - DNA, 22 bp, Homo sapiens
accaggcttgatgatttgctta

SEQ ID NO: 8231150 - DNA, 21 bp, Homo sapiens
accaggcttgtgggagggagc

SEQ ID NO: 8231151 - DNA, 21 bp, Homo sapiens
accaggcttgtgggagggagc

SEQ ID NO: 8231152 - DNA, 22 bp, Homo sapiens
aaggggaaaaagtgttaggagt

SEQ ID NO: 8231153 - DNA, 22 bp, Homo sapiens
aagggctgttatgtttttatac

SEQ ID NO: 8231154 - DNA, 22 bp, Homo sapiens
aagggctgttatgtttttatac

SEQ ID NO: 8231155 - DNA, 22 bp, Homo sapiens
aagggctgtagtttgttgatca

SEQ ID NO: 8231156 - DNA, 22 bp, Homo sapiens
aagggctgtagtttgttgatca

SEQ ID NO: 8231157 - DNA, 22 bp, Homo sapiens
aagggctgtagacaagattgct

SEQ ID NO: 8231158 - DNA, 22 bp, Homo sapiens
aagggctgtagacaagattgct

SEQ ID NO: 8231159 - DNA, 22 bp, Homo sapiens
acccagagcccttagcacagac

SEQ ID NO: 8231160 - DNA, 22 bp, Homo sapiens
accatgttggccaagctggtct

SEQ ID NO: 8231161 - DNA, 22 bp, Homo sapiens
accatgttggccaagctggtct

SEQ ID NO: 8231162 - DNA, 22 bp, Homo sapiens
accatgttggccaagctggtct

SEQ ID NO: 8231163 - DNA, 22 bp, Homo sapiens
acccagagctgggcttggcaaa

SEQ ID NO: 8231164 - DNA, 19 bp, Homo sapiens
acccagagccctttgcagg

SEQ ID NO: 8231165 - DNA, 19 bp, Homo sapiens
acccagagccctttgcagg

SEQ ID NO: 8231166 - DNA, 22 bp, Homo sapiens
accctgatataggtccaagagc

SEQ ID NO: 8231167 - DNA, 22 bp, Homo sapiens
accctgaggggtatagcagaag

SEQ ID NO: 8231168 - DNA, 22 bp, Homo sapiens
accctgcctctgcttcctgtag

SEQ ID NO: 8231169 - DNA, 22 bp, Homo sapiens
accgggaagtcctgcactgggc

SEQ ID NO: 8231170 - DNA, 22 bp, Homo sapiens
accgcagtgacgtgggacttcc

SEQ ID NO: 8231171 - DNA, 22 bp, Homo sapiens
accgggaagtcctgcactgggc

SEQ ID NO: 8231172 - DNA, 22 bp, Homo sapiens
accccttctcctggctgttcca

SEQ ID NO: 8231173 - DNA, 22 bp, Homo sapiens
accccttgaaggcagagaagct

SEQ ID NO: 8231174 - DNA, 22 bp, Homo sapiens
acccaggatgataatgttcaca

SEQ ID NO: 8231175 - DNA, 22 bp, Homo sapiens
acccctcagctcttcgtgcccc

SEQ ID NO: 8231176 - DNA, 22 bp, Homo sapiens
acccctcagctcttcgtgcccc

SEQ ID NO: 8231177 - DNA, 22 bp, Homo sapiens
accctgagatgccacagcatga

SEQ ID NO: 8231178 - DNA, 22 bp, Homo sapiens
accctgagaaagtcacatgcat

SEQ ID NO: 8231179 - DNA, 22 bp, Homo sapiens
acccaggaggcagaggttgcag

SEQ ID NO: 8231180 - DNA, 22 bp, Homo sapiens
acccaggaggcaaggttgcagt

SEQ ID NO: 8231181 - DNA, 22 bp, Homo sapiens
acccaggaggcaaggttgcagt

SEQ ID NO: 8231182 - DNA, 22 bp, Homo sapiens
acccaggagctctggggtcctc

SEQ ID NO: 8231183 - DNA, 22 bp, Homo sapiens
acccaggataatctgtgtatct

SEQ ID NO: 8231184 - DNA, 22 bp, Homo sapiens
acccaggatagagtgctgcagt

SEQ ID NO: 8231185 - DNA, 22 bp, Homo sapiens
acccaggatagagtgctgcagt

SEQ ID NO: 8231186 - DNA, 22 bp, Homo sapiens
acccaggaggtgacacagggct

SEQ ID NO: 8231187 - DNA, 22 bp, Homo sapiens
acccaggaggtggaggctgcag

SEQ ID NO: 8231188 - DNA, 22 bp, Homo sapiens
acccaggaggtggaggctgcag

SEQ ID NO: 8231189 - DNA, 22 bp, Homo sapiens
acccagagctgggcttggcaaa

SEQ ID NO: 8231190 - DNA, 22 bp, Homo sapiens
acccagagctgggcttggcaaa

SEQ ID NO: 8231191 - DNA, 22 bp, Homo sapiens
acccagaggcggaggttgcagt

SEQ ID NO: 8231192 - DNA, 22 bp, Homo sapiens
acccagaggcggaggttgcagt

SEQ ID NO: 8231193 - DNA, 22 bp, Homo sapiens
acccagaggtgtctagcaagct

SEQ ID NO: 8231194 - DNA, 22 bp, Homo sapiens
acccagaggtgtctagcaagct

SEQ ID NO: 8231195 - DNA, 22 bp, Homo sapiens
acccagagtgtctgtctcagtc

SEQ ID NO: 8231196 - DNA, 22 bp, Homo sapiens
acccaggagccgtgagaggtta

SEQ ID NO: 8231197 - DNA, 22 bp, Homo sapiens
acccagagtcatgtttattccc

SEQ ID NO: 8231198 - DNA, 22 bp, Homo sapiens
acccagagtcatggcacttagc

SEQ ID NO: 8231199 - DNA, 22 bp, Homo sapiens
acccagagtcagacagccatgg

SEQ ID NO: 8231200 - DNA, 22 bp, Homo sapiens
aagccttcctgagtgcaaggcc

SEQ ID NO: 8231201 - DNA, 22 bp, Homo sapiens
aagccaagtgctggccatgggc

SEQ ID NO: 8231202 - DNA, 22 bp, Homo sapiens
aagccaaggttttggtcacagc

SEQ ID NO: 8231203 - DNA, 22 bp, Homo sapiens
aagcggcatgaggagtaagtag

SEQ ID NO: 8231204 - DNA, 17 bp, Homo sapiens
aagcggagggccgggcc

SEQ ID NO: 8231205 - DNA, 23 bp, Homo sapiens
aagcgtcttttcaatgtggctgg

SEQ ID NO: 8231206 - DNA, 21 bp, Homo sapiens
aagctacagaaaataatttga

SEQ ID NO: 8231207 - DNA, 22 bp, Homo sapiens
aagctacacatctgttgggtat

SEQ ID NO: 8231208 - DNA, 22 bp, Homo sapiens
aagctacattaagcagatttac

SEQ ID NO: 8231209 - DNA, 22 bp, Homo sapiens
aagctagataacttttatattt

SEQ ID NO: 8231210 - DNA, 22 bp, Homo sapiens
aagctatacaatgcacaaatga

SEQ ID NO: 8231211 - DNA, 22 bp, Homo sapiens
aagctagattggcattcatttc

SEQ ID NO: 8231212 - DNA, 22 bp, Homo sapiens
aagctatacaatgcacaaatga

SEQ ID NO: 8231213 - DNA, 22 bp, Homo sapiens
aagctatagagtgtaagatgat

SEQ ID NO: 8231214 - DNA, 22 bp, Homo sapiens
aagcattttagataaagcatca

SEQ ID NO: 8231215 - DNA, 22 bp, Homo sapiens
aagcatttgtgaaattcagatg

SEQ ID NO: 8231216 - DNA, 22 bp, Homo sapiens
aagcatttgtgaaattcagatg

SEQ ID NO: 8231217 - DNA, 22 bp, Homo sapiens
aagcattttgttttaagaatga

SEQ ID NO: 8231218 - DNA, 22 bp, Homo sapiens
aagcattttgccacttgaagtt

SEQ ID NO: 8231219 - DNA, 22 bp, Homo sapiens
aagcattttgccacttgaagtt

SEQ ID NO: 8231220 - DNA, 22 bp, Homo sapiens
aagcatttttcacagcaacagc

SEQ ID NO: 8231221 - DNA, 22 bp, Homo sapiens
aagcattttgttttaagaatga

SEQ ID NO: 8231222 - DNA, 22 bp, Homo sapiens
acagcctggcctgagttaaggc

SEQ ID NO: 8231223 - DNA, 21 bp, Homo sapiens
acagcctgtcatctcatggtc

SEQ ID NO: 8231224 - DNA, 21 bp, Homo sapiens
acagcctgtcatctcatggtc

SEQ ID NO: 8231225 - DNA, 22 bp, Homo sapiens
acagcctgtttgatctggtgct

SEQ ID NO: 8231226 - DNA, 22 bp, Homo sapiens
acagcctgtttgatctggtgct

SEQ ID NO: 8231227 - DNA, 22 bp, Homo sapiens
acagcctgtgtaccagctggga

SEQ ID NO: 8231228 - DNA, 22 bp, Homo sapiens
acagcctgtgtaccagctggga

SEQ ID NO: 8231229 - DNA, 22 bp, Homo sapiens
acagcctgtgtaccagctggga

SEQ ID NO: 8231230 - DNA, 22 bp, Homo sapiens
aagctgccttccatgtgaggaa

SEQ ID NO: 8231231 - DNA, 23 bp, Homo sapiens
aagctgccttcgcagttggtctg

SEQ ID NO: 8231232 - DNA, 22 bp, Homo sapiens
aagctgcttggggctcctgcag

SEQ ID NO: 8231233 - DNA, 22 bp, Homo sapiens
aagctgccttgctgaggagaaa

SEQ ID NO: 8231234 - DNA, 22 bp, Homo sapiens
aagctgctggtgactgggctga

SEQ ID NO: 8231235 - DNA, 22 bp, Homo sapiens
aagctgcctgccacgctagata

SEQ ID NO: 8231236 - DNA, 22 bp, Homo sapiens
aagctgcctgggaggaagggct

SEQ ID NO: 8231237 - DNA, 22 bp, Homo sapiens
aagctgcctagagttgaatgtc

SEQ ID NO: 8231238 - DNA, 18 bp, Homo sapiens
aagctgccctcaggcagg

SEQ ID NO: 8231239 - DNA, 22 bp, Homo sapiens
aagctgccctcattcccagtgc

SEQ ID NO: 8231240 - DNA, 22 bp, Homo sapiens
aagctgccctgtgttagagttc

SEQ ID NO: 8231241 - DNA, 22 bp, Homo sapiens
acagggcagagtgaaatgctat

SEQ ID NO: 8231242 - DNA, 22 bp, Homo sapiens
acagggcagagggcagttggta

SEQ ID NO: 8231243 - DNA, 22 bp, Homo sapiens
acagggcagcaactttgtgcct

SEQ ID NO: 8231244 - DNA, 22 bp, Homo sapiens
acagggcagcaactttgtgcct

SEQ ID NO: 8231245 - DNA, 22 bp, Homo sapiens
acagggcagagtgaaatgctat

SEQ ID NO: 8231246 - DNA, 19 bp, Homo sapiens
acagggcagcaataggata

SEQ ID NO: 8231247 - DNA, 22 bp, Homo sapiens
acagggcagcaactttgtgcct

SEQ ID NO: 8231248 - DNA, 22 bp, Homo sapiens
acagggcagcaactttgtgcct

SEQ ID NO: 8231249 - DNA, 22 bp, Homo sapiens
acagggcagagggcagttggta

SEQ ID NO: 8231250 - DNA, 22 bp, Homo sapiens
acagggcagagaggcaggcttg

SEQ ID NO: 8231251 - DNA, 22 bp, Homo sapiens
acagggcagagaggcaggcttg

SEQ ID NO: 8231252 - DNA, 22 bp, Homo sapiens
acagggcagagaggcaggcttg

SEQ ID NO: 8231253 - DNA, 22 bp, Homo sapiens
acagggcagaaatgttgcatct

SEQ ID NO: 8231254 - DNA, 22 bp, Homo sapiens
acagggcagaaatgttgcatct

SEQ ID NO: 8231255 - DNA, 17 bp, Homo sapiens
acagggcagaaacagct

SEQ ID NO: 8231256 - DNA, 17 bp, Homo sapiens
acagggcagaaacagct

SEQ ID NO: 8231257 - DNA, 22 bp, Homo sapiens
aagctctgctcagcagactagg

SEQ ID NO: 8231258 - DNA, 22 bp, Homo sapiens
aagctctgtctcttgggagtta

SEQ ID NO: 8231259 - DNA, 22 bp, Homo sapiens
aagctcaggaaagagtctggtt

SEQ ID NO: 8231260 - DNA, 22 bp, Homo sapiens
aagctcagcatgtctcctagaa

SEQ ID NO: 8231261 - DNA, 22 bp, Homo sapiens
aagctcagcagccaggccctgt

SEQ ID NO: 8231262 - DNA, 22 bp, Homo sapiens
aagctcagagtctcggagggaa

SEQ ID NO: 8231263 - DNA, 22 bp, Homo sapiens
aagctattgaatttatagcata

SEQ ID NO: 8231264 - DNA, 22 bp, Homo sapiens
aagctcagaggtagataatgtt

SEQ ID NO: 8231265 - DNA, 22 bp, Homo sapiens
aagctcagagtagctcagcgtc

SEQ ID NO: 8231266 - DNA, 22 bp, Homo sapiens
aagctcagtgatgcctccaggg

SEQ ID NO: 8231267 - DNA, 22 bp, Homo sapiens
aagctcagtgatgcctccaggg

SEQ ID NO: 8231268 - DNA, 22 bp, Homo sapiens
aagctcaggctggacctggctt

SEQ ID NO: 8231269 - DNA, 22 bp, Homo sapiens
aagctccccgaaacccacctct

SEQ ID NO: 8231270 - DNA, 22 bp, Homo sapiens
aagctctctgtcccctggactg

SEQ ID NO: 8231271 - DNA, 22 bp, Homo sapiens
acatatgaggtgttattctatg

SEQ ID NO: 8231272 - DNA, 22 bp, Homo sapiens
acatatctgttagacacagcag

SEQ ID NO: 8231273 - DNA, 20 bp, Homo sapiens
acatatgaatgatagagcca

SEQ ID NO: 8231274 - DNA, 22 bp, Homo sapiens
acatagaacctggcacatagta

SEQ ID NO: 8231275 - DNA, 22 bp, Homo sapiens
acatagaacctggcacatagta

SEQ ID NO: 8231276 - DNA, 22 bp, Homo sapiens
aaggaggagtggggtcctggaa

SEQ ID NO: 8231277 - DNA, 22 bp, Homo sapiens
aaggaggagtggggtcctggaa

SEQ ID NO: 8231278 - DNA, 22 bp, Homo sapiens
aaggaggcactcgctctcaggg

SEQ ID NO: 8231279 - DNA, 22 bp, Homo sapiens
aaggaggagcggaggcttgttg

SEQ ID NO: 8231280 - DNA, 22 bp, Homo sapiens
aaggaggagtggggtcctggaa

SEQ ID NO: 8231281 - DNA, 22 bp, Homo sapiens
aaggaggagattagtgtttagg

SEQ ID NO: 8231282 - DNA, 22 bp, Homo sapiens
aaggaggagcggaggcttgttg

SEQ ID NO: 8231283 - DNA, 22 bp, Homo sapiens
aaggaggagattagtgtttagg

SEQ ID NO: 8231284 - DNA, 22 bp, Homo sapiens
aaggaggacacccaggactggg

SEQ ID NO: 8231285 - DNA, 22 bp, Homo sapiens
aaggaggacacccaggactggg

SEQ ID NO: 8231286 - DNA, 22 bp, Homo sapiens
aaggaggacacccaggactggg

SEQ ID NO: 8231287 - DNA, 22 bp, Homo sapiens
aaggaggacacccaggactggg

SEQ ID NO: 8231288 - DNA, 22 bp, Homo sapiens
aaggaggacacccaggactggg

SEQ ID NO: 8231289 - DNA, 22 bp, Homo sapiens
aaggaggaatttcagggtgaat

SEQ ID NO: 8231290 - DNA, 22 bp, Homo sapiens
aaggaggaatttcagggtgaat

SEQ ID NO: 8231291 - DNA, 22 bp, Homo sapiens
aaggaggaatttcagggtgaat

SEQ ID NO: 8231292 - DNA, 22 bp, Homo sapiens
aaggaggaattctgagttcatg

SEQ ID NO: 8231293 - DNA, 22 bp, Homo sapiens
aaggaggaattctgagttcatg

SEQ ID NO: 8231294 - DNA, 22 bp, Homo sapiens
aaggaggaattctgagttcatg

SEQ ID NO: 8231295 - DNA, 22 bp, Homo sapiens
acagtgtttggcaatgcatgca

SEQ ID NO: 8231296 - DNA, 22 bp, Homo sapiens
acagtgtttggcaatgcatgca

SEQ ID NO: 8231297 - DNA, 22 bp, Homo sapiens
aaggaggaatgtagccagctcc

SEQ ID NO: 8231298 - DNA, 22 bp, Homo sapiens
acagtgtttatgtacagattgt

SEQ ID NO: 8231299 - DNA, 22 bp, Homo sapiens
acagtgtttaagagatggcatt

SEQ ID NO: 8231300 - DNA, 22 bp, Homo sapiens
acagtgtttatgtacagattgt

SEQ ID NO: 8231301 - DNA, 22 bp, Homo sapiens
acagtgtttcacttaaccgttt

SEQ ID NO: 8231302 - DNA, 22 bp, Homo sapiens
acagtgtttatgtacagattgt

SEQ ID NO: 8231303 - DNA, 22 bp, Homo sapiens
acatatgagtactatacagtgc

SEQ ID NO: 8231304 - DNA, 22 bp, Homo sapiens
acatatgtatatgtacacagtc

SEQ ID NO: 8231305 - DNA, 22 bp, Homo sapiens
acatatgctcatctgcattccc

SEQ ID NO: 8231306 - DNA, 22 bp, Homo sapiens
acatatgtatatgtacacagtc

SEQ ID NO: 8231307 - DNA, 22 bp, Homo sapiens
acatatgcgatcataggatgca

SEQ ID NO: 8231308 - DNA, 22 bp, Homo sapiens
acatatgtctatttcatgtaaa

SEQ ID NO: 8231309 - DNA, 22 bp, Homo sapiens
acatatgtctatttcatgtaaa

SEQ ID NO: 8231310 - DNA, 19 bp, Homo sapiens
acatatgtggatatacatg

SEQ ID NO: 8231311 - DNA, 19 bp, Homo sapiens
acatatgtggatatacatg

SEQ ID NO: 8231312 - DNA, 22 bp, Homo sapiens
acatatgtgtctgcacatgccc

SEQ ID NO: 8231313 - DNA, 20 bp, Homo sapiens
acatatgtgtgcatatcttt

SEQ ID NO: 8231314 - DNA, 22 bp, Homo sapiens
acatatgtgttgtacatgcatg

SEQ ID NO: 8231315 - DNA, 19 bp, Homo sapiens
acatatgtggatatacatg

SEQ ID NO: 8231316 - DNA, 22 bp, Homo sapiens
acatatgtgtctgcacatgccc

SEQ ID NO: 8231317 - DNA, 22 bp, Homo sapiens
acatatgtgtctgcacatgccc

SEQ ID NO: 8231318 - DNA, 22 bp, Homo sapiens
aaggcagagggctggatcagag

SEQ ID NO: 8231319 - DNA, 22 bp, Homo sapiens
aaggcagagggctggatcagag

SEQ ID NO: 8231320 - DNA, 22 bp, Homo sapiens
aaggcagagggctggatcagag

SEQ ID NO: 8231321 - DNA, 22 bp, Homo sapiens
aaggcagagggctggatcagag

SEQ ID NO: 8231322 - DNA, 22 bp, Homo sapiens
aaggcagagggctggatcagag

SEQ ID NO: 8231323 - DNA, 22 bp, Homo sapiens
aaggcagagattagcagaatga

SEQ ID NO: 8231324 - DNA, 22 bp, Homo sapiens
aaggcagagattagcagaatga

SEQ ID NO: 8231325 - DNA, 22 bp, Homo sapiens
acatatgtgttgtacatgcatg

SEQ ID NO: 8231326 - DNA, 22 bp, Homo sapiens
acatatgtgttgtacatgcatg

SEQ ID NO: 8231327 - DNA, 22 bp, Homo sapiens
acatatgtgttgtacatgcatg

SEQ ID NO: 8231328 - DNA, 22 bp, Homo sapiens
acatatgtgttgtacatgcatg

SEQ ID NO: 8231329 - DNA, 22 bp, Homo sapiens
acatatgtgttgtacatgcatg

SEQ ID NO: 8231330 - DNA, 22 bp, Homo sapiens
acagtctttagagtattgtcct

SEQ ID NO: 8231331 - DNA, 22 bp, Homo sapiens
acagtctttaatttctttgtgg

SEQ ID NO: 8231332 - DNA, 17 bp, Homo sapiens
acagtgtctatgaaatg

SEQ ID NO: 8231333 - DNA, 16 bp, Homo sapiens
acagtgtctcaagcac

SEQ ID NO: 8231334 - DNA, 17 bp, Homo sapiens
acagtgtctatgaaatg

SEQ ID NO: 8231335 - DNA, 22 bp, Homo sapiens
acagtgttcttggcgctgagtg

SEQ ID NO: 8231336 - DNA, 22 bp, Homo sapiens
acagtgttcttgatattacagt

SEQ ID NO: 8231337 - DNA, 22 bp, Homo sapiens
acagtgttgtatttagtttgat

SEQ ID NO: 8231338 - DNA, 22 bp, Homo sapiens
acagtgttgaggtgcttgtttc

SEQ ID NO: 8231339 - DNA, 22 bp, Homo sapiens
acagtgttgtggctcttaatag

SEQ ID NO: 8231340 - DNA, 22 bp, Homo sapiens
acagtgtttaaaataatatgct

SEQ ID NO: 8231341 - DNA, 22 bp, Homo sapiens
acagtgtttaaaaatcagatct

SEQ ID NO: 8231342 - DNA, 22 bp, Homo sapiens
acagtgtttaaaaatcagatct

SEQ ID NO: 8231343 - DNA, 22 bp, Homo sapiens
aaggaggaataaagaggtggtg

SEQ ID NO: 8231344 - DNA, 22 bp, Homo sapiens
aaggaggaaaatattgttgctg

SEQ ID NO: 8231345 - DNA, 22 bp, Homo sapiens
acagtctgtcccccaggtgcta

SEQ ID NO: 8231346 - DNA, 22 bp, Homo sapiens
aaggaggaataaagaggtggtg

SEQ ID NO: 8231347 - DNA, 22 bp, Homo sapiens
aaggaggaataaagaggtggtg

SEQ ID NO: 8231348 - DNA, 22 bp, Homo sapiens
acagtcttgctgtatggtcagg

SEQ ID NO: 8231349 - DNA, 22 bp, Homo sapiens
acagtcttgcacttctatcagc

SEQ ID NO: 8231350 - DNA, 22 bp, Homo sapiens
acagtcttgctgtatggtcagg

SEQ ID NO: 8231351 - DNA, 22 bp, Homo sapiens
acagtcttcagaagggattggg

SEQ ID NO: 8231352 - DNA, 22 bp, Homo sapiens
aaggagacatttgcagagcacc

SEQ ID NO: 8231353 - DNA, 22 bp, Homo sapiens
aaggagacatttgcagagcacc

SEQ ID NO: 8231354 - DNA, 22 bp, Homo sapiens
aaggagacttggcatcacttaa

SEQ ID NO: 8231355 - DNA, 22 bp, Homo sapiens
aaggagacatttgcagagcacc

SEQ ID NO: 8231356 - DNA, 20 bp, Homo sapiens
aagctggaagaccagcattg

SEQ ID NO: 8231357 - DNA, 22 bp, Homo sapiens
aaggagctatgcataactgatc

SEQ ID NO: 8231358 - DNA, 22 bp, Homo sapiens
aaggagctcccggcagaccagg

SEQ ID NO: 8231359 - DNA, 22 bp, Homo sapiens
aaggagctcttaaaatcagaga

SEQ ID NO: 8231360 - DNA, 22 bp, Homo sapiens
aaggagctcccggcagaccagg

SEQ ID NO: 8231361 - DNA, 22 bp, Homo sapiens
aaggagctttcattacagcctt

SEQ ID NO: 8231362 - DNA, 22 bp, Homo sapiens
aaggagcttgttcgccttcctc

SEQ ID NO: 8231363 - DNA, 22 bp, Homo sapiens
aaggagctgggagggacacatg

SEQ ID NO: 8231364 - DNA, 17 bp, Homo sapiens
aaggagctgagagatgg

SEQ ID NO: 8231365 - DNA, 22 bp, Homo sapiens
aaggagagagctttgctggaac

SEQ ID NO: 8231366 - DNA, 22 bp, Homo sapiens
aaggagagagctttgctggaac

SEQ ID NO: 8231367 - DNA, 22 bp, Homo sapiens
aaggagagtacaggagttggta

SEQ ID NO: 8231368 - DNA, 22 bp, Homo sapiens
aaggagagtacaggagttggta

SEQ ID NO: 8231369 - DNA, 22 bp, Homo sapiens
gtgacaaaaacactgattattt

SEQ ID NO: 8231370 - DNA, 22 bp, Homo sapiens
gtgacaaaggtcaagcttttga

SEQ ID NO: 8231371 - DNA, 22 bp, Homo sapiens
gtgacaaatgcaaattgggctg

SEQ ID NO: 8231372 - DNA, 20 bp, Homo sapiens
gtgaaggctaagcacagagg

SEQ ID NO: 8231373 - DNA, 22 bp, Homo sapiens
gtctggggtactttcatctgat

SEQ ID NO: 8231374 - DNA, 22 bp, Homo sapiens
gtgaaggattggagggcatctt

SEQ ID NO: 8231375 - DNA, 20 bp, Homo sapiens
gtgaagggagtcaggtgtgc

SEQ ID NO: 8231376 - DNA, 20 bp, Homo sapiens
gtgaagggagtcaggtgtgc

SEQ ID NO: 8231377 - DNA, 22 bp, Homo sapiens
gtgacagagtgagaccttgtct

SEQ ID NO: 8231378 - DNA, 22 bp, Homo sapiens
gtgacagagttttagatctcat

SEQ ID NO: 8231379 - DNA, 22 bp, Homo sapiens
gtgacagattatagggagcgtt

SEQ ID NO: 8231380 - DNA, 22 bp, Homo sapiens
gtgacagagttttagatctcat

SEQ ID NO: 8231381 - DNA, 22 bp, Homo sapiens
gtgacagatttgctgcgcatgg

SEQ ID NO: 8231382 - DNA, 22 bp, Homo sapiens
gtgacagatttgctgcgcatgg

SEQ ID NO: 8231383 - DNA, 22 bp, Homo sapiens
gtgacagatttgctgcgcatgg

SEQ ID NO: 8231384 - DNA, 22 bp, Homo sapiens
gtgacaggccactgcggctctg

SEQ ID NO: 8231385 - DNA, 22 bp, Homo sapiens
gtgacaggcatggggtcatgca

SEQ ID NO: 8231386 - DNA, 22 bp, Homo sapiens
gtgacagggggcttggtttcta

SEQ ID NO: 8231387 - DNA, 22 bp, Homo sapiens
gtgacaggcccagtgggatgca

SEQ ID NO: 8231388 - DNA, 22 bp, Homo sapiens
gtgacaggcccagtgggatgca

SEQ ID NO: 8231389 - DNA, 22 bp, Homo sapiens
gtgacaggccactgcggctctg

SEQ ID NO: 8231390 - DNA, 22 bp, Homo sapiens
gtgacagtcaaagacatgactt

SEQ ID NO: 8231391 - DNA, 22 bp, Homo sapiens
gtgacaggtatactcaccattg

SEQ ID NO: 8231392 - DNA, 22 bp, Homo sapiens
gtgacagtggtcacttgtagtt

SEQ ID NO: 8231393 - DNA, 22 bp, Homo sapiens
gtgacagtggtcacttgtagtt

SEQ ID NO: 8231394 - DNA, 22 bp, Homo sapiens
gtgacatttacgaatcttatcc

SEQ ID NO: 8231395 - DNA, 22 bp, Homo sapiens
gtgacatttacgaatcttatcc

SEQ ID NO: 8231396 - DNA, 22 bp, Homo sapiens
gtgacatttattagatgcttac

SEQ ID NO: 8231397 - DNA, 22 bp, Homo sapiens
gtgacatttcccatcagtatcc

SEQ ID NO: 8231398 - DNA, 22 bp, Homo sapiens
gtgacattcaggatatcaatgg

SEQ ID NO: 8231399 - DNA, 22 bp, Homo sapiens
gtgacattgctaggaacagatt

SEQ ID NO: 8231400 - DNA, 22 bp, Homo sapiens
gtgacatttttactgatgagag

SEQ ID NO: 8231401 - DNA, 22 bp, Homo sapiens
gtgacatttcgtgacgtgagaa

SEQ ID NO: 8231402 - DNA, 20 bp, Homo sapiens
gtgaccagaagacagtgggt

SEQ ID NO: 8231403 - DNA, 22 bp, Homo sapiens
gtgaccagccagtgctgtctgt

SEQ ID NO: 8231404 - DNA, 22 bp, Homo sapiens
gtgaccagagcgggagattggg

SEQ ID NO: 8231405 - DNA, 22 bp, Homo sapiens
gtgaccagcccatagagaggcg

SEQ ID NO: 8231406 - DNA, 22 bp, Homo sapiens
gtgaccagccagtgctgtctgt

SEQ ID NO: 8231407 - DNA, 22 bp, Homo sapiens
gtgaccagtgatgctgaggagt

SEQ ID NO: 8231408 - DNA, 22 bp, Homo sapiens
gtgcctggaatgcgcctcggcg

SEQ ID NO: 8231409 - DNA, 22 bp, Homo sapiens
gtgcctggaatgcgcctcggcg

SEQ ID NO: 8231410 - DNA, 22 bp, Homo sapiens
gtgcctggaatgcgcctcggcg

SEQ ID NO: 8231411 - DNA, 22 bp, Homo sapiens
gtgcctggaatgcgcctcggcg

SEQ ID NO: 8231412 - DNA, 22 bp, Homo sapiens
gtgcctggaccctctttccgga

SEQ ID NO: 8231413 - DNA, 22 bp, Homo sapiens
gtgcctggaactgggtaggctg

SEQ ID NO: 8231414 - DNA, 22 bp, Homo sapiens
gtgcctggaactgggtaggctg

SEQ ID NO: 8231415 - DNA, 22 bp, Homo sapiens
gtgcctggaactgggtaggctg

SEQ ID NO: 8231416 - DNA, 22 bp, Homo sapiens
gtgcctggaactgggtaggctg

SEQ ID NO: 8231417 - DNA, 22 bp, Homo sapiens
gtgcctggaactgggtaggctg

SEQ ID NO: 8231418 - DNA, 22 bp, Homo sapiens
gtgcctgcagcaatccatggca

SEQ ID NO: 8231419 - DNA, 22 bp, Homo sapiens
gtgcctgagccagctgcagctc

SEQ ID NO: 8231420 - DNA, 22 bp, Homo sapiens
gtgcctgctgcagctgagcagt

SEQ ID NO: 8231421 - DNA, 22 bp, Homo sapiens
gtgcctgctgcagagtcgctgt

SEQ ID NO: 8231422 - DNA, 22 bp, Homo sapiens
gtgcggtcaacatcagcagttg

SEQ ID NO: 8231423 - DNA, 22 bp, Homo sapiens
gtgcgggggttcccagcagccg

SEQ ID NO: 8231424 - DNA, 22 bp, Homo sapiens
gtgctaagtgcaggatattgaa

SEQ ID NO: 8231425 - DNA, 22 bp, Homo sapiens
gtgcgtttctttcccagcttcg

SEQ ID NO: 8231426 - DNA, 22 bp, Homo sapiens
gtgctaattgaccatttgatat

SEQ ID NO: 8231427 - DNA, 22 bp, Homo sapiens
gtgctacagactgagtacactt

SEQ ID NO: 8231428 - DNA, 22 bp, Homo sapiens
gtgcgcaccctcccggcatccc

SEQ ID NO: 8231429 - DNA, 22 bp, Homo sapiens
gtgccttccccggtggtctgtt

SEQ ID NO: 8231430 - DNA, 23 bp, Homo sapiens
gtgcgccaggacaacctgacgga

SEQ ID NO: 8231431 - DNA, 22 bp, Homo sapiens
gtgcgcttcttcctgagccagg

SEQ ID NO: 8231432 - DNA, 21 bp, Homo sapiens
gtgcggatgccgtcattgtca

SEQ ID NO: 8231433 - DNA, 22 bp, Homo sapiens
gtgcggatcggtgtcctccaaa

SEQ ID NO: 8231434 - DNA, 20 bp, Homo sapiens
gtgcctggagaagaggctgt

SEQ ID NO: 8231435 - DNA, 20 bp, Homo sapiens
gtgcctggagaagaggctgt

SEQ ID NO: 8231436 - DNA, 20 bp, Homo sapiens
gtgcctggagaagaggctgt

SEQ ID NO: 8231437 - DNA, 20 bp, Homo sapiens
gtgcctggagaagaggctgt

SEQ ID NO: 8231438 - DNA, 20 bp, Homo sapiens
gtgcctggagaagaggctgt

SEQ ID NO: 8231439 - DNA, 20 bp, Homo sapiens
gtgcctggagaagaggctgt

SEQ ID NO: 8231440 - DNA, 22 bp, Homo sapiens
gtgcctggcacacagaaggcaa

SEQ ID NO: 8231441 - DNA, 22 bp, Homo sapiens
gtgcctggcacacagaaggcaa

SEQ ID NO: 8231442 - DNA, 22 bp, Homo sapiens
gtgcctggagctaatgtgtata

SEQ ID NO: 8231443 - DNA, 22 bp, Homo sapiens
gtgcctggcagggtcagctgct

SEQ ID NO: 8231444 - DNA, 22 bp, Homo sapiens
gtgcctggcagggtcagctgct

SEQ ID NO: 8231445 - DNA, 22 bp, Homo sapiens
gtgcctggcatgcgccggtgct

SEQ ID NO: 8231446 - DNA, 22 bp, Homo sapiens
gtgcctggcagggtcagctgct

SEQ ID NO: 8231447 - DNA, 22 bp, Homo sapiens
gtgcctggcatgcgccggtgct

SEQ ID NO: 8231448 - DNA, 22 bp, Homo sapiens
gtggaaatagtttggttataga

SEQ ID NO: 8231449 - DNA, 22 bp, Homo sapiens
gtggaaatgcccccaaatagtg

SEQ ID NO: 8231450 - DNA, 22 bp, Homo sapiens
gtggaaattttaggatcatctt

SEQ ID NO: 8231451 - DNA, 22 bp, Homo sapiens
gtggaaaactgagaaaattgct

SEQ ID NO: 8231452 - DNA, 22 bp, Homo sapiens
gtgctactagtttcatttttca

SEQ ID NO: 8231453 - DNA, 22 bp, Homo sapiens
gtgctacatggtagtgtagtta

SEQ ID NO: 8231454 - DNA, 22 bp, Homo sapiens
gtggaagcaaccctggcaggag

SEQ ID NO: 8231455 - DNA, 22 bp, Homo sapiens
gtggaagcaaccctggcaggag

SEQ ID NO: 8231456 - DNA, 22 bp, Homo sapiens
gtggaagcagtaaggcaagttt

SEQ ID NO: 8231457 - DNA, 22 bp, Homo sapiens
gtggaagcaggttgctaacagg

SEQ ID NO: 8231458 - DNA, 22 bp, Homo sapiens
gtggaagctgatgggagacagg

SEQ ID NO: 8231459 - DNA, 22 bp, Homo sapiens
gtggaagcctactcttgtggtt

SEQ ID NO: 8231460 - DNA, 22 bp, Homo sapiens
gtggaagcctaagagtagggag

SEQ ID NO: 8231461 - DNA, 22 bp, Homo sapiens
gtggaaggtgaaggagcagcga

SEQ ID NO: 8231462 - DNA, 20 bp, Homo sapiens
gtggaatgcactctgtgctg

SEQ ID NO: 8231463 - DNA, 22 bp, Homo sapiens
gtggaatggccatgggatcctt

SEQ ID NO: 8231464 - DNA, 22 bp, Homo sapiens
gtggaatgtccttgatcataag

SEQ ID NO: 8231465 - DNA, 22 bp, Homo sapiens
gtggaaggaagagatggcccca

SEQ ID NO: 8231466 - DNA, 22 bp, Homo sapiens
gtggaaggaagagatggcccca

SEQ ID NO: 8231467 - DNA, 22 bp, Homo sapiens
gtggaaggaattaacagactag

SEQ ID NO: 8231468 - DNA, 22 bp, Homo sapiens
gtggaagggtcacagcccctac

SEQ ID NO: 8231469 - DNA, 22 bp, Homo sapiens
gtggcactaaatacagcatttc

SEQ ID NO: 8231470 - DNA, 22 bp, Homo sapiens
gtggcactaaatacagcatttc

SEQ ID NO: 8231471 - DNA, 22 bp, Homo sapiens
gtggcactcacctgtagtttca

SEQ ID NO: 8231472 - DNA, 22 bp, Homo sapiens
gtggcagagccgtgcaggtagg

SEQ ID NO: 8231473 - DNA, 22 bp, Homo sapiens
gtggcacataggatcctgtggc

SEQ ID NO: 8231474 - DNA, 22 bp, Homo sapiens
gtggcacataggatcctgtggc

SEQ ID NO: 8231475 - DNA, 22 bp, Homo sapiens
gtggcacattggtagggtctgt

SEQ ID NO: 8231476 - DNA, 22 bp, Homo sapiens
gtggcacattggtagggtctgt

SEQ ID NO: 8231477 - DNA, 22 bp, Homo sapiens
gtggcacagtgggagagcccca

SEQ ID NO: 8231478 - DNA, 22 bp, Homo sapiens
gtggcacagtgggagagcccca

SEQ ID NO: 8231479 - DNA, 22 bp, Homo sapiens
gtggcacagggttgttggtcat

SEQ ID NO: 8231480 - DNA, 22 bp, Homo sapiens
gtggcacagtgggagagcccca

SEQ ID NO: 8231481 - DNA, 22 bp, Homo sapiens
gtggcacagtctgaaattttga

SEQ ID NO: 8231482 - DNA, 22 bp, Homo sapiens
gtggcacagagatggggcatga

SEQ ID NO: 8231483 - DNA, 22 bp, Homo sapiens
gtggcacagagatggggcatga

SEQ ID NO: 8231484 - DNA, 22 bp, Homo sapiens
gtggcacacaggagagagctca

SEQ ID NO: 8231485 - DNA, 22 bp, Homo sapiens
gtggcacagccaagcctcactc

SEQ ID NO: 8231486 - DNA, 22 bp, Homo sapiens
gtggcacagggttgttggtcat

SEQ ID NO: 8231487 - DNA, 22 bp, Homo sapiens
gtggcacagggttgttggtcat

SEQ ID NO: 8231488 - DNA, 22 bp, Homo sapiens
gtggcacagggtgtggcacaca

SEQ ID NO: 8231489 - DNA, 22 bp, Homo sapiens
gtggcacagggtgtggcacaca

SEQ ID NO: 8231490 - DNA, 22 bp, Homo sapiens
gtggcacaaggcttacacagca

SEQ ID NO: 8231491 - DNA, 22 bp, Homo sapiens
gtggcaagtgttccaagaggcg

SEQ ID NO: 8231492 - DNA, 22 bp, Homo sapiens
gtggcacaaggcttacacagca

SEQ ID NO: 8231493 - DNA, 22 bp, Homo sapiens
gtggcacacaggagagagctca

SEQ ID NO: 8231494 - DNA, 22 bp, Homo sapiens
gtggcacagaagtttagagaac

SEQ ID NO: 8231495 - DNA, 22 bp, Homo sapiens
gtggcacagagatggggcatga

SEQ ID NO: 8231496 - DNA, 22 bp, Homo sapiens
gtggatggattgaggcagtggg

SEQ ID NO: 8231497 - DNA, 22 bp, Homo sapiens
gtggatggattgaggcagtggg

SEQ ID NO: 8231498 - DNA, 22 bp, Homo sapiens
gtggatggagctggaagccatt

SEQ ID NO: 8231499 - DNA, 22 bp, Homo sapiens
gtggatggagctggaagccatt

SEQ ID NO: 8231500 - DNA, 16 bp, Homo sapiens
gtggattcccagcctg

SEQ ID NO: 8231501 - DNA, 22 bp, Homo sapiens
gtggattacaagacagttgaga

SEQ ID NO: 8231502 - DNA, 22 bp, Homo sapiens
gtggcagcaggtactcacgcac

SEQ ID NO: 8231503 - DNA, 22 bp, Homo sapiens
gtggcagccatgagaatataac

SEQ ID NO: 8231504 - DNA, 22 bp, Homo sapiens
gtggcagcatggcttttagctg

SEQ ID NO: 8231505 - DNA, 16 bp, Homo sapiens
gtggcagccccttctc

SEQ ID NO: 8231506 - DNA, 19 bp, Homo sapiens
gtggcagcagatttggtgt

SEQ ID NO: 8231507 - DNA, 19 bp, Homo sapiens
gtggcagcagatttggtgt

SEQ ID NO: 8231508 - DNA, 19 bp, Homo sapiens
gtggcagcagatttggtgt

SEQ ID NO: 8231509 - DNA, 22 bp, Homo sapiens
gtggcagcagaggggtggtatg

SEQ ID NO: 8231510 - DNA, 22 bp, Homo sapiens
gtggcagcagaggggtggtatg

SEQ ID NO: 8231511 - DNA, 22 bp, Homo sapiens
gtggcagcaaatgcctggacta

SEQ ID NO: 8231512 - DNA, 22 bp, Homo sapiens
gtggcagcaaatgcctggacta

SEQ ID NO: 8231513 - DNA, 22 bp, Homo sapiens
gtggcagcaaatgcctggacta

SEQ ID NO: 8231514 - DNA, 22 bp, Homo sapiens
gtggcagcggtgtgcaaggagg

SEQ ID NO: 8231515 - DNA, 22 bp, Homo sapiens
gtggcagcggtgtgcaaggagg

SEQ ID NO: 8231516 - DNA, 22 bp, Homo sapiens
gtggcagcggtgtgcaaggagg

SEQ ID NO: 8231517 - DNA, 22 bp, Homo sapiens
gtggcagcggtgtgcaaggagg

SEQ ID NO: 8231518 - DNA, 22 bp, Homo sapiens
gtggcagctcatgttgttttaa

SEQ ID NO: 8231519 - DNA, 22 bp, Homo sapiens
gtggcagctctcttgatttccc

SEQ ID NO: 8231520 - DNA, 22 bp, Homo sapiens
gtggcagctacatttaatgcaa

SEQ ID NO: 8231521 - DNA, 22 bp, Homo sapiens
gtggcagctcatgttgttttaa

SEQ ID NO: 8231522 - DNA, 18 bp, Homo sapiens
gtggcagcctttggcttt

SEQ ID NO: 8231523 - DNA, 22 bp, Homo sapiens
gtggcagccgcaggccctgtgt

SEQ ID NO: 8231524 - DNA, 22 bp, Homo sapiens
gtggcagccgcaggccctgtgt

SEQ ID NO: 8231525 - DNA, 22 bp, Homo sapiens
gtggcagcggcccaggccgtct

SEQ ID NO: 8231526 - DNA, 22 bp, Homo sapiens
gtggcagcggcccaggccgtct

SEQ ID NO: 8231527 - DNA, 22 bp, Homo sapiens
gtggcagagtgcggttctgacc

SEQ ID NO: 8231528 - DNA, 22 bp, Homo sapiens
gtggcagattgctcaccatggt

SEQ ID NO: 8231529 - DNA, 22 bp, Homo sapiens
gtggcagcaaaatcctgcattc

SEQ ID NO: 8231530 - DNA, 22 bp, Homo sapiens
gtggcagcaaaatcctgcattc

SEQ ID NO: 8231531 - DNA, 22 bp, Homo sapiens
gtggcagcaaaatcctgcattc

SEQ ID NO: 8231532 - DNA, 22 bp, Homo sapiens
gtggcagattgctcaccatggt

SEQ ID NO: 8231533 - DNA, 22 bp, Homo sapiens
gtggcagagccgtgcaggtagg

SEQ ID NO: 8231534 - DNA, 22 bp, Homo sapiens
gtggcagaggctctgggaccag

SEQ ID NO: 8231535 - DNA, 22 bp, Homo sapiens
gtggcagaggctctgggaccag

SEQ ID NO: 8231536 - DNA, 22 bp, Homo sapiens
gtggcagagccttgcggctttg

SEQ ID NO: 8231537 - DNA, 22 bp, Homo sapiens
gtggcagagggtgagctggact

SEQ ID NO: 8231538 - DNA, 22 bp, Homo sapiens
gtggaggacaaaagaagccttt

SEQ ID NO: 8231539 - DNA, 22 bp, Homo sapiens
gtggagggtgagctcatgtttg

SEQ ID NO: 8231540 - DNA, 22 bp, Homo sapiens
gtggagggaatgaatcttctct

SEQ ID NO: 8231541 - DNA, 22 bp, Homo sapiens
gtggagggaatgaatcttctct

SEQ ID NO: 8231542 - DNA, 22 bp, Homo sapiens
gtggagggtttgcaatgtgcag

SEQ ID NO: 8231543 - DNA, 18 bp, Homo sapiens
gtggagggttctcagaat

SEQ ID NO: 8231544 - DNA, 22 bp, Homo sapiens
gtggagggtgattgccggctgt

SEQ ID NO: 8231545 - DNA, 22 bp, Homo sapiens
gtggagggtgattgccggctgt

SEQ ID NO: 8231546 - DNA, 22 bp, Homo sapiens
gtggagggtgattgccggctgt

SEQ ID NO: 8231547 - DNA, 22 bp, Homo sapiens
gtggagtggtgatggataggtt

SEQ ID NO: 8231548 - DNA, 22 bp, Homo sapiens
gtggagtggtgatggataggtt

SEQ ID NO: 8231549 - DNA, 22 bp, Homo sapiens
gtggatctggctgtgtcctggc

SEQ ID NO: 8231550 - DNA, 22 bp, Homo sapiens
gtggatgcttaggcagcctggg

SEQ ID NO: 8231551 - DNA, 18 bp, Homo sapiens
gtggatgcattgggaggg

SEQ ID NO: 8231552 - DNA, 17 bp, Homo sapiens
gtggaggtgctctggta

SEQ ID NO: 8231553 - DNA, 17 bp, Homo sapiens
gtggaggtgctctggta

SEQ ID NO: 8231554 - DNA, 22 bp, Homo sapiens
gtggagtgcaacggttggagtt

SEQ ID NO: 8231555 - DNA, 22 bp, Homo sapiens
gtggagtgcaacggttggagtt

SEQ ID NO: 8231556 - DNA, 22 bp, Homo sapiens
gtggagtggcctggccctgaga

SEQ ID NO: 8231557 - DNA, 22 bp, Homo sapiens
gtggagtggcctggccctgaga

SEQ ID NO: 8231558 - DNA, 22 bp, Homo sapiens
gtggagtggcctggccctgaga

SEQ ID NO: 8231559 - DNA, 22 bp, Homo sapiens
gtggagtggcctggccctgaga

SEQ ID NO: 8231560 - DNA, 22 bp, Homo sapiens
gtggaggtcccgggcaggagca

SEQ ID NO: 8231561 - DNA, 22 bp, Homo sapiens
gtggagggtttgcaatgtgcag

SEQ ID NO: 8231562 - DNA, 22 bp, Homo sapiens
gtggaggtcccgggcaggagca

SEQ ID NO: 8231563 - DNA, 22 bp, Homo sapiens
gtggaccaaggtggaagataaa

SEQ ID NO: 8231564 - DNA, 22 bp, Homo sapiens
gtggacaggcaggctgtcgggg

SEQ ID NO: 8231565 - DNA, 22 bp, Homo sapiens
gtggagagagataagcctggtc

SEQ ID NO: 8231566 - DNA, 22 bp, Homo sapiens
gtggagagagataagcctggtc

SEQ ID NO: 8231567 - DNA, 22 bp, Homo sapiens
gtggagagagataagcctggtc

SEQ ID NO: 8231568 - DNA, 22 bp, Homo sapiens
gtggagagagataagcctggtc

SEQ ID NO: 8231569 - DNA, 22 bp, Homo sapiens
gtggacaggcaggctgtcgggg

SEQ ID NO: 8231570 - DNA, 22 bp, Homo sapiens
gtggacagcttctaggtgccag

SEQ ID NO: 8231571 - DNA, 22 bp, Homo sapiens
gtggacagcttctaggtgccag

SEQ ID NO: 8231572 - DNA, 22 bp, Homo sapiens
gtggacagagctagaaaatgtg

SEQ ID NO: 8231573 - DNA, 22 bp, Homo sapiens
gtggacagagataataaactga

SEQ ID NO: 8231574 - DNA, 22 bp, Homo sapiens
gtggacagacataatcctaatt

SEQ ID NO: 8231575 - DNA, 22 bp, Homo sapiens
gtggaattgctggataatatca

SEQ ID NO: 8231576 - DNA, 22 bp, Homo sapiens
gtggacagacataatcctaatt

SEQ ID NO: 8231577 - DNA, 22 bp, Homo sapiens
gtggagccctggtagggacccc

SEQ ID NO: 8231578 - DNA, 22 bp, Homo sapiens
gtggaggaagggattcagacca

SEQ ID NO: 8231579 - DNA, 22 bp, Homo sapiens
gtggaggacaaaagaagccttt

SEQ ID NO: 8231580 - DNA, 22 bp, Homo sapiens
gtggaggacaaaagaagccttt

SEQ ID NO: 8231581 - DNA, 22 bp, Homo sapiens
gtggaggaagggattcagacca

SEQ ID NO: 8231582 - DNA, 22 bp, Homo sapiens
gtggagaggaacccagctctgt

SEQ ID NO: 8231583 - DNA, 22 bp, Homo sapiens
gtggagccctgccttgctcatg

SEQ ID NO: 8231584 - DNA, 22 bp, Homo sapiens
gtggagaggaacccagctctgt

SEQ ID NO: 8231585 - DNA, 22 bp, Homo sapiens
gtggagaggaacccagctctgt

SEQ ID NO: 8231586 - DNA, 22 bp, Homo sapiens
gtggagaggaacccagctctgt

SEQ ID NO: 8231587 - DNA, 22 bp, Homo sapiens
gtggagaggaacccagctctgt

SEQ ID NO: 8231588 - DNA, 22 bp, Homo sapiens
gtggagagcaaataattggaat

SEQ ID NO: 8231589 - DNA, 22 bp, Homo sapiens
gtggagagagtgacagcatctt

SEQ ID NO: 8231590 - DNA, 22 bp, Homo sapiens
gtggagagagtgacagcatctt

SEQ ID NO: 8231591 - DNA, 22 bp, Homo sapiens
gtggagagagtgacagcatctt

SEQ ID NO: 8231592 - DNA, 22 bp, Homo sapiens
gtggagagagataagcctggtc

SEQ ID NO: 8231593 - DNA, 22 bp, Homo sapiens
gtggagagagtgacagcatctt

SEQ ID NO: 8231594 - DNA, 23 bp, Homo sapiens
gtggagagattagtaattcaccc

SEQ ID NO: 8231595 - DNA, 23 bp, Homo sapiens
gtggagagattagtaattcaccc

SEQ ID NO: 8231596 - DNA, 22 bp, Homo sapiens
gtggagagcaaataattggaat

SEQ ID NO: 8231597 - DNA, 23 bp, Homo sapiens
gtggagagattagtaattcaccc

SEQ ID NO: 8231598 - DNA, 23 bp, Homo sapiens
gtggagagattagtaattcaccc

SEQ ID NO: 8231599 - DNA, 22 bp, Homo sapiens
gtggccagcaagtgctgcctct

SEQ ID NO: 8231600 - DNA, 22 bp, Homo sapiens
gtggccagcaagtgctgcctct

SEQ ID NO: 8231601 - DNA, 22 bp, Homo sapiens
gtggccagccagggtgctgatg

SEQ ID NO: 8231602 - DNA, 22 bp, Homo sapiens
gtggccagccagggtgctgatg

SEQ ID NO: 8231603 - DNA, 22 bp, Homo sapiens
gtggccagccagggtgctgatg

SEQ ID NO: 8231604 - DNA, 22 bp, Homo sapiens
gtggccagagtgtcattttatt

SEQ ID NO: 8231605 - DNA, 22 bp, Homo sapiens
gtggccagagtgtcattttatt

SEQ ID NO: 8231606 - DNA, 22 bp, Homo sapiens
gtggccagcaagtgctgcctct

SEQ ID NO: 8231607 - DNA, 22 bp, Homo sapiens
gtggccagcaagtgctgcctct

SEQ ID NO: 8231608 - DNA, 22 bp, Homo sapiens
gtggccagcaagtgctgcctct

SEQ ID NO: 8231609 - DNA, 22 bp, Homo sapiens
gtggccagcaagtgctgcctct

SEQ ID NO: 8231610 - DNA, 22 bp, Homo sapiens
gtggccagaggtcccatgtgtc

SEQ ID NO: 8231611 - DNA, 22 bp, Homo sapiens
gtggccagccccatggacagtt

SEQ ID NO: 8231612 - DNA, 22 bp, Homo sapiens
gtggccagccagggtgctgatg

SEQ ID NO: 8231613 - DNA, 22 bp, Homo sapiens
gtggccagccccatggacagtt

SEQ ID NO: 8231614 - DNA, 22 bp, Homo sapiens
gtggccagccccatggacagtt

SEQ ID NO: 8231615 - DNA, 22 bp, Homo sapiens
gtggccagccccatggacagtt

SEQ ID NO: 8231616 - DNA, 22 bp, Homo sapiens
gtggccagccccatggacagtt

SEQ ID NO: 8231617 - DNA, 22 bp, Homo sapiens
gtggccagccccatggacagtt

SEQ ID NO: 8231618 - DNA, 18 bp, Homo sapiens
gtggccagcctggtcttg

SEQ ID NO: 8231619 - DNA, 18 bp, Homo sapiens
gtggccagcctggtcttg

SEQ ID NO: 8231620 - DNA, 18 bp, Homo sapiens
gtggccagcctggtcttg

SEQ ID NO: 8231621 - DNA, 18 bp, Homo sapiens
gtggccagcctggtcttg

SEQ ID NO: 8231622 - DNA, 22 bp, Homo sapiens
gtggccagaaccaggagaatga

SEQ ID NO: 8231623 - DNA, 22 bp, Homo sapiens
gtggccagaaccaggagaatga

SEQ ID NO: 8231624 - DNA, 22 bp, Homo sapiens
gtggccagaaccaggagaatga

SEQ ID NO: 8231625 - DNA, 22 bp, Homo sapiens
gtggccagaagttaagtggtta

SEQ ID NO: 8231626 - DNA, 22 bp, Homo sapiens
gtggccagaagttaagtggtta

SEQ ID NO: 8231627 - DNA, 22 bp, Homo sapiens
gtggccagaagttaagtggtta

SEQ ID NO: 8231628 - DNA, 22 bp, Homo sapiens
gtggccagaagactgcaatgct

SEQ ID NO: 8231629 - DNA, 22 bp, Homo sapiens
gtggccagaagactgcaatgct

SEQ ID NO: 8231630 - DNA, 22 bp, Homo sapiens
gtggccagaagactgcaatgct

SEQ ID NO: 8231631 - DNA, 22 bp, Homo sapiens
gtggccagaagactgcaatgct

SEQ ID NO: 8231632 - DNA, 22 bp, Homo sapiens
gtggccagaatcttgaggcctt

SEQ ID NO: 8231633 - DNA, 22 bp, Homo sapiens
gtggccagaatcttgaggcctt

SEQ ID NO: 8231634 - DNA, 22 bp, Homo sapiens
gtggccagaatcttgaggcctt

SEQ ID NO: 8231635 - DNA, 22 bp, Homo sapiens
gtggccagagattaaatagagt

SEQ ID NO: 8231636 - DNA, 22 bp, Homo sapiens
gtggccagaggatttgttcagt

SEQ ID NO: 8231637 - DNA, 22 bp, Homo sapiens
gtggccagaggtcccatgtgtc

SEQ ID NO: 8231638 - DNA, 22 bp, Homo sapiens
gtggccagaggtcccatgtgtc

SEQ ID NO: 8231639 - DNA, 22 bp, Homo sapiens
gtggcccaggcttggcgctggc

SEQ ID NO: 8231640 - DNA, 22 bp, Homo sapiens
gtggcccaggttggagtgcagt

SEQ ID NO: 8231641 - DNA, 22 bp, Homo sapiens
gtggcccaggctggagtgcagt

SEQ ID NO: 8231642 - DNA, 22 bp, Homo sapiens
gtggcccaggcaccctgatgac

SEQ ID NO: 8231643 - DNA, 21 bp, Homo sapiens
gtggccctgccgcagtgtcca

SEQ ID NO: 8231644 - DNA, 21 bp, Homo sapiens
gtggccctgccgcagtgtcca

SEQ ID NO: 8231645 - DNA, 22 bp, Homo sapiens
gtggccctgagccctttgacag

SEQ ID NO: 8231646 - DNA, 22 bp, Homo sapiens
gtggccctctgatagggtcagg

SEQ ID NO: 8231647 - DNA, 22 bp, Homo sapiens
gtggccctcagcagttgccaag

SEQ ID NO: 8231648 - DNA, 22 bp, Homo sapiens
gtggccctctgatagggtcagg

SEQ ID NO: 8231649 - DNA, 22 bp, Homo sapiens
gtggccctctgatagggtcagg

SEQ ID NO: 8231650 - DNA, 22 bp, Homo sapiens
gtggccctctgatagggtcagg

SEQ ID NO: 8231651 - DNA, 22 bp, Homo sapiens
gtggccctaacaccgtttctca

SEQ ID NO: 8231652 - DNA, 22 bp, Homo sapiens
gtggccctatttgaggacccca

SEQ ID NO: 8231653 - DNA, 22 bp, Homo sapiens
gtggccctcagcagttgccaag

SEQ ID NO: 8231654 - DNA, 22 bp, Homo sapiens
gtggccaggagagggtgggaca

SEQ ID NO: 8231655 - DNA, 22 bp, Homo sapiens
gtggccaggccgactgccaggc

SEQ ID NO: 8231656 - DNA, 22 bp, Homo sapiens
gtggccaggagagggtgggaca

SEQ ID NO: 8231657 - DNA, 22 bp, Homo sapiens
gtggccaggagagggtgggaca

SEQ ID NO: 8231658 - DNA, 22 bp, Homo sapiens
gtggccaggccgactgccaggc

SEQ ID NO: 8231659 - DNA, 22 bp, Homo sapiens
gtggccaggccgactgccaggc

SEQ ID NO: 8231660 - DNA, 22 bp, Homo sapiens
gtggccaggagaccttgggcat

SEQ ID NO: 8231661 - DNA, 22 bp, Homo sapiens
gtggccaggagaccttgggcat

SEQ ID NO: 8231662 - DNA, 22 bp, Homo sapiens
gtggccaggacattgccaggca

SEQ ID NO: 8231663 - DNA, 22 bp, Homo sapiens
gtggccaggacattgccaggca

SEQ ID NO: 8231664 - DNA, 22 bp, Homo sapiens
gtggccaggacattgccaggca

SEQ ID NO: 8231665 - DNA, 22 bp, Homo sapiens
gtggccaggacattgccaggca

SEQ ID NO: 8231666 - DNA, 22 bp, Homo sapiens
gtggccaggacattgccaggca

SEQ ID NO: 8231667 - DNA, 22 bp, Homo sapiens
gtggccagctgtcagcaccctt

SEQ ID NO: 8231668 - DNA, 22 bp, Homo sapiens
gtggccagctgtcagcaccctt

SEQ ID NO: 8231669 - DNA, 22 bp, Homo sapiens
gtggccagctgtcagcaccctt

SEQ ID NO: 8231670 - DNA, 22 bp, Homo sapiens
gtggcatcagagctccctccag

SEQ ID NO: 8231671 - DNA, 22 bp, Homo sapiens
gtggcatcgtctgaggtggggt

SEQ ID NO: 8231672 - DNA, 22 bp, Homo sapiens
gtggcagggtgctcatcatgca

SEQ ID NO: 8231673 - DNA, 22 bp, Homo sapiens
gtggcagggtgctcatcatgca

SEQ ID NO: 8231674 - DNA, 22 bp, Homo sapiens
gtggcaggggcgggctgttccg

SEQ ID NO: 8231675 - DNA, 22 bp, Homo sapiens
gtggcaggggcgggctgttccg

SEQ ID NO: 8231676 - DNA, 22 bp, Homo sapiens
gtggcaggggtattccagctga

SEQ ID NO: 8231677 - DNA, 22 bp, Homo sapiens
gtggcaggggcgggctgttccg

SEQ ID NO: 8231678 - DNA, 22 bp, Homo sapiens
gtggcaggggtattccagctga

SEQ ID NO: 8231679 - DNA, 22 bp, Homo sapiens
gtggcaggggtattccagctga

SEQ ID NO: 8231680 - DNA, 22 bp, Homo sapiens
gtggcaggggtattccagctga

SEQ ID NO: 8231681 - DNA, 22 bp, Homo sapiens
gtggcaggggtattccagctga

SEQ ID NO: 8231682 - DNA, 22 bp, Homo sapiens
gtggcagggtgctcatcatgca

SEQ ID NO: 8231683 - DNA, 22 bp, Homo sapiens
gtggcagggtgctcatcatgca

SEQ ID NO: 8231684 - DNA, 22 bp, Homo sapiens
gtggcaggggtattccagctga

SEQ ID NO: 8231685 - DNA, 22 bp, Homo sapiens
gtggccaaaaggaagaaggtta

SEQ ID NO: 8231686 - DNA, 22 bp, Homo sapiens
gtggcatttggaaagagcacta

SEQ ID NO: 8231687 - DNA, 22 bp, Homo sapiens
gtggcatttgggagatgcgtgg

SEQ ID NO: 8231688 - DNA, 22 bp, Homo sapiens
gtggcattttagaacagctgac

SEQ ID NO: 8231689 - DNA, 22 bp, Homo sapiens
gtggccaagaggggactggata

SEQ ID NO: 8231690 - DNA, 22 bp, Homo sapiens
gtggccaaggcagagaaagagc

SEQ ID NO: 8231691 - DNA, 22 bp, Homo sapiens
gtggccaataggagcagctatc

SEQ ID NO: 8231692 - DNA, 22 bp, Homo sapiens
gtggccaaggtgcagagcagct

SEQ ID NO: 8231693 - DNA, 22 bp, Homo sapiens
gtggcattgacagcttcagtgg

SEQ ID NO: 8231694 - DNA, 22 bp, Homo sapiens
gtggcattctcggcaccatctg

SEQ ID NO: 8231695 - DNA, 22 bp, Homo sapiens
gtggcattatcttaagacgatt

SEQ ID NO: 8231696 - DNA, 22 bp, Homo sapiens
gtggcattgacatgtaaacagt

SEQ ID NO: 8231697 - DNA, 22 bp, Homo sapiens
gtggcatttgaacaatcacata

SEQ ID NO: 8231698 - DNA, 22 bp, Homo sapiens
gtggcatttgctgaagagcggt

SEQ ID NO: 8231699 - DNA, 22 bp, Homo sapiens
gtggcatttactctgactgaaa

SEQ ID NO: 8231700 - DNA, 22 bp, Homo sapiens
gtggcatttactctgactgaaa

SEQ ID NO: 8231701 - DNA, 22 bp, Homo sapiens
gtggcattgccttctgcaggaa

SEQ ID NO: 8231702 - DNA, 22 bp, Homo sapiens
gtggcattgccttctgcaggaa

SEQ ID NO: 8231703 - DNA, 22 bp, Homo sapiens
gtggcattgacatgtaaacagt

SEQ ID NO: 8231704 - DNA, 22 bp, Homo sapiens
gtggcattgaggtatttggttg

SEQ ID NO: 8231705 - DNA, 22 bp, Homo sapiens
gtggcattaggccaggtgcata

SEQ ID NO: 8231706 - DNA, 22 bp, Homo sapiens
gtggcatgtgcctgtaatctca

SEQ ID NO: 8231707 - DNA, 22 bp, Homo sapiens
gtggcatgacagtgaatgggca

SEQ ID NO: 8231708 - DNA, 22 bp, Homo sapiens
gtggcatggagaaggaggcagt

SEQ ID NO: 8231709 - DNA, 22 bp, Homo sapiens
gtggcatgatgtcggcttagtg

SEQ ID NO: 8231710 - DNA, 22 bp, Homo sapiens
gtggcagctgtgggacactggt

SEQ ID NO: 8231711 - DNA, 22 bp, Homo sapiens
gtggcagctggtatgcagacag

SEQ ID NO: 8231712 - DNA, 22 bp, Homo sapiens
gtggcagctggtatgcagacag

SEQ ID NO: 8231713 - DNA, 22 bp, Homo sapiens
gtggcagctgtgttgcagtttt

SEQ ID NO: 8231714 - DNA, 22 bp, Homo sapiens
gtggcagctgtgttgcagtttt

SEQ ID NO: 8231715 - DNA, 22 bp, Homo sapiens
gtggcaggagactggaagatgg

SEQ ID NO: 8231716 - DNA, 22 bp, Homo sapiens
gtggcaggagactggaagatgg

SEQ ID NO: 8231717 - DNA, 22 bp, Homo sapiens
gtggcaggagagacacagccat

SEQ ID NO: 8231718 - DNA, 22 bp, Homo sapiens
gtggcaggagactggaagatgg

SEQ ID NO: 8231719 - DNA, 22 bp, Homo sapiens
gtggcaggagactggaagatgg

SEQ ID NO: 8231720 - DNA, 22 bp, Homo sapiens
gtggcaggagtgggccttgaag

SEQ ID NO: 8231721 - DNA, 22 bp, Homo sapiens
gtggcaggagtgggccttgaag

SEQ ID NO: 8231722 - DNA, 22 bp, Homo sapiens
gtggcaggagtgggccttgaag

SEQ ID NO: 8231723 - DNA, 22 bp, Homo sapiens
gtggcaggatcacggctcactg

SEQ ID NO: 8231724 - DNA, 22 bp, Homo sapiens
gtggcaggatcacggctcactg

SEQ ID NO: 8231725 - DNA, 22 bp, Homo sapiens
gtggcaggagagacacagccat

SEQ ID NO: 8231726 - DNA, 22 bp, Homo sapiens
gtggcaggagagacacagccat

SEQ ID NO: 8231727 - DNA, 22 bp, Homo sapiens
gtggcaggagggcatcacttgg

SEQ ID NO: 8231728 - DNA, 22 bp, Homo sapiens
gtggcaggagggcatcacttgg

SEQ ID NO: 8231729 - DNA, 22 bp, Homo sapiens
gtggcaggagagacacagccat

SEQ ID NO: 8231730 - DNA, 22 bp, Homo sapiens
gtggcaggagagacacagccat

SEQ ID NO: 8231731 - DNA, 22 bp, Homo sapiens
gtggcaggatcacggctcactg

SEQ ID NO: 8231732 - DNA, 22 bp, Homo sapiens
gtggcaggatcacggctcactg

SEQ ID NO: 8231733 - DNA, 22 bp, Homo sapiens
gtggcaggatcacggctcactg

SEQ ID NO: 8231734 - DNA, 22 bp, Homo sapiens
gtggcaggatcacggctcactg

SEQ ID NO: 8231735 - DNA, 22 bp, Homo sapiens
gtggcaggatcacggctcactg

SEQ ID NO: 8231736 - DNA, 22 bp, Homo sapiens
gtggcaggatcacggctcactg

SEQ ID NO: 8231737 - DNA, 20 bp, Homo sapiens
gtggcaggcagtgaaggagc

SEQ ID NO: 8231738 - DNA, 22 bp, Homo sapiens
gtggcaggatcacggctcactg

SEQ ID NO: 8231739 - DNA, 20 bp, Homo sapiens
gtggcaggcagtgaaggagc

SEQ ID NO: 8231740 - DNA, 20 bp, Homo sapiens
gtggcaggcagtgaaggagc

SEQ ID NO: 8231741 - DNA, 20 bp, Homo sapiens
gtggcaggcagtgaaggagc

SEQ ID NO: 8231742 - DNA, 20 bp, Homo sapiens
gtggcaggcagtgaaggagc

SEQ ID NO: 8231743 - DNA, 20 bp, Homo sapiens
gtggcaggcagtgaaggagc

SEQ ID NO: 8231744 - DNA, 20 bp, Homo sapiens
gtggcaggcagtgaaggagc

SEQ ID NO: 8231745 - DNA, 20 bp, Homo sapiens
gtggcaggcagtgaaggagc

SEQ ID NO: 8231746 - DNA, 22 bp, Homo sapiens
gtggcagggcaatgctccctct

SEQ ID NO: 8231747 - DNA, 22 bp, Homo sapiens
gtggcagggcaatgctccctct

SEQ ID NO: 8231748 - DNA, 22 bp, Homo sapiens
gtggcagggctttgctgttctt

SEQ ID NO: 8231749 - DNA, 22 bp, Homo sapiens
gtggcagggctttgctgttctt

SEQ ID NO: 8231750 - DNA, 22 bp, Homo sapiens
gtggcagggctttgctgttctt

SEQ ID NO: 8231751 - DNA, 22 bp, Homo sapiens
gtggcaggggcgggctgttccg

SEQ ID NO: 8231752 - DNA, 22 bp, Homo sapiens
gtggcagggctttgctgttctt

SEQ ID NO: 8231753 - DNA, 22 bp, Homo sapiens
gtggcagggagaagccattggg

SEQ ID NO: 8231754 - DNA, 22 bp, Homo sapiens
gtggcagggagaagccattggg

SEQ ID NO: 8231755 - DNA, 22 bp, Homo sapiens
gtggcagggagaagccattggg

SEQ ID NO: 8231756 - DNA, 22 bp, Homo sapiens
gtggcagggagaagccattggg

SEQ ID NO: 8231757 - DNA, 22 bp, Homo sapiens
gtggcagggcaatgctccctct

SEQ ID NO: 8231758 - DNA, 22 bp, Homo sapiens
gtggcagggcaatgctccctct

SEQ ID NO: 8231759 - DNA, 22 bp, Homo sapiens
gtggctgcagagggcacagcat

SEQ ID NO: 8231760 - DNA, 22 bp, Homo sapiens
gtggctgcagagccagcaagct

SEQ ID NO: 8231761 - DNA, 22 bp, Homo sapiens
gtggctgcagagccagcaagct

SEQ ID NO: 8231762 - DNA, 22 bp, Homo sapiens
gtggctgcagagccagcaagct

SEQ ID NO: 8231763 - DNA, 17 bp, Homo sapiens
gtggctgcacacacatg

SEQ ID NO: 8231764 - DNA, 17 bp, Homo sapiens
gtggctgcacacacatg

SEQ ID NO: 8231765 - DNA, 17 bp, Homo sapiens
gtggctgcacacacatg

SEQ ID NO: 8231766 - DNA, 22 bp, Homo sapiens
gtggctgagcagcagagagctg

SEQ ID NO: 8231767 - DNA, 22 bp, Homo sapiens
gtggctgagtggtcgagtcaga

SEQ ID NO: 8231768 - DNA, 22 bp, Homo sapiens
gtggctgagcagcagagagctg

SEQ ID NO: 8231769 - DNA, 22 bp, Homo sapiens
gtggctgagcagcagagagctg

SEQ ID NO: 8231770 - DNA, 22 bp, Homo sapiens
gtggctgacaaccactggagga

SEQ ID NO: 8231771 - DNA, 22 bp, Homo sapiens
gtggctgacaaccactggagga

SEQ ID NO: 8231772 - DNA, 22 bp, Homo sapiens
gtggctgacaaccactggagga

SEQ ID NO: 8231773 - DNA, 22 bp, Homo sapiens
gtggctctctggtcccctgcca

SEQ ID NO: 8231774 - DNA, 22 bp, Homo sapiens
gtggctctctggtcccctgcca

SEQ ID NO: 8231775 - DNA, 22 bp, Homo sapiens
gtggcctggcgagctggcgcgg

SEQ ID NO: 8231776 - DNA, 22 bp, Homo sapiens
gtggcctggcgagctggcgcgg

SEQ ID NO: 8231777 - DNA, 22 bp, Homo sapiens
gtggcctggatgagcttcgaca

SEQ ID NO: 8231778 - DNA, 22 bp, Homo sapiens
gtggcctggatgagcttcgaca

SEQ ID NO: 8231779 - DNA, 22 bp, Homo sapiens
gtggcctggcgagctggcgcgg

SEQ ID NO: 8231780 - DNA, 22 bp, Homo sapiens
gtggcctggctggcaccacctc

SEQ ID NO: 8231781 - DNA, 22 bp, Homo sapiens
gtggcctggggtttgttctgag

SEQ ID NO: 8231782 - DNA, 22 bp, Homo sapiens
gtggcctggggtttgttctgag

SEQ ID NO: 8231783 - DNA, 22 bp, Homo sapiens
gtggcctggggtttgttctgag

SEQ ID NO: 8231784 - DNA, 22 bp, Homo sapiens
gtggctcagcggagctctgcac

SEQ ID NO: 8231785 - DNA, 22 bp, Homo sapiens
gtggctcagcggagctctgcac

SEQ ID NO: 8231786 - DNA, 22 bp, Homo sapiens
gtggctctaggtgagcatggag

SEQ ID NO: 8231787 - DNA, 22 bp, Homo sapiens
gtggctccttttcaggaggctg

SEQ ID NO: 8231788 - DNA, 22 bp, Homo sapiens
gtggcctcctccgtccgcctct

SEQ ID NO: 8231789 - DNA, 22 bp, Homo sapiens
gtggcctagaggtgcaaggaac

SEQ ID NO: 8231790 - DNA, 22 bp, Homo sapiens
gtggccctttgttttgatacct

SEQ ID NO: 8231791 - DNA, 22 bp, Homo sapiens
gtggccctggagttgtgacact

SEQ ID NO: 8231792 - DNA, 21 bp, Homo sapiens
gtggccctggtgtggctgcac

SEQ ID NO: 8231793 - DNA, 22 bp, Homo sapiens
gtggccctgtcccaggcctcct

SEQ ID NO: 8231794 - DNA, 22 bp, Homo sapiens
gtggccctgtcccaggcctcct

SEQ ID NO: 8231795 - DNA, 21 bp, Homo sapiens
gtggccctggtgtggctgcac

SEQ ID NO: 8231796 - DNA, 22 bp, Homo sapiens
gtggccctgtcccaggcctcct

SEQ ID NO: 8231797 - DNA, 22 bp, Homo sapiens
gtggcccttgaagcagcttcat

SEQ ID NO: 8231798 - DNA, 22 bp, Homo sapiens
gtggcccttggagttgtgacct

SEQ ID NO: 8231799 - DNA, 22 bp, Homo sapiens
gtggccctgtgaacagcgcagt

SEQ ID NO: 8231800 - DNA, 22 bp, Homo sapiens
gtggccctgtgaacagcgcagt

SEQ ID NO: 8231801 - DNA, 20 bp, Homo sapiens
gtggcccttaaagagggaag

SEQ ID NO: 8231802 - DNA, 20 bp, Homo sapiens
gtggcccttaaagagggaag

SEQ ID NO: 8231803 - DNA, 22 bp, Homo sapiens
gtggcctgagcttcagagttgg

SEQ ID NO: 8231804 - DNA, 22 bp, Homo sapiens
gtggcctgatgccagccctgtg

SEQ ID NO: 8231805 - DNA, 22 bp, Homo sapiens
gtggcctgatgccagccctgtg

SEQ ID NO: 8231806 - DNA, 21 bp, Homo sapiens
gtggcctgattatgaatgggt

SEQ ID NO: 8231807 - DNA, 21 bp, Homo sapiens
gtggcctgattatgaatgggt

SEQ ID NO: 8231808 - DNA, 21 bp, Homo sapiens
gtggcctgattatgaatgggt

SEQ ID NO: 8231809 - DNA, 22 bp, Homo sapiens
gtggcctgccagcagatggcgc

SEQ ID NO: 8231810 - DNA, 22 bp, Homo sapiens
gtggcctgccagcagatggcgc

SEQ ID NO: 8231811 - DNA, 22 bp, Homo sapiens
gtggcctgccagcagatggcgc

SEQ ID NO: 8231812 - DNA, 21 bp, Homo sapiens
gtggcctgattatgaatgggt

SEQ ID NO: 8231813 - DNA, 22 bp, Homo sapiens
gtggcctgcaggcaccttgggg

SEQ ID NO: 8231814 - DNA, 19 bp, Homo sapiens
gtggcctgcgctgggtgcg

SEQ ID NO: 8231815 - DNA, 22 bp, Homo sapiens
gtggcctgccgcaccccaatat

SEQ ID NO: 8231816 - DNA, 19 bp, Homo sapiens
gtggcctgcgctgggtgcg

SEQ ID NO: 8231817 - DNA, 22 bp, Homo sapiens
gtggcctgccgtgtggtatggg

SEQ ID NO: 8231818 - DNA, 22 bp, Homo sapiens
gtggcctgccgtgtggtatggg

SEQ ID NO: 8231819 - DNA, 22 bp, Homo sapiens
gtggcctggaaaggctggtctg

SEQ ID NO: 8231820 - DNA, 22 bp, Homo sapiens
gtggcctggaaaggctggtctg

SEQ ID NO: 8231821 - DNA, 22 bp, Homo sapiens
gtgggagtttgaacttcatgtt

SEQ ID NO: 8231822 - DNA, 22 bp, Homo sapiens
gtgggatgcagtggtgagtggc

SEQ ID NO: 8231823 - DNA, 22 bp, Homo sapiens
gtgggatgcagtggtgagtggc

SEQ ID NO: 8231824 - DNA, 22 bp, Homo sapiens
gtgggatgcagtggtgagtggc

SEQ ID NO: 8231825 - DNA, 22 bp, Homo sapiens
gtgggatgcttaggatcttgcc

SEQ ID NO: 8231826 - DNA, 22 bp, Homo sapiens
gtgggagtggagctcagcatgt

SEQ ID NO: 8231827 - DNA, 22 bp, Homo sapiens
gtgggagtttgaacttcatgtt

SEQ ID NO: 8231828 - DNA, 22 bp, Homo sapiens
gtgggagtggggaagcagagtg

SEQ ID NO: 8231829 - DNA, 22 bp, Homo sapiens
gtgggagcttcatcaagcagtt

SEQ ID NO: 8231830 - DNA, 22 bp, Homo sapiens
gtgggagccctcagggaggtgc

SEQ ID NO: 8231831 - DNA, 22 bp, Homo sapiens
gtgggagaagccctgttcgtag

SEQ ID NO: 8231832 - DNA, 22 bp, Homo sapiens
gtgggagaatggccttgcaaac

SEQ ID NO: 8231833 - DNA, 22 bp, Homo sapiens
gtgggagaatggccttgcaaac

SEQ ID NO: 8231834 - DNA, 22 bp, Homo sapiens
gtgggagaagccctgttcgtag

SEQ ID NO: 8231835 - DNA, 22 bp, Homo sapiens
gtgggagagaccccgcttaggg

SEQ ID NO: 8231836 - DNA, 22 bp, Homo sapiens
gtgggagaagatttggtcatct

SEQ ID NO: 8231837 - DNA, 22 bp, Homo sapiens
gtgggagaagatttggtcatct

SEQ ID NO: 8231838 - DNA, 22 bp, Homo sapiens
gtgggagaaattagctctagtt

SEQ ID NO: 8231839 - DNA, 22 bp, Homo sapiens
gtgggagaaattagctctagtt

SEQ ID NO: 8231840 - DNA, 22 bp, Homo sapiens
gtgggactcttctttggcagtg

SEQ ID NO: 8231841 - DNA, 22 bp, Homo sapiens
gtggcttccatgtgcatctgac

SEQ ID NO: 8231842 - DNA, 22 bp, Homo sapiens
gtggcttccaagactaagtcac

SEQ ID NO: 8231843 - DNA, 22 bp, Homo sapiens
gtggcttcatgaacactgatga

SEQ ID NO: 8231844 - DNA, 22 bp, Homo sapiens
gtggcttcatcaactgtgctta

SEQ ID NO: 8231845 - DNA, 22 bp, Homo sapiens
gtggcttcaccccagttgtctc

SEQ ID NO: 8231846 - DNA, 22 bp, Homo sapiens
gtggcttcatcaactgtgctta

SEQ ID NO: 8231847 - DNA, 22 bp, Homo sapiens
gtggctggtttcctgcatgcaa

SEQ ID NO: 8231848 - DNA, 22 bp, Homo sapiens
gtggctggtttcctgcatgcaa

SEQ ID NO: 8231849 - DNA, 22 bp, Homo sapiens
gtggctggtttcctgcatgcaa

SEQ ID NO: 8231850 - DNA, 22 bp, Homo sapiens
gtggctgggctccgagcggctt

SEQ ID NO: 8231851 - DNA, 22 bp, Homo sapiens
gtggctgggctccgagcggctt

SEQ ID NO: 8231852 - DNA, 22 bp, Homo sapiens
gtggctgggctccgagcggctt

SEQ ID NO: 8231853 - DNA, 22 bp, Homo sapiens
gtggctgggctccgagcggctt

SEQ ID NO: 8231854 - DNA, 22 bp, Homo sapiens
gtggctggagtatgaggaaagg

SEQ ID NO: 8231855 - DNA, 22 bp, Homo sapiens
gtggctggagtatgaggaaagg

SEQ ID NO: 8231856 - DNA, 22 bp, Homo sapiens
gtggctggccctggaccctaag

SEQ ID NO: 8231857 - DNA, 22 bp, Homo sapiens
gtggctgctgtcctctctggtt

SEQ ID NO: 8231858 - DNA, 22 bp, Homo sapiens
gtggctggagtatgaggaaagg

SEQ ID NO: 8231859 - DNA, 22 bp, Homo sapiens
gtggctgctcgggctccggccc

SEQ ID NO: 8231860 - DNA, 22 bp, Homo sapiens
gtggctgctacagagctggagg

SEQ ID NO: 8231861 - DNA, 22 bp, Homo sapiens
gtggctgctaagtctccttcct

SEQ ID NO: 8231862 - DNA, 19 bp, Homo sapiens
gtggctgccgatcgcggct

SEQ ID NO: 8231863 - DNA, 22 bp, Homo sapiens
gtggctgctaagtctccttcct

SEQ ID NO: 8231864 - DNA, 19 bp, Homo sapiens
gtggctgccgatcgcggct

SEQ ID NO: 8231865 - DNA, 22 bp, Homo sapiens
gtggctgctggtactctgggaa

SEQ ID NO: 8231866 - DNA, 22 bp, Homo sapiens
gtggctgctggtactctgggaa

SEQ ID NO: 8231867 - DNA, 22 bp, Homo sapiens
gtggctgctcgggctccggccc

SEQ ID NO: 8231868 - DNA, 22 bp, Homo sapiens
gtggctgctgtcctctctggtt

SEQ ID NO: 8231869 - DNA, 22 bp, Homo sapiens
gtggctgctgtcctctctggtt

SEQ ID NO: 8231870 - DNA, 22 bp, Homo sapiens
gtggctgctggtactctgggaa

SEQ ID NO: 8231871 - DNA, 22 bp, Homo sapiens
gtggctgcatcggggtgaccag

SEQ ID NO: 8231872 - DNA, 22 bp, Homo sapiens
gtggctgcagtagtgtagggtc

SEQ ID NO: 8231873 - DNA, 22 bp, Homo sapiens
gtggctgcagctctgaacggac

SEQ ID NO: 8231874 - DNA, 22 bp, Homo sapiens
gtggctgcagcggctgtggaga

SEQ ID NO: 8231875 - DNA, 22 bp, Homo sapiens
gtggctgcagctctgaacggac

SEQ ID NO: 8231876 - DNA, 22 bp, Homo sapiens
gtggctgcagcggctgtggaga

SEQ ID NO: 8231877 - DNA, 22 bp, Homo sapiens
gtggctgcagcccagcggcacg

SEQ ID NO: 8231878 - DNA, 22 bp, Homo sapiens
gtggctgcagcccagcggcacg

SEQ ID NO: 8231879 - DNA, 22 bp, Homo sapiens
gtggctgcagcccagcggcacg

SEQ ID NO: 8231880 - DNA, 22 bp, Homo sapiens
gtggctgcagagggcacagcat

SEQ ID NO: 8231881 - DNA, 22 bp, Homo sapiens
gtggctgcagagggcacagcat

SEQ ID NO: 8231882 - DNA, 22 bp, Homo sapiens
gtcggccacgcaggtgcggtag

SEQ ID NO: 8231883 - DNA, 22 bp, Homo sapiens
gtcgctgaggagatgtgcaagg

SEQ ID NO: 8231884 - DNA, 22 bp, Homo sapiens
gtcggccacgcaggtgcggtag

SEQ ID NO: 8231885 - DNA, 22 bp, Homo sapiens
gtcggcagcgcggctgccaggg

SEQ ID NO: 8231886 - DNA, 22 bp, Homo sapiens
gtccttggctgtggctgtaatg

SEQ ID NO: 8231887 - DNA, 22 bp, Homo sapiens
gtccttggcttcttgttgactg

SEQ ID NO: 8231888 - DNA, 22 bp, Homo sapiens
gtccttgcttgagacaggcagt

SEQ ID NO: 8231889 - DNA, 22 bp, Homo sapiens
gtccttgctttggagcaggcta

SEQ ID NO: 8231890 - DNA, 22 bp, Homo sapiens
gtccttggaggtgtggaatctg

SEQ ID NO: 8231891 - DNA, 22 bp, Homo sapiens
gtccttggcctgggtagagtgg

SEQ ID NO: 8231892 - DNA, 22 bp, Homo sapiens
gtccttggcattctgagtcttg

SEQ ID NO: 8231893 - DNA, 22 bp, Homo sapiens
gtccttggcacccatgtgattc

SEQ ID NO: 8231894 - DNA, 22 bp, Homo sapiens
gtccttggagtcaggcaaggct

SEQ ID NO: 8231895 - DNA, 22 bp, Homo sapiens
gtccttcatttcctgatctcta

SEQ ID NO: 8231896 - DNA, 22 bp, Homo sapiens
gtccttcatctggagcctggtc

SEQ ID NO: 8231897 - DNA, 22 bp, Homo sapiens
gtccttcaagtaacctgggacc

SEQ ID NO: 8231898 - DNA, 22 bp, Homo sapiens
gtccttcagcacctccctcggc

SEQ ID NO: 8231899 - DNA, 22 bp, Homo sapiens
gtccttgagtaagtcatggtgg

SEQ ID NO: 8231900 - DNA, 22 bp, Homo sapiens
gtccttcttttcatccctggtt

SEQ ID NO: 8231901 - DNA, 22 bp, Homo sapiens
gtccttctcaaatcctgtgttt

SEQ ID NO: 8231902 - DNA, 22 bp, Homo sapiens
gtccttcttttcatccctggtt

SEQ ID NO: 8231903 - DNA, 22 bp, Homo sapiens
gtccttcttttcatccctggtt

SEQ ID NO: 8231904 - DNA, 22 bp, Homo sapiens
gtccttctcaaatcctgtgttt

SEQ ID NO: 8231905 - DNA, 22 bp, Homo sapiens
gtccttctcaaatcctgtgttt

SEQ ID NO: 8231906 - DNA, 22 bp, Homo sapiens
gtctctgagctctgagctggct

SEQ ID NO: 8231907 - DNA, 22 bp, Homo sapiens
gtctctgagctctgagctggct

SEQ ID NO: 8231908 - DNA, 22 bp, Homo sapiens
gtcggccacgcaggtgcggtag

SEQ ID NO: 8231909 - DNA, 22 bp, Homo sapiens
gtctctgagctctgagctggct

SEQ ID NO: 8231910 - DNA, 22 bp, Homo sapiens
gtctcttttatggtgagttgat

SEQ ID NO: 8231911 - DNA, 22 bp, Homo sapiens
gtctcttttatggtgagttgat

SEQ ID NO: 8231912 - DNA, 19 bp, Homo sapiens
gtctctggatttcaggtcc

SEQ ID NO: 8231913 - DNA, 22 bp, Homo sapiens
gtctgacacctagagtccagga

SEQ ID NO: 8231914 - DNA, 22 bp, Homo sapiens
gtctgaatgatgagtgggactc

SEQ ID NO: 8231915 - DNA, 22 bp, Homo sapiens
gtctgaatacgtacttgtgaag

SEQ ID NO: 8231916 - DNA, 22 bp, Homo sapiens
gtctgagaatcttgcatatcat

SEQ ID NO: 8231917 - DNA, 22 bp, Homo sapiens
gtctgaggcctgaggccctggg

SEQ ID NO: 8231918 - DNA, 20 bp, Homo sapiens
gtctgaggagcagtgggaaa

SEQ ID NO: 8231919 - DNA, 22 bp, Homo sapiens
gtctgaggaagatgcaggggga

SEQ ID NO: 8231920 - DNA, 22 bp, Homo sapiens
gtctgagggagaaggatctggg

SEQ ID NO: 8231921 - DNA, 22 bp, Homo sapiens
gtctgagggagaaggatctggg

SEQ ID NO: 8231922 - DNA, 22 bp, Homo sapiens
gtctgagggacagagtcctggc

SEQ ID NO: 8231923 - DNA, 22 bp, Homo sapiens
gtctgcatacaggacatgcaca

SEQ ID NO: 8231924 - DNA, 22 bp, Homo sapiens
gtctggcacataagaggagctc

SEQ ID NO: 8231925 - DNA, 22 bp, Homo sapiens
gtctgagggttgtgctggagga

SEQ ID NO: 8231926 - DNA, 22 bp, Homo sapiens
gtctgagggttgtgctggagga

SEQ ID NO: 8231927 - DNA, 21 bp, Homo sapiens
gtctgatgcttgatgcagttg

SEQ ID NO: 8231928 - DNA, 22 bp, Homo sapiens
gtctggctgttcctgcctgtga

SEQ ID NO: 8231929 - DNA, 22 bp, Homo sapiens
gtctggctgataaaatgctctt

SEQ ID NO: 8231930 - DNA, 22 bp, Homo sapiens
gtctggctcccactcttacaaa

SEQ ID NO: 8231931 - DNA, 22 bp, Homo sapiens
gtctggctccgaggagtggcag

SEQ ID NO: 8231932 - DNA, 22 bp, Homo sapiens
gtctggctctggaaggcaaagg
